United States Patent 9,061,059 (MODIFIED POLYNUCLEOTIDES FOR TREATING PROTEIN DEFICIENCY) - sequence listing, part 71

SEQ ID NO: 135756 - DNA, 1569 bp, Artificial Sequence
  Description of Artificial Sequence: Synthetic coding sequence
atggcaagcggaggaggcgggtgtagcgcttctgagcggcttcctccgcctttccctggactggagcctgagagtgagggggccgctggtggaagtgaaccagaagccggagattccgacactgaaggggaagatatctttacaggcgctgcagttgtttcgaaacaccagagccctaagattacgacctccctcctgccaattaataatgggtccaaggagaacggcattcatgaggaacaggaccaggaaccccaagacctattcgctgacgcaaccgtggaactgtctctggattcgacacagaataatcagaagaaggtcctggcaaagaccctgatctctctaccgcctcaggaagcgacaaactcttccaaaccacagccaacatatgaggagctcgaggaggaggagcaagaagatcagttcgacctgacagtcgggatcacggatcccgagaagattggagatggcatgaatgcttacgtggcatataaagtcacaacgcaaacatccttacccctattccgcagcaagcagtttgcagtaaagcgccggttctctgactttctggggttgtatgaaaaactaagtgagaagcactctcagaacggcttcatagttcctcctccaccggaaaagtcattgatcggcatgaccaaagtgaaagtcgggaaagaagacagcagcagcgctgagttcctagagaagcggcgcgctgccctggaacgatatctgcagcggatcgtgaaccacccaaccatgttgcaggaccctgatgtgagggagttccttgaaaaagaggaattgccgagagccgtgggcactcaaacattgtctggagctggcctcctaaagatgtttaataaagccactgatgcagtttctaaaatgacaataaaaatgaatgagtcagatatctggttcgaggaaaaactacaggaggtagaatgtgaagagcagcgcctgcgcaaacttcacgctgttgtcgagacactggtgaaccaccgcaaggagctcgccctaaacactgcccagttcgccaagagcctcgccatgctgggatcctcagaggacaacacagcactgtcgcgcgccctgagccaactggctgaggttgaagaaaagatcgagcagctgcaccaagaacaagcaaacaatgattttttcctgctggccgagctcctgtctgactacatacggctacttgctattgtgagggccgccttcgaccagcgtatgaagacatggcagcgctggcaggacgcacaggccaccttgcagaagaagcgggaagctgaggctaggctgctatgggccaataaaccagataagctgcaacaggccaaagatgagattcttgaatgggagagcagggtgactcagtatgagagagatttcgagcgtatctccactgtcgtgagaaaagaagtcatcaggttcgaaaaagagaaatctaaggactttaagaaccacgtcataaagtacctggaaactcttctttactcacaacagcagctggccaaatactgggaagctttcctgcccgaagcaaaagccataagctag

SEQ ID NO: 135757 - DNA, 1374 bp, Artificial Sequence
  Description of Artificial Sequence: Synthetic coding sequence
atggcaagcggcgggggcggctgcagcgcaagcgagcgacttccaccgcccttccctggcctggaaccggagtctgagggcgccgctggcggaagtgagccagaggccggggacagtgatacagagggcgaggatattttcaccggcgcggcagtggtaagcaaacaccagtcaccaaaaataaccaccagcctgctaccaattaataacggctctaaagaaaacggaatacatgaggagcaggaccaggaaccgcaggacctgtttgctggtgatggtatgaacgcctacgttgcttataaggtgaccacacaaacttcccttccgctgtttcgcagcaagcagtttgcagtaaagaggcggttttcggatttcctcggcctgtacgagaagctcagtgagaagcacagtcagaatggatttatcgtgcccccaccacctgaaaagagtcttatagggatgaccaaggtgaaagtgggaaaagaggatagcagcagcgccgagttcttagaaaaaagaagggcagccctagagcgctacctccagcggatagtaaatcacccaaccatgctgcaggaccctgatgtgcgggaattcttagagaaggaagagctcccacgagcagtcggcacccagaccctgagcggtgccggcctgttaaagatgttcaacaaggctactgacgctgtaagtaagatgacaattaagatgaacgagtcggatatatggttcgaagaaaaactccaggaggtcgagtgcgaggagcaaagactaaggaagctgcacgcagtggtggagaccctggtgaaccaccgcaaagagctcgctctaaacaccgcccagtttgctaaatccctggccatgttaggcagcagtgaggataacactgccctgtccagagcgcttagtcagttagccgaagttgaagagaaaattgaacagttgcaccaagaacaggctaataacgacttttttctgcttgctgagctgctctccgactatatcaggctgctggctattgtgcgtgccgcattcgaccaacgcatgaagacttggcagcgctggcaagatgcgcaggctactctgcaaaaaaagcgagaggccgaggctcgactgctatgggccaataaacctgataagctacagcaggccaaagatgagattctggagtgggaatctagggttacccagtacgaaagagattttgaacggatctccaccgtggtcagaaaggaggtgatccgctttgaaaaggaaaaatctaaagacttcaagaaccatgtaatcaaatatttagagaccttgctctattctcagcagcagcttgcaaaatactgggaagcttttctgcccgaagccaaagcaatctcctag

SEQ ID NO: 135758 - DNA, 1374 bp, Artificial Sequence
  Description of Artificial Sequence: Synthetic coding sequence
atggcatccgggggcgggggctgttccgccagtgagagactcccaccgccattccccggtttggaaccagagtctgaaggcgctgctgggggctccgagccagaggccggagattccgacaccgaaggcgaagacatttttactggagccgcagtggtgtctaagcaccaaagtccaaagatcaccacaagcctgttgcccatcaacaacggttcaaaggaaaacggaatacacgaggagcaggaccaggagccccaagacctgttcgccggagatggcatgaatgcttacgtcgcttacaaagtcactacacagaccagtctgccactatttagaagcaaacaatttgcagtgaagagaagattttccgatttcctgggtctctatgagaagctctctgagaagcactcacagaatgggtttattgtgccgccacctcctgagaaaagtctgataggaatgaccaaggtgaaagtgggcaaagaggacagctcgtccgcagaatttttggaaaaacggcgggccgccctagaacgatatctccagcggattgtgaatcatcccacgatgttgcaggacccagacgtgcgcgagttcctggagaaggaggagctgcctcgcgcagtgggcacacaaactctgtccggcgccggcttgctcaagatgttcaataaagctactgatgcagtgtcgaagatgacgatcaaaatgaatgaatcagacatctggttcgaggagaagcttcaggaggtcgaatgcgaggagcagcgccttcgaaaactccacgcagtggtggaaactctggtgaatcacaggaaagaattggcattaaacaccgcacagtttgcaaagtccctggcaatgcttggcagttccgaagacaataccgcactgtctagggcactgtctcagttggccgaggttgaggaaaaaatagaacagctccaccaggagcaggctaacaacgactttttcttattggcggagctactatctgactacattcgtctgcttgctatcgtgcgcgctgcctttgatcagcgcatgaagacatggcagcgatggcaagatgcgcaagctaccttgcagaagaagcgagaagctgaagcacgtctgctgtgggccaataaacctgataagctccagcaggcaaaagatgagattttggaatgggaatcaagggtcacacaatacgagagggatttcgaacggatctctaccgtggtccgcaaggaagtgattcgctttgaaaaagagaaatcaaaagattttaagaaccacgtgattaagtacctagaaacactgttgtattcccagcagcagctggcaaaatactgggaagcattcctgcccgaagcaaaagccatctcctag

SEQ ID NO: 135759 - DNA, 3018 bp, Artificial Sequence
  Description of Artificial Sequence: Synthetic coding sequence
atggccgcgagacctagtcgcgctaccggcccacgagggggacaacgaagtcgagtcaaacccccccctggtcgccgtttgaaggaacagctgccgcccctggccgctgcgcgcgctgtgtttgctgctgccacagctgtcataatgctaaccgaagcctcactgagtatctggggctggggctccctcggcatcgtcctgttccttatcacatttgggccctttgtgatcttttacctaaccttctatattctgtgtttcgttgggggcgggttggttgtgaccctgcttttcggcaaaacgaactccgagaagtatctggaacagtgcgagcattcatttctgccaccgacatctccgggggtccctaaatgcctcgaagagatgaagcgggaagcccgaactatcaaaatagatcgtcgcttaaccggcgctaatatcatcgacgaacctctgcagcaggtaattcaattctccctgcgcgattacgtccaatattggtactatactttgtctgacgatgagagttttctgctcgagatcagacaaactctccagaacgccctcatccagttcgccacaaggtctaaagagatcgactggcagccttacttcaccaccagaattgtcgatgatttcggcacacatctgagagtctttagaaaggcgcagcaaaagattaccgagaaggatgaccaagtgaagggtaccgccgaggacctggtggacacgtttttcgaagttgaggtggagatggagaaggaggtctgcagagacctggtgtgcacatcccctaaagatgaggaagggtttctccgcgacttatgcgaggttttgctctatctgctactcccccccggcgatttccagaacaagataatgagatacttcgtgcgcgaaatcctagcacgggggatactgctaccacttataaaccagctgtcagacccagattacatcaaccagtatgtgatttggatgattcgggactctaactgcaattatgaagccttcatgaatattattaagttaagtgacaatataggagagctggaggcggtacgggacaaggccgccgaagaactgcagtacctacgatccctcgatactgccggggacgacatcaacacaataaagaatcaaattaactcactgctgttcgtcaagaaggtgtgcgactctagaatccaacggctgcagtctgggaaagagatcaacactgtgaagcttgccgccaacttcggcaaactctgcacggtcccactcgactcaatacttgtggacaacgtggccctccagtttttcatggactatatgcagcagacaggcgggcaagcgcacctgttcttctggatgactgtagaaggataccgggtgaccgcccagcagcaactggaggtactactgagtagacaaagggatggtaagcatcagaccaatcaaacaaagggcctactgcgcgctgcagccgtgggaatctacgagcagtatctgtcggagaaggcctccccacgcgtaactgtggatgactatcttgtcgctaagctcgctgacactttaaatcacgaagatcccacccccgagatcttcgacgatattcagagaaaagtgtacgaactgatgcttcgcgatgaaagattctacccaagttttcgacagaacgctctatacgttcggatgctggccgagcttgacatgctcaaagacccttcctttcgcgggtccgatgatggcgacggtgagagttttaacggctccccgaccggaagtattaacctgtcactcgatgaccttagcaatgtgtcgagcgacgactccgtgcagctgcatgcctatatcagtgacacaggtgtgtgcaacgaccacggaaagacatacgccctgtacgccataaccgtgcacagacggaatctcaactcggaagagatgtggaagacatatagaagatacagtgacttccacgattttcatatgaggatcaccgagcaatttgaatcactgtcaagcatacttaaattgccagggaagaagacatttaacaatatggaccgtgattttctggagaagcgtaaaaaggacctcaatgcctacctgcagctgctgcttgcccccgagatgatgaaggcttcgcctgccctcgctcattatgtgtacgacttcttggaaaataaggcctacagtaaggggaagggggacttcgctcggaagatggatacttttgtcaacccactccgcaactccatgcgaaacgtctcaaacgctgttaaatcgctgccagattctcttgccgagggcatgactaaaatgagcgacaatatgggcaagatgagcgaacgcttaggacaggatattaaacagagcttcttcaaggtcccaccacttatccccaagactgattcagatccggaacacagacgggtttctgcccagctcgatgacaatgttgatgataatatcccactcagggtgatgctgctactgatggacgaggtttttgacctaaaggagagaaatcaatggttgcgtaggaatataaaaaacttattacagcagctcattcgtgcaacatacggggatactataaatcgcaagattgtggaccatgtagattggatgacatccccggagcaggtcgccgatagcgtgaagagattccgggacgctttttggcctaacggaattctcgcagaggctgtcccctgcagggacaaaagcatacgaatgcgtactcgcgtggccggaaaaactaaactgctggctataatgccagatgaactgaaacatataatcggagcggagacaactcgtaaaggcatcctgcgcgtttttgaaatgttccaacataaccaactcaacaggaggatggtctatgtcttcctggaaggctttctggagaccctatttccgcaatacaagtttcgggaactgtttaacaagctgcattcccggtccaaacagatgcagaagtataagcagaaactgcagaccacacaggctcccagtctgcagaaaagatag

SEQ ID NO: 135760 - DNA, 2874 bp, Artificial Sequence
  Description of Artificial Sequence: Synthetic coding sequence
atgctgacagaagcaagtctgtctatctggggctgggggagtctgggcatcgtgcttttcttaatcacattcgggccctttgtgattttctacctgactttttatattctatgctttgtcggagggggtctcgtggtaaccttattattcgggaagacaaactctgaaaaatacctggagcagtgcgagcactcctttctgccacctaccagcccgggtgtccctaagtgtctggaggaaatgaagcgggaggctagaaccataaagatcgacagacggctgacaggagcgaatatcattgacgagcctctgcagcaggtcatccaattttcattacgcgattatgtgcaatactggtattacactctgagcgacgacgagagctttctgttagaaatccgccaaacactccagaacgcactgatccagtttgcaacccgctcaaaagagatcgactggcagccctatttcactacaagaatagtcgacgacttcggaacccacttgcgcgtcttccggaaagcccagcaaaagattactgaaaaagatgatcaggtgaagggtacagccgaggacctggtggatactttttttgaggttgaagtggagatggagaaagaggtgtgtcgggatctggtgtgcacaagtcccaaggatgaggaggggttcctgagggatctgtgcgaagtgctgttatatttgctgctcccacctggtgactttcagaacaaaatcatgcgatatttcgtacgcgagatcctggcccggggtatcctgttgccattgatcaaccaactgagtgacccggactatattaaccagtacgtgatctggatgatcagagattcgaattgcaattacgaggccttcatgaacatcattaagctgagcgacaatataggtgagctggaggccgttagggacaaagccgccgaggaattgcagtacttacgcagccttgacaccgccggtgatgatatcaatactatcaaaaaccagatcaactcattgctgtttgtgaaaaaagtctgcgattcgcggattcagcgtttacaatctggtaaagagattaacacagttaagctggccgccaattttggcaagctatgcacggtaccgttggacagcatactggtagacaatgttgccctacagttctttatggattacatgcagcaaaccggaggtcaggcgcacctctttttctggatgactgttgaaggatacagagtgactgcccagcaacagcttgaggtcctgctctcccgacaaagggatggtaagcaccagaccaaccagaccaaggggcttctgagggcagcagccgtcggcatttacgagcagtacctgagcgagaaggcgagtcctcgggttacagtggacgactacctcgtcgcgaagctggccgacacgctgaatcatgaggatccaacgccagaaattttcgacgacatacagagaaaagtttacgagctgatgctccgcgacgaacgcttttatccctctttccgacagaacgcactgtatgtgcgcatgctcgctgagttggatatgttaaaggatccatcattccgaggtagcgatgacggggatggggagtcctttaatggcagccccactgggtccatcaatcttagcctggatgacttaagcaacgtgtcaagcgatgatagcgtgcagttgcatgcttatatcagtgataccggagtttgcaacgaccatggcaagacatatgctctctatgcaatcaccgttcataggcgaaatctgaattccgaggaaatgtggaaaacttaccgcagatacagcgacttccacgattttcacatgcgtattaccgagcagttcgaatccttaagtagtatcttaaagttgcctggcaagaagaccttcaacaacatggaccgcgactttctcgaaaaacggaaaaaagatcttaacgcttacttgcaactgcttcttgcacctgagatgatgaaggcttctcccgctctggcgcattacgtttacgattttctagagaacaaggcctacagtaaagggaaaggggattttgcacggaaaatggacaccttcgtcaatccactgagaaattccatgcgaaatgtaagtaatgcggttaaaagtcttcctgatagtttggccgaaggcatgacaaaaatgtccgacaacatggggaagatgagcgaaaggctgggccaagacataaaacaatcattttttaaggtgccgccactaataccaaagacggactccgatcctgaacataggcgggtctctgcacagctagacgataacgtggacgataacatccctttaagagttatgctcctgctgatggacgaagtgttcgacttaaaagagcgtaaccagtggctgcgccgtaatattaagaacctcttgcagcagctcatccgtgccacttacggcgacacaatcaatcggaagatcgttgatcacgtagactggatgactagccccgaacaggtcgccgactctgtgaaaagattcagggatgcattttggccaaatggaatcctggccgaagcggtaccctgcagagacaagagcattcggatgcgcacccgtgtcgcagggaagaccaagctgttagctatcatgcctgacgagttgaagcacatcatcggcgcagaaaccactcgtaaagggatcctgcgcgtgtttgagatgtttcagcacaaccaacttaaccgacgcatggtctatgtgttcttggaaggtttccttgaaaccctgtttccccaatacaagttcagagagctattcaacaagctgcactcccgctccaaacagatgcagaaatacaaacagaaacttcaaacaacccaggcaccgagcttacaaaaacgctag

SEQ ID NO: 135761 - DNA, 771 bp, Artificial Sequence
  Description of Artificial Sequence: Synthetic coding sequence
atgtcccggcaggctaaggatgactttctgcgacattatactgtgagtgacccaagaacacacccaaaagggtatacagaatacaaggtgacagcccagtttatcagtaaaaaggaccccgaggacgttaaggaagtcgttgtatggaagcgatattctgatttcagaaagctacacggtgacctcgcgtacacccacagaaacttgtttcggcggctggaagagtttcccgcattcccaagagctcaagtgtttgggagattcgaagcgtcggtgattgaggaacgccgaaaaggagcagaagacctcctacggtttaccgtgcacatccctgccctaaataattcaccacagttgaaagaatttttcagaggtggcgaagtgacacgaccgctcgaggtgagcagagaccttcatatcttgccacctcccctgatccccactcctcctccagacgatccgagattgtcacaactgcttccagccgaacgccgcggattggaggaactcgaagtccccgtcgaccccccgcctagctcccccgcacaggaagcgcttgatctactgttcaactgtgaatctaccgaggaggcctcagggagtcctgctaggggaccactgaccgaagcagagcttgctctgttcgacccctttagtaaggagggtgatccactcccagcacgccaggaaggagtcaaaaagaaggcagccgaatacttgaaaagggccgaagaaatccttcggctacatctctcccagctgccaccatag

SEQ ID NO: 135762 - DNA, 1029 bp, Artificial Sequence
  Description of Artificial Sequence: Synthetic coding sequence
atgtcacgccaggctaaggacgacttcctgaggcattacacggtgtccgatccgagaactcaccctaaagggtatacagagtataaggtgaccgcccagttcatcagcaaaaaggaccccgaagatgtcaaggaggtggtggtttggaagcgctatagtgactttcgcaaactgcacggcgacttagcctatactcaccggaacctcttcaggagactggaagagtttcctgcctttcctcgcgctcaagtcttcggtcgctttgaggctagcgtgatcgaggaacgcagaaagggagctgaagatctcctcaggtttactgtgcatatcccagctcttaacaactctccccagcttaaggaatttttcagggggggtgaggtcactcgaccactcgaggtctcgagggacctgcacattctcccgccacccctcattccaacccctccaccagatgatccccgcctcagccagctgctgcccgctgagaggcggggcctggaagaacttgaggtacctgtggaccctccacccagtagtcccgcacaggaggcattggacctcttatttaattgtgaaagtaccgaagaagcttccggttctccagcacggggccccttgaccgaagctgaacttgctctgtttgatcccttctcaaaagaagaaggggctgctccttcaccaactcacgtagccgaactagcaacaatggaggtggaaagcgctcgactggatcaggaaccctgggaaccaggcgggcaggaggaggaagaggacggggagggcggtccaacccctgcttacctgtctcaggccacagagctgatcacacaggctctgcgtgacgagaaggccggcgcctacgcagctgccctacagggataccgcgatggtgtacacgttttattgcagggcgtaccttccgatccgctgcctgctaggcaggagggcgttaaaaaaaaggcagcagaatacctgaagcgggccgaagagattttgcgcctacacctttcgcagctgccaccttag

SEQ ID NO: 135763 - DNA, 1608 bp, Artificial Sequence
  Description of Artificial Sequence: Synthetic coding sequence
atgagcgagggagagtctcaaaccgtcctgtcaagcggttcagatccaaaggtggaatcatcatcatctgcccccggattgacgagcgttagtccccctgtgacaagcacgacaagcgccgctagtccagaggaagaagaggagtccgaggatgagagcgagatcctggaagaaagcccttgcggtcgatggcagaagcgaagagaagaagtaaaccagagaaatgtaccaggaattgatagcgcatacctcgccatggatacggaagagggagtcgaggtcgtgtggaatgaagtacagttctctgagaggaagaattataaactgcaagaggaaaaggtccgcgccgtttttgataatctaattcagctggagcacttgaatatagtcaaatttcataaatattgggccgacattaaagagaacaaggcacgggtcatcttcatcacagagtacatgtctagcggctcactgaaacaattcctgaagaagaccaaaaaaaaccacaagactatgaacgaaaaagcctggaagcgttggtgcactcaaatcttgtccgctttgtcctacttgcactcttgtgaccctcccatcattcatggcaatctgacttgcgacaccatctttatacaacacaacggactgattaagattggaagcgtcgccccagatactattaataatcatgtgaaaacatgtcgggaagagcagaagaatctccacttttttgcacctgagtacggagaagttaccaatgtgactactgcggtcgatatctactcatttggtatgtgcgctcttgagatggcggttctagagatccagggcaatggagagtcttcatatgtgccgcaggaggcaatttcctctgcaatccagctgctggaggaccctttgcagcgggagttcatacagaagtgtttgcagtctgagccagctcggcgccccactgcccgcgaattactgttccatccggctctcttcgaggttccttcactcaagctgttggctgcacattgtattgtaggacaccagcacatgatccctgagaatgcactggaagaaatcaccaaaaatatggacacttccgccgtgttggcagagattcctgccggcccaggcagagagcctgtgcagacactctacagtcaatcccctgctctggagctggacaaatttctggaagacgttagaaacggcatttaccctttaaccgcctttggactacccagacctcagcagccgcagcaggaagaggtgacctcacccgtcgtccccccgtcagttaaaacacctactcctgagcctgctgaggtcgaaaccagaaaggtggtgctaatgcagtgcaatattgagagtgtggaggagggggttaagcaccacctgaccctgctacttaaactggaggataaactgaataggcacctgagttgcgatctgatgcccaacgaaaatattcccgagctggcggcggaactcgtccagctagggtttatttccgaggcagaccaaagtcgattaacatctctcttagaggagacattaaacaaattcaatttcgcccgcaacagcacactgaactccgccgcagtcacggtttcctcgtag

SEQ ID NO: 135764 - DNA, 1338 bp, Artificial Sequence
  Description of Artificial Sequence: Synthetic coding sequence
atgcacttttcgatccccgagaccgaaagcaggagcggcgattccggagggtcagcttatgtattgcgaaaagagtacggcgcaaatgtgctccctgcttttcctcccaagaaactgtttagtctcacgccagccgaggttgaacagcgcagggaacaactggagaagtatatgcaggccgtcagacaagatccgctgctaggctcctctgagacatttaattctttcttacggcgcgcccaacaggagacccagcaggttcctacagaggaggtgtcattagaggtgctgctttctaacggccagaaggtgctggttaacgtgctgacatccgatcagaccgaggatgttctggaagctgtggccgccaagctggacctgcctgatgaccttatcggctattttagcctgttcctggtccgagaaaaggaagacggcgctttttctttcgtgcgcaaactccaagagttcgagttaccctacgttagtgttacctcattacggtctcaggagtacaaaatcgttttgcgtaagtcatattgggactccgcctacgatgatgacgtcatggagaaccgggtaggcctgaatctgctgtatgcacagacagttagcgatattgaaaggggatggattctggttaccaaagaacagcaccgacagctaaagagtttacaggagaaggtcagcaagaaagagttcctaaggttggcacagacccttaggcactatggctacttgagatttgacgcttgcgtggccgatttccctgagaaggactgtcctgtcgtggttagtgcagggaactctgaactctccctgcagttaaggttaccagggcagcagctgcgtgaggggtccttccgggtgactcggatgaggtgttggagggtgacctcaagtgtgccccttcccagcggttcaactagctcccccgggcgcggccgcggtgaggtgcggctggaactagcgtttgagtatctgatgtccaaggacaggctgcagtgggtcactattacatctcctcaagccatcatgatgagcatctgcctccaatctatggtggatgaattgatggttaagaagtccggcggatccataaggaaaatgctgcgccggagggtcggagggacactgagaagaagcgactcccagcaggcagtgaaatctccccccttgctagagagccccgatgcaactagagagtcgatggtgaaactgtctagcaagctgagtgcagtttcgcttagagggataggatcaccatccactgacgccagtgcctcagacgttcatggtaactttgctttcgaaggaatcggcgatgaggatctgtag

SEQ ID NO: 135765 - DNA, 771 bp, Artificial Sequence
  Description of Artificial Sequence: Synthetic coding sequence
atggagaaccgggttggcctgaacctgttgtatgcacagaccgtttctgatatcgagcggggatggatattagtgacaaaagagcagcatcgccagctcaagagtctgcaggaaaaagtgtccaaaaaggaattcctgcgtcttgcccagaccttacgccattatggatacttgagatttgatgcatgtgttgctgattttcctgaaaaggactgccccgtggtggtctctgccgggaatagcgagctctcccttcaactaaggttgcctggtcaacagctgcgggaggggagtttccgtgtcacccgtatgagatgctggagagtcacgagcagcgttcctctccccagcggttctacttcttctccaggacgcggaagaggggaggtaaggctcgaactggcatttgaataccttatgtctaaggatcggctgcagtgggtaacaattacctctccccaggccattatgatgagcatttgcctgcaatcaatggtggatgaacttatggttaaaaagtccggcggatctatcagaaagatgttacggcggcgggtggggggaactctgcggagaagcgattcacagcaggccgtcaaaagcccgcccctcctggagtcacccgatgccacaagggagtccatggttaaactgagctcaaagctttccgctgtctcactccgcggaatcgggtctccgagtaccgacgcctccgcttccgatgtccacggtaatttcgcatttgaaggaattggagacgaggatctatag

SEQ ID NO: 135766 - DNA, 771 bp, Artificial Sequence
  Description of Artificial Sequence: Synthetic coding sequence
atggagaatcgcgtcggtctgaacctgctgtacgcccagactgtctctgacatcgagagaggatggatcctcgttaccaaggagcagcatagacagctcaagtccctgcaggagaaagtgagcaagaaggagttcttgcgtctggcccaaaccctgaggcattacggctatcttcggttcgatgcatgtgtggccgatttccctgaaaaggactgcccggtcgtagtgagcgcaggcaacagcgagctgtctctgcagctgcgactaccgggacagcagttgagggagggaagctttagggttacaaggatgcgctgttggagagtcacgagttccgtgcccctaccctctggatccacgagctccccaggtcgggggaggggggaggtgcggctcgagttggcgtttgaatacctcatgtcgaaggatcggctgcaatgggtgactattacctccccacaggctatcatgatgagcatttgcctccaaagtatggtggacgagttgatggttaagaagagtggcggctccatccgcaaaatgttgagaagacgggtaggtggcaccctgcgccgcagtgacagccagcaggcagttaagtctcccccactgctggagagtcccgacgccacaagagaaagcatggtcaaactgagttcaaaattgagtgccgtgtctctcagggggatcggaagtccttccaccgatgcatccgccagcgatgtgcacggaaatttcgcatttgagggaatcggagatgaagatctttag

SEQ ID NO: 135767 - DNA, 1560 bp, Artificial Sequence
  Description of Artificial Sequence: Synthetic coding sequence
atggcggccgagcgagaaccaccgcctctgggagatggcaaacccaccgactttgaggatctggaagacggagaggatctttttacatccactgttagtaccctagaaagttcccccagcagtcccgagcccgcaagcctccctgccgaggatattagcgcgaattctaatgggcccaagccgacggaggttgtcttagatgatgatcgggaagatctatttgccgaagcgactgaagaagtctctctcgattcaccggagcgcgaacccattctttcatccgaaccatctccagctgtgacaccagtgacccctactacactgatagccccccggattgagagcaagagcatgtccgcccctgtgatatttgaccgctcacgggaagagatcgaggaagaggctaatggcgatatattcgatatcgagatcggcgtctccgatccagagaaggtcggcgacgggatgaatgcctatatggcttaccgcgtgacaaccaaaacctctctgtcaatgttttccaaaagcgaattcagtgtgaagaggaggttctctgacttcttaggcttgcatagtaagcttgcctcaaaatatttgcacgtgggatatattgtgcctcccgctccagagaaatctatcgtgggtatgactaaggtgaaggtcggtaaggaagatagttcaagtaccgagttcgtggaaaagcgccgagccgctttagagcgctacttgcagcgtaccgtgaaacaccccacattgctccaggatcctgacctccgccaatttctggagagttcagaactgcctcgggcagttaacacacaggccctgtcaggggctggtatcctgagaatggtgaacaaggctgcagacgctgttaataagatgaccatcaagatgaacgagtccgatgcctggttcgaggagaagcagcaacagtttgaaaacctggaccaacaactgcgtaagcttcatgtatcagttgaggccctggtctgccatagaaaggaactgtccgccaataccgctgccttcgctaaaagcgctgccatgctgggtaacagtgaggatcacacggccctgtcacgcgccctctctcaactcgccgaagtggaggagaaaattgaccagcttcatcaagagcaggcttttgctgatttctacatgttctctgagctattaagcgattacataaggttgatcgctgcagtaaagggtgttttcgaccatagaatgaagtgttggcagaagtgggaagatgcccaaattaccctgctgaagaaaagggaagctgaagccaagatgatggtcgcaaacaagcccgataagatccagcaagcaaagaatgaaatcagggaatgggaggccaaggttcagcagggtgagagagatttcgagcagattagtaaaacaattaggaaagaggtgggtaggtttgagaaagaacgggtcaaggactttaagaccgtgatcatcaagtatctcgagtccctagttcagacccagcagcaactcatcaaatattgggaagcctttctccccgaagccaaagcgattgcttag

SEQ ID NO: 135768 - DNA, 390 bp, Artificial Sequence
  Description of Artificial Sequence: Synthetic coding sequence
atggcgagccctgagcaccccggtagccctggttgtatgggccccattacccagtgtacggcaagaacgcagcaggaagcaccagccacaggcccagaccttccacatcctggtccagacggacaccttgacacccactcaggccttagctcgaacagttcgatgacaactcgcgagctgcagcagtattggcaaaaccaaaaatgccgctggaagcatgtcaagctgttattcgagatagccagcgcacgcattgaggaaaggaaggtgtccaaattcgtcatgggtaaatcacgcccgggtgagatgacttacccaggatctagaggcgagactggaacagccccagagccagacccgcgatgtcctcgccagtctgacatgctgtag

SEQ ID NO: 135769 - DNA, 951 bp, Artificial Sequence
  Description of Artificial Sequence: Synthetic coding sequence
atggccagtccagagcatcctggctcacctggttgtatgggaccgatcacacagtgcacagcgcgcacacagcaggaggcccccgccaccggacctgatctgccccatcccggcccggacggacatttggacacacattctggcctaagttcgaactcaagcatgacaaccagagagctgcaacagtattggcagaaccagaaatgccgctggaagcacgtgaagctgctttttgaaatcgcttccgcccgcatagaggagcgcaaggtgtctaagttcgtggtctaccaaatcatcgtgattcagactggcagtttcgataacaataaagcagtgctggagagaaggtactctgatttcgccaagctgcaaaaggccctgctgaaaacattccgggaggagatcgaggatgttgagtttccccgaaagcatctgactggcaacttcgccgaagagatgatttgcgagagacggcgtgccttgcaggagtacctgggtctcctctacgccatcaggtgcgtgcgtcgaagcagggagttcctcgatttcttgacacgcccggaactcagggaggcctttggatgtttgcgggccggacagtacccccgggcattagaactgcttctcagggtgttgcctctacaggaaaagcttaccgcccactgcccagccgctgcggtcccagctctgtgcgccgtcctcctgtgtcaccgagaccttgacaggcctgcggaagcctttgctgccggcgaaagggccctgcagcgtctccaagcccgcgagggccacaggtactatgctccacttctcgacgctatggtgcgcttggcctatgccctggggaaagactttgtgaccctacaggagagactggaggagtcccagctccgccggcccacccctaggggtataacacttaaggagcttaccgtgcgcgagtacctgcattag

SEQ ID NO: 135770 - DNA, 459 bp, Artificial Sequence
  Description of Artificial Sequence: Synthetic coding sequence
atggctagtcctgagcacccaggaagccccggatgtatgggacccataacgcaatgcactgcgcgcacacagcaggaggctcccgctactgggcctgacctccctcatcctggcccggatgggcacctggacacacactcaggactttcctctaactcctctatgactaccagagagcttcagcagtattggcagaaccagaagtgtaggtggaaacatgtgaagctgttgtttgaaatagcgagtgcacgcattgaggaacggaaggtgagcaagtttgtggtgtatcagattatagtgatccagaccggcagctttgacaataataaagcagtcctggagcgacgctactctgatttcgtaacactgcaggagcggctcgaggagtcccagcttcgccgccctacccccaggggtattaccctgaaagagcttaccgtgcgagagtacctgcattag

SEQ ID NO: 135771 - DNA, 309 bp, Artificial Sequence
  Description of Artificial Sequence: Synthetic coding sequence
atggcttcaccggagcacccagggtccccaggatgtatgggaccaataacccagtgtaccgccaggacccagcaagaagcccccgctacagggcccgatctgccccaccctgggcccgacggccacctggatactcattcaggactctcgagcaattcttccatgaccaccagagaactccagcaatattggcagaatcagaaatgcagatggaaacatgtaaaactgctattcgaaatcgctagcgcaagaatcgaggagagaaaggtgtccaaatttgtcgctcctgcacccgatgctaccccttag

SEQ ID NO: 135772 - DNA, 807 bp, Artificial Sequence
  Description of Artificial Sequence: Synthetic coding sequence
atgcaacagattagacctccatttattcgggggcctcctcatcacgcgtccaaccctaattcccccctatctaatcctatgctgccaggcatcggtcccccgcccggagggcccaggaatctgggccctacgtcatcgcctatgcacagacccatgctgtcccctcatattcatcctccctcaacccctacaatgcctggcaacccccctggactccttcccccacccccgcccggggcccctttaccttccctccctttccccccagtttccatgatgcctaatgggcccatgcccgttccacagatgatgaactttggactgcccagcttggcccccctggtccccccacccactcttctggtgccctatcccgtcatcgtgcctctgcctgtgcctatccccataccaatccccatccctcatgtctcggattcaaaacctcctaagaagctacttagccccgaagagccagctgtctcagagctggagagcgtcaaggaaaacaactgcgcttctaattgtcacctagacggcgaggccgctaagaagctcatgggtgaggaggccctggctggaggtgataagtccgacccaaacttgaataatccagctgacgaggaccacgcatacgctttgaggatgctgcccaagaccggctgcgtcatccagcccgtcccaaagccagctgaaaaagcagcaatggccccttgcattatctcctcgcctatgctaagcgccggacctgaggacctcgagccaccactgaagcggaggtgtttaagaatacgcaatcaaaacaaatag

SEQ ID NO: 135773 - DNA, 423 bp, Artificial Sequence
  Description of Artificial Sequence: Synthetic coding sequence
atggccgaaacagtggccgacacccgaagactgatcaccaaaccacagaacctgaacgacgcttacggaccacccagtaacttcctcgagatcgacacaaacttaccaatatttaaactgaaagagagcacagtgcgcaggaggtactccgactttgagtggcttcggagtgagttggaaagagagtctaaggtggtagtaccaccactgcctgggaaggcatttctgcggcagttaccgttccggggagacgacgggatcttcgatgacaatttcatcgaggaaaggaagcaaggactagagcagtttatcaataaagtcgctgggcaccccctggctcaaaacgagaggtgcctccatatgtttttacaggatgagattattgataaaagctacactcctagtaagatcagacacgcgtag

SEQ ID NO: 135774 - DNA, 342 bp, Artificial Sequence
  Description of Artificial Sequence: Synthetic coding sequence
atggctgaaaccgtggccgacacccggaggctaattactaagccacagaacctcaacgacgcatatgggccgccaagtaattttcttgagatcgacgtgtctaatcctcaaacagtgggggttgggagagggcggtttacgacctacgagatccgggtgaagacaaatctgccgatctttaaactcaaggaatcaaccgtccggcgtcggtactctgactttgagtggctgcgatccgaattggaacgggaatccaaaccctgccttcggatgacttctgaggcacgaagccatggcaggacctggtgcgcccagaatgacgagaagcttttttgtgattag

SEQ ID NO: 135775 - DNA, 393 bp, Artificial Sequence
  Description of Artificial Sequence: Synthetic coding sequence
atggctgagacagttgccgacacgcgaagactaattacgaagccccagaacctcaacgacgcctatggacccccctcaaatttccttgagattgatgtgagcaatcctcagacagtcggcgtcggacggggacggttcactacatacgagatcagggtgaaggtggtcgttccacctttgcctggcaaggcgtttcttcggcaactgccatttcggggggacgacggcattttcgatgataacttcattgaggaacgaaaacagggccttgagcagttcatcaacaaggtcgctggacaccctctagcccagaacgaacgctgcctccacatgttcctgcaggacgagattatcgataaaagttacaccccctccaagattcgacacgcctag

SEQ ID NO: 135776 - DNA, 1353 bp, Artificial Sequence
  Description of Artificial Sequence: Synthetic coding sequence
atggagcaggcacctcctgacccagagcgccagctccagccagctcctcttgagcctctaggctcgcccgatgccggccttggggcggctgtcggcaaagaggctgaaggagcgggtgaagagtcttccggagtggatacaatgacacacaacaatttctggctgaaaaagatcgagataagcgtctctgaggctgagaagcgtactggccgcaatgcaatgaacatgcaggaaacatataccgcatacctcatcgagactcgatctgtggagcataccgacggacagtcggtgctcacagattccctttggcgcaggtattcagagttcgaactcctgcggagttatcttctcgtgtattatccacacatcgtggttcccccgttgcctgaaaagagagccgagtttgtctggcacaagctcagcgctgacaacatggaccccgattttgtagaaagacgcaggattgggttggagaactttcttcttaggattgcatctcatcccattctctgtagagataaaattttctacctgttcctgactcaggagggtaattggaaggagacagttaacgaaaccggctttcagctgaaggccgactcccggctgaaagcactaaacgccacgtttcgtgtgaaaaatcccgacaagcgtttcaccgatctcaagcactatagcgacgaactgcaatctgtaatttctcatcttcttcgggtgcgggcaagggtggccgatcgtctgtacggagtgtacaaagttcacggtaattacggccgggtcttcagtgagtggtctgccatagaaaaggaaatgggcgacggactgcagtccgcgggccatcacatggatgtatatgcatcctcgatcgatgatatcctggaagatgaagaacattatgcagatcagttgaaagagtacctgttctacgcagaagcgctgcgagccgtatgccgtaaacacgagcttatgcagtatgatcttgaaatggcggcccaggatctcgcctctaagaagcagcaatgcgaagagctagtgactgggacggttcgaacattttcgctcaaaggaatgacaactaagttgttcggtcaggagacacccgaacagcgagaggcccgcattaaagtcctggaagaacagatcaacgaaggagagcagcagcttaagtcaaaaaacctagaggggagagagttcgtgaagaatgcctgggcggacattgagcggttcaaggaacagaagaaccgggatcttaaagaggctttgatctcttatgccgttatgcaaatctccatgtgtaagaaaggcattcaggtatggacgaatgccaaagaatgcttctcaaagatgtag

SEQ ID NO: 135777 - DNA, 918 bp, Artificial Sequence
  Description of Artificial Sequence: Synthetic coding sequence
atggaccccgattttgtagaacggcgtcggatagggctggagaactttctgctgcggattgctagccacccaatactgtgccgggacaagattttctacctgtttttgactcaagaaggcaactggaaggaaactgtcaacgagaccggttttcagctcaaagccgatagcaggctcaaggccctgaatgccacctttcgagtgaaaaacccagacaagaggttcacagacctgaaacactactcagacgagcttcagagcgtaatttcccatctcttgcgagtcagggctagagtggcggacagactctatggcgtgtataaggtacatggcaattacgggagggttttctcagaatggagcgctattgagaaggagatgggggacggcctccaatctgcaggccatcatatggatgtgtacgccagctccatcgatgacattctcgaagatgaggagcactacgcagatcagctgaaagaatacttgttctatgccgaggcgttacgtgccgtttgcaggaagcatgagctgatgcagtacgatctcgaaatggccgcccaggacttggcctcgaaaaaacagcagtgcgaggaattggtcacgggaacggtgcgtactttcagcttgaaaggtatgaccaccaagctgtttggccaggagactcccgagcagagagaggccagaatcaaagtgctggaagaacagatcaatgagggagaacagcagttgaagagtaagaatcttgaaggacgagagttcgtcaagaatgcgtgggctgacattgagcgctttaaagagcaaaagaaccgggatctgaaggaagcccttatatcctacgcagtcatgcagataagcatgtgcaagaagggcattcaggtgtggacgaatgcaaaagaatgcttcagcaaaatgtag

SEQ ID NO: 135778 - DNA, 1215 bp, Artificial Sequence
  Description of Artificial Sequence: Synthetic coding sequence
atggccgcagtgcccgagctgctgcagcagcaagaggaggacagatctaaattgagatctgtctccgttgaccttaatgtagacccatctctgcaaatcgacatccctgatgcgttgtcagagcgggacaaggtgaagtttaccgtacacacaaagacaacactacccacattccagtcacctgaattctccgtcacacggcagcacgaagattttgtctggcttcacgataccttgattgaaaccacagactatgcaggtctcattataccccccgcccctacaaagcccgactttgacggccccagagaaaagatgcaaaagctgggtgagggggaagggtcaatgaccaaggaggaattcgccaaaatgaaacaggaactggaggccgaatacctggcggtgtttaagaagacagtgtcgagccacgaggtgttcttacagcgactctcctctcaccctgtgctttccaaggataggaattttcacgtattcctggaatatgaccaggacttgagtgtgcggagaaagaatactaaggagatgttcggaggcttcttcaagagcgtggttaaatcagcggatgaggtgctgttcacaggcgtaaaggaggttgacgatttttttgagcaagagaaaaactttctcatcaattactataaccgcataaaggactcctgcgtcaaggccgacaagatgacccggagccacaagaacgttgcagatgactacatacataccgccgcttgtctgcatagtctggcattggaagagcctactgtcattaaaaagtacctgctcaaggtggccgagctctttgagaagctccggaaggtggaaggccgcgtatcctctgacgaggatctcaaactgaccgaattattgcgatactacatgttaaatattgaggccgccaaggacttactatataggcggaccaaagcgctgattgactacgagaactctaataaggcactggacaaggctagattaaaaagtaaggatgtgaaactggcagaggcacaccagcaagagtgctgtcagaagttcgagcagttaagtgagagcgccaaagaagaactgatcaactttaagcgcaaaagggtggccgcttttagaaagaatctaatcgagatgtccgagctggagattaaacacgctcgtaataacgtatctttattgcaaagctgcatcgacctgttcaaaaacaattag

SEQ ID NO: 135779 - DNA, 1215 bp, Artificial Sequence
  Description of Artificial Sequence: Synthetic coding sequence
atggcggcagtgccggagctgctgcagcagcaggaagaagaccggtctaagcttcggagtgtctccgtggacctgaacgtagatccatctttgcagatcgatattccagacgcactcagcgaacgtgacaaggtcaaatttaccgtacacaccaagacaacacttcctacttttcagagccccgagttttcggttacacgtcagcatgaagatttcgtgtggctccatgacacattaattgagacaactgactatgccggcctaattattcctcccgctccgactaagccagacttcgatggaccgcgggagaaaatgcaaaagttaggggagggggaaggcagtatgactaaagaggagttcgccaagatgaagcaagaactcgaggccgagtacctggcagtgttcaaaaaaaccgtcagtagccatgaagtgttcctgcagcggctcagtagtcatccggtgctgagtaaagaccgcaattttcacgtgttcttagaatacgaccaggatctgtccgttcggaggaagaatactaaagaaatgttcgggggttttttcaaatcagttgtcaagtccgccgacgaagtgcttttcaccggggtgaaggaagttgatgatttcttcgaacaggagaagaacttcctcatcaattactataaccggattaaggacagctgtgtgaaagccgacaaaatgactaggtctcataagaatgtcgccgatgactacatccataccgcggcttgcctgcatagcttggccttggaggaacccacagtgatcaaaaagtacttgctgaaggtggcagagctgtttgagaagctccgcaaggtggagggaagagtgtccagtgacgaggacctcaagttgaccgaactgctgaggtactatatgcttaacattgaggcggcaaaagacctgctatatcgacggactaaagctctcatcgactatgaaaatagtaacaaagccctggacaaggccaggctcaagtccaaagatgtgaagctggccgaggcccatcagcaggaatgctgccagaaatttgagcagctgtctgagtccgccaaggaggaactaattaacttcaagaggaagcgcgtggccgccttcagaaagaatctgattgagatgagcgagttggagatcaagcatgcccgcaacaatgtcagtctgctccagtcatgcatcgatcttttcaaaaacaactag

SEQ ID NO: 135780 - DNA, 687 bp, Artificial Sequence
  Description of Artificial Sequence: Synthetic coding sequence
atggccgccgtgccggagcttctgcagcagcaggaggaggatagatccaagaccacactgccaacatttcaaagccctgaatttagcgtgactcgacagcacgaagatttcgtgtggttgcatgatactctcattgagacgacggattatgcaggcttgattatcccccctgcccccaccaaacctgacttcgacggcccccgagagaaaatgcagaagctaggagagggagaaggcagcatgaccaaggaggagtttgccaagatgaagcaagagctggaagctgaatacctggctgtctttaagaagacggtgtcctctcatgaggtgttccttcagcggttatcgtcacatcctgtgctaagtaaagatcgtaacttccatgtgttcttggagtacgatcaggacctgtcagttcggcgcaaaaataccaaagaaatgttcggaggttttttcaagagtgtggtgaagagtgcagacgaggtgctgttcactggggttaaggaagttgacgatttcttcgaacaggaaaagaattttctcattaactactacaataggatcaaagattcctgtgtgaaggctgacaagatgacccgaagccacaagaacgtagcagatgactacatccacaccgccgcttgcctccactctctggctctcgaggaacctaccgtgataaagtag

SEQ ID NO: 135781 - DNA, 810 bp, Artificial Sequence
  Description of Artificial Sequence: Synthetic coding sequence
atggcggccgtgccagagctgcttcaacagcaagaggaagaccggagcaagctgagatccgtctcagtagacctcaatgtggaccccagcctgcagatcgatataccagacgccctcagtgagcgagacaaagtaaaattcactgtgcacacaaagatccccccagcccccaccaaaccggacttcgatgggccccgggagaaaatgcagaagctgggcgagggagagggatccatgacaaaggaggagttcgctaagatgaaacaggagctggaggctgagtatttagcagtcttcaaaaagacggtatcttcccatgaggtgttcttacagaggcttagcagccaccctgtgcttagcaaagatcggaacttccatgtgttcctggaatatgaccaggacttatccgtacggcggaagaataccaaagaaatgtttggcgggtttttcaagagcgttgtgaaatctgccgatgaggtcctgttcacaggggtcaaggaagtcgatgatttcttcgaacaagagaagaattttcttattaactattacaatcgcattaaggacagttgtgtcaaagctgacaagatgaccagaagtcataagaacgtcgcagatgattacatccacaccgccgcatgccttcatagtctcgctctcgaggagcccaccgtgataaagaaatatttactgaaagtcgctgaacttttcgagaaactgcgaaaagtcgaagggcgggtgtctagcgatgaggacctgaaactcactgagttgcttagatattacatgcttaacatagaggccgccaagtag

SEQ ID NO: 135782 - DNA, 885 bp, Artificial Sequence
  Description of Artificial Sequence: Synthetic coding sequence
atgacaactcttaccgagattaagctactgcctagcctggtgctacttgtgtgttgtgagtatttagccattttcaaaaagacagtagccatgcacgaagtgttcttgtgccgcgtagccgcccatcccatcctgagaagagatcttaacttccacgtcttcctggaatacaatcaggacctctccgtaagggggaaaaataagaaagagaaattggaggatttcttcaagaatatggtaaagtctgcagatggtgtgattgtttccggggttaaggacgtggacgacttttttgagcacgagcggacattccttctggagtaccacaaccgggtgaaagacgcctccgcaaaatccgaccgcatgaccaggtcccataaatccgctgccgacgactataacaggatcgggtcctctttgtacgctcttggcacccaagatagtacagacatttgtaaattcttcctcaaagtatccgaactgttcgacaaaaccaggaaaattgaggcacgcgtctcagccgacgaagatctaaagctcagcgacctcttgaaatattacctgagagagtcccaggctgcaaaggatctactgtatcgccgatccagatcgctggtggattacgagaacgctaataaagctctggataaggccagagcgaaaaataaagacgtattgcaagctgaaacatctcagcagctatgctgtcaaaaattcgaaaagatcagtgaatccgccaagcaagagcttatagattttaagactagacgcgtggctgcttttcggaagaatttggtggagctagctgaactcgaactaaagcatgcgaaggggaatctccaactgctacagaactgtctggctgtcctgaatggagacacatag

SEQ ID NO: 135783 - DNA, 1257 bp, Artificial Sequence
  Description of Artificial Sequence: Synthetic coding sequence
atgcgggcgtgtgctggaccccggctcggagcagccatgatggaaggattagacgacgggccagacttcctgagtgaggaagaccgcggtctgaaggcgataaatgtggatctccaatccgatgctgccctgcaggttgatattagcgacgccctctccgagagagacaaggttaagttcaccgtacacaccaaatcctccctccctaattttaaacaaaacgaattttcggtcgttaggcagcacgaagaattcatctggctgcatgactctttcgtcgagaatgaagattacgcaggctatataattccacctgctccccctagaccggattttgacgcaagcagggagaaattgcagaaactgggagagggagaagggtctatgaccaaggaggagttcacaaaaatgaagcaggaactggaggcagaatacttggccatttttaagaagaccgtggcaatgcacgaagtctttctgtgtcgggtggctgcacatccaatcttgaggcgtgatttgaatttccacgtgttccttgaatacaaccaggacctgtctgtgagaggtaagaacaaaaaggagaagctggaggatttcttcaagaatatggttaagtctgctgatggggtgatagtctctggagtgaaagacgtggacgattttttcgagcatgagcggacctttcttctggaatatcacaatcgggtgaaggatgcctccgccaagagcgatcggatgacacgtagtcacaaatcagcagccgacgattacaataggattggctcctccttatacgccttgggcacacaggattctacagatatctgcaaatttttcctaaaggtgagcgaactgtttgacaagaccaggaagatcgaggccagagtcagcgccgacgaagacctgaaactgtcagacctgctgaaatactatcttcgcgaatcccaagccgctaaggacctcctctaccgtagaagccgttccctggtcgactatgagaacgccaacaaggctttggacaaagccagggctaagaacaaggacgtcttacaggccgagacctctcaacagctttgctgtcaaaagtttgaaaaaattagcgagtctgccaagcaagaactgatcgattttaaaactagacgtgtcgccgctttcagaaaaaatctggtggagctggccgaacttgaactgaagcacgccaaaggtaaccttcagctgttacagaattgcttagcggttctcaacggcgacacatag

SEQ ID NO: 135784 - DNA, 873 bp, Artificial Sequence
  Description of Artificial Sequence: Synthetic coding sequence
atgaccaaggaggagtttacaaaaatgaagcaagagttggaagctgaataccttgcaatttttaaaaagacagtcgccatgcatgaggtgtttctgtgcagagtggccgcccatcccatcctacgtagagacttgaattttcacgtcttcctagagtacaaccaggacctgtccgtccgtggcaagaacaagaaggagaagcttgaggacttcttcaagaacatggtgaaatcggcagatggcgtcatagtttctggcgttaaggacgtcgacgattttttcgagcacgaaagaaccttcttattagagtaccacaatcgagttaaggatgcaagtgctaaatctgatcggatgacacggagtcataaaagcgctgccgatgattacaaccgcatcggcagctccttgtacgccttaggtacacaggactccaccgatatctgtaagttcttcttaaaggtcagtgaactgttcgataagacaaggaaaatcgaggcgcgtgtgtccgcagacgaagatcttaagctctctgacctcctcaagtattaccttcgcgagtcccaggctgcaaaggacctgctatacaggcggtctcgcagtcttgttgattacgaaaacgcgaacaaagcactggataaagcccgagctaaaaacaaggatgtgctgcaggcagaaacttctcaacagctatgttgccagaaattcgagaagatttctgagtcggcaaagcaggagctcattgattttaaaacaagacgggtggccgctttcaggaagaacctggtagaactggccgaattggaactgaaacacgccaaaggtaacctgcagctgcttcaaaattgtctcgctgtcctcaatggcgatacctag

SEQ ID NO: 135785 - DNA, 873 bp, Artificial Sequence
  Description of Artificial Sequence: Synthetic coding sequence
atgactaaagaggaatttaccaaaatgaagcaagagctggaggccgaatatcttgcaatttttaaaaagaccgtggcaatgcatgaggtcttcctgtgcagggtggccgcccaccccatcctgagacgcgacctgaatttccatgtcttcctggaatataaccaagatctgtccgtgcgtggcaaaaacaagaaggagaagctcgaggacttcttcaagaacatggtcaaatctgccgacggcgtgatcgtctctggagtgaaagacgtggatgatttttttgaacacgagcggacctttctgttggagtaccacaaccgcgtgaaggatgcgtccgccaaatctgatcgaatgacacggtcccacaagagtgctgcagatgactacaatcggattggttcgtccctgtatgctttaggaacgcaggacagcactgatatctgtaaattcttcttgaaggtgagcgagctgtttgacaagacaaggaagatcgaagcgagggttagcgccgacgaggatctgaaactgtccgatttgctgaaatactatctgcgggaaagtcaagcagccaaagatttgctctatcgccggtcgcgcagcctggtagactatgaaaatgctaataaggcccttgataaagcccgggctaagaacaaagatgtgctgcaggccgagacctcccagcagctgtgctgccagaaatttgagaaaatatccgaaagtgcgaagcaggagctgattgacttcaaaactcgtcgcgtggccgcgtttcggaagaacctcgtggaactagcagagttggagctgaagcacgccaaagggaacttacagttactgcagaattgcctcgctgtgctcaacggagacacgtag

SEQ ID NO: 135786 - DNA, 1188 bp, Artificial Sequence
  Description of Artificial Sequence: Synthetic coding sequence
atgaaaatccctctgaacaagtttcctggcttcgccaaaccagggaccgagcagtatcttctagccaagcaactagccaagcccaaagagaaaatccctatcatcgtgggggactacggtcctatgtgggtttacccaacctcgacttttgactgcgtagtcgccgatccccgcaaagggtccaagatgtacgggctcaaatcatacatcgagtatcagctaacgcccaccaataccaaccgctccgttaaccatcggtataagcattttgactggttgtacgagcgcctgctggtcaagtttgggtctgcaatcccgatcccaagtctgcccgacaagcaagtgactggcagattcgaggaggaatttatcaaaatgcggatggaaaggctgcaagcttggatgacacgcatgtgcagacaccccgttatatctgaatctgaagtgtttcaacagtttctgaattttcgggacgagaaggaatggaagaccgggaagaggaaggcggaacgtgatgaattggccggtgtgatgatctttagcaccatggagcccgaggcgcccgatttggatctggtggagatcgaacagaaatgcgaagctgtgggcaaatttaccaaagctatggacgacggagttaaggagctactgaccgtgggccaggagcactggaaaaggtgtacaggtccactgcctaaggagtatcagaagatcggcaaggccctacagtcactagccaccgtcttttcttcttccggataccagggggagacagatttaaatgacgccatcactgaagcagggaaaacatacgaggagatcgctagcctggtggccgagcagcctaaaaaggatctgcactttttgatggagtgcaaccacgagtataaggggtttttgggctgtttccccgacatcataggaacccacaagggcgctattgagaaagtgaaggaatcagataaactcgtggccacgtctaaaattaccctgcaagataaacaaaacatggtgaagagagtctcaatcatgtcatatgcacttcaggcagagatgaatcactttcactctaatcgcatttatgattataattctgtcattcggctgtacttggaacagcaggtccagttctacgagaccatcgctgaaaagctccgccaagctttgtccaggttccctgtgatgtag

SEQ ID NO: 135787 - DNA, 1788 bp, Artificial Sequence
  Description of Artificial Sequence: Synthetic coding sequence
atggctactaaggcacgagtcatgtatgactttgccgccgagcccggtaacaatgagttgaccgtcaatgaaggcgagataatcaccattacaaatccggatgttggcgggggatggctcgaggggcgtaatattaagggcgagcgcggcctagtgcccaccgattacgtggaaattctgccctccgacggcaaggatcaattctcatgcggaaactctgtggctgaccaggcctttctggatagcctgtcagccagcacagcccaagccagttcttccgccgcatccaataaccaccaggtcggaagtggcaacgacccctggagcgcatggagtgcatctaagagtggcaattgggagtccagcgaaggttggggggcccagccggaaggcgctggcgcgcagcggaatacgaacacacctaataactgggataccgcttttggccatcctcaggcttatcaaggcccagctacaggtgatgatgacgattgggatgaagactgggatgggcccaagagttctagttatttcaaggactctgagtcagctgacgccggtggtgcccagaggggcaacagtcgcgcgtcgagtagttctatgaaaataccccttaataaatttccaggattcgccaagcccggaacagagcaatatcttctggccaaacagctcgccaagccgaaggagaagatcccaattatcgtgggtgactacggccccatgtgggtttaccctaccagcactttcgattgcgtggtggccgacccccgtaaaggctcaaagatgtacggcctgaaatcctacatagagtaccaactcacgccgactaatactaaccggtctgtaaaccaccgttataagcattttgattggttatatgaacggcttctcgtaaaattcggatccgccattcctatcccttcgttgccagacaagcaggtcaccggacgctttgaagaagaatttattaaaatgcgaatggagcgtctgcaggcctggatgactaggatgtgtcgtcaccccgttatcagcgaatcggaggtgttccaacagttcctcaacttcagggatgagaaggaatggaagaccggcaagaggaaagctgaaagagacgaattggccggggtgatgatcttttcaaccatggaacctgaggcccccgatttagacctcgttgaaattgaacagaaatgcgaagccgtggggaaatttacgaaggcaatggatgatggtgtgaaggagcttctcacagttgggcaggaacactggaagcgttgtaccggtccactccccaaggagtatcagaagattggtaaagccctgcagagcctggcaaccgtttttagcagttctggctatcagggagaaaccgatctgaatgacgcgatcactgaagcaggaaagacatatgaagagattgcatctctggttgccgagcagccaaagaaggacctccactttttaatggagtgtaaccacgagtacaagggctttctcggatgctttcccgatatcatcggaacccacaaaggcgcaatagaaaaagtgaaagaatcagataagctggttgcgaccagcaagatcacgctgcaggacaaacagaatatggtgaagcgggtgtctataatgagctacgccctgcaggctgagatgaatcactttcactctaatagaatatacgattacaattccgtcattcggctgtacctggagcagcaagtgcagttttatgagaccatagcagagaagttaagacaagcactgagtaggtttccagtcatgtag

SEQ ID NO: 135788 - DNA, 1788 bp, Artificial Sequence
  Description of Artificial Sequence: Synthetic coding sequence
atggccactaaggcaagagtaatgtacgactttgccgctgaaccaggaaacaacgaattaactgttaacgagggtgagattatcaccatcaccaaccctgatgttggtggtggctggcttgaaggtcggaacattaagggagaaagaggtcttgtgcctaccgactacgtcgaaatcctgccgtctgacggtaaggatcagttttcgtgcggcaattctgtagcagatcaggccttccttgactcactgtccgcatccactgctcaagcctcttcatccgcagccagcaacaatcaccaagtagggtcaggcaacgatccgtggtctgcatggagcgcgtctaaaagcgggaattgggagtcttccgaaggctggggagcgcaacccgaaggcgctggagctcagcggaatacgaacactcctaacaactgggatacagcctttgggcatccccaagcatatcagggaccagcaacaggcgatgatgatgactgggacgaggactgggatggaccaaagtccagctcgtattttaaagatagtgaatccgcggatgccggcggggcccaacggggcaactctcgcgcaagctcaagttctatgaaaatcccgctgaataaatttccaggatttgcaaagccagggacggagcagtaccttcttgccaaacagctcgctaaacctaaggagaaaatacccattatcgtcggagattatggacctatgtgggtctatcccacttcaactttcgattgcgtcgtggctgatccacgcaagggctcaaagatgtacggactcaaatcttatatagagtaccaattaactcctactaatacgaaccgctccgtcaaccacagatacaagcactttgattggctttacgaacgcctcttggtcaagttcgggagtgccattcccattccgtccttaccagataagcaggtcacgggccgctttgaggaggagttcattaagatgcgcatggaaaggctgcaggcctggatgactagaatgtgccgccaccccgttatcagcgagagtgaggtatttcaacagttcctgaactttcgtgacgaaaaggagtggaagaccggaaaacggaaggccgagagggacgagctcgccggcgttatgatttttagcaccatggagccggaagcacccgatcttgacctagtggagatcgaacagaaatgcgaggctgtcggcaagtttactaaggcaatggatgatggggttaaggagctgttaaccgttggtcaagagcattggaaacgctgcacgggaccgttgcccaaggaataccagaaaatcggaaaggctctgcagagtttggccactgtgttctccagttcgggttatcagggcgaaacagaccttaatgacgcgattaccgaggctgggaaaacctatgaagagattgcatcactggtggctgagcagcctaaaaaagacctgcacttcctcatggaatgtaatcacgagtataaaggattcctggggtgttttcccgatatcattggcacccataaaggcgctattgagaaagtgaaggagtcggacaaactggtagccacctccaaaatcacattgcaggacaaacagaacatggtgaagagggtgagcataatgtcatacgcgctccaagctgagatgaaccatttccatagcaatagaatctatgactacaattcggttatccgactgtatcttgagcaacaggttcaattttacgagacaatcgcagaaaagctacggcaggccttgagtcgttttcccgtcatgtag

SEQ ID NO: 135789 - DNA, 1308 bp, Artificial Sequence
  Description of Artificial Sequence: Synthetic coding sequence
atgggactctctttcagcctctttccactccggaatcatgtcaacgttgagggggctacacataaacaggtggtggacttaattagggctggagaaaaggagctgatccttactgtgttgagcgtccctccccatgaggccgacaatctggatccatccgatgacagcctgggacaaagtttctatgattataccgagaaacaggctgttcccatatctgtcccgcgatataaacatgtggaacagaatggagagaagttcgtggtatacaacgtttatatggccgggcgtcagctgtgcagtaagaggtatagggagttcgcaatactccaccagaatcttaaacgcgaatttgctaactttacatttcctagacttccaggcaaatggccgttctctctgtctgagcagcagctcgacgcgagaagaagagggttggaggaatacctggagaaagtgtgctctatcagggtcataggggagagcgacatcatgcaagaattcctatcagaaagcgatgaaaactataacggcgtcagcgatgtggagctgagggtagcgctgcctgacgggacaaccgtgacagttcgagtgaagaaaaactccaccactgaccaggtataccaggccattgccgccaaagtggggatggattccaccaccgtgaactacttcgcactgtttgaggttatcagccattctttcgtgagaaagcttgcccccaacgagtttccacataaattgtatatccaaaattatacttcagccgttccaggcacttgcctgaccatccgaaagtggctttttactacagaggaagagattctcctgaatgacaacgatctggctgttacatacttcttccaccaagcagtcgatgacgtaaagaagggctacataaaagccgaagagaaatcctatcagttgcagaagctgtacgagcagcgcaaaatggtgatgtatcttaacatgctgagaacttgcgaaggatacaacgagattattttcccacactgtgcctgcgacagccgccggaagggccacgtaatcactgcgatctcgatcacccacttcaaattacacgcatgcacagaggagggacaactggagaatcaggtcatcgcatttgagtgggacgagatgcagcggtgggatacggacgaggaaggaatggctttttgttttgaatatgctcgaggcgagaaaaaaccacgatgggtgaaaatcttcaccccttacttcaactatatgcacgaatgcttcgaaagagttttctgtgagcttaaatggcgcaaggaggagtattag

SEQ ID NO: 135790 - DNA, 1587 bp, Artificial Sequence
  Description of Artificial Sequence: Synthetic coding sequence
atggccgacgaggatggggaagggatccacccgagtgccccccaccggaacgggggaggcggcggcggaggaggatctggcttacattgcgctggcaatggcggcggcggtgggggaggtcccagagtggttcgcattgtcaagtctgagtctggatatgggttcaatgtgcgcggacaggtgtcggaaggcggtcagctgaggtctataaacggggaattatacgcgcccctgcagcacgtgtccgccgtgcttccaggcggtgctgccgatcgagcaggcgtgcggaagggagatagaattcttgaggtgaaccacgtgaatgtggagggtgctacccacaaacaagttgtggacttaatcagggccggcgagaaggagcttattctgaccgtgctgtcagtacccccccacgaggcagacaacctcgatccaagcgatgattcactgggacaatctttttacgattataccgagaaacaagcagttccaatctctgtgcctaggtataagcatgttgaacagaacggcgaaaagttcgtggtgtataatgtttatatggccggccgccagctgtgctctaagaggtatagagaatttgccatcctacatcagaatctgaagcgggagtttgcaaatttcacttttccacggctcccaggcaagtggccattctccctgagtgaacagcaattagatgctcggaggcggggcctggaagaatatttagagaaggtgtgcagcattagggttatcggtgaatccgacatcatgcaagagttcctgtctgagagtgacgagaactacaacggtgtctcagatgtcgagctgagggtggcactccccgatggcacaacagtcaccgttagggtgaaaaagaacagcaccacagaccaggtttaccaagcaattgcagcaaaagttggaatggactcgaccactgtgaattacttcgcactttttgaggtcatttcccactctttcgttcgcaagctggcaccgaacgaatttccccacaaactgtatattcagaactacactagcgcagtccctgggacctgcctgacaatcagaaaatggttattcactaccgaggaggagatcttgctaaacgataacgatctcgccgttacctacttcttccatcaagcagtggatgatgtaaaaaaagggtacattaaagcggaagaaaagtcctatcaactccaaaagctctatgaacaaaggaagatggtaatgtatttgaacatgttgcggacatgtgaaggttataacgagattatatttcctcactgtgcttgtgattctcgtaggaagggccacgttattacagctatcagtataacccactttaagttacacgcgtgcacagaggagggacagctggagaaccaggtgatcgccttcgagtgggacgagatgcagcgctgggatacagacgaagagggaatggccttctgctttgaatatgccaggggggagaaaaaaccgcgctgggttaagatctttaccccgtatttcaattacatgcatgaatgcttcgaaagagtgttctgcgaactgaagtggcggaaggaggagtactag

SEQ ID NO: 135791 - DNA, 1626 bp, Artificial Sequence
  Description of Artificial Sequence: Synthetic coding sequence
atggccgacgaagacggcgagggcatccaccccagcgctccccatcgaaacggtggaggggggggcggcgggggttccggactgcattgtgctgggaacggcggagggggcggtgggggccctcgtgtggtccgtattgtgaagtctgagtccggatacgggtttaacgtaagggggcaggtgagcgaaggcgggcagctgcgatccatcaacggcgaactgtacgccccactacagcacgtgtcagctgttctgcctggcggggccgctgatagagccggggtcaggaagggcgatcgaattctggaggttaaccacgtgaacgttgagggcgctactcacaaacaggtggtggacctgattcgggctggcgagaaggagctcatcctcacggtgctcagtgtcccccctcacgaagccgataacttggaccccagtgatgattccctaggccagtcattctatgactacactgagaaacaggccgtgcctatctctgtaccccgctataagcatgtagagcaaaatggggaaaagtttgtcgtgtacaacgtctacatggcgggtcgccagctgtgttccaaacgttaccgagagttcgctatcctccaccaaaatctgaagcgggagtttgcgaatttcacattccctaggctccccgggaagtggccttttagtctctctgaacaacagttggacgcccggcgtagggggctggaggaatatttggagaaggtgtgtagtatccgcgtaatcggagagtcagatatcatgcaggaattcctttccgaaagcgatgagaactataacggggtcagcgacgtcgagctacgcgtggctcttccagacggtaccacagtcactgtgagggtcaaaaagaactccaccaccgatcaggtttaccaagccattgcggcaaaagtgggaatggattcgacaaccgtgaattatttcgccctgttcgaagttatctcgcattcgtttgtacgcaagctggctcccaatgagtttccccataagctctacattcagaattatacttcggctgtgccaggaacctgtttaacgataagaaagtggttattcaccacggaggaggaaattctccttaacgacaacgacttagccgtaacatacttttttcatcaggcagtggatgacgtgaagaagggatacattaaggcagaggagaagagctatcagcttcaaaaattgtatgaacagcgcaaaatggtcatgtatctgaacatgctgcgcacgtgtgagggctataacgaaatcatctttccccattgcgcctgtgactccagacgcaagggccatgtaattaccgccatcagcatcacccacttcaaactgcacgcctgcaccgaagaggggcaactggagaaccaggtgatcgcatttgagtgggatgagatgcaaagatgggatactgacgaggaaggcatggccttctgctttgaatacgccaggggggagaaaaagcctcgatgggtgaagatattcactccatacttcaattacatgcacgagtgcttcgaacgagtcttctgtgagcttaagtggagaaaagagaatattttccaaatggctcgctctcagcagcgcgacgttgcaacatag

SEQ ID NO: 135792 - DNA, 2640 bp, Artificial Sequence
  Description of Artificial Sequence: Synthetic coding sequence
atggctggaggtggaggggacttatctacaaggcggctgaatgagtgtatctctcctgtcgccaacgagatgaatcatctccccgcccacagtcacgacttacagcggatgttcaccgaggatcagggtgtcgacgatcggcttctgtacgacattgtgttcaagcactttaaacgaaataaggttgagatttctaacgcgatcaagaagacctttccatttttggaagggctgcgggatcgcgaccttatcacaaacaagatgtttgaagatagccaggatagctgcagaaatctggtgcccgtccagcgcgtcgtgtataatgttttgagtgagttagagaaaactttcaatcttccagtcttagaggcactcttctcagacgttaacatgcaggagtaccccgacctcatccacatttataaagggtttgagaacgttattcatgataagctcccgctccaagagtccgaagaagaggagagagaggaacgttctggactgcaattgagcctggagcagggcacaggcgagaattctttcaggagcctgacctggccaccaagtggctctccctcccatgctggaacaactccacccgagaatgggttgagcgagcacccctgtgaaaccgagcagatcaacgccaagcggaaggataccacctcggacaaagacgactccctcggcagtcaacaaacaaatgaacagtgcgctcaaaaagctgagccaactgagtcctgtgagcagatcgcagtgcaggtcaacaacggggatgccgggcgcgagatgccatgtccgttgccctgcgacgaggaatctccagaggctgagctgcataaccacggtattcagattaatagttgttctgtaaggctggtcgacatcaagaaggagaaaccgttctctaattccaaagtggagtgtcaggcccaagcgcggacacaccacaatcaggcatctgacattatcgtgatttctagtgaagacagcgaggggagcaccgatgtagacgagcctctcgaggttttcatctccgccccaagatcggagccagtaattaataatgacaatccactcgagagtaacgatgaaaaggaagggcaggaggcaacttgctcccgcccgcagattgtccctgaaccgatggattttaggaagctgtccacgtttagagagagcttcaagaagagagtaattgggcaggaccatgacttctccgaaagcagtgaggaggaggccccagctgaagctagcagcggggcactgcggagcaagcatggcgagaaggcccccatgaccagccgctccactagcacctggaggataccgagcagaaagcgtcgattttcctctagcgattttagtgatctgtcaaacggcgaagagctccaggaaacttgttcgtcctcgttgagacggggtagcggtagtcagcctcaagaaccagaaaataagaagtgtagctgtgtaatgtgctttcctaaaggagtcccgcggtctcaggaggcgcgcacggaatcctctcaggcttcagacatgatggataccatggacgtggagaacaactcgacgttggaaaaacactcaggtaaacgtcggaagaagagaaggcacaggtcaaaagtgaacggacttcagagggggcgcaaaaaggatcgccccagaaagcaccttacgttgaataataaagtgcagaaaaaaaggtggcagcagagaggccgaaaggctaacacacggcctctcaaaaggaggcggaaacgcggccccaggatcccaaaggatgagaatattaattttaaacagtcagagctgcccgtcacctgcggagaagtgaaggggacgctctacaaagagcgcttcaaacagggcaccagtaaaaaatgcatccagtcagaggacaagaagtggtttaccccacgtgagttcgaaatcgagggagatcggggtgcgagcaagaactggaaactgagcatcagatgcggtgggtacactctgaaggtgctcatggaaaataagtttctccccgagccaccaagcactcgcaaaaagcgaatactcgagagccacaataacaccctggtagatccttgcgaggagcacaagaagaagaatccggacgcatccgtgaagttttctgaatttcttaagaaatgttctgagacgtggaagacaattttcgccaaggaaaagggtaagtttgaagacatggcaaaggctgacaaagctcattacgagcgggagatgaaaacctacatcccgcccaagggtgagaagaagaagaaattcaaagatcctaatgcacccaaacgccctcccctggcattttttctattttgttctgagtataggcccaaaatcaaaggggaacatcccggcttgtctattgatgacgtcgtcaaaaaactggctggcatgtggaataacaccgcagccgcggacaagcagttttatgagaaaaaggcggcgaaacttaaggagaagtataaaaaagacatagcagcgtatcgtgcgaaaggcaaaccgaatagtgcaaaaaagcgcgtggtcaaagccgagaagtcaaaaaaaaagaaggaagaagaggaggatgaggaagacgagcaggaggaagagaacgaggaagatgatgataagtag

SEQ ID NO: 135793 - DNA, 2658 bp, Artificial Sequence
  Description of Artificial Sequence: Synthetic coding sequence
atggcaggcggcggtggtgacctcagcaccagaaggctgaacgaatgtattagtcctgtggcaaatgaaatgaatcatctcccagctcattcccatgatttgcagcgcatgtttaccgaggaccagggtgtggatgaccgactactctatgacatcgtcttcaagcacttcaagcggaataaggtcgagatttccaatgccattaagaaaacgttcccatttctcgagggattacgcgaccgtgatctgatcacaaacaaaatgtttgaggacagccaagactcctgccggaatcttgtccccgtccagagagtggtatacaatgtgctcagcgaactagaaaagacattcaatttacccgtactggaagccctgttcagtgacgttaacatgcaggagtacccagacctcattcacatctataaggggtttgaaaatgtgatacacgataagctccctctgcaggaaagtgaggaagaagaacgagaggagcggtccggcctgcagctgtctctggaacagggaaccggcgaaaacagcttcaggtcactcacttggccgcccagcggtagcccaagtcatgccggaactaccccgccagagaatggcctgtccgagcacccttgcgagactgaacaaatcaatgctaaaagaaaggacaccacgagcgataaagatgactcgctaggatcacagcagacgaatgaacagtgtgcacagaaggccgagccaacggagagttgtgagcagatcgcggtgcaggtgaacaacggcgacgctggcagagagatgccatgtcccctgccttgtgacgaggaaagccccgaagccgagctgcataaccacggtattcaaattaattcttgttccgtgcggctggtggatataaaaaaagagaagcccttttcaaattccaaggtcgagtgtcaggctcaagccagaactcaccataatcaagcctctgacatcatcgttatctcctcagaagattctgagggtagcaccgatgtcgacgagccactggaagtgttcatttccgctcctaggtcggagccagtgattaataatgataaccctctcgaatccaacgacgagaaggagggacaggaggcaacatgtagtcgaccacaaatagtaccagagcccatggacttcaggaaattgtccacatttcgggagtcttttaaaaaaagggtcattggacaggatcatgacttctctgagtcaagcgaggaggaagctcctgccgaagcctccagtggcgccctcaggtcaaaacacggtgaaaaagccccaatgacctccaggtcaacaagtacctggagaattccttcaagaaagaggagatttagcagctccgatttcagtgatttgtcaaatggggaggaactgcaggagacttgttcatcctctctgaggcgagggtccggctcccagcctcaggaaccagaaaataagaaatgcagctgcgtgatgtgctttccaaagggggttccgcggtctcaggaggcacgcacggaaagtagccaggcctccgacatgatggataccatggatgtggagaataactcaacattggagaaacacagcggtaaaagaagaaagaagcggagacatcggagcaaggtcaacggcttgcagcgcggtagaaagaaggatagaccccgtaagcatctgactctgaacaacaaagtgcagaaaaagcgttggcagcaacgtggcagaaaagccaataccagacccctcaagaggcgtcgcaaacgagggccacgtattcctaaagatgaaaacatcaactttaaacagtccgagttgcccgtgacgtgtggtgaagttaagggaacactctataaagaacggtttaagcaagggacgtcaaaaaaatgcatccagagtgaggataagaagtggttcactcccagggagtttgagattgaaggcgatcgcggagcatccaaaaattggaaacttagtatcagatgtggtggatatactctcaaggtgctgatggagaacaagttcctgcccgagccccccagcacgaggaagaagagaattctcgagtcacataataacacacttgtagacccctgtcctgagaactcaaacatatgtgaagtgtgtaacaaatgggggcggctgttttgctgtgacacctgtcctaggtccttccacgagcattgtcacattccatctgtcgaggcgaacaagaatccctggagctgcatcttttgccgtataaagaccatccaggaaaggtgtcccgagtcccagtccggtcatcaggaatcagaagtgctgatgcgtcagatgctcccggaagagcaactaaaatgtgagttcttgctccttaaagtgtattgtgacagtaaaagctgttttttcgccagcgagccctattataaccgagaaggtagccagggtccacaaaaacccatgtggctcaataaggttaagactagcttaaatgaacagatgtatactagagtggaggggttcgttcaggacatgcgactgattttccataaccacaaagagttctatagagaagataaatttacgcgcctgggtatccaggtgcaggacatctttgaaaagaacttccggaatattttcgctattcaagaaaccagtaaaaacatcattatgtttatctag

SEQ ID NO: 135794 - DNA, 1422 bp, Artificial Sequence
  Description of Artificial Sequence: Synthetic coding sequence
atggccggaggaggcggtgatctcagcaccaggcggcttaacgagtgtatttcacctgtcgcgaacgagatgaatcacctgccagcccacagccacgacttacaacggatgtttacagaagaccagggagttgatgaccgtctcctgtacgacatcgtctttaagcacttcaagcgcaataaggttgagatttcaaacgccattaagaagacctttccttttctggaagggctacgagatagggatctgattactaacaaaatgttcgaagacagccaagattcatgtcggaacttggttcccgtgcagagagtcgtctataatgtgcttagtgagctggagaaaactttcaatctgcccgtgttggaggccttgttctctgatgtaaacatgcaagaatacccagacctgatccacatctacaagggcttcgagaatgtgatccacgataaactacccctgcaggagagtgaggaggaggagcgggaggagaggtcagggttgcaactctctctcgaacagggtaccggggaaaattcattccggtctctgacatggccaccttctggttcacccagtcatgcgggcacaacgccccccgaaaatggactgtccgagcacccatgtgagaccgaacagataaatgccaagcgcaaagacaccacctcagataaggacgatagcttgggatcccaacaaacgaacgagcagtgcgcacagaaagcagaaccgaccgaaagttgcgaacaaatcgcagtacaagtaaacaatggagacgcaggccgggagatgccatgtcccctgccttgcgatgaggagtccccggaagcagagttgcacaatcacggaatccaaatcaactcttgctccgtccggctggttgatatcaaaaaagaaaaacctttctctaatagcaaagtggagtgtcaagcccaggctagaacccatcacaatcaggctagtgacataatagtcatcagctcagaggactctgaggggtcgacagacgtggacgagccacttgaagtcttcatctccgctcctcggtccgagccggtaatcaacaacgacaaccccttggaaagtaatgacgagaaagagggccaggaggcaacatgtagccgtccccaaattgtacctgagcccatggacttcagaaaactcagcacttttagggaaagctttaaaaaacgggtgatcggacaagatcacgattttagtgagagcagtgaggaggaggccccagctgaggcatcttcaggagctctgcgttccaaacatggtgagaaagcccctatgacaagtcggagtacatccacttggaggatcccatctcgaaaacgccagttgaaaaagaagaaaaagaagaaacagtgccatccccaaccacagcctcaacgaggactactggagcagtcgtag

SEQ ID NO: 135795 - DNA, 2067 bp, Artificial Sequence
  Description of Artificial Sequence: Synthetic coding sequence
atggctggaggaggcggggacctgagcacgcgtaggctgaatgagtgcattagcccagtggcaaacgagatgaatcacttgcccgctcattcccacgatctgcagagaatgtttacagaggaccagggtgtagacgataggctcctgtatgacattgtgtttaagcacttcaaacgaaacaaggtcgagatatccaatgccatcaagaaaacattcccttttctggaggggttgcgggatagggacctcataaccaataagatgttcgaagatagtcaagacagctgtcgcaatttggtccccgtccagagggtcgtatataacgtgttaagcgagcttgagaaaaccttcaacctgcccgtgctagaggccctcttctctgatgttaatatgcaggaataccccgacctgattcacatctataaggggttcgagaacgttatccatgataagctcccattgcaagagagtgaagaggaggagagggaggagaggagcggtcttcagctgagtctggagcagggtactggagaaaactcctttcgaagtctgacctggcccccctctgggtcgccaagtcacgccggcaccacaccaccggaaaacggtctctctgaacacccatgcgagactgagcagatcaatgcaaagcgtaaggatacaacctccgataaggacgacagcctcgggtcccagcagactaacgaacagtgtgcccagaaggcagagccaaccgaatcctgcgaacagatcgccgttcaagttaataatggagatgctggacgggaaatgccgtgcccactcccatgcgatgaagagtctccagaggccgagctgcataaccatggcattcaaattaacagctgctcagtgaggctcgttgatataaaaaaagagaagccattcagcaacagcaaggttgagtgtcaggcccaggctcggacacaccacaaccaggcaagcgatataattgtaatctcatccgaagactccgaaggatccactgatgtagacgaacccctcgaagtctttatcagtgctccaaggtccgaaccggtcattaacaacgacaatcccctcgagtcaaacgacgagaaagaggggcaagaggccacctgctctaggccccaaatcgtacccgagcctatggatttcagaaagctttccacttttcgcgaatcatttaagaagcgggtcatcgggcaagatcacgactttagcgaaagctccgaggaagaagccccagccgaagcaagctccggagctctgaggagtaagcacggagagaaggccccgatgacatctagatcaactagtacttggcgcataccctccaggaaacggaggtttagttcaagcgatttctccgacttgtcaaatggtgaggagttgcaggagacctgtagttccagcctccgaagagggtccggcagccaacctcaggagccagagaacaagaagtgctcctgtgttatgtgtttcccaaagggagtgcctagatctcaggaggccagaaccgagtcaagtcaggctagcgatatgatggacacaatggacgtcgaaaacaattcaaccctagagaagcatagtggcaagagacggaagaagcgccgtcaccgatctaaggtgaatggcctgcagcgaggaagaaaaaaagatcgcccacgtaaacacctgacgttgaataataaggttcagaagaagaggtggcagcagcgcggcagaaaagcaaataccagacctctgaagcgccgccgtaagcgcggacccagaatccccaaggatgaaaatattaacttcaagcagtccgaattacccgtcacctgtggcgaagtcaaaggcacactgtataaagagcgattcaagcagggaacctccaagaaatgtatccaaagtgaggacaagaaatggttcactcccagagaatttgagatcgagggcgaccggggggcctctaaaaactggaagttgtcaattagatgcggggggtacactcttaaggtcctgatggaaaataagttcctccccgaaccacccagcacaagaaagaaagtgatgataaagtag

SEQ ID NO: 135796 - DNA, 1443 bp, Artificial Sequence
  Description of Artificial Sequence: Synthetic coding sequence
atggcaggggggggtggcgatctgtctacgagacgcctgaacgagtgtatcagccccgtcgccaacgaaatgaatcatctccctgcccattcacacgacctgcagcggatgttcacagaagaccagggggtggacgacagactgttgtacgatattgttttcaagcacttcaaaaggaacaaggttgaaatctcaaatgccatcaaaaaaaccttcccttttctggaggggctgagagaccgtgatcttattactaataagatgttcgaggacagccaggacagctgccggaacctggttccagtgcagcgggtggtgtacaatgtgctgtctgaactggaaaaaactttcaatctcccggtccttgaggccctgttctctgacgtgaacatgcaggaatatcccgatctgatccacatctacaaagggttcgaaaacgtgattcatgacaagctgcccctgcaggagtcagaagaggaagagagggaggagcgcagcggcctgcaactatctctggagcaggggaccggagagaattcttttaggtctctgacatggcctccctccggaagtccgagccacgctggcactacccctcctgaaaatggtctgtccgagcacccttgtgaaactgagcagattaatgccaaacgaaaggacaccacaagcgataaggatgatagccttggtagccaacagaccaatgagcagtgcgctcagaaggccgagccaactgagagttgtgagcaaattgccgtacaggttaataatggggacgctggacgcgaaatgccatgcccactgccctgtgacgaggagagtcctgaagctgagctgcacaaccacggtatccagatcaactcctgctctgtccgcctcgtcgacataaagaaggagaaaccattctctaatagtaaagtcgagtgtcaggcccaggccagaactcaccataatcaggcctccgatataatcgtgatcagcagcgaggattccgagggaagcaccgacgtggacgagccacttgaagtgtttatcagcgcgcctagaagcgaacccgtgataaacaatgataacccactggaatctaatgacgagaaggaggggcaagaagccacttgttcaagacctcaaattgttcccgagcccatggattttcggaaactatccactttccgggagtcattcaagaagagggttataggccaggaccatgacttctctgaaagttctgaagaagaggcaccagccgaggcatcctccggggcgctgaggtccaaacacggggagaaggcacccatgacctctcgcagcactagcacctggcgaattccatctcggaaacgtcggttcagcagtagcgacttctccgatctgtccaatggagaggaactgcaggaaacttgtagcagttctctgcgaagagggagtgggaaggaagattag

SEQ ID NO: 135797 - DNA, 1068 bp, Artificial Sequence
  Description of Artificial Sequence: Synthetic coding sequence
atggacgtggaaaacaactccacactggaaaaacactccggcaaaaggaggaaaaagagacgccaccggtctaaggtcaacggcctgcagagagggcgtaagaaagatcggccccggaaacacctaacgctcaacaataaagtgcagaagaaacggtggcagcagagaggaaggaaggctaacacccggccactgaagaggagacgaaagcgcggaccaagaatccccaaagacgaaaacattaactttaagcagtccgagctgccagttacatgcggcgaagtcaagggaacactgtataaagagcggtttaagcaggggacatctaaaaaatgcatccagtccgaggataaaaaatggtttactccccgcgaatttgagatagagggcgatagaggcgcatccaaaaactggaaactttcaattcgatgcggcggctatactctcaaagtgttgatggagcgaattctggaaagtcataataacacactggtggacccttgcccagagaactccaatatatgcgaggtgtgtaacaagtgggggcgtctgttctgttgtgacacttgtccgaggagtttccacgaacattgtcatattccttctgtggaggccaacaaaaacccctggagctgcattttctgtcggatcaaaaccatccaagagaggtgtccagagtctcagagtggacaccaggagtccgaggtgctgatgcggcaaatgcttcccgaggaacaactgaaatgtgaatttttactattaaaggtgtattgcgactccaaatcatgttttttcgcaagcgaaccatactataacagagaggggagtcagggccctcagaagccaatgtggctgaacaaagtcaaaacctcacttaatgagcaaatgtatacgagagtggagggcttcgtgcaggacatgagactcatcttccacaaccacaaggagttttacagagaggataagtttacccgccttgggatacaggttcaggacattttcgagaagaattttcggaatatcttcgcaattcaggaaacatctaagaacattattatgttcatctag

SEQ ID NO: 135798 - DNA, 1359 bp, Artificial Sequence
  Description of Artificial Sequence: Synthetic coding sequence
atggctggtggcgggggtgacctttctaccagaatgtttaccgaagaccaaggcgtggacgacagattgctttacgacatcgtctttaagcacttcaaacgcaataaagtggagatttccaacgccataaaaaaaacgtttccgttcctggaaggtctcagggatcgggacctcataaccaataagatgtttgaagacagtcaagatagttgtaggaatctcgtgcctgttcagcgggtggtgtataacgtcctctctgaacttgagaagacctttaacttgcctgtactggaggccctcttctccgatgtaaacatgcaggagtatcccgacctgatccatatttacaaagggttcgagaacgtcatccacgacaagttgcccctgcaggagtccgaggaggaggagcgcgaggagaggtcaggccttcaactatccttggagcaaggcactggtgaaaacagttttcggagtctcacttggcccccttctggatcacctagccatgcaggaaccactccaccagagaatgggctctctgaacatccgtgtgagactgagcaaatcaacgccaagcggaaggatacgacaagcgataaggacgatagcctgggctcccagcagacaaacgagcagtgtgcgcaaaaagccgagcccacggaaagctgtgagcaaatcgcagtgcaggtgaataatggtgatgctggacgcgagatgccctgtcccttgccctgcgacgaagaaagcccagaagccgaactccataatcacggcatacagatcaattcctgttccgtccgccttgtggacattaaaaaagaaaagccattctcaaattcgaaagttgagtgccaggctcaggcccgtacacatcacaatcaagcctctgatatcatcgttatctcatcagaggatagcgagggctcaaccgatgtagatgagccattggaggtcttcatctctgcccccagaagcgagccggttatcaacaatgacaacccacttgaatcaaatgacgagaaagagggacaggaagctacgtgctcccgcccccaaatcgtaccagagccaatggactttagaaaactcagcacattccgcgaaagctttaagaagcgagtcattggccaggaccacgacttctcagaatcgtccgaagaggaggctccggctgaagccagttcaggggccttgcgtagtaagcacgcacccatgactagtaggtccacatctacgtggcggataccctcccgtaaaagacgcttcagctcatcagacttttccgacctgagcaatggggaagaactgcaagagacatgttcttcgagcctgcgcagggggtcaggaaaggaagactag

SEQ ID NO: 135799 - DNA, 1338 bp, Artificial Sequence
  Description of Artificial Sequence: Synthetic coding sequence
atgatgttcactgaagatcagggtgtggacgatcgtttactgtacgatattgtattcaagcatttcaagaggaacaaggttgaaatttccaacgctattaagaagacattcccttttttggaaggactgagagatcgagatctgatcactaacaagatgtttgaagattcccaagattcttgcagaaacctggtcccggtccaaagagttgtgtacaacgtactctcggagttggaaaagacctttaatcttccggtcctggaagcacttttctcagacgttaacatgcaggagtaccccgacctcatccatatctataaaggatttgagaacgtaattcatgataagctccccctccaggagagcgaagaggaagaaagagaagagcgcagtgggctgcaactgtccctggagcagggaaccggcgagaactctttccgttcacttacttggccaccctcaggcagcccttcccatgccggcacaacaccccctgaaaacggcctgtccgagcatccctgtgaaactgaacagattaacgctaagcgcaaagacacgacttcggataaggatgactcattaggatctcagcaaacgaatgagcagtgcgcacaaaaggccgagcccacggaaagctgtgagcaaattgccgttcaggtgaacaacggagacgcaggacgggaaatgccttgccctctgccatgcgacgaagaatccccggaggcagagctacacaatcatgggattcagatcaattcctgctcagttaggctggtcgacatcaagaaggagaagcccttcagtaactctaaagtagagtgccaggcccaggccaggactcaccacaatcaagcctcggacatcatcgtgatctcatccgaggatagtgaaggctccactgatgtcgatgaacctctcgaggtattcattagtgcacctaggtctgaaccagtgattaataacgataaccctcttgaatctaatgatgagaaggaggggcaggaggccacctgctctaggccacagattgtgcctgaacccatggatttcaggaagctcagcacattccgtgagtctttcaagaagcgggtgatcggtcaggaccacgacttctcagagagctccgaggaggaagcccccgccgaagcatcttcaggagccctaagaagcaaacacggcgagaaggccccaatgacctcgcgttctacatcgacatggcgaattcctagtcgaaagcgccgcttcagcagttctgatttctctgacctgagcaatggggaggaactccaagagacttgctccagctctttaaggagagggtctgggaaagaggattag

SEQ ID NO: 135800 - DNA, 2142 bp, Artificial Sequence
  Description of Artificial Sequence: Synthetic coding sequence
atgttcaccatgacacgggccatggaagaggctttgttccaacatttcatgcatcaaaagctggggatcgcctatgccatacataaacctttcccattctttgaagggctgctggataactccatcattacaaagcgaatgtatatggaaagtctggaagcttgccgcaacctgatccctgtgtctagagttgttcacaatatccttactcaactggagcgaacattcaacctcagtttgctcgtcaccctattctcccagatcaatctacgagaatatcccaaccttgtcacgatttatagatcctttaagcgagtgggagcttcctacgaatggcaatccagagacacccctatcctactggaagcgccaaccggcctagctgagggttcctctctccatactcccctcgccctaccgcccccacagcctcctcagcccagctgctcaccatgcgctccccgcgttagcgagcctggcaccagtagccagcagtcagacgaaattctctcggaatccccatcgcccagcgaccctgttttaccacttcctgcgttgattcaggagggaagatcaacaagcgtgaccaacgacaagctcacttctaagatgaacgctgaagaagattctgaggagatgccctcacttctgacctccaccgttcaggtggcctctgacaatttgatcccccaaattagggacaaggaggatccccaggagatgcctcactcccctttaggctccatgccagagattcgcgacaatagcccagagcccaatgacccggaagaaccgcaggaggtgagcagtactcctagcgataaaaaagggaaaaagaggaaacgttgcatatggtccacaccaaagaggcggcacaaaaagaaatccctgccaggcggaactgcatcctctcggcacggaatccagaagaaactgaagcgggtggatcaggtgccacaaaaaaaagatgattcgacatgtaacagtactgtggagacacgggcacaaaaggcgaggaccgaatgcgctaggaaaagtcgcagcgaggagattatcgatggaacctccgagatgaacgaaggaaagcgttcccagaaaacacccagcacacccaggagagttacgcaaggcgcagcatcccccgggcacggaatacaagaaaagctgcaggtagttgataaggttactcagcggaaagatgacagcacatggaattctgaggtcatgatgcgggtgcaaaaggcgcggaccaagtgtgccagaaagtctcgcctgaaggagaaaaagaaggaaaaggatatttgttcttcttctaaacgtcggttccagaaaaacattcacaggaggggcaagcctaaaagtgacactgtcgacttccactgctccaagcttccagtcacttgtggcgaagcaaagggcattctctataagaagaaaatgaaacatggcagctccgtgaagtgcattcgtaacgaagatggaacttggctgacaccaaacgaatttgaggtcgaggggaagggacgaaatgcgaagaattggaagcgcaacatcaggtgcgaaggcatgaccctgggagaactactgaagcgaaagaactccgacgagtgcgaagtgtgctgtcaaggcggacagctcttgtgttgcggcacttgtccacgggtgtttcacgaagattgtcacatcccgcctgtggaagccaagaggatgctgtggagctgcacattctgcagaatgaaacgttctagtggctctcaacaatgccatcatgtgagtaaaacactcgaaaggcagatgcagccgcaagaccaactgaaatgcgaatttttgctactgaaggcatactgccatccgcagagctctttcttcactggaataccgttcaatatacgggattatggcgagcccttccaggaggctatgtggctcgatctggtcaaggagcgcctaatcacagagatgtatacggtagcgtggtttgttcgggatatgcgcctcatgtttcgtaaccacaagaccttctacaaggcctccgacttcggacaggtggggctcgacctggaagcagagttcgagaaagacctgaaggatgtcctcggtttccatgaggctaatgatggggggttctggacactcccctag

SEQ ID NO: 135801 - DNA, 1650 bp, Artificial Sequence
  Description of Artificial Sequence: Synthetic coding sequence
atgttcaccatgactcgcgccatggaagaagcgctgtttcagcattttatgcaccagaaactggggatcgcatacgccatccataagcctttcccattcttcgaagggcttctggataactctattattactaagagaatgtatatggaaagcttagaagcctgccgaaacttaatccccgtctcccgagtcgtccacaatatcctgacccaactcgagcgcacctttaacctttcactattggtgacacttttctcacagataaacctaagggaataccctaatctggtcacgatctacagatcatttaagagggtcggggcgtcttatgaatggcagtcaagggatacacccattctgctggaagcccctaccggcctagcagaggggtccagtctgcacacccctctcgccctgcctccccctcaacctcctcagccttcttgtagcccttgcgcccccagggtcagcgagccaggtacgtcctcacaacagtccgacgagattctgtcagagtctcccagtccatctgatccagtattacctctgcccgccctgatccaggagggcaggagcacttcagtgactaatgataagttgacttccaagatgaacgccgaggaagactctgaagagatgccttccctgttaacaagcactgtccaggtagccagtgataatttaatccctcagatcagagacaaggaggatcctcaagagatgccacactctccactagggagtatgccggagatcagagataactctccggaacctaatgatccggaagagccccaagaggtgagctcaacgcctagtgacaagaaaggcaaaaagcggaagcgttgcatttggagcaccccaaagcggcgacataagaagaaaagcctgcccggcggtaccgcctcttcccggcatggtattcagaaaaagctgaagcgcgtggaccaagtgcctcagaagaaagatgattcaacatgcaattcaacagttgagaccagggcccaaaaagccagaactgaatgtgcaaggaagtctagatccgaggagatcattgatgggactagcgagatgaacgaggggaagcggtcccagaagactccctcgacccctaggcgggttactcagggggctgcctctccaggacatggaatccaggagaagctgcaggtggtcgataaggtcactcagcgtaaggacgactcgacttggaattccgaagtaatgatgcgcgtccagaaggccagaacaaagtgtgcccggaaatctcgccttaaggagaagaaaaaggaaaaggatatatgctcttcctctaagaggcgatttcagaagaacattcatcggagagggaagcccaaatccgacacagtggacttccattgctctaaacttcctgtgacctgcggggaggccaagggtattttgtacaaaaagaaaatgaagcacgggtcatcggtgaaatgtattcggaatgaggatggcacctggcttacgcccaatgaattcgaagtcgagggcaaggggcgaaatgccaagaattggaaaagaaatatacgctgtgagggaatgacgctgggtgagctgttaaagtctggcctgctgctgtgcccccctagaataaacttgaaacgcgagctcaactctaagtag

SEQ ID NO: 135802 - DNA, 756 bp, Artificial Sequence
  Description of Artificial Sequence: Synthetic coding sequence
atgcccgagataagggacaactctcccgagccgaacgatcccgaagaaccacaggaggtctcctcaacgccctcggacaagaaaggcaagaagcgaaaaagatgcatttggtctacccctaaacggcgccataagaaaaagtccctacctggagaaataatcgacggaactagcgagatgaatgagggaaagcggtcacagaaaacccccagtactccacgcagggtgacgcagggtgcagcatctcctggtcacggaatccaggaaaagttgcaggtcgtggacaaggttactcagagaaaggacgactctacctggaactccgaggtaatgatgcgcgtgcagaaagccagaaccaaatgtgccaggaagtcaagactcaaggaaaaaaaaaaagagaaggatatttgctcatcttctaagcggcggttccaaaagaacatccaccggcgcggtaaacctaagtccgatactgttgacttccattgctccaagctgcccgttacgtgtggtgaggctaagggcatcctctacaaaaagaagatgaagcatgggagctcagtgaaatgcattagaaatgaagacggcacctggctgaccccgaacgagtttgaagtggaaggtaagggacggaacgcaaagaactggaagcgcaatattaggtgtgaagggatgacattgggagagttgctcaagagcggcctgctgctatgtcccccccggatcaaccttaaacgggaactgaattcgaagtag

SEQ ID NO: 135803 - DNA, 2070 bp, Artificial Sequence
  Description of Artificial Sequence: Synthetic coding sequence
atgtttaccatgacccgcgccatggaggaggccctttttcaacattttatgcaccagaaactaggcatcgcttacgcgatccacaaaccctttccgtttttcgaggggctgttagataatagtatcatcacaaagcggatgtacatggagagcctggaagcctgccgtaatctgatccctgttagccgcgtcgttcacaacatcctaacccagctggaacggaccttcaacctgtcactgctagttaccttgttctcgcaaattaacttgcgggaatatccaaatctagtgacaatttatagatcttttaaacgagtcggtgcttcctatgagtggcagagcagggacactcccatactgttggaagctccgactgggttggccgaaggcagttcccttcatacaccattggccctcccccctccacagccacctcagccgtcctgcagtccatgcgcacctcgggtgtccgaacctgggacgagtagccaacagtctgatgagatactgtcggaaagcccatcgccttccgatcctgtgcttcccctgcctgccctgatacaagaaggtcggtccaccagtgtgaccaatgataagctgacatccaagatgaacgcagaggaggacagcgaggaaatgccttccttactcacttccaccgtccaggtcgcttcagataacctgatcccccagatcagggacaaagaggatccacaggagatgccccattctcccctaggttcaatgccggagattcgggacaacagtccggagccaaatgatcccgaagagcctcaggaggtttctagcacaccctcggataagaaaggcaaaaagcgaaaacggtgcatctggagtacaccgaaacggcgccataagaagaaatcattgcccggggggacagctagtagtcgtcacggcatccagaagaagctaaaaagggtcgatcaggtgcctcaaaagaaagacgattccacttgcaactcgactgtggagacgagagcccagaaagccaggacagaatgtgcgaggaagagccggtccgaggagatcatcgacggaacctcagagatgaatgagggcaagcgatcccaaaagactccctcaacgcctaggcgggttacccagggggcggcaagtcccggacatggcatacaggagaagctccaagtggtggacaaagtgacccaaaggaaagacgatagcacatggaacagcgaagtgatgatgcgcgtccaaaaggcaagaaccaagtgtgcacgcaagagccgactgaaggagaaaaagaaggaaaaggacatctgctcttctagtaagagacggttccaaaagaatatccaccgtcggggcaagccgaaatccgatacagtggactttcattgtagcaaactgcccgtaacgtgcggagaggctaaggggatcttatacaagaaaaagatgaagcacggctcgagtgtgaaatgcatccgcaacgaggacgggacttggctgaccccaaatgaattcgaggttgaaggcaaaggtcggaatgcaaagaattggaaacgcaacatcagatgcgaagggatgacccttggggagcttctgaaacgtaaaaatagcgatgaatgtgaggtttgctgccagggagggcagctactttgttgcggcacgtgtccacgcgtttttcacgaggactgtcacatcccacccgtagaagctaaacgaatgctatggtcgtgcactttctgcaggatgaagaggtctagcggctctcaacaatgtcatcatgtgtcgaagacacttgagaggcagatgcaaccacaggaccaactgatacgggattatggggagccatttcaagaggctatgtggcttgacctcgtaaaggagagattgatcactgaaatgtatactgtagcgtggttcgttcgcgatatgcgacttatgttccggaatcataaaacattctacaaagccagcgattttggacaggtgggcctcgacctggaggcggaattcgagaaggacttgaaagacgtcctgggattccacgaagccaacgatgggggtttttggaccttgccatag

SEQ ID NO: 135804 - DNA, 1644 bp, Artificial Sequence
  Description of Artificial Sequence: Synthetic coding sequence
atgtttactatgacacgtgcaatggaagaggccctgtttcagcacttcatgcatcagaaactgggcatcgcatatgccatccacaagccttttccttttttcgaaggtttactggacaactctatcatcaccaagagaatgtacatggaatccctggaggcttgcagaaacctcatacccgtgtcccgggtcgtacacaacattctgacgcagctcgagcggacctttaatctttcgctgctagtgaccctcttcagccaaatcaatttgcgcgaatacccaaatcttgtgactatttatcggtctttcaagagagtcggagccagctatgaatggcagagtagagacactccaattctgctggaagcgccgactggcctggctgaagggtcttccctgcacacccctcttgcactgccccctccccagccacctcagcccagttgtagcccatgtgctcccagagtgtcagagcctggcactagcagccagcaaagcgatgagatactatcggagtcaccatccccatcagaccctgtgctgcccttgccagctctcatccaggagggcagatctacctccgtcacgaacgataaactgacatctaagatgaatgctgaggaagatagtgaggagatgccaagcctcctgacatcgacggtacaggttgccagcgataatctcatcccacaaatccgggataaagaggatccccaagagatgccacattccccactgggttccatgcccgagatccgagacaattcccccgaacccaatgatcccgaagaaccacaggaagtgagcagcacacccagcgataaaaagggcaaaaagaggaaacgttgtatttggtccaccccgaaacgacgccataaaaagaaatccctaccgggggctagctccaggcatgggatacagaaaaaattaaagagagttgaccaagtgccccagaagaaggatgactctacatgcaactcaacagttgagaccagggcacagaaggccagaaccgagtgcgccagaaagtctaggagtgaggaaatcatagacggcaccagtgaaatgaatgaaggcaagcgtagccaaaaaactccaagtacaccacgcagggttacccagggagctgcctcaccaggccacgggattcaggaaaaactgcaggttgtggacaaggtcacacagcggaaagacgatagcacttggaatagtgaggtgatgatgcgggtgcaaaaggcgcgtaccaaatgtgcccggaagtctagactgaaagaaaagaagaaggaaaaggatatatgtagttccagcaaaagaagattccagaagaacatacatagaagggggaagccgaagagcgataccgtggacttccactgtagcaagctgcctgtgacctgcggagaggccaagggcatcctgtataaaaaaaaaatgaagcatggtagctctgtgaagtgtatccggaacgaagatggcacatggctgactcctaacgaatttgaggtggagggaaaaggcagaaacgccaagaattggaaacggaacattagatgcgaaggcatgactctgggagaattactcaagtccggattgctgctgtgtcccccccgcattaacctgaagagagagctgaactcaaagtag

SEQ ID NO: 135805 - DNA, 666 bp, Artificial Sequence
  Description of Artificial Sequence: Synthetic coding sequence
atgttcacaatgacacgcgctatggaagaggccctgttccagcatttcatgcaccaaaagctggggattgcttacgcgattcacaagccatttccattctttgaaggtttgctcgacaacagcataattacgaagcggatgtatatggagtccttggaagcctgtaggaatttgatccctgtgtccagggtggtccacaatattctgacgcagctggagagaacatttaacctctctctgctcgttactctgtttagccagatcaacctgagggagtatcccaacctggtcacgatttatcgttctttcaagcgggtgggggcatcgtatgagtggcagagccgggatacccccatcctgctggaggcacctactggactagcggaaggcagctccctccacactccgcttgcgctgcccccccctcaacctccccagccgtcttgctctccttgcgctcctagggtttcagagccaggtacgtcttctcagcaaagcgatgaaatcttgtcagagtcaccttctccctctgacccagtccttcccctcccagccctgatacaagagggacggtctacttccgtcaccaacgacaaacttacgagtaaaatgaatgcggaggaggacagcgaagagatgccttccctgctcactagcactgtttag

SEQ ID NO: 135806 - DNA, 306 bp, Artificial Sequence
  Description of Artificial Sequence: Synthetic coding sequence
atgtttacaatgactcgtgcgatggaggaagctctctttcaacatttcatgcatcagaagttaggtatcgcctacgctatccataagcccttcccattctttgagggacttctcgataacagtatcatcaccaaaaggatgtacatggagagccttgaagcttgtcggaacctgataccggtgtctcgggtggttcataacattctgactcagcttgaacggacctttaaccttagtctactggtgaccctgttctcccagataaatttacgagaataccctaatttggtaactatttataggtag

SEQ ID NO: 135807 - DNA, 1668 bp, Artificial Sequence
  Description of Artificial Sequence: Synthetic coding sequence
atgggccgcggcttcagaatgttcacaatgacccgggcgatggaggaggctttatttcaacacttcatgcatcagaagctcggcatcgcttacgcaatacataagccatttcccttcttcgagggactgctggataatagcataattactaaacgtatgtacatggagtcgctggaagcctgtagaaaccttatccctgtgtcaagagtcgtacacaatatactcacccagttggaaaggactttcaacctctccctgctggtgacactgttcagtcaaatcaatctcagggagtatcccaacttagttactatctatcgctctttcaaacgtgtgggcgcctcttacgagtggcaaagcagagacacaccgatcctgctggaagctcctaccggcctcgcggaaggtagctcattgcataccccactggctctccctccaccccagccaccccagccttcctgttccccctgcgcaccccgggtatcagagcccgggacttcaagccagcagtccgatgagatcttgagtgagtcaccaagcccatctgatcccgtcctgccattgcctgctctcatacaggagggtcggtccacttccgtgactaacgacaagctgacctctaagatgaatgcagaggaagatagcgaagaaatgccttcattgttgacctccaccgtgcaggtggcctctgacaacttgatcccacagatacgggataaggaagacccccaggagatgccgcacagcccccttgggtccatgcctgagatcagggataatagtcctgagccgaatgatcctgaggaaccacaggaagtgtccagcacaccttctgacaaaaagggaaagaagagaaaaaggtgcatatggtccactccaaaaagaagacacaagaagaaatctctgcccggaggtacagcgtcctcgagacacgggatccagaagaaattgaaacgagttgatcaggttcctcagaaaaaggacgactctacctgtaactcaacagtggaaacccgagcccagaaggcacggacagaatgcgcaaggaagtccaggtcggaagaaatcattgacggaaccagtgagatgaatgaaggcaaaaggtcccagaagaccccgagcacacctaggagagtaacgcagggggccgcctctccaggacacggtattcaggagaagcttcaggtggtcgataaagtgactcagagaaaagacgacagtacatggaatagcgaggttatgatgcgcgttcagaaggccaggaccaagtgcgcgaggaagtctcgccttaaagaaaagaagaaggaaaaagacatctgtagtagcagcaagaggcggtttcagaagaatattcatcgtcgaggaaagcccaagtccgataccgtggacttccactgctcgaagcttcccgtgacatgcggtgaagcaaaggggatcctgtataagaagaaaatgaaacatggaagcagcgtcaaatgcattagaaacgaggacggtacttggctgactccgaatgagttcgaggtggaaggtaaaggcaggaatgctaagaattggaaacgcaacatcagatgtgaggggatgacccttggagagcttctgaagagtggtctgttgctttgtccgccacgaattaacctcaagcgtgaattgaactccaaatag

SEQ ID NO: 135808 - DNA, 2346 bp, Artificial Sequence
  Description of Artificial Sequence: Synthetic coding sequence
atgaccgcccctgagaaacccgtcaagcaagaggagatggcagccctggacgtggattctgggggaggcggtggtggcgggggaggccacggcgagtatctgcagcaacaacagcagcacggaaatggcgcagtcgccgcagcagcggcagcccaggacacccagccctccccactggccctcctggcagcaacatgttctaagatcgggcctccttccccaggggatgatgaggaggaagcagcagctgccgccggagctccagctgccgctggcgctacaggagacttggcaagcgctcagttaggcggggcacccaaccggtgggaggtgctgtctgctacaccaactacaatcaaagacgaagccgggaacttagtccagatcccttcagccgcgacttcatctggacagtacgtacttccgctgcagaatctgcagaatcaacagatcttctcagtagctcccggttccgacagcagtaacgggaccgtgagttcagttcaatatcaggtcataccccagatccaatcagcggatggccaacaagttcagattgggtttacaggtagttcagataacggcggcattaaccaagaaagctcacagatccagatcatcccgggaagtaatcagacgctcctggccagcgggactccctctgcgaacatccagaatctaattccccaaacaggccaggtccaggtacagggagtggctatcggaggctcgagcttcccgggtcaaactcaggtcgtggctaatgttccgctaggccttccaggcaatattacgtttgttccaataaattctgttgacctcgacagtctggggcttagcggctccagccagacaatgacagccggcattaacgccgatggtcatctaattaacactggacaagcaatggattcaagcgataacagcgagagaactggggaaagggttagccctgacatcaatgagactaacaccgatacggatttgtttgtgcctacatcttctagctcccagctgccagtcaccatcgacagtactgggatcctccagcagaatactaactcactgacaaccagtagtggtcaggtgcattccagcgatctacaagggaattatattcagagccctgtatctgaagaaacacaagctcagaatatccaggtgtccacggctcagccagtggttcagcacctccaactgcaagaatcgcagcagccgacctcccaggctcaaatagtgcagggtatcacccctcagaccatccacggcgttcaggcctccgggcaaaatatctcccagcaggccttgcagaatctgcagttacaactcaaccccgggaccttcctgatccaggcacagactgttacaccatccggtcaagtcacctggcagacatttcaggtgcagggggtccagaacctgcaaaacttgcaaatccaaaacacggctgcacagcaaatcaccctgactccagtgcaaactttgaccctcggccaggtcgccgccggcggagcttttacatctacacctgtttccctgtccactggccagctccctaacctacagaccgtgactgtaaattccatcgattccgctggcatccagctgcacccaggcgaaaacgctgatagtcccgccgatatccggatcaaggaagaagagccagatcccgaagaatggcagctgagtggggattcgacactcaacaccaacgatctgacccatctgcgcgtccaggttgtcgatgaggagggtgaccaacagcatcaggaagggaagaggctcagaagagtggcctgcacctgccccaattgcaaagagggcggagggaggggcactaatttaggtaaaaagaagcagcatatctgtcacattcccggctgcgggaaagtgtatggcaaaacctcccatctcagagcacacttgagatggcacagtggcgagcgccccttcgtctgcaactggatgtactgtggcaagcgcttcaccaggagcgatgagctccagcgacaccgcagaacccatacgggggagaaaaaattcgtgtgtcctgaatgtagtaagcggttcatgcgctccgaccacctcgccaagcacatcaagacacatcagaataaaaaaggcatccactcttccagtactgtgctcgcctctgtcgaagccgctagagacgacacccttattactgcggggggcacaactcttatcttagccaacattcagcaggggagtgttagtgggatcggtaccgtcaacacctctgctacctccaaccaggatatactgaccaataccgagatccctcttcagcttgttaccgtgtcaggcaacgaaaccatggagtag

SEQ ID NO: 135809 - DNA, 2217 bp, Artificial Sequence
  Description of Artificial Sequence: Synthetic coding sequence
tgacctgagaagccagttaaacaagaagagatggcagcattagacgtggattcaggaggtgggggtggtggaggcgggggccatggggaatatctccaacagcagcaacagcatggcaatggcgctgttgcagccgcggccgccgcccagacaggcgacctagcctccgcgcagttagggggggccccgaataggtgggaggtgctcagtgctacgccaacgaccatcaaagacgaagctggtaacctagttcaaatcccatctgccgccaccagctccggacaatacgtgctgcctctccagaatctgcaaaaccagcagatttttagcgtcgcccctggcagcgatagtagcaatgggaccgtctcttctgtacagtaccaggtgataccccagatccaatccgccgacgggcagcaggtacagatagggtttactggatcctccgacaatggcggaatcaatcaggagagttcacaaatccagattattcctgggtccaatcagactctgctggccagcggtacaccatcagccaacattcagaaccttatccctcagaccggacaggtccaagtccaaggggtcgccatcgggggatcttcttttcccgggcaaacacaagtcgtggccaacgtgcccctgggcctgcccggaaacatcacctttgtgcccattaattcggtagatctagactctctggggctaagtggaagctctcagactatgaccgctggtatcaatgctgacggccaccttattaacactggccaggccatggacagctctgataatagtgagcgcaccggcgagagagttagcccagacatcaatgaaacgaataccgatactgacctatttgttccaacgtcctcctccagccagcttcccgttaccatcgattctactggcatcctgcaacagaacaccaattccctcacgacgagtagtggccaggtccatagtagcgacttacagggtaattacattcaaagcccagtctccgaagagactcaggcccagaatatccaggtctctacagcccagccagtggtgcagcacttgcagctccaagaaagccagcagcccacctctcaggcgcaaattgtgcagggaatcaccccgcagacgattcacggggtacaggcaagcggacagaatatatcccagcaggccctccagaatctccagctccagctgaacccagggacatttctgatacaggcacagactgtgaccccatccggccaggtgacctggcagacatttcaggtgcagggcgtgcagaacctgcagaacttacagatccagaacactgccgctcagcagatcacactgactcctgttcagacactcactttggggcaggtagccgccgggggggcgttcaccagcacgcccgttagtctgtccaccgggcagcttcccaatctgcagacggtcacagtcaactcgatcgactctgccggcatccagttgcacccaggagaaaatgccgatagcccggccgatattcggattaaggaagaggagcccgatcccgaggaatggcagttgtccggtgatagcacgctgaacaccaacgatcttacacatcttcgtgtccaggtcgttgatgaggagggcgaccagcagcaccaggagggaaagaggttaaggcgtgtggcatgcacgtgccctaactgtaaagagggcggcgggcggggcacaaatctcggcaagaagaaacagcacatctgtcatatccctggatgcggtaaggtctatggtaagacttcccacttaagggcccacctgagatggcattccggcgagcggccttttgtctgcaactggatgtactgtggaaagcgcttcacccggtcagatgaactgcagcgacatcgaaggacccacaccggcgaaaaaaagtttgtgtgtcccgaatgcagcaagaggtttatgcggtccgatcatctggctaaacacattaagacccaccaaaacaaaaaagggattcattcttcatccacagtcctggcaagcgttgaggccgccagggatgataccctgattacagccggaggcactacgttaatccttgccaacatccagcagggatcggtgtctggcatcggcaccgtcaataccagtgctacctctaatcaggacattttaacaaacacggaaattccccttcaactggtcaccgtttctggaaatgaaactatggagtag

SEQ ID NO: 135810 - DNA, 2142 bp, Artificial Sequence
  Description of Artificial Sequence: Synthetic coding sequence
attgggccaccctcacctggggatgacgaagaggaggcagcagccgcggcaggtgcccccgccgccgcaggcgctactggagatctcgcatcagcgcaactcgggggcgcaccaaacagatgggaggttctatcggccactcccaccacaattaaggatgaggctggtaacctggttcagataccgtcagcggctacttcttcgggccagtatgtattgccactacagaacctacagaatcaacagatcttttccgttgcgcctggctcagattcgagtaacggtacagtgtcaagcgttcagtaccaggtaatcccgcagattcagtctgccgatggccagcaggtgcaaatcgggttcaccggcagttctgataatggtggcataaaccaggaatcaagtcagatccagataataccaggaagtaatcagaccttactggcctctggaacgccaagcgccaacatccaaaatttgataccacagacgggccaggttcaggtgcagggtgtggccattggaggcagctcattcccgggacagactcaggttgtcgccaacgtgcctctcggacttcccggtaacatcacattcgtccctatcaatagcgtggatttggacagcttgggactgagcggatcctcccagacgatgacagctggtatcaatgctgacgggcacttgatcaatactggtcaggcaatggacagttccgacaattccgaacgcaccggcgaacgggtttcacctgacattaacgagactaataccgatactgatctgtttgtcccaacctcctccagttctcagttacctgtcactatcgatagcacagggattttgcagcagaatacgaactctctgactacctcgagcggacaagtccacagtagtgatctccagggcaattacatacagagccccgtgtctgaagaaacccaggctcagaacattcaagttagcactgcccagcctgtggtccaacacctccagctgcaggagtcccagcagccaacctcacaagcccagattgtccaaggtattactccacagacaattcacggggtacaggccagtggtcagaatattagccagcaggctctgcagaaccttcagttacagctaaacccaggcacctttctgatccaagcacagactgttaccccaagcggccaggtgacctggcagaccttccaggtacagggagtccagaatttgcagaatctgcagatccagaatacggccgcccagcagattactcttactcccgtgcagaccctcacactgggacaggtcgcagcaggaggcgcctttacttctactccagtttcgctgagcacaggccaactgcctaacctgcagaccgtcaccgtgaacagcattgattcagcgggtatccaacttcaccctggggagaacgcagactcccctgccgatatcaggatcaaagaggaggagccagacccagaggagtggcagctgagtggggactcaacactgaacaccaacgatctcacccatctccgggtgcaagtcgtcgatgaagaaggggatcagcagcatcaggagggaaaaaggctcagacgcgttgcttgtacctgtcctaactgcaaagaaggggggggacgaggtaccaatttgggcaaaaagaaacagcacatttgccacataccaggctgcggaaaggtctacggaaaaacctctcacctcagagcccacctcagatggcacagcggagagcgtccttttgtctgcaactggatgtattgcggcaaacgctttacccgtagcgatgaattgcaacggcaccgccggacccacaccggagagaagaagtttgtatgtcccgagtgtagtaaacgcttcatgcgctctgatcatctggcaaagcacataaaaacgcaccagaataagaagggtattcattcctcatccactgtgctggcatctgttgaggctgcccgtgatgatacactgattacagccggcggtaccaccctcatactggccaacattcagcaagggtctgtctcaggaatcggcaccgtcaacacatctgctacctctaaccaggacatcctcacaaataccgagatccctcttcagttggtcaccgtcagcggcaatgaaaccatggaatag

SEQ ID NO: 135811 - DNA, 2187 bp, Artificial Sequence
  Description of Artificial Sequence: Synthetic coding sequence
atggctgctcttgacgttgacagtggcggcggtgggggtggcggcggcggacatggtgagtacctacaacagcaacagcagcacggcaacggggccgtcgctgctgccgcagctgcacagaccggggatctcgcctctgctcagttggggggcgctccgaaccgttgggaagtcctgtctgcaacacccaccaccatcaaggacgaggcggggaatctcgtgcagatcccttctgctgctacatcgtccggccagtacgtgttgccactccagaacctgcaaaaccagcaaatcttctccgtggcaccaggctccgactcttctaacgggacagtgtcttctgtccaataccaggtgatcccacagatccaatcggcggatggacagcaggttcagatcgggttcacaggctccagcgacaatggaggcattaaccaggagagttcccagatccaaatcatccctggaagtaatcagaccttactagcctcaggcacaccatccgccaatatccagaatttgatcccccaaacgggccaagtgcaggtgcagggcgtcgccatagggggttccagttttccaggtcagacgcaggtggtggctaatgtgcctttaggcctcccaggtaacataacgttcgtccctattaatagcgtcgatcttgacagcctcggcctctctggttccagtcagacaatgactgctggtattaacgccgatggacaccttattaacacaggccaagctatggattcaagcgataatagtgaaaggactggagagcgtgtttcacccgatatcaacgagacaaacacagacaccgacctgtttgtgcccacaagctcatcctcgcagttacctgtgaccatcgacagcacaggtatccttcagcaaaatactaacagtttgactactagctctggacaggtccattcctccgatctgcaggggaattatatacagtctcctgtgtctgaggagacccaggctcaaaatatccaggtttcgactgcccaaccagtcgtgcagcatttgcagctccaggagagtcagcagcccacgtcccaggcccaaatcgtgcaaggtatcacgccccagaccatacacggggttcaggccagcggtcaaaatatttcacaacaagcactgcagaatctgcaactacaactgaaccctgggacgttcctcatccaagcacagaccgtcacccccagcggccaggtgacatggcagactttccaggtgcagggcgtccaaaatctccagaacctacagatccagaacacagccgcccagcagattacgctgactccagtgcagacactcactctgggtcaggtggcagccggcggtgccttcacaagcacccccgtgtcgctcagtacgggccaattacccaaccttcaaacagtaacagtgaattccatagatagtgctggcattcagcttcacccaggagaaaacgccgactccccagcggacattagaattaaggaagaagagccggacccggaggaatggcagctcagcggagactctaccttgaacactaacgaccttactcacttgcgcgtgcaggttgtcgacgaggagggcgaccaacagcaccaggaaggcaaaaggctgcggagggtggcctgcacctgccccaactgtaaggaaggcggtgggcggggtacaaacctcgggaaaaagaagcagcatatctgccacatcccaggatgtggaaaagtctacggtaaaaccagccacctgcgggcacatctgcggtggcattcaggggaaagacctttcgtttgcaactggatgtattgtggtaagcggtttactcggtctgacgagctgcagagacatcgcagaacccacaccggagaaaagaaatttgtctgcccagaatgctcaaaacggttcatgcgatcagatcatctggccaagcatataaagacccatcagaataagaagggaattcattctagctccactgtattggcctctgtggaagcagccagggatgacaccctgatcactgcaggaggaaccactttgattctagccaacattcagcagggttcagtgtctgggattgggaccgtgaacacctcagccacctccaaccaggatattttgactaatacagagatacctctccagctggtgaccgtcagcgggaatgagaccatggaatag

SEQ ID NO: 135812 - DNA, 1545 bp, Artificial Sequence
  Description of Artificial Sequence: Synthetic coding sequence
atggtgtgggaagtcaagaccaaccaaatgcccaacgctgtgcagaagctgctgctggtgatggataaaagggctagcgggatgaatgactcattggagctactgcaatgtaatgagaacctcccgtcgagcccaggctataactcctgtgacgagcatatggagctcgacgatctccccgaactccaggcagttcaaagcgatcctacacagagcgggatgtaccagttgagttctgacgtcagccatcaggaatatccaagaagctcttggaatcaaaacacctcagatatccctgagaccacctatcgggaaaacgaagtcgactggctgacggagttagcgaacattgctacttctccccagtcacccttaatgcagtgttcgttctataataggagttccccagttcacattatcgctacttctaagagcctccacagttacgcacgccctccgccagtcagcagcagctcgaaatccgagcccgcttttcctcatcaccattggaaggaggagacccctgtccgtcacgagagggctaattccgagtccgagtctggtatattctgcatgtctagcctgtcggatgacgatgaccttggctggtgtaactcatggccaagcaccgtgtggcactgctttcttaaggggacccgactttgcttccacaaaggcagcaataaggagtggcaggacgtggaggacttcgcgcgggccgaaggatgtgacaatgaggaagacttgcagatgggcatacataaggggtatgggtctgatgggctgaagcttctctctcacgaggagtctgtatcattcggcgagtcagtgctaaagctaacattcgatcctgggactgttgaggacggcctcctgaccgtagaatgcaaactcgatcatccattctacgtcaagaataaggggtggtccagtttttatccctccttaaccgtggtgcaacacggaatcccatgctgcgaggtgcacatcggagatgtatgtctgcctccgggtcacccagacgctatcaatttcgatgactcgggagtgtttgatacgtttaaatcctatgactttactccaatggacagttcagccgtgtatgtgctatcttccatggcccggcagaggcgggccagtctgagctgcgggggtccaggcggacaagattttgccaggtcaggcttcagtaagaattgcggaagtccaggaagtagtcagttgagtagtaattcactttacgccaaggctgtcaaaaatcattcctccgggacagtttcagctacctcgcctaacaaatgtaaacggccgatgaacgcatttatgttgttcgccaaaaaataccgcgttgaatacacccaaatgtaccccggcaaggataaccgcgccatcagtgttattttaggcgatcgttggaagaagatgaagaatgaagaacgccgcatgtataccttggaggccaaggccctggccgaggaacagaaacgcctgaacccggactgctggaagagaaaaaggaccaacagtggctcccaacagcactag

SEQ ID NO: 135813 - DNA, 432 bp, Artificial Sequence
  Description of Artificial Sequence: Synthetic coding sequence
atgtccgatcagaaaaaagaggaagaggaggaagcagccgcagccgctgctatggctacagaagggggcaaaactagcgaaccagaaaataacaataaaaaaccaaagacaagcggatcacaggatagtcagccgtcccccctggctctcctggctgccacttgttccaaaatcggcacccctggagaaaaccaggcgactgggcagcagcagagaaatctgttggagacattaggtaacctgttgccgccacttctgctgcttcagaagagaatcactttcctgaaccagcctctcgttcgactcgtgttgcccgccgtgattacaggcgtgcacctgctccagaagcttaaccaggtgatcctgcctccactggttaacttcaaatcttacaagtacaagatccaggttgtcgtctattcgacaaaatag

SEQ ID NO: 135814 - DNA, 1296 bp, Artificial Sequence
  Description of Artificial Sequence: Synthetic coding sequence
atggctagctcactgctcgaggaggaggtgcattacgggagcagcccgctcgccatgttaaccgccgcatgctccaagtttgggggctcctctcctctgcgcgattctacaaccttggggaaagcaggaactaagaagccatattcagtcggctccgacctgtcagcttccaagactatgggagacgcctaccctgcacctttcacttccacaaatgggttgctgtcccctgccggatcaccccctgcacctaccagtgggtacgctaatgattacccgccattttcgcattcgtttcctggcccaacgggcacccaggaccccgggcttctggtgccaaaaggccattctagtagcgactgcctaccctcggtgtatacatcactggatatgacacacccctatggcagctggtataaggccggtattcacgctggaattagtcctggccccggcaacactcctactccctggtgggatatgcaccctgggggcaattggctaggaggcgggcagggacagggtgatggactgcaagggacgttaccgaccgggccagcccagccgccgctgaatccccaactccctacctacccttctgatttcgcaccactcaatcccgctccctaccctgccccacacttgctgcagcccgggcctcagcacgtccttccccaggacgtctataaaccaaaagccgtgggtaattcaggccagctggaaggtagtgggggagctaaacctccaagaggcgcaagcaccgggggcagcggcggttatgggggaagtggcgccggccgcagctcatgtgattgtccaaactgccaggagctggaaagactgggggcagccgccgccggacttaggaaaaagcctattcattcctgtcacatccccggctgcggaaaagtgtacgggaaggcttctcacctgaaggcacaccttcgatggcatacaggagagaggccctttgtgtgtaactggctcttctgcggtaaaaggttcacaagatcagatgagctggagagacacgtgcgtacccacactcgagagaagaaattcacctgcctcctgtgcagcaagcggtttacccgcagcgatcatctgtccaagcatcagagaacacatggcgaaccagggcccggtcctccaccatctggccccaaggagttgggggaaggccgcagtacaggcgaggaagaggcgtctcagaccccccgtccgtccgcttcgcccgccacacctgagaaggcccccggcggcagcccagagcagtccaacctgcttgagatctag

SEQ ID NO: 135815 - DNA, 1296 bp, Artificial Sequence
  Description of Artificial Sequence: Synthetic coding sequence
atggcatcctcactgcttgaggaggaggtgcattacggctcctcccctttagccatgctcacggcagcatgtagcaaattcggcggaagttctccactgagagattctacaacactcgggaaagccggcaccaaaaagccatacagcgtggggagtgaccttagcgcttccaagacaatgggcgacgcctacccggcgccgttcacttccaccaacggcctgctgtcaccagcaggctctccaccagcacctactagcggctatgccaatgactaccccccttttagtcacagcttcccgggcccaactggaacccaagatccgggcctccttgttcccaaggggcactcatccagcgactgcctcccttccgtttacacaagtttagatatgactcatccatatggcagctggtacaaggccggaattcatgctgggattagtcccggaccgggaaataccccaaccccttggtgggacatgcaccctggaggcaactggctgggcggcggacaaggccagggggatggcctgcaaggcactttgccaacaggacccgctcagccgcccctgaacccacagctccccacctacccctctgattttgcacctttgaatccagccccctacccagctcctcacctcctgcagccaggaccccagcacgtactgccgcaagacgtctataagcctaaggcagtgggaaactctgggcagttggaaggatctggtggtgcaaagcctccccgaggcgcctcgacgggcggcagcggtggttacggcggtagcggggccggacggtcctcatgcgattgtcccaactgtcaggagttagagaggctgggagcagccgcagctggcctgaggaaaaagccgattcactcatgtcacatcccggggtgtggaaaagtctacggaaaagcttcacatcttaaggcccacttgcggtggcatactggagaaagaccttttgtgtgcaattggctcttctgcggcaagaggtttaccaggtcagacgagctcgagaggcacgtccgaacccacacccgcgagaagaaattcacatgcctgctatgctcaaagcgctttaccagaagcgatcacctgtctaagcaccagcgcacgcacggtgaacctggtccggggccaccccctagcggtccaaaagagctcggcgagggtagatctaccggcgaggaagaagcatctcagactccccgtccctccgcttcgcccgccactccagaaaaagcacccgggggctctccggaacagtcaaatctgttggagatttag

SEQ ID NO: 135816 - DNA, 1242 bp, Artificial Sequence
  Description of Artificial Sequence: Synthetic coding sequence
atgctcactgctgcctgctctaagtttggcggctctagccccctccgagactctacgacgcttggtaaggccgggactaaaaagccctatagcgtagggagcgatctctccgccagcaaaaccatgggtgatgcataccctgcccccttcacctcaacgaatgggctgctgagtcctgccggatcaccaccggcccctacttctggttacgccaacgattaccccccgtttagccacagcttccctgggcctacaggtacacaggaccccggtctgctagtgcccaaagggcacagctccagcgattgcctcccgtccgtctacacttcccttgacatgacacacccatatggctcttggtacaaggctgggatccatgctggcatttcgccaggccctggcaacactcccactccctggtgggatatgcatccgggcggcaattggcttgggggtgggcaggggcagggagacggcttgcagggaacccttccaacgggacctgcgcaaccacctctgaaccctcagctcccaacctacccttccgatttcgcgccactcaacccggccccttatccagcaccccatttgctccagcccgggccacagcacgtgctcccccaggacgtttacaagcctaaggccgtgggcaattctggacagcttgaggggagcggaggggcgaaacctccacgcggcgcttctaccggcggcagcggcgggtacggagggagtggcgcaggtaggagctcatgcgactgtccaaactgtcaggagctggagcgtttgggtgccgctgcggcaggcctccgtaagaaaccgattcactcctgccatattcccggatgtggcaaagtctatgggaaggcaagccacctcaaggctcacctgcggtggcatacaggggagcggccattcgtttgcaactggcttttctgcgggaagagatttactaggtccgatgagctagaacgccacgtgaggacccacaccagagagaagaagttcacttgcctcctgtgcagcaaacgatttacaaggagtgatcacttgagcaagcaccaaaggacccacggggagcccggcccagggcccccaccctcaggaccaaaagaactgggtgaggggcggtccacgggggaggaagaggcatctcagacccctcgaccatccgcatctcctgcaacgcccgagaaagcacccggcgggtcccccgaacaatccaaccttttagagatctag

SEQ ID NO: 135817 - DNA, 1401 bp, Artificial Sequence
  Description of Artificial Sequence: Synthetic coding sequence
atggcaacctctctgctaggcgaggagcccagactggggtccacacctctcgctatgctcgccgcaacttgcaataagatcggctcgccctcaccatctccttcatcgctgagcgattctagtagttcttttggtaagggttttcatccctggaagaggtcttcctccagcagcagcgcctcgtgtaacgtggttggatcttccctgagtagctttggtgtgtccggggcaagtcgcaacggaggcagctcttccgcagcggccgcggccgcagccgccgcagccgcagccgccgccctggtgtcggattcattctcttgcggggggagtccgggaagctccgctttctccctcaccagttcgggtggaagctcagcccactcccaagacggcagtcatcaacctgtcttcatctcaaaggtgcacacgtctgtcgacggactccaggggatataccccagagtgggaatggcgcatccttacgagagctggttcaagccatcacatccgggcctcggtgctgccggggaggttggatccgccggagcaagcagttggtgggatgtcggcgctgggtggattgatgtccagaaccctaattccgccgcagccttgcctggctctctgcatccagctgccggtgggctccagacatcactccatagccctttaggcggttacaactctgactactcagggctgtcccactcggctttctcctctggggcttcttcccatctgctgtctcccgccggtcaacacctcatggacggctttaagcccgtccttcccggctcttaccccgatagcgctccaagtccactggcaggagcgggtggctctatgctgtccgccggaccgtccgcccccctgggaggatcaccacgctcttcagctaggcgctactcaggcagggccacctgtgattgccctaactgccaagaggcggagagactgggccctgccggcgcgtctttgcgtcgaaaaggattgcactcctgtcacatccccggttgcgggaaggtttatggaaagactagtcacctcaaggcccatctgcggtggcatacaggggagcgcccttttgtatgcaactggctattttgcgggaaacggttcactcgcagcgacgagctacagagacatctccgcacacataccggcgagaagcgtttcgcttgccccgtgtgcaataaaagatttatgagaagtgaccacctcagcaaacatgtcaagacccactccggaggaggcggtggcggggggagcgccggctctgggagcggcggaaaaaaaggaagcgataccgacagcgaacattctgcagccggctctcctccatgccactctcccgagttattgcagcctcccgagcccggacaccgcaacggccttgaatag

SEQ ID NO: 135818 - DNA, 1473 bp, Artificial Sequence
  Description of Artificial Sequence: Synthetic coding sequence
atgctcgccgcaacttgtaacaaaatcggtagccctagccctagcccatcctcactgtccgactctagtagctctttcgggaaaggattccatccctggaagcgctctagctcaagttcttccgcttcttgcaatgtggtgggatcctccctttcaagctttggagtgagcggggcctcccgcaacggagggagtagctccgcagctgcagccgctgcagcagcggctgccgctgcagctgccctggttagcgatagtttcagctgcgggggctcccctgggtccagcgcattttccctcacttcctccagcgcagctgctgcggccgctgccgcagctgccgctgcctcaagttctccttttgccaacgactattcggtgttccaggcgcctggagtgtccggaggctctggcggtgggggcggcggcgggggcggcggctctagtgcacattcccaggatggatctcatcaacccgtcttcatctcaaaggtgcacacctctgttgatggactgcaggggatctatcctagggtgggcatggcccacccttacgagagctggttcaagccctcccaccccggattgggcgccgctggcgaagtcgggtctgccggagctagcagctggtgggacgtgggggcaggttggatcgacgttcagaatcccaatagtgctgctgctctgccaggcagtctccaccctgccgccggtggacttcaaacctccctccattccccccttggcggatataactcagattattcgggtctgagccactctgccttctcatcgggcgcaagctcccatctgctgtcacccgccggccaacacctcatggacggattcaagcctgttctgcccggctcttaccccgattccgctccgagccccctggcaggcgcagggggctcaatgcttagcgccgggcccagcgcccctctgggaggcagtcctcgctccagtgcccggcgctatagcggtagggccacgtgcgactgtcctaattgccaggaggccgaacgtctcgggccggcaggagccagcttacgtagaaaagggttacacagctgccatattccgggatgcggtaaagtgtacggcaagacctcccacctcaaagcccaccttcggtggcacacgggtgagaggccgttcgtgtgcaactggctgttttgtggtaagcgttttacaaggtccgatgagctccagcggcaccttaggacccatactggcgagaaacgtttcgcgtgtcccgtctgtaacaagcggttcatgcggagtgatcatctgtctaagcacgtgaagactcattcaggaggtggagggggggggggtagcgccggtagcgggagcggtggcaaaaaaggttctgacaccgacagtgagcatagcgcagcggggtcccctccatgtcattctccagagctccttcagcctcccgaaccagggcaccgaaatggcctggagtag

SEQ ID NO: 135819 - DNA, 1527 bp, Artificial Sequence
  Description of Artificial Sequence: Synthetic coding sequence
atggcaactagtctgctaggggaagaacctcgcctgggctcaacccctctggctatgctggccgccacttgcaataagattggcagcccaagcccttccccaagctcattgagcgactcttcgtcttcgtttggaaagggcttccatccgtggaaaagatcttctagtagctcatccgcatcatgtaatgtggttggcagtagcctctcgtcctttggcgtttcaggagcatcacgcaacggcggtagttccagcgccgccgctgccgcagcagcagccgcagcagctgccgcggcgctagtgtcagacagcttcagctgtggcggcagcccagggtcctctgctttcagtttaacctcctcgagtgctgcggcagcagcagccgccgctgcagcggccgcttcttctagccccttcgctaatgattactccgtgttccaggcccctggtgtttccggcgggtctggcggcggcgggggaggaggcggcggcggcagctccgcccacagtcaggatggaagccatcagccggtctttattagtaaagtgcatacttccgtggacggcttacagggaatctaccccagagtgggtatggcccacccctatgagtcctggtttaagccatcccaccccggtctaggggccgccggagaagtgggcagtgccggagcttcttcctggtgggacgtcggcgccgggtggattgatgtccagaaccctaacagcgccgccgccctgccggggtccctccatcccgcggctggcggcctgcaaacctccctgcacagcccactgggaggatacaatagcgattactcagggctgtctcattccgccttctctagcggcgcctctagtcatctgctttcacccgccgggcaacatctgatggacgggttcaagccagttttgcctggttcctatccggactcagccccctctcccctcgccggcgcaggcgggtctatgctgtccgcgggcccatccgccccgctgggggggtcccccagaagctctgcgaggaggtactcgggccgcgccacttgcgactgtcctaactgtcaagaggccgaaaggctaggcccagccggtgccagcctacggcggaaggggctccattcgtgccatattcctggttgcgggaaagtttatggaaagacctctcacctaaaggctcaccttcggtggcacaccggggagaggccttttgtttgcaattggcttttctgtggcaaacgctttactcgctccgatgagctgcagcggcatctccgtacacatacgggtgagaagcgctttgcatgtcccgtttgcaacaagcggttcatgcgatctgatcacctgtctaagcatgtcaagacacacagcggtggcggcggaggcggcggcagcgcaggctctggtagcggcggcaaaaaaggctcagatacagattcagagcacagcgccgctggatctcctccatgtcatagcccggagctactgcagccccccgaaccaggacataggaacggactggaatag

SEQ ID NO: 135820 - DNA, 294 bp, Artificial Sequence
  Description of Artificial Sequence: Synthetic coding sequence
atggacaaacagtcatcagccggcggcgtgaaacgcagcgtgccatgcgatagcaacgaagccaatgagatgatgcctgagacacctactggagactcagatccccagccagcacctaagaagatgaagacctcagagagttccaccattttagttgtaaggtatcgcagaaacttcaaaaggacaagccctgaagaactgctcaacgatcatgcccgggaaaaccggataaatcccctgcaaatggaggaggaggagttcatggaaatcatggttgaaattccagcaaaatag

SEQ ID NO: 135821 - DNA, 294 bp, Artificial Sequence
  Description of Artificial Sequence: Synthetic coding sequence
atggataaacagagttccgcagggggagtaaaacgtagcgtaccatgcgaaagcaacgaagtgaacgaaacaatgcccgaaacgcccacgggggattctgacccacaacctgcccctaaaaagatgaaaacatccgagagttctacaatactcgtggtcaggtaccggcgcaacgtcaagcgaacatctcccgaagaattgctcaacgaccatgcccgggaaaatagaataaaccccttgcaaatggaggaggaagagtttatggagattatggtcgagatccctgccaagtag

SEQ ID NO: 135822 - DNA, 1308 bp, Artificial Sequence
  Description of Artificial Sequence: Synthetic coding sequence
atgctgcctgctcgatgtgcgcggctattgactccgcaccttctgctggttctggttcagctcagtcccgccagaggccaccggacgacaggccccagattcctcatttcagacagggacccgcaatgtaatctgcactgtagtagaacacagccgaaacctatctgcgcttccgatgggcgatcttacgaatctatgtgcgaatatcaaagagccaagtgcagggacccaactttgggagtggtgcaccggggccgttgtaaagacgctggtcagtcaaagtgccgactggagagagcccaggcactcgaacaggccaaaaaacctcaggaagccgttttcgtccctgagtgtggcgaggacggctctttcacacaggtccagtgccacacatacactggctactgctggtgtgttacacctgatgggaagcccattagtggttcaagcgtgcaaaataaaaccccagtgtgttccggcagcgttaccgataaaccccttagtcagggtaacagcggacgaaaagatgatggatcaaagcctaccccgacgatggagacccaacctgtctttgacggggacgaaattactgcaccaacgttatggatcaaacacctggtgatcaaggatagcaaacttaacaacacgaacataagaaactcggagaaggtctatagctgcgatcaggaacggcagtctgccttggaggaggcccagcagaatccacgggaggggatcgttatccccgaatgtgccccaggcgggctctacaagccagttcaatgccatcagtctactggatattgctggtgcgtcttagtagacactggccgacctctgccagggaccagcactcgatatgtgatgcctagctgcgaatcggatgcccgagctaaaacaaccgaagcggacgatccctttaaagatcgcgagcttcccgggtgtcctgaaggcaagaagatggaatttatcacgtctcttcttgacgccttaaccacagacatggtgcaggccatcaattcagccgcccctaccgggggaggacggttcagtgagccagacccgtcgcacacacttgaagaacgggtggtgcactggtacttttcacaattggactctaactcttctaacgacattaataaacgggaaatgaaaccattcaaacggtacgtcaagaagaaggcaaaaccaaaaaaatgtgcaagacgtttcaccgattattgtgacttgaacaaagataaagttatttcactgcctgaactcaagggctgcttgggggttagcaaagaggtcggacggttggtgtag

SEQ ID NO: 135823 - DNA, 1305 bp, Artificial Sequence
  Description of Artificial Sequence: Synthetic coding sequence
atgctccccgcccggtgcgctcggctcctcacccctcatctgctacttgtacttgtgcagttgtctcccgcccggggccaccggacaaccggccctcggtttctaatatcagatcgcgatccgcagtgcaatctacactgcagccggacacagcctaagcccatttgtgcgagcgacgggaggtcctatgagagcatgtgtgaataccaaagagcaaagtgtcgcgaccctacacttggggtcgtccatcggggaaggtgcaaagatgccggacaatcaaaatgtcgcttggaaagagctcaggccctcgagcaggcaaagaagccacaggaagccgtctttgtccctgaatgcggggaagatgggtctttcacacaggtgcagtgccacacatataccgggtactgctggtgtgtgaccccagacggaaagcctatctctggctccagtgtccaaaacaagacacctgtctgctctggatccgttacggacaagccgcttagccagggtaattcaggcaggaaagacgacggcagcaaaccaacacccaccatggaaacccaaccagtgtttgacggggatgaaatcacggcaccaactttatggattaaacacctcgtgattaaggacagtaaactgaacaataccaacatccgaaactcggagaaagtgtacagctgcgaccaagaacgtcagtcagctctcgaagaagctcagcagaacccaagggaagggatcgtaatccctgagtgtgccccaggcggcctgtacaagcctgtccagtgtcaccagtcaaccggttactgttggtgtgtactggtggatacaggcaggcctctgccagggacaagcactcgctacgtcatgccgagttgcgagtccgacgcgagggctaaaactactgaagctgacgatcccttcaaagaccgtgaactgccgggctgccccgagggaaagaaaatggagttcattacctccttacttgacgcactgactactgacatggtccaggctatcaattccgctgctcccacgggtggcggtaggttcagcgagccagatccctcccacactttggaggagcgtgtagtccattggtattttagccagttggacagcaacagctccaacgatattaataagcgggaaatgaagccctttaagcggtacgtaaagaagaaggccaagccaaagaaatgtgcccgtaggtttaccgactattgcgatttaaataaagacaaagtaatctctctgccggaactgaaaggctgtctcggggtctcaaaagaaggcagactggtctag

SEQ ID NO: 135824 - DNA, 1374 bp, Artificial Sequence
  Description of Artificial Sequence: Synthetic coding sequence
atgctgttgcctcagctgtgctggttgcctcttctcgccgggcttttaccaccagttcctgctcagaagtttagcgctctgacctttctgcgcgtggatcaggacaaggataaggattgttctcttgactgcgcaggcagcccccagaagccattatgcgcttcagatgggcgtacatttttaagccgctgtgagtttcaaagagctaagtgtaaagacccgcagctcgaaattgcctacagagggaattgcaaggatgtttctcgctgcgtcgcagaaagaaaatatactcaagaacaggcacggaaggagttccagcaagtttttattcctgagtgcaacgacgacggcacctactcacaagtgcagtgccatagctacacagggtactgctggtgtgtgacccccaatggaaggccaatatcgggaacagcggtggcgcataaaacccctagatgcccgggatccgtgaacgaaaagctgcctcagagggagggcaccggaaagaccgtctccttacaaatctttagtgtgttgaacagcgatgacgctgcggctccagctctggaaacccagccgcaaggggacgaggaagatatcgcttcaagataccctacattgtggaccgaacaagtgaaatccaggcaaaataaaactaataaaaatagcgtgtcttcatgtgaccaagaacaccagtccgctctggaggaggccaaacagccaaaaaacgacaacgtggtaatccctgaatgtgcgcatggcggcctctacaagccggtccagtgccatccaagcaccggttattgctggtgtgtgctggtagacactgggcgacctattccgggaacctccaccagatatgagcagcctaaatgcgacaatacggcaagggcgcacccagctaaggcaagagatctgtataagggacgccagctccaggggtgtccgggagcaaagaaacacgagtttctcacatccgtgctggacgcactcagcactgatatggtacacgcggcctccgacccatccagttccagtgggcgcctttcagaaccagacccttcccatactctggaggaaagagtggtccactggtattttaaactgcttgataaaaattccagcggcgacattggtaagaaagagataaaaccctttaaacgatttcttcgaaagaaaagtaaaccaaagaagtgcgtcaaaaaattcgtcgagtactgtgacgtgaacaacgacaaaagcatctcagtgcaggaactcatgggttgcctcggagttgccaaagaggacgggaaggccgacactaagaaacggcacactccaagagggcatgcggagagcaccagtaaccgacagcctaggaaacaaggatag

SEQ ID NO: 135825 - DNA, 1341 bp, Artificial Sequence
  Description of Artificial Sequence: Synthetic coding sequence
atgctgctgcctcagttatgttggctgccacttctcgcgggactccttccacccgtacctgcccaaaaattttcagcactgacattcctcagagttgatcaagataaagacaaggattgtagccttgactgcgccggaagcccgcagaaacctctatgtgcgagtgacggtaggacattcctgagcaggtgcgagttccagagagctaaatgtaaggaccctcagctggagattgcataccgcggtaactgcaaggacgtgtcccggtgcgtcgctgaaagaaagtatactcaggagcaggcaaggaaggagtttcaacaggttttcattccagaatgcaatgacgacggcacatatagtcaggtgcaatgtcactcttacacaggatattgctggtgcgtaaccccaaacggacggcctatttccggtacagctgtggcccacaagacccccagatgccccggaagtgtgaacgaaaaactaccccagcgcgaagggactggcaagaccgacgacgccgccgcgccagcactggagactcagccacagggcgacgaagaggacatagcttcccgctaccctacactctggactgaacaggtcaagtcccgccaaaacaagactaataaaaatagcgttagttcctgtgaccaggaacaccagtccgcgctcgaagaggccaaacaacccaagaacgacaatgtagtaattcctgaatgcgcgcatggcggattatataaacccgttcagtgccacccgagcacaggttactgctggtgcgtgttagtggacaccggccgacccattcctggcacctcgacccggtacgaacagcccaagtgtgataacacagcgcgggctcatccagctaaagctcgagatctgtacaaaggccggcagttgcagggatgccctggggccaagaaacatgaattcctgacatccgtgctcgatgcattatcaacagatatggtacatgccgcgtctgatccgagttctagctccgggcggttaagcgagcctgacccaagccacactttagaggaacgagttgttcattggtattttaagttgctggacaaaaatagttctggggatataggcaagaaagagatcaagccatttaagaggtttctgagaaagaagagtaagcccaagaaatgcgtgaagaagtttgtggagtattgtgacgtaaataacgataagtccatcagtgttcaggaattgatgggatgcttgggcgtggccaaggaagatggaaaagccgacacgaagaaacgccatactccgagaggccacgctgaatctacctccaatcggcagccacgtaaacaaggatag

SEQ ID NO: 135826 - DNA, 1347 bp, Artificial Sequence
  Description of Artificial Sequence: Synthetic coding sequence
atgctcctgccccagctttgctggttgcccctgctggcagggctgcttccccctgtgcccgcccaaaagttctctgcactcacctttctgagagtggatcaagacaaggataaggattgctccctcgactgtgctggtagcccacagaagccgctgtgcgctagtgatgggcgcaccttcttatcccgatgcgagttccagagagccaaatgcaaagatccacaactggaaatcgcatacagaggcaattgcaaggatgtatcacgctgtgtcgcagagcgcaaatatacccaagaacaagcgagaaaagagttccaacaggtgtttattccggaatgtaatgatgacgggacatattcgcaagtgcagtgtcactcgtacacgggctattgttggtgcgtgactccaaacggcagaccgatatccggtaccgcggtggcacacaaaactcctagatgcccggggagcgtgaatgagaagctgcctcaacgtgaagggaccggcaagactgatgatgccgcagcacctgcactggagactcagcctcaaggagatgaagaagatatcgcctcaagatatccaacactgtggacggagcaagtgaaatctcgccaaaataaaaccaacaagaatagtgtctcctcatgcgaccaggaacaccagtctgccttggaggaagctaagcagccgaaaaatgacaatgtcgtgatccccgagtgcgcacatggtgggctgtacaaaccggttcagtgccatccttccactgggtactgctggtgtgtgctggtggatacgggccgtcccatccctgggacaagcacacgctacgagcaaccaaaatgtgataacactgcccgagcccaccctgcgaaggcaagggatttatacaaaggccggcagctgcagggttgcccaggggctaaaaaacacgagttcctgacctcagtgctggacgcgttgtctacggacatggttcacgctgcctctgacccttccagcagttccggtcggctgtcagaacctgatccatcacatacattggaggagagggtagtgcactggtacttcaagctgctcgacaagaatagcagcggtgacataggtaaaaaggaaattaaacctttcaaacgcttcctacggaagaagtcaaagcctaagaagtgtgttaagaaatttgttgagtactgcgacgtgaacaatgacaagagtatatctgtgcaagaactgatgggatgcctcggcgttgctaaggaggacggaaaggccgacaccaaaaaaagacacactcccaggggccatgccgagagcaccagcaaccgacaggagaatcccaggaaagaaggctag

SEQ ID NO: 135827 - DNA, 255 bp, Artificial Sequence
  Description of Artificial Sequence: Synthetic coding sequence
aagaagagcaagcctaagaaatgtgtgaagaagttcgtggagtactgcgacgttaacaatgataaatcaatctccgtccaggaattgatggggtgtctgggggtggccaaggaagacggaaaggctgacacaaagaaacgccacactccccgagggcacgctgagagcacaagtaacagacaagatgctatggtggtgagctcgcggcctaaggcaaccacccacaggaaatctcggaccctgtcaagacgctag

SEQ ID NO: 135828 - DNA, 1275 bp, Artificial Sequence
  Description of Artificial Sequence: Synthetic coding sequence
atgagagcgcctgggtgcgggcggcttgtgttgcccctcctgctgttagcagctgccgcccttgcagaaggcgatgcaaagggactgaaggagggggagacccctgggaattttatggaggatgagcagtggctgagttccatcagtcagtatagtggtaaaataaaacactggaaccggtttagagatgaggtcgaggacgactacattaagtcctgggaggacaatcagcagggagatgaggccctagacacaacaaaagacccgtgccagaaggtgaagtgttccaggcataaagtgtgcatagcacagggataccagagagctatgtgtatctccaggaaaaagctcgaacacagaatcaaacagccaaccgtaaaattgcatgggaacaaagatagcatatgtaagccatgtcacatggctcagctggcaagcgtttgcggatcagacgggcacacttactcatccgtgtgtaagttagagcaacaagcgtgtctctctagtaaacaactcgcggtccgctgcgaaggtccttgtccctgtcctaccgagcaggccgccacatccactgccgacgggaagccagagacgtgcaccggccaggatctcgcagacctcggagacaggttgagggattggtttcagttgttgcatgaaaattcaaagcagaatggttcagcttccagcgttgccggacccgcaagcggcttggacaaatcgctcggggcttcatgcaaagactccatcggttggatgttctctaagctagacacctccgcagatctttttctggatcagaccgaactcgcagccatcaacctggataaatatgaggtttgcattcgcccctttttcaactcttgcgatacctacaaagatgggcgggtcagtaccgctgaatggtgtttctgcttctggcgcgagaagcctccctgtctcgccgagctcgaaaggatccaaattcaggaagcagctaagaagaaacctggcatattcattccatcctgcgatgaagatggatattatagaaaaatgcagtgcgaccagtcttccggtgattgctggtgtgtcgatcagttaggactggaattgacaggaactcgcacgcacggatctcctgattgcgacgacattgtcggctttagcggcgactttggctcgggagttggatgggaagatgaggaagagaaggagactgaagaggcaggagaggaggcagaggaagaggagggtgaagctggggaggccgacgacggtggatacatctggtag

SEQ ID NO: 135829 - DNA, 1266 bp, Artificial Sequence
  Description of Artificial Sequence: Synthetic coding sequence
atgagagctccaggatgtggcagacttgttctgcccttgctgctgttggccgcagcggctctggccgagggggacgcgaaggggctgaaggaaggagagactcctggcaattttatggaggacgaacaatggctgtcatctatcagccagtatagcggcaaaattaagcactggaaccgcttcagagacgacgactatataaagagctgggaggacaaccagcaaggggacgaggccctcgacactaccaaggatccgtgccaaaaggtcaagtgctcccggcataaggtgtgcattgctcagggttaccagagagctatgtgcatcagcaggaagaagttggagcatcgcatcaaacagccaaccgtcaaattgcatgggaacaaagattccatatgtaaaccctgtcatatggcacagcttgcatcggtctgtgggtccgatggacatacttattcatctgtttgtaagctggagcagcaagcatgcctgagctcaaaacagctggcagtgaggtgtgaggggccatgcccctgtcccacagagcaggccgctactagcacagctgatggcaaacctgagacatgtacggggcaagacctggcagacctaggagatcgcctccgcgactggttccaactgctgcacgagaactccaagcagaacggttctgctagttcagtcgccgggcctgccagtggcctggacaagtcacttggggcgagttgtaaagattccattggatggatgttcagtaaattagacacgtccgccgacttgttcttggaccagacagaactggctgcaatcaacctggataaatatgaggtgtgtatccgacctttcttcaatagttgtgacacctataaagatggcagggtgtctactgccgaatggtgtttttgtttttggcgcgagaagccgccttgtcttgccgaactagaaaggatacagatccaagaggctgctaaaaagaagcctgggatcttcatccccagctgcgacgaggacggttactaccggaaaatgcagtgcgaccagagctccggcgattgctggtgcgtcgatcagctggggcttgagttaactggcacccgtacccatgggtctccggactgcgatgacattgtcgggttctctggagatttcggatccggggtaggttgggaggacgaagaagagaaggagaccgaggaagccggagaggaggcagaagaagaagagggtgaagccggtgaggctgatgacggggggtacatttggtag

SEQ ID NO: 135830 - DNA, 234 bp, Artificial Sequence
  Description of Artificial Sequence: Synthetic coding sequence
atgagagcccccggttgcggtagactggtgctcccactgctgctcctggccgcagcagccctggccgaaggcgatgcaaagggactcaaggaaggagagacccctgggaattttatggaggacgagcaatggcttagttccatcagccagtacagcggcaagatcaaacactggaatagattccgtgacgtgccaagcagcgacccgccttcaacaacccaggctaccccgtag

SEQ ID NO: 135831 - DNA, 1275 bp, Artificial Sequence
  Description of Artificial Sequence: Synthetic coding sequence
atgcgggccccggggtgcggcagactggtgttgcctttgttacttcttgccgctgccgcactggcagagggcgacgctaaggggctgaaagagggcgagactccaggaaacttcatggaagatgaacaatggctgtcctcaatcagccagtatagcgggaaaattaaacactggaacaggttcagagacggtatcgaggacgactatatcaaatcatgggaagacaaccagcagggcgatgaggccttggatacaaccaaggacccctgtcagaaggtgaagtgttcacggcacaaggtgtgtatcgcccagggttaccagcgggctatgtgcatttcccggaagaagttagaacaccgtatcaaacaacccaccgttaagcttcacgggaacaaggatagcatctgcaagccctgtcatatggcccaactggcctctgtatgtgggagcgacgggcacacatatagcagtgtttgtaaactggagcagcaggcatgtctgagtagtaagcagctggccgtgagatgtgagggtccatgcccatgccccacggaacaggcggctactagcacagccgacggaaagccggagacctgcacgggccaggatctggctgatctgggcgaccgcctcagggactggttccagcttctgcatgaaaactctaagcagaatggtagtgcaagcagtgtcgcaggccccgccagtggattagacaagagcctcggggcttcttgtaaggactctatcgggtggatgtttagtaagcttgacacttcagccgacctcttcctagaccaaaccgaactcgctgcaataaacctggataaatacgaggtctgcatcaggcccttcttcaacagttgcgacacttacaaggacggcagagtgtctactgccgaatggtgcttctgtttctggcgggagaagcccccctgtctggccgaactcgagagaatccagatccaggaggcggctaagaagaaaccgggtatatttatccctagttgcgatgaggatggatactatagaaagatgcagtgcgaccaaagctcgggcgattgttggtgcgtagatcagctgggtctggagctgaccggaacacggacacatggcagtcccgattgcgacgatatcgtgggattcagcggcgactttggtagcggcgtcgggtgggaggatgaagaagagaaagaaaccgaggaagcaggcgaggaagccgaagaagaagagggcgaggctggggaagccgatgatggaggctatatttggtag

SEQ ID NO: 135832 - DNA, 1311 bp, Artificial Sequence
  Description of Artificial Sequence: Synthetic coding sequence
atgctcaaggtgtcagcagtgctgtgtgtttgtgcagccgcatggtgttctcagtccctggccgcggccgctgctgttgcagccgccggtgggagaagtgatggtggaaatttcctagatgacaagcagtggctgacgacaatttcccaatacgacaaagaggtgggtcagtggaataagtttcgcgatgaggttgaggatgactatttcaggacttggtctccgggcaagccctttgaccaggctctggatcctgcaaaggacccgtgcctaaagatgaaatgtagccggcacaaggtctgtattgcgcaagattctcaaacagcggtctgtatctcgcatagaagactgacacatcggatgaaggaggcaggagtggatcacaggcagtggagagggccaattctgagtacttgtaagcagtgcccggttgtttacccctcccccgtgtgtggctctgacgggcacacctattcttttcaatgtaaactggaatatcaggcctgtgtgctggggaagcagatctctgtcaagtgcgaagggcactgcccttgcccgagcgacaaaccgacttctaccagtagaaacgtgaaacgggcctgttcggacctcgaatttagagaagttgctaatcgattgagagactggtttaaagccctacacgagtctggaagccagaacaagaagaccaagaccttactgagaccagaaagatcaagattcgacacgagcattcttcctatttgcaaggactccctgggatggatgtttaatcgtcttgacacaaattacgaccttctgctggaccagtccgagctgcgtagcatctacctcgacaaaaacgagcagtgcacaaaggctttctttaattcctgtgatacctataaggactccctcatatcaaacaatgagtggtgctactgctttcagaggcagcaggaccctccctgccaaaccgagctttccaatatccagaagcgccagggtgtcaagaaactcctgggccaatatatccccttatgcgatgaagacggatactacaagcccacgcagtgccacggctctgtcggacagtgttggtgcgtggaccgttacggaaacgaggtgatgggcagccggatcaacggtgtggccgattgtgccatagatttcgagatctccggggactttgcttctggcgactttcatgaatggacagatgatgaggacgatgaggacgatattatgaatgatgaggatgagatcgaggatgatgacgaggatgagggcgacgatgacgacgggggtgacgaccacgatgtctacatctag

SEQ ID NO: 135833 - DNA, 1302 bp, Artificial Sequence
  Description of Artificial Sequence: Synthetic coding sequence
atgctgaaggtgtcagccgtattgtgtgtctgtgctgcagcctggtgctcacagagcctggcagccgccgccgctgtcgccgctgccggtggaagaagcgatggcggaaatttcctcgacgacaagcagtggctgactacgattagtcagtacgacaaagaggtgggacagtggaacaagtttagagacgacgattattttaggacgtggtcccctggcaaacccttcgaccaggctctcgacccagctaaggacccctgcttaaagatgaagtgctcacgccataaagtgtgtatcgctcaggactctcagaccgccgtgtgcattagtcacagacgcctgacccatcgcatgaaggaagccggtgtagaccaccggcaatggcgaggacccattctatccacttgtaagcagtgcccagtggtttatccatctcctgtgtgcggaagtgacgggcacacatactcgttccagtgtaaactcgaataccaggcttgcgtattgggcaaacagatttctgttaagtgtgaagggcattgcccttgtccgtctgacaagccaacaagtacttctcgaaacgtcaaacgggcctgtagcgacctggaatttcgcgaggttgcaaacaggctgagagactggttcaaggccctgcacgaaagtggatctcaaaacaagaagacgaagacccttcttcgtccagagaggagccggtttgacacatcaattttgccaatctgcaaggactcactgggctggatgtttaacaggctggatacaaactacgacctgctgctcgatcaaagtgagctgagaagtatttatttagacaagaacgagcagtgcaccaaggcttttttcaacagctgtgacacttataaggactctttaattagcaacaatgagtggtgctactgtttccaacgccaacaggatcctccatgccagacagaattaagtaatatccagaagagacagggagttaagaagcttctgggccagtatatcccactttgtgatgaagatgggtattacaaaccgactcagtgtcacggttccgttggccagtgctggtgcgtggaccgttacggaaatgaagttatggggtcacgtatcaacggggtggccgactgtgcaatcgactttgagatttccggcgatttcgcttcaggcgactttcacgaatggacggatgatgaggatgacgaggacgatattatgaacgacgaggatgagatcgaggatgatgacgaagacgagggagatgatgacgatggaggcgacgatcacgacgtctatatctag

SEQ ID NO: 135834 - DNA, 1158 bp, Artificial Sequence
  Description of Artificial Sequence: Synthetic coding sequence
atgattacccaggatcacatccacatgagcagcggcctcagtcaggacgattattttaggacgtggagtcccggcaaaccattcgaccaagcacttgatccagccaaggacccttgcctaaaaatgaagtgctcacgccataaggtgtgcatcgcccaggatagtcagaccgcagtttgtatcagccatcgtagactgacacacagaatgaaggaggcaggggttgaccaccgtcagtggcgaggccccattctttccacttgtaaacaatgtccggtcgtgtatccttcacccgtgtgcgggtctgatgggcatacttatagttttcagtgcaagttagagtatcaagcgtgcgtcttagggaaacagatctcggtcaagtgtgagggacactgtccttgtccgtccgataagccgacttccactagccgcaacgtgaaaagagcttgcagcgacttggaattccgcgaagtcgcaaaccgcctgagagattggttcaaagcgttacatgagagcggctcccagaacaagaagactaaaactttgctgcggcccgagagatctagattcgacacgtccatactacctatttgcaaggattcgctgggatggatgttcaacagactggacacaaactatgacctactcctagaccaatccgagctgagaagcatttatctggacaaaaatgaacagtgcacaaaagctttctttaacagttgtgacacttacaaggactcgctcatatcaaacaacgaatggtgttactgtttccaacgacaacaggaccctccgtgtcagacagaattgtccaatatccaaaagaggcagggcgtgaagaagcttttaggccaatatattccactttgcgacgaggatgggtactataagcccacacagtgccatgggtcagtgggccagtgctggtgcgtggaccggtatggcaatgaggtgatgggctcacggatcaacggtgtagccgactgcgccattgattttgagatctcaggtgactttgctagcggtgactttcatgaatggactgatgacgaggatgacgaggacgatatcatgaacgatgaggacgaaatcgaggacgacgatgaagacgaaggagatgatgacgacgggggggacgatcacgatgtttacatctag

SEQ ID NO: 135835 - DNA, 1311 bp, Artificial Sequence
  Description of Artificial Sequence: Synthetic coding sequence
atgctaaaagtgtccgcagtcttgtgcgtgtgcgccgctgcatggtgttcccagagtctcgctgctgccgctgccgtggcagctgccggcggaaggagcgacggaggcaattttctagatgataaacaatggctcaccaccatctcccagtacgataaagaagtggggcagtggaacaagtttcgagatgaggtggaggacgattatttcagaacatggtcacctggtaaacctttcgaccaggcacttgacccggcaaaagacccttgtctgaagatgaaatgttctaggcacaaagtatgcattgcgcaggattcccagaccgccgtgtgtatctcacaccgccggttgactcaccgaatgaaagaagcaggagtggaccaccggcagtggagaggacccatactaagcacctgtaagcagtgtccagtcgtctaccctagccccgtgtgcggcagtgacggtcacacctatagttttcaatgtaagctggagtatcaggcctgtgtcctgggtaagcagattagtgttaaatgtgaaggacattgtccttgcccttcagataaaccaactagcacatctcgaaatgtcaaaagggcatgcagcgatctggaattccgcgaggtggccaaccgcctccgagattggtttaaggcactgcacgaatcgggaagccagaataagaagacaaaaacacttctgagaccagagcgatcacggttcgacaccagcatacttcccatctgcaaggactctctgggctggatgttcaacaggctggatacgaactacgatctgctccttgaccagtcagagctgcgcagcatctacttggataagaatgagcaatgtaccaaggctttctttaacagctgtgatacatataaagacagcctcatttcgaacaacgagtggtgctactgtttccagaggcaacaagatcctccctgccaaacagagttgtctaatatccagaagagacagggggtaaaaaagctcctcggccaatatatccccctgtgcgatgaagacgggtactataaaccaactcagtgccacggctcagttggtcagtgttggtgcgttgaccgatatgggaacgaagtcatgggttcaaggattaatggggtggctgactgtgcaatagatttcgagatctccggagacttcgcctctggcgatttccatgaatggaccgacgacgaagatgacgaagacgatataatgaacgacgaagacgagatagaagacgacgacgaggacgagggggatgatgacgatgggggggacgaccacgatgtctacatctag

SEQ ID NO: 135836 - DNA, 1302 bp, Artificial Sequence
  Description of Artificial Sequence: Synthetic coding sequence
atgctcaaagtgtctgctgtgctgtgcgtttgtgccgccgcatggtgcagccagtctctggcagcagccgctgccgtggctgccgccggcggccgctccgacgggggcaacttcctcgatgacaagcaatggctgacgacaatttcccagtatgacaaagaggtcgggcagtggaacaaatttagagacgacgactactttaggacttggtccccagggaagcccttcgaccaagctcttgaccctgccaaggatccttgcttgaaaatgaagtgttctcggcacaaagtgtgcatcgcgcaggatagtcagacagcagtctgtatttcccatcggagacttacacatcgtatgaaggaagccggagtcgatcatagacagtggcggggacctatcctgtctacgtgcaagcagtgtccagttgtgtaccccagcccagtatgcggcagtgacggtcatacctacagtttccagtgcaagctcgaataccaggcgtgcgtcctgggcaagcaaattagcgtgaagtgcgaagggcactgtccttgtccaagcgataagccgacaagcacttctcgtaacgtgaaacgcgcctgtagcgaccttgaattccgcgaggtggctaataggcttcgggactggtttaaagccctccatgagagcgggtcccagaacaagaaaaccaaaactctgctccggcccgaacgttcccggtttgacacttcaatcctgcctatctgtaaggatagcttgggatggatgttcaaccgactcgacacaaactatgatctgctcctggatcagtcggaactccggtccatctaccttgacaaaaatgagcagtgtaccaaagcttttttcaattcttgtgatacttataaagattccttgatatccaacaacgaatggtgctattgcttccaaagacaacaagaccccccgtgtcagacagagctatcaaatatccagaagcgacaaggcgtcaagaagcttctggggcaatatattccgttgtgcgacgaagacggatactataagccaacccagtgtcacgggtcagtgggccagtgctggtgcgtcgatcgatatggcaacgaagtgatgggatctcggattaacggggttgctgactgcgcaattgacttcgaaattagcggcgacttcgcttctggggacttccacgagtggacggacgatgaagacgatgaggacgacattatgaacgacgaggatgagatcgaggacgacgatgaggacgagggtgacgatgacgatgggggtgatgaccacgatgtttacatttag

SEQ ID NO: 135837 - DNA, 348 bp, Artificial Sequence
  Description of Artificial Sequence: Synthetic coding sequence
atgctgaaggtcagcgcggttttatgcgtctgcgcggctgcatggtgcagccagagcctcgccgcagccgctgctgtagccgcagccggagggcgcagtgatggcggaaactttctggatgataagcaatggctcacgactatctcacagtacgacaaagaagtcggccaatggaacaagttcagagacgaggtcgaagacgattatttccgaacctggagtcccggaaagccctttgatcaagctctcgatcccgccaaggatccatgtctcaagatgaagtgttcaaggcataaagtatgtattgcacaggattcccaaacggcggtatgcatctctcatagatag

SEQ ID NO: 135838 - DNA, 1311 bp, Artificial Sequence
  Description of Artificial Sequence: Synthetic coding sequence
atgctgaaagtgtccgcggtcttgtgtgtgtgtgctgcagcgtggtgttcacaatcactggctgccgctgccgccgtggctgcagccggcggacgctccgacggcggaaactttctggacgacaaacagtggcttaccactataagccagtacgacaaggaagtaggccagtggaataaattcagagacgaggtcgaggacgattatttccgaacatggagccctgggaagccttttgatcaggccctggacccagctaaagacccttgcctgaagatgaagtgctctcgtcacaaagtctgcatcgcacaagattcgcagactgccgtgtgtatcagtcaccgccgcctgactcatagaatgaaagaagcgggcgtggaccaccgccagtggcgggggcccatactgtctacctgtaaacagtgccctgtggtatacccgtcccctgtgtgtgggagcgatgggcacacatattccttccagtgcaagcttgaatatcaggcatgcgtccttggaaagcagattagtgttaaatgcgagggtcactgcccgtgcccttctgataagcccacctctaccagtagaaacgtgaagagggcttgttctgatttagaatttcgggaagtcgccaataggctcagggactggtttaaagctctgcacgagtcaggctcccagaataaaaagaccaagacactgcttcgccccgaacggtctcggttcgacacatctatcttacctatctgtaaggattccctggggtggatgtttaacaggcttgataccaattatgatctgctgctggaccaaagtgagctgaggtcgatttatttggataaaaatgagcagtgtacaaaggcgttttttaattcctgcgacacttacaaggattctcttatctccaataatgagtggtgttactgttttcagcggcagcaggacccgccgtgccagacagagctctcaaacatacagaaaagacagggagtcaagaagctgttaggccagtatattccactgtgtgacgaagacgggtactataagcctacacagtgccacggctccgttgggcagtgttggtgtgttgatcgctacgggaatgaggtgatgggctctcgaattaacggtgtagccgactgtgctatagactttgaaatttcaggagattttgcttccggtgatttccacgagtggacagacgacgaggatgacgaagacgatatcatgaacgatgaggatgagattgaggacgacgacgaggacgagggtgacgatgacgacggaggcgacgaccatgacgtgtacatctag

SEQ ID NO: 135839 - DNA, 486 bp, Artificial Sequence
  Description of Artificial Sequence: Synthetic coding sequence
atgcttaaggtgagcgccgtcctgtgcgtgtgtgcggcggcttggtgtagtcagtcccttgccgctgccgctgcagtagccgctgcaggcggacgatcagacggcggcaatttccttgatgataagcagtggttgacgacgatcagccagtatgataaggaggtaggacagtggaacaagtttcgtgacgacgactacttccgcacctggtctccaggaaagccattcgaccaagctctggaccccgcaaaagacccctgtctgaagatgaaatgctccaggcataaagtttgcatcgcgcaagatagccagactgccgtgtgcatctctcatcgtaggctgacgcatcgcatgaaagaagccggagtggatcaccggcagtggagaggacctattttaagcacctgtaaacagtgtcctgtggtgtatcctagccctgtctgcggttctgacggacatacttacagctttcaatgtaagttgtag

SEQ ID NO: 135840 - DNA, 522 bp, Artificial Sequence
  Description of Artificial Sequence: Synthetic coding sequence
atgctgaaagtgagcgcggtgctgtgtgtttgcgccgccgcttggtgctcgcagtctctggccgcagctgcggccgtagccgcagcaggcggtagatccgatggcggcaattttctggatgataagcagtggttaacaaccatatcccagtatgataaagaggtgggccagtggaacaaattcagggacgatgattatttccgcacctggagccctgggaaaccgttcgatcaggcttgtagtgacctggagtttagggaggtggcgaatcgcctcagggactggtttaaggcactccatgagtccggcagccagaacaagaagacaaagacgctgctgagaccagagagaagtagattcgacacatcgattttgcccatctgcaaagactccctgggatggatgttcaacagactggacactaactacgatctgcttcttgaccagtccgagctacgaagcatctacctggacaagaacgagcaatgtaccaaagcttttttcaatagctgtgacacctag

SEQ ID NO: 135841 - DNA, 1182 bp, Artificial Sequence
  Description of Artificial Sequence: Synthetic coding sequence
atgttgaaggttagcgccgtgctctgtgtttgtgctgctgcttggtgctcacaatccctggcggccgccgcagccgtcgccgcagcaggtgggcggagtgatggaggtaatttcctggatgacaagcagtggttgacaactataagtcaatacgacaaggaggtgggacagtggaataaattccgcgatgatgattacttcagaacttggtcacccgggaagccattcgatcaggccctagatccagcaaaagatccttgtctgaaaatgaaatgcagtaggcacaaagtgtgtattgctcaagactcacagacggccgtctgcatctcccataggcgactgacgcaccgcatgaaggaggctggcgtcgatcaccgtcagtggcgggggcctattttgagcacctgcaaacaatgtccagtcgtttatccctccccagtatgcggctccgatggacacacctattcctttcagtgtaagctggagtaccaggcctgcgtgcttgggaaacagatttccgtgaagtgcgaaggccattgtccttgtccgtccgataaaccgacttcaactagccgtaacgtgaaaaggggatttgatactagcattctccctatctgcaaagactctttggggtggatgttcaacaggctggatactaactacgacctcctgctcgaccaatcagaactccgctctatatacttggataagaacgaacagtgtacaaaggctttctttaatagctgcgatacttataaggattcattaatttccaacaacgagtggtgctattgcttccagcgacaacaggaccctccatgtcagaccgaattgagtaatatccagaagaggcagggcgttaagaaactgctggggcagtacatacctctgtgcgacgaagatggctactacaaaccaacacagtgtcacgggagcgttggacagtgttggtgcgttgaccggtatggaaatgaggtcatgggctctagaatcaatggagtggccgattgtgcaatagactttgagataagcggcgatttcgctagtggagatttccacgaatggaccgacgatgaggatgatgaagatgacattatgaatgatgaggacgagatcgaagacgatgacgaagatgagggcgacgatgacgatggtggagacgaccatgatgtgtacatttag

SEQ ID NO: 135842 - DNA, 1302 bp, Artificial Sequence
  Description of Artificial Sequence: Synthetic coding sequence
atgctgaaggtgtccgcagtgctctgtgtgtgcgctgcagcttggtgttcacagtcattggcagctgcagcagccgtggctgccgccggtgggaggtcggatggggggaatttccttgacgacaaacaatggctcaccaccatctcccagtatgataaagaagtcggacagtggaacaagttcagagacgatgattattttagaacatggagtccaggtaagccatttgatcaagccctggacccggcaaaagatccttgcctcaagatgaagtgcagccgtcacaaggtgtgcattgcgcaggatagccagacagcggtctgtattagccaccggcgtttaacgcatcgtatgaaagaggctggggtggaccacaggcagtggaggggtcccattctatccacatgcaagcaatgtcccgttgtttacccctcacctgtttgtggtagtgacggacacacctactctttccaatgtaagttagaataccaggcttgcgttctgggtaaacagatctcagtcaaatgcgaaggtcattgtccgtgcccttcagataaacctacgagtacctctagaaatgtgaagagggcctgctccgaccttgagtttcgagaggtcgccaaccgccttagagactggtttaaggctctacacgagtcgggcagccagaacaaaaaaacaaagaccctgcttcggcccgagagaagccggttcgatacgtcaatcctgccgatctgtaaagattcacttggctggatgtttaatcggctggatactaactacgacttgttgctggaccaatcggagttaagatccatctatttagacaaaaatgaacagtgtacaaaggctttctttaactcgtgtgacacatataaggactcactcatttcaaacaatgaatggtgctactgctttcagcgccagcaggacccgccttgtcaaacagagctttccaacatccagaaaaggcagggcgtgaagaagttgctgggtcagtatattcctctttgcgacgaagatggctactacaagccgactcaatgtcatggatccgtggggcagtgctggtgcgtggaccgatacggcaatgaggtgatgggttcccggattaacggggttgcagattgcgccatcgatttcgaaatttccggcgatttcgcgagcggtgattttcacgagtggaccgatgacgaggacgatgaggacgatatcatgaacgacgaggacgagattgaagatgacgacgaagacgagggcgacgacgacgacggcggagatgatcacgacgtctacatttag

SEQ ID NO: 135843 - DNA, 1311 bp, Artificial Sequence
  Description of Artificial Sequence: Synthetic coding sequence
atgctgaaggtctcagcagttctatgcgtctgtgcggcagcctggtgctcccagtccctggcggctgcggctgctgtggctgctgctggcggcagatctgatggaggcaactttctggatgacaaacagtggctcacaaccatttcacagtatgacaaggaagttggccagtggaataagtttagagacgaggtagaggatgactactttcgaacgtggtcacccggcaaacccttcgatcaggccctagatcctgcaaaggatccttgtctgaaaatgaagtgcagtaggcacaaggtctgcatagcacaggattcccagactgccgtctgcatcagtcacaggagattgacgcatcgaatgaaggaggcgggcgtggaccatcgccagtggcgggggccaatactgtcaacctgcaaacaatgccccgtggtctacccaagccctgtctgtggaagcgacggccacacctattcatttcagtgtaaattagagtaccaggcgtgcgtacttggcaagcagattagtgtcaaatgtgagggacactgtccatgtccttcggataaacctacctcgacttctagaaacgtcaaacgggcatgtagcgaccttgagtttcgtgaggttgctaatagactgcgtgattggtttaaagccctgcatgaatccggcagtcagaacaaaaagacaaagactctacttcggcctgagcggagccgcttcgatacttccattcttccaatttgcaaggactccctaggttggatgttcaacagactggacaccaactatgacctgctgctggatcagtctgagctgagatccatctatttagacaaaaatgaacaatgcaccaaagcattcttcaattcgtgcgatacatacaaggactctctcatcagcaataacgagtggtgttactgtttccagagacagcaggatccaccttgtcagaccgaactgtctaatattcaaaaaagacagggtgtgaagaagcttctgggacagtacatcccactatgcgacgaggacggctattacaaaccaactcaatgccacggatctgttggacagtgctggtgtgtggaccggtatggcaacgaggtaatgggaagccggatcaacggagtcgctgactgtgcgatcgatttcgagatctccggggacttcgcctcaggcgattttcacgagtggaccgacgatgaggatgatgaagatgatatcatgaacgatgaagatgagattgaggacgacgatgaggacgaaggggatgatgacgatgggggagacgaccatgatgtttatatctag

SEQ ID NO: 135844 - DNA, 348 bp, Artificial Sequence
  Description of Artificial Sequence: Synthetic coding sequence
atgcttaaagtaagcgcagtcctgtgcgtgtgcgcggccgcctggtgcagtcagagcttggccgcggccgctgctgtagctgcagcaggagggagatccgacggcgggaattttctggatgataaacaatggctgactacgatcagccagtacgacaaggaggtaggccagtggaataagttccgtgatgaggtggaggacgactacttccgaacgtggtcccctggtaagccgttcgatcaggccctggatccagccaaggatccttgcctaaagatgaaatgttccaggcataaggtgtgtattgcccaggatagtcaaactgcagtgtgtatctctcatcggtag

SEQ ID NO: 135845 - DNA, 942 bp, Artificial Sequence
  Description of Artificial Sequence: Synthetic coding sequence
atgctgaaggtatctgccgtgctgtgcgtgtgtgccgccgcttggtgctcccagagcctggctgcagctgccgcagttgcggcggctggaggccgctccgatgggggaaatttccttgatgataaacagtggctaacaactatatcccagtacgacaaggaagttggccagtggaacaagtttagggacgatgattattttcggacctggtctcccggaaagcccttcgaccaggcgttagatcctgccaaagatccgtgcctgaagatgaaatgcagtcgccacaaggtttgcatcgcacaggacagccaaactgcagtttgtattagccacagacgactcacccatcgtatgaaagaagccggggtcgaccacagacagtggcgcggaccaattctgtccacatgcaaacagtgtcccgtcgtctatccgtctcccgtgtgtgggtctgacggccacacctatagcttccagtgtaagctcgaatatcaagcatgcgtcctcggcaaacagatttctgtgaaatgcgaggggcactgtccctgtcctagcgacaagcccacatcgacgagtaggaatgtaaaacgcgcgtgctctgaccttgaattccgggaagttgcgaatcgtctccgcgactggttcaaggccctgcacgagtccggctctcagaacaagaagaccaagactcttctgcgccctgagcgaagccgtttcgatacctctattctacccatatgtaaagactctctggggtggatgttcaacagattggatacaaattacgatctgctgctcgaccaaagcgagctgcgtagcatctatctggacaaaaacgagcaatgtactaaagcatttttcaactcgtgcgacacgtacaaagacagtctcatctctaataacgagtggtgctactgcttccagcggcagcagggaaaaaggtag

SEQ ID NO: 135846 - DNA, 1017 bp, Artificial Sequence
  Description of Artificial Sequence: Synthetic coding sequence
atgctgaaagtctcagccgtgttgtgcgtctgtgctgctgcatggtgttcccaatctcttgccgcggccgcggctgttgctgccgctggcggtaggagtgacggcggaaactttttggatgataagcagtggctgactacgatctctcagtatgacaaagaggtgggtcagtggaacaaatttcgcgattgtaagctggaataccaggcatgtgtactgggcaaacagattagtgttaaatgcgagggccattgtccttgcccctcagataagcccacatctacaagccggaacgtgaaacgggcttgctcggatctggagttccgtgaagtggccaaccggttgcgggactggttcaaggcactgcatgaatcaggctcgcaaaataaaaagaccaagaccctcttgcgccccgagcgatcaagatttgacacctctatcctcccaatttgtaaggattcactcggatggatgttcaaccgacttgataccaattatgacctgttgctcgatcagagcgaactaaggtcaatctatctcgacaaaaacgaacagtgtaccaaggctttcttcaacagttgcgacacgtataaagacagcctaatctccaacaacgagtggtgctattgcttccagcgccagcaggaccctccctgccaaactgagttgtcgaatatccagaaacgccagggcgtgaaaaaacttctgggacaatatattccattgtgtgacgaggacggttactacaagcctacccaatgtcatgggagtgttgggcagtgttggtgcgtggaccgatatggaaatgaggtgatgggctctcgtattaacggagtggccgactgcgcgatcgattttgaaatttcaggcgactttgcaagcggagattttcatgagtggacagacgatgaggatgacgaggatgacattatgaacgatgaagacgagatcgaggacgatgatgaggacgagggagatgacgacgacggcggcgacgatcacgatgtgtatatctag

SEQ ID NO: 135847 - DNA, 1023 bp, Artificial Sequence
  Description of Artificial Sequence: Synthetic coding sequence
atgataaacaacgggagccctcagtccctaagtatgactcggaagagcgacagtgggactaacagtgaaacaatgaaagaagctggtgtggaccatcgtcagtggcgaggcccaatccttagcacttgcaagcaatgccccgtcgtctacccttcaccagtgtgcgggtcagatgggcatacgtactcctttcaatgtaaactggagtaccaggcctgcgtcttgggtaaacagattagtgtcaagtgtgagggccactgcccttgcccatccgacaagcccacgtctactagccgaaacgtaaaaagagcttgttccgacctcgagttcagggaggtggctaaccgcctgcgggactggttcaaagcacttcacgagtctggctcacagaacaaaaaaactaagactctgcttcgccccgagcggagcagattcgacacctccatactgccaatttgcaaggattccctaggatggatgtttaaccgactggacactaactacgacttactgctggaccagagtgaattacggagtatctacctagacaagaacgaacaatgcaccaaagctttctttaactcatgcgatacttacaaggattcactcatctccaataatgaatggtgttattgctttcagagacagcaggaccccccttgtcaaactgaactgagcaatattcaaaaaagacagggtgtcaaaaagctgctgggtcagtacattccactatgcgatgaggatggctactataaacctacccagtgccatgggtctgtgggtcagtgctggtgcgtggatagatacgggaatgaggttatgggttccagaatcaacggcgtagctgattgtgccatagactttgaaataagcggtgatttcgccagcggggactttcatgagtggaccgatgacgaggacgatgaggatgatatcatgaatgacgaagatgagatcgaagatgacgacgaggatgagggagacgatgatgacggcggcgatgaccacgacgtttatatatag

SEQ ID NO: 135848 - DNA, 915 bp, Artificial Sequence
  Description of Artificial Sequence: Synthetic coding sequence
atgaagtgctctcggcacaaagtttgtatcgctcaagactcacaaaccgcagtctgcattagtcacaggcggctcacacatcgcatgaaggaggcaggtgttgatcacagacagtggcgagggcccatcttgtcgacctgcaaacagtgccctgtcgtctaccccagccccgtgtgcggatctgacggccatacctactcctttcagtgcaagcttgaataccaggcatgcgtgttgggaaaacagatttctgttaagtgcgaggggcattgcccctgtccctcagacaagccgacaagtacatccagaaatgtcaagcgcggattcgacaccagtatcctcccgatctgcaaagattctctgggttggatgtttaaccgtctggatacaaattacgacctgctcttagatcagagtgagctgaggtctatttaccttgacaagaatgaacaatgcaccaaggcgttctttaacagctgtgacacgtacaaggacagtctgattagcaataatgagtggtgctactgctttcagcgccagcaagacccaccatgccagacagagctctccaacatacaaaagagacagggagtaaaaaaattattagggcagtatatccccctctgtgacgaagatgggtattacaagccgacccaatgccacggctctgtgggccaatgctggtgcgtggaccggtatggaaatgaggtaatgggctcccgaattaacggggtggctgactgcgcaatcgattttgagatctctggcgacttcgcctctggtgactttcatgaatggacagatgatgaggatgatgaagacgatataatgaatgatgaagacgaaattgaagatgatgacgaggatgagggagatgatgacgacggaggtgatgatcacgacgtgtacatctag

SEQ ID NO: 135849 - DNA, 951 bp, Artificial Sequence
  Description of Artificial Sequence: Synthetic coding sequence
atgaaagaggcaggcgtggaccacagacagtggcgtggtccaatactcagcacatgcaaacagtgtccagttgtatacccctcaccagtctgtggcagcgacggccacacctattccttccaatgtaaactggagtatcaagcgtgtgtgttaggcaagcaaattagcgtgaagtgtgaaggacattgcccctgtccctccgacaagccaaccagcaccagcaggaacgtgaaacgggcttgctctgacctcgaatttcgggaggtggccaatcgattgcgagattggtttaaggcccttcatgagagtggcagccagaacaagaagactaagactttactgagacctgagaggtccaggttcgacaccagcatcttgcctatctgcaaggattccctcggttggatgttcaatagattggatactaactatgaccttctgctggaccagagcgagttgaggagcatctacctcgacaagaatgaacagtgcacgaaagccttctttaacagctgtgacacttacaaggactcattgatatcaaataacgaatggtgctactgttttcagcgccagcaagacccaccctgccagacagagctcagtaatattcaaaaaagacagggagtcaaaaaactgttggggcaatatatcccactgtgcgacgaagacgggtactacaagcccacacagtgtcacgggagtgtgggccagtgttggtgcgtagaccgctacgggaatgaagttatgggctccaggattaatggggtggccgactgcgccattgacttcgagatttccggtgatttcgcctctggagactttcatgagtggaccgacgatgaggacgatgaggatgatatcatgaacgacgaggacgaaatcgaggatgacgatgaggacgagggagatgatgacgatgggggggacgatcatgacgtatacatttag

SEQ ID NO: 135850 - DNA, 1017 bp, Artificial Sequence
  Description of Artificial Sequence: Synthetic coding sequence
atgctgaaggtgagcgccgtgctgtgcgtctgcgcagcggcgtggtgctcccagtctctagctgccgccgccgcagtggcagccgcaggaggacggagcgatggaggcaacttcctggacgacaagcagtggttgaccaccatctcccagtacgacaaggaggtgggtcagtggaacaagtttcgagattgcaaactggagtaccaggcgtgtgtgctgggaaaacagatctccgtgaagtgcgagggccactgtccgtgcccctccgacaaacccacctccactagtcggaacgtgaagcgggcttgctcggacttggaatttagagaagttgccaatagactgcgagactggttcaaagccctccacgagtcaggctcccagaacaaaaaaaccaaaacactgctgcggccagaacgtagtcggttcgacacctctattttgccaatatgtaaggatagccttgggtggatgttcaaccgcttggataccaattacgacctcttactggaccagagcgaattgaggagtatttaccttgataaaaatgaacagtgcacaaaggctttttttaacagctgcgatacttataaggactcactcataagcaataatgagtggtgttattgctttcaacgacagcaggatcccccctgccagaccgagctgtctaatatacaaaaaaggcaaggcgtcaagaaactgctcggccagtacattcctctgtgcgacgaggacgggtactataagcccacgcagtgccatggctcggtgggacagtgttggtgcgtggaccgctacggtaacgaggtaatgggcagtaggatcaatggcgttgcagactgtgctatagattttgagatctccggcgactttgccagcggcgactttcacgaatggacagatgatgaagacgatgaggatgacatcatgaacgacgaggatgagattgaagacgacgatgaggatgagggcgacgacgatgacggcggcgacgatcatgacgtgtatatttag

SEQ ID NO: 135851 - DNA, 13740 bp, Artificial Sequence
  Description of Artificial Sequence: Synthetic coding sequence
atggagacgaaggaaaaccgatgggtgcctgtcaccgtgctgccagggtgtgtggggtgccggaccgtggcagcgttggccagctggacagtgagggacgtgaaagagagaatcttcgcggagactgggttccccgtgagcgaacagaggctttggagaggcgggcgggaactgtcagattggatcaagatcggggacctgacttccaagaattgccatctctttgtgaacctccaatcaaagggcctgaagggcgggggtagattcggacagaccaccccgcctctggttgacttcctcaaagacatcctccggcgctacccggagggaggacagattctaaaggagctaattcagaatgcagaagacgccggcgcaacagaggttaagtttctgtatgacgagacgcagtacggtacagaaacactctggtccaaggatatggcaccataccaagggcccgccctgtatgtttacaataacgcagtgtttacccccgaggactggcatggtatccaagagatcgcccggagtcgcaagaaagatgatccgttgaaggtgggtcgctttggcatcgggtttaactcagtataccacatcactgacgtaccatgcatctttagcggcgatcagattggtatgctggaccctcaccagacccttttcggacctcacgagtccggacagtgctggaatcttaaagacgattctaaggagatttccgaactaagcgatcagttcgcaccatttgtcggaattttcggttccactaaggaaacattcatcaatggaaatttccccggcaccttctttcggttccctctacggcttcaaccaagccagctctcaagcaacttgtataacaaacagaaagtgctggaactgttcgagagcttccgagctgacgcagatactgtgctgctgtttctgaagagcgttcaagatgtgagcctctacgtgagggaggccgatggcaccgagaaactggtgttccgtgtcacctcttctgaatccaaggctctaaaacatgagcgccccaatagtatcaagattctcggaacagctatttccaattattgtaagaagactcccagcaataatattacatgcgtgacctatcacgtaaatattgttttggaggaggaatcaacaaaagatgctcagaagaccagctggttggtgtgcaactctgttggcggaagggggatttcgtctaagctcgacagcctcgccgatgaactgaagtttgtgcctataatcggcatagctatgcccctctccagcagggacgatgaggccaagggcgcgaccagcgacttcagtggcaaagccttttgctttctccccctgcctcccggcgaagagagcagcactggtctgcctgtacacatctcagggttctttggcctcacagataataggcggagtataaaatggcgcgaactcgaccagtggcgggatcccgcagcactctggaatgagtttctcgtgatgaatgtggtgccaaaggcatacgctacactgattctggattccatcaagcgcctcgaaatggaaaaatcaagtgactttccactcagcgtggatgtcatttataaactatggcccgaagcgtctaaggtgaaggtgcattggcagcccgtcctcgagcctttgttctctgaattgctgcagaacgccgtgatttacagcatcagttgcgactgggtaagactggagcaggtgtacttttcagaacttgatgaaaatctagagtacacgaagaccgtgctgaactacctgcagagctccggcaaacagatcgccaaagtccctggaaatgtggatgccgccgtgcagctgacggccgcttctggtacgactcctgtaagaaaagtcacacctgcgtgggtacggcaggtacttaggaaatgtgctcatctgggctgcgcagaagagaagctgcacctgctggagttcgtgctctctgaccaggcatattcagagctccttgggctggagctactaccccttcagaatggtaatttcgtgcctttctcctcaagtgtaagcgaccaagacgtaatatatatcacttctgctgagtaccctagaagcctgtttccctccctggaaggcagatttattctcgataacttaaagccacacctggttgccgcactcaaggaggccgcccagactagagggaggccgtgcacccagctccagctgctcaaccccgagcgctttgcacggctgatcaaagaggtgatgaatactttctggcctggaagagaactcattgtgcagtggtatccctttgatgaaaaccgcaatcatccaagtgtctcgtggttgaagatggtatggaaaaatttgtacatccacttttctgaagacctgaccctgtttgacgagatgccactcatccccagaaccatactggaggagggccagacatgtgtggaactgatccggctgcgcataccaagtttagtgatcctggacgatgaatctgaagcccaactgccagagtttctggccgacatcgttcagaaactgggcggctttgtcctcaaaaaactggacgcctcaatccagcatcctttaataaagaaatacattcacagtcccctcccttctgcagtgctgcagatcatggagaaaatgcccctccagaagctctgtaatcagatcacaagcctgttaccaactcacaaggacgcgctccgtaagttcctggcatccctcacagactcctcagagaaagaaaaacgcataatccaagaactagccatatttaagagaatcaatcactcctcggaccaggggatttcttcgtatacaaaactgaagggatgtaaagtactccaccataccgctaaactgcccgccgatttgcgcctttccatctccgtaatcgattcatctgacgaagcaaccatcagactggccaatatgctcaaaatcgagcagctcaaaaccaccagttgcctgaagctggtgctgaaggatatcgaaaacgccttttattctcatgaagaggtaactcaactgatgctttgggtcctggagaatcttagttcgttaaagaatgagaatcctaatgtgctcgagtggctaactccactcaagtttattcaaatcagccaggaacagatggtatcggcgggtgagttgtttgaccctgacattgaagtgcttaaggatctgttctgtaacgaggaaggaacgtattttccaccctctgtgtttacctccccagatatcctccactctctgagacagattggtctgaagaacgaggcatctttgaaagaaaaagacgtagtccaggtcgccaagaagattgaggccctacaggtaggcgcctgcccagaccaggacgtgctgctcaaaaaagccaagacgctactccttgtcttgaataagaaccataccttacttcagtcatcggaggggaaaatgacgctgaagaagatcaaatgggttcccgcttgcaaggaacgaccaccaaattatcccggttctctggtgtggaagggagacctgtgcaatctgtgcgctccgccggacatgtgcgacgtggggcacgctatcctgataggatctagcctcccccttgtggagagtatccatgtgaatcttgaaaaagctttgggtatctttacaaagccctccctgtccgcggtgctgaaacacttcaaaatagtggtagactggtacagtagcaagacttttagcgatgaggattactatcagttccagcacattcttctcgagatctatgggtttatgcacgaccaccttaacgagggcaaagactctttccgtgcccttaagttcccctgggtctggactgggaagaaattctgcccattagcacaggcagttattaagccaatccacgatctcgatctgcagccctatcttcacaatgtcccaaaaacaatggccaaattccaccagctcttcaaggtctgcggctctattgaggaactaacctccgaccatatcagtatggtgattcagaaaatttacctgaagagcgaccaagatctgagcgagcaagagagcaaacagaatctccatctgatgttgaacatcattcggtggctgtatagtaaccagatcccagcgtcaccaaacaccccagttccgatccaccatagtaaaaaccccagtaagctaataatgaagcccatccatgagtgttgctactgtgatatcaaagtggacgacctgaacgatctcctggaggattccgttgaacctattattctagtgcacgaggacattccaatgaagactgccgagtggctcaaggtcccttgtctctctaccagactcattaaccccgagaacatgggtttcgaacagagtgggcagagggagccactgactgtaaggattaagaatatcctggaggagtacccctccgtgagcgacattttcaaggagctcctccagaacgccgatgatgctaacgcaacagaatgctcctttcttattgacatgagacggaatatggacattagggagaatttgttggatcccgggatggctgcatgtcacggccctgctctgtggagctttaataactcccagttcagcgatagcgatttcgtcaacatcacccgtctgggagagtccctgaaaagaggggaggtcgataaagttggcaagtttggattaggcttcaatagcgtttatcacattacagatattcccatcatcatgagccgcgagttcatgatcatgttcgaccccaatatcaatcatatcagtaagcatattaaggataaatcaaacccgggcattaaaattaactggtctaagcagcagaagcgattgaggaaattccctaaccagttcaaacctttcattgatgtgttcggttgtcaactgcctttaacagtggaggcaccatatagctacaacggcactctctttaggttgagctttaggacccagcaggaggcaaaggtcagtgaagtctcctcgacatgttacaatactgcagatatatacagcttggtggatgagttcagtctctgcgggcataggcttatcatctttacacagtccgtgaaatctatgtacctgaagtacctaaaaattgaggagactaatccgagcctcgcccaagataccgtcattatcaaaaaaaagtcatgctcttctaaagcgttaaacactccggtcctctcagtgttgaaggaagccgccaaactgatgaagacatgctcatctagcaacaagaagctgccctctgacgagcctaaatcctcgtgcattttacagatcaccgtggaggagttccaccacgtattcagacggatcgcagatttacagtctcctctcttccggggccccgacgatgatcctgccgctctgttcgaaatggcaaagtcgggacagagtaaaaaaccttcagatgaactgtcacagaaaactgtggagtgtaccacatggctcttgtgtacttgtatggacaccggcgaggcccttaaattcagcctatcggagtccgggagacggctcggcctcgtgccttgcggagcggttggtgtacagctgagcgagatccaagaccaaaaatggacagtgaagcctcacatcggcgaagtgttttgttatctgcccctccgcatcaaaaccggattaccggttcatatcaacgggtgctttgctgtgacttcaaatagaaaagaaatctggaaaacagatacaaaggggagatggaacactacgttcatgcgtcacgttattgttaaggcatacctgcaggtgctttccgttctgagagacctggctacctctggggaactcatggattacacatactacgccgtgtggccagatcctgacttggtccacgacgatttttccgtcatctgtcaaggtttttatgaggatatcgctcacggcaaggggaaggaactgactaaggtttttagcgacgggtcaacgtgggtgtccatgaaaaacgtccgcttcctcgatgactcaatcctgaagaggcgggatgtggggtctgcagccttcaagatttttctcaaatatttgaaaaagaccggctcaaaaaatctctgtgccgttgaactgccttcaagtgtaaagcttggctttgaggaggcaggctgcaaacagattctcttggagaacaccttcagtgagaagcaatttttctcggaggtattcttccctaatatacaggaaattgaagcagaactgcgggatccactcatgatcttcgttctgaacgaaaaagtggacgagtttagtggtgttcttcgggtgaccccatgcatcccatgctcccttgagggccatccattagtcctcccttcccggttgattcatcccgaaggcagggtggccaagctatttgacatcaaagatggacggtttccgtacggaagcacacaagactaccttaaccccatcatcctaatcaagctggttcaactcggcatggcgaaagacgatatactgtgggacgacatgctggaacgggccgtctctgtagctgagattaataaatccgatcacgtggccgcttgcctgaggtcttctatcctcctgtccctgatcgacgaaaagctgaagatccgggacccaagggccaaggattttgccgcaaagtatcagaccatccggttcctcccatttctgacaaaaccagctggcttttccctggattggaagggtaatagctttaaacctgaaacaatgtttgccgcaactgacctttacactgccgagcatcaagacatagtgtgcctgctgcagcccatcctgaatgaaaatagccacagcttccgaggatgcggctcagtgtccctcgcagtaaaagaattcctgggtcttctgaagaaaccaaccgtggacttggtgattaaccagcttaaagaagtggccaagtccgtggacgacggcattacactgtatcaagagaatatcaccaatgcctgctacaagtatttacatgaggctctgatgcagaacgaaattactaagatgtcaattatcgataaactgaaaccattctcctttatcctggtggaaaatgcttatgtggattcagagaaagtatccttccatttaaattttgaggcagccccatatctgtatcaactaccaaataaatacaaaaacaattttcgcgaactgttcgaaactgtgggggtgcggcagtcctgcacagtggaggatttcgccctagtattggaaagtatcgatcaggagcgaggaacgaaacaaatcactgaggagaactttcaactttgccgacggattataagcgaagggatctggtctttaatcagggaaaaaaaacaagaattttgcgaaaaaaactacggaaagatattacttccggatactaatctcatgcttctgcctgctaaatccctgtgctataacgactgtccttggatcaaggtgaaggatacaactgtgaaatattgtcacgcagatattccacgggaagtggccgtgaagttgggagctgtccctaaacgccataaggccctggaaagatacgcttctaacgtgtgttttacaacactcggcaccgagttcggtcagaaggagaagctgacctcacggattaagtcaattctgaacgcatacccttccgagaaggaaatgttgaaggagctcctgcagaatgcggatgatgccaaagccacagaaatctgttttgtcttcgatccacggcaacacccagttgacaggattttcgatgacaagtgggcccctttacagggaccagctctgtgcgtttataataaccagccctttactgaggatgatgtgcgcggaattcagaatctcgggaagggaacgaaggaaggaaatccctataagacggggcagtacggcatcggctttaattcagtatatcatatcacagactgccctagcttcattagcggcaatgatatcctttgtattttcgatccgcatgctcgctacgcgcccggagcaactagcatctcaccggggcgaatgtttcgcgacctggatgcagactttcgaactcagttctccgacgtactggatctctacctgggaacccactttaagctagataactgtaccatgtttagatttcccctgagaaacgcagagatggcaaaggtctcagaaatttcttccgtccctgcctccgaccggatggtccagaatttgcttgataaactgaggtccgatggcgccgaactgttgatgtttctgaaccacatggagaaaatctctatatgcgagattgataagagcacaggcgccctaaacgtgctgtatagcgtgaagggaaagataacagacggagaccgtctgaaaaggaagcaatttcacgcatccgttatcgacagcgtaaccaagaagcggcagctgaaggatatacccgtccaacaaatcacttacactatggatacagaggattctgaaggtaacctcaccacttggttgatttgcaatcgctccggttttagctccatggaaaaggttagtaagtccgtgatctctgcacataaaaatcaggacataaccttgtttccccggggaggcgtcgcggcatgtataacgcacaactacaagaaaccccatagagctttctgtttcttgcctctgagcctggagaccggcctgccctttcatgtgaacgggcactttgctctggattctgccaggagaaacctgtggcgggatgacaatggcgttggcgtgcgatcggactggaacaactcccttatgaccgctttgatcgcccctgcatatgtggaattgctgatccagctcaagaaacgatacttcccaggaagtgatccgacccttagcgttttgcagaatacccctatccacgtagtaaaggataccctcaagaagttcctgtctttctttcccgtaaataggttagatctgcagccagacctgtattgcctagtgaaggctttatacaactgtatccatgaggatatgaagcggctgctacccgtagtgcgggcgccaaatatagatggaagcgacttgcacagcgctgtcattataacctggataaacatgagtaccagtaacaagacccgaccgtttttcgacaatctcctgcaggatgagctgcaacatctgaagaatgccgactataacatcactactaggaaaaccgttgctgagaacgtgtatagactcaagcacctcctcctagagatcggattcaatctggtctataattgtgacgaaactgccaatttgtaccactgcttaatcgacgcagatattccagttagttacgtcacccccgcagatatccggagctttctgatgaccttcagcagtcccgacaccaactgccacattgggaaactgccgtgtcggcttcagcagactaatctaaagctgtttcactcactgaaacttctcgttgattactgttttaaggatgctgaggaaaacgaaattgaagttgaagggttacctctcctaattacgcttgactcagtgcttcagacattcgatgccaagaggccaaagtttctgacaacataccacgaactgatcccctcgagaaaggacctctttatgaataccttatacctgaagtactccaatatcctgctgaactgcaaggtagccaaggtatttgatatctcaagttttgcggatcttctgagctccgtactaccccgggagtataaaaccaagagttgtaccaaatggaaagataatttcgcttctgagtcctggctgaaaaatgcttggcattttatctccgaatccgtctccgtaaaagaggatcaggaggagacaaaacccacttttgacatagtcgtggatactcttaaagactgggcactgcttccaggtaccaagttcacagtatcagctaaccagttggtggtgcccgagggcgatgtgctgcttccactgagcctaatgcatattgctgttttcccgaacgctcagagcgacaaggtgtttcatgccctgatgaaagctggatgcatccagctcgcccttaataagatttgtagcaaggatagcgcattcgtaccgttactaagctgtcacaccgctaacattgagtcaccaactagtattctcaaggccctgcattacatggtacagacctctaccttcagagccgaaaagctggtggagaatgactttgaggcgctgctgatgtactttaactgtaatttaaatcacttaatgagccaggacgatatcaaaatcttgaaaagcctgccttgttataagtccatttctgggagatacgtctcgatcggtaaattcggaacctgttacgtactcaccaagtcaattcctagcgccgaggtggaaaagtggactcagtcttcttcctctgccttcttggaggagaaaattcatttgaaagagttatatgaggtcatagggtgcgtacccgtcgatgacctagaagtttacttaaagcacctgcttccaaaaatcgagaatctcagctatgacgccaaactggaacatcttatctatctgaaaaaccggttatcctcagcagaagagctctcagaaatcaaagaacagctattcgagaagctggagagtttattgatcatccatgacgcgaatagcaggctcaagcaggcaaagcatttctatgacagaactgttagggttttcgaagtgatgctgcccgagaagctcttcatcccaaatgatttctttaaaaaactagaacagttgattaagcccaagaaccacgtcacctttatgactagttgggtcgaattcttgcggaacattggtcttaagtatatattatctcaacagcagctgctgcagttcgccaaggagatctcagtgagggccaacactgagaactggtctaaagagaccctgcagaacacagtggacatcctgttgcatcatatttttcaggagcgaatggatcttctatccggtaatttcctcaaagagctgtctctgataccattcctgtgccccgagcgcgccccagccgaatttatacgttttcacccccagtatcaggaggtgaacggtacattgcccttgatcaaatttaatggagcgcaggtgaatcccaagtttaaacaatgtgacgtattacaactgctgtggacgtcgtgcccgatcctccctgaaaaggccactccgctttctattaaggaacaggaaggttctgacctggggccacaggaacagctagaacaagtactcaatatgctcaatgtcaatctcgacccccctctggacaaggtgatcaataactgccgcaacatttgtaacatcacaactttggatgaagaaatggtaaaaaccagagcaaaggttctaaggagcatatacgagttcctcagtgctgagaaaagagagtttcgtttccagctgcggggagtcgcctttgtaatggttgaagatgggtggaagctactcaaacctgaggaggtggtgattaaccttgagtatgagagcgacttcaaaccctatctctacaagctgcctttggaactggggacctttcatcagctgtttaagcacctgggaactgaggacattatctccacgaaacagtatgtggaagtgctctctcggatcttcaagaactctgaaggtaagcagctggaccctaacgagatgcgtacagtgaaaagggtggtgtccgggctgtttcgctctctgcagaatgatagcgtcaaggtgcggagcgacctggaaaacgtgcgagacctcgcattgtatcttccatcccaggacgggaggctggtgaagtccagcatccttgtgtttgacgatgctccgcattacaaaagccgcattcagggaaacattggggtacagatgcttgtcgacctgtcacagtgttatcttggaaaggatcacgggtttcacaccaagctgataatgctgttccctcagaagctgagaccacgccttttgtcctctatcttggaagagcagcttgatgaggagacccccaaggtgtgtcagtttggcgctctgtgctctctgcagggacgactgcagctgcttctcagtagcgagcagttcattaccgggctcatcagaatcatgaaacacgaaaacgataatgcattcttagctaatgaggagaaggcaattcgcctgtgcaaggctctcagagaaggcctgaaggtttcttgctttgagaagttacagaccacgctgcgggttaagggattcaacccaattccacactcccgaagtgagacttttgcatttttaaagaggttcgggaacgccgtcatactactctacattcaacactccgacagcaaagatatcaatttcctgctggcactggccatgacattgaaatcagccacagataatctgattagcgatacgagctatctaatcgctatgctgggctgcaatgatatataccgaatcggtgagaaactcgatagtctcggagtgaaatacgactcaagcgaaccttccaagctggagttacccatgccaggtacccctattccagcagagattcactatacattgttgatggatcctatgaacgtgttctatcctggggagtatgttggatacctagttgatgctgaggggggcgacatctatgggagttaccagcccacttatacatacgccattatcgtacaggaagttgagcgcgaagatgccgacaattcatctttccttggaaagatttaccagatcgatattggctactccgagtataagattgtgtcatctctagacctgtacaaattcagccggcccgaggaatcctctcagtccagggactcagccccatctactccgacttctccaaccgagtttctgacacccggactccggtccatccctcctctgttcagcggccgagagtcccacaagacttcatccaaacatcaatcccccaaaaaactgaaagtaaactcattaccagagattctcaaagaggtgacgtccgtcgtggaacaggcgtggaaactgcccgagtctgaacgcaagaaaatcataaggagactttacctgaagtggcaccccgacaaaaatcctgagaaccatgatattgccaatgaagtattcaagcacctgcagaacgagattaacaggctcgaaaagcaagcctttcttgaccagaacgccgatcgggccagtcgaagaaccttcagcacgagcgctagtaggtttcaaagtgacaaatatagcttccagagattctatacatcttggaaccaggaggccactagccacaaaagtgagaggcagcagcagaacaaagagaagtgtcccccgagtgccggccagacatacagtcagcgtttcttcgtgcctccaactttcaagagtgtgggcaatcccgtggaagccagaaggtggctgagacaggctcgggctaatttctctgctgcaagaaacgatttacacaaaaacgctaacgagtgggtgtgcttcaaatgttatttatccactaaactagcgctgattgcagctgattacgccgtgaggggaaaatcagataaagatgtgaagcctactgccctggcacagaaaatagaagagtattctcaacaactcgagggcctgaccaatgatgtccatacgcttgaagcctatggcgtggactcactcaagaccagataccccgatctactcccttttcctcagatccccaatgaccggtttaccagtgaagtagcgatgagagtgatggagtgcaccgcgtgtataatcatcaagctggagaactttatgcaacagaaagtctag

SEQ ID NO: 135852 - DNA, 13740 bp, Artificial Sequence
  Description of Artificial Sequence: Synthetic coding sequence
atggagaccaaggagaaccggtgggtacctgtcaccgtgctgccagggtgcgtgggttgccgcaccgttgcagctcttgcctcttggaccgtcagggatgtgaaggagaggattttcgccgagactggtttccccgtgtctgaacagcggttatggaggggaggccgggagctgagcgactggattaagattggcgatcttacatcgaagaactgtcacctattcgtaaacctgcaaagtaagggcctgaagggcggcgggcggtttggtcaaaccacccctcctctggtcgactttttgaaggatatcctgaggaggtaccctgagggcggccagatactaaaggaactgattcagaatgcagaagatgccggagctaccgaggtaaaattcctttatgatgaaactcagtacgggaccgagactctgtggtccaaggatatggcaccgtatcagggcccggcactgtacgtgtataataacgccgtcttcactcctgaagattggcatgggatacaggagatcgccagaagcagaaagaaggacgatcccctgaaggttggccgctttgggataggattcaactctgtttaccatatcactgatgtgccatgtatatttagtggagaccaaatcggaatgctcgaccctcaccagacgctctttggaccccatgagtcaggtcagtgctggaacttgaaggacgacagcaaggaaatcagtgagttatctgaccagttcgctccattcgtgggaatattcggctccaccaaagaaactttcataaatggaaacttccccggcaccttctttagatttcccctgaggctgcagccaagtcaactctcttcgaacctctacaacaagcagaaagtgctggagttgtttgaatcttttcgcgccgatgcagacaccgtcttactgtttttgaagagtgtgcaggacgtgtcgctatatgtccgagaggcggacgggactgagaaactggtcttccgagtgacttcatcagaaagtaaggctctgaaacatgaaagacctaactccatcaagatcctcggaaccgccataagcaactactgcaagaaaacaccgtcaaacaatataacctgtgtgacctatcacgtgaacattgtgcttgaggaggagagcaccaaggacgcccagaaaacctcatggctcgtgtgcaattctgtgggagggcggggtatctccagcaaattggactcgctggccgacgagctgaaattcgtgcctatcatcggcattgccatgccactatcaagtcgggacgatgaggccaagggggctacatccgacttctccgggaaggctttttgtttccttccattaccgcccggagaggagtcttccaccggattaccagtgcatatatctggattctttggcctgaccgacaatcgtcggagcattaagtggcgtgagttggatcaatggagggatcctgcagcattatggaacgagttccttgtgatgaatgtggtacccaaggcatacgctacacttattttagattctataaagagattggaaatggaaaagtcgtctgacttcccactgagcgttgacgtaatatataaactgtggcctgaggcttcaaaggtgaaggtacactggcagcccgttcttgagcctctatttagtgagctcctgcagaatgccgtcatatacagcatttcatgtgactgggtgcgcctggagcaggtgtatttttctgaacttgatgaaaacctggagtatacgaaaaccgtactcaactaccttcagagctctggaaagcagatagctaaggtaccaggcaatgtggatgcagctgtgcaacttacagcggcctcagggaccacacccgtgcgtaaggtgactcccgcctgggtgcgccaggtgctgagaaaatgcgcccatcttgggtgcgcagaagaaaagctccatctcctcgaatttgtcctctccgatcaggcttactctgagctcctcggactggaattgctgccactgcaaaacggcaacttcgtgccattttctagcagcgtctcagaccaggacgtcatctacattacatccgcagaatacccgcgatcgctgttcccctcactggagggccggttcatcttagacaatttaaaaccccatcttgtggccgccctgaaggaagccgcccaaacccggggaaggccttgtacccagttacaactccttaatcccgagcgctttgctcgccttataaaagaggtgatgaataccttctggcccggacgggaactaatcgtacagtggtaccccttcgacgaaaaccgtaatcaccccagcgtgtcatggctgaaaatggtgtggaaaaacctgtatatacatttctccgaggatctaacgctgttcgatgagatgcccctcatccctagaaccattctggaggagggacagacttgtgttgaattgattcgcctgcggatcccatccctggtcatcctcgacgacgaaagcgaggcccaactgcccgaattcctggccgacatcgtgcagaagctgggaggcttcgtcctgaaaaaactggacgcatcaatccagcatcctctgataaagaaatacatccattcaccactgcctagcgctgttttgcagataatggaaaagatgccgttacaaaagctttgtaaccagatcacgtctctgttgcctacacacaaggacgccctccgcaaattccttgccagcctgactgactcctctgagaaggaaaagcgcatcatccaggagttggctattttcaagaggatcaatcattcaagtgatcaaggaatttcttcttacacaaaactaaaggggtgcaaggtgctccaccacaccgcgaaactcccggcagaccttcggctttccatctcagtgattgattcctctgatgaagcaaccatcagattagctaacatgttgaagattgaacagctgaaaaccactagttgcctcaaactagtccttaaagacatcgagaatgcattctactcccacgaggaagtcacccaattaatgctgtgggtgcttgagaatctgagttctctgaagaacgagaatccgaacgtgctggaatggctgactccattgaagttcatccagatcagccaggagcaaatggtgtcagcaggcgaactgttcgatcccgacatcgaagtgctgaaagatctattttgtaatgaagagggtacgtactttcccccgagcgtatttacctcacccgatattctgcatagcctacgtcagataggattaaaaaacgaagcgagtctcaaagaaaaggacgtggtgcaggtggccaaaaagatcgaggcgcttcaggtaggtgcctgccccgaccaggatgtattattaaaaaaggccaagacactgctgctcgtcctgaacaagaatcacactctgctgcagtcatctgaaggcaaaatgacgcttaagaaaattaagtgggtacccgcctgcaaggaacgcccgcccaactaccccggttcactggtctggaagggggatctctgtaacctttgtgctccacctgacatgtgtgacgttggccatgcaatattgatcgggagtagtctgccactggtcgaaagcatccacgtaaatctcgaaaaagcactaggaattttcacaaagccctccttaagtgctgtgctaaagcatttcaagattgttgtggattggtattctagcaagaccttctcggatgaggattactatcagttccagcacatactactcgagatctacgggtttatgcatgatcaccttaacgaaggtaaggatagcttccgcgcactgaagttcccctgggtctggactggcaagaagttttgtcctttagctcaggccgtaattaagccaattcatgatttggacctgcaaccctatctgcataatgtgccgaagactatggcaaagttccatcagttgttcaaggtgtgtgggtccatcgaggagctgacaagcgatcacatcagcatggttatccagaaaatttacctgaagagcgaccaagatctgagtgagcaggagagcaagcaaaacctccacctcatgttgaacattatccgatggctctacagcaaccagatccccgcatcccctaacaccccagtgcccatccaccatagcaaaaacccttctaaactgattatgaaaccgatacacgaatgctgctattgcgatatcaaagtggacgacctcaacgaccttttagaggactccgtggaacccatcattctagtccacgaggatattcccatgaagaccgctgagtggctcaaggtgccctgtctgtctacgaggctgatcaatcccgagaatatggggttcgagcaatccggccagagggagcctttgactgttagaataaaaaatatcttagaggaataccccagcgtcagcgacattttcaaagagctgctccaaaacgcggatgatgcaaatgctactgaatgctcctttctgatagacatgcggcggaacatggatattcgggaaaatttactggaccccgggatggcagcctgtcatggcccagcactgtggtccttcaataactcccagttttctgactctgatttcgtgaacattacaaggctgggggaatcacttaagagaggtgaggtggacaaggtaggcaaattcggcctcggattcaacagcgtgtaccacataacagatattcctatcatcatgtctcgagaattcatgatcatgttcgatcctaacattaatcacattagcaagcatatcaaggataaaagcaatcctgggataaaaattaactggagcaaacaacagaagcgactccgcaagtttccaaaccaatttaagcccttcattgacgtatttgggtgccagcttccactgactgtggaggctccatactcctataatggaactctgttccgccttagcttccgtacgcagcaggaagcaaaggttagtgaggtctccagcacttgttacaatacagcagacatatacagtttagtagatgagttcagcctgtgtgggcataggcttataatttttacacagtccgtcaagtccatgtatctcaagtatctcaagatcgaggaaacgaacccctccctggctcaggatactgttatcatcaaaaagaagagttgctcctctaaagccctcaacaccccggttctttcagtattgaaagaagccgccaagctaatgaaaacctgttcttcttccaataagaagctgccctctgacgaaccgaagagctcttgcattctacagatcaccgtggaagaattccaccacgtctttaggagaatcgcagatctccaaagcccgctcttccggggcccggatgacgatcccgcggctctgtttgagatggccaaaagcggccagagtaaaaaaccctcggatgaactttctcaaaaaactgttgagtgcaccacttggcttctgtgcacctgcatggatacaggcgaagcactaaaattttcgctgtctgaatctgggaggagactcgggctcgtcccttgcggcgctgtcggcgtccagctgagcgagatccaggatcagaagtggactgtaaagcctcacataggcgaggtgttctgctacctgccactccgtatcaaaacaggtctgccggtgcacattaacggctgcttcgccgtgactagcaaccggaaagaaatatggaagacggacaccaagggacgctggaatacaacctttatgcggcacgtaattgtaaaggcctatctgcaggtcctctctgttttgagggatcttgccacaagcggggagttgatggattatacgtactatgcagtctggcccgatcctgacctggttcatgacgatttcagtgtgatctgtcaggggttctatgaggacatcgcccacgggaaaggtaaggaactgacaaaagtattttctgacgggagcacatgggtttcaatgaaaaacgtcaggttccttgacgatagtattctgaaaaggagagacgtgggatctgctgctttcaagatcttccttaagtatttaaagaagaccgggtctaaaaacttgtgtgctgtagaactgccctcctcggttaaattgggcttcgaggaagcgggttgtaagcagattctgttggagaatactttttccgagaagcagttcttttctgaggttttttttcctaatatacaggaaatagaggctgaactccgggatccgctaatgattttcgtcttgaacgaaaaggtcgacgagttcagtggtgtgctccgggtcaccccatgtattccatgtagtttagaaggccatcctctagtcctgccttcccgactgatacacccggagggccgagtcgctaaactattcgacataaaggacgggcgatttccatacggcagcactcaagactacctcaatcctatcattctcatcaagcttgtacaattgggaatggcaaaggacgatattctgtgggatgacatgctagagagagccgtatcggtcgctgagattaataaatccgaccatgttgcagcctgccttcggagctccattctactcagccttatcgacgaaaagctgaagataagagatcctagggccaaggactttgctgccaaatatcagaccattcgctttctgccctttctgacaaagccagccgggttttctcttgactggaaggggaacagttttaagccggagacaatgtttgcggcgacagacttgtatacagcagaacaccaggacatagtgtgtctgctccagcctatattgaatgagaattcacattctttccgaggctgtgggagcgtctccttggcagtcaaagagtttctgggcttgctaaagaaacccaccgttgatctcgtgatcaaccagctgaaggaagtggcgaagagcgtggatgatggaattactctgtaccaggagaatatcacaaatgcctgctataagtatctgcatgaagcgttgatgcagaatgagattaccaagatgtccataattgataaactaaagcctttctcattcatactggtggagaacgcttatgtcgatagcgaaaaggtgtctttccacctgaactttgaggccgccccctatttatatcagcttccgaataaatataagaataatttccgtgagctcttcgagaccgtcggggtccgacagagttgcaccgtagaagattttgcccttgtcctggaatccatcgaccaggaacgcgggactaagcaaatcaccgaggaaaactttcaactgtgtagaaggattataagcgagggaatttggtctctaatcagggagaagaaacaggaattctgcgagaagaactacggaaaaatcctcctgccggatactaatctgatgttacttcccgcgaagtccctgtgctataacgattgtccttggatcaaggtgaaggataccaccgtgaagtactgccacgccgacattccaagggaggttgctgtgaaactgggcgccgtgccaaagcgtcataaggctctggaacgctacgcatcgaatgtgtgtttcacaacacttgggacggagtttggccagaaagagaagttgactagccggattaaatccatcctgaacgcgtacccgtccgagaaggagatgctcaaagaacttctccagaatgccgacgacgctaaggcaactgagatttgcttcgtatttgaccccagacagcaccccgttgaccggatcttcgatgataagtgggcacctctgcaggggcccgccctgtgcgtctacaataaccagccgttcactgaggatgacgtgcgaggtatccaaaacctggggaagggaactaaagaaggtaatccttataagaccgggcagtacgggattgggttcaacagtgtgtaccacattactgactgtccttcgttcatctcaggcaacgatattctttgcatattcgacccacacgctcgctatgcgccaggggccaccagcattagccccggtcggatgttcagagacctggatgccgacttcaggacccagttttctgatgtgctcgatctttacctgggtacccacttcaagttggacaactgcacgatgtttcgttttcctttgcggaacgccgaaatggccaaagtgtctgagatctcaagcgtgcccgccagcgaccgcatggtgcagaacctcctggacaaattgcggagcgacggggccgagctgctgatgttccttaatcacatggaaaaaatctcaatttgtgaaatcgacaaatccacaggggcccttaatgttttgtacagcgtcaaaggaaaaattacagacggagacaggttgaagaggaagcagttccatgcctccgtgattgacagcgtgactaaaaagcggcaacttaaagacattcccgtccagcaaattacttatacaatggacaccgaggactccgaggggaatctcacgacatggctgatttgcaaccgatctggcttctcttcgatggagaaggtgagcaagtcagttatttctgcccacaaaaatcaggacattacactttttccacgtgggggggttgcagcgtgtataacccacaactataagaagcctcaccgcgccttttgctttctgccgctgagccttgagactggcctgccattccacgtgaacggtcactttgcccttgattccgctcgacgcaatctgtggcgggacgacaacggagtgggagtgagaagtgattggaacaactccctgatgacagcccttatcgccccagcctatgtggaactgctaatacagttgaagaaacgatacttccctggttccgatcctaccctctccgtcctccagaatacacctattcacgtggtgaaggacactttgaagaaatttctctccttctttcccgtaaataggctcgatttgcagccagacctgtattgtctcgtcaaggcactatataattgtatccacgaagacatgaagcggcttctccctgtcgttagggcaccgaacatcgacggttcggatctgcattccgccgtcataatcacatggatcaacatgagtaccagcaataagactagaccgttcttcgacaacctgctgcaggacgagctgcaacacctgaagaacgcagactataatattaccactcggaaaactgtggccgaaaacgtttacaggctgaaacatcttttattggagattggctttaatctcgtttacaattgcgatgaaactgctaacctttaccattgcctgatagatgccgatataccagtcagttatgtaacgccagcagacatcaggtcttttctcatgactttttcttcccctgacacgaactgccacatcggaaagctcccctgcagactacagcagacaaatcttaagctcttccacagcctaaaactcttagtggactactgtttcaaggatgcagaggaaaacgagattgaagttgagggactgcctctgctcatcaccctggactccgttcttcagacattcgacgcgaagcggcccaagtttctcacaacataccatgagttgatcccatcaaggaaggacctgttcatgaatacattatacttgaagtacagtaacatccttctaaattgcaaggttgcaaaggtcttcgacattagttcttttgctgacctgttgtcaagtgtgttgccccgcgagtacaagaccaaatcctgcaccaagtggaaggacaatttcgccagcgaatcatggctgaagaacgcttggcacttcatctctgagagcgtcagcgttaaggaggaccaggaggaaaccaagccaaccttcgacatcgtggtcgatactcttaaggactgggcactattgcccggcactaaatttacggtatctgctaatcaactggtggtccctgaaggtgacgttctcctgccactttccctgatgcacatcgcggtgtttcccaacgctcaatccgataaggtattccatgcgctcatgaaggccgggtgtattcagctggccctgaataagatttgctcaaaggactcggctttcgtgccgctcctttcctgtcatactgcaaacatcgagagtcccactagtattctgaaggccctccactatatggtccaaacctcaaccttccgcgccgagaaactagtcgaaaatgatttcgaggccctcctgatgtacttcaattgtaacctgaatcacctgatgagtcaggacgacattaagatcctcaagagtctgccctgttacaagtccatatccggtcgttacgtcagcataggtaagttcggtacctgctatgtgctgacgaaatctatcccctcggctgaagttgagaaatggacacaaagttcgagtagcgcattcctggaagaaaaaattcacctgaaggagctgtacgaggtgattgggtgcgtgcctgtcgatgatctggaggtttatctcaaacacctgcttcccaagattgagaacttgagctatgacgcaaaattagagcacctgatctacctgaaaaataggctgtccagcgctgaggagctttccgagattaaagagcaactgttcgagaagctggaaagcctcctgatcattcatgacgccaatagcagacttaaacaggcgaagcacttttacgatcggacagtaagggtgtttgaggtaatgctacccgaaaagctattcatccccaatgacttctttaaaaaattagagcaactaattaagccaaaaaatcacgtcacattcatgactagctgggtggaattcctccgcaacatcggactcaagtatattctgtcgcagcagcaactgcttcagttcgccaaagaaatatccgtccgtgcgaatactgaaaactggagtaaggaaacattacagaatactgtggatatcctgcttcatcatatctttcaggagaggatggacctgctcagtggaaattttcttaaggaactgtctctgatcccctttttgtgtccagagcgggcccccgccgagtttattaggttccacccccagtaccaagaggtcaacggcacattgcctctgatcaagttcaacggggcgcaggtgaaccccaagttcaaacaatgtgatgtactgcagcttctgtggacctcctgcccaatactccccgagaaggccacacctctttccatcaaagagcaggaaggctccgacctggggccccaagagcagctggagcaagtgctgaatatgttgaacgttaatttggatccaccactggacaaagtgattaacaactgtcgtaacatctgcaacatcacaactctcgacgaagagatggtcaaaaccagggctaaagtgctgagatctatctacgagtttttatcagccgagaaacgtgaatttagatttcagctgcgcggtgttgcctttgttatggtagaagacggctggaaactcctgaaacctgaagaagtagttataaatctcgagtacgaatctgattttaaaccatatctctacaaactgccattggaacttggcaccttccatcagctgttcaaacacctgggaactgaagatatcatttctacaaagcagtatgtggaggtcctcagtaggattttcaaaaatagtgaaggaaaacagctggatcccaatgaaatgaggacagtgaagagggtcgtaagcggcctttttcgctccctacaaaatgatagtgtgaaggttaggtctgacctggaaaacgttagagatctggccctgtatttgccttcacaagacggtagacttgtgaaatcctctatcctagtgtttgatgacgcaccccactataagagccgcattcaagggaatattggagtgcagatgctcgtggacctgtctcagtgctacctgggcaaggatcacggcttccatactaaactgattatgctcttccctcagaagctgcgccccagactcctgtcatcgatcctagaagagcaactggacgaggaaacccctaaagtctgccagtttggcgcactttgttcacttcagggacgcctacaactgctgctgagctctgaacagttcattaccggattaatcaggatcatgaaacatgagaatgacaatgcattcctggccaacgaagagaaagcgattcggctgtgcaaggccctccgagaaggcctgaaggtttcttgcttcgagaagctgcaaactaccctgagagtcaagggcttcaacccgattcctcattcacggtcggaaactttcgcattcttgaagcggttcggtaatgccgtgatacttctgtacatacaacacagcgatagtaaagacattaactttctcctggcgttggccatgacactaaaaagcgccacagacaatttaattagcgatacctcttacctaatagctatgcttggatgcaacgacatctacagaatcggcgagaaactggattccttgggagtaaaatacgatagttccgaacccagtaagttggaactccctatgcccggcacccccatccccgcggagatacactatacactgctgatggatcccatgaacgttttttacccaggggagtacgtgggttacctggtggacgcggagggcggagatatatacgggtcctatcaaccaacgtacacttacgcaattatcgttcaggaggtggaaagggaggacgctgacaacagttcttttctcgggaaaatctaccagattgatatcgggtactccgaatacaagatcgtgtcaagtctagacctgtataaatttagccgccctgaggagagcagccagagcagagatagcgctccttctactccaacctctccaaccgagttcctcacacctggcttaagatccatccctcctctgttctcaggacgggagtcacacaaaacctcgtccaagcaccagagtccaaagaagctcaaggttaactctctgccagaaattcttaaagaggtcaccagcgtcgtggaacaggcctggaaattacccgagagtgagagaaagaagattatccgcagactgtatctcaagtggcacccagacaagaatccagaaaaccatgatattgcaaatgaggtctttaagcacctgcagaatgagatcaatcgccttgaaaagcaggcttttttggaccagaacgccgacagagcctcacgtcgcacctttagcacgtctgcatctaggttccagtccgataagtattcattccagcgcttttatacctcctggaatcaggaggccaccagccataagtccgagaggcagcagcagaacaaagagaagtgtccacccagcgccggccagacgtattcccagaggttcttcgtacccccaacattcaaatccgtgggtaatcctgtcgaggcgaggagatggctcagacaggccagagccaatttctcagccgcaagaaatgatcttcacaagaatgccaacgagtgggtgtgttttaagtgttacttgtccaccaagctggccctgattgcagctgactacgcagtgcgggggaagtctgataaggacgtaaaaccaaccgcactggcccagaagatcgaggagtattcccaacagttggaaggactgactaatgatgtgcacaccctagaagcctacggagtagatagccttaaaactcgttatccggatcttctgccttttcctcagatcccaaatgacagattcacctctgaagtggcaatgagggtcatggaatgcacggcatgcatcattatcaagctcgaaaactttatgcagcagaaggtctag

SEQ ID NO: 135853 - DNA, 11490 bp, Artificial Sequence
  Description of Artificial Sequence: Synthetic coding sequence
atgaacactttttggcccgggagggagctcattgttcagtggtatccttttgacgagaatcgcaaccatccatctgttagttggttgaaaatggtctggaagaatctgtacatacattttagtgaagacctgacactctttgacgagatgcccctcatccctagaactatcttggaggagggacaaacctgcgttgaactgatccgactgcggattccgtccctggtgatcctggatgatgagtctgaagcccagctgccagaatttctcgctgacatcgtccaaaagcttggcggttttgttctgaaaaagctggatgcctcaatccaacatcctcttataaagaagtatattcattctccactgcccagcgcggtcctccagattatggagaaaatgccactccagaaactttgtaaccagatcacatcattactgcccacccacaaggatgcacttcggaaattcctagcatctctcactgactcctctgagaaagagaagcgaattattcaggagttagcgatcttcaaaaggatcaatcactcatcagatcagggcatttcatcgtatacaaagctgaagggatgcaaggtgcttcatcacactgccaaactgcctgcagacctgagactgtctatcagtgtgattgattccagcgatgaagctaccatacgtttagcaaatatgctgaagatagagcagctgaagacaacgagttgtctcaaattggtgctgaaggatatcgagaacgccttttattctcacgaggaggtaacacagttgatgttatgggtgcttgagaatctgtcctctctgaaaaacgagaatccaaatgtgctcgagtggttaacccccctgaagtttatacagatttcccaggaacagatggtttctgctggagagttgttcgaccccgacatcgaagttctgaaggacctcttttgtaacgaagaaggtacctatttcccgccaagtgtttttacaagtcccgacatacttcatagtctccggcaaatcggactgaaaaatgaagcctctcttaaggaaaaagatgtggttcaagtcgcaaaaaagattgaggcgcttcaggttggagcctgcccagatcaggatgttttgctcaagaaggccaaaacactgctgctggtgcttaacaagaaccacacactgctccaatcctccgaagggaaaatgacgcttaaaaagataaaatgggtcccagcatgcaaggaaaggccccccaactatcctgggtctctggtgtggaaaggagacctctgcaacctctgtgcaccaccagacatgtgcgacgtgggccatgccattctgattggctcaagcttacccctcgtggagtcaatccacgtcaatctagaaaaagctctgggaattttcaccaaaccgtccctgtcagctgttttgaagcatttcaagattgtggttgactggtattcgtccaaaacattctctgacgaagactattaccagtttcagcacatattattagagatttacggcttcatgcacgaccacctgaatgagggtaaagactcatttcgagcgcttaagttcccttgggtgtggacaggtaagaagttctgtcctctggcccaggctgtgataaaacctatccacgatctcgaccttcagccatacctgcacaacgtgcctaagaccatggctaaattccatcagctgttcaaggtgtgtggctccatcgaagagttgacctctgaccacatctctatggtgatccagaaaatctacttaaaaagcgaccaagatcttagtgagcaggagagcaagcaaaacttacacttgatgctaaacattatcaggtggctatactccaaccagatcccggcctctccgaacacccccgttcctatacatcactccaagaacccttctaaactcattatgaagcctattcacgaatgctgctactgcgacattaaggtggatgaccttaatgaccttctggaggactctgtggagccgatcatcctggttcacgaagatattcctatgaaaaccgcagaatggctaaaggtgccgtgtttatcaactcggttgataaatccggagaacatggggtttgagcagagcgggcagagagagcctctcacggttcgcatcaagaacattctggaagagtatcccagcgtgtctgatatcttcaaagaactgctgcagaatgccgacgacgctaacgcaacggagtgtagcttcttaatcgacatgagacgcaatatggacataagggagaatctgctcgaccctgggatggccgcatgtcacggccccgctctgtggtcctttaataacagccaattctctgattctgacttcgttaacataaccagacttggcgagtcgctcaaacgcggcgaggttgataaagttggtaaatttgggttaggcttcaactccgtgtaccatataacggacatccctattattatgtctagggaattcatgataatgtttgacccgaacataaatcacatcagcaagcacattaaagataagagcaaccctggtatcaagattaattggtcgaagcagcagaagagactgagaaagttccctaatcagtttaagccattcatcgatgtgtttggctgccagctgccgctgaccgttgaggcgccgtactcttacaatggcacccttttccggttatcttttcgcactcagcaggaggctaaagtaagcgaagtttcctctacgtgttacaataccgctgatatctactcactcgttgacgaattcagtctttgtgggcacagattaatcatcttcactcagtctgtgaagtccatgtacctgaagtacctgaagatcgaggaaactaatccttccttagcacaggacacagtcataataaagaagaagagctgcagtagtaaggccctgaacacacccgtcctgtctgtactgaaagaagcggccaaactcatgaagacgtgttcatcgagcaataaaaaactgccatcagatgaacctaaaagttcttgcatactgcagattaccgtggaggagttccatcacgtgtttaggcgcatagccgacctacaatctcctctgtttaggggcccggacgatgatcctgctgcactgtttgaaatggctaagtcaggccagagtaaaaagccatcagatgaactgagccaaaagacagttgaatgtaccacttggctcctttgcacctgcatggacacaggcgaagctttaaaattttcactcagcgagtctggccgcagactcggcctggtaccatgcggggccgttggtgtgcagcttagtgagatccaggaccagaaatggaccgtaaaaccacacatcggcgaggtcttttgttatctccccttacgtataaaaaccggccttccggtgcatattaacggctgtttcgctgtcaccagcaaccgtaaagagatttggaagaccgatacgaaaggccggtggaacacgacttttatgcgccatgtgatcgttaaagcttacttgcaggttctgagtgttctccgcgacctcgccacaagcggtgaactaatggactacacatattacgcagtctggccagaccctgacctggtgcacgatgatttctcagtaatctgccagggtttttatgaagatatagcccatggcaaaggcaaggaactgaccaaagtgttttcagatggttctacatgggtgtctatgaagaatgtgcggtttctcgatgatagcatccttaaacggagagatgtcggctccgctgccttcaaaatctttctaaaatatctgaaaaagactggttccaagaacttgtgcgctgtcgagctgccatcctctgtgaagttaggatttgaagaggcaggctgcaagcaaatactactagagaacactttcagtgaaaagcagttctttagcgaggtttttttccccaatattcaggaaatagaggccgaacttagagaccccttaatgatctttgtgttaaacgagaaagtggacgaattttcaggggtgctccgggttaccccttgtatcccatgctctctggagggacacccattagtcctaccttcaaggctcattcaccccgagggtagggtcgctaagctcttcgacatcaaagacggcagatttccctacggctcaacgcaggactacttgaacccaataattctgattaaactggttcagcttgggatggctaaagatgacatcctgtgggatgatatgctcgaacgggcagtgtcagtggctgagatcaacaagagtgaccacgtggctgcctgcctgagaagttctatccttttaagccttattgatgagaagcttaaaatcagagatccaagagcaaaagatttcgccgcgaaataccagacaatccgcttcctgccatttctgacaaaaccagccgggttctccttggattggaagggtaatagttttaaacctgagactatgtttgctgctaccgacctttatacggcggaacatcaggacatcgtgtgtctgctgcagccaatacttaacgagaactctcactcatttagaggttgtggcagcgtgtccctcgccgtgaaggagtttctgggactcctgaaaaaaccaacagtggatcttgttataaaccaactcaaagaggtagcaaaaagtgtagacgatggaattacactctatcaggagaacatcactaacgcttgctacaagtacctccacgaggccctcatgcagaacgagatcaccaaaatgtctattatcgataagttaaaacccttctcgttcatactggtcgaaaacgcttacgtagatagtgagaaggtgagcttccacctcaactttgaagcggccccatatctttaccaattgccaaacaagtacaaaaacaattttcgtgagttgtttgagacagtaggggtccggcagagttgcacagtggaagattttgccttagtgctggagtccatagaccaagagaggggcaccaaacagattactgaagagaatttccagctgtgcaggaggattatctccgagggtatttggagcttgatacgggagaaaaagcaagagttttgcgagaaaaattacggcaagattctcctcccagacaccaatctgatgctgctcccagccaagagtctttgctataacgattgcccctggatcaaggttaaagataccaccgtgaaatactgtcacgccgatatccctcgggaggtagccgtgaagctcggcgctgtgcctaagcggcacaaggcgcttgaacgctatgcctcaaacgtttgttttactacactggggaccgaatttggccaaaaagaaaaacttacatctaggattaaatctattctgaacgcttacccctccgaaaaagagatgctgaaagagctcctccagaacgcagatgatgccaaggctacagaaatctgttttgtatttgaccccagacagcatccagttgatcgcattttcgacgataagtgggctccactccagggcccggcactgtgcgtgtacaacaaccaacctttcactgaggatgatgtgagaggcatacagaacctgggtaaggggacaaaggagggcaatccgtacaagacagggcagtacggcatcggtttcaactccgtgtatcacatcactgactgcccatctttcatctctggcaacgacatcctgtgtatattcgatccacacgcaaggtacgccccaggtgccacttcgatctcaccgggaagaatgttcagggatctcgacgccgactttagaactcagtttagcgatgtactagatctgtacttggggactcactttaagctggacaactgtacgatgtttcggttccctttaagaaacgccgagatggctaaggtttctgaaatttccagtgtgccggcaagcgatcgaatggtccagaaccttttggacaagctgagatctgatggcgcggaattgctgatgtttctgaaccacatggaaaagatttctatctgtgaaatcgataagagtaccggtgcgctgaatgttctgtatagtgttaaggggaagatcactgatggggacagactgaaacgtaagcaatttcacgcctcagtgatcgactccgtgacaaagaagcgccaactcaaagacatccctgtccagcaaattacttatacgatggatacggaggacagtgagggtaatctgacaacctggctgatttgcaacaggtcaggcttctcaagtatggagaaagtgtccaaatcagttataagcgcccacaagaatcaggacatcacgctgtttcctcgcgggggagtcgcggcctgcataacacataactataaaaaaccccatcgggcgttctgcttcctcccactcagcttggaaaccggtctcccctttcacgtgaatggccacttcgccctcgactctgctcgaagaaacctttggcgggatgataatggggtcggtgttcgcagtgactggaacaactctctgatgactgctcttatcgctccagcatacgtcgaattgctcatccagctcaagaaacgctattttcccggtagtgaccctaccctgagcgtccttcaaaatacacccattcacgttgtcaaagacacactgaaaaagttcctctcattctttcccgtaaacagacttgatctccagccagacctatactgtctggttaaggctttgtacaactgcattcacgaagatatgaagcggctgctgccagtggttagagctcccaacatcgacgggtctgacctgcattccgccgtgattatcacatggatcaatatgagcacttccaacaaaacccgtccgtttttcgacaatctgctccaggatgagctccagcaccttaagaatgccgactacaatattaccactcgaaaaactgtggcggagaacgtttataggttgaaacatcttctgttggaaattggcttcaacctggtctacaactgcgacgaaacggctaacctttaccattgccttatcgatgccgacatacctgtcagttacgtcacacccgcagatatcaggtccttcctcatgacctttagcagcccggacactaactgccacatcggaaaactcccttgcagactccagcagacaaacctgaaactttttcacagcctcaagctcctcgtggactattgcttcaaggatgccgaagagaacgaaatagaggtcgagggcttgccgttactaatcaccttagattctgtactccagacgttcgacgcaaaaagacccaagttcctgaccacataccacgaattgatcccctccaggaaggatctgttcatgaacactctctatctcaaatactctaatatcctgctgaactgtaaagttgctaaggttttcgatatctcctccttcgccgacttacttagctcggtgctccccagagaatataagacaaagagttgcacgaaatggaaggataacttcgcctccgagtcttggctgaagaatgcttggcacttcattagcgaatctgttagcgttaaggaggatcaggaggaaactaagcccacgtttgatatcgtcgtggacacactcaaagattgggctctgctcccaggaaccaagttcaccgtatctgctaatcagctggtggtgcctgagggagatgttttgcttcctttgagcctgatgcacatcgctgttttcccgaacgcccaatccgacaaggttttccatgctttgatgaaggctggttgcatccagcttgctctgaataagatttgttccaaggactccgcattcgtgccactgttgagctgccacacagctaatattgaatcgcccacctctattctgaaggccttacactatatggttcagacctctacgtttcgggccgaaaagctggttgagaacgacttcgaggctctccttatgtatttcaattgtaacttgaaccacctgatgtcccaggacgacatcaaaattctcaagagcctgccttgctacaaatcaatatctggcaggtatgtttccataggcaagttcggcacctgctacgtcctaactaagtctataccctcagcggaagttgagaaatggactcagagctcgtccagcgccttcctagaagagaaaatacacttgaaagagctgtatgaggtgattggctgtgtccctgtggacgacctagaggtgtaccttaagcatctgcttccgaaaatcgagaatttgagttatgatgcaaaattggagcacttgatctacctcaaaaatcgtttgtccagcgcagaggagttgagcgaaatcaaggaacagctgttcgaaaaacttgaatcactgctgattattcatgacgccaacagcagactgaaacaagccaaacacttctatgaccggaccgtacgagtttttgaggtcatgcttcctgaaaaactgtttattcccaatgatttttttaagaaactagaacagctcattaagcctaaaaaccatgtgacgtttatgacctcgtgggtggagttcttgagaaacatcgggctgaagtacatcttgtcacagcagcaactgctccaattcgctaaagagatctcagtaagagctaatactgagaattggagtaaagaaacccttcagaacacagtggatatcctgctacaccacattttccaggagcggatggaccttctatcgggtaattttctgaaggaactgtctctgataccctttctatgtcctgagcgtgctccggctgagttcatcaggttccacccgcagtatcaggaagtgaacggcacgttgccactgatcaagtttaatggggcccaggtgaatcccaaattcaaacagtgcgacgtattacagcttctctggacctcctgccccattctgccagaaaaagctactcccctgtcaataaaggagcaggaggggagtgacctgggcccccaggaacagttggaacaagtcctcaatatgctcaacgtcaatctcgatcctcccttagataaagtgataaacaactgccgcaacatatgcaatattactactctggacgaggagatggttaaaacacgggcaaaagttctgaggagcatctatgagttcctgtccgctgagaagagggagtttcggttccagttacgcggggttgctttcgttatggttgaggatggctggaagctccttaagcccgaagaggttgtgataaacctggaatatgagtcagactttaaaccatatctctacaagctgcccctggagctaggaacgtttcaccaactgttcaagcacctgggcaccgaggatatcatctccactaagcagtacgtagaagttctgagccgcatttttaagaactctgaaggaaaacagctagatcctaacgagatgcggaccgtcaaacgggtggtgtccgggttgtttcgctcactccaaaacgattctgtcaaagtgcggtctgacctggagaatgtaagggatctagcgctctatcttccctctcaagacggaagactggtcaaaagttctatactggttttcgacgacgctccacactataagtctagaatccaggggaacatcggggtgcagatgctcgtcgacttgtcgcaatgctacctggggaaggatcacgggttccatactaagctgataatgctgtttccccagaaattacgcccccggctcctgtcctcaatcctcgaggaacagctggacgaagaaacaccaaaggtgtgccagtttggagcgttatgtagtctacaagggcgcctgcagctattgcttagtagcgaacaattcatcacgggactgatcaggattatgaagcatgaaaacgataacgccttcctggccaacgaagagaaggccattagactgtgtaaggctctccgggagggtctgaaggtgagctgtttcgagaaactgcagaccaccctgagagtgaaaggctttaatcctatcccgcattcaagatctgaaacctttgcatttctcaagaggttcggcaacgccgttattctgctgtatattcagcacagcgattccaaagacatcaactttctcctcgccctggccatgacccttaaaagcgccaccgacaacctcattagtgatacctcatacctgatcgccatgctgggctgcaatgacatttacaggatcggggaaaaattggatagccttggcgttaaatacgacagctcggagccctcaaaactagagctgccaatgcctggcacacctattccagctgaaatccactacacacttctgatggatcccatgaacgtgttctacccaggggagtacgttgggtatctggtcgatgccgagggcggtgatatctacggaagctatcagcctacttacacatacgccattatcgtccaggaagtcgagcgcgaggacgccgacaactcctcattcctggggaagatataccagatagacatcggctactccgagtacaaaatcgtaagtagcttagacctctacaaattttctcgacctgaggaaagctctcagagcagggatagtgcccccagtaccccaactagccctacagagtttctgacgcccgggctgagatctattcccccacttttctctgggcgagagtcacacaagacttcctcaaagcatcagtctccaaagaaattgaaggtaaatagcctgccagagattttgaaggaagtcacctccgtggtcgagcaagcatggaagctgcccgagagtgagagaaaaaagataatccggagattatatctaaaatggcacccagacaaaaatccagaaaaccacgacatcgccaacgaggtgttcaaacaccttcagaacgagattaatagactcgagaaacaggcttttctcgaccaaaatgcagatagggcatcccgcaggaccttttccacctcagccagccgctttcaatccgacaaatactctttccagaggttttacacttcttggaatcaggaggccacctctcacaagagtgagcggcaacagcagaataaggagaaatgtcctcccagcgccgggcagacttactcccaacgtttctttgtgccgcctaccttcaagtcagtggggaacccagtggaagcccggcggtggctgcgccaagcgagagcgaatttctccgccgcacgtaatgatcttcacaagaacgcgaacgaatgggtctgcttcaaatgctatctgagcactaagcttgctttgatcgcggctgactacgccgtccgcggaaagagcgataaagacgtgaagcccaccgctctcgcccagaaaattgaggagtattcccagcagctggaaggcctgactaacgatgtgcataccctggaagcttacggtgtcgattcattgaagactagatatccggatctgctccctttcccacagatccccaacgatcggttcacctctgaagtggccatgcgtgtgatggaatgtactgcatgcatcatcatcaagctggagaacttcatgcaacagaaagtatag

SEQ ID NO: 135854 - DNA, 7332 bp, Artificial Sequence
  Description of Artificial Sequence: Synthetic coding sequence
atggcagcagaggagggggtggcttcagctgccagcgccggtgggagctggggaaccgccgccatgggccgcgtgcttccaatgctccttgttcctgtgcctgctgaagccatggggcagctaggctcccgcgcgcaattgagaactcagcctgaagccttaggatccctcacggccgccgggagtctccaggtattgtctctgaccccaggcagccggggaggaggcaggtgttgcttagaaggccctttctggcactttctgtgggaggattctcgaaacagctcaacaccaaccgagaaacctaaactgctggcccttggagaaaactacgaactgcttatatatgagtttaatctcaaagacggaagatgcgatgcaaccatcttatactcctgctctagagaagcactccagaagttgatcgatgatcaggatatctccatttcactgctttcccttagaatcctaagcttccacaacaacacatcactcctcttcattaacaagtgtgtgattctccacattatcttccccgaacgtgatgctgccatcagagtgctgaactgcttcaccctgcccctgcctgcacaagcagtcgacatgataatcgacactcagctgtgccgggggatactgtttgtactatcttcccttgggtggatctatatattcgacgtggttgacggcacatacgtcgctcacgtagatttagctttacacaaggaagacatgtgtaatgaacagcagcaggaacctgccaaaatctcaagctttacttccctgaaagttagccaagacctggatgtagccgtaattgtttcaagcagtaacagcgccgttgcactgaacttaaatttgtatttcagacaacaccccggacacctcctctgtgaacgaatcctggaagaccttccaatacagggtcctaagggggttgatgaggacgacccggtgaactcggcctataacatgaagctagccaagttttcatttcagattgatcgatcatggaaagcccagctcagttcactgaacgagaccattaaaaactccaagctggaagtttcgtgttgcgctccttggtttcaagacatcctgcaccttgagtcacctgagtccggcaaccactccacttctgtgcaatcttgggcattcataccacaagatattatgcacggacagtataatgtcttgcagaaggaccacgccaaaacttccgaccctggtcggtcatggaaaattatgcatatttccgaacaggaagagccgattgagttaaaatgcgttagtgttacaggcttcacggctttgttcacttgggaggtggagcgaatgggctacaccatcacactctgggacctcgagacccagggcatgcagtgtttcagccttgggaccaagtgtatccccgtagattctagtggtgaccagcagctttgctttgtattaacggaaaatggtctaagcttaattcttttcggactcacgcaagaagaattcctcaaccgcttgatgattcacgggtctgcctcaacagtggataccctgtgccatctcaacggatggggacgatgtagtatccccattcacgccctggaggcaggtattgagaatcgacagttagatacggtaaacttcttcttaaagtctaaggaaaatctgtttaaccccagcagcaagtcatccgtttctgatcaattcgaccacctatcctcccatctgtacctgagaaacgtggaggagctgattcccgcactcgacctgctgtgcagtgctatcagagagtcctacagcgagccccagtctaaacacttttctgagcaattattaaatcttacactgtcattcctgaataatcagatcaaggagctgtttatccacaccgaggaactggatgagcacctgcagaagggggtcaatattctcacctcttatatcaacgagctgcgaactttcatgattaagttcccttggaagctgacagatgctatcgacgagtatgatgtgcacgaaaatgtacccaaggtgaaagaaagcaacatctggaagaagctctcgttcgaagaagtcattgctagtgccatcttaaacaacaaaattcctgaggcccaaacattcttcaggattgattcgcactcggcccagaaacttgaagagctaataggcatcgggttaaaccttgtgtttgacaacctgaaaaagaataacattaaagaagcatctgagctcctcaaaaacatgggattcgacgtgaaagggcaactgttaaagatttgtttttatactactaataaaaacattagggacttcctcgttgagatcctgaaagagaaaaactattttagtgagaaagagaagcgaaccatagactttgttcaccaggtagagaaactctacctcgggcattttcaggaaaacatgcagatacaaagcttcccaaggtactggatcaaggagcaagacttctttaaacacaagtcagtcctggatagctttttgaagtacgactgtaaggacgagttcaataagcaggaccaccgcatcgtgttgaactgggcactgtggtgggatcagctgacacaggaaagcattttgctccccaggatctcccctgaagagtataaaagttacagcccagaagcgctatggcgttatctcaccgctcgccacgattggttgaatatcatactgtggatcggagaatttcaaacacaacatagttacgcctctctgcagcagaacaagtggcctcttctgactgttgatgtaatcaatcagaatacctcgtgtaataactatatgcgcaacgaaatattagataagttagctcgaaacggtgtgttcctggcctccgagctggaggacttcgagtgcttcctgctccggctgtcaaggatcggaggtgtcattcaggatactctgcctgtgcaaaactataagactaaagaaggatgggattttcatagccagtttattctgtactgcctcgagcactccttacagcacctactgtacgtgtacctcgactgttacaagttatccccagaaaattgtccattcctggagaaaaaagaactgcatgaagcacacccttggttcgaattcctcgtacaatgccgacaggtggccagtaacttaacagatccaaagttaatatttcaggcctccttggcaaacgcacagatcctcattcctactaatcaggccagtgtgagttcaatgctgctcgaaggtcacacactgcttgcattggcaacaacaatgtatagcccaggcggcgtttcacaggtggttcagaatgaagagaatgagaactgcttgaaaaaagtagatcctcagctcctgaaaatggcacttactccatatcccaagctcaaaaccgcactattcccgcagtgtacacccccttcagtgctgcccagtgacattactatctatcacctcatccagtcactcagtcctttcgaccccagtaggctgttcggatggcagtccgcaaacaccttggcgattggggatgcgtggagtcaccttccacatttctcctcaccagacctggtgaataaatacgcgatcgtggagcgactgaatttcgcatactacttacataatggtcgaccttctttcgccttcggaacgttcctggtgcaggaactgatcaagtctaagacccctaagcaactcatccagcaggtgggcaatgaagcttatgtcatcggcctgtcctccttccacattcccagcataggggcagcatgcgtgtgttttctcgagcttctggggcttgattcactgaagctacgtgtagatatgaaggtggcaaacatcattctcagctataagtgtaggaatgaggacgcccagtacagcttcatcagagaaagtgtcgcagagaagctgtccaagctcgccgatggggaaaaaaccacaactgaggaactgctggtccttctcgaggagggtacatggaacagcatacagcagcaggaaattaaacggctgtcatcggaatccagttcccagtgggccctggtcgttcaattttgcagattgcacaatatgaagttgagcattagttacctccgggaatgcgcgaaagcgaacgattggcttcagtttatcatccactcacagttacacaattaccacccagcagaagttaaaagcctgattcagtacttttcaccagtgatacaagatcacctcagattggccttcgagaatctgccctccgtgccaaccagcaagatggacagtgatcaagtgtgcaataaatgtcctcaggagcttcaggggtccaaacaagaaatgaccgatctgttcgagatcctgttacagtgctctgaagaacccgacagctggcactggttgcttgtcgaggccgtcaagcagcaggcccccattctgtctgtgctcgcctcttgtctgcaaggcgcttctgccatatcatgtctgtgtgtttggattatcaccagtgtggaggacaatgtggccaccgaggccatggggcacatacaggatagtaccgaagaccacacttggaacctcgaggacctgagtgttatctggagaaccctgttgacccggcaaaaatcgaaaacacttattcgaggcttccagctttttttcaaggactcgcccttattgctggtcatggagatgtacgagctgtgcatgtttttcagaaattataaggaggccgaggctaaactcttggaatttcagaaaagtctggagactttgaacacggctgccaccaaggttcatcccgtgatccctgccatgtggctcgaagatcaggtttgcttcttattaaagcttatgttacagcaatgcaagacacagtacgaactagggaagctcctgcagctgttcgtagaaagggagcaccttttcagcgatggtcctgacgtcaaaaagctttgcattttatgtcagatactgaaagataccagtattgcaattaatcacactatcattacgtcatacagcatagaaaacctccagcacgagtgtagatctattttggagcggcttcagaccgatggacagtttgccctggcgcgaagggtcgctgaactggctgaattacccgtggacaacctagtgattaaagagattacccaggagatgcagacgctcaaacatatagagcaatggtctctgaagcaggcacgtattgacttttggaagaaatgtcatgagaacttcaaaaagaatagtattagtagcaaggccgccagttctttctttagcactcaagcccacgttgcttgtgagcatccaacaggctggtcttcaatggaagagcgtcacctgctcttgacgctggctgggcattggcttgcccaagaggacgtcgtccccttagataagctggaggaactagaaaagcaaatctggttgtgtaggatcactcaacacacactggggcggaatcaggaggagaccgaaccccgctttagtcgtcagatttctacttctggcgaactgtccttcgattcattagccagcgaatttagcttctccaaactcgcggccctcaatacctccaagtatctcgagcttaacagcctgccatctaaggaaacttgcgagaacaggctggactggaaagagcaagaatccttaaattttttgattggtcgcctcttggatgatggttgcgtgcatgaggcctcgcgagtgtgccggtactttcatttttataatcccgacgtggctctcgtgttacactgccgggctctggcatcaggcgaggccagcatggaagacctgcatccagaaattcatgccctcttacaatccgctgagctgttagaagaagaggcccctgacatacctctacgtagggttcatagtaccagctcccttgatagtcagaagttcgttaccgtccctagctccaacgaggtggtaaccaatctggaggtactgacatcaaaatgcctgcacggtaagaactactgtaggcaggttctttgtctgtacgatctggcaaaagaattgggctgtagctacaccgacgtggcggctcaagacggggaggccatgctgagaaagattttggccagtcagcagcctgaccggtgtaagagggcgcaggctttcatatcaacccaagggctcaaaccggacactgtagcggagctcgtggcagaggaagttactagagaattgctgacctctagccaaggcactgggcacaaacagatgtttaaccctacggaggaatctcaaaccttcctccagctgacaacgctctgccaggaccggactctggtcggcatgaaactccttgataagatctcctccgtgccacacggggagctgtcctgtaccaccgaattacttatcctagcacatcactgctttacgttgacatgccacatggagggcattatccgggtgttgcaggccgctcacatgctcacggataaccatttagccccaagtgaggaatatggcctcgtcgttcggctgttgaccggtatcggacggtacaatgagatgacttatatttttgatctcctgcacaagaaacactactttgaggtgctgatgcggaagaagcttgacccctctggaaccttaaaaactgccctgttggactacataaaaaggtgccggcccggcgactcggagaagcataatatgattgctctgtgctttagtatgtgtagagagatcggcgagaatcacgaggctgcggcccgcattcagctgaagctcatcgaatcacagccatgggaggactccctgaaggacggccaccagctgaagcagctccttctcaaagccttgaccctcatgttggatgctgccgagagctatgctaaggatagttgcgtgaggcaagcgcagcactgtcaacgcctcacaaaactgattacactgcagatccatttccttaatacagggcagaataccatgttgatcaacttaggcagacacaaattaatggactgcatactggctttgcctcgtttttatcaagcttccatcgtggctgaagcttatgacttcgtgcccgactgggccgagattctataccaacaagtaatcctgaaaggggactttaactatctcgaagagtttaagcagcagcggcttctgaagtcctcgatatttgaggagatctctaaaaaatataagcagcaccagcccacagatatggtgatggagaatctgaaaaagctcctcacatattgtgaagacgtgtacctctattacaaactggcatatgagcataagttttatgaaatcgtaaacgttcttctaaaggatccacagactggttgttgtttaaaagacatgcttgccggatag

SEQ ID NO: 135855 - DNA, 6993 bp, Artificial Sequence
  Description of Artificial Sequence: Synthetic coding sequence
atggcagccgaggaaggcgttgcgtctgcggctagcgcaggcgggtcctgggggacggcagccatgggaagggtgttgccaatgttgctggtgcccgtgcccgcagaagcaatggggcagcttgggagccgcgcgcaactaaggactcaaccagaggccctaggctcattgaccgccgccgggtcactacaggtgttgagtcttaccccgggctccagagggggcggcagatgttgcctggagggccccttctggcacttcttgtgggaggattccagaaatagcagcactcctaccgaaaaacccaagctgctggcattaggggagaactacgagttgctgatatatgaatttaacctgaaggatgggaggtgtgacgccacaatcttgtacagctgttcccgtgaggccctgcagaagcttatcgacgaccaagacatctccatatccctgctttccctccgaatcttgagttttcacaataatacgagtttgctgttcattaacaagtgcgtcattctacatatcatatttcccgagcgggatgcggccatccgggtcctgaattgcttcacactgccattgccggcacaggccgtcgacatgataattgatacacagctttgcagaggcatcctcttcgttctgtcctccctcggctggatctatatcttcgacgtggttgatgggacatatgtggcccacgtggacctggcattgcataaagaggacatgtgcaatgagcaacagcaggagccagcaaaaatcagctcgttcacctcactgaaggtgagccaagacttggatgtggccgtgatagtgtccagctccaatagcgcggtggcactcaacctgaacctctatttcaggcaacacccagggcatttgctgtgtgaacgcattctcgaagatctgccaattcagggccctaagggcgtggatgaagatgatcccgttaattctgcttacaatatgaaactggcgaaattctcattccaaatcgaccggtcatggaaggcacagctgtcttcactgaacgagaccattaaaaacagcaagctggaggtcagctgctgcgccccctggtttcaagatatcctccatttagaaagtcccgagagcggaaaccactcaacaagcgtgcagtcctgggcttttatacctcaggacataatgcacggccaatataatgtgctacagaaagatcatgctaagacttccgaccctgggcgctcctggaaaatcatgcacatcagtgagcaggaggagcccattgaactcaagtgcgtttccgtcaccggttttaccgccctgttcacctgggaggtagagcggatgggctacactattacgctttgggacctggagactcagggaatgcagtgtttctcactgggcacaaaatgcatacctgtggactcatccggagaccagcaactgtgttttgtgttaaccgagaatgggctgagtctgatcctgttcggtctgacccaggaagagtttttgaaccgcttgatgattcacggatccgcatcgaccgtcgacaccctctgtcatcttaacggatggggccgctgctccattcccattcacgccctggaagctggaatcgagaaccgccagcttgacacggtgaacttcttccttaagagcaaggagaatttgtttaacccgtcatccaagtcttcagtgtcagaccaattcgatcacttaagttcacatctgtacctacgcaacgttgaagagctgatccccgccctagatctgctctgctctgccatcagagaatcttactctgagccacagtccaagcacttctcagagcagttacttaatcttacactgtcttttctgaataaccagattaaggagctcttcattcacaccgaagagcttgacgaacaccttcagaaaggggttaacattttaaccagttatattaatgaactcaggacgttcatgattaaattcccctggaaacttactgatgcaatagatgagtacgatgtgcatgagaatgtacccaaagtgaaggagtctaatatctggaagaagctctcctttgaggaagtgatcgcttccgcgattctgaataacaagattccagaggcccagactttcttccgtattgattctcatagtgcgcaaaagctggaggagctgattggcattggactgaacttggtgttcgataacctcaaaaagaacaacataaaggaggcctcggaactcctgaagaatatgggtttcgacgtcaaaggtcaactcctgaagatctgtttttacactaccaataagaacatccgggactttctcgtggagatcctgaaagagaaaaactatttcagcgagaaggagaagcgcacaatcgacttcgtccaccaggtggaaaagctgtacctgggccattttcaagagaacatgcaaatccagagtttcccacgctactggatcaaggagcaagatttttttaagcataagtctgtcctggattcctttctaaagtatgactgcaaggacgaattcaataagcaagatcataggatcgtgttgaactgggcgttgtggtgggatcagctgacccaggaaagcattctcctgcctaggatctctcccgaggagtataagtcatattctccagaggccctgtggcgctacctcaccgcgcgacacgactggctgaatattatactatggatcggtgagtttcagactcaacactcctacgcatccctccagcagaataaatggccgttgctaacagtagatgttattaaccagaacaccagctgcaataactatatgaggaatgagatcctggataagctcgccagaaacggggtcttcctggcctctgagctggaggacttcgagtgctttctgttgaggcttagccgcattggcggcgtcatccaggacactctgcccgttcaaaattacaagaccaaggagggatgggacttccattctcagtttattctctactgtctggagcattctcttcagcatctgctctacgtgtacctcgactgttacaagctgtcacctgagaactgtccttttttggagaaaaaggagctccacgaggctcatccatggttcgaatttctggtccagtgcagacaagttgcaagtaatctgacagacccaaagctgatcttccaggcgtctctagcaaacgctcagatcctcattccgacgaaccaggcaagcgtcagcagtatgctgttggagggacacacgcttctcgcattagcaaccacgatgtattcccccggaggcgtaagtcaggtggtgcagaacgaagaaaatgaaaactgcctgaaaaaggtggacccccagttacttaagatggctctcactccttacccaaagctgaaaacagctctgtttccccagtgcacccctcccagcgtcctgcccagcgatattacaatatatcacctgatacagagcctgtctcctttcgatccgtccaggctgttcggatggcagtcggccaacacacttgcaattggggatgcctggagtcacctgccccacttttcatccccagatctggtgaacaagtacgccatcgtcgaaaggctgaatttcgcttactatctgcacaatggccggccgtctttcgcctttggcacattcctggttcaagaactgatcaagtccaagacaccaaaacagctgatacaacaagtaggaaacgaagcctacgtgattggtctctcttcttttcatattccctctatcggagcagcttgcgtttgcttcctcgagctgctgggtttagactcactgaaactgcgggtggatatgaaggtcgccaatatcatcctgtcttacaaatgtcgcaacgaggacgcgcagtacagtttcatccgagagtcagtggctgagaagttatccaagctggcggacggcgaaaagacgactaccgaagaactcctggtgctcctggaagagggcacctggaactccatccagcagcaggagatcaagagattgagttcagagagctcctcacagtgggcgctagtagtgcagttttgccggctgcataacatgaagttgagcataagttaccttagagagtgcgccaaggccaatgactggttgcagttcatcattcactcccagctgcacaactatcaccccgccgaagtgaaatcgctgatacagtatttctcgcccgtgatccaagaccatttgagattagcgtttgaaaatctcccttccgtcccaacatccaagatggatagcgaccaagtgtgtaacaaatgtccacaggaactccaaggcagcaaacaggagatgactgatcttttcgaaatcctgctccagtgcagtgaggagcccgactcatggcattggctactggtggaagctgttaagcaacaggccccaatactaagtgtattagcttcctgtctgcagggagcgtctgccatatcgtgtctgtgcgtctggataatcacctcggtggaggataatgtggccacggaagctatgggtcacatccaagactccactgaagaccacacgtggaatctcgaagatttaagtgttatttggcggacgttacttactaggcagaagagcaagacacttatccgagggtttcaactgttttttaaagacagccccttacttctcgtgatggagatgtacgaactgtgcatgtttttcagaaattataaggaggctgaggcaaagttgcttgagtttcagaagagtctcgaaactctgaataccgccgctaccaaagttcaccccgttattcctgccatgtggttggaggaccaggtgtgctttctgttgaaattgatgctgcagcagtgtaaaacgcaatatgagcttggcaagcttctgcagctctttgttgagcgcgaacatctcttcagtgatggaccagatgttaagaaactctgtatcctctgtcagatattaaaagatacatctattgccatcaaccataccataatcacatcttattcaatcgagaacctgcagcacgagtgcaggagcattctcgagagacttcagacggacggtcagttcgccttggccaggagagtggcagaattggcggagctccccgtcgacaacttagtcattaaagagataacgcaggagatgcagacactgaagcacatagaacagtggtccctgaagcaggctaggatagacttttggaagaaatgtcacgaaaattttaagaagaactccattagctcgaaagccgcttcttcatttttcagcacccaggcccacgtagcctgtgagcacccaacaggatggtcttcaatggaggaacgccaccttctactgacactggcaggccactggttggcgcaggaagacgttgtgcccctggacaagctggaagagttagaaaaacaaatttggctgtgcaggatcacgcaacacactttaggtcgcaatcaagaagagacagaaccgagattttcccgccagatctcaacctctggtgaactgtcattcgattctcttgcaagcgagttcagtttttctaagctggcagccttaaataccagtaagtacctggagctgaacagcctccctagcaaagagacctgtgaaaacagactcgactggaaggaacaggagtccctgaacttcctgattggccgcctcttggatgatggatgcgtgcacgaggcaagccgcgtctgtcggtattttcacttctacaaccccgacgtcgccctggttcttcactgtcgggctctcgctagcggagaggcctccatggaagacctgcaccccgagatccatgcgctgttgcagtcagccgagcttctggaagaagaagccccggacataccattgagacgcgtgcattcccggcacaagcagatgttcaaccctacagaggagtctcaaaccttcctgcaactgactaccctatgtcaggataggaccctggttgggatgaagctcctggacaaaatttcatccgtccctcatggcgaactgtcctgtaccactgagctccttatcctggcacaccattgctttaccctgacctgccacatggagggaattatacgagtgcttcaggccgcccatatgctcaccgacaaccatctagccccgtccgaggagtacggcctcgtggtgcgtctcctcaccggtattggcaggtacaatgagatgacttacatctttgaccttctgcacaaaaagcattatttcgaagtccttatgagaaaaaaattagatccatcgggaactctcaagacagcccttctagattatattaagaggtgtcggcccggggattcggaaaaacacaacatgattgcactgtgcttttccatgtgtcgggagatcggggagaatcacgaagccgcagcccgtattcagcttaaattgatcgaatctcaaccttgggaggacagtttgaaagatggtcatcagctcaaacagctcctcctgaaggcccttactcttatgctggatgccgctgaatcatatgccaaggattcctgtgtcagacaggcccagcactgccagcgcctcaccaagctaatcacgctgcagatccatttcttgaatacaggccagaatacaatgttgataaatttgggacggcacaaactgatggactgcattctggccctccctaggttctaccaggcctctatcgtcgctgaagcgtacgacttcgtacctgattgggcggagatcctctatcagcaggtgatcttaaaaggggatttcaattatttggaggaatttaaacagcagaggctactaaaaagctcaattttcgaagaaatctcaaagaagtataaacagcaccaacctacagatatggtcatggaaaatctgaagaagctgttgacatactgcgaggacgtttacttatactataaattagcatacgagcacaagttctatgagatagtaaacgtgctgttgaaagacccccagacaggctgttgcctgaaggacatgctagccgggtag

SEQ ID NO: 135856 - DNA, 6240 bp, Artificial Sequence
  Description of Artificial Sequence: Synthetic coding sequence
atggccgctgaggaaggtgtggcctccgctgcatcagctggcggtagttggggaaccgctgcaatgggtagggtattgccaatgcttctcgtgcctgtgccagcagaggccatgggacagctggggagccgggcacagttacgcactcaacccgaggcactcggatcattgactgctgccggatcattgcaggtgctctcacttacacctggtagcagggggggtgggcggtgctgcctcgaaggacccttctggcactttctctgggaggattcccgaaacagctcaacacccactgaaaagcccaaactgctcgcccttggggagaattacgaattgttaatttatgagtttaatttgaaagatggtaggtgtgatgctaccatcctttattcatgttcccgcgaagccctacagaaactgatcgatgatcaagacatctctatctccctcctcagtttgcgaatcctgagtttccacaataacacaagcctgctattcatcaacaaatgtgtcatcctgcacatcatttttcccgagagggacgcagccatccgggtgttgaattgttttactctgccgttgcctgcccaggctgtcgatatgatcatcgacacgcaactgtgtcggggaatattatttgtattatcaagcctggggtggatttacatctttgacgtcgtggatggtacatatgtggcacatgtggatctggcccttcacaaagaggacatgtgtaatgagcagcagcaagagcctgctaagatcagttctttcaccagcctgaaggtgtcacaggacttggacgtcgcagtgattgtctcttcatcgaatagtgctgttgctctgaatctgaacctctattttcgccagcacccgggacatctgttgtgcgagagaattctggaggatctcccgatccagggacctaaaggggtggatgaagacgaccctgtgaactccgcgtataatatgaaactggctaagttttctttccagatcgatcggagctggaaggctcagttatccagcctgaacgagactatcaagaattctaaattggaggtgagctgctgcgccccgtggtttcaggacatccttcatctggagtcaccagagtctggcaaccactcaacttccgtccagagttgggcctttataccccaggatattatgcacggccaatacaacgtgctacagaaggatcacgcaaaaacaagtgatcccggtcgttcttggaaaatcatgcatattagcgaacaggaggagcctatcgagcttaaatgcgtgtctgtgacaggctttacggcactgttcacttgggaggttgaaaggatgggttataccatcactctttgggatctggaaacacagggcatgcagtgcttcagtctgggcaccaaatgtatacccgtcgatagctctggggaccagcaactttgctttgtcctaaccgaaaatggactgagtctaatcctgttcggcctcacacaagaggaatttctcaataggctgatgatacacggctccgcaagcactgttgacaccctgtgtcacttgaatgggtggggccgttgcagcattccgatccacgccctggaggccggcatcgaaaacagacagttggacacagtgaattttttcctcaagagcaaagagaatctgttcaacccatccagcaagagcagcgtgagcgatcagtttgatcacctgtcctcacacctctaccttagaaacgtggaggaactcattccagcactcgatttgctgtgctccgctatccgggagtcttactccgagccccaaagtaaacatttctctgagcagctgctaaacctgaccctgtcgttccttaataatcagatcaaagagctttttatccacactgaggaactggacgaacacctgcaaaaaggggttaatatactcactagctatatcaatgagctgaggacattcatgatcaaattcccctggaagcttaccgatgcgattgatgaatacgacgttcatgagaatgtcccaaaagtgaaggagagtaatatttggaaaaaactctcctttgaagaagtgatcgcgtccgcaatcttaaataataagatccctgaggcccagacattcttccgaatcgactcccactcagcccagaagttggaggagctcattgggattggactgaacttggtgttcgataacctaaaaaaaaataacataaaagaagcctcggagctcctaaagaacatgggcttcgacgtaaagggtcagctgctcaagatttgtttttacactaccaataagaacataagagattttctagtagaaattctcaaagagaagaactactttagcgagaaggaaaagcgaactatcgacttcgttcaccaagttgaaaagttatatctggggcattttcaggagaatatgcagatccaatctttcccacggtactggatcaaggaacaggatttcttcaagcacaaatctgtgctggactcattcttgaagtacgattgtaaagacgaatttaacaaacaggatcaccgcatcgtgctgaactgggcactatggtgggatcagctgacccaggagagtatcctgctgccccgaatctcaccagaggaatataagagttattccccggaggcattgtggcggtacctcactgctcggcacgattggttaaatatcatactttggatcggcgaattccagacccagcactcctacgccagcttacaacagaataagtggcccctcttaactgtggatgttatcaatcagaatacgtcgtgtaataattatatgagaaacgagatcctcgataagctggcaagaaacggcgtgttcctagcgagtgaacttgaggacttcgagtgctttttactccgtctgagccggatcgggggggtgatccaggatacactgcccgtccaaaattataagacaaaggagggctgggacttccactcccagttcatcctatattgtttggagcactccttacagcaccttctgtacgtgtacctcgactgctataagctttcgcctgaaaattgccctttcttagagaaaaaagaactacacgaagcccatccatggtttgagttcctagtgcagtgtcgtcaggtggctagcaatctcaccgatcctaagcttattttccaggcgtctctggcgaacgcccaaattctgattccaacaaaccaggcaagcgtgagttccatgctattggaaggtcacactttgttggccctggccacaactatgtactcacctggtggtgtgtcccaagtcgtgcaaaacgaagagaacgagaactgtctgaagaaagtggatcctcagcttctgaaaatggcactgactccatatcctaaactgaagactgcactctttccccagtgcacaccccctagcgtgctaccttccgacatcacgatttaccatctgatccagtccctgtcgccatttgacccctctaggttgttcggttggcagtctgctaacacactcgccatcggggacgcttggtcgcatctgcctcattttagctcacccgatcttgttaacaaatacgccatagttgagcggctaaactttgcctactatttacacaacggaagaccttcctttgcattcgggacttttctggtgcaggaactgatcaaaagtaaaactccaaaacagctgatccagcaggtggggaatgaagcttacgtgattggactcagcagctttcatattcccagtattggggccgcttgtgtttgcttcttggagctcttgggactggacagtttaaaattacgagttgatatgaaagttgcaaatattatcctctcttacaagtgcaggaacgaggacgcccaatatagcttcattagggagtcagtggctgagaagctttcgaagctggcagatggagagaagactacgaccgaggaacttcttgtgctgctcgaagagggcacctggaatagcattcagcagcaagaaattaagaggttgtcttcagagtctagttctcaatgggcattagttgttcagttctgcaggttgcacaatatgaagctctctatcagttacctcagagaatgcgccaaggcaaacgactggttgcagttcataattcatagccaactgcacaactatcaccctgcagaggtaaagtctttaattcagtacttctcccctgttattcaggaccatctgaggttggcctttgagaacctgcctagcgtccctaccagtaaaatggattcagatcaagtctgtaacaaatgcccgcaagaactgcagggtagtaagcaggaaatgactgacctattcgagatcctgctccagtgttcagaagagccggacagctggcattggctgctggtggaggctgtcaagcaacaagcacccatcctgagcgttttggccagttgcctgcagggggcttccgctatctcctgcctgtgcgtgtggattatcacctctgtagaggacaacgtagctaccgaggcaatgggtcatatacaggacagtaccgaggaccatacgtggaatctggaggacctcagtgtgatctggcggaccctgttaactagacaaaaatccaagacgcttattagaggatttcagctgttctttaaagacagtcctctgctgttggtgatggagatgtacgagttgtgtatgttctttcgtaattacaaggaggcagaggccaagctactcgagttccagaagagtttggagaccctgaacaccgccgcaactaaagtccacccagtcattcctgctatgtggctcgaggaccaggtctgcttcttgctgaaactgatgttacaacagtgcaagacccagtacgaacttggcaagttgcttcaactcttcgtggagagggagcacctcttttcagatggtccggacgtgaagaaactctgcatcttgtgtcagatcctcaaagacacgtctattgcaattaaccacacaatcatcactagctactctatcgagaacctccagcacgaatgccggtcaattctggagagactgcagacagatggacagttcgcccttgcgcgaagagtagcagaactggcagagttgcccgtggataacttggtgataaaagagatcacccaggaaatgcagacgctgaagcacattgagcagtggtctctgaagcaggctagaattgatttttggaaaaagtgccacgagaactttaaaaagaactcaatcagtagtaaagcagcctccagcttcttcagcactcaggcccatgtcgcatgtgagcatcccactgggtggtccagcatggaagaacgccacctgctgctgaccctcgccgggcactggctggctcaggaagatgtagtgcctttggataagttagaagaactggaaaaacaaatttggctctgtcggatcacccagcataccctgggcagaaaccaggaagagactgagccccggttttcccgacagatttccacgagcggggagctttcgtttgactccctcgccagcgagttttccttctctaaattggccgccttaaacacgtctaagtatctggagctgaactctctgccctccaaagaaacatgtgaaaatcggctggattggaaagagcaggagtccctcaactttctgatcgggaggctgctagatgatggatgtgtgcatgaggctagccgcgtctgccgatacttccacttctacaaccccgacgtagctttggtcctccactgtagagctctggcaagcggggaggctagcatggaagatctccatcctgagatccatgccctgctgcagtccgccgagttactggaggaagaggcccccgacattcccctcagaagagttcattccacgtcctcgctcgacagtcagaaatttgtcacggtccccagttcaaacgaggtggtgacaaacctagaagttctgacgagtaagtgcctgcacggcaagaactactgtcggcaggtgctgtgcctgtacgatcttgcaaaagagctcgggtgctcttacacagatgtggcagctcaggacggggaggctatgctgagaaagatcttagcttcacagcaacccgataggtgcaagagagcgcaagcctttataagtacccagggtttgaaacccgacaccgttgccgaactggtagcagaggaagtcactagggaactgcttacctcatcacagggtacaggagctctcccaccgggagacagccagcccctctag

SEQ ID NO: 135857 - DNA, 2001 bp, Artificial Sequence
  Description of Artificial Sequence: Synthetic coding sequence
atggaacaagagcctcagaatggggagccagccgagattaaaataattcgcgaggcatataaaaaagcttttcttttcgtgaataaaggcctcaacacggacgaattgggccagaaagaggaagcgaaaaattactacaaacaggggatcgggcacctacttcgaggcatcagtatttctagtaaggaatctgaacacaccgggcccggatgggagtccgctaggcagatgcagcagaagatgaaggaaacgcttcagaatgtgagaactcgcctggagattcttgaaaaggggttagctacgagtttgcaaaatgaccttcaggaggtgccgaagctctatcccgagttcccccctaaggacatgtgtgagaagctgcctgagccacaatctttcagttcagctcctcaacacgcagaggtaaatggaaacacatccacgccgtctgctggtgcagtagcggctcctgcgagcctgagcctaccttcccagagctgccccgccgaagctcctcctgcatacacccctcaagcagctgaaggccattatactgtgagctatgggaccgattctggtgaattttcctctgtgggagaggagttttacagaaatcattctcagcccccccctctggaaacgctgggcttagatgcggacgagctgatcctcatccctaacggtgtgcaaatatttttcgttaaccctgccggcgaagtgtccgcgccgagttaccccgggtaccttcgcatcgtccgctttctcgacaacagtttggacacggtgctgaatagacctcccgggttcctgcaggtctgtgattggctttaccctctggtgccagatcgttccccagtccttaaatgtaccgcgggcgcatacatgttcccagatacgatgctgcaggccgctggctgttttgtaggggtcgtgctgtcaagtgagctcccagaggatgaccgggaattattcgaggacttacttcgacaaatgtccgatcttaggctacaggccaactggaaccgcgctgaagaagaaaacgaattccagattcccggccggacgaggccatctagtgatcaactgaaggaagcttccgggaccgatgtcaagcagctcgaccaggggaacaaggacgtgcgccacaaggggaagcgggggaagcgggccaaagatacatcgtcagaggaggttaacctgagccacatagtgccttgcgaaccagtaccagaagaaaaacctaaggaacttcctgaatggtcagagaaggtagcacacaatatcttgtccggggcctcatgggtctcatgggggcttgttaagggcgcagaaatcacaggcaaggctatccagaaaggggccagtaagctgagagagcgaatccagcccgaggaaaaacccgtcgaggtcagtcccgccgtgactaaaggcctctacatcgctaagcaagccactggcggcgcagccaaagtgagccagttcctcgtggatggcgtttgtactgtcgcgaactgtgtggggaaggaattggcccctcatgtaaaaaagcacggctcaaaactggtccccgagagtctcaagaaggacaaggacggcaaatccccgctcgacggggctatggtagtggctgcctcgagtgttcaaggtttcagtaccgtctggcaggggcttgagtgcgcagccaaatgcatcgtcaataacgttagtgccgagaccgtgcagacagtcagatacaaatatgggtacaatgctggggaggcaacccatcatgctgtggacagcgccgtgaatgtaggagttaccgcttataatattaacaatatcgggatcaaggcgatggtgaagaagaccgcaacacaaacaggtcatacgctgctggaagattaccagatcgtcgacaatagccaacgggaaaaccaggaaggggccgcgaatgttaatgtcagaggtgagaaagatgagcagacaaaggaagttaaggaggcaaaaaagaaagacaaatag

SEQ ID NO: 135858 - DNA, 2001 bp, Artificial Sequence
  Description of Artificial Sequence: Synthetic coding sequence
atggagcaagaacctcagaatggggagcccgcagaaatcaaaatcatcagggaagcatataagaaggcattcctgtttgttaacaaggggctaaataccgatgaacttggtcagaaggaggaggctaagaattattacaagcaaggcatcgggcatcttctcagaggtatatctatttcaagcaaagagtctgaacacactggccctgggtgggagtccgctagacagatgcagcaaaagatgaaggaaactctgcagaatgtgaggacaaggctcgaaatcttagaaaaggggttagctacatcattacagaatgatttgcaggaggtgcctaaactatatcccgaatttccccccaaggacatgtgtgaaaaattaccagagccccagtcgttctcatccgctccacagcacgcggaagtgaacggcaatacttccacacctagcgcgggggccgtcgcggcccccgcgagcctgagcctcccctcccaatcctgccccgccgaagcaccccccgcttataccccccaggccgccgaaggtcattacaccgtgtcttatggcacagactcgggggagtttagctctgtcggcgaagagttttacaggaaccatagccagccaccccccctggagacactgggtctggatgctgacgaacttattcttatccctaatggggtacagatcttctttgtgaatcccgccggtgaggtcagcgctccttcctaccccggatacctccgcattgtaagattccttgataacagcctcgacactgtgctgaatcggccaccaggctttttgcaggtgtgtgattggttatacccactggtgcctgacagaagtcccgtactgaagtgtactgctggtgcctacatgtttcccgataccatgttacaggcagccggttgcttcgttggagtcgtgctgagcagtgagctacccgaggacgaccgggaactctttgaagacctgctccgccaaatgtccgaccttagacttcaggccaattggaatcgcgcagaagaggaaaatgagtttcagatcccggggcgcacgcggccgtcatccgaccagctcaaagaggcttccggtacagacgtgaaacagttagatcagggaaataaagacgtacggcacaagggaaagcggggtaaacgagctaaggataccagctccgaggaggtcaacctctctcatattgtgccatgtgaacctgtccccgaggaaaaacctaaagagctgcctgaatggtcggagaaggttgcccacaacatcctctccggggccagctgggtctcatggggtctcgtgaaaggggcggagataactggtaaggccatccagaagggggcttctaaacttagagaaaggatccagccagaggagaaacccgtcgaagtcagtccagcggtcaccaaggggctttacattgccaagcaggcgaccgggggcgctgccaaggtgagtcagttccttgttgatggcgtgtgtaccgtagcaaactgcgtgggaaaggagctggcacctcacgtgaagaaacacggttctaaactggttcctgagtccctgaaaaaggacaaagatggtaaatctcctctggatggggccatggtcgttgcagcatccagcgtgcaaggcttctccaccgtatggcaaggtctagagtgcgccgccaaatgtattgtcaataacgtaagtgccgaaaccgtgcagaccgtgcggtataagtacggatacaacgcaggtgaggccactcatcacgctgtggacagcgccgtgaacgtaggcgtgaccgcatacaacattaataatatcggaatcaaggccatggtaaaaaagaccgccactcagactggtcacacccttctggaagactaccagattgttgataatagccagagggaaaaccaggagggggccgctaacgtgaacgtcaggggcgagaaagatgagcagaccaaggaggttaaagaagcaaaaaagaaagacaagtag

SEQ ID NO: 135859 - DNA, 2001 bp, Artificial Sequence
  Description of Artificial Sequence: Synthetic coding sequence
atggaacaggagccgcaaaatggggagcccgcggagattaaaatcattagagaggcatacaagaaagcgttcctgtttgtcaacaagggattgaacactgatgagctagggcagaaggaagaggcaaagaactattataagcagggaataggccacctccttaggggcatctccatatcatccaaggaatctgagcacacaggtccaggctgggagtccgcgcgccagatgcaacagaaaatgaaagaaactctgcagaacgtgcggacccgactcgaaattctggagaaagggcttgctactagcctgcaaaatgatttacaggaggtgcctaagctttacccggagtttcctccaaaagatatgtgcgaaaagcttcctgaaccgcagtccttcagtagcgcgccccaacatgctgaggtgaacggaaatacctctacccctagcgctggcgccgttgcggcccccgcctctctctctttacccagccagtcatgccccgccgaggcccccccagcgtacaccccccaggcggcagagggccactacaccgtcagttacggcactgattccggggagttcagtagcgttggtgaagaattttacagaaatcactcccagcccccacctttggaaacccttggccttgacgccgacgagctgatcctgatcccaaacggggttcagattttcttcgtcaatccagctggggaggtgtccgcacccagttaccccggctacctgcgtattgtgcggttcctcgacaactctttggacaccgttttgaacagacctcctggctttttgcaggtgtgtgactggctgtatcctctagttcccgaccggagtccagtgttaaagtgtacggcaggcgcctacatgttccctgacacaatgttgcaagccgccgggtgttttgtgggagtcgttctgtcctcggagcttccagaagacgacagagagctgtttgaggatctgctgaggcagatgtcagatttacgcctgcaagccaactggaaccgcgcagaagaagaaaacgaatttcagatccctggccggacccggccaagttcagaccaattaaaagaagccagcggaacagacgtcaagcagctggaccagggcaataaagacgtgcgccataaaggcaagaggggcaaacgggctaaggatacatccagcgaagaggttaacctatctcacatcgttccctgcgagcctgtgccagaagagaagcccaaggagctacctgagtggtcagagaaggtagcccataatattctgagtggtgcaagttgggtgtcttggggtttagttaaaggcgccgaaattacaggaaaggccattcaaaagggcgcctcgaagctgcgggagagaatccagccggaagagaaaccagttgaggtgagtcctgccgtgactaagggactgtatattgctaagcaggctactggtggcgcagccaaagtctctcaatttctggtagacggtgtttgcacagtggcaaattgcgtggggaaggagctcgcaccccacgtaaagaaacatgggagcaaactggtgcccgagtcacttaagaaagataaagacggcaaatcccccctcgatggcgcaatggtggtggctgccagttctgtgcagggtttcagcaccgtatggcagggcctcgaatgtgccgccaaatgcatcgtcaataatgtgtctgcggagaccgtgcagacagtcagatacaagtatgggtacaatgccggggaggccacacaccatgcggtcgattcagctgtcaacgttggcgttactgcttacaacatcaacaatatcgggataaaagctatggtgaagaaaacagccacacagaccgggcataccttactggaggattaccaaattgttgataactcacagagggaaaaccaggaaggagccgccaacgtcaatgtgcgtggagaaaaggatgagcagaccaaggaagtgaaagaagcaaagaaaaaggacaaatag

SEQ ID NO: 135860 - DNA, 2001 bp, Artificial Sequence
  Description of Artificial Sequence: Synthetic coding sequence
atggaacaagagcctcagaacggtgaacctgccgaaataaaaatcataagggaagcttataagaaagccttcctgttcgtcaataaagggcttaacaccgacgagctgggacaaaaagaggaagccaaaaactactacaagcaaggtatcgggcatctgctacgaggaataagcatctccagtaaagaaagtgagcacaccggacctggctgggagagcgccaggcaaatgcagcagaagatgaaggagaccctgcaaaacgtgagaacgagattagagatcctggagaaagggctggcaacttcactgcagaatgacctgcaagaggtgcctaagctgtaccccgaattcccaccaaaagatatgtgtgagaagctacctgaacctcagtctttttcctccgccccacagcatgctgaagtgaacgggaacacatccacaccctctgcaggagccgtggcagctccggctagtctgtctctgccatctcagtcgtgccccgctgaggcccctcccgcctacaccccgcaagcagcagaaggtcattacacagtctcttacggcacagactccggggagttttcctccgtgggcgaggaattctaccggaaccattcccaacctccccccttggaaactctgggtctggatgccgacgagctgattctgattccaaatggggtgcagattttttttgttaacccagcgggcgaagtttcagccccatcttaccctggttacttgcggatcgttagattcctggacaactcactcgacactgtgttgaatcggcctcccgggtttctgcaggtatgcgattggctgtatcccctggttcccgatcggtcacccgtactaaagtgcaccgcaggcgcctacatgttccccgacactatgctccaggccgctggttgctttgttggtgtggtgctgagctccgagctccctgaagatgaccgggaactctttgaagatctgctgcgacagatgtcggatcttcgtctccaggccaattggaatcgtgctgaagaagagaacgaattccagatacccgggcgcactagaccttcaagcgatcagcttaaagaggccagcggaacggatgtgaagcaacttgatcaggggaacaaggacgttagacataagggcaagagaggcaagcgagcgaaggacacctcaagcgaagaagtcaacttgtcacacattgtcccatgtgagcccgttcccgaggagaagccaaaggaacttccggagtggtccgagaaggtggcccataacatcctgagcggagcttcctgggtgagctggggtttggtgaagggcgcagagattactggtaaagctattcaaaaaggagcttcaaaactgagagagagaattcagcccgaggaaaagcctgtggaggtctcccccgccgtgactaaaggcctgtatatcgccaagcaagctaccggaggagccgctaaggtgagccaattcctcgtcgacggagtgtgtacagtcgccaattgcgtggggaaagaactggcaccgcacgttaagaagcatggatctaaacttgtccctgagagcctcaaaaaagacaaggatggtaagtcccccctagatggagcaatggtggtcgccgcgtccagtgtgcaaggcttttcaacagtatggcagggccttgagtgcgctgcaaagtgcattgtcaacaatgtgtccgccgaaaccgtgcagaccgtacgatataagtacgggtataatgccggagaagcaacgcatcacgctgtcgatagtgctgttaacgtcggcgtaacagcttataacattaataacataggcataaaggcaatggttaaaaagactgctactcagaccgggcacactctgctggaggattaccagattgtcgacaactctcagagggagaatcaggagggagctgcgaatgtgaacgtacgaggtgagaaagatgaacagacaaaagaggttaaagaagctaagaagaaagataagtag

SEQ ID NO: 135861 - DNA, 846 bp, Artificial Sequence
  Description of Artificial Sequence: Synthetic coding sequence
atgggggagatcaaagtgtccccggattacaattggtttaggggcacagttccgctgaaaaagatcatcgttgacgatgacgattccaagatctggagtctttatgatgcaggcccacgttccattcgatgtccgctcattttcttgcctcccgtgagtggcaccgcggacgtcttttttagacagattctggctctgactggttggggatatagggttattgccgtgcacctgttcggcgcgtcactcggaggcttcctggcccagaaattcgctgaatatactcataaaagcccccgtgttcactctctcattctgtgtaattccttctctgacacaagcatttttaaccagacctggaccgcaaacagcttctggttgatgcccgctttcatgctcaagaaaattgtattgggcaatttttcatctggcccagtggatcccatgatggcggatgcgatagacttcatggtggatcgtttggaatcgttagggcaatcagagttagctagcaggctgaccttgaactgccagaattcctacgttgaaccgcacaagatccgagacataccagttaccataatggatgtgttcgaccagtccgctctgtctacagaggctaaggaggagatgtataaactgtatccaaacgcgagacgggctcacctgaagacaggagggaatttcccctatctgtgcaggtcagcagaggtgaatctttacgtgcaaatacatctgctgcagtttcacggaacaaaatacgcagctatcgacccatcaatggtgagcgccgaggagctcgaagttcagaagggatcactggggataagccaggaggaacagtag

SEQ ID NO: 135862 - DNA, 927 bp, Artificial Sequence
  Description of Artificial Sequence: Synthetic coding sequence
atgggagaaataaaagtatcacctgactataattggttccgagggacagtccctctgaagaagatcattgttgatgatgacgacagtaagatttggagcctctatgacgctgggccaaggagtatcagatgccctctgattttcctccctccagtgagtggcactgcagacgtgttctttagacagatcttggccctgactggatgggggtatagagtgattgctttgcagtatccagtgtattgggaccacctcgagttttgtgatggattcagaaagctactggaccatctgcagctggacaaggtgcacctgtttggtgctagcctgggcgggtttctggcccagaaatttgctgaatatacccataagagtcctcgagtccactctttgatactctgcaatagttttagcgatacatctatcttcaatcaaacctggactgcgaattctttttggctgatgccggcctttatgttgaagaagattgtgttgggcaacttcagctcaggcccagtcgacccaatgatggccgatgccatcgattttatggttgatcgcctcgaatctttgggccagtccgagctggcatcgcgcctgacattgaattgccagaactcctatgtggaacctcacaagattagagatatccccgtgacaattatggacgtgttcgaccagagcgctcttagcacggaggctaaggaagagatgtacaagctgtaccccaacgcccggcgtgcccatctgaaaacagggggcaacttcccttacctgtgtaggtccgctgaggttaacctgtacgtgcagatccacctgcttcagtttcacggcacaaaatacgctgcaatcgacccatcgatggtgagcgcagaggagctagaagtccaaaagggctccctaggaatctcccaggaggagcagtag

SEQ ID NO: 135863 - DNA, 927 bp, Artificial Sequence
  Description of Artificial Sequence: Synthetic coding sequence
atgggggagatcaaggtcagtcccgactataactggtttcggggaactgtgccactcaaaaagattatcgtggatgacgatgactccaagatttggtcactgtatgacgctggcccccgctctatacggtgtccattaatttttctgccacccgtttctggcaccgccgatgtcttctttagacagatccttgccttgacaggctgggggtatcgggtaattgcactgcagtaccccgtctattgggaccatctggagttctgtgatgggtttcgtaagcttttggaccacctgcagctcgataaagtacacttgtttggtgcctctctcgggggcttcctcgctcagaagttcgcggaatacactcacaaatcccccagggtgcacagcctgatcttgtgcaattcgttctcagatacatcaatcttcaaccagacctggaccgccaacagcttttggctgatgcccgccttcatgttgaagaagattgtgctcggtaacttctcatccgggcctgtggacccgatgatggcagatgccatcgactttatggtagaccgcctggagagcctggggcaaagtgaactagcttcaaggcttacactgaactgccagaactcttacgtggagccccataagatcagagacatccctgtgaccatcatggatgtttttgatcagtcagcgctttctaccgaggcaaaggaggagatgtacaagctctatccgaatgcaagacgcgcacacttgaaaactggaggcaacttcccgtacttgtgtcgaagtgccgaagttaatttgtacgtgcagatccaccttcttcagttccatggaactaagtacgccgctatcgatccgtcaatggtctctgctgaagagctagaggtgcagaaaggttcactgggtatctctcaggaggagcagtag

SEQ ID NO: 135864 - DNA, 2388 bp, Artificial Sequence
  Description of Artificial Sequence: Synthetic coding sequence
atggccgttctgctgctcctgctgcgcgctctcaggaggggtcccggtccgggtccaaggcccttatggggtcctggaccggcatggagccccggattccccgctaggcccggacgaggccggccctatatggcaagtcgtccgccaggtgatctggccgaagctggaggacgagccctgcaaagtcttcagctgagattactaacgccaaccttcgaaggcataaatggtctcttactcaagcagcatctggtgcagaatcctgtgcgcctttggcagctgctggggggaactttttactttaacacgtcccgtctgaaacagaaaaataaggaaaaagacaagtccaaaggaaaagcacctgaggaagatgaggaagaaaggcggcgacgtgagcgtgatgaccagatgtatagggagaggctccgtacactgttggtgatcgccgtcgtgatgtcccttctgaacgccctctccacgtcaggaggcagtatatcatggaatgactttgtgcatgagatgcttgctaagggagaggtgcagagggttcaagtcgtgccagaatcagatgtggttgaagtctatcttcatcctggggctgtggtcttcggcagaccgcggttggcactcatgtaccgcatgcaggtggcgaacatcgataagtttgaagagaaactgcgggccgctgaagacgaattaaatatcgaggctaaggataggatcccagtctcctacaaacgcaccggattctttggcaacgccctttactcggtggggatgacagccgttgggcttgcaatcctgtggtatgtgttcaggctggcaggcatgacagggcgcgagggtggattttccgccttcaaccaactaaagatggcccgttttacaatcgtagacggcaaaatgggcaagggcgtttcctttaaagacgtggcaggaatgcacgaggcaaagctggaagtgagagagttcgtcgattatctaaaatcacctgaacgctttctgcagctcggcgccaaggttcctaagggagctctgctcctgggtcccccaggctgcggcaagaccttgctagccaaggccgtggcaactgaggcgcaagtgccctttttggccatggccgggccagagttcgtggaagtcatcggggggctgggtgcggcgcgcgtacgaagtttatttaaggaagcgagggccagagcaccatgcatagtgtacattgacgaaattgatgcagttggtaaaaaaagatcgaccactatgtctggattttccaacacagaagaggagcaaaccttgaaccagctcctcgtcgaaatggatggcatggggactactgatcacgtcattgtgttagctagcacaaacagagcagacattcttgatggcgccttgatgcggcccggcagacttgacaggcatgtcttcatcgatctgcctacactgcaggaacgtagagagatatttgaacagcacctcaaatcacttaaactgacccagagttctacattttatagccagcggctggccgaattaactcccggcttcagcggcgccgatatagctaatatatgtaacgaagccgcacttcacgctgcgcgcgagggtcacacttctgtgcacaccctaaacttcgagtacgcagttgaaagagtgctcgccggaaccgcgaaaaagtccaaaatcctgagtaaagaggagcagaaggtagtcgcttttcacgaatcaggacatgcactggtaggctggatgctggagcatacagaagcagttatgaaggtgtcaattacccctcgaacaaacgccgcgttagggttcgcacagatgcttccccgggaccaacacctgttcactaaggagcagctgtttgagaggatgtgtatggccctgggcggccgcgcatccgaggcactgtcgtttaacgaggtgactagtggggctcaggacgacctgaggaaggttacccggattgcctatagtatggtgaagcagtttggaatggctcccggaatcggccctatttccttccctgaggctcaagaaggactcatgggtatcggtcgaagaccgttttcccagggactgcagcagatgatggaccatgaagccaggcttctggtcgccaaagcgtatcgccataccgaaaaagtgcttcaggacaacctcgataagcttcaggctctcgcaaacgcactgctcgagaaggaggtgattaactatgaagacattgaagccctgataggcccccctcctcatgggccaaaaaaaatgattgctcctcagcgctggattgatgcccagcgggagaagcaggacttaggcgaggaagaaacagaggaaactcaacagccaccgcttggcggcgaggagcctacatggccaaagtag

SEQ ID NO: 135865 - DNA, 672 bp, Artificial Sequence
  Description of Artificial Sequence: Synthetic coding sequence
atgaggctcaggtgtacccgcagagggagagataccttaccgtgcacactgtctacatcgagcaccccatggagcgctagtagccaggtgcccagggcacaactcggaaaggcagtggggagctgcagaggagtggggagctgctgcgcaagacactgtaaaacacacttggctagccttcgccagccatgcggggagagaacaggagcagcctgtgtcttgctgatttactttcgggttactatttatttctacgtcgagatcgaaaagctactcatcatcgtcgcaaagcaggaaggattaagcggcaaccacaaacccgtcgagcggaaatatatgacttacctgtccgcccaggatcacgagcttattcaggtggtccagaacggccacctacaaatgtgtggcaagtcagagactggaaacgaagccagcccaggtctgcccaaacgtgctcgaagctgccctaggaaaaatcggaaatggcttcggttcatgagcagagctaccccgtggtgggccgggtgttggtcaaccaggcgggatgagggcttgcacaatcccagtacaaatgccgcactgggattcgcacaggcccctcagagaccagctcctttgcatgaacagttgtttgaacggatgtgtatggccctgggaggccgcgcctcctag

SEQ ID NO: 135866 - DNA, 618 bp, Artificial Sequence
  Description of Artificial Sequence: Synthetic coding sequence
ttgggtccccaggcatgtaccgtggtgcctaggtctaaatgctttgaccttgagatggtgtcgagccggtgggagcccctgctcttactgactgaagttacatctgcaaacgaggtctgggttacctctaactctactgctctagttttcgttagcgataacgtgagggaggagctcgaggaggtgcaagatctcctgtgcagaacgctgcctctgcccgtccaactgtcatttcccgaggaagccctggacgtggcgagggtggctcacgtctttgtctcccccttctgcttttccgctgggtctgaggagagacgccgacgagagagggatgatcaaatgtatagggaacggctgaggactttgctggtcatcgcggtcgtgatgagtttgttgaacgcactcagtacttccgggggcagcatcagttggaatgactttgttcatgagatgctggccaagggcgaagtgcagcgggtgcaggtggtgccagagtcagacgttgtggaggtgtatttgcaccctggcgctgtggtgttcggcagaccaaggctcgcccttatgtaccgtatgcaggtggcaaatattgacaagtttgaggaaaagctccgagcgtag

SEQ ID NO: 135867 - DNA, 1470 bp, Artificial Sequence
  Description of Artificial Sequence: Synthetic coding sequence
atggctgtgctgctgctgctactgagggcactgaggagaggccctgggcctggccctaggccactgtgggggccaggacctgcatggtctcctgggttcccagccagacctggaagggggagaccttatatggcatcacgcccgccgggggacctggctgaggcaggtggccgtgctttacagtcgttgcagcttcgcttactcaccccaacctttgaggggataaacggactgcttctgaaacagcatctggtgcagaacccagttcgcctctggcagctgctcggagggaccttctacttcaacacttcccgcctgaagcagaagaacaaggagaaggataaaagcaaggggaaagctcccgaggaggacgaggaagagcgccgaaggcgcgagcgagacgatcagatgtacagggagaggttacgaactctcttggtgattgcagtcgtaatgtcattactgaacgccttgtccacatccggaggaagcatttcatggaacgattttgttcatgaaatgctggctaaaggagaggttcagcgagtgcaagtggtgcccgaaagcgacgttgtggaagtgtacctgcaccccggagcagttgtgtttggcaggccgcggctcgccctgatgtaccggatgcaggtagcaaacatagacaaattcgaagaaaaactgcgggcggccgaggatgaactcaacattgaagcgaaagatcgtattcccgtgagctacaagcgaacaggcttcttcgggaatgccctctattctgtcgggatgactgccgtggggctcgctatcctgtggtatgtgttccgcctagcaggtatgaccgggagagaaggcggcttctctgccttcaatcagctgaaaatggcgcgatttacaattgtcgacggaaaaatgggtaagggcgtctcctttaaggatgtcgctggaatgcatgaagcaaaactcgaggtgagagaattcgtggactacctcaagtcccccgagcgcttcctccagctgggtgccaaagtccctaagggagcgctgttgcttgggcctcccggctgtggaaaaactctgctggcaaaggcagtggcaaccgaggcccaggtcccctttctcgctatggctggacctgagttcgtggaagtgatcggaggcctcggggccgcccgagttcgcagcctatttaaggaagcaagggctagagccccttgcatcgtttacatcgacgaaatcgatgccgtggggaagaaacggagcaccactatgtccggttttagcaacacagaagaggaacagacactcaaccagctgctggtcgaaatggacggcgcatccttggatcagcttccctcacagggcacgatgagaaagctccgtgggaagactccagcctgttcatgtctaaccgagcctactggatcccgcagggccatggaagggcacagcctgtgctggggatgtcttctccactag

SEQ ID NO: 135868 - DNA, 1851 bp, Artificial Sequence
  Description of Artificial Sequence: Synthetic coding sequence
atgaactcaccagggggccggggaaagaaaaagggttctgggggcgcatccaaccctgtgcctcccaggcccccccccccatgtctcgctccagcacctcctgcggccggacctgctcctcctccagagtccccgcacaagaggaacttgtactatttctcgtacccgttgtttgtggggtttgcactcctgcgtctcgtggcattccacctgggcctcttgtttgtgtggctctgccagaggttctccagggcactcatggccgctaaacgatcctctggggctgcccctgctcctgcatccgcaagtgccccagccccggtgcccggtggcgaggcggagagagttagggtgtttcacaagcaggcgttcgaatacattagcatcgcgctgagaatcgacgaggacgagaaagccggccaaaaagaacaggccgttgagtggtacaagaaaggaattgaggagctcgaaaaagggatcgcagtgattgtgacaggacagggggaacagtgcgagcgagcacgccgcctgcaggccaaaatgatgactaacctcgtgatggccaaagatagactgcagttgctcgagaaaatgcaacccgtgctgcccttctcaaagagccagactgatgtgtataatgactcaacgaatctggcatgtcgtaacgggcacctccagagtgagagtggagccgtgcctaaacgcaaagatcccctgacacacacatctaactctcttcccagatccaagacagtgatgaagacaggtagtgcaggcctgtctggccaccaccgcgcgcccagctactcaggcctgagtatggtttcgggggtgaaacagggtagcggcccagcaccaaccactcataaaggtacaccaaagactaacagaaccaataaaccttcaacgccgaccacagccacacgaaaaaaaaaagacctgaaaaattttcgtaatgtggacagcaatctcgcgaacttaatcatgaacgaaatcgtggacaacgggacagctgttaagtttgacgacatcgccggacaggacttagctaagcaggctctgcaggagatagtcatactgccctctctacgtccagaactgttcactgggttgcgtgcaccagcccgcgggctgctgctgttcggtcccccaggaaatggcaagaccatgttggccaaggctgtggctgccgaaagtaacgccacttttttcaacatttccgccgcctccctcacttccaagtatgtgggggagggtgagaagcttgtcagagcgctcttcgctgttgcccgggagttacagccgtcaatcatattcatcgatgaagtggactcattactttgcgagcgccgcgagggcgagcatgacgcttctcggcgcctgaaaaccgagttcctgatcgagttcgacggggttcaaagtgccggagatgatagagtgctggtgatgggagccactaatcgccctcaagaactggatgaagctgttctaagacgatttatcaagcgcgtatacgtgtctctacctaatgaggagacgcgtctcttgttgctcaaaaacctcctctgtaagcaaggcagccctctaacacagaaagaactggcccagctggcaaggatgacagacggctattctgggtcggatcttacggctctggctaaggatgccgcactgggcccgattagagagctcaaaccagagcaggtcaagaacatgagcgcatcagagatgcgcaacattcggctcagcgacttcacggagtccctgaaaaaaatcaagcgaagcgtcagtcctcagacactggaggcctacatccgatggaacaaggacttcggtgacaccacagtttag

SEQ ID NO: 135869 - DNA, 1755 bp, Artificial Sequence
  Description of Artificial Sequence: Synthetic coding sequence
atgaactccccgggaggccgcggaaagaaaaagggcagcggaggagcctcaaatccagttcctccccggccccctcctccctgcctggcgccagcacctccggccgccgggcctgctccccctcctgagtctcctcataaaagaaatctttattatttcagttatcccctcttcgttgggttcgccctcttgcggctggtggcatttcacctggggctcctcttcgtatggctctgtcaacggttctctagagcactcatggccgccaaacggtcctccggggctgctcctgcacccgcgtcggctagcgctcccgcgcctgtccctggaggcgaagccgaacgcgtgagagtgtttcataaacaggctttcgaatacatcagcatcgcactgcgcatcgatgaggacgaaaaagctggccagaaagaacaagccgtcgagtggtataagaaggggatcgaggaattggaaaaaggtatagccgtgattgtgactggtcagggtgagcagtgcgaacgcgccagaaggctccaggctaaaatgatgaccaacctcgtgatggctaaggacagactgcagctgcttgagtctggtgccgtaccgaagcgtaaggacccactcacacacactagcaatagcctcccacggtcgaagactgtgatgaagaccggcagcgctgggctcagcggacatcaccgggcaccctcatattctgggctatcgatggtaagcggagtcaagcaggggtctggtccagccccaaccacacataagggcaccccgaaaacaaacagaaccaacaaaccaagtacccccaccactgcgacccggaagaagaaagatctgaagaacttcagaaacgtcgattctaatctggccaatctcataatgaatgagattgtcgacaacgggacagctgtgaaatttgacgatattgccggacaggacttggccaagcaggctctacaggagatcgtcatcctcccgagtctaagacccgaactgtttaccggactgagagctcctgctcgaggtttgctactgttcggccctccaggaaatggcaagacaatgttggccaaagctgtggcagctgaaagtaatgccacattttttaacatttctgctgcatccctgaccagtaagtacgtgggcgagggcgaaaagctggtgcgggctctttttgcggtggctagagagttacaaccctcaatcatcttcatcgatgaggttgattcactgctgtgtgaacgaagggagggggaacacgatgctagcaggcgactgaagacggaatttctgatcgaatttgacggagtacagtctgctggagatgaccgagtgctggttatgggagctaccaataggcctcaagaacttgacgaagccgttctcagaagatttataaagagagtatacgtcagcttgcctaatgaagaaacacgactgctcttactgaaaaatctgctgtgtaagcaaggtagccctctgacccagaaggaactcgcccagctggcccgcatgactgatgggtattccggcagcgacctgacagcactggccaaggacgcagcactgggcccaattagggagttgaagccagaacaagttaaaaacatgagcgcgtcggaaatgcggaacatccggctgagcgactttacagagtccttgaagaaaatcaaacgtagtgtgtccccgcagaccctggaggcctatatccgatggaataaggattttggagataccacagtgtag

SEQ ID NO: 135870 - DNA, 26394 bp, Artificial Sequence
  Description of Artificial Sequence: Synthetic coding sequence
atggccacatccagaggggccagcaggtgtcctcgagatatagccaacgtaatgcagcgcctgcaggatgagcaagagatagtacagaaacgtacttttactaagtggattaattcgcacttggccaaaagaaagccccctatggtcgtggatgacctgttcgaagacatgaaggatggcgtgaagttactggcgctccttgaggttctttccgggcagaaattgccatgcgaacaaggaaggcgaatgaaacgcatccatgcggtcgctaacatcggcactgcgctaaagttcctggagggcagaaagatcaagcttgttaacattaactccacggatatcgctgacgggcgcccatcgatagttttaggtctcatgtggaccatcattctctattttcagatagaggaactcactagcaacctacctcaactgcagagcctcagtagctccgcctcctctgttgactccattgtttcgtcggaaaccccctcccctccatctaaaagaaaggtcactactaaaattcagggaaacgccaagaaagctctgctgaaatgggtacagtataccgcaggaaaacagaccgggattgaggttaaagacttcggcaagtcctggcgaagcggggttgcctttcacagcgtaatccacgccattcgacctgaattggtggatctggagacagtcaaagggcgatctaaccgagaaaatctggaagatgcattcacgatcgccgaaactgagctggggatccctcggctcctcgaccctgaagatgtcgatgtggataagccggacgaaaaatctatcatgacatacgtcgctcagttcttaaagcattatccagacatccacaatgctagcacagacggccaggaagatgacgagattctgccgggcttcccctcatttgccaactccgtgcagaacttcaaacgcgaagaccgcgtgattttcaaggagatgaaagtgtggattgagcaattcgagagagacctgacaagggcccagatggttgagagcaatttgcaggataagtatcagtcctttaagcacttcagagtccagtatgagatgaagagaaagcaaattgagcacctgattcagccgttgcaccgcgacgggaaactctctctagaccaggctctcgttaaacagagttgggatagggtgacttctcgcctgttcgactggcacattcaactggataagagccttccagctccacttggcacaattggtgcttggctctatcgggctgaggtcgcgcttcgtgaagagattacagttcagcaggttcatgaggagacagccaataccatccagagaaagttggaacagcacaaagacctcttacagaatacagatgcccataaacgggctttccacgagatctatcgcacaagaagcgttaatggcattccagtgccacctgatcagctggaggatatggccgaaagattccatttcgtgtcgtctacctccgagctgcacctcatgaagatggagttcctggaattgaaataccgtctcctcagccttttggtgctggctgagtccaaacttaaatcatggattatcaagtacggcagacgagagtccgtggagcagcttctgcagaattatgtatctttcatcgaaaactctaaatttttcgagcaatacgaggtgacttaccagatattgaaacagaccgcagaaatgtacgttaaagctgatggttcagtagaggaagccgagaatgttatgaagtttatgaacgaaaccacagcccagtggaggaatctgagtgtcgaagtgcgctctgtgcgttcaatgctcgaggaggttatttccaactgggacaggtacggaaacacagtcgcctccctccaggcttggttagaggacgccgaaaaaatgctgaatcagagcgaaaatgctaagaaggattttttccggaacctgccgcactggatacagcaacataccgccatgaatgatgcaggcaactttctcattgaaacatgtgacgagatggtttctcgagatcttaaacaacagctacttctcctgaatggcaggtggcgagaactgtttatggaagtgaagcagtacgcccaggccgatgagatggatcgaatgaaaaaagagtacactgactgtgtcgttaccctgagcgctttcgctacagaggcacacaagaagctcagcgagccattagaggtttccttcatgaacgttaaactgctgatccaggacctggaggacattgagcaaagggtgccagtaatggacgcccaatataaaatcatcaccaagacagcccatctgatcaccaaggagagcccacaggaagagggcaaagagatgtttgctacaatgtccaagttgaaggaacagctcacaaaagtgaaggaatgctacagcccactgctgtatgagagtcagcaattattgataccgctggaagagcttgagaagcagatgacctctttctatgattcactcggcaaaatcaatgagatcattaccgtgctggagcgggaggctcagagctctgccctgttcaaacagaagcaccaggaattgctggcttgccaagaaaattgtaaaaagacacttacactgattgagaagggttctcaatcagtacagaaatttgtgacgctgagcaacgtgttgaaacactttgatcaaaccaggctccaaaggcagattgccgatattcatgtagcattccagagcatggtgaaaaaaacgggcgattggaagaaacacgtggaaactaattcccgactcatgaaaaagtttgaagaatcccgagcagagcttgaaaaggtgctccgaatcgctcaggagggcctcgaggagaaaggagaccctgaggaactccttcgtcgacacacagagttcttttcacagcttgatcaaagagtccttaacgctttcctaaaagcctgtgacgaactaacagatatcctcccagaacaggagcagcaaggcctgcaggaggctgtaagaaagctccacaaacagtggaaagatctgcaaggcgaggcgccttaccacctccttcacctaaaaattgacgtcgagaagaatagatttctagcatcagtggaggagtgccgaactgaattggaccgcgaaaccaagctcatgccacaggagggctcagaaaaaattattaaagagcatagagtcttcttctccgacaagggaccccaccacttgtgtgaaaaaagattacaattaatcgaggaactttgtgtgaaactgcctgtccgcgatcccgtacgagatactcctggaacttgccacgtgaccctgaaggagctaagggctgccattgacagcacctatcgcaagcttatggaagatccggataaatggaaggactacaccagccggttttctgaatttagctcttggattagcacgaacgagacacagctcaagggcatcaagggcgaggccattgacacagcaaatcatggcgaggttaaacgcgctgtcgaggaaatacggaacggggtcacaaaaaggggcgaaacactcagctggcttaagagtagactgaaggtgctgacggaagtcagttcggagaatgaggcccaaaagcagggcgacgagctggccaagctgtctagttcattcaaggcactggtgaccttactgtccgaagtggaaaaaatgctcagcaactttggagattgcgttcagtacaaagaaatcgtgaagaattctctggaggaactgatttcaggatccaaagaagtccaggaacaggccgagaaaattctggatacagagaacttattcgaagctcagcaattgctgctgcaccatcagcagaaaactaaaagaatctccgccaaaaaacgcgatgtccagcaacagatcgcgcaggcacagcaaggggagggcggtctgccagacagaggccatgaggagttaagaaagttggagtctacattggatggccttgagcgttctagagaacggcaagagagaaggatccaggttacactccgaaaatgggagcgtttcgaaacaaataaagagactgtcgtccggtatttgtttcaaaccggcagcagccacgaacggtttctgagttttagctcactagaaagcctgagcagcgagttggagcagactaaagaattcagcaagaggaccgaatccattgcggttcaagccgagaatctggtcaaagaagccagcgagattccgctggggccccaaaacaaacagctcctgcagcagcaggccaagagcataaaggaacaggttaagaagctggaagatacactagaagaagatatcaagactatggagatggtgaagacaaaatgggatcactttgggagcaactttgagaccctatccgtatggatcaccgagaaagagaaggagctgaatgccctggagacgtctagttctgcaatggatatgcaaatttcccaaattaaggtaaccatccaggagattgagagtaaactgagctcaatcgtggggctggaggaggaagcacagagcttcgcccagttcgtcactacaggcgagtctgcacgtatcaaagcaaagctaacccagatacgcaggtatggcgaggaactgagagagcatgctcagtgcttagaggggaccatcttgggccacctgtcacagcagcaaaagttcgaggaaaatctccgaaaaatccaacaaagcgtctccgagttcgaagataaattggcagtcccgatcaagatttgtagttctgcaactgagacttacaaagtgttacaggaacatatggacctctgtcaggccttggaaagcctgtcatcagcaattacggctttctccgcttcagctaggaaggtggttaaccgtgatagctgcgttcaggaagccgccgcactacaacagcagtacgaggacatcctgcgacgcgccaaggagaggcagaccgcattagagaatctgttggctcactggcaaaggcttgagaaggagttgagttctttcctcacctggctggagagaggggaagcaaaggctagttcgcccgagatggacataagtgcagaccgagtaaaggtcgagggtgagttgcagttgatccaggcccttcagaacgaagtggtgtcacaggcctccttctactccaaactccttcagttgaaggagagtctgttctcggtcgcctctaaggacgatgtgaaaatgatgaagcttcatttagagcaactagacgaaaggtggagggacttgccacagatcattaacaaacgaatcaattttctgcagagcgtagtggccgaacatcaacagtttgacgagctcctattatctttctcagtgtggatcaaattattcctctccgagttgcagaccacaagcgagatctctataatggaccaccaggttgcactgacacgccacaaagaccatgccgccgaggtagagtccaagaaaggggaactacagtcgttacagggccacctggccaaacttggctcattgggccgggctgaagatctacatctgctccagggcaaggccgaggactgcttccagctcttcgaagaggcatcacaagttgttgagcggcggcagctcgcccttagccatctggccgagttcctccagtctcatgctagcttgtccggcatccttaggcagctacggcagacagtggaggccactaacagcatgaataaaaatgaaagcgacttgattgaaaaggatcttaatgatgcgctgcagaacgcgaaagcactggaaagtgccgctgtgtccttagacgggatcttatcgaaagcacagtatcatttaaagatcgggagttcagaacagagaacctcctgtagagctacagctgaccagctctgcggggaggtcgagagaatccagaatcttctaggcactaagcagagcgaagccgacgccctggccgttttgaaaaaggccttccaggatcaaaaagaggagctcttgaagagtatcgaggatatagaggagcggaccgacaaggaacgcctgaaggaacccacgagacaagctcttcaacagcgcctgagggtcttcaaccagctcgaggatgagctgaacagtcacgaacacgagctctgttggttaaaggataaggctaagcaaatcgcccagaaggatgtggcatttgcccctgaggttgatagagagattaaccggcttgaagttacctgggacgacacaaaacgcctgatccatgagaatcagggccagtgttgcgggctgattgacctgatgagagagtatcagaacctgaagagcgcagtaagcaaagtgttggaaaatgccagcagtgtgatagtaacaaggacaactatcaaggaccaggaggacctcaagtgggcgttcagcaagcatgagactgctaaaaacaagatgaattacaaacagaaggatcttgacaattttacttcaaaaggaaagcacctgctttctgagctgaaaaagatccactcctctgattttagtctggtaaagacggacatggaatcgaccgtggacaaatggctggacgtctcggagaagttggaggaaaatatggataggctgcgggtgtctctttcaatctgggacgatgtactgtcaacgagagatgagattgagggctggtctaataactgcgttccacagatggccgaaaacatttctaatttggataatcatctacgagctgaggagctattaaaagagtttgagtcggaagtcaaaaacaaagccctaaggttggaagaactgcattctaaggtcaatgatctgaaagagctcacgaaaaacctggaaacccctcccgacttgcagttcattgaagctgatctcatgcagaagcttgaacatgcgaaggagatcactgaagttgccaaaggcaccctgaaagattttacagcacagagcactcaggttgagaaatttattaatgacatcactacttggtttaccaaagtggaagagtctcttatgaattgtgcccaaaacgagacctgtgaggcgctaaaaaaggtgaaggatattcagaaggaactgcagagccagcagtcaaacatttcgagcacgcaggaaaaccttaattcgttatgcagaaagtatcactctgcagaattggagtccctgggacgggctatgacaggtctaattaagaagcacgaggctgtctctcaactgtgcagcaagacccaagcctcactgcaggagtccttggagaagcactttagcgagtctatgcaggagttccaggagtggttcctgggggccaaggctgctgcaaaagagagcagcgatcgtacaggcgactcaaaggttcttgaggccaagctacatgatctccagaatatcctggattcagtgagcgatggtcaaagtaaactggatgctgtgacccaggaggggcagaccctctacgcgcatctctccaaacagattgtctccagcatccaggagcaaatcacgaaggcaaacgaagagttccaggccttccttaaacagtgtcttaaggataagcaggcgttacaggactgcgcatccgaactgggctccttcgaggatcaacaccgaaagttgaacctctggatccatgagatggaggagcgattcaacaccgagaacctgggtgagagcaagcaacacatccctgagaagaagaatgaggttcataaagttgaaatgttcctcggagagttattagctgctcgcgagtctttagataagctctcgcagagaggccagctgctgtcagaagagggccacggcgctggccaagaaggaagactctgcagccagctgctcaccagccaccagaacttgctcagaatgaccaaagaaaaattacgatcctgtcaggttgccctccaagagcacgaggccttagaggaggccttgcagagcatgtggttttgggtcaaagctattcaagatcgcctcgcatgtgcagagtctaccctcggatctaaggatacattggagaaacgactgtcacagattcaagacatcctacttatgaagggcgagggcgaagttaaactgaatatggctattggcaagggggaacaggccttgaggtctagcaacaaagagggccagagggttattcagacacagctcgaaacactaaaggaggtgtgggctgatatcatgtccagctcagtgcacgctcaatccacattagaaagtgttatatcccagtggaacgactatgtggagcgcaagaaccagctcgagcagtggatggagtctgtggaccaaaagatagagcacccactgcagcctcagccaggtctgaaagagaagtttgtgctgctcgatcacctgcagagtattctttctgaagccgaagaccacaccagggccctgcacagactgatcgctaagagcagggaactgtacgaaaagaccgaagatgagtccttcaaggacacagctcaggaggagctaaaaacacagtttaatgatatcatgaccgtggctaaggagaagatgagaaaggtagaggagatcgtgaaggatcacctgatgtatctcgacgcggtgcacgagtttacagactggcttcattccgccaaagaagagttacatcgatggagcgatatgagcggcgatagcagcgcaacccagaagaagctatccaagatcaaggagctgatcgactcccgtgaaatcggcgcctctcggctgagccgagtggagagcttggcacccgaggtgaagcaaaacaccaccgcaagcgggtgtgaactgatgcacaccgaaatgcaagctctccgcgctgattggaaacagtgggaagactccgtcttccagacccaatcctgcctggaaaatcttgtctcccagatggcactgagcgagcaggagttctccggccaagttgcgcaactggaacaagcgctggagcagttctcagcactgttgaagacatgggcccagcagctcacactcctcgaaggaaagaacactgatgaagaaatcgtcgaatgctggcacaagggacaggagatcctcgacgcactccagaaagccgaacctcggacagaggacctgaaatcccagctgaacgaattgtgtcgcttttctcgtgatctgtccacgtacagcggaaaggtaagcgggttgattaaggagtataattgtctgtgtctccaggcatccaagggctgtcagaataaggaacagatcctgcaacagagatttaggaaggcattccgcgactttcagcaatggcttgtcaacgcaaaaatcactaccgctaaatgttttgatattccccagaatataagtgaagtttctacgagtctccaaaaaatccaggagttcctttctgaaagtgaaaatggtcaacacaaactcaatatgatgttgtctaaaggcgagttgctgtccacattgctgactaaggaaaaagccaaggggatccaggccaaagttacggcggctaaggaagactggaaaaactttcattcgaacctccaccagaaagagagcgccctagagaaccttaagatacagatgaaggactttgaggtcagcgccgagccaatccaggattggttgtcaaagacagagaaaatggtgcatgagtccagtaaccggctgtacgatcttcctgctaaaagaagggagcagcaaaaactgcagtccgttctggaggaaattcattgctacgagccccaacttaaccgtctgaaagaaaaggctcagcagttgtgggaagggcaggctgccagtaaatccttccgacaccgcgtgtctcaattatcttctcaatatttggcactcagcaatctcacaaaagaaaaggtctcaaggctggaccgcattgttgcggagcacaaccagttctctttgggcatcaaagagctgcaagattggatgacagatgcaatccacatgctggatagctactgtcacccaacctccgacaagtctgtgcttgatagcaggaccttgaagctggaagcccttctctcggtaaagcaggaaaaagagatccagatgaagatgattgtgacccgaggcgagtcggtgctacaaaacacgtcgccagaaggaatcccaactattcagcagcaacttcagagtgtcaaggacatgtgggcgtccttgctgtctgccggaattcgatgcaagtctcagttagagggggcactgtctaagtggacctcatatcaggatggcgtgcggcagttcagtggatggatggatagcatggaggcaaatctaaacgagtcagaacgccagcacgctgaactgcgggataagactacaatgttaggaaaggctaaattactcaatgaagaagtcctgtcttactctagtctgctggagacaatcgaggtaaagggagccggtatgaccgaacattacgtgacccagttggaacttcaggatttgcaggagcggtaccgcgctatccaagaaagggcaaaggaggctgttacgaagtcggagaaactggttcgactacaccaagagtaccaacgggaccttaaggccttcgaggtttggcttggtcaggaacaggaaaaactggaccaatattcagtcctggaaggcgacgcccacacacacgaaaccacattaagagatttgcaggaactacaggtacactgtgccgaggggcaggccttgctgaatagcgtgttacatacaagagaggacgtgattccgagcggtatccctcaggccgaagaccgggcgctggaaagcctgcggcaggattggcaggcgtaccagcatcgcttgagcgagaccaggacacaattcaataacgtagtcaacaaactgaggcttatggagcagaaattccagcaggtggatgagtggctgaaaacggctgaagaaaaggtcagtcctcgcacccgcagacagtccaatcgagcgactaaagaaattcagttgcatcagatgaagaaatggcatgaagaagtcacggcctatcgggacgaggttgaagaagtgggcgcaagggcccaggagatccttgacgagagtcacgtcaattcccgtatgggatgccaggctactcagttgacctcccgataccaggcattgctccttcaggtactggagcaaattaaatttctcgaggaggaaatacagtccctggaggagtccgaatcttccttaagttcctactccgactggtatgggtctacacataaaaactttaaaaacgtggcgaccaagattgacaaagtagataccgtgatgatgggtaagaagctgaagaccctcgaagtgcttctgaaggatatggagaagggtcattctctcctcaaaagcgcacgtgaaaagggggagcgggcggttaagtacctggaagagggtgaagccgagcggctccgtaaagagattcatgaccacatggagcaattgaaagagctgacgtccaccgtgcgtaaagagcacatgacactcgagaaaggacttcacctggcgaaggagttctccgataaatgtaaggcccttactcagtggattgctgaatatcaggagattctgcacgtccctgaggaacctaaaatggaactttatgagaaaaaagcacagctgtcgaagtacaaatcactgcagcagacagtcttatcacatgaaccctccgtcaaaagtgtacgggaaaagggtgaggctttgctggaacttgtgcaggatgtgaccctgaaggacaagatagaccagcttcagtcggattaccaagatctgtgtagcataggtaaagagcacgttttctccttagaagcgaaagttaaggatcacgaagactacaattccgaactccaagaggtggaaaaatggctgctgcagatgtctggcagactcgtggctccagatttactggaaacatcctctctagaaaccattacacagcagctagcccaccataaggcgatgatggaagaaattgccggatttgaagacagactcaataatttgcagatgaagggggacacccttatcgggcaatgcgcggaccacctgcaagcgaaacttaaacaaaatgtgcatgctcaccttcaaggaactaaggactcctattctgcaatctgtagtaccgcccagcgaatgtatcagagccttgagcacgaactgcaaaagcacgtgtcccgccaggacacactccaacagtgtcaagcttggctcagcgcagtacagcccgacctggagcccagcccccaaccgcctcttagtagagctgaagcgattaagcaagtgaaacactttcgcgccctacaggaacaggcccggacatacctggaccttctgtgcagcatgtgcgatctctccaacgcttcggtgaaaactactgccaaagacattcaacagaccgagcagactattgaacaaaaactggtgcaggcccagaaccttacgcagggctgggaggagattaagcatcttaagtctgaactctggatctacctgcaggatgcagaccagcagctgcaaaacatgaagcgtcgccattctgagctggagttgaacattgcacagaacatggtgagccaggtgaaggacttcgtgaaaaaactccaaagtaaacaggcaagcgtgaacaccatcatagagaaagtcaataaattgactaaaaaagaggaatcccctgaacataaagagattaaccacctgaatgaccagtggctggatctctgtcggcaatcaaacaacctgtgcctccagagggaagaagatctgcaacggacacgcgattaccatgactgcatgaatgtggtggaggtgttcctggagaaatttacaactgagtgggacaatctcgccaggagcgatgctgaaagcaccgccgtgcacttggaggctttgaagaaactggccctggcactccaagaacgaaaatatgccatcgaggaccttaaagaccaaaaacagaaaatgatcgaacatttgaatctggacgacaaagagcttgttaaagagcagactagccatcttgagcagcgatggtttcagctggaagacctcatcaagagaaagattcaggtgagtgtgacaaatcttgaggaactgaatgtagtacagagtaggttccaggagctgatggaatgggccgaggagcagcagcctaatatcgctgaagccctcaaacagtcccctccaccagatatggcccagaacttactgatggaccatctggccatctgtagcgagcttgaggccaaacagatgctgctcaaatcattgataaaagacgcggaccgggttatggctgacctgggactcaacgagcggcaagtcattcagaaagccctttctgatgcacagtcccatgtaaactgcctcagcgacttggttggccaaagacgcaagtatttaaacaaagccctgtctgaaaagacccagtttctgatggccgtgttccaggctacttcccagatccagcaacatgagagaaaaatcatgttccgtgagcatatctgtctgctaccagacgatgtgtctaaacaagttaaaacttgcaaatccgcacaggcgtctctcaagacataccaaaatgaggtgactggcttgtgggctcagggccgggagctaatgaaagaagtcactgaacaggagaaatcagaggtattgggtaaattgcaagaattgcagtccgtctacgatagcgtcctgcagaaatgttcacatcgtctccaggaactggagaaaaaccttgtctccaggaaacattttaaagaggacttcgacaaagcatgtcattggctgaagcaggcggatattgtgacttttccagagatcaatctcatgaacgaaagcagtgagttgcatactcagcttgcgaaataccagaacatactcgagcagtccccagagtacgaaaatctgctgcttacactgcaaaggactggtcaaacaatacttcccagtctcaacgaagtggaccacagctacctgagcgagaaacttaacgccctacctcgacaattcaacgtaattgtcgccttagctaaagacaagttctacaaagtccaggaagccatcttagcacgcaaggagtacgcaagtctgatcgagctaacaactcagtcgctgagcgagctggaggcccaattcctacgaatgtcgaaagtgcctacagacctagccgtggaggaggcgttgtcactacaagatggatgcagagctattctggatgaagtcgccggcttgggagaagcggtagatgagctgaaccagaaaaaggaggggttcaggtccaccggacagccttggcagcccgataaaatgctgcacctcgtcacactctatcaccgcctgaaacggcagactgaacagagggtctcactgctcgaagacaccacttcagcctatcaggagcacgagaagatgtgtcaacagttggaacgccagcttaaatctgtcaaagaggagcagtcaaaagtcaacgaagagaccctcccagcggaggagaagttgaagatgtaccactcattggcaggctcactgcaggacagtgggatcgtactgaaacgagtcacgatccaccttgaggacctggccccccacctggatcctctcgcctatgaaaaggcccgccaccagattcagtcctggcaaggggagctgaaacttctgaccagtgccattggagaaaccgtgaccgagtgtgagtctcggatggtccagtctatcgatttccagaccgaaatgagtcggtccctggattggcttcggcgagtgaaagctgagcttagcggacctgtctatctcgatctcaatctccaagacatacaagaagagattaggaagatccagatacaccaggaggaagttcagagctctctgcggattatgaacgcgttgtcccacaaggagaaagagaagttcaccaaggccaaggagctaatttctgccgatctggagcatagtctggccgaactgagcgagctggatggagatattcaggaggcgctccgcacccgacaggctacactgacagagatatattcgcagtgtcagcgatattaccaggtgttccaggcagctaatgattggttagaggacgcccaagagctgctgcaactggccggcaatggcctcgatgttgagagcgcagaagaaaatcttaagagccatatggagttcttctccactgaagaccagtttcacagcaatctggaagagctgcacagtttagtagccacactggaccctctcataaaacccaccggcaaggaagacctcgagcagaaagtggcttcattggagctgagaagccagcgcatgtcacgagattctggggcccaggtagacctgctgcagcgctgcaccgcacagtggcatgactatcaaaaggccagagaggaggtgatcgaattgatgaatgataccgaaaaaaagctttcagagttttccctgctcaaaacatccagttctcatgaggctgaggagaaattatccgaacataaagccctggtctctgtcgttaattcgtttcacgaaaaaatagtcgctctcgaggagaaggcttcgcagcttgagaaaaccggaaacgatgcatcaaaggcgaccctaagccggtccatgaccaccgtttggcagagatggacccgactccgggccgtggcacaggaccaggaaaagatcctggaagatgccgtggacgagtggaccggctttaataacaaagttaaaaaggcaacagagatgattgatcagctccaggacaaactgcctgggtcttcagccgaaaaggcatccaaggcggagttactgactctactcgagtaccacgacacgtttgtactggaattggagcaacagcaatctgccttaggaatgctccgacagcagactctatctatgctgcaagacggggccgcccccacaccaggagaagagccgccactcatgcaggagatcactgcaatgcaagacaggtgtctgaacatgcaggaaaaggttaagacaaacgggaagctggtgaagcaggagctgaaggaccgggaaatggtggaaactcagattaactcagtgaaatgctgggtgcaggagactaaagagtaccttggcaaccctactattgagatagacgcacagttagaagagctccaaattctgctgacggaggcaactaatcatagacagaacattgaaaaaatggcagaagagcagaaggaaaagtatctggggctgtacaccatcctgccctctgaactaagcctccaactcgccgaggtcgctctcgatctcaagattagagaccagattcaggataagattaaagaagtggagcaaagcaaggctacttctcaggagctaagcaggcagatccagaagctggctaaggatttgacaacaatcttgacaaagctgaaggctaagactgataacgtggtccaggccaagactgaccagaaggttcttggagaggaactcgatggatgcaacagtaaactaatggaactcgacgctgcagttcaaaaattccttgagcagaatggccaattaggcaaacccttagccaaaaagattgggaaattgaccgagcttcatcaacagaccattcgccaggcagagaaccgcctcagtaagctcaaccaggccgcttcccatctggaagaatataacgagatgcttgagctcatactcaaatggatcgaaaaagctaaagttctcgcccacggtacaatcgcttggaattccgcaagccagctccgcgaacagtatattctccatcagacactgctcgaggagtcgaaagaaattgactctgagctcgaggcaatgactgaaaagctgcagtacctaacaagtgtgtattgcacagagaagatgtcccaacaagtggccgagctgggcagagagacggaggaactgcggcagatgattaaaatccggcttcagaacctgcaggacgctgccaaagacatgaaaaagttcgaagcagagctcaaaaaactccaagcggcactcgagcaggcacaggctacactgacaagtcccgaagtggggcgtctgtccttgaaggaacagctgtcgcacaggcagcacctgctgtctgagatggagtctctcaaacccaaggtgcaagccgtccagctgtgtcagtcagctctacgcataccggaggacgtggtggccagtttacccctgtgtcatgctgctttaagactccaagaggaagcatctagactgcagcataccgctatccagcaatgcaacataatgcaggctgccgtggttcaatacgaacaatacgaacaagagatgaagcacctgcagcagctaatcgagggtgcacaccgagagatcgaggataagccggtcgccacatccaatatccaggagctgcaggcacagatctcgagacacgaggagttggctcaaaagataaagggataccaggaacaaattgcttctctgaattctaagtgcaagatgttaactatgaaggccaagcacgctacaatgctgctgaccgtcactgaggtggaaggcctcgctgaagggaccgaggacttggatggcgagctgctcccaacccctagtgctcacccaagtgttgttatgatgacagccggacggtgtcacacattgctgagccctgtgacagaggaatcaggcgaggagggaactaactcagaaattagctcccctcccgcatgtaggtccccgtctccagtagccaatactgacgccagtgtcaatcaagatattgcctactaccaagccctatcagcagagagactccagacagatgccgcaaaaatacacccctctacaagtgcctcccaggaattctacgaaccagggcttgagccttccgccacggccaaactgggcgatctacagcgctcttgggagaccctgaaaaatgtgatttcagagaagcagcgcactctctacgaggcccttgagcgacaacagaagtatcaggattccttgcagtccatcagtacaaagatggaagccatcgaactcaagctgagcgagagcccggaacccggccgctctccagaatcccagatggctgaacatcaggccctaatggatgagattctgatgttacaggacgaaataaacgaactgcagtcgtccctggctgaagaactagtttccgaatcctgcgaagctgaccccgccgagcagctggcactgcaatctacgctgactgtccttgcggagcggatgtccaccattcgtatgaaggcctcaggtaagcgccagctgctcgaagagaagctgaatgatcagttggaggaacagagacaagaacaggccctgcagcgctatagatgcgaggccgatgaattggactcttggcttctgtctactaaggccacactagacaccgcgttatcccctccaaaagaacctatggacatggaagcacaactcatggactgccagaacatgctggtagagattgaacagaaagtagtggctctgtccgagctgtcggtacataatgaaaacctgcttttagagggaaaggcccacaccaaggacgaggccgaacagctggccggtaagctgcgtcgcctgaaaggatccctgttggagcttcaaagggccctccatgacaagcaactaaatatgcaggggaccgctcaagaaaaagaggaaagcgatgtggatcttaccgcgacccaatcaccaggtgtgcaggagtggctggcccaggcaagaacaacgtggacccagcagaggcagagcagtttacaacagcagaaagagttagagcaggaactcgctgaacagaagagccttctcaggtctgtcgcatcaaggggtgaggagattttaatccagcactcagctgcggaaactagtggagatgcgggggaaaagcctgacgtgttgtctcaggagctgggaatggagggagagaagtctagtgccgaagaccagatgcgcatgaaatgggaaagcctccaccaagaattttctaccaaacaaaagctacttcagaatgtgttagagcaagaacaggaacaggtgctgtactcacgccccaaccgcctcctgtccggggtccccctttacaagggagatgttcccacacaagataagtcagcagttacttctctcctcgatggccttaaccaggcatttgaggaagtctccagccagtcaggcggtgccaagaggcaatccattcatctcgaacagaagctctacgatggggtaagcgccacctcgacttggctcgacgatgtcgaggagcgcttattcgtggccactgccctcttacccgaggagaccgagacctgtctctttaatcaggagattcttgctaaagacattaaggaaatgagcgaagaaatggataagaacaagaacttgtttagtcaggcctttcccgaaaacggcgataaccgggacgttatcgaggacacactgggatgcctgttgggaagactttcattgctggacagcgtcgtaaatcagcgctgtcaccaaatgaaggagcgcttgcagcaaattttaaattttcaaaatgatctgaaggttctgtttacttcattagccgacaataaatacataatcctgcaaaaactggcgaatgtgtttgagcagcctgtggctgaacaaattgaagccatacaacaggcggaagacggattgaaggagttcgatgcaggtattatagaacttaaacgtcgtggcgataaacttcaggtcgagcaaccatcaatgcaggagttatctaaactgcaggatatgtacgatgaactgatgatgattattggctcacgcagatctggcctgaaccagaacctgaccctcaaatcacagtatgaacgcgcactgcaggacctggcggacctcctggagaccggccaggaaaagatggccggcgaccagaagattattgtttccagtaaggaggagatccaacaactattggataaacacaaagaatattttcagggtctggaaagccatatgatcctgaccgaaactttatttcgaaagataatctcctttgcggtccagaaggaaacccagttccatacagagcttatggctcaagcatcagccgttctgaaaagggctcataaaagaggcgtggaactggaatacatcctggagacttggagtcacctagatgaggaccagcaggagttatctcggcagctggaggtggtcgaaagcagcattcccagcgtcggcctggtggaggagaacgaggatcgcctgatagatcgtattactctctatcaacacctgaagtccagtcttaacgaatatcagcctaaactttatcaagtgctggacgacgggaaaaggcttctcatttccatttcctgcagcgatctggaatctcagttgaaccagctcggtgaatgctggctgagcaatacaaacaagatgtcaaaggaactgcatcgactggagacaattttgaagcattggactagatatcagagtgaaagcgccgacctcattcattggttacagtccgccaaggatcggctggagttctggacacagcaatccgttacagtgccgcaggagctggagatggtgcgagatcacctgaatgcattcctcgagttcagcaaggaggtggacgcacagtctagccttaaaagttccgtcctctctactgggaatcaactgctgcgcctgaaaaaggtagacacagcaaccctgcgttccgaactctcccgcatagacagtcagtggactgatctgcttaccaatatccccgccgtacaggagaaattacatcagctgcagatggataagctgcccagtagacatgctattagcgaagtgatgagttggatttcccttatggagaacgtgatccagaaggatgaagacaacattaagaatagcattggctataaggctatccacgagtacctgcagaaatacaagggcttcaagatagacatcaactgcaaacagctgaccgtcgacttcgtgaatcagagcgtgttgcagattagtagccaggatgtagagtccaaacgaagcgacaaaaccgactttgctgagcagctgggggccatgaataagtcttggcagattctccagggtttagtgacagagaaaatccagctactggaggggcttttagaaagttggtcagaatacgagaacaacgttcaatgtctcaagacctggttcgagacccaagagaaaaggctgaaacagcagcaccggatcggtgatcaggcttctgttcagaatgctctgaaggattgccaggatctggaagaccttattaaagctaaagaaaaagaggtcgagaaaattgaacaaaatggccttgctctgatccagaataagaaggaggatgtctcatccatcgtgatgagcacccttagggaattagggcagacttgggccaacctcgatcatatggtgggacagctgaagattctgctgaaatccgtgcttgatcagtggagtagtcataaggtggccttcgacaagatcaattcttacctcatggaagctcggtactccttgtcccgcttcaggcttctgacaggatctctcgaagcagtccaggttcaggtagacaacttacagaatctacaggatgacttggaaaagcaggagagatcactgcagaagttcggaagtatcaccaaccagctgttaaaggaatgtcatcctcctgtaacggagaccctgaccaatacactaaaggaggtgaatatgcggtggaataatctgctcgaggagatcgcagagcaattacaatcctcgaaggctctcctacagctttggcagaggtacaaggactattccaaacagtgcgcgtcgacagtgcaacagcaggaggaccgcacaaatgaattgctgaaggcggcgacaaacaaggatattgccgacgatgaggtcgctacatggatccaggattgcaatgatctgctgaaggggctggggacagtaaaagattcactattcttcttacacgagctcggggagcagctgaaacagcaggtggacgcgagcgccgcttcagccatccagtccgaccagctgagcctgtcccagcacctgtgcgctctggagcaggcactgtgtaagcaacagacatctctgcaagctggcgtactggattatgaaacctttgctaaatccctggaagctttggaggcctggattgtcgaggctgaggaaattctccagggtcaggatccttctcactcgtccgacctaagcacgatacaggagcgaatggaagaactgaaggggcagatgctgaagttctccagcatggcccctgatctggatcgtctgaatgagcttggttatagactgcctctgaatgataaggagataaaaagaatgcaaaatttgaatagacactggtctctcattagttcccagacaaccgaacggtttagcaaacttcaatcgttcctcctgcagcatcagaccttcctcgagaagtgtgaaacatggatggaattccttgtacaaaccgagcaaaaactggccgtggaaatcagtggcaactatcagcacctcctggaacagcaacgcgctcatgagcttttccaagccgagatgtttagtcgtcagcagatattacacagcataattatcgacgggcagcgcctactcgagcagggccaggtagacgatagggacgagttcaatctgaagctaacattgctgtccaaccagtggcagggtgtgatccggagagcccagcagaggcggggaatcatcgactcccagattaggcaatggcaacgctatcgggaaatggcggagaaattgcgcaaatggcttgtggaggtgagttacctgcccatgagtggactggggagcgttcccatcccgctgcagcaggcccgcacgctgttcgatgaggttcaatttaaggagaaagtgttcctgcgccaacaaggttcatacatcctaactgtggaagcgggcaaacagttgcttcttagcgccgacagcggagctgaggctgctttacaggccgagttagccgaaattcaggaaaaatggaagagtgcaagtatgaggctggaagaacagaaaaagaagctggcttttttactgaaagactgggaaaagtgcgagaagggcatcgctgactctctggaaaagctaaggactttcaagaaaaaactaagccagtctctgccagaccatcatgaggaactgcatgctgagcaaatgcggtgcaaggaactggagaacgccgtcggttcgtggaccgacgacctaacccagttgtcactgctaaaggacacattgagcgcatatatctcagccgatgatatcagtattctgaacgaacgcgtggaactgttgcagcggcagtgggaggagctttgccatcagctgagtctcaggcggcagcagatcggcgaacgccttaatgagtgggcagtgttttctgagaaaaacaaggagttgtgcgagtggctcactcaaatggaatcaaaggtatctcagaacggggacatcctcattgaggaaatgattgagaagctcaaaaaggactaccaggaagaaattgcaattgcccaggagaacaagattcagctccagcagatgggcgagcgccttgctaaagcatcacacgaatccaaagcttccgaaattgaatacaagcttggtaaagtcaacgataggtggcagcatctgctggatttaattgctgcgcgcgtgaagaaactcaaagaaactctcgtggcagtgcagcagcttgacaagaatatgagcagtctccgtacttggctggctcatatcgagagcgaattggccaaaccgatcgtctacgattcatgtaattctgaggaaatacagcggaaacttaacgaacagcaagaactgcagcgagacatcgagaagcactctactggggtggcctcagtcttgaacttgtgtgaagtgctgctgcacgactgtgatgcctgtgctactgacgctgagtgtgatagcatccaacaggccacaagaaacctggaccgacggtggcgaaacatctgcgcaatgtctatggagcgcagactaaaaatagaggagacttggagactgtggcagaaattcttggatgattattcccgcttcgaagactggctcaagtctagtgagcggactgccgcctttccaagcagcagcggcgtcatctatacagtggccaaagaagaactgaagaagttcgaggcgtttcagagacaggtccacgagtgtctgactcagctggaattgattaataagcaatataggagactcgccagagagaaccgcaccgattccgcctgctcactgaagcagatggttcatgaaggaaatcagagatgggataacctgcaaaaacgtgtgacgtcgatcttgagaagactgaaacattttatcgggcagcgcgaggagtttgaaaccgctagagactctattttggtctggctcacagaaatggacttacagcttaccaacatcgaacacttcagcgaatgcgacgtgcaggcgaagatcaagcagctgaaagccttccagcaggaaatcagccttaaccacaacaagatagaacaaatcatagcccaaggcgagcagcttatcgagaagagcgaaccgcttgacgccgccatcattgaagaagagcttgacgagcttcgaagatattgccaggaggtatttggccgcgttgaacggtaccacaaaaaactcatccgcctccccctccccgatgacgaacacgatctttccgacagggagctggagctggaagacagcgccgctctcagcgacctccactggcatgaccgcagcgcagattctttgcttagcccgcaaccttcctcaaacctgtcactgagtttggcgcagcctctgcgttccgagcgtagcggtcgggacacacccgcgtccgtcgactccatcccccttgagtgggaccacgactatgacctatcccgcgacctcgagagcgccatgtctagggccctgccttcggaagacgaggaagggcaggacgacaaggatttttatcttcggggggctgtaggactgtccggagatcacagcgctctggagtcacagatccggcaattaggaaaggccctggatgacagcaggttccagatccaacagactgagaacataatacgcagcaagacccccactggccccgaattggatacctcttacaaggggtatatgaagctcttgggcgaatgtagttctagcatcgacagcgtgaagcgcttagagcacaagctgaaggaggaagaggaaagcttgcctggttttgtgaaccttcatagcaccgaaacccaaactgccggcgtgatcgatcgctgggagttgctgcaggcgcaagcattgtcgaaggagctgagaatgaagcagaacctgcagaaatggcagcagtttaacagtgacctcaattccatctgggcatggcttggagacacggaggaggaactcgaacagttgcagcgtctggaactttctacggatatccaaacaattgaacttcagattaagaaactcaaggaattgcaaaaagcggtcgaccatcgtaaggctatcatcttaagtattaacctttgctctcctgagtttactcaggctgacagtaaggagagccgtgacctgcaggatcgtctgtcccagatgaatggcagatgggacagggtctgtagcctgctcgaggaatggcggggtcttctgcaggacgccctcatgcaatgccagggctttcatgagatgtcgcatggactactccttatgttggagaacattgaccgacgcaaaaacgagatcgtgccaatagactcaaatctggacgctgagatattacaggatcatcacaagcagttgatgcagattaagcatgagttgttagagtcacaactgcgtgtggccagcttgcaggacatgagctgtcagttacttgtaaatgcagaaggcacggattgccttgaggcaaaagaaaaggtccacgtgatcggcaataggttaaaacttctgttaaaagaggtgtccaggcacattaaggaactggagaagctgcttgacgtatcctctagccagcaggatctgtctagttggtcctcagctgatgagctcgacacatctgggtccgtcagcccgacttctggcaggagcacccctaatcgacagaaaacccccagagggaagtgcagcctctctcagccaggtccttctgtgagctcacctcatagcagatctacaaaaggagggagcgattcaagtctgtcagagcctgggcccggtaggagcggtaggggctttctgtttcgggtccttcgggccgctctgccattgcagctactactgctactgctcatcggccttgcgtgcctcgtgcccatgtcagaagaggactactcctgcgccttaagcaataatttcgcacggtctttccatcccatgctgcgctacacgaatggccccccacctttatag

SEQ ID NO: 135871 - DNA, 25230 bp, Artificial Sequence
  Description of Artificial Sequence: Synthetic coding sequence
atggccacttcaaggggtgctagtcggtgcccacgcgacatcgctaatgtgatgcagcggctgcaagatgagcaagagattgttcagaaaaggacatttaccaaatggatcaattcacatttggctaaacgcaaacctcccatggtcgtggacgatttgttcgaggatatgaaagatggtgtcaagctcctggcactcctggaggttctgagcggccaaaagctaccctgcgagcagggacggcggatgaagagaatccatgccgtggctaatatcggaacagccctgaaatttctggagggccgcaagatcaagctggttaatatcaactccaccgatatcgcagatgggaggccctctattgtgctgggccttatgtggaccattatcctttattttcaaatcgaggagcttaccagtaacctcccccagttgcagtctctatcaagctccgcctctagcgtggattccatagttagttctgagaccccgtcccctccctcgaagcggaaggtgaccaccaagatccagggaaacgcaaaaaaagccctgctgaagtgggttcagtataccgccggcaaacagacaggaattgaagtaaaggattttgggaaatcgtggagatcaggggtcgcgttccacagcgtgattcatgccattcgtccagagttagtagatctggagacggtcaagggccggtcgaaccgcgagaacctggaagatgccttcactatcgcggaaacggagttgggcatcccacgtctccttgaccctgaagacgttgacgtcgataagccagatgagaagtctatcatgacttatgtagcacagttcttgaagcactaccccgatatccacaacgcttccacggacggccaggaagatgatgagatactgccgggctttccttcattcgccaactccgtgcagaacttcaagagggaggacagagtcatttttaaggaaatgaaggtgtggattgagcagtttgaacgcgacctcaccagagctcagatggtggaatctaacctacaggacaagtaccagagctttaaacactttcgggttcagtacgagatgaagcgtaagcagattgagcatctgatacagccactccatagggatggcaagctcagcctggaccaggccctagtgaagcagagctgggaccgagtgaccagccggttgtttgattggcacatacagctggacaaaagtttacccgctcctctaggaacgatcggagcgtggctctatcgtgccgaagtggcccttagagaggagattaccgtgcagcaggtacatgaggagactgccaacaccatccaaaggaaactagaacagcacaaacgaaagcttaggaacgtgatcgacttgttgcagaataccgatgctcataagcgtgccttccacgaaatataccgcactcggagcgtgaatggaatccctgtaccaccagaccagctggaggacatggctgaacgtttccacttcgtctcgtctacgtccgagctgcacctgatgaaaatggagtttttggagctgaagtataggctgttgtctctgctcgtcctggctgagtctaagctgaagtcctggatcattaaatatggaagaagagaatctgtggagcagctcctgcagaattacgtctcattcattgagaacagtaaattttttgaacagtacgaagtaacttatcaaatcctgaaacagactgcagaaatgtacgtaaaggctgatggttccgtggaagaagcggagaatgtgatgaagtttatgaatgagactacagcccagtggagaaatctgtctgttgaagttcgttctgtgcgatctatgctggaggaagtgatttctaattgggataggtatggaaacacagtcgcttccttgcaagcatggctcgaggacgccgagaagatgttgaaccaaagcgagaatgcgaagaaggatttcttcaggaatttgcctcactggatccagcagcatacagccatgaatgatgccgggaactttttgatcgagacatgtgacgaaatggtgtcaagagacctgaaacaacagttactactgctcaatggacgctggcgggagctcttcatggaggtgaagcaatatgctcaggctgacgagatggataggatgaaaaaggaatacaccgattgtgtcgttactctgtccgccttcgcaaccgaagcccataaaaagctgagcgaaccactggaagttagtttcatgaatgtcaaactgctgatccaggacctcgaggacatcgaacagagagtccctgttatggatgcacagtacaaaattattaccaagaccgcacaccttatcacaaaggagtccccacaggaggaagggaaggaaatgttcgcaaccatgtccaagctcaaggagcaacttaccaaggtgaaggaatgttactcaccactgctgtatgagtcgcagcagctgctgattcccctagaagaactggaaaagcagatgacctccttttatgattcattaggcaagattaatgagatcattacagtcctggagcgagaagcccagtcatccgcgttgttcaaacagaaacaccaactgaggattctgaaatgcaaatggtgcaattcgagtcagaagatgacactctgtctggtgctgggcagtatgatcagcatgttgagcaccgccaaaatcactatcgccggatataagtcggaggtggaagtgagtgaacttcttgcctgtcaagagaactgcaaaaagaccctgacactaattgagaagggttctcaatccgttcagaagtttgtcactctcagcaacgtgctcaagcatttcgatcagaccaggctccagactgattgccggtacagctgttgtttcagtgtgatgaggaagcagcaccatataatgatagtgttccacataaaatctatggtgaagaaaacaggagattggaagaaacacgtagaaacgaattctagactaatgaagaagtttgaggagtccagggcagagctggagaaagttctgcgcatagcacaggaggggctagaagaaaagggcgaccctgaggagcttctcagacgacataccgagtttttttcacagctggatcagcgcgtgcttaacgcatttctcaaagcctgtgatgaattaaccgatatcctcccggaacaagagcagcagggcctgcaagaggccgtgcggaaactgcacaaacagtggaaggatcttcagggcgaggccccttaccacctactgcatctgaaaatcgacgtagaaaagaatagattcttggccagtgttgaggagtgcaggaccgaactggatcgtgagacaaagcttatgcctcaggaggggagcgagaagatcatcaaagagcatagagtgttcttctctgataagggtcctcaccacctgtgtgaaaagcgtcttcagcttatcgaagaactgtgtgtgaaattgccagtcagggatcctgttagagatacccccggaacttgccatgtgactctgaaagagttgcgtgccgcgattgattccacttatcgtaaactaatggaggacccggataagtggaaggactataccagtaggttcagtgagttctcatcatggattagcaccaatgaaactcagcttaagggcatcaaaggtgaggccattgataccgcaaaccacggcgaggtcaagagagctgttgaggaaatcaggaacggggtgaccaaaagaggagagactttgagctggctcaagtccagactgaaggtgctcacagaagtttcatcggagaacgaggcccagaaacagggggacgagctggccaaactgtctagcagctttaaggcattggtgaccctcctctcggaggttgaaaagatgttatctaatttcggcgattgcgtgcagtacaaggagatcgttaagaacagtcttgaggagttgatttccggaagtaaagaggtgcaggagcaggcggagaaaatcctggatactgagaatctgtttgaagcccagcagctgctgctccatcatcaacagaaaacaaaaaggatcagtgccaaaaaaagggatgttcaacagcagatcgctcaggctcagcagggcgaagggggcttgccagatcggggccacgaagaattgagaaagctagagtcaacactcgatggactcgagaggagccgtgagcgccaggagcggcgtatccaggttaccctgagaaaatgggaaaggtttgaaacaaataaagaaacagtggttagatacctttttcagacgggctcttcccacgaacggttcctctcgttcagttctctggagagcctctcctctgagcttgaacagaccaaagagtttagcaaacggaccgaatctatcgcagtgcaggccgaaaacctggtgaaggaagcttctgagattcccctaggcccacaaaacaagcagctgcttcagcaacaagctaagagcataaaggaacaggttaagaaattggaagataccctcgaggaggagtacgtgatagataataaaacgatggaaatggtcaagaccaagtgggatcatttcgggtcgaattttgaaaccttatccgtttggataaccgagaaagagaaagaattgaatgccctggagacttctagcagcgctatggatatgcagatttcgcaaataaaggtcactatacaagagatcgagagcaaactgagcagcattgtcggacttgaagaggaggcccaatcattcgcgcagtttgtcaccactggcgagagtgcaagaattaaagcaaaattgactcagatcaggcgctatggagaggagctcagggagcacgcccagtgtctggaaggcaccatccttgggcatttatcccagcagcagaagttcgaggagaacctgcggaagattcagcagtctgtgagcgaatttgaggacaagctggccgtgccaattaagatttgctcttctgccacagaaacgtacaaggtgctgcaagagcacatggatctttgccaggccctggagagtcttagctcggcaattacagctttctctgctagtgcgaggaaagtggtgaacagagattcctgtgtgcaggaagccgcggcgcttcaacaacagtacgaggacattttacggcgggcaaaggagagacaaaccgcgctggaaaatctgctagcccactggcagaggcttgaaaaggaactgtcctcctttcttacttggttagagcgaggcgaagccaaagcttcatcccctgaaatggatattagcgctgacagagtcaaagtagaagcttccaaagacgacgtgaagatgatgaagctgcacctggagcagctggatgagcggtggcgggatctgcctcagatcatcaacaagagaataaattttctccagagcgttgtggcagaacaccagcagtttgatgagctgttattgtcttttagtgtgtggattaagctttttctcagcgagctccagaccaccagtgaaatctctataatggaccatcaggtcgcactgactaggcacaaggaccatgcagccgaggtggagagtaagaagggggaactgcagtcgctccaggggcacctggccaaactcggctctctcgggagagcagaggatctccacttattgcagggcaaagcagaagattgtttccaattatttgaggaggcatcacaagtcgtggagcgacgccaactggctttgagtcaccttgccgaattcctgcagtcacatgctagtctttccggaattttgcgccagctacgtcaaaccgtagaggctactaacagcatgaacaaaaatgagtcagacctcatcgaaaaggatttaaacgacgctcttcagaatgcaaaggccctggaatctgctgccgtaagcctagacggaatcctctctaaggcccagtaccatttgaaaatcggatccagtgagcaacggacatcttgtcgggctactgcagaccagctttgtggagaggtcgagaggattcaaaacttgctggggactaagcaatccgaagccgacgcgctggccgtgttgaagaaagcttttcaagaccagaaagaggaattgttgaagtccatcgaggacattgaggagaggacagataaggagcgattaaaagagccgactaggcaggcgcttcaacagcgattgagggtctttaatcaattggaggatgaacttaactctcatgaacatgagctgtgctggctcaaggacaaagccaaacagatcgctcagaaagatgtggccttcgcccccgaagtagatagagaaatcaacaggctagaagtgacttgggatgatacaaaacgactgatccacgagaatcagggccagtgttgtgggctcatcgacttgatgcgggagtatcagaatcttaagagcgccgtgagtaaggtcctggaaaacgcatcgagcgtgatcgtaactcggactacaatcaaggatcaggaagatctgaagtgggctttttcaaagcacgaaacggcgaaaaacaaaatgaactataagcagaaagatcttgataacttcacttctaaaggcaaacacttattgtcagaattaaagaagattcatagctcagacttctctctggtgaagacagatatggagtcaaccgtggacaagtggctggatgtgagcgaaaaactggaggaaaacatggaccgcctgagagtctctctcagtatatgggacgacgtactcagcacaagagatgagatcgaaggttggagcaataattgcgttccccagatggccgagaacatttcaaacctggataaccatctgcgagcagaagagctcttaaaagagttcgagagtgaggtgaagaataaagcactgcgcctcgaagagcttcatagcaaagtcaatgatttaaaggagctgaccaagaatctggagacccctccagacttacagtttattgaggcagatctgatgcagaagctggaacacgctaaagaaatcaccgaggtggccaaagggaccctcaaggacttcaccgctcagtcaacacaggtcgagaagtttattaacgatattaccacatggtttactaaggttgaagagagcctgatgaattgcgcgcagaatgagacctgtgaggccctcaaaaaggtcaaggacattcagaaggagctccagagccagcagagcaacatctcaagcacacaggagaatctcaattcactctgtcggaaatatcactctgccgaactggaatctttgggacgtgcaatgacggggcttattaagaaacatgaagccgtgtcgcagctgtgctctaagacacaggcaagccttcaggaaagtctggagaagcacttcagcgaagaaagcatgcaagaatttcaagaatggtttctgggcgccaaagctgccgctaaggaatccagtgatcgcacaggagactccaaagtgctggaagccaagctgcacgatctgcaacagaacattctggattcggtgagtgacggacagagcaagctggacgctgtgacacaagagggccagactctatatgctcacctgtcgaagcagattgtgagcagcatccaagagcagatcactaaagccaacgaagagtttcaggcctttctcaagcagtgcctcaaagataaacaagccttacaggattgtgcatctgagctgggctccttcgaggaccagcaccgaaagctgaacctgtggatccacgagatggaagaacggtttaacaccgagaacctcggagaatccaagcagcatatccctgagaaaaagaacgaagtgcataaggtggagatgtttctgggtgaattgctcgctgcaagggaaagcttggacaagctgagtcaacgggggcagcttctgtccgaggagggccatggtgcggggcaagaagggagactatgctcgcagctgctgaccagtcatcagaatctgctccggatgacaaaggagaagctccggagttgtcaggtggccctacaggaacacgaggctctggaagaggccctgcaaagtatgtggttctgggtcaaggccatccaggacagattggcttgtgcagagtcaaccttgggatctaaggacaccctggaaaaacgcctatcccagatccaagatattcttctgatgaaaggggaaggggaagttaagcttaacatggctattggcaagggcgagcaagccctgcgttccagcaataaggaagggcagcgggtcattcagacgcagctggaaactctgaaggaggtttgggccgacattatgagctcctccgtgcatgcccagtccactttggagagcgtgatcagccaatggaatgactacgtcgagcggaaaaatcagcttgagcagtggatggagtccgttgatcaaaaaatcgagcaccctctgcaaccacagcctggtttaaaggaaaaatttgtcctgctcgatcacctccagtcaattctcagtgaggctgaggatcataccagagcccttcacagattgattgcaaagagtagagaactatatgagaaaactgaagatgagagcttcaaggacacggcgcaggaagagctgaagacacaatttaacgacatcatgaccgttgctaaagaaaaaatgaggaaagtggaagaaatcgtgaaggaccaccttatgtatttagatgctgtccacgagttcaccgactggttgcatagcgccaaggaggaattacaccgctggagtgacatgtccggcgactccagcgccactcagaaaaagttgagcaaaatcaaggagctgattgactctagggaaattggggctagccgactgagccgcgtagagagccttgctcccgaggtaaagcagaacaccactgccagcggatgcgaactgatgcataccgaaatgcaggctctcagggccgactggaaacagtgggaggactcggtattccagactcagagctgcctcgaaaatctggtgagccaaatggccctcagtgaacaggaattctccggacaagtagcccaactcgagcaggctctggagcagttcagcgctctgctaaagacttgggcccagcagctgacactcctcgagggcaaaaataccgacgaagagattgtggagtgctggcataaagggcaggaaattctggacgctcttcagaaagccgaacctaggaccgaagacttgaagagtcagctgaacgagctttgtagattctccagagatttgagcacatattccgggaaagtcagtgggctgatcaaagaatataactgtctgtgcctgcaggcaagtaagggctgccagaacaaggagcagattctccagcagaggttccgtaaggctttcagagatttccaacagtggcttgtgaatgcaaaaatcactaccgccaagtgcttcgacattcctcagaacatcagcgaagtttccacttccctgcagaaaattcaggaatttctcagtgagtcagagaatggccagcacaagttaaacatgatgcttagcaagggcgaactcctctccaccttactcacaaaggaaaaagctaagggaatccaggccaaagttacggccgccaaagaggactggaagaattttcactccaacctgcatcagaaggaatcggccctcgagaatttaaagattcagatgaaagattttgaggtctctgcagaaccaattcaggattggctatcgaagacggagaaaatggtgcatgagtcaagcaacagattgtacgacctccccgccaagcgccgggagcagcaaaagcttcagagtgtcctggaggagattcactgttacgaacctcaacttaatcgtctcaaggagaaagctcaacaactctgggaaggccaggcagcctcgaagagcttcaggcatcgggtcagccagctgtctagtcaatatttggccctgagcaatcttaccaaggaaaaggtgtcaaggttggatcggatcgtggccgagcataaccagtttagccttggcatcaaggaactccaagattggatgacagatgcaatccacatgctggactcatactgccatcccacgagtgataagtcagtgctggactcccgtaccctcaagctggaagccttgctgagtgtgaaacaggaaaaggagattcagatgaaaatgattgtcacccgcggagaatcagtgctgcagaatacaagccccgagggtatcccaaccattcaacagcagctgcaatcagtaaaggacatgtgggcgtctctcctgagcgcgggcatcaggtgcaagagagtgagacttccctgcgcttacattgccctgaaactgcgcgttcaccagcacgctgagctccgggacaaaactacaatgctaggaaaggcaaaggaagccgtgacaaaatcagaaaagctcgtgcggctgcaccaggagtatcagcgcgacttgaaggccttcgaggtgtggctgggtcaagagcaagagaaacttgatcaatactctgtcctagagggcgacgcccacacgcatgagaccacattgcgagacctacaggagttacaggttcactgcgccgagggacaagcccttctcaactcggtgctacacactagggaagacgtgatacccagcggcattccgcaggccgaggatcgtgcgctggaatctttgcgccaggactggcaagcctaccagcaccggctgtccgagactcgcacgcagtttaataatgttgtgaacaagctcagacttatggaacagaagtttcagcaggttgatgagtggctcaagacagcagaggagaaggtgagccctcggacaaggcggcaaagtaatagggccacaaaagagatccagctgcatcaaatgaaaaagtggcatgaagaggtcacagcatacagggacgaagtggaggaagtgggggctcgggctcaggaaatcctcgacgagtcccacgttaattcaagaatggggtgtcaggcaacccagctgacttctaggtaccaggcgctcctcctccaagttctcgaacagatcaagtttttagaagaagagatccagtcattggaggagagcgaatctagcctgtctagctacagcgactggtatggttccacccataagaacttcaaaaatgtcgccacgaagattgataaagttgacacagtgatgatggggaaaaagctgaaaaccctcgaggtcttactgaaagacatggagaaaggtcactcactgctgaaatctgcccgcgagaagggggaacgcgccgtgaagtacctggaggagggcgaggccgagaggcttcggaaagaaattcatgatcacatggagcaattaaaagagctgacctccactgttcgaaaagagcacatgactctggagaagtctctccaacagactgtgttgagccatgaaccttccgtaaaaagcgttagagagaaaggtgaagcactcttagagctggttcaggatgtgacgctcaaagacaaaattgatcagctgcagagcgactatcaggatctttgctcgattggtaaagagcatgtgtttagcttagaagccaaagttaaggaccacgaagactacaacagcgaactgcaggaagtggagaagtggcttctgcagatgtccggcaggctcgtggcccctgatttgctggagacgagcagcctagagaccatcactcagcagctggcgcatcataagatgtaccagagcctggagcatgagctgcagaagcacgtaagccggcaagatacactgcagcagtgtcaggcttggctctcggctgtgcagcccgacctcgagcccagtccgcagccacccctatcaagggccgaggccatcaaacaagtcaagcatttcagggctctgcaggagcaggccagaacttatctggacctactgtgctctatgtgtgatctgtccaatgcatcagtaaaaacaaccgctaaggacatacagcagacagaacagactattgagcaaaaattagtgcaagcccaaaacctgacgcagggatgggaagagatcaagcatcttaagtccgaactgtggatttatctccaggacgcagatcagcaactccagaatatgaagcgccggcactccgaactggagctaaatattgcccaaaatatggtctctcaggtgaaggacttcgtaaagaagttacagtctaaacaggcctcagtcaacactattatcgaaaaagtgaacaagctaacaaaaaaggaggagagcccagagcataaggaaatcaatcatctgaatgatcagtggttggacctatgcagacagtcgaataatctctgcctgcagcgtgaggaagacctgcaacgtaccagagactaccatgactgtatgaatgtggtcgaagtgtttttggagaaatttacaacagagtgggataacctggccaggagcgatgcggagtcaactgccgtgcatctggaagccctcaaaaagcttgccctggccctgcaagagcgtaaatacgcgattgaagacctaaaagatcagaagcagaagatgatcgagcacctgaacttagatgacaaagagttagtgaaggaacagaccagccatttggagcagaggtggttccagctggaggatcttatcaaacggaaaatccaggttagtgtcaccaacctggaggagctcaacgtcgtccagtctaggttccaggagctgatggagtgggcagaagagcagcagcccaatatcgccgaggcattaaagcagtcccctccccctgacatggcccagaatctgctgatggaccatctcgccatttgcagcgagttggaagctaagcagatgcttcttaaatccctaatcaaggacgccgaccgggtgatggcagatcttggtttaaatgagcgacaggtgatacagaaagccctgagtgacgctcagtcccatgtaaactgcttaagtgaccttgtcgggcagcgtcgtaagaagcatttcaaggaggacttcgataaggcttgtcattggctgaagcaggctgatatcgtaacatttccagaaattaacctgatgaatgagtctagcgagctgcacacccagctggccaaataccagaatatactcgagcagtcacccgagtacgagaacctcctcctgactctccagcgcactggtcagacaatactccccagcctgaacgaagtcgaccattcctacctgtctgagaaactgaatgccctcccccgccagttcaacgttatcgttgctctcgctaaggataaattctacaaggtccaggaggctattctggcaaggaaagagtacgcgtccctgattgaactcactactcagagcctgtctgagcttgaggcgcaatttctcagaatgtcaaaagtgcctacagacctcgctgtcgaagaagcgctgagcttgcaggacggctgccgagccattctcgatgaggtcgccggattgggcgaggccgtggatgaactgaatcagaaaaaggaaggtttccgatctactggacagccatggcagccggataagatgttgcaccttgtcaccctttatcataggctcaagagacagactgaacagcgagtgagcctcctggaggacaccactagcgcgtaccaggaacatgaaaaaatgtgccaacaacttgagaggcagttgaagtccgttaaagaggagcagtcgaaagttaatgaagaaacccttccggccgaggaaaagctcaaaatgtaccattctcttgctggctcactccaggactcaggaatcgtgcttaagagggtgacaattcatctcgaggacttagctccacacctagatcccctcgcctacgaaaaggcccgacaccagatccaatcctggcagggggagttgaagctgctcacttcagccattggcgaaaccgtgacggaatgtgaaagcagaatggtacagtccatcgatttccagaccgagatgtccagaagtttggactggctgcggcgagttaaagcggaactcagtggaccagtgtacctggatctcaacttacaggatatccaagaagaaatccgcaagatccagattcaccaggaagaggttcagtcaagcctgcgaataatgaatgcactgtcgcacaaggaaaaggagaagttcacaaaggcaaaggagcttatatccgcagatctggagcactcccttgcggagctctctgagctggacggcgatatacaagaggctctgaggaccaggcaagccaccctcacagagatatatagtcagtgccaaagatattatcaggtttttcaagctgccaacgattggctggaagacgctcaggaactcttacagctggccggcaatggcctggatgtagaatcggcagaggaaaacctgaaaagccacatggaattcttctccacagaggaccagtttcacagcaacctggaggaactccacagcttggtggctactttggatcccctgataaagcccacagggaaggaggaccttgagcagaaagtagcttctctggaactgaggagccagcggatgagcagagatagcggtgcccaagccctcgtctctgtcgtgaactccttccatgagaagattgtggccctggaggaaaaggcttcccaactcgagaaaacaggaaacgacgccagtaaagccacactgtcacggtctatgacgactgtgtggcaaaggtggacaaggctgcgagccgtagcacaagatcaggagaagattctcgaggacgcagtggatgaatggacaggtttcaataataaagtgaagaaagctacggaaatgatcgatcagcttcaagataagctcccagggtcctcagctgagaaagcttccaaggctgaactgctgacattgctggagtaccacgacacattcgtcctcgagctcgaacagcagcagtcagccctcggcatgctccggcagcaaaccctgtcaatgctgcaggatggtgctgcccctactcccggtgaggaacctcctctcatgcaagagatcacggctatgcaggaccggtgtttgaaaatggtagaaacccagatcaacagtgtcaagtgctgggtgcaggaaactaaggaatatttgggaaatccgaccattgagatcgatgctcaactagaagagcttcagatactgctgacagaagctacaaatcacaggcagaacatagagaaaatggccgaggagcagaaagaaaagtacctgggcctctacactatcctgccgtcagagttgtctttgcaactggcggaagtggcactggacctgaagatcagggatcagatacaggacaaaatcaaggaggtcgaacagtctaaggccacctcacaggagttgtctcggcagatccagaagctggctaaagacttgaccacgatattaacaaaactaaaagcaaaaacagataatgtcgtgcaggctaagaccgaccagaaagcggcctcacacctggaagaatacaacgagatgctggaacttatcctgaaatggatcgagaaggctaaggtgctcgcacacggaacaattgcttggaattccgcaagtcagctgagggaacagtacatactccaccagactctacttgaggagagtaaagaaatagattctgaactagaggcaatgactgagaaattgcagtacctcacctctgtgtactgcaccgagaagatgtctcagcaagtcgccgaactgggaagagaaacagaagagctgcgccagatgattaaaattcggctccagaatcttcaggacgcggctaaggacatgaaaaagtttgaggcagaattaaagaagttgcaggctgctctagagcaggcccaggcaaccctcacgagccccgaggtcgggagactcagtctgaaagaacagctaagtcatcggcagcaccttctgtcggaaatggagtctctgaaaccgaaggtgcaggcggtgcaactatgccagagcgccttgcgtattcccgaagatgtagtcgcctctctgcccctttgccacgcggccctgcgcctgcaagaagaggcctcccgattgcagcacacagccatccagcagtgtaacattatgcaggaagcggtggtccagtatgaacaatacgaacaggagatgaagcaccttcagcagcttattgaaggtgcccatcgagagattgaagataaaccagttgcaacatctaatattcaggagctccaggcccagatatctcgccacgaggagcttgcccaaaagatcaaagggtaccaggagcaaatcgccagccttaatagcaaatgtaagatgctgactatgaaagcgaagcatgctacaatgcttctcaccgtcactgaggtagagggcttggccgagggcaccgaagatctggatggcgagcttctacccactccatccgcgcatcccagtgtcgtcatgatgacagcaggcagatgccatacccttctctcacccgtgaccgaggagagtggcgaggaggggacaaattcggagataagctcaccccccgcctgtcgatcaccctcccctgtcgctaatacggatgcatcggttaatcaggatatcgcatactaccaagctctgagtgcagagagactccagaccgatgccgccaagatacacccctcaacttccgcaagtcaggaattttatgagcctggtttggaaccctctgccaccgccaaattaggagaccttcaaaggagctgggaaactcttaagaatgtcattagtgagaaacagaggacgctgtacgaggccctggaaagacagcagaaatatcaggactccctccaaagtatctcaacaaagatggaagccatagagttaaagcttagtgagtctccagaacctggacgatctccagagagccaaatggccgaacatcaagccctgatggacgagatcctgatgctgcaggatgagatcaacgaactgcaatccagcctggcggaggaactcgtctccgaaagctgtgaggcagaccccgccgaacaactagccttgcagtctacccttacagtgcttgctgagcgcatgagtactatccgaatgaaggcctctgggaaacgtcaactacttgaggagaaactgaatgatcagctggaagaacaacggcaagaacaggcccttcagagatatcgctgtgaggcggatgagctggatagctggctgctgtctaccaaggctacactggacacagcactttcaccccccaaggagccgatggacatggaagctcaacttatggattgccagaatatgctcgtcgagatcgagcagaaggtggtggctctatcagaattgtcagtgcataatgaaaacttattgttggaggggaaggcccacacaaaagatgaagctgagcaacttgctgggaaattgaggaggttaaagggctctttactagaactccagcgggcccttcacgacaagcagctgaacatgcaaggcactgctcaagagaaggaagagagcgacgtcgacctgacagcgactcagtcaccaggagtccaggagtggcttgcccaggcgcgaaccacctggacacagcagaggcagtccagcctccagcagcagaaagagctggagcaggaactcgccgaacaaaaatctcttcttcgttcagtcgccagcaggggtgaggagattttaattcagcactcagccgctgaaacctccggcgacgctggggagaaacccgatgtgctttcccaggagctaggcatggaaggtgagaaatcaagcgctgaggatcagatgagaatgaagtgggagtctctccaccaggagttcagcaccaagcaaaagttactgcagaatgtgcttgagcaggagcaggagcaagtgctttatagcaggccaaaccgtcttctttccggggtcccactgtacaaaggcgacgttcctacgcaggacaaaagtgccgtgacaagcctcttggatgggctcaaccaagccttcgaggaggtgtcttcccagtccggtggagcgaaacgacagtccattcacctggagcagaaactgtacgatggtgtaagcgcaacctctacctggctcgacgatgtcgaggagcggctcttcgtggccaccgcactcctgcccgaggaaaccgaaacatgcctgttcaaccaagagatcttggctaaagacataaaagaaatgtccgaagaaatggataagaataagaatctattcagtcaggccttccctgaaaatggcgataaccgagacgtaattgaggatacgctgggatgcctgctgggacggctgagcctgctcgactctgtggtcaaccagagatgccaccagatgaaagagcgcctccaacagattttgaacttccagaacgacctgaaggttcttttcacaagtcttgccgacaacaaatacattatattacagaagctcgcaaatgtgttcgaacaacccgtagctgagcagatcgaggcaattcaacaggcagaagatggcctgaaagagtttgatgctggaatcatagagcttaagagaagaggcgacaaacttcaagtagaacagccatctatgcaggaactgtctaagctgcaggacatgtacgatgaactcatgatgatcattggcagcagacggagtgggctgaatcagaatttaaccctgaagtcccagtatgagagggcactgcaagacctggcggacctcctggaaaccgggcaggaaaagatggctggagaccagaaaatcatcgtttcctccaaggaggagattcagcagttgctcgataagcataaggaatacttccagggattggaaagccacatgatcctgactgagaccctgttccgaaaaataatctcttttgctgtgcagaaagagacacagtttcatacggagcttatggcacaggctagcgccgtgttgaaacgagcacataagagaggagtggagcttgagtatattttggaaacctggtcacatcttgacgaggaccagcaggagctgagtaggcagctagaggtggttgaatcctcaatcccgtccgtggggctggtcgaagaaaatgaggataggctcatcgacaggatcaccctgtaccagcaccttaaatcctcccttaatgaatatcagcctaagctgtaccaagtgttagacgatggcaagcgtctactgatcagcatttcttgtagcgatctggagagtcagctcaaccagctgggagaatgctggttgtctaacaccaacaaaatgagcaaagaactccacagactcgagaccattctcaaacactggactcggtaccagtccgaatccgcagacctcatccattggctgcagtccgcaaaagataggttagagttttggacacagcagagtgtgacagtcccacaggaactggaaatggtgcgcgatcacttgaatgccttcctggagttttccaaggaggtcgatgcccagtcttctctcaaaagcagtgttctgtctaccggtaatcagcttctccggctgaagaaagtggatactgccactctgcgctctgaactatctcggattgatagccaatggactgacctactgaccaatatacccgccgtacaggagaagttgcaccagctgcaaatggacaaacttcctagccgacacgccatatccgaggtgatgtcatggattagcctgatggagaacgttattcagaaggacgaagataatatcaagaactctattggctacaaggccatacatgagtacctgcagaagtacaaaggtttcaagatcgatataaattgtaaacagttgacggtggacttcgtaaatcaatccgtcctccagattagctcacaggatgtggagtccaagcgcagtgacaagacagactttgcggaacagctaggcgccatgaacaaaagttggcaaatactgcaaggtctggtgaccgaaaaaattcagctgctggaaggtttgttagaatcgtggtctgagtacgaaaataacgttcagtgccttaaaacatggtttgagacacaggagaagcgactaaagcagcagcatcgcattggagaccaagccagtgtgcagaacgccctcaaggactgtcaggatctcgaggacttgataaaagcaaaggaaaaggaagttgagaagatcgaacagaacggtttagccttgatccagaacaaaaaagaagacgtctcatccatcgtaatgtcgacactgcgcgaactgggccagacctgggccaacctggatcacatggtggggcagctgaaaattctgcttaaatcagtcttggaccagtggtctagtcacaaggtggcattcgataagataaactcctacctcatggaggcacgatacagcttgtcacgctttcgactacttaccgggagtctcgaagccgtacaggtacaggtggacaatttgcaaaatctccaggatgatttagaaaagcaggagaggtctcttcagaagtttggatccataactaatcaattgctgaaggaatgccatcctcccgtgaccgaaactttaactaacacgctcaaggaagtgaacatgaggtggaacaacctgttggaggaaattgctgagcagctacagagcagcaaagcgctcttacaattgtggcagagatacaaggactacagtaaacagtgcgcctctactgtgcaacaacaggaggatcggaccaacgagcttctgaaggcagccactaataaggacatcgccgatgacgaggtggccacatggatccaggattgtaatgatctactgaaaggcctcggcaccgtaaaagactctttattttttctgcacgagctaggcgagcagctcaagcagcaggtcgatgcctccgctgcctccgcgatccagtccgatcagctgtccctctcccaacacctgtgtgcgctagaacaagcgctgtgcaaacagcagacttccctgcaagcaggggtactggattacgaaaccttcgcaaagagcttggaagcgcttgaggcctggattgtggaggctgaagagatcctgcaaggtcaagatccatcgcacagctcagatctctccaccatacaggagcggatggaagagctcaaaggacagatgttgaagttcagtagcatggcccccgacctggaccgtcttaacgaactcggctatcgacttcctctgaatgataaggagattaaacgtatgcagaacctcaacagacactggagtctcatatccagccagaccaccgagcgcttttccaaactccagtcttttctccttcagcaccagactttcctggagaaatgcgagacttggatggaattcctcgtacagacagaacagaagctggctgtggaaatcagtggaaactaccagcacttactggagcaacagcgggcccatgaactatttcaggccgagatgttctctaggcagcagatcttgcacagtataattatcgatggtcagcggcttctcgagcaggggcaggttgatgaccgagacgagttcaacctgaagctgacccttttatctaatcaatggcagggagtcattaggcgcgcacagcagagaagggggataatcgattcacagatccggcagtggcagcggtaccgcgaaatggctgagaagctgaggaagtggctggtggaggtctcataccttcctatgtcaggactgggctcagtgcccattcctctgcaacaggccagaaccctgtttgatgaggtgcagttcaaagagaaagtgttcctgcgacaacaggggagttatatcctgacagtggaagctgggaaacagctgttactgagcgctgatagcggagctgaggcagcacttcaggccgaattagcagagattcaggagaagtggaagtccgcatccatgcgtttggaggagcagaaaaagaagctagcattcctgcttaaagactgggaaaagtgcgagaagggaattgctgactccctggagaaattgcgcacttttaagaaaaagttgagccagtccctgcctgatcatcatgaggagttgcacgccgagcaaatgcggtgcaaggaactggagaacgccgtggggagctggacagacgatctgacccagctgtcactgctgaaagacacactgtctgcctacatcagcgcggacgacatcagtatcctgaacgagagggtggagctcctgcaaagacagtgggaagaactctgtcatcaactgagccttaggcgccagcagataggggaacggctgaacgagtgggctgtattttcagagaaaaataaagaactgtgcgagtggcttacacagatggaaagcaaagtgtctcagaacggtgacattctgatcgaagagatgatcgaaaaactcaaaaaagactaccaggaggagatcgcgattgcacaggagaataaaattcaactgcagcagatgggcgagagactggcaaaggcttctcacgagagcaaggcgtctgagatcgagtataagttgggaaaagttaacgaccgttggcaacacctactagaccttatcgccgccagggtcaagaaactcaaggagacactggtggctgtgcagcagctggacaaaaacatgtcgtcgctgcggacttggctcgctcatatcgaaagtgagctggcaaaaccgatcgtttacgatagctgtaacagtgaggaaatccagcgcaaactaaatgaacagcaggagcttcagcgggacatcgagaagcatagcactggggtggctagcgtgctgaatctgtgcgaggtgctgctccatgattgcgatgcttgtgcgactgatgctgagtgtgactccattcaacaagctactcggaatctcgacagacggtggcgcaacatttgtgccatgtctatggaacgtcgcttaaagatagaagagacgtggcggttatggcagaagttcctcgacgattactcacggttcgaagactggctgaagagctctgaacgaacagctgcctttccatcgtcatctggcgttatttataccgtggcaaaagaagagttgaaaaaattcgaagcgtttcagcggcaggtgcatgagtgtcttacccagttagagctaattaataagcaatataggcggctggctcgggagaacagaaccgactccgcctgctcactgaaacagatggtccacgaggggaatcaacggtgggataatctgcagaagagagtgactagtattctccggagacttaagcatttcataggccagcgcgaggagttcgagactgccagggactccatattagtttggctgaccgaaatggacctgcagctgacaaatatcgaacatttctcagaatgtgatgtgcaggctaaaataaaacagctcaaagccttccagcaggagataagtctaaatcacaacaaaatcgagcagatcatcgcacaaggggaacagttaatcgaaaaaagtgagcctcttgacgcagcaatcattgaggaggagctagatgagctacgtagatactgtcaggaagtgtttggaagggtcgagagataccataaaaaattgattcggcttcccctgcccgacgatgaacacgacctgtctgaccgcgagctcgagcttgaggactctgccgccctgtccgacctccattggcacgatcgttctgctgactcacttctgagtccccaaccatccagcaacctgtccttgagccttgcccagccactgcgatcagagcgctcaggccgagatacccctgcatcagtggattctataccccttgaatgggaccatgattatgacttgagcagagatttggaatcggctatgtcacgagccctcccctccgaggacgaggaaggtcaggatgataaggacttctacctgaggggtgccgtgggtctgagcggggaccattctgccctcgagtctcagatcagacagctcggtaaagctctcgacgacagtaggtttcagatacagcagaccgagaatataattagatcgaaaacgccgaccggacctgagctcgatacctcctacaagggatacatgaagcttctaggagaatgctcttcctccattgactccgtcaaaaggttggagcacaagttgaaggaagaagaagaaagcctccctggatttgtgaacctgcattccacggagacccagacagctggcgtgatcgacaggtgggaattactccaagcacaggccctgtctaaagagctgaggatgaagcagaatcttcagaagtggcagcagttcaactcagatctaaactcaatttgggcctggcttggagacaccgaggaagagcttgagcagctgcagcggctcgagttgtcgacagatatacagacgatcgagctgcaaattaagaagctcaaagaattacagaaagcagttgaccaccgcaaagccatcatcctgagtattaacctttgttcccctgagttcacccaagctgactctaaagaaagcagggatctgcaagacagactgtcacagatgaacgggcgatgggatagggtttgctctctgctagaggaatggagaggtctcctgcaggatgccctgatgcagtgccagggatttcacgaaatgtcacacggcctgttgttgatgcttgagaatatcgatcgcagaaagaatgagatcgtcccaattgactccaatctggacgctgagattctgcaggatcaccataaacagctgatgcagatcaagcacgaattactcgagagccagctgagggtggcgagcctccaagacatgagttgccaactactggtcaacgccgagggtacagattgtctggaagccaaggagaaggtccacgtgataggaaataggctaaagcttctgctgaaagaggtgtctagacacatcaaagagctggaaaagctgcttgatgtgtcctcctcacaacaggatctgtcgtcgtggtcctccgccgacgaactggacacatccggctctgtctctcctacgagcgggcgttccaccccgaacaggcaaaagacacctaggggaaagtgctcattgagtcagcccggtccttctgtaagtagccctcatagccgttcaaccaaaggcggatccgattcatcactaagcgagcccgggcccggccgtagcggtcggggttttctctttcgagtactgcgcgcagcgctgccgcttcagttactcttactcctgctaattggtctggcatgtctcgttccgatgtctgaggaggactatagctgtgctctgtcaaacaacttcgcccgaagcttccatccaatgcttcggtataccaacggcccaccacccctctag

SEQ ID NO: 135872 - DNA, 9966 bp, Artificial Sequence
  Description of Artificial Sequence: Synthetic coding sequence
atggaattggatgccgccgtccaaaaatttctggagcagaacggtcagttaggcaaacccctggccaaaaagatcggcaagctgacagagctgcaccagcagactatccgacaggccgaaaacaggctcagcaagttaaatcaggcagctagtcatctggaggagtataatgagatgttagagctgatccttaagtggatcgaaaaggcaaaggtgctggctcacggcaccatcgcatggaactcggcatcacagctacgggagcagtacattcttcatcagactctcctggaagagtctaaagagattgactccgaattggaggctatgactgagaagctgcagtatttgacttcagtgtattgcaccgagaaaatgtcgcagcaggtggcagaattgggaagggagaccgaggaactccggcagatgatcaaaatcagactacagaacctccaggatgcagcaaaggatatgaagaagttcgaagccgagctgaaaaagttgcaagcggcgctggagcaggcccaggctactctcacctcccccgaggtcgggcggttatcacttaaggagcaactctctcatcgacagcacctgttgtctgagatggagagccttaaacccaaagttcaggccgtgcagctatgccagtcagccctgaggattcccgaggatgtggtcgccagcctcccactttgccacgctgccttaagactgcaggaagaggccagccggttacaacatacagctatccagcagtgcaacattatgcaggccgcggtcgtgcagtacgagcagtacgagcaggaaatgaaacatctgcaacagctgattgaaggtgcccatcgggaaatcgaggacaaaccagttgcaaccagcaacattcaggaactgcaagcccagatttcacgtcatgaggagcttgctcaaaagataaaggggtatcaagaacagatcgccagcctaaactccaagtgtaaaatgcttacaatgaaagccaaacacgcgaccatgctcttgaccgtcactgaggtggaaggactcgctgaagggaccgaggatctggacggcgagctgctgcctactccgtcagcccatcccagcgtggtgatgatgaccgctggccggtgtcacaccctgctctctcctgtgacagaggaaagtggcgaagagggcaccaacagtgaaattagctctccccctgcctgcaggtcgccatcccctgtggcaaataccgatgcgtctgtgaatcaagacatcgcatactaccaggcactgtcggctgagcggctccagactgatgccgctaaaattcacccctcaacgtctgcttcccaagaattctacgaacctggcctggaaccatctgctaccgccaagctcggggaccttcagcggagctgggaaaccctgaaaaatgtgatcagtgaaaagcagcggacactgtacgaagctcttgagcgtcaacagaagtaccaggattcgctccagagcatatcaacgaagatggaagccattgagcttaagttgagcgaaagccccgagccaggaaggtcccctgaatcacaaatggccgagcatcaggcactcatggacgagatcctgatgctacaggatgaaatcaatgaactgcagtcttctctggcagaggagctggtttccgaatcgtgcgaggccgaccccgctgaacaattggccctccagagcacgttaacggtgctcgctgagaggatgtcgacaattcgaatgaaggcttcgggtaagaggcaactcctggaagagaaattgaacgatcagcttgaagaacagcgccaagagcaggctctacagcggtaccgctgcgaggccgatgagttagattcatggctcctttcaactaaagctaccctcgataccgctttgtcccctccaaaagagcctatggatatggaagcccagctgatggactgtcagaacatgctagtggagatcgaacagaaagtggtcgctctctccgaactgagtgtccacaatgaaaacctcttactggagggcaaggcgcacacaaaagacgaggccgagcagctggccggaaagttaaggcgcctgaaaggcagcctattagagctgcagagagccctacacgacaagcagcttaatatgcagggtacagcccaggagaaagaagagagcgatgtagacctaactgcaactcaatctcccggggttcaagagtggctagctcaggctcgcacgacctggacccagcagcggcagagttcattgcagcagcaaaaggagctggaacaggagctcgccgagcagaagagcctcctgaggagtgtggcatctcggggtgaggaaatactcattcagcacagtgcggcagagacgtccggcgatgccggggagaaacctgatgtactctcccaggaactgggcatggagggggagaagagctccgctgaggaccagatgaggatgaaatgggagagtttgcaccaagaattttctacaaagcagaagctgctccagaatgtcctcgaacaagagcaagagcaagtgctgtattcaaggcccaaccgcctgttgtcaggggttccactatacaagggagatgttcccacccaggataagagtgccgttacatctctgctggacggacttaatcaagcattcgaggaagtctcgagccagtcaggcggagccaagcggcagagcattcatcttgagcaaaaattatacgacggcgtgagcgcaacctcaacttggctcgacgacgtggaagagaggcttttcgtcgcaactgccctcctcccagaggagaccgagacgtgcctcttcaaccaagaaatcctggccaaagacattaaagagatgagcgaggagatggacaagaacaaaaacctcttcagtcaggcatttcctgaaaatggcgacaatagggacgtgatcgaggataccctgggctgcctgctcggacggctgtccttgctggacagcgtggtgaaccagagatgtcaccagatgaaagagcggctgcagcagattctaaattttcagaatgatcttaaggtactgttcacgtccctcgccgacaataaatatataatcctccagaaactggccaacgtattcgagcagcctgtcgcggaacagatcgaagctattcagcaagccgaggatggcctgaaagaatttgatgccgggattattgaacttaaacgaagaggcgataaacttcaggtggagcagccttccatgcaggagttatctaaacttcaggacatgtatgacgaactcatgatgatcatcgggtcccgccgctcaggactcaaccagaacctgaccctcaaatcccagtatgagagggccttacaggatctggctgacttgctcgaaactggccaggagaagatggccggagaccaaaaaatcatagtctcatcaaaagaggagattcagcagctgttagacaagcacaaggaatatttccagggacttgaaagtcatatgatcttaacagagacactgtttcgcaagattatcagtttcgctgtgcagaaagaaacccagtttcatactgagctcatggcgcaggctagcgccgttctaaaacgggcccacaagcggggcgtcgagctggagtacatcctagagacatggtcacacctggacgaggaccagcaagagttaagcaggcagctggaagtggtggagagcagtatcccgtctgtggggctagtggaggaaaacgaggacagactcatagacaggattaccctgtaccagcatttgaagagctcattgaacgagtaccaacctaagttgtatcaggtgctggatgacggaaagcgcctgctcataagcatctcttgcagtgatctcgagagtcagcttaatcagttgggggaatgctggttaagtaatactaacaagatgagtaaagagttgcatagactggagaccattttaaagcattggaccagataccaaagcgagtcagccgatctgattcactggctccagagtgcaaaagaccggttggaattttggactcagcagagcgttacagtgccccaggaactggagatggtgcgtgaccacttaaatgcattcctcgaattttctaaagaggtagacgctcagtcctctcttaagagttctgtcttatccactggcaatcaactcttgaggctcaaaaaagtggacactgcgaccctccgatccgaattgtcccgaatcgactcccaatggaccgatctgcttactaatatccctgctgttcaggagaagcttcatcagttacagatggacaaactcccaagcaggcatgcgatcagtgaagtgatgtcatggatttcactgatggaaaacgtaattcagaaggacgaggacaacattaaaaatagtatcgggtacaaagcaattcacgagtacttgcagaagtacaagggattcaagattgacattaattgcaaacagctgacggtggacttcgtgaatcagtctgtcctgcagatatccagccaggacgtcgagagcaaaagaagtgacaagaccgatttcgccgagcaactgggcgcgatgaacaaaagctggcagatcctccaaggtctcgtcacggagaagatccagcttttggaaggtctgctcgagtcatggtcagaatacgagaataatgttcagtgcctgaaaacctggttcgagacccaggaaaaacgcctcaagcagcagcatagaatcggggatcaagcctcagttcagaacgctttgaaagattgccaagacctggaagacttaatcaaggcaaaagaaaaggaagtagaaaaaatcgaacagaatggcctcgcccttattcagaacaagaaggaagatgtctccagtatcgtgatgagcacactccgagaacttgggcaaacctgggcgaacttggatcacatggtcggccaattgaagattctcctgaaaagcgtgttagatcagtggtcaagtcataaggtggcctttgataaaattaacagttaccttatggaagctcggtactctctgagccggttccgacttctgacaggtagtctggaggctgtgcaggtccaggtagacaacttgcagaacctccaggacgatctggagaagcaggaacgctctctccagaagtttggctcaataacaaaccagctgctgaaagagtgtcatccccctgtcaccgaaacactcacaaacacactgaaagaggttaatatgagatggaataatttgctcgaggaaattgccgagcagttacagagttcgaaagctctgttgcagctctggcagcggtataaagattattcaaagcagtgcgcctcaacagttcagcagcaggaagacaggactaacgaactgctgaaagctgccaccaataaagatatcgccgacgacgaggtggccacctggatacaggactgcaacgatctgctaaagggtctcggaaccgtcaaggattcactctttttcctgcatgagctcggagagcagctgaagcagcaggtggatgcttccgctgcgtcagcaatccagtctgaccagctctctttgtcacaacacctgtgtgcactggaacaggcactgtgtaagcagcaaaccagtctgcaagccggagtccttgactacgagaccttcgctaagagcttagaggcgctagaggcttggatagttgaagctgaagagatcctgcagggacaagatccctctcattccagtgacctctccactatacaagagcggatggaggaactcaaaggtcaaatgctcaagtttagctccatggctcccgacttggatagattaaatgaattaggctataggctacccctcaacgacaaagagatcaaaagaatgcagaatctgaacagacattggtctctgataagctcccagactaccgaaaggttctccaagttacaatcattcctactgcagcaccagacctttctcgagaaatgtgaaacctggatggaatttctcgtccagacagaacagaagttggcggttgaaatatcgggcaactaccagcatttgcttgaacaacagagagcccatgagctctttcaggccgagatgtttagccgtcagcagatcctgcatagtataattatcgatggacagcggctgttggagcagggacaggtggatgatagagatgaattcaaccttaagctgaccctgctatcaaaccagtggcaaggcgttatcaggcgagcacaacagaggcggggaatcatagattcccagatcagacagtggcaacgctatagagaaatggccgagaagttgcggaagtggctggttgaagtgtcctacttacccatgagcggccttggctctgtgcccatcccgttgcagcaagcaaggacattgtttgatgaagtgcagtttaaagagaaagtctttctgcgacagcagggatcctatatcttgaccgtggaggcaggtaaacagctgctgctcagtgctgactcaggtgctgaggctgctttacaggccgagttggcagaaattcaagaaaaatggaagtccgcttccatgcgactggaggaacaaaagaaaaagctcgctttcctcctgaaagactgggagaagtgtgagaaggggatcgccgacagcctcgagaaactaaggacctttaaaaagaaacttagccagagcttgcctgatcaccacgaggagctgcacgcggagcagatgcgctgtaaggagttagagaacgcagtcggatcatggaccgatgatttgacgcagctttctctcctcaaagatactttatctgcctacatcagtgctgatgatatatcgattttaaacgaacgcgtggagctgctgcagaggcagtgggaggaactatgccaccagctgtccctcagaaggcagcagatcggagaacggctcaacgagtgggctgttttctccgaaaagaataaggagttgtgtgaatggttgacccagatggagtctaaggtgagccagaacggcgacatcttgattgaagagatgattgaaaagttgaaaaaggattatcaagaggagatcgcaatagcccaggagaataaaatccagctccagcaaatgggcgaaagattagccaaggcgagccatgaatctaaggcctcagaaattgaatacaaattgggcaaggttaacgacaggtggcagcacctgctggacctgattgctgcccgcgtgaaaaagctgaaagagacgctagtggctgtgcagcaactggacaagaacatgagctccctaagaacatggcttgcacacatagaaagtgagcttgccaaaccaatcgtttatgacagctgcaatagcgaggagatccagcgcaaattaaatgaacagcaggagctgcaacgcgatattgaaaagcattccactggagttgctagcgtgctcaatttgtgcgaggttctactccacgactgtgatgcctgcgcaaccgatgcagaatgtgactcgatccagcaggcgaccagaaacttggacaggcggtggcgtaacatctgcgctatgagcatggaaagacgcttgaagatagaggagacgtggcggttgtggcagaagttcctggatgattactcaaggtttgaagactggctgaaatcatctgaaagaactgctgcattcccctccagcagtggcgtgatttacacggttgctaaggaggagctcaaaaagtttgaggccttccaaagacaggtgcatgagtgtctgacccagctggagttgattaataagcagtatagaagactggcgcgagagaatcgaacggacagtgcctgttccttgaaacagatggtgcacgaagggaatcagcgctgggataacctgcagaaacgagtgactagcatcctgcggcgtctgaagcatttcattggacaaagagaagagtttgagacagcacgggactccatcctggtatggctcactgaaatggacctccagttaactaacatcgaacatttttcagaatgtgatgtgcaggctaagataaaacagctcaaggctttccagcaggagatcagtctgaaccacaataaaatagaacagattatcgcacagggggagcaattgattgaaaaaagcgagcccctcgatgccgctattatcgaagaggaattggatgagctcagacgctattgtcaagaagtgtttgggcgcgtggaaagataccataaaaaacttattcggttaccactgccagacgacgaacacgacctctcggaccgtgagctggagcttgaagacagtgccgccctgtccgacctgcattggcacgataggagcgccgattctttgctgtcccctcagccctccagtaatctgagcctgtccttagcgcagccactgaggtctgagcgatctggtagggatacccccgcatctgtggactccattccattggagtgggaccacgattacgacctgtcacgggacctggagtctgctatgagccgcgccttaccatcggaagatgaggagggtcaagacgacaaggacttctacctgcggggggccgttggactgtcgggagatcattccgccctcgaaagtcaaatacgccagctcggcaaggcgctggatgactcccgcttccagatacagcagacggagaatatcattcgatcaaaaactccaacgggcccagaactggatacgtcatacaagggatacatgaaactgttaggtgaatgctcatcctctattgattctgtaaaacggctcgaacataaactgaaagaagaagaggaaagcttaccagggttcgtgaacttgcacagcaccgaaacgcaaacagccggagtgatagaccggtgggagttgctccaagcacaggctctcagcaaggagctgcgcatgaaacaaaatctgcagaagtggcaacagttcaatagcgacctgaactctatctgggcttggctcggtgataccgaggaggagctggaacagctgcagcgattggagctgagcacggatatacagaccatcgagctccagataaagaaactaaaagagttacagaaggcggtcgaccatcgcaaagccatcatcttgtccataaatttgtgttcaccagagtttacgcaggccgactcgaaagagtcccgggacttgcaggataggctgtctcagatgaacgggagatgggacagagtgtgctctttgctcgaagagtggaggggacttctgcaggacgcccttatgcaatgccaaggatttcacgaaatgtcacacggactcctgctgatgcttgagaacatagatcgtagaaagaatgagatcgtgccgatcgactctaacctggatgcagaaatcctgcaggaccatcataagcagctgatgcaaataaagcatgagctgcttgagtctcaactgagagtggctagcctacaggatatgtcttgtcagctcctcgtgaatgcagaggggactgattgtctggaagctaaggagaaggtacacgtcatcggaaacaggctgaagctactcctgaaggaggtctctagacacatcaaggagttagaaaagctgctcgatgtcagcagttcccagcaagaccttagcagctggagtagcgccgatgaattggacacttcgggaagtgtaagtcccaccagcggccgtagtacccctaatcgacagaagacaccccgtggcaagtgcagtctgagtcaacctgggccttctgtttcatccccgcacagcagatctactaagggagggtccgactcaagcctgtcggagcctggcccgggcagatcagggaggggctttctgttccgcgtgttgcgcgctgccctccccctacaactgctgctgttgctgctcatcggtttagcgtgtctcgtgcctatgtccgaagaggactattcttgcgctctgtcaaataacttcgccaggagcttccatcccatgcttaggtacactaatgggccgcctcctctgtag

SEQ ID NO: 135873 - DNA, 2934 bp, Artificial Sequence
  Description of Artificial Sequence: Synthetic coding sequence
atggtcgtcgcggaagacctcagtgcactgcggatggcagaggacagctgtgtggatgccgaccttcccgactgtaattgcgatgtcacccggcagcgagtgaaaaaattgaaagaaaccttggtcgcagtgcaacaacttgataagaacatgtcgagtctaaggacttggttagcacacattgaatcagagcttgctaaacctattgtctatgacagttgcaactctgaggaaatccagagaaaactgaacgagcagcaggaactgcaaagggacatcgaaaagcacagcaccggcgtggcttcagttcttaacctctgcgaggtcctgctgcatgactgtgatgcctgcgccaccgacgcggagtgcgacagtatccagcaagccaccagaaatctggaccggaggtggcggaacatttgcgcaatgtccatggagagaaggctgaagatcgaagagacatggagactctggcagaagtttctcgatgactattcaaggtttgaggattggctgaaatcatccgagagaactgctgcgtttccatctagttcaggcgtgatctacacagtggctaaagaagaactgaagaagttcgaggccttccagcgacaggtgcatgaatgtctaactcagcttgaactcattaacaaacagtatcgacgactggcccgcgaaaatagaaccgatagtgcatgtagtctgaaacagatggtacacgaggggaatcagcggtgggataacctgcagaagcgggtaacctcaattctgagacgactgaagcatttcataggacagcgtgaagagttcgagaccgcccgagatagcattttagtctggctgacagagatggacttacaactcactaacatagagcatttttccgagtgcgacgtccaagccaagataaaacagcttaaggcctttcagcaggagattagccttaaccataacaagatcgaacagatcatcgcccaaggtgaacagctgattgagaagtccgagccactggacgcagcaatcattgaggaagaattggatgagctgcgccgttactgtcaggaggtcttcggaagagtcgagcgttatcacaagaagttgattagactgcccttacccgacgacgaacacgatctgagtgatagggagctggagctagaggactctgctgcgctgtctgaccttcactggcacgacaggtccgccgactccctactgagccctcagccttccagcaatctgagcctgagcctggcccagccgctgaggtccgaacgctcaggccgcgatacccctgccagtgtagatagcattccattagagtgggaccacgactacgacctgagtcgggaccttgagagcgctatgtctagagctctgccttccgaagatgaagaagggcaagacgataaggacttttacctccgtggtgctgttggcctgtccgacgtgatgattccggagtcacctgaggcttacgtgaaactcaccgagaatgctatcaaaaatactagcggagatcacagcgcccttgaaagccagattcggcagctgggcaaggccttagatgactctagattccagatccagcaaaccgaaaacatcattcggagtaagacaccgactgggccggaattggatacctcttacaagggctacatgaagctcctgggggagtgttctagtagcatagattcagttaaaaggctcgaacacaagctgaaagaggaagaagagtccctgccgggttttgtgaacttgcacagcaccgagacccagacagccggcgtgatcgatagatgggagttgctgcaggcacaggctctgtcaaaggaactccgcatgaaacagaatctacaaaagtggcaacagtttaattcggacctgaactctatttgggcctggctcggcgacacagaggaggaactggaacagctgcagcgcctggaattgagcaccgatatccagactattgaattgcagatcaaaaagctgaaagaactgcagaaggcagttgatcaccgcaaagccataatcctttctattaacctgtgctctcccgaatttacccaagcagactctaaggagtctcgcgatctgcaagatcgactctctcaaatgaatggacgatgggaccgcgtgtgttctctgctggaggaatggcgaggattgctgcaggatgcactcatgcagtgtcagggtttccacgagatgtctcacggcctgctgctcatgctagagaacatcgatcgtcggaaaaatgagatagtgcccattgacagtaatctggatgctgaaattctgcaagaccaccacaaacagctgatgcagataaaacacgaacttctcgaaagccagctgcgggttgcaagtctacaggatatgagttgccagctcttggtgaacgcggaaggtactgattgcctcgaagctaaggagaaggtccacgtgatagggaaccgtttaaaacttcttcttaaggaggtaagcagacatattaaagaacttgagaaactcctcgacgtttcctcttcacagcaagacctctcaagttggagcagcgccgatgaacttgatacctctggttctgtgtctccaacatcaggcagaagtacccctaatcggcagaagacaccccggggcaaatgtagcctttcccagcctggacccagcgtgagctcaccacactcacgcagcaccaagggcggtagcgattcctccctaagtgagccaggccctggtcgctcgggaagaggttttctcttcagggtattacgtgcagccctgcccctccagctcctgctgcttctgctcatcgggctggcttgcctcgttccaatgtctgaggaggactatagttgcgcactgtccaataactttgccaggtcatttcacccgatgctgaggtataccaacgggcctccacctttatag

SEQ ID NO: 135874 - DNA, 26394 bp, Artificial Sequence
  Description of Artificial Sequence: Synthetic coding sequence
atggccacatcacggggtgcgtccagatgtccacgcgatattgctaacgtgatgcagaggcttcaggacgaacaggaaatcgtccagaaaaggacattcacaaagtggatcaactcacacctcgccaagagaaagccacctatggtggtggacgacctgttcgaagatatgaaggatggcgtgaagctgcttgcactcttagaggttttgagcggtcagaagcttccctgtgagcaaggtcggagaatgaaacgaattcacgccgtagcgaacatcggcaccgctttgaaatttctagagggacggaaaatcaaactggtgaacatcaactccacagacatcgccgatgggagaccatctattgttcttgggctgatgtggacaattatactgtactttcaaatagaggaactgaccagcaatctacctcagctgcagagcttgtcttccagcgcaagtagcgtcgattctatcgtgtccagcgagacaccctctcctcctagtaaaaggaaagttaccaccaagatacagggtaatgccaagaaggctctcctcaagtgggtccagtatacagccggcaaacagactgggatcgaggttaaggatttcggaaagagctggcgcagtggagtggccttccacagcgttatccacgcgatccgccctgagctggtcgacctcgagaccgtgaaaggacgttccaatagggaaaatttagaggacgccttcaccatcgcagagactgagctcgggatacccagattgttggatccagaagatgtggatgtcgacaagcctgacgaaaagtcaattatgacctacgtcgctcagttcctgaagcattacccagatatacacaatgccagtaccgacggacaggaagatgacgagattctgccagggttcccgtctttcgctaatagcgtccagaactttaaaagagaggatcgggttattttcaaagaaatgaaggtttggattgagcagttcgagagagatctgacacgtgcccagatggtggaatcgaacctccaagacaagtatcagtcattcaagcacttccgcgtacagtacgaaatgaaaagaaagcagatcgagcacctgatccaacctttgcatagggatggaaagttatctttagaccaagccctggttaagcagtcatgggatcgtgttacatctaggttatttgattggcatatccagctggataagtctttgcctgcaccgctcggaactatcggagcatggttgtacagagcggaggttgcactccgagaagagatcacggtacaacaggtacatgaagaaactgccaatacaatccagcggaagctcgaacaacataaagatctcctacagaatacagatgcacataaacgagcctttcatgaaatatacagaacaagaagcgtgaacggtatccccgtgccaccagaccaactggaagacatggccgagagatttcacttcgtgtcgtccacatccgaactccatctgatgaagatggagtttctggaactcaaatatagactgctctcgctgctggtgctcgctgaatcaaaattaaaatcatggatcatcaaatatggtaggcgggagtccgtcgaacaactgcttcaaaactatgtcagcttcatcgagaactccaagttttttgaacagtacgaggtgacataccagattctgaaacagaccgctgagatgtacgttaaggccgacggctcagtggaagaagcagagaacgtgatgaagtttatgaatgagacgaccgcacagtggcggaacctgtcagtagaagtccgatcagtgagaagtatgctagaagaggtcatttccaactgggacagatacggaaatacagtggctagtctgcaagcctggctggaggacgcagaaaagatgctcaatcagagcgagaatgccaagaaggattttttcagaaatttgcctcattggattcagcagcatactgccatgaatgatgcggggaattttttgatcgagacctgtgatgagatggtatcccgagatctcaagcagcagctactcctgctcaacggcagatggcgggaacttttcatggaagtgaagcagtatgctcaggccgacgagatggacaggatgaaaaaagagtacaccgactgcgtggtcactctgtccgccttcgccacagaagcacacaaaaagttgagtgaaccattagaagtatcatttatgaacgtgaaactactgattcaagacctcgaggacatagagcagagggtgccggtcatggatgctcagtataaaataattactaaaacagctcacctgattacaaaagagtccccacaggaagaggggaaagaaatgtttgcaactatgagtaagctcaaggagcagttaactaaagtgaaagagtgctactctccgttactctacgagagtcaacagctcctgatcccactcgaggaactggagaagcagatgacgagcttttatgatagcctgggtaagatcaacgagatcatcaccgtgctagagagagaagctcagtcgtcggccttgtttaagcagaaacaccaagaactgctcgcttgccaggaaaactgcaaaaaaaccctgacactgattgagaagggttcacaaagtgtgcagaagttcgttactctatcaaatgtactcaaacacttcgaccaaacccgtctccagaggcagatcgccgatatacacgtcgcatttcagagcatggtgaagaagaccggagactggaagaagcacgtggagactaattccagactcatgaagaagtttgaagagagtagggccgaattagagaaggttctccgaattgcccaagagggactggaggagaaaggggatcctgaggaactgctccgtcgtcacaccgagtttttcagccaactagatcagagggtgttaaacgcttttctgaaggcatgtgatgagttgactgacattttgccagagcaggagcagcagggtctgcaagaggctgttcggaagttgcataagcagtggaaagacctccagggagaggccccatatcacctccttcatcttaagattgatgtggaaaagaatcgtttcttagcctctgtagaggagtgtaggacagagctggatcgcgaaacaaagctgatgccgcaagaaggtagtgaaaagattatcaaagagcatcgtgtgttcttttctgataagggaccccaccatctctgtgagaagcgactgcagcttattgaggaactgtgcgtgaagctccctgtgcgcgaccctgtcagagacaccccgggcacctgtcatgtgaccctaaaagagctgcgagctgctatcgattccacctaccggaagttaatggaggacccggacaaatggaaggattacacttctagatttagcgaattctcttcctggataagtacgaatgaaacccaactaaaagggatcaagggggaggcaatagacaccgcgaatcacggagaggtgaaacgcgccgtggaggagatacggaacggtgtgaccaagcggggggaaacactgtcatggctgaaaagtcgacttaaggtgttgacggaggtgtctagtgaaaacgaggcccagaagcaaggagatgagctggctaagttaagctcctccttcaaagcgctggttaccctactgtccgaggtggaaaaaatgctgagtaatttcggcgactgtgtacagtacaaggagatcgtgaagaatagtctggaagaactgatatctgggagcaaggaggtgcaggagcaggcagagaaaattctggatacggaaaacctcttcgaagctcagcagctgcttctgcaccatcaacagaagaccaaacgaatttcagccaagaaacgggatgtgcaacagcagattgctcaggcgcagcagggcgagggcggccttccggataggggccacgaagagctccgaaagcttgaatccacactggacgggctggaaagaagcagggagaggcaggagaggcgtatccaagttacgctgcgaaaatgggaacgcttcgaaaccaacaaagaaaccgttgttagatatttgtttcagacagggtcaagccatgaacgattcctaagcttctcttcacttgaaagcttgagctcagagttggagcagacgaaggagttcagcaagcgcaccgaatcaattgcagtgcaggcagaaaacctggtgaaagaagcctccgagattcccctgggccctcagaacaagcagctgctccagcaacaggccaagtccattaaagagcaggttaagaaactggaagatactctcgaagaagacatcaagacgatggaaatggtgaagacaaaatgggatcattttgggtccaacttcgaaacccttagtgtctggatcaccgaaaaggaaaaggagttaaatgccctggaaacatcttcctccgccatggatatgcagatctcccagatcaaagtgacgattcaggagattgagtcgaaattaagttcgatagtgggactggaggaagaggcccagtccttcgcccaattcgttactactggagaatccgccagaatcaaagcaaagcttactcaaatccggagatacggcgaggaactgcgcgagcacgcccagtgtctcgaaggaacaatccttggccatctgagccaacagcagaagtttgaggagaacctccgcaagattcagcagagcgtgtcagagtttgaggataaactggctgtgcctatcaaaatctgttcaagtgccacagagacttacaaagtactgcaagaacacatggatttgtgccaggctcttgagtccctgtcctctgccattacggctttcagcgcatccgcccgcaaggtcgtgaatagggactcatgtgtgcaggaggcagccgccctacagcagcagtacgaggacatccttcgccgcgctaaggaacgccagactgccctagaaaatctgctggcccattggcagagactagagaaagaactgtccagctttctcacttggctggagcggggagaagccaaggcatcaagcccagagatggatatttcagcggacagagtcaaggtagagggcgagttgcaattaatccaagcgctgcagaacgaggtcgtatcccaagcttctttttactcaaagctgcttcagctgaaagaatctctgttttcagtagccagcaaggacgatgttaaaatgatgaagctgcacctcgagcagctggatgagcgatggcgagacctgcctcagatcataaacaagcggatcaatttcctgcagtcggtggtggctgagcaccagcagtttgacgagctgctgctgagctttagcgtgtggatcaagctgtttctcagtgaacttcagaccaccagcgagataagtatcatggatcaccaagtggccctgacccgacataaagatcacgcagcggaggtggaatctaagaagggcgaattacagtccctacagggccatcttgctaagttgggatcactcggccgggccgaagatttgcacctgttgcaaggcaaagcggaggactgctttcagttatttgaagaagcttcccaagttgtggaaaggcgccagctggcactcagccatctggccgagttccttcagtcccatgcgtcactgagcggaatccttaggcagttacggcagactgttgaggcaaccaattctatgaataaaaacgagagtgacctgatcgaaaaggacctcaatgacgcgctacagaacgcaaaagctctggagtccgctgcagttagtctggacgggatcctgtcaaaggcccagtatcaccttaagattgggagcagtgaacagagaaccagctgtcgcgctaccgccgaccagttatgcggagaagtcgagcgcatacagaatctgcttggcacgaaacagtccgaagccgacgctctggctgtgctgaagaaggcttttcaggaccaaaaagaggaacttctcaagagcatcgaagatatcgaagaacggaccgataaagagcgcctaaaggagccaacccgccaggccttgcagcagagactgagggttttcaaccagctagaggatgaattgaacagtcatgaacacgaactctgttggttgaaagataaggccaaacagattgcccagaaggacgtcgctttcgcaccggaggtagaccgggagattaaccggcttgaagtcacctgggacgacacgaagagattaattcacgagaaccagggccagtgctgtggcttgattgatcttatgagagaataccaaaacctcaaaagtgcagtgagcaaggtgcttgagaacgcgagctccgtcatagtgacacggactacaatcaaggatcaggaggacctgaaatgggcattttcgaagcatgagactgctaaaaacaaaatgaattacaagcagaaggacctagacaactttacaagcaaaggtaagcacctgttgtccgagcttaagaaaattcattccagcgatttcagtctggtgaagacagatatggaatccactgtcgataagtggcttgatgtgtccgagaaactggaggagaatatggatcggttgagggtcagcctttctatctgggatgacgttctgagcacacgtgacgagatagaggggtggagtaacaactgtgtgccccaaatggcagaaaacatatccaacctggataatcatctgagagccgaagagctgctgaaggaatttgaaagcgaggtcaagaataaagcgttgagactagaggagctgcattctaaggttaatgacctgaaggagctaactaagaatctcgaaaccccaccagacttacagtttattgaggccgaccttatgcagaaattggagcatgcaaaagagatcaccgaagtggccaaaggtacactgaaggactttaccgctcaatctacccaggtagagaagttcataaacgatatcaccacttggttcacgaaggttgaagaatccttgatgaactgcgcccaaaatgagacatgcgaggccctaaagaaggttaaagatattcagaaggaactgcagtcgcagcagtctaacatctcctcaacccaggagaatcttaattcattgtgtcggaagtatcactctgcagagctggagagcctgggacgtgccatgactgggttgatcaaaaaacacgaggcagtatcccagctttgctcaaaaacacaggcctcactccaggaatctctggaaaagcacttttcagaaagtatgcaagaattccaggagtggtttctgggcgcgaaggccgcggccaaggagtcatctgatagaacgggtgactcaaaggtgctagaggccaagctacacgacctgcaaaacattctggactctgtctctgacgggcagtcgaagctggatgcagtgacccaggaaggccaaaccttgtacgcacacctgtctaagcagattgtcagctcaattcaggaacagatcacgaaggctaatgaagagttccaagcgttcctgaagcagtgcctgaaggacaagcaggcgttgcaagattgtgcttctgagctaggatcctttgaggatcagcatagaaaactgaacctgtggatacacgaaatggaggagcggttcaacaccgagaatttgggggagtctaagcagcatatccctgagaaaaagaacgaagtccataaggtcgagatgtttctcggagaactcctcgccgcacgggaaagcttagacaaactgtcccaaaggggacagctactgtcagaagagggccacggcgccggacaggaggggcgtctgtgcagccaattgctcacctctcaccaaaatctgcttcgcatgactaaagagaaactgaggtcttgccaagtggctttgcaggagcatgaggcacttgaggaggccttacagtcgatgtggttctgggtgaaggccatccaggatagactggcgtgtgccgaatccacattgggcagcaaggatacactagagaagcggttatcgcagatccaggacattctgctgatgaaaggagaaggggaggtcaaactgaacatggccatcggaaaaggggaacaagccctgcgctcaagcaataaggagggtcaacgagtaatccagacacagctggaaactctcaaggaggtttgggctgacatcatgagttctagcgtacatgcccagagtaccctagagtccgtgatctcccagtggaatgactatgtggagcggaagaatcagcttgaacagtggatggaatccgtcgatcagaagattgagcaccctctccagccgcagcctggcttgaaggagaagtttgtcctccttgatcatctccagtcaatacttagcgaagctgaagaccatacacgagccctgcaccggctcatcgctaagagtagggaactgtacgaaaagaccgaagacgaatcatttaaggacacagcccaggaggagctcaagacccagttcaacgacattatgacagtggcgaaagagaagatgcgaaaagtcgaagagattgtgaaagatcacctgatgtacctcgacgcggttcacgaatttaccgactggctacatagcgctaaagaagagcttcatcgctggtccgatatgtccggcgattcttctgccacacagaaaaaattatcaaaaataaaggagttaattgattccagggaaataggagccagccgactatccagagtggagtctcttgcacctgaggtgaaacagaacacaactgcaagcggatgcgagctgatgcataccgaaatgcaggcactgcgggccgattggaaacaatgggaggactcagtattccagacacagagctgtctcgagaatttggtgagtcagatggccctcagcgagcaagaattttcaggtcaggtcgctcagctggaacaagctctcgaacaattctccgctctcttgaagacatgggcccagcagcttacgcttctcgagggaaaaaataccgacgaggagattgtggaatgctggcataaaggacaggaaatcctcgatgctttacaaaaggcagaaccaaggaccgaggatctgaagagccaactgaacgaactgtgtcggttctccagggatttgtcaacctacagcggcaaggtgtcagggctgatcaaggaatataattgcctctgcttgcaggcctccaaaggctgccagaataaggagcagatacttcagcagaggtttaggaaagcgttccgagacttccaacagtggctggtaaatgcaaaaattaccactgcgaaatgctttgacattcctcagaacatatccgaagtaagcacctcactgcaaaagatccaggagtttctctcagaaagcgagaacgggcagcacaagctgaatatgatgctgtccaaaggtgagttactgtctacactgttaaccaaggaaaaggctaaggggattcaagccaaagtgaccgccgccaaagaagattggaagaattttcattcaaatctgcaccagaaggaatctgctcttgagaatctgaaaattcagatgaaggatttcgaagtgtccgccgaacccatacaggactggctttccaagacggaaaaaatggtgcatgaaagcagcaatagactctacgacctgcccgcgaaaagacgggagcaacagaagttgcaaagcgtactcgaagaaatacactgctatgagcctcagcttaatcggctcaaggaaaaagctcaacagctgtgggaggggcaagccgccagcaagtccttcagacatcgtgtatcccaattaagttcccaatatctcgcgttgtctaacctcacaaaggaaaaagtctcgaggttggaccgcatcgtggcagagcacaatcagttttccctcggcataaaggagctgcaggactggatgacagatgcgatacatatgctcgactcatactgtcatccaacatctgataagtcagttcttgactcgaggaccctcaaactggaggcactcctgtctgtaaagcaggagaaagagattcagatgaagatgatcgttacccgaggggagtcagtgttgcagaatacttcccctgagggcattcccacgattcagcagcagctgcaatccgtaaaagatatgtgggcatcccttctaagtgctggcattcggtgtaagtcacagctcgagggagcattatccaagtggactagttatcaggatggggttcgacagttcagcggatggatggatagcatggaagccaacctcaatgagagcgagagacagcacgcagaacttagagataaaactaccatgctggggaaggctaagctgctgaacgaagaggtactgagctacagcagtctgcttgaaacgattgaggtgaagggcgcaggcatgacggaacactacgtcacccagcttgaactgcaggacctgcaggagcgctaccgagccatacaggagcgggcgaaagaagcagtcactaagagcgaaaaactggtgcgccttcatcaagaatatcagcgtgatctgaaagctttcgaggtctggttggggcaggaacaagagaagttggaccagtacagtgtactcgaaggggacgcccacacacacgaaacaacactgcgcgatctccaggagctgcaggtgcattgcgccgagggccaggcactgctaaactccgtcctgcacacacgggaagatgtgattccgagcggtattccacaggctgaagacagggccctcgagtcactcagacaggattggcaggcttaccagcacagattatcagaaaccaggacccagttcaataacgtggttaataagctccggttaatggaacagaaattccagcaggtcgacgagtggctgaagaccgctgaagagaaagtgagccctagaaccagacgccagtccaatagagccaccaaggagatacagctccaccagatgaaaaaatggcacgaagaggttacggcatatagggatgaagtggaggaggtcggggcaagggcccaggagatattagacgaatctcatgtcaactcccggatggggtgccaggccactcagctaacatcccggtatcaggctctcctcctgcaagtgttggaacagataaagtttctggaggaggaaatccagtcactggaggaatcagagtcttccctcagctcatactcagattggtacggttctactcacaaaaactttaagaatgttgcgacaaaaatcgacaaagtcgatacagtgatgatgggcaagaagctaaagacattggaggtgctgttgaaggatatggaaaagggacatagcctgctcaagagtgcacgcgagaagggagagcgggcggtgaaatatctggaagaaggcgaggccgaaagactgcgtaaggaaattcacgatcacatggagcagctgaaggagctcacttctaccgtcagaaaggagcacatgacactagagaaaggactgcacctcgctaaggagttctccgacaagtgtaaagcgctgacccagtggatcgctgagtaccaggagatcttgcatgtgcctgaagagccaaagatggagctgtatgaaaagaaagctcaattgtccaagtataagtcattgcaacagacagtactcagccacgaaccctcagtcaaatcagttcgcgaaaaaggcgaagcgctactcgagttggtgcaggatgtaacactgaaagacaaaattgaccagctccagtccgattaccaagatttatgcagcatcggcaaggagcatgtgtttagcctcgaagccaaagtcaaggaccacgaggattacaacagcgaattacaggaagtagaaaagtggttgctccaaatgtccggaaggcttgtggcacccgatttactcgaaactagctcgctcgaaacaattactcagcagctcgcacatcacaaggcaatgatggaggaaatcgctggctttgaggaccggctcaacaatctacagatgaaaggggatacattgatcggccagtgcgccgaccacttacaagccaagctcaaacagaacgtgcacgcccatctgcaggggacaaaagacagctattctgcaatctgctcaactgcacagagaatgtatcagagcctcgaacacgagctgcagaagcatgtaagcaggcaggacacccttcagcaatgccaggcatggctgtctgcagtgcagcctgatttagagccttcacctcaaccgcccttgagtagagctgaagctattaaacaggtaaagcatttccgcgcattacaggagcaagccaggacgtacttagatctcttatgttcaatgtgcgatttatcaaatgcgtccgttaagaccaccgctaaggatattcaacagacagaacagactatcgagcagaagctggtccaggcgcagaatttgacgcagggctgggaagagattaagcatttaaagtccgagctttggatctatctgcaagacgcagaccagcagctgcaaaacatgaaaaggcgccatagcgagcttgaattgaatatcgcacagaatatggtgtcccaggttaaagattttgtgaagaagctgcaatccaagcaggccagcgtcaacaccatcatcgaaaaggttaataagttgacaaagaaagaagaatccccagagcataaggagatcaaccatctcaacgaccagtggctggatctgtgccgccaaagcaataacctgtgcctgcagcgagaagaagacttgcaacgcactcgggactaccatgattgtatgaacgtcgtcgaggtcttcctagagaagtttactaccgaatgggataacctcgcaagatcagacgcagaaagtaccgccgtccacctggaagccctcaagaagctggcacttgccctgcaggagagaaagtacgcaatcgaggatcttaaagaccagaaacagaaaatgatcgagcatctgaaccttgatgacaaggagcttgtgaaagagcagaccagtcacctggagcaacggtggtttcagcttgaggatctgatcaaacgaaagattcaggtctctgtgacaaacttggaggaactgaatgttgtccagtcaaggtttcaagagctgatggaatgggccgaggaacagcaaccaaacatagctgaggcattgaagcagtcacctccaccagacatggcgcagaatctgcttatggatcaccttgccatctgctctgaactggaggcgaaacagatgctgctgaagagccttatcaaagatgcagacagagtgatggctgacctggggctgaacgagaggcaggtcatacaaaaggcgttgtctgacgcgcagtctcatgtcaattgcctgagtgatctggtcgggcagcggaggaagtatctcaacaaggccctgagcgaaaaaacacagttcctgatggctgtgtttcaggcgacttcgcagatacagcagcacgagcggaaaattatgtttagggaacacatttgcttgctcccggatgacgtgagcaagcaggtgaagacatgcaagtccgcccaggcttcgcttaaaacttatcagaatgaagtaactgggttatgggcccagggacgggagctgatgaaggaagttacagaacaagagaagtccgaggtgctgggaaagctgcaggagctgcagtcagtttacgacagtgttctacaaaagtgctcacaccgtttacaggagctcgagaagaacctggtatctaggaagcactttaaggaagacttcgataaggcttgccactggctgaagcaggccgatattgtgacgtttcccgaaattaaccttatgaacgagagctccgagctccacactcagctggctaagtaccagaacatactggaacagtcccccgagtacgagaacctcttactgacacttcaaaggaccggccagacgatcctgccgagtctgaacgaggttgatcactcctacctgtccgaaaagctgaacgccttgcctcgtcaatttaacgtgattgtggccttagctaaagacaagttttacaaggtgcaagaagcaatcctcgcccgaaaagagtatgcctccctcattgaactcacaacacagagcctctctgagttagaagcacaattcctccgcatgagcaaagtgccaacagacctggccgtggaggaagctctgtctttacaagacggctgccgggctatccttgacgaagtcgcaggcttaggggaggccgtggacgagctcaatcagaagaaagaaggattcagaagtactgggcagccttggcagccagacaaaatgctgcatttagtaacactctaccaccgactgaagcggcagaccgagcagagagtaagtctactcgaggacaccaccagtgcataccaggagcacgagaagatgtgccagcagcttgaaaggcagctgaagtctgtgaaggaggaacagtcaaaggtgaacgaggaaacccttccagccgaagagaagctgaagatgtatcactcactggcaggttctctccaggactccgggattgtcctcaaacgggtgactatacacttagaggacctagcccctcacctggacccactcgcttatgagaaggcccgccaccagatccaaagctggcaaggagagctgaaactgttgacttctgccatcggcgaaacggtcaccgaatgcgaatctaggatggttcagtccatcgatttccagactgagatgtccaggagcttagactggctgcgccgcgtgaaagctgaactttctgggccagtgtaccttgatttaaacctgcaggatattcaggaggagataagaaagatccaaattcatcaggaggaagtacagtcttctctgagaatcatgaatgctctttctcataaagaaaaggaaaaattcactaaggcaaaagagcttatcagcgcagacttggagcactccctcgctgagctgtccgaactggatggcgacattcaggaagctctgcgcaccagacaggcgacactaaccgagatatactcacaatgtcagaggtactatcaggtcttccaagctgcaaacgactggctcgaagacgcccaggaactcctacagctggctgggaacggcctagacgtagagagcgccgaggagaatctaaagtcacacatggagtttttctccaccgaagatcaatttcattctaacttggaagaactgcatagccttgtagccactttggaccccctcatcaagcctacagggaaggaagatctggaacaaaaagtagcaagccttgaattgaggtcacagcggatgagtcgcgattcaggcgcccaggtcgaccttctccaaaggtgtacagcccagtggcacgattaccaaaaggctcgggaagaggttatagagctcatgaacgacaccgagaagaagctcagcgaattctctctccttaagacctctagctctcatgaagctgaggagaagctaagcgagcacaaggcgctggtctccgtggtgaattccttccacgagaagatagtagcactggaagagaaggcttctcagttagagaagacagggaacgacgccagtaaagcaacactaagccgctcaatgactactgtgtggcagagatggaccaggctgcgagcagtcgctcaggatcaggaaaagatcctagaagatgcggtggacgaatggacagggtttaataataaagtcaagaaggccacagaaatgatcgaccaactccaggacaaactccctgggtcgagtgccgagaaagcctctaaggctgagctgctcacacttttggaatatcacgatacgtttgttttggagctagaacaacaacagagtgcccttgggatgctacgtcagcagacactctccatgctgcaggatggcgctgcgcctacccccggcgaggaaccccccctaatgcaggaaatcaccgccatgcaggaccgctgcctgaacatgcaggagaaagtcaaaaccaacggcaagctggtcaagcaggaactcaaggaccgcgagatggtagagacacaaatcaactctgtgaaatgctgggtgcaagagaccaaagagtacctgggtaaccccacaatcgagatagacgctcagctggaagaactccaaatcctcctaaccgaagctactaaccaccggcaaaatatcgaaaagatggctgaggagcagaaagaaaaatatctgggactatacacaattcttcccagcgagctgagtcttcaattggccgaggtcgccctcgatctaaagatccgggaccagattcaagacaaaatcaaagaggtggagcaatccaaggcaacctcacaggaactgtcacgccagatccagaaacttgctaaggacctaacaaccatcctgacaaaactcaaggctaagacagacaacgtagtacaggcgaagacagaccagaaggtgcttggcgaggagctggacggctgcaactccaagctgatggagctagacgccgccgttcagaagttcctggaacagaacggccagctcggtaaacccctcgctaagaagataggcaaattgaccgagctccaccagcaaactatcaggcaggccgagaatcggctatcgaaacttaatcaggctgctagtcacctcgaagagtacaacgaaatgttggaactgatcctgaagtggatagagaaggccaaagtactcgcccatgggacaattgcctggaatagtgcatcgcaattgcgagaacagtatatactgcaccaaactttgctcgaagaatcgaaggaaatagattctgaactggaggccatgaccgagaagctgcagtatctgacaagtgtgtactgtaccgagaaaatgtcacagcaggtggctgagcttgggcgggagacagaggagttgagacagatgataaagattcggctccagaatttacaggacgccgccaaagatatgaagaaattcgaagcagagttgaagaaattgcaggccgccctagagcaggcccaggccacattgacctcacccgaagtcggacgactgagcctgaaagaacagctgtcacataggcagcatttgctgtcagagatggaaagtctcaagcccaaggtgcaggcggtgcagctgtgtcagtcagccttgaggatacccgaagacgtggtggccagcctgccactatgtcacgcggcgctgcgcctgcaagaggaagcatcaaggctgcaacacacagcaatacaacaatgcaacatcatgcaggaggccgtcgtgcaatacgaacagtacgaacaggagatgaaacatctccagcagcttattgagggcgcccacagggagatcgaggacaaacccgtggcgacctctaacattcaagaactgcaggcccagatatccaggcacgaggaactcgctcagaagattaaaggttatcaggagcagattgccagccttaattccaagtgcaaaatgttgaccatgaaggcgaaacatgctacaatgctgctaactgttacagaggtggagggtctcgccgaagggaccgaagatttggatggggagctgttacccaccccgagtgctcaccctagcgtggtgatgatgacagccgggagatgccatacactgctgagcccggtgacagaggagtccggagaggaaggaactaacagcgaaattagctctcctcccgcatgtagatcaccttcacctgttgcaaacaccgatgcttctgtgaatcaggatatcgcttactaccaggccctgtccgccgaaaggttgcagacagacgcagcgaagatacaccccagcacctcagcatctcaagagttctacgagccaggcttggagccttcagcaacagctaaactgggtgacctgcagcggagctgggaaactctcaaaaacgtgatttcagaaaagcagagaactctctatgaagctctggagcgccaacaaaaataccaagactccctgcagtcaattagcactaagatggaggccattgaactgaagctgtccgaaagcccagagcccgggcggagtccagagagccagatggcggaacatcaggctctcatggacgaaattctcatgcttcaggacgaaataaacgagttacagagctccctggccgaggagctggtcagtgagtcttgtgaggcggatcccgccgagcagctggccttgcaatccactcttaccgtcctggcagaacgtatgtcgacaattcgaatgaaggcatccggtaaacgacagctcctggaagaaaagctgaacgaccagttggaagaacagcggcaggagcaggcactccaacggtatcgctgtgaggcagatgagttagactcttggctgctctcaactaaagctaccctggacactgccctgagtccccctaaagagcctatggacatggaagctcagcttatggactgtcagaatatgctggtggagattgagcaaaaggttgttgcattgagtgaacttagcgtgcataatgaaaacctcctcctggagggtaaggcacacacaaaggacgaggcagagcagctcgctgggaaattgcggaggctcaaagggtccctgctggagctacagagagcactgcacgacaagcagttaaatatgcagggcacagcccaggaaaaagaggagtccgatgtggatcttaccgccactcagagtccgggggttcaggagtggcttgcccaggctagaaccacctggacacagcaacgtcagtcctccttacaacagcagaaagagcttgagcaggagttggcagagcagaagagcctgcttcgcagcgtggctagtcggggggaagagattttgatccagcattcagccgcagaaacctccggcgacgccggtgagaaacctgacgtcctatcacaagaactgggcatggagggcgaaaaatcaagcgccgaggaccaaatgaggatgaagtgggaatctctgcatcaggagttcagcacgaagcagaaactgttgcagaacgttctcgaacaggagcaggagcaggtgctgtatagccgcccaaatcgcctgctgtctggagttccactttataaaggagatgtacccactcaggacaagtctgccgtaacctccctcctagatgggttgaaccaggctttcgaagaggtgtcctctcagtcaggaggggcaaagagacaaagtatccacttggagcagaaactatatgatggggtgtccgcgaccagcacttggctcgacgacgttgaggaaaggctgtttgtcgccaccgctctgctcccagaagagaccgaaacatgtctctttaaccaggaaattctggccaaagatataaaagaaatgagtgaggagatggataaaaacaaaaacttattctcccaagccttccctgagaacggcgataaccgggacgtgattgaagatactctcggatgcctcttggggaggctgtcgctgctggactcagtggtcaatcagcgatgccatcagatgaaagagaggctccaacagattttgaacttccagaacgatctgaaggtgttgtttactagtctggcggacaataaatatattatcctccagaagctggccaacgtcttcgagcagcctgttgcagagcagatcgaggccatccagcaagcagaagacggcctcaaggagtttgacgccggcatcatagagctgaagcgtcgcggcgataagctgcaggtggagcagccatctatgcaggaactgtccaagctccaggatatgtacgacgaacttatgatgatcattgggagccggaggagtggtctaaatcagaacctcaccctgaaaagccagtacgaaagggcactacaggatttggccgacctcttagagactggacaggagaaaatggccggggaccagaaaatcattgtgagctccaaggaagagattcaacagctcttggacaagcacaaggagtacttccagggattagaatcgcacatgattctgacggaaactctgtttcgtaagatcatcagcttcgccgtgcaaaaggaaacacagttccatacagagttgatggcgcaggccagtgcagtgttgaaacgagcccataagaggggcgtggagctagaatacatcctggaaacatggtcccacctggacgaggatcagcaagagctcagtagacagctggaggtagtcgaatcttccatcccctctgttggtctcgtggaggagaacgaagaccgcctgattgacagaataaccctctatcagcacctcaagtcatctctaaacgagtaccagccaaagttgtaccaggttctggatgatggaaagcgcctcttaataagcatttcctgtagtgatttagaatctcagctgaaccagctgggagaatgttggctgagtaacacaaacaaaatgtcaaaggagcttcaccgacttgagacgattctcaaacactggacaagataccagtctgagtcagcggatctcatccactggttgcagtccgccaaggatagactggagttttggactcaacagtctgtgacagtgcctcaggagctggagatggtccgggatcacctgaacgcatttctcgagttcagcaaagaggtggacgcccagtcttctctgaaatcatctgtgctgagtacaggcaaccaacttctacgtctcaaaaaggtagacactgctaccctgcgcagcgagcttagccgaattgactcccagtggaccgacctgttgaccaacattcccgcggtgcaggagaaactccatcaactgcagatggacaagctgccaagccgtcacgctatttccgaagtgatgtcatggataagcctgatggagaacgttattcagaaggacgaagacaatatcaaaaacagcatcggttacaaggccattcacgaatacctgcagaaatataagggcttcaaaatagacataaactgtaagcagcttactgtcgattttgtcaaccagtccgttctccaaatttcctcccaggacgtagaatccaagaggtccgacaagacggactttgcggaacagcttggcgctatgaacaagtcctggcagatcctgcagggactggtgaccgagaagatccagctcctggaaggactgctggagagctggagcgagtacgagaataatgtccagtgtctgaaaacatggttcgagacccaggagaaaagactcaagcagcagcatcgcattggagaccaggccagcgtgcagaacgcattgaaagactgccaggatctggaagatctgatcaaagccaaagaaaaggaggtggagaagatagagcaaaatggccttgcgctgatacagaataaaaaggaggacgtgagttctatcgtgatgagtactttgagagagctgggccagacctgggcaaatctggatcacatggtgggccagctcaagatcctcctgaaatccgtgctggaccaatggtccagtcacaaggtcgctttcgataagattaactcatacctgatggaagcccggtatagcctgtcaaggtttagactcctgactggatctctggaggctgttcaagttcaggttgacaacctccagaacctacaggacgatcttgagaaacaagaaagatcactgcagaagtttggctctattaccaaccagctcctgaaagaatgccatccaccagtcactgaaaccctgacaaacacactgaaggaagtgaacatgcgctggaacaatctacttgaggagatcgccgagcagctccagagctccaaggcccttctacaattgtggcagagatataaggactatagcaaacaatgcgcgtccaccgtgcagcagcaggaggaccgtaccaatgaacttttgaaagcagcgacgaataaggacatagcagatgatgaggtagccacgtggatccaggactgcaatgatctcctgaagggcctgggcaccgtgaaagactcactgttctttctacatgagctcggagagcaactgaagcagcaggtagatgcaagcgcggcaagcgcaatccagtcagaccagctgagtctgagccagcatctctgcgccctcgagcaggcactgtgcaaacaacagacgtcgctccaggctggagtgctagactatgagactttcgccaagtctctagaggccttggaggcatggatcgtggaggccgaagagatcctgcagggacaggatccttctcacagttctgatctgagtaccatccaagagaggatggaggagctaaagggtcagatgctcaaattttcctccatggcacctgatctggacagactgaacgagcttggatacagactacccttgaatgacaaggaaatcaaacgcatgcagaatcttaaccggcactggagcctgatttcctcccagacaaccgagaggttctcaaagttgcagagtttcctcctgcagcaccagacattcttagaaaaatgcgaaacttggatggagtttctggtccagacggagcagaagctcgccgtggagatctcgggcaattatcagcacttattagagcagcagcgagcacacgagcttttccaggccgaaatgttctccagacaacaaatcctgcacagcataattatagatgggcaacggctactggagcagggtcaagtggatgacagagatgagttcaatttgaagctcacgctactgtccaatcaatggcaaggtgtgattcgccgagcacaacagcggcggggtataatcgactctcagatacggcaatggcagaggtatcgagagatggctgaaaagctgagaaaatggctggttgaagtgtcttatctgccaatgtctgggcttgggtccgtaccaatccccctgcagcaggcccgtaccttgttcgatgaggttcaattcaaagagaaggtgtttttgagacaacagggttcatatatcctaacagttgaggccgggaagcagctgctgttaagtgccgacagcggcgccgaagccgctctgcaggccgaactggccgaaattcaagagaagtggaagtccgcctctatgagactcgaagagcagaagaaaaaactggcctttctgctgaaggactgggaaaaatgcgagaaaggaattgccgactcgctagagaagctgcggaccttcaaaaaaaaactgtctcagtccctgccagaccaccatgaggagctgcacgctgagcagatgagatgtaaggagctggaaaacgccgtgggctcctggactgacgacctgacccagctctccctgctgaaggacaccctgtctgcttacatatcagccgacgacatctccatcctcaatgagcgggtagagttacttcagaggcagtgggaagaactctgtcaccaattgtctttgaggaggcagcagatcggcgaacgcctgaacgaatgggccgtgtttagtgaaaagaacaaagagttgtgcgagtggttgacccagatggaaagcaaagtgagccaaaacggtgacattcttatcgaagaaatgatcgaaaagctgaagaaggattatcaggaagagattgcaatcgcacaagagaacaagattcaactgcagcaaatgggagaaagattggcaaaggcgtcccacgaatccaaggcttccgagatagaatataagttgggcaaggtaaacgatcgatggcagcatttgcttgatctcatagctgctcgggtcaaaaagttgaaggagacattggtggctgtacagcagcttgacaagaatatgtcctcactgcggacttggctcgcccatattgaatctgaactcgcgaagccaatagtctatgattcatgcaacagcgaggagatccagaggaaactgaacgaacagcaggaacttcagcgagacattgaaaagcattcgaccggcgtggcttcagtactgaacctttgcgaggtacttctgcatgattgcgatgcatgcgcaacagacgctgaatgtgattctatacagcaagccacccgcaacctggacaggcggtggcgaaacatctgtgccatgtctatggagcggaggcttaagattgaagagacctggcgcctatggcaaaagttcctggacgactactctcggtttgaggactggctcaagtcgtccgagaggaccgctgcttttccttcatcttccggtgtaatttatacagtggcgaaggaggagctaaaaaaatttgaagcatttcagagacaggtccatgaatgtctgacgcagctggaactgattaataagcagtaccggcggctggcccgcgaaaataggaccgatagtgcctgcagtctgaagcagatggtgcacgaaggcaaccagcggtgggacaatctgcagaagagagtgacttccatactgcgcagactcaagcattttatcggacaaagggaggaattcgagaccgccagagattccatactggtttggctgactgaaatggatttgcagctgactaatattgagcatttttcagaatgtgatgttcaggcaaagatcaagcaactcaaagcattccaacaggaaatcagcctgaaccacaacaagatagagcaaattattgcacagggtgagcagctgattgagaaaagtgagccacttgatgctgccatcattgaggaggaattggatgaattgcgcaggtactgccaggaggtgttcggccgcgttgagagataccacaagaaactcatcagactcccacttcctgatgatgagcacgatctgagtgaccgtgagttggaactggaagacagtgcggcattgagtgatctgcattggcacgacaggtcagcagacagtctactttctccacagccttctagtaatctgagcctgtctttggcgcagccactcagaagcgagcggtcggggcgcgacacccctgcttcagtggatagtattcccctggagtgggatcacgattacgatctgagtcgtgacctagagtccgccatgtctagagccctgccctcggaggatgaagagggtcaagatgataaagatttttatttgcgcggtgccgtcggactgtccggggaccacagcgccttggaatcccagatcagacaacttggaaaagccctagatgattccaggttccagatccaacaaactgagaacatcatccggtctaagacccccactggcccagagttagacacatcttacaagggctacatgaagctgttgggtgagtgtagttcctccatagatagtgtgaagcgcctcgagcacaaactcaaggaagaggaagaaagtcttcccggatttgttaatctccactctaccgagactcagactgcgggtgtgattgaccgctgggagctcctgcaagcccaagcactctctaaagagctgcgaatgaaacagaatctgcagaagtggcagcaattcaacagtgacctgaactctatctgggcttggttaggcgataccgaggaggagctcgagcaactccagaggttagagctgtcaaccgacatccaaaccatcgaactgcaaattaaaaaactaaaggagttacagaaggccgtagatcaccgaaaggcgataatactgagcatcaacctgtgcagcccagaattcacacaggcagactctaaggaaagcagggacctgcaggatcggctgagtcagatgaacgggagatgggatagagtttgtagtctcctagaggagtggcgcggcttgctgcaggacgctttaatgcaatgccagggtttccatgaaatgtcacacggtttgctgctaatgctggaaaatatcgaccggaggaagaatgagatcgtgcctatcgactcaaatctggacgctgagatacttcaggatcaccacaaacagttaatgcagattaagcatgagcttttggagtctcagttgcgcgttgctagtctgcaagacatgagctgccagcttctcgtgaatgcggaggggacagattgccttgaggccaaagagaaggtgcacgtgatcgggaaccgcctgaaactgttgttgaaggaggtaagcaggcacatcaaagaacttgagaaacttctcgacgtctcttcgagtcagcaggacctttcgagctggagctcagctgatgaacttgacacatctggatcggtctcccctactagcggcagatccactcctaacagacagaagacccccagggggaaatgctctctctcccagcccggcccctccgtgagttccccccattctcgcagcactaaggggggatctgattcttcattatctgaacccgggccaggcaggtctggcaggggcttcctgtttcgggtgctgagagcagcactgccactgcagctattgttgctgcttctgattgggctcgcgtgtctggtgccaatgtcggaagaggactatagttgcgcactgtcaaacaattttgcacgcagtttccaccccatgctgcgatacacaaacgggcctccaccgctctag

SEQ ID NO: 135875 - DNA, 26250 bp, Artificial Sequence
  Description of Artificial Sequence: Synthetic coding sequence
atggcgacgtcccgcggcgcctcgagatgtcctcgggatatcgcgaacgtgatgcagcggctgcaggatgagcaagaaatcgtgcagaagcgaacgtttacgaagtggatcaatagccatctagctaaacggaaacccccgatggtggtggacgacctttttgaagacatgaaagatggtgtgaagcttctcgcactgctggaagttctctccggtcagaaattgccgtgcgagcaggggcgcagaatgaagcgcatccatgcagtggccaacatcggcactgctcttaaatttctagaaggacgcaaatctatgcacagaggcagccctattaagctggtcaatatcaattcaacggacattgcagacggccgcccaagcatcgtccttggtctgatgtggacgataatcctttatttccagattgaagagctgacttcaaatctcccgcaactgcagtccctaagttcttccgcctcctctgtggacagtatcgtgagcagtgaaaccccaagcccccccagtaagagaaaagtgaccactaagattcagggtaacgccaagaaggcccttctgaaatgggtccagtacaccgccggcaaacagacaggaattgaagtgaaggacttcggaaagtcatggcggagtggggtggcttttcacagtgtgatccatgcgatccggcccgaattggtcgacttagagacagtgaagggtcgcagtaatagagaaaatttagaagacgcttttaccatcgccgagacagaattgggaattcccaggttgctggatcctgaggatgtggacgtggataaaccagacgagaagagcataatgacatatgttgcccaattcttgaagcattaccctgatattcacaacgcaagcactgatggccaagaagatgatgagattctgcccggctttccatcatttgccaacagcgtgcagaacttcaaacgtgaagatagagtgatctttaaggagatgaaagtgtggatagagcagtttgaaagagatctgacccgagctcaaatggtggagtccaacttgcaggacaaatatcaaagcttcaagcactttagagtgcagtacgagatgaagagaaaacagatcgaacatcttatacagcccctgcatcgcgatggaaaactgagtttggaccaggctttggttaaacagtcatgggatcgcgtgaccagtaggttattcgattggcatatacagctggacaagtcccttccagcacctctcggaactattggggcctggttgtatcgcgcagaggttgctctgcgtgaggagatcaccgttcagcaggtccacgaagaaactgccaacactatacagagaaagttagagcagcacaaggatttactgcagaataccgacgcacataagagggcttttcacgagatctaccggactaggagtgtcaatgggatacccgtcccacccgaccagcttgaagatatggccgagaggtttcactttgtcagtagcacatccgagttgcacctgatgaaaatggagttcctagaactaaagtaccggctactgagtctcttggtcttggccgaatcaaaactaaaatcatggatcataaaatacggcaggagagagtccgttgagcagctactccagaactacgtaagcttcattgaaaatagtaagttttttgaacagtacgaggtgacctatcaaattctgaagcagacagccgaaatgtatgtgaaagctgatggctcggtggaagaagccgaaaacgtgatgaagtttatgaacgaaacgaccgcccagtggcgtaacttatccgttgaggtgcgaagcgtcagaagtatgctggaggaagttatatccaactgggatcggtatggaaatactgtcgcttctctgcaggcttggcttgaggatgctgagaaaatgttaaatcagtcggagaacgcaaagaaggatttttttcgcaacctcccacactggattcagcaacacaccgccatgaacgacgctggaaattttcttattgaaacctgcgatgaaatggtgagccgcgacctgaaacagcagttacttttacttaatggccgctggcgtgaactgttcatggaagtcaagcagtacgcccaagccgacgagatggatcggatgaagaaggagtacacggattgtgttgttacactctctgctttcgctacggaagcgcacaagaagctgtctgaaccactggaggtgagcttcatgaatgtcaaactgctcatccaggatctggaggacattgagcaacgcgttccagtcatggatgcacaatacaaaattataacgaaaacagcgcatctgattactaaggaatcccctcaggaggagggaaaagaaatgtttgccaccatgagcaagctgaaagagcagttgaccaaggtcaaagagtgctattcccccctgttatacgagtcccaacagctgctgatcccactggaagaactggagaagcagatgacctccttttatgactccttgggcaaaataaacgaaattataacggtgctcgaacgcgaagcccagtcatctgccctgtttaaacagaagcaccaggagttactcgcttgtcaggagaactgcaagaaaactctcaccctgatcgagaaaggatcccagagcgtccaaaagttcgttaccttgtccaacgtgctcaaacacttcgaccagacaagattgcagaggcagatcgcggatatacacgttgccttccaaagcatggtgaagaagacaggtgactggaagaagcatgtggagaccaatagtcgcctgatgaagaaatttgaagaatccagggcagaactcgaaaaagtactcaggatcgcacaggagggtctagaggagaagggagatccagaggaactgctgcggcgccatacagaattcttctcccagttggaccagcgagtattgaacgctttcttgaaagcatgtgacgaacttaccgacatcctgcctgaacaggaacagcaaggattacaggaggctgtcaggaagctgcacaagcagtggaaagacttgcaaggagaagccccctatcacttgctacacctcaaaatcgatgtggaaaagaatcggttcttagccagcgtcgaggaatgtagaaccgagttggacagggagaccaaactgatgccacaggaaggcagcgaaaagatcattaaagaacaccgggtcttctttagtgataagggaccccatcatctttgtgaaaagcgtttgcagcttatcgaagagctatgtgtcaagctgccagtgcgggaccccgtaagggatacccccggcacttgccatgtcacactgaaagaactcagagcggctatagacagtacttatagaaaactgatggaggaccctgataagtggaaagactatacttcccgcttctccgagttttcatcatggatatctacaaacgaaacccaactcaagggcataaaaggagaggctatcgacaccgctaatcatggagaagtgaaaagggcggtggaggagattaggaacggcgtgacaaaacgaggtgagacactcagctggctgaaaagcaggttgaaggtactcaccgaggttagctccgaaaacgaagcacaaaaacagggcgacgaactcgcaaagctctccagctcctttaaggctttagtcacccttttgtcagaggtcgagaagatgttgagcaatttcggcgactgcgtgcagtataaggagatcgtgaagaactccctggaagagctgatctctggttctaaagaggtccaagaacaggcggagaagatcttggatactgaaaacctgtttgaggcccagcagttgttactgcaccaccagcaaaagactaaaaggatatcagctaagaaacgcgacgttcagcagcagatcgcccaggcccaacagggtgaaggcggtctgcctgatagaggccacgaggagctgcggaagttagaatcaaccctggacggcctggagcgctcacgggaaagacaagagcgccggatccaggtgacgctgaggaagtgggaaagattcgagaccaataaagaaaccgtggttcgctatctctttcagacagggtcgtctcacgaacgctttctgtctttctccagcctggagtccctcagtagtgagctcgagcagactaaagaattttcaaagagaacagaaagtatagctgtccaggcggaaaacctggtcaaagaggcctccgaaatccctctggggccccagaataagcagctgttgcaacagcaggccaagtccatcaaggaacaggtgaagaaactggaagatacactagaagaggatattaaaaccatggagatggtgaaaaccaaatgggaccatttcggctctaatttcgagaccctctccgtgtggataactgagaaagaaaaggagctaaacgccctcgagaccagcagcagtgctatggatatgcagataagtcagattaaagttactatacaggagattgagagcaaactaagcagtattgttgggttagaggaagaggcccagtcctttgcgcagttcgttacaaccggagaatccgcgcgtatcaaggccaagctcactcagataaggcgctacggtgaagaactcagagagcacgcgcaatgcctggagggaacaatcctggggcacctcagccagcagcagaaattcgaggagaatttgagaaagattcaacagtctgttagcgagtttgaagacaaactggcagtgccaattaagatctgctcatccgctaccgagacctacaaggtgctgcaggaacatatggatctttgccaggccctcgaaagcctgagttcggctatcacagcattctccgcttctgcccggaaggtggtaaatcgcgacagctgtgtccaggaagccgccgccttacagcagcagtacgaggacatcctgagaagagctaaagaacgtcagacggctctggagaacctgttggcacattggcaacgcctggagaaagaactgtcttcctttttgacctggctagagaggggtgaggctaaggcaagctctcctgagatggatatctcagccgatagggttaaggtggagggggaactgcagctgatccaggcactgcagaacgaggttgtgtcacaggcctccttctacagtaaactgctgcaactgaaagaaagcttgttctccgtggcttcaaaagatgatgtgaagatgatgaaattacatctggagcagcttgatgagagatggcgggaccttccccagattattaacaagagaattaactttctgcagtcagttgtcgccgaacaccaacagttcgacgagctccttctgtctttctcagtttggattaaattgttcctgtcagagctgcagaccactagcgagatttcgatcatggatcaccaagtggcactcacccgccacaaagatcatgcggccgaagtagaaagtaaaaagggcgaactccagtctctgcagggacatttggccaaattaggttccctggggagggctgaggacctccatctgcttcaaggaaaagccgaggattgttttcagctgtttgaagaggcctcacaggtcgtggaacgcaggcagcttgccctgagccatttggcagagttcctacagtctcacgcctctctgagtggcatcttaaggcagttgcggcagacagtagaggctacgaattcaatgaacaagaacgagtctgacctcatcgaaaaggatctgaatgatgctttgcaaaacgccaaagcccttgaaagcgccgctgtctcgcttgacggcatcttaagcaaagctcagtaccacctcaagattgggtccagtgagcagcgtacttcttgtcgtgcaaccgccgaccagctctgtggagaggttgaacggatccagaacctcctaggtacgaaacagtcagaagcagacgcgcttgccgtactgaagaaagccttccaggaccagaaagaagagctgctgaagtctattgaagatattgaagaaaggactgacaaggagaggctgaaggaacctacaaggcaagctctccagcagaggctgagggtgtttaatcagctggaagacgagctgaactcacacgagcacgagctgtgttggttgaaggacaaagccaagcagatcgcccagaaagacgtcgcgtttgcgccggaggttgatcgggaaattaacaggctggaagttacttgggatgataccaagaggctaatccacgaaaatcaagggcagtgctgcgggttgatcgatcttatgagggagtatcagaacctaaagtctgctgtgtctaaagttctggaaaatgcatctagtgtgatcgtcactcgaaccaccattaaggaccaggaggaccttaagtgggctttctctaaacacgagacagccaagaacaagatgaattacaagcagaaggatctggataattttacgtccaaggggaagcacctgctttctgagctgaagaaaatccatagcagcgactttagcctcgtcaaaacagacatggagagcacggtcgacaaatggctggatgtgagtgagaagcttgaagagaacatggataggctgcgtgtgagcctgagcatttgggacgatgtgctttcaacaagagacgagatcgagggttggagtaacaactgtgtgccacagatggcggaaaatatttccaatctggacaaccatctgagggccgaggagttgctcaaggaatttgaatccgaggtaaaaaacaaggcacttagactggaagagctgcatagcaaggtgaatgatttaaaagaactcaccaagaatctcgaaacaccaccagacttgcagttcatcgaagctgaccttatgcagaagttggagcacgcaaaagagataaccgaggtggcaaagggaacacttaaggactttaccgctcagtcaacgcaggtcgaaaagtttatcaatgacataactacgtggttcaccaaggtagaggaatctctgatgaactgcgcccagaatgaaacctgtgaagccctgaagaaggtcaaggacatacagaaggagctgcagtcccaacaatctaacattagtagcacccaagaaaacctgaatagcctctgtcggaaatatcattctgccgagctggaatcattagggagagccatgactgggttaataaagaagcacgaagccgtctctcagctgtgctccaaaacgcaggcaagcttgcaggaaagtctcgagaagcacttctccgagagcatgcaagagttccaggagtggtttctaggggccaaggcagccgccaaggagtcgtcagaccgcactggagatagcaaggtgctggaggccaaactgcacgaccttcagaatatactcgacagcgtttcagacgggcaaagcaagctggatgctgtgacccaggaaggccagactctgtacgcccacctgtccaagcagattgtgtcctctatccaggaacaaattactaaggcaaacgaagaatttcaggcattccttaagcagtgcttgaaagacaaacaggccctgcaggattgcgctagcgagcttggatcattcgaagatcagcatcgaaagctgaacctctggatacacgaaatggaagagcgcttcaatacggaaaatctgggagagagcaagcaacacatcccggaaaaaaagaacgaagtccataaagttgaaatgttcctcggcgagctgctggctgcccgagaatctttggataaactcagtcagaggggccagctccttagtgaggagggccatggggccggacaggagggaaggctgtgttcacagctcctgacttcacaccagaatctgcttcggatgaccaaggagaaattacggtcctgtcaggtggcactgcaagagcacgaagcactggaagaagcactgcagtccatgtggttctgggtgaaagccattcaggatcgcctggcgtgtgctgaaagtactctgggcagtaaggacaccctcgaaaagaggttatctcagatacaggacatccttctcatgaaaggcgagggggaagtgaaactcaatatggccatcgggaagggggagcaggcactccggtcttccaacaaagaaggacagcgggtaatccaaactcaactggagactctgaaggaagtttgggcagacatcatgtcaagtagcgtgcacgcccagagcaccctagaaagtgtaatatcccaatggaacgactatgtggaacggaagaaccaactggagcagtggatggaatcagtcgatcaaaagattgagcacccactgcagccccagcccggcctcaaggaaaagtttgtcttgctcgaccacctgcagagtattctaagcgaggccgaagatcacacacgcgcattacatcgactcatcgctaaatcacgcgaactgtacgagaaaacggaggacgagagcttcaaagataccgctcaggaggagctgaagacacagttcaacgatatcatgactgttgctaaggagaaaatgaggaaagtagaggagatcgttaaggaccatctaatgtacctggatgctgttcacgaattcacagactggctccactccgcaaaagaagaattgcatcgctggagcgatatgtccggagattccagcgctactcaaaagaagttgtcgaagattaaggaactgatagattcacgcgagatcggcgcctctagactgagtcgagttgagagcttggccccagaggtaaagcagaataccactgcctctggctgcgagctcatgcacacagaaatgcaggctttgagagcagactggaagcagtgggaggatagcgtcttccagacccagtcatgcctggaaaatcttgtctctcaaatggctctcagtgagcaggaattcagcggacaggtggcccagctcgaacaagctcttgaacagttctcagctctcctcaagacttgggctcagcagctgacactgctggaggggaagaatactgacgaagagatagtggagtgttggcacaaaggtcaggaaatccttgacgccctacagaaggccgagccccgtaccgaggacctgaaatcacagttgaacgaactctgtcgcttctcccgggatttgagcacctactcggggaaagtatccggcttaatcaaagagtacaattgcctgtgtcttcaggcctcaaagggatgccagaataaggaacagattctgcaacagcgttttcggaaagcctttcgtgacttccaacaatggctagttaacgcaaagataacaacagcgaaatgtttcgacattcctcagaatatatcagaagtgagcacctcactgcaaaagatacaagagttcctaagcgaatccgaaaatggacaacataaactgaatatgatgctgagtaagggggagctgctgtctacactactgacaaaggagaaggccaaggggatccaggcaaaggtgaccgcggctaaggaagattggaagaatttccatagcaatctccaccaaaaggaaagtgctctggaaaacctgaaaattcagatgaaagactttgaggtgtcagccgaacctatccaggactggctatcgaagacagaaaaaatggttcacgagtcatcgaacagactgtatgacctacctgctaagcgccgggagcagcagaagctgcaatctgttctagaggaaattcactgttatgagcctcaattgaaccgcctcaaggagaaagcacagcagctgtgggagggtcaggccgcgagtaaatcatttaggcacagggtttcacaattgagttctcagtacctggcacttagcaatctcacgaaggagaaggtcagccgccttgatcgtatagttgcagagcacaatcagtttagtctagggataaaagagttgcaggattggatgaccgatgctattcacatgctcgacagctattgccaccctacctctgacaaatcagtcctagattctcgaaccctgaagctggaggctcttcttagcgttaagcaggagaaagagattcaaatgaaaatgattgtgaccaggggggagagtgtgctacaaaatacgtcacctgagggtattcccaccatccagcagcagctacagagtgtcaaggatatgtgggcttctttgcttagtgccggaatcagatgcaaaagccagctcgaaggagccttaagtaaatggacctcataccaagatggtgtgcggcagtttagcgggtggatggattccatggaagcgaatctcaatgaaagtgagaggcaacacgccgaactccgggacaaaactacaatgctaggaaaggcaaaacttttgaatgaagaggtcctctcctactcttctctcttggagacaatagaagtgaagggggccggaatgaccgagcactacgtgacgcagttagaacttcaggatcttcaggagagataccgcgccattcaggaacgagctaaggaagccgtgaccaaatcagaaaaactagtgcgtctccaccaggaatatcagcgagacctcaaagctttcgaagtatggctgggccaggagcaggaaaagttggaccagtacagtgtacttgagggggatgcacacactcacgagaccacacttagggacctgcaagaactccaggtccattgcgctgagggacaagctctgctcaactccgtgctgcacacaagggaggacgttattccatctggcatcccacaagccgaagatagggcattggaaagtttacggcaagactggcaggcatatcagcataggctgtcagaaactagaacacagtttaataatgtcgtcaacaagctcaggctcatggaacagaagtttcagcaggtcgatgaatggctgaaaaccgccgaggagaagaagtggcacgaagaagtgacagcgtacagagacgaggtggaagaggtcggggcccgagcccaggagatactcgatgagtcccatgtgaacagtcgcatgggctgccaggcaacccagcttacaagtcgttaccaggcgcttttgctccaggtgctggaacagatcaagttcttagaggaggagattcagtccttggaggaatcggaatcgtcattgagttcttattcagactggtatggtagcacccacaagaattttaagaacgtggctaccaaaatagataaagtggacaccgtgatgatgggcaaaaagctgaaaactttggaggtgctgctaaaggatatggaaaaagggcactctctacttaaaagtgcccgcgaaaaaggcgaacgcgccgtcaagtacctggaggaaggcgaggccgagaggttgcgcaaggagatccacgaccacatggaacagctcaaggagttaaccagtaccgttcgcaaggagcacatgaccttggaaaagggactgcacctcgccaaggagttctcagacaagtgcaaggctctgactcaatggatagctgaatatcaggaaattctgcacgtcccagaagaacccaagatggagctgtacgagaaaaaagctcagttgagcaaatacaaaagtctgcaacagacagtactatcccacgaacctagcgttaagtcagtgcgcgagaaaggggaggcgctgctcgagctggtgcaggacgtcaccctcaaggacaagatcgaccagctgcagtctgactatcaggacttgtgttctatcgggaaagctatgatggaagagattgcaggctttgaggatagattgaataatctccagatgaaaggggacactctcatcgggcagtgcgcagaccacctgcaggccaaattaaaacagaatgttcacgcccacttgcaaggaacgaaggactcatacagcgctatttgcagcacagcccagagaatgtaccaatccctcgagcacgaattgcagaagcacgtcagtagacaggacacgttacagcagtgtcaggcgtggctgagcgctgtgcagcctgatctcgaaccgtcaccgcaacctcccctttctcgcgccgaagcaataaaacaggtcaaacactttagggcattacaagagcaagcgcgcacatacctggacctgctgtgttccatgtgcgacctgagtaatgcatctgtgaagaccaccgccaaagacatccagcagactgaacaaactatcgagcagaaactggtccaggcccagaatctcactcagggctgggaggagattaagcacctgaagagtgagctgtggatatacctccaggacgccgatcagcaactccagaatatgaaacgccgccatagtgaactcgaactgaacattgcccaaaatatggtgagccaggtgaaggactttgttaagaagctccagtccaagcaggcctctgtgaataccattatcgagaaggtcaataagctgaccaaaaaagaggagtctccagagcacaaggaaattaaccatctgaatgatcagtggctcgatctgtgcagacagagtaataatctttgtcttcagagagaggaagatctccagcgtacacgcgactaccacgactgcatgaacgtcgttgaggtctttctggaaaaatttacgaccgaatgggacaatctggcacggagcgatgcagagtccacagcagttcacctggaagccctgaagaaattggccttagcactccaggagagaaaatatgcaatcgaagatttgaaagaccagaaacagaagatgattgagcacctcaacctcgatgataaagaactggttaaggaacagacaagtcacctcgagcagcgttggttccagctggaggatctcataaaaagaaagatccaggtttctgtcacaaatcttgaagaactgaatgtggttcaaagccggttccaagaactgatggagtgggcggaggagcagcagcctaacatcgcggaggccctcaaacagtccccgccgcccgacatggcgcagaatttactcatggaccacctcgctatatgctccgagttggaggcaaagcagatgctgctgaaaagtctcattaaggacgcggatagagtgatggcagatcttggattaaacgagaggcaggtaatacagaaggctctgtcagatgcccagagccacgtgaactgtctgtccgatttggttggccagaggcgtaagtacctgaacaaagcgctcagtgaaaagacccaatttcttatggccgtgttccaggcaacaagtcagattcagcagcatgagcgaaaaatcatgttccgtgagcacatctgcttgctgcccgacgatgtgtccaaacaggttaaaacatgtaagtcggcacaggcctccctgaaaacttatcagaatgaggtcaccggactttgggcccaggggagagagttgatgaaggaggtcacagagcaggaaaagagtgaggttctaggaaagcttcaggagctgcaaagcgtgtacgatagcgtactacaaaaatgcagccaccggttacaagaactggaaaaaaatctggttagcagaaagcactttaaagaggatttcgataaagcatgccactggctcaaacaggccgatatcgtcaccttccctgagatcaatctgatgaacgagtctagcgaactgcatacacagctcgcgaagtaccagaatatcttggaacaatcacctgagtacgagaatctcctgctgacactgcaacgtactggccagacgatcttacccagcttaaacgaggttgatcatagctacctctctgaaaagttgaacgcgctcccgaggcagttcaacgtcatagtggctctggctaaggacaaattctataaggtccaggaagccattctggctagaaaagagtacgcttctcttatcgagttgaccacacagagcctgtctgaactggaggcacagttcctgcggatgagcaaggtgccaacagaccttgctgtcgaagaagccctcagtctgcaggacggctgtcgtgctatactggacgaggtagccgggttgggtgaagccgtagacgaactaaaccagaagaaggaaggtttcaggagtactggccaaccatggcagccagacaaaatgctgcacttggtgactctttaccataggttgaaacggcagacagaacaacgagtgagtctgcttgaggacacaacctctgcctaccaagaacacgaaaaaatgtgccaacagcttgagaggcagctcaaatcagtgaaagaagaacagagcaaggtaaacgaggagacactgccggccgaagagaagctgaagatgtaccatagcctcgcagggagcctacaggattctgggatcgtgctgaaaagggtcacaatccacttagaggatctcgcaccccacctcgatccgttagcctacgagaaggccaggcaccagattcagagctggcagggcgaattgaaactgctgacctctgctataggagagacagttaccgagtgcgaatccaggatggtgcagtcaattgacttccagacagaaatgtctaggtctttagactggctgcggcgtgtgaaagcagagctgagtgggcccgtgtatctcgacctaaacctacaagatatacaagaggagatccgcaaaatccagattcatcaggaggaggtgcagtcaagcttgagaataatgaatgcactgagccataaggaaaaggaaaagttcacgaaagccaaggagctaatctccgccgatttggagcactcgctggcagagctgtctgagctcgatggggacattcaggaggccctgcgcaccagacaagctactctgaccgaaatttactcacagtgtcagcggtattaccaggtatttcaggccgccaatgactggctagaagatgcccaagagctcctacaattggccgggaacggactggatgtcgagtccgccgaggaaaacctaaagagccacatggaatttttctcaaccgaagatcagttccactctaatcttgaggaacttcatagcttggtggcaactcttgatcctctgataaaacccactggaaaggaggatctggagcagaaggttgccagccttgagctacggtctcagcggatgagcagagacagcggtgcacaagttgatctgctccaacggtgtaccgctcagtggcatgattaccagaaggctagggaggaggttatcgagcttatgaacgacaccgagaagaaactctcagaattctctctactgaagacatccagcagtcatgaggccgaagaaaagctgagtgagcataaggccctggtgtcagtggtgaactcctttcatgagaagattgtggctttagaggagaaggcttcacagctagagaaaaccggcaatgacgctagcaaggccacgctgagtcggtccatgacaacagtgtggcaacggtggacaagactccgcgctgtggcacaggatcaggagaaaatcctggaagatgccgtcgatgagtggactggattcaacaataaagttaaaaaggccaccgaaatgatcgaccagcttcaggataagctcccggggtcaagcgctgagaaggcatccaaggcagagttactgacgcttctagagtaccacgataccttcgtcttggaactggaacaacaacaaagtgctctgggaatgctgaggcagcagactctcagcatgctgcaggacggagctgcacccacacctggcgaggagcctccacttatgcaggagatcactgccatgcaggaccggtgccttaatatgcaagaaaaggtgaaaacaaacggcaagcttgttaagcaggagctcaaggatcgcgagatggttgagacacagatcaatagtgtgaagtgttgggtgcaagagaccaaggaatacctggggaatcccaccattgaaatcgatgcccaacttgaggagcttcagatcctcctaaccgaggctaccaaccatagacaaaacatagagaagatggcggaagagcagaaagaaaagtacctcggcttatatactatactcccaagcgaactctcactccaactcgccgaggtggctctagatctcaagatccgcgaccaaatccaggacaaaattaaagaggttgagcagtcaaaggcaacgtctcaggagctttctcgacagatacagaagctagccaaagatctaactaccattcttactaagctgaaagcgaagacagataatgtcgtgcaagctaagactgatcagaaggtgcttggtgaggagctcgatggatgcaattcaaaactaatggaactcgacgccgccgtccagaagttcttagagcagaatggacaactcgggaaacccctcgccaagaagatcgggaagttgacggagctgcatcagcagacaatccggcaagcagaaaaccggcttagcaaattgaaccaagcggccagtcacctggaggaatataatgagatgctggaacttattctcaagtggatcgagaaggctaaggtgttggcacatggcactatcgcctggaactccgcaagtcagctgcgagagcagtacatactgcatcaaaccttactcgaagagtctaaagagatcgactccgaattggaagccatgaccgaaaagctccagtacctgactagcgtttactgcaccgagaagatgagccagcaggttgctgagcttggacgggaaactgaagaattgagacagatgattaagattagactgcagaatctgcaagacgcggccaaggatatgaagaagtttgaggctgaactgaagaaattgcaagcagcgctggaacaggcacaggccactctgacaagcccggaggtaggccggctttccctcaaggagcaactcagtcacagacagcacttgctgtctgaaatggagagcttaaagccgaaggttcaggcagtgcaattatgccagtctgccctacgaataccagaggatgtagtggcgtctctgccattgtgtcatgcagccctacgactccaagaggaagcgagccggcttcagcatactgctattcagcagtgtaacataatgcaggctgcagtggtgcagtacgaacagtatgaacaggagatgaaacatcttcagcagttaatagaaggggcccatcgagaaatcgaggacaaacctgtcgcgacaagcaatattcaggagcttcaagcccagatctccaggcatgaggagctcgcacaaaagatcaagggttaccaggagcagatcgcgtcactcaactcgaagtgtaagatgctgacaatgaaagccaagcatgctaccatgctgctgaccgtgactgaggtggagggtctggctgagggaacggaagatttggacggggaattgcttcccacccctagtgcacacccgtctgtggtaatgatgacggccggcagatgccacaccttactgtccccagttacagaggaaagtggcgaggagggaactaattctgagatcagcagtcccccggcttgcagaagcccctcccccgtggcaaataccgatgcgtctgttaaccaggacatcgcgtattaccaggcactttccgccgagcgtctacagaccgatgctgccaaaatacacccttctacctccgcaagtcaggaattttacgagcccggattggagccctccgcaacagccaagctcggtgacttgcagagatcctgggagaccttgaagaacgttatctccgaaaaacagcgaaccctgtacgaagcgctggagaggcagcaaaaataccaggatagcctgcagtccatatcaaccaagatggaggcaatagaattaaaactctcagagagtcccgagcccgggcgctcccctgagtcccagatggctgagcaccaggccctgatggacgaaatattaatgcttcaagacgagattaacgaattacaaagctcacttgccgaagaactcgttagcgagtcatgtgaagcggatcctgctgaacagctcgccctccaatcgactctgaccgtgcttgcagagcggatgtcaaccatccgcatgaaggcgtccggtaagcggcaattgctcgaagagaaactgaacgaccagctcgaggaacaacgccaggaacaggctctccagaggtataggtgcgaggcggatgagttggactcttggctgttgtcgacaaaagcgaccctagacaccgcccttagccctccaaaggaacccatggacatggaagcccaactgatggactgtcagaatatgttggtagaaattgaacagaaggtagttgccctgagcgaattaagtgtccacaatgaaaacttactccttgaaggcaaagctcatactaaggacgaggccgaacagctggccggcaagctcaggcgcctgaagggctcgcttctggaactgcaacgcgccttacacgataaacagctgaacatgcaagggacagctcaggagaaggaagaatcggatgtagatctgacggccacacaaagccccggcgtgcaggaatggctggctcaggcccgcacgacctggacgcagcagagacagagttcactacaacaacaaaaggaactggagcaggaactggcagaacaaaaatctctcttgaggtctgtagcgagccgcggagaggaaattctgattcagcacagtgctgcagagacatctggcgatgcaggcgagaagcctgatgttctgagccaggaactcggcatggaaggggagaagtcgagcgccgaagaccagatgcgtatgaaatgggagagcttgcatcaagaattttccaccaagcaaaaactcctgcagaatgtcctggaacaagaacaggagcaggtcttatatagcaggcctaaccggctcttgagcggtgttcctttgtacaagggagatgtgcccacccaggataagtcggcagtgactagcctgctggacgggttaaaccaggccttcgaagaggtgtcttcccagtctgggggggctaagcgccagtcaatccacctggaacaaaagctctacgacggcgtgtctgctacctcaacatggttagacgacgtggaggagcgtctgtttgtagccaccgctctccttccagaagagaccgaaacgtgtctgttcaaccaggaaattctggccaaagatataaaggaaatgagcgaggagatggacaagaacaaaaacctcttcagtcaagcatttcctgagaatggcgataaccgcgacgtcattgaggatacattgggctgcctcctcggtagattgagccttctggactcagtggttaaccagaggtgccatcaaatgaaagagagattacaacagatcctaaactttcagaacgaccttaaggttctgttcacatctttagccgataataagtacattatactgcaaaaactcgccaacgtttttgagcaaccagtcgccgaacagattgaagccatccaacaggcagaggacggattgaaggaattcgacgccggcataattgaattgaagcgccgaggcgataagttacaggtcgaacagccttccatgcaggagttgtcgaagctccaggatatgtatgacgaattgatgatgatcattggaagtaggagatcaggccttaatcagaatctgacactcaagagtcagtacgaacgggctctccaggatctggctgacctactagaaacaggtcaggagaagatggctggcgaccagaaaataattgtaagtagcaaagaagagatacagcagctactggataaacataaggagtactttcaaggtctggaatcccacatgattctgaccgagacactgttccgaaaaatcatttcttttgccgtgcagaaagaaacacagtttcataccgagctaatggctcaagctagtgctgtcctgaaacgggctcataagaggggggtcgaactggagtacatcctggaaacctggtcccacctggacgaggatcagcaagagctgagccgtcagctggaagtggttgaatcctctatcccctccgttggtctggtcgaggaaaacgaagacagattgattgacagaatcacactgtaccagcatttgaaaagcagtctcaacgaatatcagccaaaactgtaccaggtgctcgatgacgggaagcgcctgctgatttcaataagctgttctgatttggaaagccagttgaaccaactcggagaatgctggttatcgaacactaacaagatgtctaaagaactccatagactggagacaattctcaagcactggacaaggtaccagagtgagtcggctgacctaattcactggctgcagagcgcaaaggacagactagagttttggacacagcagtcagtgactgttccacaagaactagagatggtacgcgaccatctgaatgcttttttagaattctctaaagaggtggatgcccagtcaagcctgaaaagcagcgtcctgagtaccggcaatcaattactgcgactcaaaaaagtggacaccgctacactgaggagcgagctctcacgcatcgatagtcagtggactgacctgctgacaaacattcctgccgtccaggagaagctacaccaactgcagatggacaagttgccaagtaggcacgctatctctgaagtaatgtcatggatcagtctcatggaaaacgtgattcagaaggacgaggataacatcaagaattccatcggttacaaggccatccatgagtacctgcagaagtataagggctttaagatcgacattaattgtaaacaactgacagtcgattttgtgaaccaatcagtgcttcagattagcagccaagatgtggaatcaaagaggtctgacaaaacggactttgccgaacaacttggtgcaatgaacaaaagttggcagattctgcagggcctcgtgacagagaagatccaattgctggaggggcttctggaatcttggtccgaatacgagaataacgtgcagtgcctgaagacgtggttcgaaacacaggagaaaaggctgaagcagcagcatcggattggcgatcaagcctcagtccagaacgcactcaaagactgccaagacctagaggatcttattaaggccaaagagaaagaggttgagaaaatcgaacagaatgggctggcactgatccagaacaaaaaagaggacgtatcctccatcgtgatgtccacgctcagagaattggggcagacctgggcgaacctggaccatatggtgggccagcttaagatcctcctgaaaagtgttctggatcagtggtcatcccacaaagtggccttcgataaaataaactcctatctgatggaggccaggtactcactatcgcggtttaggttgttaactgggagcctggaagctgtccaggtgcaggttgacaatctgcagaatctgcaggatgatctggagaaacaggagagaagcctccagaagtttggatcaattacaaaccagctcctgaaggaatgtcacccgccagtcactgagacgttaacgaacactttgaaggaggtgaatatgaggtggaataacctgctcgaggaaatcgccgagcaattgcaaagcagcaaagccctactgcagctttggcaaaggtataaggattacagcaagcagtgtgcatccactgtgcagcagcaggaggacaggactaacgaactgctcaaagcggcgaccaacaaggacattgccgatgatgaagtggctacttggattcaggattgtaacgatctgctgaaaggacttgggaccgttaaggactcgctgttctttctacacgaactgggagaacagctcaagcagcaggtcgacgcgtctgcagcctctgcaatccagagtgatcaattatcactatcccaacatttatgcgccctggagcaggcgttgtgcaagcaacagacatcacttcaggccggcgttctggattacgaaacctttgccaagagccttgaggccctggaggcttggatagtcgaagcagaggagatactgcagggtcaggatccctcccactcatcagatctgagtactattcaagaaagaatggaggaacttaaaggccagatgctgaagttctccagtatggcgcctgacctggatcgcctcaatgaactggggtacaggctgcccctcaacgacaaggagataaaacgtatgcagaatctcaatcgccactggtcactcatctcttcacagaccaccgagagattcagcaaactgcagagtttcctgctgcagcatcagacctttttggagaagtgcgaaacgtggatggaattcctagtgcagaccgagcagaagctggccgtggagatatccgggaactatcaacacttgctggaacagcaacgcgctcatgagctgtttcaagcggagatgttcagcaggcagcagattctgcacagtattattatcgatggacaacgcctgctcgaacagggccaggtggatgatcgtgatgagtttaacctgaaactgacgctcttgtctaatcagtggcagggagtcatcagacgtgctcagcaacggcgtggcatcattgattctcagattcgccaatggcagaggtatcgtgagatggccgagaagctcagaaagtggttggtggaagtctcttacctgcctatgtccggacttggttcagtgccaatccctctgcaacaggcgagaacactgttcgacgaagttcagtttaaggagaaggtattcttacgccagcagggcagttacatcctcacggtggaagccggcaaacagttattgctatctgccgatagcggggcagaggccgctctgcaagcagagctggccgaaatccaggagaagtggaagtcagcctccatgaggcttgaagagcagaagaagaagctcgccttcctcctcaaagattgggagaagtgtgaaaaggggatcgccgatagcttggaaaaactccgcacgtttaaaaagaagctgtcacaatctctccccgatcaccacgaagagcttcatgccgaacaaatgcggtgtaaggaattggaaaacgctgtggggtcttggacggatgatttgacacagttgtccctgttgaaggatactctctcggcatacatctctgccgatgacatttccatcttgaacgagcgcgtcgagttgctgcagagacagtgggaagagttgtgtcaccaactgtcattgaggaggcagcagattggcgagagactgaatgaatgggccgtgttttccgagaagaacaaggagctctgcgagtggctcacacaaatggaatctaaggtgagccagaacggcgacatcttgattgaagagatgattgagaagctcaaaaaagattaccaggaggaaattgctattgctcaggaaaacaagattcagctgcagcagatgggagaaaggctggccaaggcttcacatgagtccaaagcgagtgaaatcgaatataaactggggaaggtcaacgaccggtggcagcatctgctggatctgatcgccgcaagggttaagaagctaaaggagacgctggtcgccgtgcagcagcttgacaagaatatgtcttcccttcgaacgtggttagcacacatcgagtccgagctcgctaagcccatcgtgtacgactcctgcaacagcgaagagatccaacgcaagttaaacgagcagcaggaattgcagcgggatatcgaaaagcattccactggggtggcgtcagtgttgaacctgtgtgaagttctcctccacgactgcgacgcatgtgccactgatgctgaatgtgactctatccagcaagccacgaggaatctggatcggcgctggaggaatatctgcgcgatgagcatggaacgacggctgaagattgaagagacttggcggctctggcaaaaattcctggacgactattcaaggtttgaagattggctgaagagctcagagcgcaccgccgcttttccttccagttctggggtcatttatacagtcgctaaggaagagttgaaaaaattcgaagcttttcagcggcaggtgcacgaatgcctcactcagcttgagttaattaacaagcagtaccggagacttgcccgagaaaatagaacagactctgcctgcagtctaaaacagatggtgcacgagggcaatcagagatgggataatctccaaaagcgagtgacatctatcttgagacgcctcaagcacttcatcggccagcgagaggagtttgagacagcccgtgacagcatcctggtctggctgacagagatggatctgcagcttactaacatcgaacacttcagcgaatgtgacgtccaggccaagattaaacagttaaaggctttccaacaggaaatctcactgaatcacaataagatcgagcagataatagcacaaggagaacaactgatcgaaaagtccgagccgctggacgccgccatcatcgaagaagaactcgacgagctgaggcggtactgtcaagaggtttttggacgagtcgagagataccacaagaagctcatccgactcccgctgcctgatgatgagcatgacctgagtgaccgcgaattagagcttgaggattccgccgccctgtcagacttacattggcacgaccgaagtgctgactcccttttaagcccccaaccaagcagcaatctgagcttaagcctagcacagccattgaggtctgagagatccggccgggacactcctgcgtctgtcgattccattccgctggagtgggaccacgattatgacctgtctcgcgacttggaaagcgcgatgtcacgcgcactgccaagtgaggacgaggaaggccaggacgacaaggatttctatctgcggggagcggttggtctgtccgatgtaatgatcccagaaagcccggaagcgtacgtgaaactgaccgagaacgccatcaagaacacatccggagatcacagcgccctcgaatcccagatccgccaacttggaaaggcattagatgatagtcgattccagatccagcaaaccgaaaacatcatccggtccaaaacaccaaccggccctgagttggacacttcctataaaggatacatgaaactcctgggagagtgcagctcaagcatcgattccgttaagaggttagaacacaaactcaaggaggaggaggagtcacttccagggttcgtgaatctgcactccacggaaacgcagactgccggcgttatcgataggtgggaactgctgcaggcccaagcactatcaaaagaattgcggatgaagcagaatctccagaagtggcagcagtttaattctgatctcaattccatctgggcctggctgggggataccgaagaggaactcgagcagctccagcgcctggagctgtccaccgacattcagactattgaactgcagataaagaaactaaaggaactgcaaaaagcagtggaccataggaaagctattattctcagtatcaacctttgcagtcccgagttcacccaggcagattctaaagagagcagagacttgcaggacagactgagtcagatgaatggaagatgggatagggtgtgctcacttctggaggagtggcgcggcctgttgcaagatgccttgatgcagtgccaggggttccacgagatgtcccatgggctgttgctgatgctcgagaacattgataggagaaagaacgagattgtgcctatcgacagcaatcttgacgctgagatcttacaagaccatcacaaacaactcatgcagattaaacacgaactcctcgagagccagctgagagttgctagcctgcaagatatgagctgccagttgctcgtgaatgctgagggcaccgattgcctcgaggcaaaagaaaaggtgcacgttatcggaaatcggttgaagctgctgctgaaggaagtctctcgacacatcaaagagctcgagaagttgctcgatgtctctagcagccagcaggatctgagttcgtggagcagtgcagacgagctcgacacatctgggtctgtcagtccaacctcaggtcgctcaaccccaaatcggcagaagactccacgaggaaaatgcagcctgtcacaacccgggccctctgttagtagcccacactcccgctcgaccaaagggggctctgatagtagcctctccgagccaggacccggtagatccggacgagggttcttattcagggtgctccgcgccgctctgcccctgcagctcttgttgctgctcctgatcgggttggcctgcctcgtgcctatgagcgaggaggactattcttgcgccctaagcaataactttgctagaagctttcacccgatgttgcggtacaccaacggccccccgcccctgtag

SEQ ID NO: 135876 - DNA, 26250 bp, Artificial Sequence
  Description of Artificial Sequence: Synthetic coding sequence
atggcgacctcccgaggcgcttctagatgccctcgtgacatcgctaacgtgatgcagcgcttacaggatgaacaggagatagtacagaagaggaccttcaccaagtggattaattcacatttggccaagcggaagccccccatggtggttgacgatctgtttgaggacatgaaggatggagtgaaactgctggctctgctcgaggtgctcagtggtcagaagttgccctgtgagcaaggccggagaatgaagcggatccacgcggtggcaaacatcggtaccgcccttaagtttctggaaggccggaaaagcatgcaccggggtagtccaattaagctggtgaacattaattccacggatattgcagatggaaggccctcgattgtgctgggtctgatgtggactattatcctttacttccagatcgaagagctgacatcgaatctccctcaactccagagcttgtcctcaagcgcaagtagcgttgatagtatcgtgtccagtgagacaccctcaccgccctctaagcgtaaagtgactacaaaaatccagggaaatgctaaaaaggcactgctgaaatgggtccagtacacagccggcaagcagacaggcatcgaagtgaaagactttggtaagagttggagaagcggggtggcctttcattcagtgattcacgcgatccggcccgaactcgtggatttggaaacagtgaaaggcaggtcaaaccgggaaaaccttgaagacgctttcacaattgccgagactgagctggggattcccaggcttctcgatcccgaggacgttgatgtggacaaaccagacgaaaagagcattatgacgtacgttgctcaattcctgaagcactatccagacatccataatgcctccactgacgggcaagaggatgatgagattttgcccggattcccttcttttgcgaatagcgtccagaatttcaagagagaagaccgagtgatcttcaaagaaatgaaggtatggatagagcagttcgaacgtgatcttactcgggcccagatggtggaatccaatctacaggacaagtaccagagtttcaaacactttcgggttcaatacgagatgaagcgaaagcaaattgagcatctgatccagcctctgcatcgggatggaaagctttccctagatcaagccttggtaaagcagagttgggatcgcgttacttcaagactgtttgattggcacatccagttggacaaaagcttaccagcacccctgggcacgatcggggcatggttatatcgagccgaagtggcgttgcgggaggaaatcacggtccagcaggttcacgaggagaccgcgaacacgatccagcgaaaactcgaacagcataaagatcttctgcagaacacagatgcccacaagcgtgctttccatgagatttatcggacacggtctgtcaatgggatccccgtaccccctgatcagctcgaggatatggccgaaaggttccatttcgtgagctcaacttctgaacttcatctgatgaagatggaattcttggaactcaaatatcgcctgctgagtttactagtcctggctgaatcaaagttgaagtcttggattatcaagtatggtagacgtgagtctgtagagcagcttctgcaaaattacgtgagctttattgaaaacagcaaatttttcgagcaatatgaggtgacgtaccagattctaaagcaaacagcagaaatgtacgtcaaagccgacggttcagtggaagaggctgaaaacgtgatgaagtttatgaatgagaccaccgcgcaatggcggaacctgtcggttgaggtgcggtccgtccggtcaatgctggaggaggtcatcagcaactgggatcggtacggtaacacggtcgcctcattacaggcatggttggaggacgcggaaaaaatgctaaaccaatccgagaatgctaagaaggatttttttcggaatctgccacactggatccagcaacacaccgcgatgaatgacgccggcaattttctgattgaaacctgcgacgagatggtatctagggatctgaaacagcagctacttttattgaacgggcgctggagggagctatttatggaggtgaagcaatatgcccaggctgacgaaatggatcgtatgaaaaaggagtacacggactgcgtggtgaccctgagtgcattcgccaccgaagcacacaaaaagcttagcgagcctctggaggtgtctttcatgaacgtaaagcttctgattcaagatctggaagacatcgaacagagggtgcccgtgatggatgcccaatacaagatcatcaccaagaccgctcatctcatcactaaagagtctccacaggaagaaggtaaggaaatgtttgccactatgtcgaagcttaaggaacagctaacaaaggtaaaagagtgctacagtcctctgctttacgaaagccagcagttgttgatccctctggaagaattagagaagcagatgacttccttctatgactcattgggtaagataaacgagatcatcacggtgttagagcgggaagcccaatcgtccgccctgttcaagcagaaacaccaggaactgttagcttgccaggagaattgtaaaaaaacactgactttaattgagaagggctcccaatcggtccaaaagttcgtaaccttgtccaacgtgctgaagcattttgaccaaaccaggctgcagaggcagatcgctgatattcatgtggcctttcagtctatggtgaaaaaaaccggggattggaagaaacacgtggaaaccaactctagactcatgaagaaattcgaagaatcgagagccgagctggaaaaagtcctacggatagcacaggagggtttggaagaaaagggcgaccccgaagagctactgaggcggcacactgagtttttctcccagctggaccagagggtgcttaatgccttcctcaaagcatgtgacgagttaactgatatactccctgagcaggagcaacaaggactgcaggaggccgtcagaaaactgcataaacagtggaaggacctccagggggaagcaccataccatttgctccaccttaaaatagacgtggagaagaaccgcttcctcgcttccgttgaagagtgtagaactgagctggacagagaaacgaagcttatgcctcaggagggcagtgaaaaaattatcaaagaacatcgggtgttcttttcggataaaggccctcaccatctgtgcgagaaaaggcttcagctaatcgaagagctgtgcgtgaaactcccagtacgcgacccagtgagagacaccccagggacgtgtcacgttaccctaaaggagctgcgggcagctatagatagcacctatcgcaagttaatggaggaccctgataaatggaaagactacacatcccggttttccgaattttctagctggataagtacaaatgaaacacaactgaaggggattaaaggcgaagcaatcgacaccgctaaccacggagaagtgaaaagagccgtggaagagattcggaatggagtgacaaaacggggggaaaccttaagctggcttaagtctaggctgaaggtgctgaccgaagtgagttccgaaaacgaagcccagaagcagggtgacgaactggctaagctttctagcagtttcaaggctctcgttactctgctttctgaagtcgaaaaaatgctctctaacttcggagattgcgtacagtataaggaaatcgtgaagaattccctcgaggagctcatcagcggctctaaggaggtgcaggagcaggcggagaaaatccttgacactgagaacctgttcgaggcgcagcagctgctattacatcaccagcagaagaccaagcgaatcagtgccaaaaagcgagacgttcagcagcaaatcgcccaggcgcaacaaggcgaggggggcctccccgaccggggacatgaggaactaagaaaactggagtccaccctcgacggtctcgagcgttctagggaaaggcaggagaggcgcatccaggtgaccttgcgaaaatgggaacggttcgaaaccaataaagaaacagttgtccgatatctgttccagaccgggtcatctcatgagcgcttcctctctttttcctccctagaaagtctctccagtgaattggagcaaacaaaagaattcagtaaaagaacagagtctatcgccgtacaagcagaaaacctcgtgaaagaagccagcgaaattcccttaggcccacagaacaagcaattactgcaacaacaggctaagagcattaaagagcaggtaaaaaaattggaggataccttggaagaggacattaagaccatggagatggtgaaaaccaaatgggatcatttcggcagtaactttgaaaccttatccgtgtggataacagagaaggaaaaggagcttaacgccctcgagactagttcaagtgctatggacatgcagatcagccagatcaaagttaccatccaggaaattgagagcaagcttagttccatcgtcggtctggaagaggaagcgcagagtttcgcacagtttgtgactacgggggagagtgcccgaattaaggcgaaattaacacaaattcgtaggtacggcgaggagctacgggagcatgcacaatgtctagagggtaccattctcggtcacttgagccaacagcagaaatttgaagaaaacctcagaaagatccagcagagcgtctctgaattcgaagacaaattggccgtccctatcaagatctgttccagcgcgacggagacatacaaggttcttcaggagcacatggatctttgtcaagccttagagtcgcttagttccgccattacagctttttccgccagtgctaggaaagtcgtgaatagggactcatgcgtccaggaggccgcggcgctccaacagcagtacgaggacatcctgcgcagagcgaaggagcgccagaccgccctagagaacctcttagctcactggcagaggctggagaaggagttgtcttcattcctcacctggcttgagcggggcgaggccaaggccagctccccggagatggacatctcagctgatagagtcaaagtggagggcgaactgcagttaattcaggcgagctccagaaagttcgtgagccaggcctcattttactcgaagctgcttcagctaaaggagtcgttgttctctgtcgcctcgaaggacgatgtaaaaatgatgaagcttcacttggagcagctggacgagaggtggagagacctgccccagattataaataaacgcatcaacttccttcaaagcgtcgtggcagagcaccaacagttcgacgagctactgctgagcttctccgtgtggatcaagctgttcctcagtgagctgcagaccacgtctgaaatctccattatggaccatcaggtggctctcacgcgccacaaagaccacgctgctgaggttgagtcaaagaagggggaactgcagagtctccagggccacctcgccaaactagggagcttagggcgcgccgaggatctccaccttctacaaggcaaggccgaagactgcttccaactgttcgaagaggcgagtcaagtcgtggagagacgccaattggcccttagtcatctggccgagttcttgcagtctcatgctagcctgtctggcatactgagacagctgagacagactgtggaggcgaccaatagcatgaacaaaaacgaatcagatctgattgagaaagacctaaacgatgccctgcagaatgccaaggcgctcgagagcgcagcagtgtcactggacggcattttgagcaaggcacagtatcatctgaagataggcagcagcgaacaacggacaagttgcagagcaaccgcagatcagctgtgtggggaagtggaaagaatacagaatcttcttggtaccaaacagagcgaggcggatgcactggctgttttgaagaaagcattccaggaccaaaaggaggagttgcttaaatcaattgaagacattgaagagcgaacggataaagagcgcctgaaggaacctaccaggcaagccttacagcagcggctgagggtgtttaaccagctcgaggacgaactgaattcccacgagcatgaactttgctggttgaaggataaagccaaacagattgcccagaaggatgtcgcctttgcccccgaagtggatcgagaaattaataggcttgaagttacctgggacgatactaaacgtcttattcatgagaaccaaggccagtgttgcggattgatcgacctcatgcgggaataccagaatctgaagtccgcagtgtcaaaagtcctggagaatgcgtcttcagtcatcgtgactaggactaccattaaagatcaggaggatctgaagtgggccttcagcaagcacgaaaccgccaaaaataaaatgaactacaaacagaaggaccttgacaattttacttcaaagggaaaacacttactctcagaacttaaaaagattcatagttccgacttttccttagtgaagaccgacatggagtccactgtggataagtggttggacgtctctgaaaaacttgaggagaacatggaccggctaagggttagcctgagtatatgggatgatgtgttgagtactagggacgagattgagggctggagcaacaattgcgtgccgcagatggctgagaacatctctaatctcgacaaccatctcagggccgaagaactgcttaaggagtttgaaagcgaagttaaaaacaaggcactgcgattggaggagctccactccaaagtgaacgatctgaaagaactgactaaaaatctggaaacccctcccgaccttcaatttattgaagcagatctgatgcagaaactagaacacgctaaggaaataactgaagtggcaaaaggaacgctgaaggactttaccgcccagtcaacgcaagtggaaaagttcataaatgacataactacttggttcactaaagttgaggagagccttatgaactgtgcccagaatgaaacatgcgaggccctgaaaaaagtgaaggacatccagaaagagctgcaaagtcagcagtctaatatttcatcaactcaagagaaccttaattctctgtgccgcaaatatcatagcgccgagctcgaatctctcggccgggcgatgacaggacttataaaaaagcatgaggccgtctcccagctgtgcagcaaaactcaggccagtttacaggaatctctagagaagcacttttcagagtcaatgcaggagttccaggagtggttcttaggcgcaaaggccgccgccaaggaatcatccgatcgcacaggcgactcaaaagtcctcgaagcaaagttgcacgacctgcagaacattcttgattccgtgagtgacggccagtccaaactggatgcagtgacacaggaaggccagactctgtacgcccacctatccaaacaaatagtcagtagtattcaagagcaaatcacgaaggctaacgaggaattccaggcgtttctaaagcagtgtctcaaagataagcaggccctccaagactgtgcatcagagttggggtctttcgaagatcagcataggaagctcaatctttggattcacgaaatggaggagaggtttaacacagagaatcttggtgagtcaaagcagcatattccagaaaagaaaaacgaggttcataaggtggagatgttcctgggcgagctgctcgcagcccgcgaaagtctagacaaactgtcacaaagaggacagctgctgtccgaggaaggacacggtgcaggccaggaggggagactttgctcacagcttctgacttcgcaccagaaccttttgcggatgaccaaagagaagctcaggtcctgccaggtcgcgttgcaggagcatgaggccctagaagaagcgctccagagcatgtggttttgggttaaggccatccaggaccgccttgcttgcgccgagtctaccctgggatctaaggataccttggagaagcgtctcagccagatccaagacattctgctcatgaagggagagggcgaggtgaagctcaacatggccattggaaagggcgagcaggcacttcggagttctaataaggagggacaacgggtcatccaaacacagctcgaaactctgaaagaggtgtgggccgatattatgagctctagcgttcacgctcaatcaactctggagtcagtgatctctcagtggaatgattacgtcgaaaggaaaaaccagctggagcagtggatggaaagtgtggaccagaagatagagcacccactgcagccccagccagggctgaaggagaaattcgtgttgctagaccacctgcagtctattctatccgaggcagaagaccatactagagcattacacagactcatcgcgaagagcagagagctctacgaaaagaccgaggacgagtcctttaaagacaccgcacaggaggagcttaagacacagttcaacgatattatgaccgttgccaaggagaagatgcggaaagtggaggaaatcgtgaaggaccatttgatgtacctcgacgctgtacacgaatttaccgactggctgcactcagcaaaagaggagctgcaccgttggagtgacatgagtggtgattctagtgcaacacagaaaaaactgagtaagatcaaggagttaatcgacagccgggaaatcggtgcttcccgcctctccagggtcgagtccctggcccccgaggttaaacagaatacaactgcttcgggttgcgaactgatgcacacggaaatgcaggccctgagggccgactggaagcagtgggaggattctgtgtttcagacccagtcctgcctggaaaatttagtctctcaaatggcgctctccgaacaagagttttccggacaggttgcgcagcttgagcaggccttagagcagtttagcgcgctcctgaagacctgggcccagcaactcactctgctggagggaaagaatactgacgaggagatcgtggaatgttggcacaaggggcaggaaatcctagacgccctgcaaaaggccgaacccaggacagaagatctgaagagccaactcaacgagctgtgcagattcagcagagatttatctacttacagtggcaaagtctctggacttatcaaggagtacaactgcttatgcttgcaggcttccaaaggttgtcagaacaaagagcaaatcctgcagcagcgcttcagaaaggctttccgggactttcagcaatggcttgtgaatgctaagattaccacggctaagtgcttcgatatcccacagaacatttctgaggtctctaccagtctccagaagatccaggagtttctctctgaaagcgagaatggtcagcacaaactcaatatgatgctttccaaaggggaactgctgtcaacgcttctgacgaaggagaaagcaaaggggatccaggccaaagtaaccgccgccaaggaggattggaagaatttccacagtaacctgcatcagaaagaaagtgcactcgaaaatctcaagatacaaatgaaagacttcgaagtctctgctgaaccaatccaggattggctttcaaaaaccgaaaagatggtccacgagagctccaatcggctctacgatttaccagctaaacggcgagaacagcagaagctccagtcagtcctggaggaaattcattgctatgaacctcagcttaatcgcttgaaagagaaggcccagcagctttgggagggacaggccgctagtaagtcattccgacatcgcgtgtcccagctgtcgagccagtatctggctttgtccaatctgacaaaagaaaaggtctccagacttgaccgtatcgtggccgaacacaaccagttctcactgggtattaaggagctccaagactggatgactgacgcgatacatatgcttgactcatattgtcacccaacaagcgataaatcagtgctggactcccgcacccttaagctagaagcactcctgtccgtcaagcaggagaaggaaatccagatgaagatgatcgtgacgagaggggagagcgtgctgcagaatacttctcccgagggaatacctacaatacagcaacagcttcagtcagtaaaagatatgtgggcttcgctcctatcggctggcatcagatgcaagtcccaactcgaaggcgcgttgagtaagtggacttcttaccaggatggcgttaggcagttttcaggctggatggatagcatggaagccaacctgaatgaaagtgaaaggcagcacgctgaactcagagacaaaacgactatgttgggaaaagccaaattgctgaacgaggaggttctgtcatactcttctctgttggagaccatcgaggtgaaaggtgcagggatgacagagcactatgtcactcagctggagcttcaagatttgcaagagcgctacagggcaatacaggaacgagcgaaagaggctgtgaccaagtctgaaaagctggtgcgcttacaccaagagtaccagcgagatctgaaagcttttgaggtgtggctgggacaggaacaggagaagctcgaccaatattctgtgttggaaggggatgcccacacccatgagaccacgttgagagatttacaggaactgcaggttcattgcgcagaaggacaggctctgcttaacagtgtgctccacaccagggaggatgtgattccgtccgggatccctcaagccgaagatagagcattagaatcactaaggcaagattggcaggcctatcagcacaggctgtcagaaacgagaacgcagtttaacaacgtcgtcaataaacttagacttatggagcagaagttccagcaggtcgatgaatggctcaagacggccgaagaaaaaaagtggcacgaggaagtgaccgcataccgtgatgaagtcgaggaagttggcgctagggcccaagaaattctcgacgaatcacatgtgaattcacggatggggtgccaggcaactcaactgacttcgaggtatcaggctttacttctccaagtcctcgagcagattaagtttctagaggaggaaattcagtctctggaagagagtgagtcttctctttcaagctactctgattggtatggaagtacccataaaaattttaagaacgtggctactaaaatcgataaggtggatacagtcatgatggggaagaagttaaaaacactggaggtcctgctcaaagacatggaaaaagggcatagcctgcttaagtctgcgcgagaaaagggcgaacgagccgttaagtacctggaagaaggggaagcggagcggctccgaaaagagatccacgatcatatggagcagctgaaagagctcacaagtaccgttaggaaggaacacatgacactggaaaaaggcttgcaccttgccaaggaattttccgataagtgcaaggcgttgacacagtggattgccgaataccaagagatcctgcatgtgcccgaggaacccaagatggagctctatgagaaaaaagcacagttgagcaaatacaagagtctgcaacagacagtactgagtcatgagcctagcgttaagagtgtgcgcgaaaaaggtgaggccctcctcgaactcgtgcaggacgttacgctgaaggacaagatcgaccaactgcagagcgattatcaggacctgtgtagtatcggcaaggccatgatggaggagatcgcaggtttcgaggacaggttaaataatctgcagatgaagggcgacaccctaattggacagtgcgctgatcacctgcaggctaaattgaagcagaacgtacatgcccacctccagggtaccaaggactcttactccgcaatatgttcaaccgctcagcgcatgtatcagtccctcgaacatgaactccagaagcacgtgtctcggcaagacacactccagcaatgccaggcttggttatcagctgtccagcccgaccttgagcctagccctcaacctccactgtctcgggccgaggctattaaacaggtgaaacacttccgggcgcttcaggagcaggccagaacatatctggatctactgtgttccatgtgcgatctcagtaatgcgagcgtgaagaccaccgcaaaagatattcaacagacagaacagacgattgagcagaagttggtgcaggcccagaaccttacacagggatgggaagagattaaacatctgaagtcagaactctggatatacctgcaggacgccgaccagcagctccagaacatgaaaagacggcattcggagctggaacttaacattgcacagaacatggtttctcaagtgaaggattttgttaagaagctgcagtccaaacaggcctccgtgaacacaataattgaaaaggtcaataaacttacgaagaaagaggagagccccgagcataaggaaattaaccatttgaacgaccagtggttggatctgtgtagacaaagtaataatctgtgcttacagagggaagaagacctgcagaggacaagggattaccacgattgtatgaatgtcgtcgaagtcttcctcgagaaattcacaacggagtgggataatctagcccggagtgacgcagagagcaccgcagtccacctcgaagcattgaagaagcttgccctggcgctgcaggagcgcaagtacgctatcgaagatctgaaggatcagaaacagaagatgatcgaacatttgaacctcgatgacaaggagctggttaaggagcagacgtcccacctagagcagcgctggtttcagttggaggacttgattaaacggaagattcaggtgtccgtgaccaacctggaagaactgaacgtcgttcagtctcgcttccaagaactcatggagtgggctgaagaacaacagcccaacatcgccgaggccctgaagcagtctcccccgccagatatggcccagaatctgctgatggatcatctagccatatgctccgagcttgaggcgaagcagatgctacttaagtccctgataaaggacgccgaccgtgtgatggcagatctggggctgaacgaacgccaagtgatacaaaaagccctgtctgatgcccagtcccatgtcaactgcttatctgatcttgtggggcaaagaagaaaatacctgaataaggccctgagcgagaagacacagtttctgatggccgtttttcaagctacttctcagattcagcagcacgaaagaaaaatcatgtttcgggaacacatttgcctgctaccagatgatgtgtctaagcaagtcaaaacttgcaagagcgcgcaggcttcattaaagacataccaaaatgaagtgactggcctgtgggctcaggggcgggaattgatgaaagaagtgacagagcaggaaaaaagcgaggtgttgggcaagctacaggagctccagtccgtctatgatagtgtgttgcagaagtgctctcacagactccaggagttagaaaaaaatctggtgagcaggaaacatttcaaagaagatttcgataaagcatgtcactggctgaagcaggccgacatcgttacgtttcccgagattaacttaatgaacgagagctcagagctccatacgcagcttgcaaagtaccagaacatcctggaacagagtcccgagtatgagaatctgctgctaactctccagaggactggccaaactatactgccatcattgaatgaagtggatcatagttacctgtctgagaaactaaacgcccttccacgccagtttaacgttatcgtggcactagccaaggacaaattttacaaggtgcaggaggctatacttgcccgcaaggagtatgcctctcttattgagttgacgacacaatccctgagcgagcttgaggcccagttccttcggatgagtaaagtgcccacagaccttgcggttgaggaggccctgtctctacaggacggctgtagagccatcctggatgaggtcgccggcctgggtgaagctgtggacgagctcaatcagaagaaggaaggcttccggtcaaccgggcaaccttggcagcccgataagatgttacatctggtcactctttaccacagactcaaaaggcaaaccgaacagagagtgtccctcttagaagacacaactagcgcataccaagaacacgagaagatgtgtcagcagctggagagacagctgaaatctgtcaaagaggagcagtccaaagtgaacgaggaaacacttcctgccgaagagaagttaaaaatgtatcatagcctggccggatcactccaggactctggcattgtccttaagcgcgttactatccatctcgaagacctggcacctcatctggaccctctggcttatgagaaagctcggcatcaaatccagagttggcagggagaacttaagctgttaacttccgccattggagaaactgtcacagaatgtgaatctcggatggttcaaagtatagattttcaaactgagatgagcagaagcctggattggctgaggcgggtgaaggccgaactgagcggccctgtatacttagatttgaacctccaggacatccaggaagagatccgaaagatccagatccaccaggaagaagtacagtcgtcactaagaataatgaacgccctgtcccacaaggagaaggagaagtttactaaagctaaggagctgatttcagctgatctagaacatagcctggcagagctgagcgagctggatggcgatattcaggaggcactgcgaacgcgacaggccacgctgaccgaaatatacagtcagtgtcagaggtattaccaggttttccaagccgcaaacgactggctcgaggacgcccaggagttgctccaactcgcgggtaacggacttgacgttgagtcggctgaggagaacttgaaatcacatatggagttcttcagtacagaagaccaattccacagcaacttagaagagttacacagcctagttgcaacgctggaccccttaataaaacccacggggaaggaggacctggagcagaaggttgcttcgctcgagctgaggagtcaacggatgtcacgggactctggtgcacaggtggatctattgcaacggtgtacggctcaatggcacgattatcaaaaggcacgcgaggaggtcatagagttgatgaatgataccgaaaagaaactgtctgaattcagcctgttaaaaacctccagcagccacgaagccgaagaaaaactctcggagcataaagccctggtctccgtggttaattcgttccatgagaaaattgtggcacttgaggaaaaggcctctcagttagagaagactggcaacgatgctagcaaggccaccttgtcacggtcaatgactaccgtgtggcaaaggtggacacgactgcgggcggtcgcccaagaccaggaaaaaatattggaggacgcggtcgatgaatggacaggattcaataacaaagtgaaaaaggccaccgagatgatcgaccagctacaagataagctgcccggctcttccgccgaaaaagcctcaaaggccgaactgctgacgctgcttgagtaccacgatacctttgtgctggagctggaacagcaacaaagtgcattggggatgctacgccagcagactctgtccatgctccaggacggcgccgcgcctaccccaggagaggagccccccctgatgcaggaaatcacagccatgcaggacaggtgtctcaacatgcaggaaaaggtgaaaactaatggcaagctggtaaagcaagagctgaaagatagagaaatggtggagacacaaatcaacagcgtgaaatgttgggtacaggagacgaaggaatacctcgggaatccaaccatagagatagacgctcaactcgaggagctgcagatcctgctgaccgaggccacaaaccacaggcagaatatcgagaaaatggctgaggagcagaaagaaaaatacctcggactctatacaatacttccgagtgaactgtccctgcagttggcagaggtggccctagatctgaagataagagaccagattcaagacaagattaaagaagttgagcaaagcaaggctacgtcccaggaactcagtcgccagatccagaaactcgctaaggacctaacaacaattctgactaaactcaaggcgaagacggacaacgtggtgcaggccaaaacagaccagaaagtgctgggtgaagagcttgacgggtgtaactctaaactcatggagctggacgccgccgtgcagaagtttcttgaacagaatggtcagttaggtaagccattggcaaagaagattggcaagctgaccgaacttcatcaacagactataaggcaggctgaaaatcgactgtcaaaactgaatcaggctgcgtcccatctggaggagtacaacgaaatgcttgaactaatactcaaatggatagagaaggcgaaagtactggcacacgggaccatcgcctggaattccgcgtcccagcttcgagagcagtatattctccaccagacactcctggaagagtccaaagagatcgactctgagttggaggctatgactgaaaagcttcagtacctgacaagtgtgtactgtacagaaaaaatgtctcagcaagtggctgaacttggcagggagaccgaggaactccgccagatgataaagatccgcctgcagaatttacaggatgctgcaaaggatatgaagaagtttgaagcagagcttaagaaactgcaggcagctctggaacaagcccaggcaactctaactagtccggaagttggtcgactctccctgaaagaacagttgtcccatagacagcatctcctatcggagatggaaagcttgaagccaaaggtccaggctgtgcagctgtgccaaagcgcactccgtatccctgaggatgtggtggcttccctgccactgtgtcacgctgctctgcgtctgcaggaagaagcttctagactccagcacaccgctattcagcaatgcaacattatgcaggcagccgtcgtccagtacgagcagtacgaacaggaaatgaagcacctgcagcagctcatagaaggggctcatcgagaaattgaagacaagcctgtagctacctcaaacatacaggagctccaggctcagataagtcgccatgaagaattggcccagaaaattaaaggctaccaggaacagatcgcctctctcaacagcaagtgtaagatgctcactatgaaggctaagcacgcaaccatgctgcttaccgttacagaagtagaggggctggccgagggcaccgaggacctcgacggcgagctgctccctaccccaagcgcccatccttcggtggtcatgatgaccgctgggagatgccacactttactgagccctgttacagaagaatcaggggaggaggggaccaactccgagattagctctccccctgcctgtcgatctccaagtccggtcgcgaacaccgatgcctcagttaatcaggacatcgcctactaccaggccttaagcgccgaaagactgcagacagatgccgctaaaatacatccatctacgagtgcctcacaagagttttacgagccaggtcttgagcccagcgccacagccaaattaggggacctccagcgctcctgggagacactgaaaaatgtgatcagtgagaagcagaggacgctgtatgaagcactggaacgacaacagaagtatcaggattctctgcagagtatcagcacgaagatggaagccattgagctcaagctgtccgagtccccagaacccggcagaagcccagagagtcagatggctgaacaccaggctttgatggatgagattctgatgctccaggatgaaattaacgagctccagtcatctctggcagaggagttagtgagcgaaagttgtgaggccgatccagcagagcagttggccctgcaatctacgctgacagtgcttgccgagagaatgagtactatccgtatgaaagcttcaggcaagcggcaactcctggaggagaagcttaacgaccagctggaggagcagcgccaagaacaggctttgcagcgataccgatgtgaggcagacgagcttgacagttggctgctcagcactaaggccactctggacacggcactgagtccaccaaaggagcccatggacatggaggctcagctgatggactgtcaaaacatgctggttgagatcgagcagaaagtggtcgccctcagtgagctaagcgtgcacaatgaaaatctgttactggaaggaaaagcacacaccaaggatgaggccgagcagctggcaggcaagctgagaagactcaagggtagcctgttggagctccagagagctctgcatgacaaacagctcaacatgcagggaacggcacaggagaaggaggagtcagacgtcgatctaaccgcaacccagtctcctggcgtgcaggaatggttggcccaggcccgcacgacatggacccaacaacgccagtcttccctgcagcagcagaaggagctggaacaggagttagccgaacaaaagtcattgctgcgctcagtagcctcccgaggagaagagatcttgatacagcacagcgcagcagaaacttccggggatgccggcgagaagcccgacgttctgtcccaggaactcggtatggaaggagagaaatcaagtgctgaggaccagatgcgtatgaaatgggaaagtctgcaccaggagttctccacaaaacagaagttgttgcagaacgttctagaacaggaacaggaacaggttttgtactcacgtcctaacaggcttctctcaggggtgcctctttataagggagacgtacctacccaggataaatctgccgtgacctcacttctcgatggacttaatcaggctttcgaggaggtcagctctcagagcggaggggcaaagagacagtcaattcacttggagcagaaactgtatgatggcgttagcgccacatccacctggttggacgatgtcgaggagcgactgtttgtggcgacagccctcctcccagaggagactgaaacatgtctctttaatcaagaaattctcgcaaaggatatcaaagagatgtctgaagaaatggataagaacaagaacctattcagtcaggctttccctgaaaatggagacaatagagacgttatcgaagatacattgggttgtctcctcggcagactcagtctcctagattcggtggtcaaccaaaggtgtcatcagatgaaggaaaggctccagcagattctcaacttccaaaacgacctcaaagtgctgttcacctccttggcagacaacaagtacatcattcttcagaaactcgccaatgtctttgagcagcccgtggccgaacagatcgaggcgattcagcaggcagaggacggattgaaagagttcgacgcagggatcatcgagctgaagcggcgcggagataagcttcaggtggagcagcccagcatgcaggagctgagtaaactgcaggacatgtatgacgagctgatgatgattattgggtctcgtagaagtggactgaaccagaatctcaccctaaagtctcagtatgaaagggccctgcaggaccttgccgaccttctggagactggccaggagaagatggccggagaccagaaaatcatagtgtcctccaaggaggagatccagcaactgctcgacaaacacaaggaatacttccaaggactggagtcccatatgattctgaccgagactctgtttagaaagattatatccttcgccgttcagaaggaaacacagttccacactgagctaatggcccaggcctcagccgtgctgaaacgggcccataaacgtggcgtggaactcgaatacattttagaaacgtggtctcatctcgacgaggaccaacaagagttgtctagacaactcgaggttgtggagtctagcattccttctgttggactggtggaggagaacgaggaccgcctcatagaccgaatcacattgtaccaacatttgaagtcttcccttaacgagtatcagccaaagctttaccaggtattagatgacggcaagcgactgctgatctcaatctcgtgctccgatctcgaatcacagctgaaccaacttggggaatgttggctgagcaacacaaacaaaatgtctaaagagcttcatagattggagaccattctgaagcattggactcggtatcaatccgagtcagctgacttaatccactggcttcagtccgcgaaagatcgcctggagttttggacacaacagagcgttactgtgcctcaggagctggaaatggtcagggaccacttgaacgcctttcttgaatttagtaaggaagtggatgcccagtctagtttaaagtcttcggtcctgagtactggtaatcagctcttacgcttgaaaaaagttgataccgccactttgcgatcagagctatctaggattgactcgcagtggaccgatctgcttactaatattcccgctgtgcaggagaaactccatcagcttcaaatggacaagcttccttcaagacacgctatctctgaagtgatgagttggatcagcctcatggaaaacgtgattcagaaagacgaagacaatatcaaaaacagtattgggtacaaggctatccacgagtatctccagaagtacaaagggtttaaaattgacattaattgcaaacaactcactgtggactttgtgaatcaaagtgtgctgcagatcagcagtcaagacgtggaatctaagcgatcagacaagacagacttcgccgagcagttaggagccatgaataagagctggcaaatactgcagggcctggttaccgagaaaattcagcttctagaaggtctgctggagagttggtctgaatacgagaataacgttcaatgcctgaagacgtggttcgagacccaggaaaaacggctgaaacaacagcacaggattggcgaccaagcctccgttcagaacgctctaaaggattgtcaggacctggaggatctcataaaagcgaaggagaaagaagtcgagaaaatcgagcagaatgggttagccctcatacaaaacaagaaggaggacgtgagcagtatcgtgatgtccacacttagggagctgggccagacttgggcaaatctggaccacatggtcggccagcttaaaattcttctcaagagtgtgctcgaccaatggtccagccacaaagtagccttcgataagataaatagctacctgatggaggcacgatatagcctgagtcgattcagactcctgacaggatcgcttgaggccgtgcaggtgcaggtagacaatctccagaatctgcaggacgatctcgagaagcaggagcgatcgcttcagaagttcgggtctataacaaaccagcttttgaaggagtgtcaccctccagtgactgagactcttacaaacacactgaaagaagtgaacatgagatggaataacttactggaggagattgctgagcagctgcagagtagcaaggcactgctccagctgtggcagaggtacaaggattactccaaacagtgtgcctcaaccgtgcaacagcaggaagacaggacaaatgagttgttgaaggctgcaacaaataaagatattgcagatgacgaggttgcaacatggatccaggactgtaatgatctcttgaaaggactgggcacagtcaaggatagtctattctttctgcacgagctgggcgaacagctgaaacagcaggtagatgctagtgccgcctcagctatccagtccgaccagctcagtctatcacagcatctgtgtgctttggagcaggccctctgtaaacaacagacaagcctacaggctggcgtgctggactatgagaccttcgcgaaatccctggaagccctggaggcctggattgtggaggccgaggaaatcttgcaaggccaggacccctcacacagtagcgacctctccactattcaagagcgcatggaagagctaaaggggcagatgctcaaattcagttccatggccccggacctggaccgcctgaacgaactcggatataggctcccgcttaacgacaaggaaatcaagcggatgcaaaatttgaaccgccattggtctctcattagcagtcagacaaccgaacgctttagcaagctgcagagtttcctgcttcagcaccagacttttcttgagaagtgcgaaacctggatggagttcctggttcaaaccgaacagaagttggctgttgagatcagtgggaactatcaacacttgcttgagcagcagagagcccatgaattgtttcaagccgagatgttcagtcgccagcagatcctgcactcaattatcattgacggtcagaggttactggagcaggggcaggtcgacgacagagatgagtttaatttgaaactgacactgctatctaatcagtggcagggtgtcatcaggcgggctcagcagcgaagagggatcattgactcccagattagacagtggcagcggtacagagaaatggcggagaagcttcgcaaatggctggttgaggtttcttacctgcccatgagcggattgggtagcgtgcctattccactccagcaggctcggacactttttgatgaagtccaatttaaagagaaagtcttcttaagacagcaaggctcttatatcctgaccgtggaagctggcaagcagctgttgctgagtgcagactcgggagccgaggcagctcttcaggccgagttagccgagatccaagagaagtggaaatcagctagcatgcgcctggaagagcagaaaaagaaactcgcattcctgttaaaagactgggagaagtgtgaaaaaggaattgctgactccctagaaaagcttagaacttttaagaaaaaattgagccagtccctgcctgatcatcacgaggagctgcatgcggaacagatgcgctgcaaggagctggaaaacgcagttggcagttggacggacgacctcactcagctctccttgctgaaagacaccctgagtgcctatatctccgctgacgacatttccatcctgaacgagagggtggagcttctgcagagacagtgggaagagctctgccaccagctatcattgagaaggcagcagatcggagagaggctgaacgagtgggcagttttcagcgaaaagaacaaggaactctgtgagtggctcacacaaatggagagtaaggtgtctcaaaacggtgatatactcatagaggagatgattgagaaattgaagaaagactaccaggaagaaattgcgatagcccaagaaaataagatccagctgcagcagatgggtgagcggctcgccaaggcctcacatgagagtaaggctagtgaaatcgaatacaaactcggtaaagtcaacgatcgctggcagcacctactagaccttattgctgcacgcgtaaaaaaactgaaggaaactctagtggcagtacagcaacttgataagaacatgagtagcctgaggacctggctagctcacattgaaagtgagttagccaagccaattgtatatgatagctgtaattccgaagaaattcagcgcaaacttaacgaacagcaggaacttcagagagatattgaaaagcatagcaccggggtcgcttcagttttgaacctgtgtgaggtgttgctgcacgactgtgatgcttgcgctactgacgctgaatgtgactccatccagcaggcgaccaggaatctcgaccgaagatggcgtaacatttgcgccatgtctatggagcgacgactcaaaatcgaggagacctggcgactctggcaaaagtttctggatgactactcaagatttgaggattggctgaagtcatcagagagaactgcagcctttccctccagtagcggggtcatctatactgttgccaaggaggaacttaaaaagttcgaggcttttcagcgacaggttcatgagtgtcttacccagcttgagctgatcaataagcagtatcgcagactggcaagggagaatcggacagattccgcttgttcactgaagcagatggtgcacgaaggaaatcaaagatgggataacctgcaaaagcgcgtgacctctatcttgcggcggcttaagcatttcatcgggcagcgcgaggagtttgagactgcccgcgacagcatactggtgtggctcactgagatggacctgcaactgaccaatattgagcacttcagtgagtgcgatgtgcaggctaaaatcaagcagctgaaggcgttccaacaagagatctccttaaaccataataaaatcgaacagattatcgcacagggcgagcagcttattgaaaaaagcgaaccacttgatgctgccattatcgaggaggagctggatgagctgagacggtattgtcaagaggtattcgggcgcgtggagaggtaccataagaaactcatacgcctgccccttcctgatgatgagcatgacttgtccgatcgggaactcgagctagaggatagtgctgctctgagtgatcttcactggcatgacaggtctgctgactctttactatctccccagccaagcagcaatctaagtttgtccctagcacagcccctgagaagcgagcgaagcggaagggatacccctgccagtgtggactccatccccctcgaatgggaccacgattacgatctgtctcgcgacctggaatccgctatgtccagggcgctgccctcggaggacgaggaggggcaggacgacaaagacttctacctgcgtggggcagtgggactatctgatgtgatgatccccgagtctcccgaggcttacgttaaactaacggagaacgccattaaaaacacgtctggcgatcactcagccctggagagtcagatccgccagctgggtaaggcgttagatgactctagatttcagattcagcagaccgaaaatattatacgatccaaaaccccaacaggacctgagctggacactagctataaggggtatatgaaactcctgggcgaatgttcttcttcaattgattctgtgaagagactagaacacaagttgaaggaggaagaggaatcccttccagggttcgtaaatctgcattctactgagactcagacagccggcgtaattgatcgctgggaactcctgcaagcgcaggccctttccaaggagctccgaatgaagcagaatctacaaaaatggcaacagtttaattcggatctcaactccatctgggcctggctcggcgacacagaagaggagcttgagcagctgcagcggctggagctgtccacagacatccaaaccattgaacttcaaatcaagaagttaaaagagctccaaaaggccgtagaccatcggaaggctatcatactatcaattaacctgtgctcaccggagtttacacaggcggacagcaaagaatctcgagaccttcaggataggctctcacagatgaatggaagatgggaccgcgtgtgctcactgctcgaggaatggcgcggcctgttgcaggacgccctcatgcagtgccaaggttttcacgagatgtcgcatggacttctcctgatgctggagaatatcgaccgtaggaagaatgaaatagtgcccatcgactctaatctagacgctgagatcctgcaggatcatcacaagcagctcatgcagatcaagcacgagctgctggagtctcagctgagggtggcctccctgcaggacatgagctgtcagttgctggtgaatgcagaaggcactgactgcctggaagcgaaggaaaaagtgcacgtaattggaaaccgactgaaactcctgctcaaggaagtgagccgtcacattaaagaactcgagaagctgctggatgtcagctcaagtcagcaagatcttagtagctggagcagcgccgatgagctggatacatctgggtccgttagtcccacctctgggaggtccactccaaatcgccagaagaccccacgaggcaaatgctcactgtcacagcccggtccatctgtgagcagcccccactcacggagcacgaagggcggctctgacagctcactgagcgagcctggcccgggccggagcggtcggggcttcctgtttcgagtcctacgtgccgccctgcccctgcagctccttcttttattgctgatcggtctggcatgcctggttcccatgtccgaagaggactatagttgcgccttgtccaataatttcgcccgcagcttccatccgatgttgcgttatacaaacggaccaccgccactgtag

SEQ ID NO: 135877 - DNA, 2859 bp, Artificial Sequence
  Description of Artificial Sequence: Synthetic coding sequence
atggtcgtggccgaagacctgtcagcactgcgcatggcagaggactcctgcgtggatgccgacctgccagactgcaactgcgatgtaacccgcgttaaaaaactgaaggagaccctggtcgcagtacagcagctcgacaagaacatgtcatctttgagaacgtggttagctcatattgaatccgagctggccaagccaatcgtctatgacagttgcaactctgaagagatccagagaaagttaaatgagcagcaggaactccagcgcgatatcgagaagcactctacaggagttgccagtgttcttaatctctgtgaggtattgctgcatgattgcgatgcttgtgccactgatgccgagtgtgactcaattcaacaggcgacgcgcaatctggatcggcggtggcgaaacatctgtgccatgtcaatggagcggcgtctgaaaatcgaggaaacctggcgcctctggcagaaattccttgatgattactctcgattcgaagattggctcaaaagttctgagcggacggctgcctttccctcttctagtggtgtcatttacactgtggcaaaggaggagctgaaaaagtttgaagcttttcagaggcaagtgcatgaatgtcttacacagttggagcttattaacaagcagtaccggcggttagccagagagaaccgtactgacagtgcttgttcactgaagcaaatggtccacgagggaaatcagaggtgggataacctgcaaaagagagttacgagtattttgcggcggctgaaacactttatcggacagagagaagaattcgaaacagcacgggactctatcctggtctggttgactgagatggacctacaactcaccaacattgagcatttttcggaatgtgatgtgcaggcaaaaattaagcagttaaaggctttccagcaagagatcagcttgaatcacaataaaattgagcagatcatcgctcagggggagcagcttatcgaaaagagcgagcccctagacgcagccattattgaagaggagcttgatgaactgcggcgttactgtcaggaggtgttcggtcgtgttgaaaggtaccataagaaactgatcaggcttccgctaccagacgacgagcatgacctttctgaccgggagctcgagcttgaagacagcgccgccttatccgatttgcactggcatgatcggagcgctgattcccttctaagcccccagccgtcttccaatcttagcctgtctctggcccagccgttgcggtccgagagaagcggaagggacacaccagcaagcgtcgatagtatccccctggagtgggaccacgattacgatttgtcccgcgatctggagagtgcaatgtctagagccctccccagtgaggatgaggaggggcaggatgataaagacttttacctccgcggtgccgttggactgtccggagatcactctgcccttgagtctcagatccgccaactgggaaaagccctcgatgactcaaggtttcagatccaacagactgagaatattatccgttctaagactccgacgggacccgaactggacacctcttataagggctatatgaaattactcggggaatgctccagcagtatagacagtgttaaacgactagaacataagttgaaagaggaggaggaatccctcccggggtttgtcaacctgcattcgaccgaaacccagacagcaggagtgattgatcggtgggaattattgcaggcccaagcactgtcaaaggagctaaggatgaaacaaaacctgcagaaatggcagcaatttaattcagatttaaattcaatctgggcctggctgggcgatactgaggaagagctcgaacagctccagcgcctcgaattgtcaaccgatattcagactatagagctccaaatcaaaaaactgaaggaactgcagaaagccgtcgatcataggaaggccataatcctgtcaatcaacctttgctcaccagaattcacgcaggcagattcaaaagagagccgggatttacaggaccgcctcagtcagatgaacggccgttgggaccgcgtgtgctctctccttgaagagtggaggggtttattacaggacgcattgatgcagtgtcagggtttccacgaaatgagtcacggtctactgctgatgctggagaatatcgatagaagaaaaaatgaaatcgtgcctatcgatagcaaccttgatgctgagatcctgcaggaccaccacaagcagctgatgcagattaagcatgagctactggagtcacagctgcgtgtagccagcctgcaggatatgtcatgccagctgctggtcaatgcagagggaactgactgtcttgaggccaaagaaaaggtgcatgtaataggcaaccgactgaagctgcttctgaaagaggtgtctaggcatattaaggagctcgagaagctgttggacgtgagcagttcccagcaggatctgtcttcttggtcgagtgccgacgagttagacacatcaggaagtgtgtcccctacaagtggccgaagcacccctaaccgccagaaaactcccaggggtaagtgttccctcagccagcctggtcctagtgtttcatccccacactcacggagcacgaagggcggcagtgacagctccttgtcagagccaggacctggaaggtccggccggggctttctgtttcgagtcttgagggccgcactgcctctgcagttgctcctccttcttctaataggcctggcctgcctcgttcctatgtctgaggaggactatagctgcgccctgtccaataacttcgctcgcagctttcacccgatgctgaggtacacaaacggtccgccgccactgtag

SEQ ID NO: 135878 - DNA, 20475 bp, Artificial Sequence
  Description of Artificial Sequence: Synthetic coding sequence
atggccagcagccccgagctgcccactgaggacgaacagggctcttgggggatagacgacctgcacatttcactgcaggccgaacaggaagatacccagaaaaaagccttcacctgctggatcaattcccagcttgcaagacacacgtccccgtctgtgattagtgacttattcaccgacattaagaagggacacgtcctgctagatcttctggaggtcctctctgggcagcagctcccaagagataaggggtccaatactttccaatgcaggattaatattgaacacgcactgacttttttacgtaaccgttctattaagcttataaatatccacgtgacagacattattgacggaaaccctagcatcatcttgggccttatatggaccattattttgcacttccatattgaaaaactggcgcaaactctgtcatgcaattacaatcagcccagcctggacgacgtgtccgtggtggattcttccccggcttctagcccccctgccaagaagtgtagcaaggtccaggccaggtggcagatgtctgcccggaaggccctgctcctgtgggcccaggaacagtgcgccacatacgaatctgtgaatgttactgactttaagtcctcctggcgcaatggcatggcgtttttagcaatcatacatgccctccggcctgacctgatcgatatgaaaagcgttaaacatcgttcaaacaaggacaacctacgggaggcattccggattgctgaacaagaactaaaaatcccacgcctgctggaacctgaggacgtggatgtggtggatccagatgaaaaaagtatcatgacatatgtggcccagttccttcaatactcgaaagacgctcctggaaccggcgaagaggcgcaaggtaaggtgaaggacgccatgggatggctcaccctgcagaaggaaaaattgcagaagctcctgaaagactctgaaaatgatacgtactttaaaaaatataatagcctgctttcattcatggagtcattcaacgaggaaaagaaaagctttctggatgtgttgtccattaagcgcgacctagacgagctggacaaggaccacctgcagctacgcgaggcctgggatggactggatcatcagattaatgcctggaagatcaaactaaactatgcacttccacctccattgcaccagaccgaggcatggttgcaggaggtggaagaactgatggatgaggatcttagtgccagccaggaccactcgcaagcagttaccctgattcaggaaaagatgactcttttcaagtcacttatggaccggttcgagcaccactccaatattctgcttacttttgaaaacaaggacgagaaccacttgcccctggtgcctccaaacaaactggaagagatgaagagacgaattaataacatactggaaaagaagttcatccttctgcttgaattccattactataagtgtctggtgcttgggctcgtggacgaggtgaagtctaaactggacatttggaatatcaaatatgggtctcgggaaagcgtcgagcttttattggaagactggcacaagttcatagaagagaaggagtttctcgcccgcttggacacaagcttccagaagtgtggggagatttacaaaaacctggccggtgagtgccaaaatataaataaacagtatatgatggtgaagagcgatgtctgtatgtatcggaaaaacatctacaacgttaaatccacattacagaaagttctggcatgctgggccacttacgtggaaaatctacggcttctgcgggcttgtttcgaggagactaagaaggaggaaattaaagaagttccatttgagaccctcgcacagtggaaccttgaacacgctaccctcaacgaagccggtaatttcctcgtcgaggtgagcaatgacgtagttggatcgagcatcagtaaggaactgcgtaggctgaacaagcgctggcggaaactggtcagtaaaacccagctcgagatgaatctccctctgatgatcaagaaacaagatcaacccaccttcgataattcgggaaatattctttctaaagaagaaaaggctactgtggagtttagtactgatatgtcagtcgaacttcccgagaattacaatcaaaacatcaaggctggggaaaagcacgagaaagaaaacgaggagttcacaggccagctgaaggtggctaaagacgtggagaaacttatcggccaggtcgaaatttgggaagctgaggccaagtccgttctggatcaggacgatgtggacactagcatggaggagtcgctgaaacatttaattgctaagggttctatgttcgacgaactaatggctagaagtgaggatatgcttcagatggacatccagaatatctcctcacaggaatctttccaacacgtgcttactactggactgcaggctaaaattcaggaggccaaggaaaaggtacagattaatgtagtgaagctcatcgctgccctgaagaacctgactgatgtttcccccgatttagacataagattgaaaatggaagagtcccagaaggaactggaaagctatatgatgagagcccaacagcttttggggcagcgcgaaagcccgggcgaacttatttctaagcacaaagaagctcttatcattagtaacacaaaatccttggccaagtaccttaaggctgttgaggagttgaaaaacaatgtaactgaggacatcaaaatgtccttagaagaaaagagccgagatgtgtgcgctaaatgggagtctctgcaccacgaactgtcattatacgtccaacaactgaaaattgacatcgagaagggcaaactttccgacaatatattgaagctcgaaaagcagatcaacaaggagaagaaattgattaggagagggcgaaccaaaggacttatcaaggagcacgaggcctgtttctccgaagaagggtgtctgtaccagctgaaccatcatatggaggtactgcgggagctctgcgaagaattgccaagccagaaatcgcaacaggaggtgaagcgattactgaaggattacgagcagaagatagaacgcttgctgaaatgcgccagcgagatccacatgacattacagcctaccgccgggggcacgagcaaaaacgagggcaccatcacgacgagcgagaaccgtggcggtgacccccattccgaagctcctttcgctaagagcgataatcagccaagcaccgagaaggcaatggaacctaccatgaagttcagcctggcctcagtgctcaggcctctgcaggaggaatctatcatggaaaaagactactccgccagcatcaacagcctgctggagcgttatgacacctacagggatatcctggaacaccacctccagaacaacaagtttaggattacctcagatttttcctccgaagaggaccgcagttcttcatgcctgcaggccaaacttacagatcttcaggttattaaaaatgagacagacgcaaggtggaaagaatttgaaattatctcacttaaactggaaaatcatgtgaatgacatcaaaaagccattcgtgatcaaggagagggatactcttaaagaaagagaaagagaactccagatgaccctcaatacaaggatggagtctctggaaactgctctgcggctagtactgccggtcgaaaaggcctctctgctgttatgtggatcagacctgccgcttcataagatggcaattcagggtttccatctgatcgacgcagataggatatatcagcacctcagaaacatccaggatagtattgctaaacaaatcgaaatctgcaatcggctggaggaaccaggcaatttcgtcctaaaggaactgcatccgttcgacctgcacgccatgcagaacatcattctgaaatataagactcaattcgaagggatgaatcatagagtccagaggagtgaggataccctgaaggcgttggaagattttctggcatccttgagaacagcaaagttgtccgcagaacccgttaccgatctctccgcgtcagacacacaggtcgctcaggagaacacactgaccgttaaaaacaaagaaggagagatccacttgatgaaagataaagcaaaacacctggataagtgcctgaagatgctggacatgagctttaaggatgctgagaggggcgatgataccagttgcgaaaacttgctcgacgcgttctccattaagctctctgagacccacggatacggtgtgcaagaagagtttactgaggagaacaagttactggaggcctgcatttttaaaaacaacgaactgctaaagaacatccaggatgtgcagagccaaatctcaaagatcggtctgaaagaccccacggttccagccgtaaaacacaggaaaaaatcactcattcgcctggataaagtactcgacgagtatgaggaggaaaagcgtcacctgcaggagatggccaacagtttaccccatttcaaagacgggcgcgagaagacagttaaccagcagtgtcagaataccgtggttctgtgggagaataccaaggcacttgttactgaatgtctcgagcagtgtggaagagtcctggaactgctgaaacagtaccagaactttaaatcgatccttaccactctcatccaaaaagaggagtctgtgattagtttgcaggcaagctatatggggaaggaaaacttaaagaagcggatcgccgagatagagattgtaaaggaggagttcaatgagcacctggaggttgtcgataagattaaccaggtgtgtaagaatctccaattctacctcaataaaatgaagaccttcgaagagccgccctttgagaaggaagccaatataatcgtcgacagatggctcgatatcaacgaaaaaaccgaagactactatgaaaatctgggaagggccttggccttatgggacaaactatttaatctgaagaacgtcatcgacgaatggacagaaaaggccctgcagaaaatggagttgcaccagctcaccgaggaagacagagagagacttaaggaggaactgcaagtccacgaacagaaaactagcgagtttagccggcgggtggctgagatccagttcctactgcagagctcagagattccgcttgagctgcaggtaatggagagcagtatcctaaacaaaatggagcacgtccagaagtgcctcaccggcgagtctaactgccacgcgctcagcggttcgaccgccgagcttagggaagatctggaccaggctaaaacacagattggcatgaccgaatccctgctcaaagcattatccccctctgattctcttgaaattttcacaaagctcgaagagatccagcagcagattctgcaacaaaagcattctatgatcttactggagaaccaaataggatgcctgactcccgagctgagtgaactgaaaaaacagtacgagtccgtgtctgatctcttcaacacaaagaaatcagtccttcaggatcacttctccaaactgctgaatgatcaatgtaagaatttcaatgactggttcagtaatataaaagtgaacttgaaggagtgcttcgagtcaagcgaaacgaagaagtctgttgagcagaagctgcagaagctatcagacttcttgaccctcgagggtcgtaactcaaaaataaaacaggtcgatagcgtcctgaagcacgtaaaaaaacatctgccaaaggcccatgtgaaggagctaatatcttggctggtagggcaagagttcgagctagagaagatggaatccatttgtcaggcccgtgctaaagagctggaagatagcctccagcagcttctgagattgcaggatgatcacagaaacctgcgcaaatggttaacaaaccaggaggagaaatggaaaggcatggaagaaccaggagaaaaaactgagctgttctgccaggccctcgcaagaaaacgggagcagttcgagtccgtggcccagctcaataactctctgaaagagtacggctttaccgaggaagaggaaataattatggaagcaacctgtcttatggaccgttaccaaacactgctgagacagttgtccgaaattgaagaggaggacaagttgctgccaacagaagatcaaagttttaatgatctggcccacgatgtgattcactggatcaaagaaattaaggagagcctcatggtgctcaatagctctgagggtaagatgccattagaagagagaatccagaagatcaaagagatcatcctcctgaagccagagggcgacgccaggattgagacaatcatgaaacaggcagagtcatctgaagccccactagtgcagaaaaccctcacagatatcagcaatcagtgggacaacactctgcatctggcctctacttaccttagtcaccaggagaagctgctcctcgaaggcgaaaagtacttgcaatccaaggaggacctgcggctgatgctaatcgagctgaaaaaaaagcaggaagccggatttgctctacaacacggcctacaggaaaagaaggctcagctcaaaatctacaagaagttcctgaagaaagcacaggacctgacttcactgctgaaagagctgaaatctcagggaaactatctgctggagtgcacgaaaaacccatccttttcagaggagccatggctcgagatcaagcatcttcatgaaagcctgctccagcagttgcaggacagcgtgcaaaatctggatgggcatgtacgcgagcatgacagttaccaagtctgcgtgaccgacctcaacaccaccctggataattttagtaaagagttcgtttccttctctgacaagccagtggaccagatcgcggttgaagagaaacttcaaaagcttcaggaactggaaaacaggctatccttgcaggatggcacactgaaaaaaatcctagctcttgcaaaatctgtcaagcaaaatacatcaagcgtgggtcagaagattattaaggatgacattaaatcactccagtgcaagcaaaaggatctggagaatcgacttgcttcagcgaagcaggagatggaatgctgcctgaacagtattctcaaatcgaaaaggagcaccgagaaaaaaggcaagttcacattgccagggagggaaaagcaagcaacatccgatgtacaggaaagcacccaagaatcagccgcagttgagaagttggaggaggattgggaaatcaacaagaactttgttgagaatgtcatggccgttagcaagaactgtcatcacagcatgtacatcttcgaaagcatcgttaagaactttatatctgacgagatgcaagatagcgctgtagagatggctatgtcgaaacagctctcacttaacgcacaggaatccatgaagaatacagaggacgagagaaaggttaatgaactgcaaaaccagcccctggagctcgacaccatgctaagaaatgagcagcttgaggaaatcgagaaattgtacacccagctggaagcaaagaaagccgctattaagcccctggagcagaccgaatgtctgaacaagactgagacaggtgcactggttctgcataacatcggctactctgctcagcatctggacaacttactgcaggcgcttattaccctcaaaaagaataaggaatcccagtattgtgtgctgagggactttcaggagtatctcgctgccgttgaatcctcaatgaaggcccttctcacagataaagaaagtctcaaagttggccccctggattccgtcacctacctggataaaatcaagaagtttatcgctagcatagagaaagagaaggacagtctcggtaatcttaaaatcaagtgggaaaacttgagcaatcacgtgacagacatggacaagaaattgctcgagagccagataaaacagttggagcatgggtgggaacaagtcgaacaacagatccagaaaaagtactcgcagcaggtcgttgaatacgatgagttcactactctgatgaataaggtgcaggacaccgaaatcagcctccagcaacagcagcagcatctccagctccggctcaaatctcccgaagagagggcagggaaccaatccatgattgctctgaccactgatctgcaggccactaaacatggcttctccgttctgaagggtcaggccgaacttcaaatgaaacgcatctggggcgaaaaggagaagaagaacttggaggacggcatcaacaatctgaagaagcaatgggagactctggaacccctgcatctggaggctgagaaccagatcaagaaatgtgacattagaaataaaatgaaggaaaccatcctttgggcgaaaaacctactaggcgagctgaatccttccattccactgctgcccgatgacatcctatcacagattaggaagtgcaaggtcacacatgacggtatcctcgcacggcaacaaagtgtcgaatcactggcggaagaggtgaaggataaagttccaagcctcacaacctatgaggggtccgacctaaataatacactggaggatctccggaaccagtatcagatgctcgtacttaagtcgacgcaacggtcacagcagctggagttcaagctggaggagcgctcaaacttttttgcaattataaggaagtttcagttgatggtacaggaaagcgagacgctaatcatcccaagggtggaaaccgccgctactgaggctgagctgaagcaccatcatgttactctggaagcaagccagaaggagctgcaggagatcgactctggaatttccacacacctccaggagctcaccaatatatatgaagaattaaacgtgtttgagcgcctgttcttggaggaccagctcaaaaacctaaaaatcaggaccaacaggattcagcgcttcatccagaacacctgtaatgaggttgagcataaaattaagttttgccggcagtttcatgagaaaacgtccgcattacaagaggaagcagatagcatccaacggaatgagctgctcttgaaccaggaagtgaataaaggtgtgaaagaagagatctacaacctgaaggaccggcttacagcgataaaatgctgcatcctgcaggtgctgaaactgaaaaaagtcttcgactatattggtctgaattgggatttctcgcagctggatcagttgcagacacaggtgttcgaaaaggaaaaggagcttgaagaaaaaattaagcagttagacacattcgaggaggagcacggtaaatatcaggcgttgctgtctaaaatgagggcaattgatctgcagatcaagaaaatgacggaggtcgtattgaaggcaccggactcatcacctgaatctcgtagactgaatgcacagatattgtcccaacgcattgaaaaggccaaatgtctgtgcgacgagattattaaaaagctcaatgagaataagacgttcgatgatagctttaaagaaaaggagattctgcagatcaagttaaacgccgaggagaacgacaaactttacaaggtgttacaaaacatggtgttggagcttagccccaaagaactggatgaaaagaattgccaagataaattggaaacttcattacacgtgctgaaccagatcaaatcgcagctgcagcagcctctgctgatcaatcttgaaatcaaacacatacagaacgaaaaggacaactgtgaggcttttcaggagcaggtgtgggccgaaatgtgtagtatcaaggctgtaactgctattgagaagcaaagagaggagaactccagcgaggcctctgacgtggagacaaagttacgtgagttcgaggatctacagatgcaactgaatacatcaatcgacctgagaacaaatgtgcttaatgatgcctacgaaaatcttaccaggtacaaggaagctgtcacacgcgcagtggagagcatcacatcgcttgaggcaattatcattccctaccgcgtagacgtcggaaaccccgaggaaagtttggaaatgcccctacggaagcaggaggagctcgaaagtaccgttgcccatatccaagatttgacggagaagctggggatgatctcgtccccagaagccaagttacagttacagtatactttgcaggagctcgttagcaaaaactctgcgatgaaagaagcctttaaggcgcaagaaactgaggccgagaggtacctcgagaattacaaatgctataggaaaatggaagaggatatatacaccaacctcagcaaaatggagacagtcctggggcagtccatgtctagccttcccttaagttacagggaggccctcgagcggttagaacaatccaaagccctggtctccaacttgatctccaccaaggaggagttgatgaagttgagacagattctgcggctgctgagattacggtgcaccgagaatgacggaatctgcctacttaagattgtctcggctctctgggaaaagtggctgagcctgttagaagctgcaaaggagtgggaaatgtggtgcgaggagctcaagcaggaatggaagttcgtctccgaagaaatcgagcgtgaggccatcatcctcgacaatttgcaggaggaattgccggagatcagcaagacgaaagaggctgcaacaactgaggaactcagtgagttgttggactgcctgtgccagtatggggagaacgtcgaaaagcagcagctgttacttaccctgctgctacaaagaattagatccattcagaacgtgcctgaatctagtggggccgtcgagacggtgccagcatttcaggagataactagcatgaaggaaagatgcaacaagctgctccaaaaggtccagaagaacaaagaacttgtgcagactgaaattcaagagcgccacagtttcacaaaagaaatcattgccctcaagaatttctttcaacagaccactacctcgttccaaaacatggcctttcaggatcaccccgagaaatctgagcagtttgaagaactgcagtcaatacttaaaaagggaaaattgacctttgaaaatattatggagaagctacgaattaagtacagtgagatgtacacgattgtgccggctgagatcgagtctcaagtggaagagtgccgcaaagcactcgaagacattgatgaaaagatcagtaacgaagtgctgaagtcgagcccttcttacgccatgagacggaaaatcgaggagatcaataatggactccataacgtggaaaagatgctgcagcagaagtccaaaaacatcgaaaaagcgcaggaaatccaaaagaagatgtgggacgagctggatctctggcatagcaaactgaatgaattggactcggaggtgcaggacatagtcgaacaggaccccggccaggcccaggaatggatggataacctgatgattccgtttcagcagtatcagcaggtgtcccaaagagcagaatgccgcaccagtcagttgaacaaggcgaccgtgaaaatggaagagtattcagatctcctgaaatccacagaggcctggatcgagaacacctcccaccttctcgcgaaccccgccgattatgattctctccgcacactgtctcatcacgcctcaactgtccaaatggcacttgaggatagtgaacaaaaacacaacctactgcactctattttcatggatctcgaggatctttctattatctttgaaactgacgaactgacccagtctatccaggaactgtccaaccaagtaacagccttgcagcagaagattatggagtcgcttccccagattcagcggatggcggacgacgtcgtggctatcgagtcagaggtgaaatctatggagaagcgtgtgtccaaaattaaaaccatactactgtctaaagaaatctttgacttcagtcccgaggaacacctaaagcacggagaggttatactggaaaatatcagaccaatgaaaaagaccatcgccgagattgtaagctatcaggtggagttgaggctgccccagactggaatgaaacctctgccagtttttcagaggacaaatcagttgctccaagacatcaagttactcgagaatgttacacaagagcaaaatgagctcttgaaggttgttattaagcagacaaacgagtgggacgaagagatcgaaaacctgaagcagatattgaataactactccgcccaattctccctcgagcatatgtcacccgatcaggctgataagctgccccagctgcaaggagaaatcgagaggatggaaaagcagatcctctcgctgaatcagagaaaggaggatctcctggttgacctgaaggcaactgtcctaaacctgcaccagcacctcaaacaagagcaggagggtgtcgaacgcgatcgattaccagccgtcacaagcgaggagggaggggtggcagagagggatgcctcagagcgcaagctaaatcgtcggggcagcatgtcttacctcgctgctgttgaggaagaggtggaggaatcttctgtcaaatcagatcacgataaggatatggaggaagacagagcgtctagtagtagcggtactatcgtccaggaggcctatggaaagatatccactagcgacaactccatggcgcagattttgacaccggacagcttaaacaccgaacaaggtcccgagtgtagtcttcggccaaaccaaaccgaagaaggaactaccccgccaatcgaagctgacacactggactcctccgatgctcaagggggcctggaaccccgggtggagaagacccgcccagagccgactgaggtcctgcatgcgtgcaaaacccaggttgcggaattggagctgtggctgcagcaggctaacgtggcagtcgagcccgagaccctgaatgctgacatgcaacaggttctcgaacagcagttagtgggttgccaggccatgttaaccgagattgagcataaagtggcgttcctgctcgagacctgcaaggaccagggactgggagacaacggtgccacccagcatgaagccgaagcactctctcttaagctgaaaacggtaaagtgtaacttagagaaggttcaaatgatgctccaggagaaacacagcgaggaccagcaccctacaattctgaaaaaaagctcagagccagaacaccaagaagcgctgcagccagtgaaccttagtgagttggagagcatcgtcacagagcgaccccagttttcacgacagaaggacttccagcagcagcaggtgctggagctgaaacccatggaacaaaaggatttcattaagttcatagaatttaacgccaagaagatgtggccccagtactgtcaacacgataacgataccacccaggaaagttcagcccgataccccacaactgaggagctaaagacatatacaactcagctggaagatttgcggcaggaagcgagcaacctccagacccaagagaacatgactgaagaagcttacattaatctggacaaaaaactgtttgagttatttttgactctgtcccaatgtctaagctctgtcgaggaaatgctagagatgccaaggctctaccgtgaggatggcagtgggcagcaagtacactacgaaaccctcgctctggaactcaaaaagctttacttggcactgtctgataagaaaggcgacctgctgaaagcaatgacatggcccggcgagaatacaaatcttctattggagtgctttgacaatctgcaagtgtgtctggagcatacacaggccgccgccgtctgcaggtccaagagtctcaaagctgggctcgattacaatagatcttatcagaaggcggacgcatatactgtggagttggaaaacgccgagtctcgagttgcaaaattgagagatgagggagagcgcttacacctgccctatgcccttctgcaggaagtttacaaactcgaggacgtcttagacagtatgtggggaatgctccgagcgcggtataccgaactgtcttctcctttcgtcaccgaatcacagcaagacgcactgttacagggcatggtggaactggtcaaaatcggaaaggagaagctagctcatggccacttaaagcagaccaagtccaaagtggccctgcaggctcagatcgagaaccacaaggtgtttttccagaaactcgtcgccgacatgttactgatccaggcgtatagtgcaaagatactcccatctctgctccagaaccgcgagaccttctgggctgagcaggtgactgaggtgaaaatcctggaagaaaaatctcgccagtgtggtatgaagctccagtctcttctccagaaatgggaggagttcgacgagaattacgcctcactagaaaaagacctggaaattttgatcagtaccctcccaagtgtcagcctagtggaagagactgaggagcgactggtggagcgcatatctttctatcagcagattaagaggaatatcggtggcaaacatgcccgcctttaccagactctgaatgagggcaaacaattagttgcttcagtgtcttgcccagagttggagggacagattgccaagcttgaggagcaatggttgtcactaaataagaaaatagaccatgagctgcacagacttcaggctctccttaaacacttactgcgatcagccttcctgggggtgtacaatcgcgatagcgatcagcttaccaagtggctggagtcaagccaacacacactgaactattggaaggaacaatcactgaacgtttctcaggacctggataccatccgatcgaatattaataacttctttgaattcagtaaggaggtggatgagaaatcttccctgaagactgccgtgatatcgattggaaaccaactccttcatttaaaagagaccgatacagcgacactgcgggccagcctggctcagtttgaacagaaatggaccatgctgattacccaactgcccgacattcaggagaaactgcatcagcttcagatggaaaagctcccgagccgcaaggcaattacagaaatgatctcctggatgaacaatgtggagcaccaaacgagcgacgaggattctgttcactccccgtcttctgccagtcaagttaaacatcttctccagaagcacaaagaattcaggatggagatggactataagcagtggatagtggattttgtgaaccagagcctcctccagttgagcacctgtgatgtcgaatccaagcgatacgagcggactgaattcgctgagcatctcggagaaatgaatagacagtggcatcgggtgcacggcatgctgaataggaagatccagcacttggagcaactgttggagtccatcactgagagcgaaaataaaatccagattttaaacaattggttggaggcccaggaggaaagactgaaaacgttgcaaaagcccgagtcggtgatatctgtgcaaaagctgctcctggactgtcaagacattgagaaccagttagctataaagagtaaagccttggatgagctgaaacagtcctatttgactctcgaatccggagcagtccctttactggaggacactgccagtagaatcgacgaattatttcagaagaggagttcagtgctcacgcaggttaaccagctcaaaacatcaatgcaatcagtgctgcaggagtggaaaatctatgaccagctgtatgacgaggtgaatatgatgacaataagattctggtattgcatggagcactcaaaacctgtggttctgtctctcgaaactctgcgttgtcaagtggaaaacctgcagtctttgcaggacgaagccgagtccagcgagggctcgtgggaaaagttgcaggaggttatcgggaaactgaagggactgtgtccatccgttgccgaaattatagaggaaaaatgccagaacactcataagaggtggactcaggtcaatcaagccatcgccgaccaactccaaaaggcccagagcctccttcaactatggaaggcatactctaacgcacatggtgaagcagccgccagactaaagcaacaggaggccaagtttcaacagttagccaacatctcaatgagcggcaataacctcgcggagattcttcccccagccttacaggatataaaagagctgcaacacgatgtgcagaagaccaaagaagctttccttcaaaactcatcagttttggatagattgcctcagcccgcagagtctagtacacatatgctattaccgggaccactgcactcactccagcgcgctgcctatttggagaaaatgctgctagtgaaggcaaacgaatttgagaatcacgttctggcccttaccgctcagtctcccgacattgagcaccttaatgaggtctccctcaaactgcccctgtctgacgtagccgtgaagacgctgcagaacatgaacagacaatggatccgggccactgccacggctctggagagatgttccgagttacaggggatcggccttaacgagaaattcctttactgttgtgagaaatggatccagctgctagagaagattgaggaagctcttaaagtggacgtagcaaattctctcccagaattactagagcaacagaaaacttacaagatgctcgaggccgaggtcagcataaatcaaacaatagccgacagctacgttacgcagagcctccaactgctagacaccacagagattgagaatcgacctgaattcattaccgagttcagcaaattgactgatcgctggcagaacgcggtgcagggagtcagacagagaaaaggtgatgtggatggactgaatgctcacgtggctaggtgtgggggggccagtctgaagaagcaggatctgcggtactccctgcataccgcatgtggagcggccctgttatgcagatcaagtcatggagcgaataaagaaatacactttcagaggcggagaaccacttgtgctctgaccctcgaagccggagaaaagctattactgacaacagatctgaaaaccaaagagagtgtgggcaggagaattagccagctgcaagacagctggaaggatatggaaccacagctggctgagatgattaaacagttccagagcaccgtggaaacctgggatcagtgcgaaaaaaagataaaagagctgaagagccggctgcaggtgctgaaagcccagtccgaagatcccttacccgagcttcacgaggacctgcacaacgaaaaggagttgattaaagttgctatccgaaaacaagaaatcgaggacagattgaatacatgggtggttttcaatgagaagaataaggagttgtgtgcctggttggtccagatggaaaataaggttctgcagaccgctgatattagcatagaggaaatgatcgagaagctccagaagagaacagttggccgcgaagaggtgcccgaaaggtgggaatgcgagacaatcgtgtcggggcatggcaccgaggaatcttgcttcctgtcaattcggaaattccaccagggccgcggcctgcacatactcacctgccagcttatcccacaggattgtatggaggaaattaacttgtttagcgagaacaagttgcaattaaaacagatgggtgaccagctgatcaaggcttccaataagagccgcgctgccgagatcgacgacaaattgaacaagatcaacgatagatggcagcatcttttcgacgtcatcggcagcagtatggccgatcaaacaaacagtaggtggatgttttttcagtggccaagaggaatccaacgaaccgtaacctggccctgggaccacctgtgttcatgtgcgtccaccggacacactgggcctttccattctagtgtcttgcgctgctttgagcagcacatcgagtttggtatttataggaggacctacaaggtgaacaaggagctaggtggggacaagaatggccagagatgtccaattatctatccgcatgggctggtgcagtgtatccggttgggggagcccttgatactgaaaagggtaaagaagctgaaggagacattcgccttcatccagcagttggataagaatatgagcaacctgcgcacctggctggcgagaatcgaatctgaactgagcaaacctgtagtttatgatgtatgtgatgatcaagagattcagaagcgcctggccgaacagcaggaccttcagcgtgatatcgagcagcatagtgccggtgtcgaatcagtgtttaatatttgcgatgtgctcttgcatgatagtgatgcatgcgcaaatgagactgagtgcgattctatccagcagactacccggtccctggaccgcagatggcgcaatatctgcgctatgtcaatggagaggaggatgaagattgaggaaacttggaggctctggcagaagtttttagatgattatagcagattcgaggattggctcaagtccgctgagcggactgccgcctgcccaaattcctccgaggtcttatatacgtcagcaaaggaagaattgaagagattcgagcggcaaatccatgagcggctgacacagctagagcttataaataagcagtataggaggctggcaagggagaatcgaacagatacggccagcagactgaagcagatggttcacgaaggcaatcagcgctgggataatctgcagagaagagtgacagccgtgcttcgaaggctgcgtcacttcaccaatcagcgagaagagtttgaggggacgcgcgaatcgatactcgtgtggctaaccgaaatggacctgcagctaacaaatgttgagcatttctccgaaagcgacgccgacgataagatgcggcagcttaatggcttccagcaagagattacgctcaatacaaataaaattgaccagctgattgtgtttggagagcagttgattcagaaaagtgagcccctggacgcagtactcatcgaggacgagcttgaagagttgcatcgttattgtcaggaaggcttggaagacgagaaggaagctagtgaaaacgaaacggatatggaagacccgcgagaaatccagaccgatagttggcgcaagcgtggagagagcgaagagccttcgtcccctcagagcttgtgtcacctggttgcccctggacatgagcgatccggctgcgagacgcccgtgagcgtggattctattccactcgaatgggaccatacaggtgatgtggggggaagctctagccatgaggaagacgaggagggtccttattatagcgctctatcaggaaagagtatcagcgatggccattcgtggcatgtgcctgactccccctcctgcccggagcatcattacaaacagatggaaggcgatcggaatgtgccacctgtgcctcctgcatccagtactccctataaacctccatatgtttcccttaacttcactggctctactgcgtatgtgtgcgcctttgatcgatgggagatgatacaggctcaggagttacataacaaacttaagatcaaacagaacctgcagcagctaaactccgacatctccgccatcacaacgtggttaaaaaaaacagaggcggagctggagatgctcaaaatggctaaaccgcctagtgatattcaggagatcgaactcagggtcaagagactccaggaaattttgaaggccttcgatacttataaggccttagtggtttctgtaaacgtgtcctcaaaggaatttctgcagaccgagtcccccgaatctactgagctgcagtctcggctgaggcagttgtccctgctgtgggaggcagcacagggtgccgtggactcctggaggggagggctcagacaaagcctcatgcagtgtcaggatttccaccagctgagccagaatctcttgttgtggcttgcgagtgctaagaataggcggcaaaaggcccatgtcactgatcccaaggccgatccacgggcccttctggagtgtcggagggagctgatgcagcttgagaaagagctggtagagcggcaaccgcaggttgacatgctacaggaaatcagcaactcactgctgataaaagggcatggtgaggactgtatcgaggctgaggagaaggtacatgtgatcgagaaaaaactcaaacagcttcgcgaacaggtcagccaggatcttatggctctccaaggtacccagaatcctgctagcccactcccatcctttgacgaagtcgattccggagaccagccaccggccacctctgttcctgccccaagagcaaagttcttatatccagcagtccagagcagcgagaattatcggcgccgaggtggcgatcgagagcagggaccaagacagcatacggctaccgcactgttgcctctaaaggggggtcccggaagcccaaccccagccgctgctcctcctgccgcagctgcacctggtctccctgccgcgttgctgcgaagaaggttgcagctgcactctggccagcagctttgtcccgttttgctgccccatgcggaggtgcaccagtgggccactccacacatcgagggtatcgcaggtcattcggctactcccccagcctag

SEQ ID NO: 135879 - DNA, 20658 bp, Artificial Sequence
  Description of Artificial Sequence: Synthetic coding sequence
atggcgtcttcccctgagctccctaccgaggacgagcaaggatcttggggtattgatgacctgcatattagcttacaagccgagcaggaggacacccagaagaaagcctttacatgctggattaacagtcagctcgctaggcatacttcccccagtgtgatctccgacctgtttacggatatcaaaaagggacacgttctcctcgatctgctcgaggtgttgagcggccagcaattgcctcgcgacaagggctctaataccttccagtgtcggattaatattgagcatgctctcacgtttcttcggaataggagtattaagctgattaacatacacgtgaccgatatcattgacggtaatcctagcatcatcttgggcctaatttggactatcatactacatttccacatagaaaaactcgcccaaacgcttagctgcaattataaccagcccagccttgacgatgtatcagtggtcgacagtagccccgcttcaagcccaccagctaagaagtgttccaaggtgcaggccagatggcaaatgtccgccaggaaggccctcctcctttgggcccaagaacagtgcgctacatacgaatcggtgaacgttacagatttcaagagctcatggcgaaacggtatggctttcctcgcaatcatacatgctctgcgccccgacttgattgatatgaagtcggtgaaacacagatccaacaaggataacctgagagaggcttttcggattgccgagcaggagctcaaaatccccagactcctcgaacctgaggacgttgatgttgtggaccccgatgagaagagtattatgacatacgtcgcacagtttctgcaatattcaaaggacgctcctggaacgggagaggaagctcagggcaaagtgaaggatgcaatggggtggcttaccctccagaaagaaaagctccaaaagttgctgaaagactccgaaaatgacacatacttcaagaagtacaactccctcttaagcttcatggagtcctttaatgaggaaaagaaaagttttctggatgttctgtccatcaagcgggacctcgatgagctggacaaggatcaccttcagctacgggaggcctgggatggactggatcaccagattaacgcctggaagattaagctcaattatgctttgcctccaccactgcaccagacagaggcctggcttcaggaggtggaggagcttatggacgaggacctgagcgcttcccaagaccactcacaggccgttactcttattcaggagaagatgactctgttcaagagcctcatggaccgatttgaacatcactccaatatcctgctgacctttgagaacaaggatgagaaccatctgcctttggtccctcccaacaagcttgaggaaatgaagcgcagaataaacaacatacttgagaaaaagtttattctgcttctcgaatttcactattataagtgtctcgtgcttgggctggtggacgaggtcaagtcgaagctcgatatatggaacataaagtacgggagccgtgagagcgtggagttgctcctggaagactggcacaagtttatcgaagagaaggagttcctagcacggctggacacaagttttcagaagtgtggggaaatatataagaatttagccggcgaatgccagaacataaacaaacaatatatgatggtcaagagtgatgtttgcatgtacagaaaaaacatctataatgttaaatctacccttcagaaggtactcgcttgctgggcaacttacgtcgagaacttacgattgctccgggcttgtttcgaggagacaaagaaagaggaaattaaggaagtgcccttcgaaacgctagcgcaatggaatctcgagcacgcaactttaaatgaggctgggaatttcctggtggaagtatccaacgatgtcgtaggctcatctatttccaaagagttgagacggctgaataaacggtggagaaaactggtatcaaagactcagctggagatgaatctccccctcatgatcaagaagcaagatcagcccaccttcgacaacagtggtaatatcctatccaaagaagaaaaagcaactgttgagttctctacagacatgagcgtggaactgcctgagaactataatcaaaatattaaagctggggagaagcacgagaaagaaaatgaggaattcacaggacagctcaaggtggcaaaagacgtcgagaagctcattggtcaggtggaaatatgggaagcagaggccaagtccgtgctagaccaagacgatgtggatacctcaatggaggagtctttaaagcatcttatcgccaaaggatctatgttcgacgagctcatggccaggtctgaggacatgctccagatggacattcagaacatcagcagtcaggagagctttcaacatgtgcttaccaccggccttcaggccaagattcaagaagcaaaagagaaggttcagattaacgtggtaaagctgatagcagctcttaaaaacctcacagatgtatctcctgatctggacatccgcctgaagatggaagagagccagaaggagcttgaatcttacatgatgcgtgcccagcagctcctcggccaaagggagagccccggagagctcatttccaagcacaaggaggctttgatcatctccaacacaaaaagtctggccaagtaccttaaagccgtggaagagctgaagaataacgtgaccgaggatattaagatgtcactggaggaaaagagtcgcgatgtttgtgctaaatgggagagcctccatcatgagttgtccctgtatgttcagcaactgaagattgatattgagaagggtaagctttctgataacattctgaagctcgagaagcagatcaataaagagaaaaagctcattaggcggggacggacgaaagggctgattaaggagcacgaggcctgtttcagtgaggaggggtgcctgtatcagttgaaccaccacatggaggtgctgagggaactgtgcgaagagttaccatcccagaagagccagcaagaagttaaacgcctcctgaaggattacgaacagaaaatagagcgccttctcaagtgcgccagcgagatccacatgacgttgcagcccactgcaggcggcacaagcaaaaacgagggaaccatcaccacatccgaaaaccgcgggggcgatccacactctgaggccccatttgctaagtcagacaaccagcctagtacggaaaaagcaatggaaccaactatgaagttcagcttggcctcagtcctgagacctttgcaggaagaatccataatggagaaggactactctgccagcattaacagtcttttggagcgttacgacacctatagagatatactggaacaccacctgcaaaacaataaatttcggatcacttctgacttctccagcgaagaggaccgatcatcaagctgtttgcaagccaagcttacagacctgcaggtaatcaagaacgaaacagacgcccgttggaaggagtttgagattatcagcctgaagctcgaaaaccacgtaaacgatataaagaagccgttcgtgattaaggaacgggatactctgaaggagcgagagcgtgaactgcagatgactcttaacacccggatggaaagcctggaaacggctttacggctggtgctgcccgtggaaaaagcatctctcctgctatgcggcagcgacctgcctctgcacaagatggctatccagggctttcaccttattgacgccgacaggatttatcagcatcttcgcaatatccaagactccattgccaagcagatagagatctgcaatagactggaggagccaggaaatttcgtgttgaaggaactgcatcccttcgacttgcacgcaatgcagaatatcatactgaagtacaaaacacagttcgagggcatgaaccatagagtgcagaggagcgaggacacacttaaggctctggaggatttccttgcctctttacggactgccaagcttagcgcagagcccgtgaccgacctgtctgcgagcgacactcaggtggcgcaggagaatacccttactgtgaaaaacaaagagggcgagattcacctgatgaaagacaaagccaaacacctagacaaatgcttaaaaatgcttgacatgtccttcaaggacgcagagagaggcgatgacacatcgtgtgagaacttacttgatgcttttagtataaagctcagtgagactcatgggtatggggtccaggaagaatttacagaggagaataaactgcttgaggcttgcatttttaaaaataatgaactgctgaagaacatccaggacgtccagtctcagatatccaagatcggtctgaaagacccaacagtcccagccgtgaaacatcggaaaaaaagtttgatacgccttgataaagtcctcgacgaatatgaggaagagaaacgacatctgcaggaaatggcaaactccctgcctcactttaaagacggccgcgagaagactgttaaccagcagtgccaaaataccgtggttctgtgggagaatacaaaggcattagtaacagagtgcctggagcagtgtggtcgagtgctcgagttgctgaagcagtatcaaaacttcaaatccatcctgaccaccctgatacagaaagaggaaagtgtgatttccttgcaggcctcatacatgggaaaggaaaacttaaagaaacggattgctgagatcgagatcgtcaaagaggaatttaacgagcacctcgaagtggtggataagatcaatcaggtgtgcaaaaacctccaattttatttaaacaaaatgaagacctttgaggagccccccttcgaaaaggaggcgaacatcatagtggaccgatggttggacatcaatgagaagacagaggattactacgaaaatctgggtagagctctggccctgtgggataagctgtttaaccttaaaaatgttatcgacgagtggactgaaaaagctcttcaaaagatggaactgcaccaactaaccgaggaagacagagaacgcctcaaagaagaattgcaggtgcacgagcaaaaaacttcagagttcagccgaagggttgcggaaatccagttcctgctccagagtagtgagatccccttggagctccaagttatggaatcatctattttaaacaaaatggagcacgttcagaagtgcctgactggagagtcgaactgtcacgcccttagcggcagtaccgcggagctgagagaggatctggaccaggccaagacacagatcgggatgactgagagcttgttgaaggcactgagtccatctgacagtctggaaatctttacaaagctggaagaaatacagcagcaaattctgcagcaaaagcactctatgatattgttggagaaccaaattggctgcctgacaccagaattgtcggagctgaagaagcagtacgagtcagtgagtgacctgttcaataccaaaaaatcagtgctgcaagatcacttctcaaagctcttgaatgaccaatgcaagaactttaacgactggttctccaatattaaggtgaacctaaaggaatgctttgaaagcagcgagactaagaagtcagtggagcagaagctgcagaaactcagcgacttcctgacactcgagggtcgcaactccaaaatcaagcaagtagattctgtgttgaagcatgtgaaaaaacacctgcctaaagcccatgtgaaagagcttatcagctggctcgttgggcaggagttcgagctggagaaaatggagtctatatgccaggcgcgagctaaggagctagaagactccttacagcagctgctaaggctccaggatgatcaccgaaatctgagaaagtggctgacgaatcaggaagaaaaatggaaggggatggaagaaccaggagagaagaccgagctgttctgccaggcattggctagaaagcgggagcagtttgaatccgtggctcaactgaataatagcctgaaggagtacggctttactgaggaagaggaaattatcatggaggcaacctgcttaatggatagataccagacactcctcaggcagctctccgaaattgaggaagaggataagctcttacctacggaggaccaatcctttaacgacttagcccatgatgtcatccattggataaaggagatcaaagaatcgctcatggtcctgaactcctcagaaggcaaaatgcccctcgaggagaggatacagaaaattaaggagattatcctgttgaaacctgagggggacgcccgtatcgagaccatcatgaagcaggctgaaagctccgaggcacccctggtccagaaaaccctgactgatatcagtaaccaatgggacaacacattacatttggcctcaacttatctgagtcaccaggaaaagttgctcttagagggagagaaatatcttcagtctaaagaagatctgcgcctgatgctgatcgaactgaaaaagaaacaagaagccggattcgctctgcaacatgggctccaagaaaaaaaagctcagctgaagatctacaagaagtttctgaagaaggcacaggacttgaccagcctattaaaggaacttaaaagccaaggtaattacctgctggagtgtactaagaatccctcttttagtgaagaaccatggcttgaaatcaaacacctgcatgagagcctgctgcaacagctgcaggattcggtgcagaacctggacggtcacgttagagaacacgactcttaccaggtttgcgttaccgacttgaatacgacactggacaacttttctaaagaattcgtcagcttctctgacaaaccggtagaccaaatagccgtggaagaaaaactccagaagttacaggagctggaaaataggctgtccctccaggacggcacactcaagaagattttagccctggccaaatcagtgaaacaaaacacatcgtcagtgggacaaaaaattataaaagatgacatcaagtcgttacagtgcaagcaaaaagatctggaaaacaggctggccagcgcaaagcaggaaatggagtgttgcctgaattccattcttaagagcaaaaggtcgactgaaaagaagggaaagtttactctgccaggaagagagaagcaggctacaagcgacgtacaggaatccacacaggagtctgcagccgtcgaaaaactcgaggaggactgggaaatcaacaaagattctgcagttgaaatggcaatgtctaagcaactgtctctgaacgctcaggaatccatgaaaaatacagaggatgaaaggaaggtcaacgaactgcaaaatcaacctctggagctggacacgatgctaagaaacgaacagctcgaggagatagagaaactttatacccagctagaggccaaaaaagctgcaataaaacctttagaacagactgagtgccttaataagactgagaccggcgcactcgttttacacaacatagggtacagcgcacagcacctggataatctgcttcaggcccttataaccttgaagaagaataaagagtctcagtactgtgttttacgtgacttccaagagtacttggcagccgtggaatcctccatgaaggcgcttctcactgataaagaatctctcaaggtcggccctctggattctgtgacatatttggataagatcaaaaaattcatagctagcatcgagaaggagaaggattcgctcgggaatctaaaaataaagtgggagaacctgagcaaccacgtgactgatatggacaaaaagctgctggaatcccagattaaacagctcgagcatgggtgggaacaggtggaacaacagattcagaaaaagtatagtcagcaggtggtcgaatatgacgagttcaccactctaatgaacaaggtgcaggacaccgagatttcactacagcagcagcagcaacacctacaacttaggttaaaatcccctgaggaacgtgctggaaatcagagtatgatagctttgacgactgacctacaggcgaccaagcatgggttctctgtgctaaagggacaggccgagctgcagatgaagaggatatggggcgagaaggagaagaagaacttagaagacgggatcaacaacttgaaaaagcaatgggagacactagagccgctgcacctggaggctgagaatcagatcaagaagtgcgacatccggaacaaaatgaaggagaccattctctgggctaaaaaccttctgggtgagctcaaccctagcattcccctgctgcccgatgacatactgagccagattagaaagtgcaaagttactcacgacggaatactggcaaggcagcagtcagtggaatctcttgcagaggaggtgaaagacaaagtgccttccctgacaacttatgaaggttccgaccttaacaataccctagaggacttacgcaatcagtaccaaatgttggtactgaaatctacccagcggtctcagcaattggaatttaagctcgaagaaaggtccaacttcttcgccataatcaggaagttccagctgatggtgcaggagtccgaaaccttgatcattcccagggtcgaaaccgccgcaactgaggccgagctgaagcaccatcacgttaccttggaagcaagtcagaaagaactgcaggaaattgatagcggcatcagtactcatcttcaggagcttaccaacatctatgaagaactgaatgtgttcgagcgactcttcctcgaggaccagctgaaaaatctgaagattcggacaaataggatccagagatttatccagaatacctgcaatgaggtggaacacaagataaagttttgtaggcagttccacgagaaaactagtgctttgcaggaggaagctgacagcattcaacgcaatgagctgcttcttaaccaggaggtcaacaaaggagtgaaggaggagatctataaccttaaagacaggctgaccgccatcaaatgttgcattcttcaagtcctgaagctaaagaaggttttcgattatataggattgaactgggatttctcacagctcgaccagctgcagacccaagtgtttgaaaaggaaaaagaattagaagaaaagataaagcagctcgatacatttgaggaggaacatggcaagtaccaggccctgctgagcaagatgcgggcaatcgacttgcaaattaagaagatgacagaagtcgtcctcaaagcgcctgactccagcccggagtcaaggcggcttaatgctcagatcctgagccaacggattgagaaggctaaatgcctgtgcgacgaaattatcaagaaactaaacgagaataagacctttgacgatagctttaaagaaaaagagatcctgcagatcaagttaaacgctgaggaaaacgacaagctttacaaagttctacagaacatggtactcgagctgagtcctaaggagctcgacgagaagaactgtcaggacaagctggagacgtctcttcacgttctaaatcaaatcaagtctcagctccagcagccccttctgataaacctggagatcaaacatattcagaatgaaaaagacaactgcgaggcgtttcaagaacaggtgtgggccgagatgtgcagcatcaaggccgtgacggcaattgagaagcagagagaggagaactcctctgaggcctccgacgttgagaccaagctaagggaattcgaagacctgcagatgcaacttaacacatccatcgacctcagaacgaacgtcctgaatgacgcctacgaaaatctgacaagatacaaagaggccgtcacaagggcagtggagtctatcacttctctagaggctattatcatcccctatcgcgtggatgtcggcaaccccgaagagagcctcgagatgccacttaggaagcaggaagagctggaatctacggtagcccacatccaggatctgaccgaaaaactgggtatgatatcttcacccgaagccaaactgcagctccaatacactctgcaggagctggtctccaagaactctgcaatgaaagaggccttcaaagcccaggaaaccgaggctgaaaggtatcttgagaattataaatgctatcgtaaaatggaagaggacatatatactaacttaagtaagatggagacagtgctcggccagagtatgtctagtttaccactgtcttaccgcgaagcgctcgaacgcctagagcaaagcaaagccctggtgtcgaaccttattagcactaaagaagaattgatgaagttacgtcagatcctaaggctgctgcgcctcagatgtaccgagaacgatggcatttgcctactgaagattgttagtgctctctgggagaaatggctcagcttgctggaggccgctaaagaatgggaaatgtggtgcgaagagctgaaacaggagtggaagtttgtaagcgaggagattgagcgcgaagcaatcatccttgacaatcttcaggaagaactgcctgagatctctaaaactaaagaggctgcaacaaccgaagaactgtccgagcttctcgattgcctgtgccagtacggcgaaaacgttgaaaagcaacagttgctgctcacattgttgctgcagcggattagaagcatacagaatgttcctgagtccagtggcgcggtagagactgtgcccgcctttcaggagattacgagtatgaaagagcgctgtaataaactactgcagaaggtgcagaagaacaaagagctggtccaaacagagattcaagaacggcattcattcaccaaggagataatagctctcaagaacttttttcagcagacaacaactagttttcagaatatggcttttcaggaccatccagagaagtctgaacagttcgaggagctgcagagcatccttaaaaagggcaagctcacttttgagaacatcatggaaaagcttcggatcaaatacagcgagatgtatacaatcgtgccagctgaaatcgagagtcaagtggaagaatgtaggaaagcacttgaagatattgacgaaaagatcagcaacgaggtgctgaagagtagcccttcgtacgccatgaggaggaagattgaggaaataaataatggcctgcataatgtggagaaaatgcttcagcagaagtccaagaatatcgaaaaggcacaggagatacaaaagaaaatgtgggacgagttggacttatggcactctaagctcaacgaactggattcggaggttcaggatattgtggaacaggaccctggacaagcccaggagtggatggataacctgatgatccccttccagcagtatcagcaggtgtcacagagagctgagtgtcggacaagtcaactcaacaaggccacagtcaaaatggaagagtacagcgatttactgaagtccacagaggcttggattgaaaatacaagccaccttctggctaatccagcagattatgacagcttaagaacgctctcccatcacgctagtaccgtccaaatggctcttgaggattccgaacagaagcacaacttgctgcattccatattcatggacctcgaagatctgagcattattttcgagacggacgagctcactcaatctatccaagaacttagtaaccaggtcaccgcactgcagcagaagatcatggaatcattacctcagatacaacggatggcggacgacgtcgtggcgatcgagtccgaagtaaagtctatggaaaaaagggtgtccaaaatcaaaacgatcctcctgtctaaagagatcttcgatttttcacccgaggaacacttgaagcatggcgaagtcatcctggaaaacatcaggcctatgaaaaaaactattgccgagatcgtgtcctaccaggttgagctccggctacctcagactggaatgaaacccctgcccgtcttccagagaaccaatcagctgctgcaggatattaagctgcttgagaacgttacgcaggagcagaatgagttactgaaggtggtgattaagcaaactaatgagtgggacgaggaaatcgagaacctgaagcaaatcctgaataactactccgcacagttctctctagaacacatgtcgcccgatcaggccgacaagttgccacagttgcagggcgaaatcgagagaatggaaaagcagatactttcccttaatcagagaaaggaggacctgctggtagaccttaaagccacagtgctcaacctccatcagcacctgaaacaagagcaggagggggtagaacgagacagactgcctgccgttacaagtgaggaggggggcgtcgccgagcgcgacgctagcgagaggaaactgaaccgcaggggttccatgagctatctggctgctgttgaggaggaagtggaggagtcctctgttaagagcgacaatggcgatgagaaggccgagccttctcctcagtcatggagcagtttgtggaagcacgataaagacatggaggaggaccgtgcgtcaagcagtagcgggactattgtccaggaggcttacggcaaaatcagcacaagcgataactctatggcgcagattctaacacccgattccctgaacaccgaacaggggccagagtgttcccttcgccccaatcagacggaggaaggcactacccctcccatagaggctgacaccctcgactcgagcgacgctcagggaggactggagccgagagtcgagaagacacggccagagcccacagaggtgctgcatgcatgtaagactcaggtcgcggagcttgaactgtggctgcagcaagctaacgtcgccgtagagcccgagacgctgaatgccgatatgcaacaagtgctggaacaacagttggtagggtgtcaggctatgttgacagaaatagagcacaaagttgcgttcctgcttgagacttgtaaagaccagggcctgggcgacaacggcgcgacccagcacgaagccgaggccctctctcttaaactgaagaccgtcaagtgtaacctggaaaaagttcaaatgatgctgcaggagaagcactccgaagatcagcatcctactatattaaaaaaatcctctgaacctgagcatcaggaagcactgcaaccagttaacctgtcagagcttgagagtattgtgacagagcgcccacagtttagccggcaaaaggatttccagcagcaacaggtattggagctgaaaccgatggaacagaaagactttatcaagttcatcgagtttaacgccaaaaagatgtggccacagtactgtcagcatgataacgatacaactcaggagtccagcgctagcaatcaggcttcgtcgcctgagaacgacgtgcccgactcaattttatcccctcagggacagaatggcgacaaatggcagtacttgcatcacgagttatcttcaaagatcaaactgccattgccacagttggtagagccacaggtgtccacaaacatgggtatccttcccagtgtaactatgtataactttcgataccccacgacagaggagttgaagacgtataccacccagctggaggacttgcggcaggaagctagcaacttgcaaactcaagaaaacatgaccgaagaggcctacatcaatctagacaagaagctgttcgaactatttctcacactgtctcaatgcctgtcatctgtggaggaaatgttagagatgcctagactctacagagaggatggctccggtcagcaggttcactacgagacactggctctggaactgaagaaactttatctggccctgtcagataagaaaggcgacctgctgaaagctatgacatggccgggcgagaatactaacctgctgctggaatgttttgacaacctgcaggtatgtttagaacatacgcaagcggcagccgtgtgccggtcaaagtcactgaaggcaggccttgactataaccggtcctatcagaacgaaatcaaaagactgtaccaccaactaattaagagcaagacctccctccagcagagcctcaatgaaatttccgggcagtccgtggctgagcaacttcaaaaggctgatgcttatacagtagaattggaaaacgctgaatctcgtgttgcgaaattgcgagacgagggggagaggctgcacctgccgtacgccctgctacaggaggtgtacaagctcgaggacgttctggacagcatgtggggtatgctccgggctcgatataccgagttatcttcgcccttcgtgacagagtctcagcaggacgcactgctgcagggcatggtggagctcgtgaaaattggcaaggaaaagcttgcgcatggtcatttgaaacaaacaaagagcaaggtggccctgcaggctcagatagagaaccacaaggtgttcttccagaaattagtcgcagacatgttgcttatacaggcttactcagccaaaatactgcccagtctgctgcagaatagggaaaccttctgggccgaacaagtgactgaggtcaagatcttagaagaaaagtcaagacagtgcggaatgaagctgcagagtcttctccaaaaatgggaggaatttgatgaaaactacgctagtctcgagaaggacctggaaatattaatatcaactctcccttccgtgtccctggtggaggagaccgaagaaagattggtcgaaagaatcagcttttaccagcagatcaaacggaatatcgggggcaagcacgctcgcctctaccagaccctgaatgaaggcaaacaacttgtggcttcagtttcatgcccagagctggaagggcagatcgctaaacttgaagagcagtggctcagtctcaataaaaagattgatcatgaactgcacaggttacaggcactgctgaaacatctgctttcatacaatcgtgactcagaccagctaaccaagtggttggaatccagccaacacacactcaactattggaaggaacagtcgctgaacgtgagccaagacctggatactataagatccaatattaacaatttcttcgagttctccaaggaggttgatgagaagtcaagcctgaagaccgccgtgatctcaatcgggaaccagctcttgcatctcaaggagaccgataccgccacgttgagggccagtttagcccagtttgagcagaagtggacgatgctgattactcagctgcccgatatccaggagaaattgcatcaactgcaaatggaaaaactgccttctaggaaggcgataacagagatgatcagctggatgaacaacgtggagcatcagacttcagacgaggactctgttcactcccccagttccgcaagtcaggtgaagcaccttctgcagaagcataaagaatttcgcatggagatggattacaagcagtggatcgttgactttgtgaatcaatctttgttgcagctcagcacttgtgacgtagaaagtaagagatacgagaggacagaattcgcagagcacctgggtgagatgaatcggcagtggcaccgggtgcacggaatgctgaacaggaaaattcagcatctggagcagctcttggagagcattacagagagcgagaacaaaatccagattctgaataattggctggaagctcaggaggaacgcctgaagactctgcagaaacccgaaagtgtgatcagcgttcaaaaactgcttttggattgtcaggatatagagaaccagctggctattaaatccaaagcacttgatgagcttaaacaatcctaccttacgctagaatcaggagctgtgccacttctcgaagacactgcctctcgaatcgacgagctgtttcaaaagcggtcaagcgtcctaacgcaagttaaccagctgaagacctcaatgcagtcggtgctgcaggagtggaagatttacgaccagctgtacgatgaggttaatatgatgacaatcagattctggtactgtatggaacattctaaaccagtagttctgtcgttggaaacccttcgctgccaggtggagaacctgcagtctctgcaggacgaggctgagtcatcagaggggtcctgggagaaactgcaggaagtgatcggtaagttgaagggactctgtccatctgtggccgaaattatagaggaaaagtgccagaacacacacaagcggtggactcaggtcaaccaagcaattgcagatcaactccagaaagcccagtctctgcttcaactgtggaaagcatattctaacgctcatggcgaagccgcagctagactgaagcaacaggaagccaagttccaacagcttgccaacattagtatgagcggtaacaacctagccgagatcctccctccggcattgcaggacataaaagagctgcagcacgatgtccagaaaactaaggaggccttccttcagaactcctctgtccttgaccgtttgccccagcctgccgagagcagtacgcacatgcttctccccggacctctacactcattgcagcgcgctgcttatctggaaaaaatgctccttgtgaaggccaacgagttcgaattcgttctgagtcagttcaaggacttcggcgttcggctggagagtctgaagggcttgatcatgcacgaggaagagaacttggaccggctccatcagcaggaaaaggaaaacccagactcttttctgaatcacgtgctggcgttgacagcccagtcgccggatattgagcacctgaatgaggtttccctcaagttgccccttagcgacgttgcagtgaagacattgcaaaatatgaaccggcaatggatcagagctaccgcaactgcactggaacgctgttcagaacttcagggtatcggcctgaatgaaaagtttctgtattgctgtgaaaagtggatacagctcctagagaagattgaggaggccctgaaggttgatgtagcaaattccttacccgagctcctcgagcagcagaagacgtacaagatgctggaagctgaagtgtctatcaatcagactattgctgatagctacgtcacacagagcttgcaactgcttgacaccactgagattgagaataggcccgagttcattacagagttctccaagctgactgatagatggcaaaatgcggtccagggagtgcggcaacgaaaaggagacgtcgacggcctggtgagacagtggcaggacttcacaaccagcgttgaaaatctgttccgctttttgaccgatacaagtcatctgcttagcgctgtcaagggccaggaacgcttctctctgtatcagactcggtctttgatacatgagctcaagaacaaggagattcacttccagcggagacgaaccacctgtgccttgacacttgaagctggcgagaagttgctcctgaccactgacttgaaaacaaaagaatcggtagggaggcggattagccagttgcaagactcgtggaaagacatggaaccccagttggccgagatgattaagcagttccagagtaccgtggaaacatgggatcaatgtgagaagaagatcaaagaactcaagtctaggctgcaggtgctcaaggcacaatctgaagatcctctgcccgagctgcatgaggacctgcacaacgagaaggaactcatcaaggagctcgagcagtccttggccagttggacccagaatttgaaagagctccagaccatgaaagcagatttgacccgccatgtcctagtggaagatgttatggtactcaaagaacagatcgaacatttacaccgacagtgggaggacctttgcctcagagtggcaatccggaagcaagagattgaggatcggctgaacacatgggtcgtgttcaacgagaaaaacaaggagctctgtgcctggctggttcaaatggaaaataaggttttacagaccgctgatatttccattgaggagatgatcgagaaattacaaaaagattgcatggaagagattaacctattttcagaaaacaaactgcaattgaaacaaatgggcgatcagctcatcaaggcaagtaataagtcacgcgctgcagagattgatgacaagctgaataagattaatgatagatggcagcatctgttcgacgtgatcggaagccgggttaagaaactcaaggaaacatttgctttcatacaacagcttgacaaaaatatgtcaaatctcagaacatggctggccagaatagagtcggagctcagtaagccagtggtgtacgacgtctgtgacgaccaggagattcaaaagagactcgccgaacagcaagatttgcaaagagacatcgaacagcattctgctggagtggagtcagtgttcaatatttgtgacgtcctgcttcacgatagcgacgcctgtgcaaatgaaacagagtgtgactctatccagcaaaccacccgctctctcgaccggaggtggcgtaatatctgtgccatgagcatggaacggcggatgaagatcgaggaaacatggaggctctggcaaaaatttcttgacgactattcccgctttgaggactggcttaaaagtgctgagcgaaccgccgcctgtcctaactcctccgaggtcctatacacttccgcgaaagaggagcttaagcgcttcgaagccttccagcgacaaatccacgagagactcacacagctcgaacttatcaacaaacagtaccgccgcttagccagggaaaacagaactgacaccgctagtagacttaaacagatggtgcatgagggtaaccagcgctgggataatctgcaacgtcgggtcacggctgtccttcggcggctaagacactttaccaaccaaagagaggagttcgaggggactcgggaaagcattctagtctggctgacggaaatggacctgcaacttaccaacgtggagcacttctctgaatccgatgcagatgataaaatgcgacagcttaatggatttcagcaggaaattacgctgaataccaacaaaatagatcaactcattgttttcggcgaacagctgatccagaagtcagaaccacttgatgccgtgcttatcgaagatgagttggaagagttgcataggtactgccaggaggttttcggcagagtgtccagatttcaccgaaggctcacctcatgtacacccggcctggaagacgaaaaagaagccagcgaaaacgagacagatatggaggaccctcgcgagatccaaactgactcatggagaaagaggggcgagtcggaagaaccttcctcaccccagtctctttgccacctggtagctcctggccacgagagaagtggttgtgagacacctgtgtcggtggactctatccctctggagtgggaccacacaggggacgtgggcggatcttcctcccacgaagaggacgaagagggtccatactatagtgctttgtcagggaaatccatcagcgatggacacagttggcacgtgccggatagtcccagctgtccagaacaccattacaaacaaatggaaggcgataggaacgtcccaccggttccaccggcttcatctaccccatataaaccgccctacgggaaattgctgctccctccaggaaccgatggcggcaaggagggacctcgcgtcctgaacgggaacccacagcaggaagacgggggtctggctggtattaccgaacagcagagcggggctttcgatcgatgggagatgatccaggcccaagaactccacaacaagctgaaaattaaacaaaatctgcagcagctgaattcagacatcagtgcaattactacgtggctgaagaagaccgaggccgaactggaaatgctgaaaatggcgaagcctccatcagatatccaggagattgaactcagagtcaaaagattacaggagattcttaaggccttcgacacttataaagcattagtagtgtccgtgaatgtaagttccaaagaatttttgcagacagagagcccggagagcaccgaactccagtcccgtctgaggcaattgagcctactgtgggaggccgcccagggagctgttgacagctggcgtggggggctcagacagagcctgatgcagtgccaggacttccaccaactctctcagaacctcctgctctggcttgcaagtgccaagaatcgccggcagaaagctcacgtgaccgatcccaaagctgatcctcgcgctctgcttgagtgcagaagagagctgatgcaattggagaaggagctggtcgagaggcagcctcaggtggacatgctgcaagagatatctaatagcctgttgattaagggacacggcgaggactgtattgaggctgaagagaaggttcatgtgatagaaaagaaactgaagcaactccgagaacaggtgtcacaggatctgatggccctccaggggacgcagaatcccgcctctccactcccatcctttgatgaggtggactcaggcgatcaaccgcccgccacctccgtgcccgctcccagggcgaaacagtttagagctgtgaggacaactgaaggggaagaagagaccgagagccgtgtcccaggtagtactagacctcagcgcagctttctttctagggtggtgagggctgcactgccacttcagctgctgctcctgctcctattactgctcgcttgcctcctgccctcttctgaagaagattattcatgtacccaagcgaataacttcgcgagatcattttatcccatgcttcgatatacaaacggccctccccccacctag

SEQ ID NO: 135880 - DNA, 804 bp, Artificial Sequence
  Description of Artificial Sequence: Synthetic coding sequence
atggcttcttctccagaacttcctacggaagacgaacagggctcgtggggtatcgacgatcttcacataagcctccaggcagagcaggaggacacccagaagaaggcatttacgtgctggatcaactcccagctggcacggcatacatccccttctgtaatctccgatctatttactgacatcaagaaaggtcacgttttgctggacttgctggaggtgctgagcggccagcagctgccacgcgataagggctcgaataccttccagtgtcggataaacatcgaacacgcactaaccttcctgcgaaatcgctcgatcaaacttatcaatatccacgtgacagacatcatcgatgggaacccaagcatcatcctcggcctcatatggacgataatactccacttccatatcgagaagctggctcaaacactatcttgcaactacaaccagcccagcctggacgacgtgtctgtcgtggacagcagcccggcgtcgagtccaccagcaaaaaagtgttccaaagttcaggccagatggcagatgtccgcgaggaaggccctgctcctatgggcccaggaacaatgtgctacttatgaatctgtgaacgtcacggattttaagtcctcatggcggaacggaatggcgttcctggccatcatccacgcgctccgcccagatctcattgacatgaaaagcgttaaacatcgttccaacaaggataacctcagagaggcgtttaggatcgccgagcaggagctaaaaatcccaagactgttggaacccgaggcatacaagaacttttag

SEQ ID NO: 135881 - DNA, 9813 bp, Artificial Sequence
  Description of Artificial Sequence: Synthetic coding sequence
atggagaaactgaggatcaagtatagcgaaatgtatacgattgttccagccgagattgagtctcaagtagaggaatgtagaaaggctctggaggacatcgacgagaagatcagcaacgaagtcctgaagagcagccccagttacgctatgcggagaaagatcgaggagattaacaatggtttacataatgtggaaaagatgctccagcagaaatctaaaaatatagaaaaggcccaagagattcagaaaaaaatgtgggacgagttggacttatggcatagcaagctgaatgagctggactccgaagtccaagacatagttgagcaggacccaggacaggctcaggagtggatggacaatctgatgatcccctttcagcagtaccagcaagtatcgcagcgcgctgaatgtaggacatctcagctgaataaagcaaccgtgaagatggaggaatatagcgacctcctcaagtcaaccgaagcatggatcgaaaacactagccacctcctggccaacccagccgattatgactcccttagaactctatcacaccatgcatccactgttcaggattcaaaatgtttccgttcggggccgaggcctaacatatacgtgagctactatgtaactgtgatacagatggccctggaagacagcgaacaaaagcacaacctgctgcattcaatttttatggatctcgaagacctgtctattattttcgaaaccgatgaactgacacaaagtattcaggaattgtcaaatcaggtcacagcgctgcagcagaagataatggaatcactaccacagattcagagaatggctgacgacgtggtcgccatagagtccgaggtaaaatccatggaaaagcgcgttagcaaaataaagaccatactcctctctaaggaaatctttgacttttcgcccgaggaacaccttaaacatggggaggtgattttagagaacatccggcctatgaagaagaccatagccgagatcgtgtcctaccaggtggaactacgattaccacaaacggggatgaagcccttgcctgtcttccagcgaaccaatcaactgctgcaggatataaagctcctggagaatgtcacccaagagcagaacgaactgttgaaggtcgtgattaaacagacaaatgaatgggacgaggaaattgagaacctgaagcagatcctgaacaattattccgcacagttttctctcgaacacatgagccctgatcaagccgataagctgccgcagctgcagggcgagattgagcgcatggaaaagcaaattctgtctctgaatcagagaaaggaagacctgctggtagatttaaaagccactgtgttgaatttacatcaacatctgaaacaggaacaagagggcgtggaaagagatagattgcccgccgtgaccagcgaggaggggggcgttgcagagcgcgacgcaagtgaaaggaaactcaaccgacgcgggtcaatgtcatatcttgctgcagtggaggaggaggttgaagagagctccgtcaagtcagataatggcgacgagaaagcggaaccctctccacaaagttggtccagcctatggaagcatgacaaagacatggaggaggacagagcgtcaagctcctctggcacgatcgtgcaggaagcttatggtaaaatcagcacaagtgataactcaatggctcagattctcacccccgattctcttaacactgaacaagggccggagtgttccctgagacctaatcagacagaggagggtaccaccccccccatagaggctgataccctagactcctccgacgcccagggtggactggaacccagggtcgaaaagacgcggccagaacctaccgaagtactgcacgcgtgtaagacacaagtcgccgaattagaactgtggctgcagcaagcaaacgtcgctgtggagccagagacattaaatgctgacatgcagcaggtgttagagcaacagctggtgggatgccaagccatgttgaccgaaattgagcacaaagtggcattccttctggagacttgcaaagatcaggggctcggcgacaacggtgccactcagcacgaggctgaggcgctgtccctcaaactcaaaacggtgaagtgtaaccttgagaaggtacagatgatgctccaagaaaaacactctgaagatcagcatccaaccattctgaaaaaatcttccgagccagagcaccaagaagcactgcaacccgtgaacctgtccgaattggaatctatcgtcactgaaagaccacagttcagccggcagaaagattttcaacagcagcaggttctggaactcaagcccatggagcagaaagatttcattaagttcatcgaattcaacgcaaaaaagatgtggcctcagtactgtcagcacgataatgacactacacaggagtcaagtgcttccaaccaagcttcctcacccgaaaacgatgtaccggatagtatcctgtcaccccagggccagaacggagataaatggcagtacctccatcacgagttgtcaagcaaaattaagctgccgttgcctcagttagttgagccccaggtatctaccaatatgggcatcttgccatcagtgactatgtacaactttaggtaccctacaacagaagagctgaagacctataccactcaactggaagacctccgtcaagaagcatctaacttacagacccaggagaatatgacagaggaagcttatatcaaccttgataaaaaactctttgagctctttttgacgctcagccagtgtctgtcctcagtcgaggagatgctagaaatgccacggctgtacagggaggatggctctggccagcaagtccactacgagacactagccttggaactgaaaaaactgtatctcgccctgagcgacaaaaaaggggatctgctgaaagccatgacctggccaggcgaaaataccaacttgttgttagagtgttttgacaaccttcaggtgtgtctggaacacacccaggctgcggcggtatgcaggagcaaatcactcaaagcaggattggattataaccggtcataccagaacgaaataaagaggctgtatcatcaactaatcaaatctaagactagcctacagcagtcacttaatgagatttcagggcagagcgtcgcagagcagttacaaaaagccgatgcctatactgttgaactggagaacgcggagagcagagttgccaaactcagggatgagggagagcgacttcacctgccttatgcgttactgcaagaggtctacaagctggaagacgtgctggactctatgtgggggatgctgcgcgcacggtatacagaactttcaagcccttttgtcactgagtctcagcaggacgctcttctccagggaatggtggaactggtaaagattgggaaagaaaagttggctcacggccatttaaagcagacaaagtctaaggtggctctgcaggcacagatcgagaaccacaaagtgtttttccagaagctggtggcagacatgttgctaatccaagcgtattccgccaagatcctaccaagtctgctgcaaaatagggaaacattctgggccgagcaggttacagaggtcaaaattttggaagagaagagccgccaatgtgggatgaagttacaaagtctgctgcagaagtgggaggagtttgatgagaattatgcctccctggagaaggatctggagattctcatcagtactctccccagcgtctctctagtcgaggaaaccgaagagaggttagtggaaagaatctctttttaccagcagatcaaaaggaacataggaggcaaacacgcccggctgtatcagacactaaatgaagggaaacaattggtagccagcgtctcttgtccagagctggaaggtcagatcgccaagctggaggagcagtggttgagtctgaacaaaaagattgaccacgaacttcacaggctccaggccttgttaaagcacttgctgtcctacaacagggacagcgatcagctaactaagtggctggaatcctctcagcacaccctgaactattggaaggagcagtctctgaacgtcagtcaggacctggatacgattcgctctaacattaataactttttcgagttctccaaagaggtggatgagaagagctccctcaagaccgcagtgatctctatcggcaatcagttgctgcatctgaaggaaacggacacagccacgctgcgcgctagtcttgcccaatttgaacagaaatggactatgctaattactcagttgccggacatccaggaaaaactccatcaacttcagatggagaaattaccatccaggaaggccattaccgaaatgatatcctggatgaataatgtcgagcaccagacgtccgacgaagattcagtccactctccatcaagtgctagccaggtcaaacacctactgcaaaaacacaaggaatttagaatggaaatggactacaagcagtggatcgtcgacttcgtcaaccaatcactactccaactcagcacctgcgacgtggaatctaaacgctatgagagaaccgagtttgctgagcatctgggtgagatgaatagacagtggcatcgggtacacgggatgttgaatcggaagatccaacatctggaacagctgctagaatccattacagaaagtgagaacaagatacaaatcctgaataattggctggaggctcaggaagagagattgaagacacttcaaaaacctgagagcgtaatctccgtgcaaaaattgctgctggactgccaagatatcgaaaatcagttagcaatcaaatctaaagccctcgacgagctaaagcagtcttacctgacactcgagtctggcgcagtgcctctcctggaagataccgccagcagaattgacgagctgtttcagaaacgaagttctgtgctcactcaggtcaatcagctgaaaacctccatgcagtcagttcttcaggagtggaagatctatgatcagctttacgatgaggtcaacatgatgacaataaggttctggtactgcatggagcacagtaagccagtggttctatctttggaaacgctgcgctgtcaggtggaaaatcttcagtctctacaggacgaagcggagtcttcagagggctcttgggagaaactccaggaggtgatcggaaaactgaaaggtctgtgtcctagcgtagccgagatcattgaggaaaagtgccagaacactcataaacggtggactcaggtgaatcaagccatcgcggaccagctccagaaggcgcaatccctgttgcagctctggaaggcatacagcaacgctcacggcgaggccgccgcacgcctgaagcaacaggaagcaaagttccaacaactggcgaacatcagcatgagcggaaacaatctggcggaaatccttcctccagctctccaagatattaaagagttgcaacacgatgtacagaaaactaaggaggcatttctgcaaaactctagcgtgctagatagattgccccagcccgccgagagctcaacccacatgctcctgcctggcccactccatagtctccagcgcgccgcctaccttgagaaaatgttgcttgtgaaagctaacgagtttgagttcgttctgagccagtttaaggattttggagttcggctcgaatcccttaagggactgatcatgcatgaagaggaaaatctggacagattacaccaacaggagaaggaaaaccctgactcatttctcaatcatgttttggctcttaccgctcagtcaccggatattgagcatctgaacgaagtttctctgaagctcccattaagcgacgtggcagtcaagaccctccagaatatgaatcgccagtggatacgcgctactgcaactgccctcgagagatgctcagagctgcaggggattggactcaacgagaaattcctttattgctgcgagaagtggatccagctgctcgagaagattgaggaggccctgaaagtggatgtggccaattcattaccggaattactagagcaacagaaaacatacaagatgctcgaagctgaagtttccatcaatcagacaatcgctgattcatacgttacacagtctctccagttgttagataccacagagatcgaaaatcgtccagagtttatcaccgaatttagcaaactgacggaccgctggcaaaacgcagtccagggcgtgcgccagagaaagggagacgttgacgggctggtaaggcagtggcaagactttactacctccgtggaaaacctgtttcggttcctgaccgacacatcgcatctgctgagcgcagttaagggacaggagcgtttttcactgtatcagacccgatcattgattcatgaactaaaaaataaagaaatccacttccagcgacgtaggaccacctgtgccttgacactggaggccggggaaaaacttctcctaaccaccgacttgaaaactaaagaaagcgtggggcgacggatttcccagctacaggattcctggaaagatatggaacctcagctggccgagatgatcaaacagtttcagagtacagtggagacttgggaccaatgcgagaagaagatcaaggagctgaagtccagactgcaggtgcttaaagcccagagcgaagatcccctgccagagttgcacgaagacctccacaacgagaaggaactcattaaagaacttgagcagagcctcgcctcgtggactcagaatctcaaagagttgcaaacaatgaaggctgatctgacacggcacgtccttgtggaagatgtaatggtgctgaaggagcagattgagcatctccaccgacagtgggaggacctgtgcctcagggtggctataagaaagcaggagatcgaagacaggctgaacacctgggttgtgttcaatgagaagaataaggagctgtgtgcctggcttgttcaaatggagaacaaggttcttcagacggctgacatcagcatagaggaaatgatcgagaaactccagaaagattgtatggaggagatcaatctgtttagcgagaataaattgcagctgaaacaaatgggagaccaactgataaaggcatcaaataagtcacgtgctgccgagatcgatgacaagttgaataagattaacgacaggtggcagcacctgtttgacgtgatagggagcagggtgaagaagcttaaggagacatttgcgttcatccaacagttggataaaaacatgagcaacctgaggacttggctggcccggatcgagtccgagttgtctaaacctgtcgtgtatgatgtgtgtgatgatcaggaaattcagaagcggttagccgagcagcaagatctacagcgggacattgagcagcatagcgccggagttgaatccgtgttcaacatttgcgacgtgttactgcacgacagtgatgcttgcgcaaatgagacagaatgcgacagcattcaacagaccactagatccctcgacagaagatggaggaacatttgtgcgatgagtatggagaggcgaatgaagatcgaggagacatggcggctctggcagaagttcctggatgactatagtcgtttcgaggactggctgaagtcggcagagaggaccgccgcctgcccaaattcctcagaagtgctttatacctcagccaaggaagagctcaaacgctttgaagcctttcagcggcagatccatgagagactgacccaactggagcttatcaataagcagtacagacgccttgccagggaaaatcgaactgacacagcttcccgccttaagcagatggtacacgagggaaatcaacggtgggataatttgcaacgaagggtaaccgctgttctgagaagactccgtcacttcactaaccagcgcgaagagttcgagggcacccgcgagagtatactggtatggttaaccgaaatggatttgcagctgactaacgtggagcattttagcgagtccgacgccgacgacaagatgcggcagctcaacggtttccagcaggaaatcaccctgaataccaacaaaatcgatcagctgatcgtgtttggggagcagctcatccaaaaatcggagccccttgacgccgtgcttattgaagatgagctggaagagctgcacaggtattgccaggaggtattcggccgggtgtcaagattccaccgcagattgaccagttgtacccctggccttgaagatgagaaagaggccagtgaaaacgagacagacatggaggacccccgagagatccagactgattcctggcgaaaacggggtgagtcagaagagccctcatcacctcagtccctgtgccacctggtggcccctgggcacgaaaggtccggatgcgaaaccccggtttctgttgactccattcccttggagtgggaccacacaggggacgtggggggcagttcaagccacgaggaagacgaagagggaccttattatagcgcactgtctggtaaaagtatctcggatggacactcatggcacgttccagactcaccctcttgcccagagcatcactacaaacagatggaaggcgatcgtaacgttccccccgttccccccgcttcttccaccccctataaaccgccttacggtaagctcctcctcccgccaggcaccgacggaggaaaagaaggtccgcgcgtactaaacgggaatccgcagcaggaagatgggggcctagctgggataaccgagcaacagtccggggcctttgatcggtgggagatgatacaggcccaagaactgcataacaagctgaagatcaagcaaaacctgcagcagctgaattctgacatcagcgccattacaacttggcttaagaagacagaggcagagcttgaaatgctgaagatggctaaacctccatctgatattcaggagattgaactgcgggtgaagcgactccaagagattctgaaggcctttgatacttacaaagctttagtagtgtctgtcaatgtctcgtccaaagagttccttcagaccgagtcacccgagagcaccgagttacaaagtagactgcggcagctgagtctcctttgggaagcagcccagggcgccgtcgatagctggaggggcgggctgcggcaaagtctcatgcagtgccaggattttcatcagctgagccagaatttactgctttggctggcttcagctaaaaacaggaggcagaaagctcacgtgactgatccaaaggccgacccacgagccctcctcgagtgccgtagggagttgatgcagcttgaaaaggagctcgtagagcggcagccccaggtggatatgcttcaggagattagtaattccttgctgatcaaaggccacggagaggactgtattgaagcagaagagaaagtgcacgttattgagaaaaaactgaaacagctgcgagagcaggtgtctcaggatctaatggcgctgcagggaacacagaatcctgcatctcccctgccatccttcgatgaagtggacagcggagaccagccaccggccacatctgtgccagcaccgcgtgccaaacaattcagggccgtccgaaccactgagggcgaggaggagacagaaagtagagttccaggatccactcgcccacagcgttcctttctctccagggtcgtccgggccgcactcccactgcaactgctgttactcctgctgctgcttttagcatgtcttctgccatcatcagaagaagattactcttgtactcaagccaacaacttcgcccgtagcttctaccctatgctgaggtacactaatgggcctccgcctacctag

SEQ ID NO: 135882 - DNA, 20724 bp, Artificial Sequence
  Description of Artificial Sequence: Synthetic coding sequence
atggcctcctcccccgaactgccaactgaggatgagcaaggctcttgggggattgacgacctgcacataagtctgcaggccgaacaagaagatacgcagaaaaaagcctttacatgctggatcaattcccaactggcccgacacacttcaccatcagttatatctgacctgttcaccgacatcaagaaaggccacgtgctgctcgatttgctggaagtgctttccgggcagcagctgcctagagataaagggagcaatacttttcagtgtcgtatcaacattgagcacgcactcacgtttctgcgcaaccgctcgattaaactgataaatatccatgtgaccgatattatcgacgggaaccccagtataattttggggttgatctggaccattattttgcatttccatatcgagaagctggcgcagactttgtcctgcaactataatcagccctccctggatgacgtttccgtagtggactctagccctgcgtcctcaccacccgcaaagaaatgttccaaagtccaggccaggtggcaaatgtctgcaaggaaggcattgttactgtgggcgcaggagcagtgtgccacgtacgagtcagtcaacgttaccgactttaagagttcctggcgcaatggaatggcttttctggccatcatccacgccttgcgtcctgatctgatagacatgaagtctgtcaagcacagaagcaataaagacaacttacgtgaggcatttcgcattgccgagcaggaactcaagatccccagactgctcgaacctgaagacgtcgacgttgtcgatccagacgaaaagagcatcatgacctatgtggcccagtttctgcagtacagcaaggacgctccaggaacaggtgaagaggcacagggcaaagtgaaagatgcgatgggatggttgacacttcagaaagagaagctgcagaagctgttgaaggattctgagaacgatacttattttaagaagtataactcgttgctcagcttcatggagagcttcaacgaggaaaagaaatccttcctcgacgtgctgtcaataaaaagagacctggatgagctcgacaaagaccacctccagctgagagaagcatgggacgggctggatcaccagatcaatgcctggaagattaaactgaattacgcccttcccccaccactgcaccagaccgaagcctggctccaagaggtagaggagttaatggacgaagacctttctgcaagccaggatcacagtcaggccgtcacactgatccaggagaagatgacactattcaagtcgttaatggaccgtttcgagcaccattcaaatatactgctgacctttgagaataaagatgagaatcacctgcctctagtccccccaaataagcttgaagagatgaagcggcgcattaataatattttggagaaaaaatttatcctactactggaatttcactattacaagtgtctggtcctgggcctggtcgatgaggtcaagtctaaattagacatatggaacatcaaatatggatcaagagaatcagtcgagctattgttggaagactggcacaagtttattgaagagaaagagttcctggcacgacttgacacctcttttcagaaatgcggcgagatctacaaaaatctggccggtgaatgccagaatataaacaagcagtacatgatggttaagtcagacgtatgcatgtatcggaagaatatctataacgtcaagtctactctacaaaaggttctggcctgctgggccacgtacgtggagaatctgcgtctgctgagggcctgcttcgaggagactaagaaggaggagattaaagaagttcctttcgaaaccctggcacagtggaacttagaacacgcaaccctaaatgaagcagggaattttctcgtcgaggtcagtaacgacgtggtaggttcttcgatctctaaggaattgcgcaggcttaacaagcgctggagaaaacttgtgtccaagacacagctcgagatgaatctgcctctaatgatcaaaaagcaggatcagcctacctttgataacagtggcaatattctgagcaaagaagaaaaggccacagtagagttcagcacagacatgagtgtcgagctccccgagaattataatcaaaatatcaaggcaggggaaaagcacgagaaagagaacgaggaattcacaggacagctgaaagtcgccaaggacgtggaaaaactgataggccaagtggagatttgggaggctgaagcaaaaagtgtgttggaccaggacgatgtagatacctcaatggaggagtcactcaaacacctgattgccaagggctctatgtttgatgaactgatggccaggtcggaggacatgctgcagatggatatccagaacatttcatcccaagagtcattccaacatgttctgacaaccggcctgcaggctaagatccaggaggccaaagaaaaggttcagataaatgtcgtaaagctgatcgctgccttgaaaaacctgactgacgtgagtcctgacctcgacatcaggctcaaaatggaggagagccagaaagagctggaatcatatatgatgcgggcacagcagctgctggggcagagggaatccccaggtgaactgattagcaagcacaaggaggcacttataattagtaacacaaaatccctggcaaagtacctgaaagcagtcgaggagttgaagaataacgtgaccgaggatattaagatgtcgttagaagagaagtcgagagatgtgtgtgcgaaatgggaatcactgcaccatgaactctctctttacgtgcagcagctgaagatagatatagagaagggaaaattgtctgataatatactgaagttggagaaacagattaacaaagagaagaaactgattcgcagagggcgcactaaaggactgatcaaggagcatgaggcatgctttagcgaagaggggtgtctttatcagttaaaccatcatatggaggtgctgcgggaactgtgcgaggagctgccttcccaaaagtctcaacaagaagtcaagcgcctgctcaaggactacgaacagaaaatagaacgactcctgaaatgcgcctccgaaatccacatgactttgcagcctacagctggcggtaccagtaaaaatgagggtacgataactactagcgagaacagaggcggagaccctcatagtgaagctccatttgccaaaagcgacaaccagccctcgaccgagaaagcaatggaaccaaccatgaaattcagcttggcgtccgtactccgtcctctgcaggaagaatctataatggaaaaagactattctgcctcgattaattctctgctcgagcggtatgatacgtatagggacatcctagaacaccatttgcagaataataagtttagaattacttcggattttagctctgaggaggacaggtcctcttcttgcctccaggctaagttaacagacctccaagtgataaagaatgaaaccgacgctcggtggaaagagttcgaaattatttctttgaagctggaaaatcatgttaacgatatcaaaaagccgttcgttatcaaggaacgggacactttaaaggaaagagagagagagctgcagatgaccctaaacacccggatggaaagcctggagactgcattgaggctggtgctgcctgttgaaaaggcctctctcttgctgtgtggctcagatctgcctctgcacaaaatggccatccaaggattccaccttatagatgccgatcggatctaccagcacttacgcaatattcaggattctattgcaaaacaaatcgagatctgtaatcgcctggaagaacccgggaacttcgtgcttaaagagctgcatccattcgatctccacgccatgcagaatatcatactcaagtacaaaacccaatttgaagggatgaatcatagagtacagcgctctgaagatacccttaaagcacttgaagacttcctggcctctctaagaactgctaagctgtccgctgagccagtcaccgacctttcggcttcagacacccaggtggcccaggagaacaccctgaccgtgaaaaataaggagggtgagattcaccttatgaaagacaaggctaagcacttggacaaatgcctcaagatgctagacatgtctttcaaggacgctgagcggggggacgacacctcttgtgagaatctgcttgacgctttcagcattaagctatccgagactcacggctatggagtgcaggaggaattcactgaggagaataagttgcttgaggcgtgcatctttaagaataatgaactgcttaagaacatccaagatgtgcagagccagatttccaaaatcggcctgaaggacccaaccgtgccagccgtgaagcaccgtaaaaaatcactaatacgcctcgacaaggtgctggatgagtatgaggaggagaagaggcacctgcaggagatggctaatagtctgccacatttcaaagacgggcgggagaaaactgtgaatcagcagtgtcagaacactgtggttttgtgggagaataccaaggcattggtcacagaatgcctggaacagtgtggacgcgtgctggaactgctgaaacagtatcagaactttaagtctatactgactacattgatccagaaggaagagtctgtgatcagtctacaggcctcatacatgggaaaagaaaacttgaaaaagcgaatcgccgagattgaaatcgtcaaggaggaatttaatgagcacctggaggtggtcgataagattaaccaggtttgtaaaaacctccaattctatttaaataagatgaagacgttcgaggagcccccatttgaaaaagaagcgaacatcattgtcgacaggtggctcgatatcaacgaaaagaccgaagactactacgagaacctggggagggcgttggcactttgggacaagctgttcaacttaaagaacgttatcgatgaatggaccgagaaggccctccagaaaatggagctccatcaactaactgaggaggatcgggaaaggcttaaagaagagctgcaggtccatgagcagaaaacctctgaattctcccggcgggtcgccgagattcaattcctgttgcagagtagtgaaattccgctggagctgcaggtgatggagtcctccatcttgaacaaaatggaacacgtgcagaaatgcctgactggagagtcgaactgtcatgccctcagcgggtcaaccgccgaactgcgagaagacttggaccaggccaagacccagatcggaatgaccgagagcctccttaaggctctatcccctagtgatagtctggaaattttcactaagctggaagaaatacagcagcagatcctacagcagaagcactctatgatcctcctcgagaaccagatcggctgcctcacacccgaattgtcagaactgaagaagcaatatgagagcgtatcagatctgtttaacacaaagaagtctgttctccaggatcatttttctaagctgctcaatgaccagtgtaagaacttcaacgattggttttcgaatataaaagtgaacctgaaggagtgcttcgagagttcagaaacaaagaaatctgtagaacagaagctgcagaagctgtctgactttctaacccttgaaggtagaaattcaaagatcaagcaagtcgactcggtactgaaacacgtcaagaaacacttaccaaaagcccatgtgaaggagctgatttcctggctggtcggacaggaattcgaactcgagaagatggaatctatttgccaagccagagcaaaggagctggaagactctttgcaacagctgctgagattacaggatgatcacagaaacctgcggaaatggctaacaaaccaggaggaaaagtggaaaggcatggaagagcccggcgaaaagacagagctcttttgtcaagctctggcccgaaagcgagagcagttcgagtccgttgctcagctgaataactcattaaaggaatatggattcaccgaggaggaagagatcatcatggaagccacgtgcctaatggaccggtatcagaccctgttgaggcagctctcagagatcgaagaagaagataagctgctccccactgaggatcagagcttcaacgacctagcacacgacgtgatccattggattaaggagataaaggagagcttgatggtgttgaacagtagtgaaggcaagatgccccttgaagaacgcatccagaaaattaaggagatcattctcctcaaacccgagggtgacgccagaatcgagaccatcatgaagcaggccgagagtagcgaagcaccactggtccaaaagacgcttaccgacatctcaaaccagtgggacaacactctgcatctagctagcacctatttaagtcaccaagagaagctactgctggaaggagagaagtacttacagtctaaggaggacctccgcctcatgttgattgaattgaaaaagaagcaggaggctgggtttgccctacagcacggattgcaggaaaagaaggcccagctgaagatctataagaagttcctgaaaaaagcgcaagatctgactagtttgcttaaagagctgaagtcacaggggaattatcttctggaatgtaccaagaatccgtcattcagtgaagagccctggttggaaatcaagcacctccatgagtccctactgcagcagctgcaggatagcgttcagaacctggacggtcatgtgcgtgagcacgattcttaccaggtgtgcgtgacggatcttaataccactttggacaatttttctaaagagttcgtatctttctctgacaagcctgtagatcagatcgctgtggaggaaaaactgcagaagttgcaggaattggaaaacaggctgtctcttcaggacggcacgctgaagaaaattcttgcgctggccaagtcagtcaagcagaatacaagcagcgtgggccagaagatcataaaagacgatataaagtcactgcaatgcaagcagaaagacctggagaatagactcgcaagcgccaagcaggaaatggaatgttgtttgaatagtatcctcaaaagtaagcggagtacggaaaagaagggaaagttcacgcttccaggcagagagaaacaagccacctctgacgtccaggagagcacccaagaatctgcagctgtcgaaaaactggaggaggactgggaaataaataaagatagtgcagtagaaatggcaatgtcgaagcagttatcactcaacgcgcaggaatcaatgaagaataccgaagatgagagaaaggtcaacgagttgcaaaaccagcccctcgagcttgacacgatgttgagaaacgaacagttggaagaaatcgaaaagctgtacactcagcttgaggccaagaaagcagccatcaaaccattggagcagacagagtgcctcaacaagactgagaccggggctctggtgctgcacaacattggttattccgcacagcacttagataacctattgcaggctctgattacactcaagaaaaataaagagtcacagtactgcgtgctgcgcgacttccaggagtatctggctgccgtcgaatcctctatgaaggccttgctcacggacaaggaaagcctaaaagtaggccctttggactctgtaacttatctggacaaaattaagaagtttatagcgtcaatagaaaaggagaaggactctttggggaatctgaagattaagtgggagaacctgtccaatcacgtgactgatatggacaagaaattacttgagtcccaaattaaacagctggaacacggatgggagcaggttgagcagcagattcagaagaagtattcacagcaagttgttgaatatgatgaatttactaccctcatgaacaaggtgcaagatacggagatttccttgcagcagcagcagcagcatcttcagctgcgactgaagagcccggaagagagagcaggcaatcagtccatgatagccctgacaaccgacctacaggctacaaaacacggattcagcgtcttgaagggacaggcggagctccagatgaagcgcatttggggggagaaggaaaagaagaacctagaagacggaatcaataatctcaaaaagcagtgggagaccctcgagccactccatttggaggccgagaatcagattaagaagtgtgatattagaaacaaaatgaaggaaaccatcctgtgggccaaaaatttgctcggagaattaaacccttccattccattgcttccggatgatatcctctctcaaatcaggaaatgtaaagttactcatgacggcattctggctaggcagcagagcgtggaaagcctggctgaggaggtgaaggacaaggtcccctccctcacaacatatgagggcagcgacctcaacaacaccctggaggatctcagaaaccaataccaaatgctcgtgctcaaatcaactcagcgcagtcagcagttagaattcaaactagaagagcgcagtaatttcttcgctatcattcggaagttccagctgatggtgcaagaatcagaaactctcattattcctcgcgttgagaccgcagctacagaagcggagctgaagcaccaccatgtcaccctggaagcctcccaaaaggagctgcaggagatcgactctggcattagcacgcacctgcaagagctcacaaacatatatgaagaacttaacgtgttcgagagactttttctcgaagaccagcttaaaaacttgaagattcggaccaacagaatccagagatttattcagaacacctgcaacgaggtggaacacaagattaagttctgcagacagtttcatgagaaaacatcagctctacaagaggaggctgatagcatccaaagaaacgaactgttactcaaccaagaggtgaataagggcgtgaaggaggaaatctacaacctgaaagatcgcctcaccgccattaaatgttgcattcttcaggttctgaagctgaagaaggtctttgactatatcgggcttaattgggacttttcacaactggaccagttacagacccaggtgttcgagaaggaaaaggaactcgaagaaaagataaagcagcttgatacttttgaggaggaacacggtaagtatcaggccttactgtcaaagatgcgtgccattgacttgcaaatcaagaagatgactgaggtggtcctgaaggcacctgactcaagccccgagagcagaagactgaacgcccaaattctgagccagcgcatagagaaagctaagtgcctgtgtgacgagatcattaaaaagcttaatgagaacaagactttcgacgactcgtttaaagagaaagaaatcctacagatcaaattgaacgcagaagaaaatgataagctgtacaaggtgctccagaatatggtgctcgagctttcgcccaaagagttagacgaaaagaattgccaagacaaactcgaaacgtctctgcacgtgctgaatcagataaagagccagctgcagcagcctctacttatcaacctggaaattaaacacattcagaatgagaaggacaactgtgaagcatttcaggagcaagtgtgggcagagatgtgctcaattaaagccgtgacagccatagagaagcagcgggaggaaaattcatctgaggccagtgatgtggaaaccaagctccgggagtttgaggatcttcaaatgcagcttaatactagcattgatctccggacaaacgtcctgaacgatgcttatgagaatcttacccgctacaaagaggccgttacccgggccgttgaaagtattacatccctggaggccattatcatcccatatagggtggacgtgggaaatccggaggagagcctggaaatgcctctgaggaaacaagaagaactggagagcactgtggcccacattcaagacctgacggaaaaactgggcatgatttcctctcccgaggctaagctgcagctacagtatacccttcaggaattggtgagtaagaattctgcgatgaaagaagcattcaaagcccaggaaaccgaggcggaacgctatttggagaattacaaatgctatagaaagatggaggaagatatatatactaacctgtccaaaatggaaacagtgctgggtcagagtatgtcgtcactccccttgagttaccgcgaagcgcttgaacgcctggaacaatcaaaagcccttgtgtcaaatctgatttccaccaaggaagaactgatgaagctcagacagattctgcgattactgcggctgaggtgcactgagaatgatggcatttgcctacttaagatcgtctctgccctgtgggagaaatggctgtccctgttagaagccgcgaaagaatgggagatgtggtgtgaggagttgaagcaggaatggaagttcgtgtcagaagaaatagagcgtgaagccattattctcgacaatttacaggaggaactgcccgagatcagcaaaactaaggaagccgcaacaacggaggagctatccgagctgttggattgcctgtgccagtacggggagaatgttgaaaagcagcagctcctgctcaccttgctgcttcagcgcattcgcagcatccaaaacgtgcctgagtcctctggcgccgtggaaacagtgccagccttccaggagattacttctatgaaagaacgttgtaacaagcttttacagaaagtgcagaagaataaggagctggtccagacagagatccaggaacgccattctttcaccaaggagatcattgccctcaaaaacttttttcagcaaacaactacatcatttcagaacatggcttttcaagaccaccctgaaaagtccgagcagttcgaggaactgcagtcaatcctcaagaaagggaagctgacctttgaaaacataatggagaagctcagaattaaatactccgagatgtacacaattgtacctgccgaaattgaaagccaagtcgaggaatgcaggaaggccctcgaggatatcgatgagaaaatcagcaacgaagtgcttaagtccagcccaagttacgctatgcggcggaagattgaggaaattaacaatggacttcacaatgtagagaaaatgctccaacagaagtcgaagaatattgagaaggctcaggaaattcagaaaaaaatgtgggacgaactcgatctgtggcattccaaactgaatgagctggattctgaagtccaagacatcgtggaacaggaccccggacaggcccaagaatggatggataatctcatgatacccttccaacaataccagcaggtgagccagcgtgccgaatgtcggaccagtcaacttaataaggctacagttaagatggaagagtattctgatttactgaagtccactgaggcttggatagagaatacctcccacctcttggcgaatccagcagattacgactctctgcgaacactttcccatcatgcgtcgaccgtccagatggcccttgaagactcggagcagaaacataatctgctgcattccatatttatggatctggaagaccttagtatcatctttgagacggatgagctgacgcaatctattcaggagcttagtaaccaagtcaccgctctccagcagaaaattatggaatccctgcctcagatccaacgcatggcagacgacgtggttgctattgaatcagaggtcaagtcaatggagaagagggtgtctaaaattaagaccatcctactatccaaggagattttcgatttctcacccgaagagcacttaaaacatggggaggtgatccttgaaaatatccggcctatgaagaaaactatagcggagattgtgagctatcaggttgaactgcggcttcctcagacaggcatgaagccattacccgtgttccagcggacaaaccagcttctgcaggacattaagctacttgagaacgtcacccaggaacagaatgagctcctaaaggtggtgatcaagcagacgaacgagtgggacgaagagatagaaaatttgaagcagatcctgaacaactactctgctcaattcagtctagagcacatgtctccagaccaagcggacaagttgcctcagctgcaaggggaaattgaacgcatggagaagcagattctgagccttaatcagcggaaggaggacctgcttgtggacttaaaagctacagtgttaaatttgcaccaacatctcaagcaggaacaggagggagtcgaaagggatcgactgcccgccgtgacctcagaggaaggtggtgtggccgagcgagacgcctccgaacgcaagctgaatcgaaggggcagtatgagttacttggccgctgttgaagaagaagtagaagaatcaagcgttaagtccgacaacggggatgagaaggccgagccttctccccaatcctggtcgagtctctggaagcatgataaggatatggaagaggatcgcgcttcaagctctagcggtaccattgttcaggaagcctatgggaagatctccaccagcgacaattctatggcccagatcctcacgcctgacagcctcaatacagagcaggggcctgaatgtagtctgcggcccaaccagactgaggaagggacgactcctccaatagaggcagacaccttggattcttcagatgctcaggggggccttgagccccgagtggaaaaaactcgcccagaacccaccgaggtactccatgcctgcaagactcaggtggccgagttggaattatggctccagcaggcaaatgtggcagtggaacctgagacgttgaacgcagatatgcagcaagtactagaacaacaactggtcgggtgtcaggctatgctgacggaaatcgaacacaaggttgccttcttgctcgagacctgcaaggaccaagggctgggggacaacggcgccacacagcacgaagcagaggccttaagcctgaaactcaaaaccgtcaagtgcaacttggagaaggtgcagatgatgctccaagaaaaacactccgaggatcagcatcccaccatcctcaaaaaatcttcagaaccggagcaccaggaggcccttcagcccgtcaatctgtccgagctcgagtctatagtgactgagcgcccgcagtttagccgtcaaaaggatttccagcagcagcaagtattagaactcaagccaatggagcaaaaggatttcatcaagtttattgagtttaacgcaaaaaagatgtggccacagtactgtcagcacgacaacgacacaacgcaggaaagctccgcttccaaccaggccagctccccagaaaatgatgtgcctgattcgatcctgagtcctcagggccagaacggggacaagtggcagtacctgcaccatgagctctccagtaaaattaagctgcctctgccgcagctggtggagccacaggtgagcactaatatgggcatacttcccagtgtgaccatgtataactttagatatccgactacagaggaactgaagacttacactacacaactcgaggatctgcgccaggaggcatctaatttacagacacaagagaacatgaccgaggaagcctacatcaatttggacaagaaactcttcgagctcttcctcacattgagtcaatgtctgtcgagcgttgaggagatgctggagatgccaaggttatatcgggaggatgggtccggacaacaagtccactatgagactctcgccttggaattgaaaaaactgtatctggccctcagtgacaagaaaggtgaccttttgaaggccatgacctggcccggcgagaacactaacctcctgctcgaatgttttgacaatctgcaagtctgcctggagcatacacaggcagctgccgtgtgccgttcgaagagcctgaaagctggattggactataataggagctaccagaacgaaatcaagaggctgtatcatcagctcatcaaatctaagaccagtttacagcagagcctgaatgaaataagtggccagagcgtggctgagcagttacagaaagccgatgcctatacagtagagctagagaatgctgagagcagggtcgcaaagctcagagacgaaggcgagagactgcatttgccctacgctctcctgcaggaggtgtacaaattagaagacgtcctggatagtatgtgggggatgcttcgcgccagatacaccgaactgtccagtccattcgtgacggaatcccagcaggatgcactgctgcagggcatggtggaactggtaaagatcgggaaggaaaagctggcccatggccatctcaaacagacaaaatctaaggtcgcactgcaggcgcagatcgaaaatcataaagtcttctttcagaagcttgtggctgatatgttgcttattcaggcgtactctgccaagattctgccttcccttcttcagaatcgggagaccttctgggctgaacaagtgaccgaagtgaaaatcctcgaggaaaaatctaggcagtgcggcatgaagttacagtcgctgttacagaaatgggaggaattcgacgaaaattatgcaagtttggaaaaagacctggagatcttaatatctactctcccctctgtatctttagtggaggagacagaggaaaggctcgtggaaagaatttctttttaccaacagattaagcggaacattggcggaaagcatgcaaggctgtatcagacactgaatgagggcaaacaactcgtggcctccgtttcttgtcctgagcttgagggccagatagcaaaactcgaggagcagtggctgtcccttaataaaaaaatcgatcatgagttgcacaggctccaggcattgctgaagcacctgttaagctataaccgagacagtgaccagctaaccaaatggctggaatctagccaacataccctgaactattggaaagaacaatctttaaacgtgagccaggacctcgacacaatacgctccaatattaataatttttttgagttttctaaggaagtagacgagaagtcttccctgaaaactgccgtgatctctattggcaaccagctgctccacttgaaagaaactgataccgctacactgagagcctcacttgcccagtttgagcagaagtggactatgctgatcactcaactccccgacattcaggagaagctccatcagctgcagatggagaaactgccctcacggaaggcaatcacagagatgatttcgtggatgaataacgtggaacatcagacttccgacgaggattcagtgcatagcccctcttcggcttcccaggtaaaacatttactgcagaagcacaaagagtttcgtatggaaatggactataaacagtggattgtggacttcgtaaaccagagcctgttacaactgtctacttgtgatgtcgaatccaagcggtacgagcgaaccgagtttgctgagcacctcggcgaaatgaacaggcagtggcaccgggtccacggtatgctgaatcggaaaatccaacacttggaacagcttctggagtcgatcaccgaaagcgaaaacaaaatacagatccttaataactggctcgaggcacaagaagaacggctaaaaacgctccagaagcccgagtctgttatctccgtccagaaactgcttcttgactgtcaggatattgaaaaccagctggccatcaagtcaaaagctctggacgaactgaaacagtcttacttgacactggaaagcggggcggtgcctctcctggaggacactgcaagtcggatagatgagcttttccagaagcgttcctccgtgttgacgcaagtgaatcagctcaagaccagtatgcaaagcgtcctgcaggagtggaaaatctatgatcagctgtacgatgaggtaaatatgatgactatccgcttctggtactgcatggagcacagcaagcctgtcgtactgagcctggaaacccttcgctgccaggtggagaacctccagagtttgcaagacgaggctgagtcctcagaaggaagctgggaaaaactccaggaagtgattgggaagctcaaaggtttgtgtccctccgttgccgagataatcgaggagaagtgccagaacactcataagagatggactcaggtgaaccaggcgatcgcagaccagttgcagaaggcccagagcctgttgcagctgtggaaagcatactccaatgcccatggcgaggctgcagcccgcttaaaacagcaagaggccaagtttcagcagttggccaacatctctatgagtgggaataatctggccgagattttgccccctgccttgcaggacattaaagaactacaacacgatgtgcagaagactaaggaagcatttctccagaacagttcggtgctcgataggctccctcagcctgctgaaagctctacgcatatgttactccctgggcccctacactcgctccagagagcagcgtaccttgaaaaaatgctcttggtgaaggcaaatgagttcgaattcgtgctatcccagttcaaggatttcggagttaggcttgaatcattgaagggcttaataatgcacgaagaagagaacctggaccgactccatcagcaggagaaggagaatccagattcttttttaaaccacgtgctggccctgacagcccagagccctgacattgagcacttgaacgaggtgagtctgaaactacctttgtccgatgtggccgtaaagacacttcaaaatatgaatcggcagtggatcagagccaccgccacagccctcgagcgatgctctgaactgcaggggataggcctgaatgagaaatttctatactgctgcgaaaaatggattcagttgttagagaagatcgaggaggcactcaaagtggacgttgctaatagtctccctgagctgttagaacagcagaagacatataaaatgctggaggccgaggtgtctatcaaccagacaattgctgacagctacgtgacccagagtctgcagttgctggacacgacagaaattgagaatcgaccggagtttattactgaattctcgaaattgactgatcgctggcaaaatgctgtgcaaggagtccggcaaagaaagggcgatgtcgacgggctggtcagacagtggcaagactttaccacatcggtggagaatctgttccgctttttaacagacacttcccacctgctgtcagccgtgaaaggtcaagaacggttttctctttatcagacgaggtctctcattcacgagttaaaaaacaaagaaatacactttcagcgccgaaggacaacttgtgccctcaccctcgaagccggggaaaaactgttactcactaccgaccttaaaacaaaggaatccgtgggaaggagaatttcgcaactgcaggattcctggaaggacatggagccccagttggccgagatgatcaagcaatttcaaagcaccgttgaaacatgggatcagtgcgagaaaaagattaaagagcttaagtctagactgcaagttctcaaagcccagagcgaagatccgctgccggagctccatgaagacctgcataatgaaaaggaactcatcaaagaactggaacagtcgttggcatcctggacccagaacctcaaggagctgcaaaccatgaaggcggaccttacgaggcacgttcttgtggaggatgtaatggtgctgaaggagcagatcgagcacctccatcggcagtgggaagatctgtgtttgcgggtggccatacgcaaacaggagattgaggataggctgaatacatgggtggtgtttaacgaaaagaacaaagagctatgcgcatggctggtgcagatggagaacaaagtgcttcagactgctgatatttctatagaggaaatgatcgagaaactgcaaaaagattgcatggaggagatcaacttgttctctgaaaataaactgcagctcaagcaaatgggggaccagctcattaaggcatctaacaaatccagggccgccgagatcgatgataaactcaataaaatcaacgacagatggcagcatctctttgacgtgataggaagtcgcgtcaagaagttgaaagagactttcgccttcattcaacaactggacaaaaatatgtccaacctgagaacctggctagcccggatagagtctgaattgtccaagcctgtggtttatgacgtctgcgatgaccaggagatccagaagagactggctgaacagcaggatctgcagcgtgatatcgaacagcactctgcgggcgtggagtcagtgtttaatatttgcgatgtccttctacacgattctgatgcgtgtgccaacgagacagaatgcgactctattcagcagacaacacgttctctcgatcgaaggtggagaaacatatgtgctatgtccatggaaagacgcatgaagatcgaggagacttggagattgtggcagaaatttttggatgactattccagatttgaggattggctaaagtcagctgaacgtaccgcagcttgtccaaactcctccgaagttttgtacacttcagccaaagaagagctgaagagattcgaggcctttcagaggcagattcacgagcggctgactcagctggaactgatcaacaagcaataccgcaggttagcccgcgagaatcggacagataccgcctcccgcctgaaacagatggtccatgaagggaaccaacgctgggacaatctgcagcgccgagtgacggctgtactaaggaggctgagacatttcaccaatcagagagaggaatttgagggaactagggaaagtatactggtttggctgaccgaaatggatctacagttaactaatgtcgaacacttttctgaatctgatgccgacgacaagatgaggcaattgaacggatttcagcaagagattaccttgaacacgaataaaatcgaccagctgatcgtcttcggcgaacaactgatacagaagtccgagcccctggacgccgtgctgatcgaagacgagctcgaagagctccaccggtattgccaagaggtgttcggccgcgttagtcggttccacagacgactcacctcatgtactccaggcctcgaggatgaaaaggaggcgtccgaaaatgagaccgacatggaagatccacgggagatacaaaccgactcatggagaaaacggggcgagtcggaagaaccatcgtcaccccagtccctatgccatctggttgctccaggccatgagagaagtggttgtgaaacgcccgtaagcgtggactccattcctctcgaatgggatcataccggcgacgtgggtgggagttcaagccatgaagaggacgaggagggaccctattacagcgcactgtcagacgttgaaataccagaaaacccagaggcctacctaaagatgactaccaaaacacttaaagcgtcttccggcaaaagcattagcgatgggcactcgtggcatgtcccggacagcccatcctgcccagaacaccattacaagcagatggagggagacaggaatgtccctccagtgccgcccgcatcttccacaccatacaagcctccatatggaaagctgctgcttccacccggaacagacggagggaaggaagggcctagggtgctcaacggaaacccgcagcaggaagacgggggcctggcagggatcactgaacagcagtccggcgcctttgacagatgggaaatgatccaggcccaggagctgcataacaaactaaagattaagcagaacctacagcagcttaattcagacatatctgctataaccacatggctcaagaagaccgaggcagaactggaaatgctaaagatggcaaagcctcccagtgatatccaggaaatcgaactcagagtcaagcggctgcaggagattttaaaggccttcgatacctacaaagctcttgtggtctccgttaacgtgagcagtaaagagtttctgcagacggagagtcccgaaagcactgaactgcagtccaggttgaggcagctctccctgttgtgggaggccgcccaaggcgcagtagattcgtggagaggcggactgaggcagagcctaatgcagtgccaagactttcatcagctctcacaaaatctgctcctctggctggcttcggccaagaacaggagacaaaaagcacacgtgacagatcctaaagccgatccaagagcccttcttgagtgtagaagagagctcatgcagctggagaaagagctggtagaacgacagcctcaggttgatatgctccaggagatcagtaattccctgctgatcaagggtcacggcgaggattgcatcgaagcagaggagaaggttcacgtgatcgagaagaagttgaaacagctgcgcgagcaggtgagccaggatttgatggcacttcagggcacacagaaccctgcctctcctctgccctccttcgatgaagttgactcaggagaccagccgccagccacatctgtccctgcaccacgggccaaattcagggcagttaggaccacggagggcgaggaagagacagagtctcgggttccaggatctacacgaccccagaggtcgttcctctccagagtggtgagagcggctctgcccttacagctcttgctcctgcttttactgctactggcttgcctgctgccatcttcagaagaggactatagttgcacccaggcaaacaattttgcacgaagcttctacccaatgctacgatacaccaatggccctccgccgacctag

SEQ ID NO: 135883 - DNA, 9813 bp, Artificial Sequence
  Description of Artificial Sequence: Synthetic coding sequence
atggaaaagttaaggattaagtatagtgaaatgtataccattgttccagccgagattgaatcccaggtggaggagtgtcggaaggctttggaggatatcgatgaaaagatttccaatgaggttttaaagtcctccccatcttatgctatgcgcaggaaaattgaggagattaataacggtctacacaatgtggaaaagatgttacagcagaaaagtaagaacattgaaaaggcccaggagatccagaagaaaatgtgggacgagttggacctctggcattctaagctcaacgaattggacagcgaggtgcaagatatagtggagcaggatccaggacaggcacaggagtggatggataatctaatgatccctttccagcagtaccaacaagtatcccagcgcgcggaatgtcggacgtcacagctgaacaaagctacagtaaaaatggaagaatattccgacctcctgaagagcacagaggcttggatcgagaacacatcccacctcctcgctaaccccgcagactatgatagtcttcgcactctcagccatcatgcctcaacagtgcaggactctaagtgttttcgatccgggccaagaccgaatatttatgtgagttactatgtgaccgtgattcagatggcattggaggattccgagcagaaacataatttgctgcattcgatttttatggatctcgaggacctatctatcatcttcgaaactgacgaacttacccagtccattcaagagctgtctaaccaggtgacggctctccaacagaagatcatggagtccctgccacagatacagcgaatggccgacgacgtcgtggctatcgaatcggaggtaaaaagcatggagaagagagtgtcaaaaatcaaaacaatactcctgagcaaagagatcttcgactttagtccagaagagcacctcaagcacggggaggttatactcgagaacataagacccatgaaaaagacaattgctgaaatcgtgagttatcaagtcgaactgcgtctcccccagacaggtatgaaaccccttcccgttttccagcgcaccaatcaattgttgcaggatataaagctactggagaacgtcacacaggagcagaatgaactgttgaaagttgtgattaagcagaccaatgaatgggatgaggagattgagaacctgaaacagatacttaataattacagcgcacagttctcgttagagcacatgagtcccgaccaggcggacaagctgccacaactgcaaggagaaatcgagagaatggagaagcagatcctgagcctaaaccagcgaaaggaggaccttttggtggacttgaaggcgaccgtacttaacctacatcagcacctcaagcaggagcaggagggtgtagagagggaccgtctacccgctgtcacctctgaagaaggcggtgtggccgaaagagatgcgagcgagcggaaactgaaccgtaggggttctatgtcttatctggctgccgtcgaagaggaggtggaggaatcctccgtaaagagcgataatggcgatgaaaaagccgaaccctctcctcaaagttggtctagtctgtggaagcacgataaagatatggaggaggatcgggcctcctcgtcatctgggacaatcgtccaggaggcttacggcaaaatttctacttctgataacagcatggcccagatcctgactccagactcactgaacacagaacagggaccagagtgttctctgaggccaaatcagactgaagagggaaccacccccccaatcgaagctgatactcttgactccagtgacgcccagggtggcctggagcccagggtcgagaaaactcggcccgagcccactgaagtgctccatgcttgtaagacccaggttgcagagcttgagctgtggcttcagcaggccaacgtcgcagtggagccggagacgctaaacgccgatatgcagcaggtgctggaacagcagctagtgggatgtcaagccatgttgaccgaaatcgagcacaaggtggcctttctgttggagacatgcaaagatcaggggctcggagacaacggcgccacccaacacgaggccgaggctttatcgttgaaacttaaaacagtgaagtgcaatctcgagaaggtgcagatgatgcttcaagagaagcacagcgaagatcagcatcccaccattctgaaaaaatcgagcgaacctgaacatcaggaggcactgcagccagtaaatttgagcgagcttgaaagtatcgtgacagaaaggccacagttttccaggcagaaagactttcaacagcagcaggtgctggaattgaaaccaatggaacaaaaggacttcattaagttcatcgaattcaatgcaaaaaagatgtggccccagtattgtcaacacgacaacgacaccacgcaggagagcagcgcttccaaccaggcgtcatctcctgaaaacgacgttcccgacagcatcctgagccctcagggccagaatggagataagtggcagtacctacaccacgaactttctagtaaaattaaactgccactacctcagctggtcgagccgcaggtgtccaccaatatgggtatcttgcccagcgtgaccatgtataacttccggtaccccactacagaggagttgaagacttatacaacacaactcgaagatcttagacaggaggcatccaatctccagacacaggagaatatgaccgaagaagcctacatcaacttagacaaaaaactgtttgagctgttcctaacactgtctcagtgcctgtcctctgttgaggaaatgctggaaatgccccggttgtaccgagaggacgggtctggtcagcaagtccattatgagacgttagccctcgagctcaaaaagttgtacttagcgttgagcgataagaagggtgatcttcttaaagccatgacatggcccggggagaacacgaatctcctccttgagtgttttgataacctccaggtctgtttagagcatactcaggccgctgctgtctgcaggtccaagtctctaaaggctggcctggattacaaccgcagctaccagaacgagattaagcgcttgtatcatcagctgattaagagtaagacctctctgcagcagtcactaaacgaaatctctggacagtctgtagctgaacagcttcagaaggcagatgcatatacggtggagctggaaaatgccgagagtcgggtcgcaaagctgcgggatgagggtgaacgcctacaccttccttatgccttgcttcaggaagtgtacaaactcgaagacgttctggattcaatgtgggggatgctaagagccagatatacagaattgtcatcaccgtttgtcactgagagtcagcaggatgctttactgcagggaatggtggagttggtgaagatcggcaaggaaaagttagcccacggccacctcaagcagacgaagtccaaggtggccttgcaagcgcagatcgagaatcacaaggtcttcttccagaaattggtagccgacatgctgcttattcaggcctactccgctaagatcctgccatcattgctgcaaaatagagaaaccttctgggccgagcaggtcacagaggtaaaaatcctggaggagaagagcagacagtgcggcatgaagctgcagagcttgctgcagaaatgggaagaattcgatgagaactacgcaagcttagagaaagatctagagatcctcatctcgaccctgccaagcgtctctttagtcgaggaaaccgaggaacggcttgtagagagaatctctttttaccagcagattaagcgaaacattggtggcaagcacgcccgcctgtaccagaccctgaatgaggggaagcagctcgttgcatcggtgtcctgtccagaactggagggccaaatcgcgaagctcgaggagcagtggctcagtttaaataagaagatcgatcacgaactgcaccggctccaggccctgctgaagcatctgctgtcttacaatcgcgattctgaccagctaaccaaatggctagaatcttcccagcatacactgaattactggaaggagcagtcactgaacgtcagccaggatttggatacaatccggtcaaacattaacaatttctttgaattcagcaaggaagtcgacgagaagtcctccctgaagaccgccgttatcagcatcggcaatcagttattacatctcaaggagactgacacagcaaccctgagagccagcctggcccagtttgaacagaaatggactatgctcattacccagttaccagacatccaggaaaagctgcatcagctccagatggaaaaacttccctcacgcaaggcaattacggagatgatctcatggatgaataatgtggagcaccagacatcagacgaagattctgtgcattcgccttctagtgcatctcaggtgaagcacctgctccagaaacataaggaattccgtatggaaatggactacaaacagtggatcgtcgacttcgtcaaccagagccttctgcaactgtcaacctgtgacgtagagtctaagaggtatgagcggactgagtttgcagagcatctgggcgaaatgaacaggcaatggcacagagttcatggcatgctgaataggaagatccagcatttggagcagcttttagaatcgattacagaaagcgaaaacaagatccagatcctgaacaattggctggaggcacaagaggaaagactcaaaacgctgcagaaacccgagagcgtcattagcgtacaaaaactacttcttgattgccaggatatcgagaaccagctggccataaaatctaaagcactcgacgagttaaaacagtcctatttgaccttggagtccggcgcggttcctctgttagaggacactgccagtcgcatagacgaactgttccaaaaaaggtcttcagtgctgacccaagtgaatcaattaaagacttctatgcagtccgttttgcaggagtggaaaatatacgatcaactgtacgatgaggtcaatatgatgacaattagattttggtattgtatggagcatagcaagccagttgtgttgtccctcgagacactcagatgtcaggtggagaacctgcagtcactgcaggacgaggctgagagtagcgaaggttcttgggaaaagttgcaagaagtgatcggcaagttgaaaggactgtgtccatccgttgcagagataatcgaggagaaatgccagaacactcacaagagatggacccaggtaaaccaagctatagcggaccaactacaaaaggcccaatctctactgcagctgtggaaggcatattctaatgctcacggcgaggctgccgcaaggctgaagcagcaggaagccaaattccaacagcttgccaatatcagtatgagcggcaacaatctcgccgagatcctgccgcctgcactccaagacatcaaagagctgcaacacgacgtgcagaagaccaaagaggcttttttgcagaattcatcggtcttagacaggttacctcagcccgccgaatcctcaacacacatgctcctgccaggccctttacactccctccagagagccgcgtatcttgagaagatgctgctagtaaaggcgaacgaatttgaatttgtgctttcacagttcaaagacttcggggtgcgattagagagtctgaaggggctgataatgcacgaagaagaaaacctggatcgactgcatcagcaggaaaaagaaaatcccgatagctttctaaaccacgtgctggccttgacagcccaatctcctgacattgagcacctcaatgaggtcagccttaaactgcccctgtctgatgtggccgtgaaaacgctgcagaatatgaatcggcagtggatccgcgctacagccacagctctggaacggtgttcagaactgcagggcatcggcctgaatgagaagtttctctattgttgcgagaagtggatccagctcctggagaagatcgaagaggccctgaaggttgacgtggcaaatagtttgcctgagctgcttgaacagcaaaaaacctataagatgctggaggcggaggtgagtattaaccagaccatcgctgacagctacgtgacccagagtttgcaactgttggacacgaccgaaatcgaaaatagacctgagtttataacagagttcagtaaactgactgatcgctggcagaatgccgtccaaggagttcggcaaagaaagggcgatgtagacggccttgtgcggcagtggcaggacttcacaacgagcgtggaaaacctattcaggttcctgactgataccagccatctgcttagcgccgttaaaggacaggaaaggtttagcctgtaccagactagatcattgatccatgagctcaagaataaggagattcattttcagcgtcggcgcaccacttgcgccttgactctcgaggccggtgaaaaactgttgctgactactgacctgaagacaaaagaatctgttggtcggcggatttctcagctgcaagactcatggaaggacatggagccacagctggcagaaatgataaaacagttccagagtaccgtagagacctgggaccaatgcgagaagaaaattaaggagctgaaaagtagattgcaagtgctgaaagcacagagcgaggaccccctacccgaactgcacgaggaccttcacaacgaaaaggaactgatcaaagaactcgaacagtcattagcttcttggacgcagaatctgaaagaactgcagaccatgaaagccgacctgacccgacacgtgttggttgaggatgtgatggtactaaaggagcagattgaacatctgcatcggcagtgggaggacctctgtcttcgcgttgcaatccgaaagcaggagattgaggacagattgaatacctgggtcgtgttcaatgagaagaataaagagctgtgtgcatggctcgtgcagatggagaacaaagtcttgcagaccgctgatatctccatcgaagaaatgatcgaaaaactgcaaaaggattgcatggaggagattaacttattttcagaaaataaactgcagctgaagcagatgggcgaccaactaattaaagcatctaataagagccgtgccgccgagatcgacgataagttaaataagataaatgaccgctggcagcatctcttcgatgtgatcggtagcagagtcaagaaactgaaagaaacatttgcatttattcaacagttggacaaaaacatgtcaaacctccggacctggctggcgcgaatcgagtcagagctctccaagcctgtggtttacgatgtctgtgatgaccaggagattcaaaagaggctcgccgagcaacaggacctccagcgcgacatcgagcagcacagtgctggtgtggaatcggtctttaacatatgcgacgtgctgcttcacgatagcgatgcctgcgctaacgagactgaatgcgactcaatccagcagacaaccagaagtctggatcgcagatggcggaacatatgcgctatgtcgatggaacgcagaatgaaaatagaagagacatggcgactgtggcagaagtttttagatgactattccagatttgaggattggctaaaatcagcggagaggactgccgcttgtccaaactcttctgaagttctgtataccagcgcgaaggaggagctcaaaagattcgaggcatttcagcggcagatccatgaacggctgacccagctggagttgatcaataagcagtatcggagactcgcccgagagaacagaaccgacacagcctcgcgacttaagcagatggtccatgagggcaatcagcgatgggacaaccttcagcggagagtgaccgctgttctgaggaggttacggcactttacaaatcaacgtgaggagttcgagggcactcgggaatctattctcgtctggctcaccgagatggatttacagctgacaaacgtggagcacttttccgaaagtgacgccgacgacaaaatgagacagctgaacgggttccagcaggagattaccctgaacaccaacaaaatagatcagctgatagtctttggagagcaattgattcagaaaagcgaaccattggacgccgtgcttatcgaagacgaactggaggagttgcaccgatactgccaggaggtctttggccgtgtctctaggttccaccgaagactcacgtcttgcacacctggattggaggacgaaaaggaagcctctgaaaacgagaccgatatggaagatcctagggagatccagactgattcttggcgtaagaggggcgagtccgaggagcctagttctccacaatctctgtgccacctggtagctcctggacacgaaaggagtggatgtgaaactcctgtatccgtggactcaatcccgctggagtgggatcataccggcgatgtgggaggcagcagttctcacgaagaggacgaggagggcccttactacagcgcgctgagtgggaaatctatatctgacggccactcttggcacgtgccagactcacccagctgtcccgaacaccactataaacaaatggaaggcgaccgtaacgtaccaccagtccctcccgcttcctccacaccttacaaacctccatacggtaagctgctgctgccgcccggcacagacggaggtaaggagggacctagagtgcttaacggaaatcctcagcaggaggacggcgggttggccgggatcactgaacagcaatctggcgctttcgatcggtgggagatgattcaggctcaggagttgcacaataaacttaaaattaagcaaaaccttcagcaactgaactccgatatatccgccatcaccacatggctcaagaaaactgaggccgagctggagatgcttaagatggccaagcctccatcagacatccaggagattgaactgcgggtgaaacgcctgcaggagatcttgaaggctttcgacacctacaaagccctggttgtgtctgttaatgtctctagcaaagaatttctgcagaccgagtctcccgagtctaccgagttacagtctagattgagacagctctcgctactctgggaggctgctcagggagctgtcgacagctggagagggggtctacggcagtctttgatgcagtgccaggactttcatcagctcagccagaatctcttactgtggttggcttcagccaagaacagacgccagaaggcacatgtcactgacccaaaagctgatccccgggcactgcttgaatgccgccgagagctgatgcagctggagaaagagttagtggaacgccagccgcaggtcgacatgctccaggagatttctaactcactgttaatcaagggccatggggaagactgcatcgaggctgaagagaaggtgcacgtgattgaaaaaaaactgaaacaactgagggagcaggtttcacaggatctaatggcattgcagggaacacaaaacccagcaagccctctgccttctttcgacgaggttgactccggagaccaaccccccgccacatcagttcctgcaccacgggcaaagcaatttagagccgtgcggacgaccgaaggagaagaagaaacagaatccagagtcccgggttcaacaagaccacaacgcagtttcctgtcacgcgtggtgcgggcagcactacctttgcagctcctgctgctcctgttgctgctgctggcctgcctgctgccgagctctgaggaggattactcatgtacccaggcaaataacttcgcacggtccttttaccccatgttgaggtacacaaacggacccccgcccacatag

SEQ ID NO: 135884 - DNA, 1290 bp, Artificial Sequence
  Description of Artificial Sequence: Synthetic coding sequence
atggaaggcgacaggaacgttcctccggtgccccccgcctctagcactccctataagcctccttatgggaagctgctgctaccaccgggaacagatggcggcaaggaaggccctcgagtgttgaatggtaatccacagcaggaggatggtgggcttgcaggaatcacagagcagcaaagcggagctttcgaccgctgggaaatgattcaggcccaggagttgcataataaactcaagatcaaacagaacctgcagcagcttaattccgatatctcagccatcactacatggctgaaaaaaaccgaggcagaattggagatgctaaagatggccaagcctccttccgatattcaagaaattgagctgagagtcaaacggttgcaggagatcctaaaagcctttgatacttacaaagccctggtggttagtgtgaatgtgtccagcaaggagttccttcagacagaaagcccagagtctacagagttacaatcccggctaagacaattgtcactgttatgggaagccgcccagggcgcggtggactcttggcgcggaggtctccgacagtccctcatgcaatgccagggctccaagactagacccaggtccgatgtcctcttttttaaagatttccaccagttgagtcagaatttgctgttatggctggcaagtgccaaaaacaggaggcagaaagctcacgttacagaccccaaagcggaccctcgcgctctgctcgagtgcaggcgggaactgatgcagctggagaaggaactggttgagcgacagccccaggtggacatgctgcaggaaatatctaactcactcttaatcaaggggcatggcgaggactgtatcgaagctgaggaaaaagtgcacgtcattgagaaaaaactgaaacagctgcgagaacaggtgtcacaagacctgatggcattacaaggaacacagaacccagccagccccctaccatcctttgacgaagtggatagtggcgatcaaccccccgctacaagcgtacctgcgccacgcgccaaattcagagctgtacgcacgactgagggagaggaagaaacagagagccgggtgccaggaagcaccagacctcagaggtccttcctctcccgtgttgtacgagcagccctgcccttgcagctcctcttgcttctgctacttctattggcctgcctgctgccatctagtgaggaggactattcctgtacgcaggctaataatttcgcccgctccttttaccccatgctccgctacaccaatggtccaccccctacctag

SEQ ID NO: 135885 - DNA, 1671 bp, Artificial Sequence
  Description of Artificial Sequence: Synthetic coding sequence
atggaggatccccgggagattcagaccgattcctggaggaagcgaggcgaaagcgaagagccttctagtccccagagtctttgccacctagtggcccccggccacgagaggtctggatgtgagactcctgtgtccgtggacagcatcccattggaatgggaccacacaggcgacgtcggcggatcctcctcacacgaagaagatgaggaaggaccatactactctgccctctccgatgtcgagattcctgagaatcctgaagcctacctcaagatgaccactaaaacattaaaagctagtagtggtaaatctatcagcgacggacattcgtggcacgtgccagactcccccagctgccctgagcaccattacaagcaaatggagggagatagaaacgtgcctcctgtaccccccgcatctagcactccttacaaaccgccgtacggaaagctgcttctcccacccggtactgacggcggtaaagaaggccctagggtcctgaatggcaatccacagcaggaagacggcggtcttgcagggataactgagcagcagagcggagccttcgatagatgggagatgatccaggcccaagaactccacaacaagttaaaaataaaacaaaatctccagcagttaaattctgatatctctgcaatcaccacctggctcaagaaaaccgaggctgaactggaaatgctgaaaatggccaagccaccatccgacattcaagagatagaactcagagttaagcgcctacaggagatactgaaggccttcgatacctataaagcccttgtcgtctctgtgaatgtgagcagcaaggagttcctgcagacagagtcccctgagtccaccgaactgcagtcaagattaagacagctgtccctgctgtgggaggccgcgcaaggtgcagtggacagctggcgcggtgggcttaggcagtctttgatgcaatgccagggaagtaagactagaccccgttccgatgttctgtttttcaaggactttcaccagctttcacagaatctgctgctgtggttagcaagtgccaagaaccgcagacagaaggcccacgtgacggaccccaaagctgacccgcgcgccttgcttgagtgccgtcgcgagctcatgcagcttgagaaagaactagtggaaagacagcctcaggttgacatgctgcaagagatatcaaatagtcttctgatcaaaggacatggggaagattgtatagaagctgaagagaaggtgcacgtcatcgagaaaaaattgaagcagcttcgtgaacaggtgtcccaagacctcatggcactacagggcacccagaatcctgcttcgcccctgccatcttttgacgaggtcgattccggcgatcagccacccgccacttcagtcccggccccccgggccaaacagtttcgggctgtgcggaccaccgaaggagaggaagaaacggaaagtagagtgccaggatctacccggccacagcggtcttttctgagccgggtggtcagggctgccctccctctgcagctgctccttctgttattgcttctgctcgcctgtctcctgccgtccagcgaggaggactactcctgtacacaggctaataactttgcccgctctttctacccaatgctgcggtatactaatggccccccaccgacctag

SEQ ID NO: 135886 - DNA, 2007 bp, Artificial Sequence
  Description of Artificial Sequence: Synthetic coding sequence
atggtccatgaaggcaatcagaggtgggataatctacagcgtagggttactgctgttttaagacggctccggcatttcaccaaccaaagggaagagttcgagggcacacgcgaatcaatcctggtgtggctcacagaaatggaccttcagcttacaaatgtagagcacttctccgaatccgacgccgacgacaagatgcgccagttaaatgggttccaacaagagattactctcaacactaacaaaattgatcagcttatcgtgtttggagagcaactgatccagaaatctgagccattagacgcagtcctcatagaggatgaactggaggagctccaccgctactgccaagaggtattcggaagagtgagtagattccatcgcaggctcaccagctgcaccccaggcctcgaggacgagaaggaggcttccgagaacgaaacggacatggaagacccacgcgagatccagactgattcatggaggaaacgaggggagtcagaggaaccttctagcccccagagcctttgtcatctggtggcacccggccatgaaaggtcaggatgtgagactcccgtgtcagtagacagtataccccttgagtgggatcatactggggacgtgggaggtagcagtagtcacgaagaagatgaggaaggcccatactactccgcacttagcggcaagagcatttccgacggacactcgtggcatgtgccggactctccatcatgcccagagcaccactacaaacaaatggagggcgaccgaaacgtccctccggtgccacctgctagctccaccccctacaagccaccgtacgggaaactgcttctgccaccgggcacagacggcggtaaagaagggccacgcgtgcttaacggcaacccccagcaggaggacgggggtctcgccggcattaccgagcaacagagcggcgccttcgacaggtgggaaatgattcaggcgcaggagctgcacaataagcttaagattaagcagaatcttcagcagctgaatagtgacatttcagccattacaacctggctgaagaagactgaggcagaattagaaatgttgaaaatggctaaaccgccgtcagacatccaggagatcgagcttagggttaagcgccttcaggagatcctgaaggcctttgacacatataaggccctagtagtgagcgtaaacgtgtcctccaaagagttcctccagaccgagtctcccgagtccaccgagttgcagagcaggcttaggcaactgagcctactgtgggaggcagctcagggagcagtggattcatggaggggagggctgcgtcagtcgctcatgcaatgccaggattttcatcagctgtcccaaaacctccttctgtggctcgcatccgccaagaaccgcagacagaaggctcatgtaacagaccctaaagccgatccccgcgccctattggagtgtcgacgggagctaatgcagctggaaaaggaattagtcgagcgccagccacaggttgatatgctgcaggaaatatcaaacagcctactgataaaaggccacggcgaggattgcattgaagctgaagagaaagttcacgttatcgagaagaagcttaagcagctccgcgagcaagtatctcaagatctgatggctctgcagggcacccagaatccagccagccccttaccttcattcgatgaagttgacagcggcgaccaaccgcccgcgacgtccgttccagcaccaagggcgaaacagtttcgagctgttagaacaacagaaggcgaggaggagacagagagccgcgtgcctggctctacacggccacagaggagctttctctcccgcgtagtgagagccgccttacccctccagctcctcctgctgctgttgctactcctggcttgtctgcttccatcttctgaggaggactatagctgtacgcaggcaaacaacttcgcaaggtctttctacccgatgctgcgttatactaacgggccccccccaacatag

SEQ ID NO: 135887 - DNA, 10626 bp, Artificial Sequence
  Description of Artificial Sequence: Synthetic coding sequence
atggaagaagatatttatactaacctttcaaagatggagacagtgctgggccagtctatgagtagtttgccattgtcataccgggaggcactcgaacgcctcgagcagtctaaagctttagtgagcaacctgatcagcaccaaggaggagctgatgaagctgcgacagattctgaggctgctgcgcctgcgttgtaccgaaaatgatgggatctgtctactgaagatcgtatctgccctctgggagaagtggttgagcctcctagaggccgccaaagaatgggagatgtggtgcgaagagctgaagcaggaatggaaattcgtttccgaggagattgagcgtgaggctatcattctggacaatttgcaggaggagctgcccgagatctctaagacgaaggaggccgccactacagaggagctatcggagctgctggactgcctctgtcaatacggtgagaacgtagaaaagcaacagctgctgctgaccttgctgctgcagcgaatccgctccattcagaacgtgccagaatccagcggagcagtggagacagtcccggcctttcaagaaatcacgagcatgaaggagaggtgcaataaactattgcagaaggtacaaaagaacaaggagcttgtgcagaccgagatccaggaaagacactcctttacaaaagagattatcgccctgaagaatttcttccagcagaccactacatccttccagaacatggcattccaagaccaccccgagaagtctgagcagtttgaggaactccagtctattctgaaaaaaggcaaactaaccttcgaaaatatcatggagaaactccggatcaagtattcagaaatgtacacaatcgtgcctgcagaaattgagtcacaggtcgaagagtgcaggaaagccctggaagacatagatgagaaaatctcaaatgaggtcttaaagagtagcccttcttatgctatgcggagaaaaatcgaggaaataaataacggcttacacaatgtggagaagatgctgcagcagaagtctaaaaacatcgagaaggctcaggaaatccagaagaaaatgtgggatgaattggacctatggcattccaagctgaatgaacttgacagtgaggtgcaggacattgttgagcaggatccagggcaggcccaggaatggatggacaatctaatgattcctttccagcagtaccaacaggtgagccaaagagctgaatgtagaacgtcgcagctgaacaaagccacagtgaagatggaggagtattccgacctgttgaaaagtacggaggcttggattgagaacacatcgcacctgctggccaacccagcggattacgacagcctgcgcactttgagtcaccacgcaagcactgtgcagatggctctggaggactctgagcagaagcacaatctgttgcacagcatctttatggatcttgaagatctctctatcatctttgagaccgacgagttaacacagtccattcaggaactgagcaaccaggtgactgcacttcagcagaagattatggagtctctgccccaaatccagcggatggcggacgacgtggtggctattgaatcagaagtaaagtctatggaaaagcgcgtgagcaaaattaagaccatcctgctgagcaaagaaatatttgatttttccccagaggagcatctgaaacacggggaggtcatcctagagaacatccgccctatgaaaaaaaccatcgcggagattgtgtcctaccaagtggaattacggctgccacagacaggcatgaaacctctaccagtcttccagcggaccaatcagcttctgcaggacatcaaactcctagagaacgttacacaagaacagaatgaactgttgaaggtagtgatcaagcagactaatgaatgggatgaggaaatcgagaatctgaagcagatacttaacaattactctgcccagttcagcctggaacatatgtcgccagaccaggctgataagctgcctcagttgcagggtgaaattgagcggatggagaaacagattctgtccctcaaccagaggaaggaagacctgctggtagacctgaaggccaccgtgctcaatctgcatcagcacctaaagcaggagcaggagggagtcgagagggataggctgcccgcagtgacttccgaggaggggggagtggccgagcgggacgcctctgaacgcaaactgaaccgccgaggaagcatgagctacttagcagcagttgaagaggaggtggaggagtcctcagtgaagtccgacaatggagacgaaaaggcggagccaagcccacagtcttggtcgtctttatggaagcacgacaaggatatggaggaagacagagcctcttcatcctctggaaccatcgtccaggaagcgtatggtaaaatatctacctccgacaacagcatggcacaaatcttgactccagactcactaaatacagagcagggacccgagtgcagtctcagacctaatcagacagaggagggcaccactcctcctatcgaagccgacacactggattcgtctgacgcgcagggagggctcgagccccgagtggagaagacccgaccagagcccaccgaggtcctgcacgcttgtaagacccaagtcgcggaactcgagctgtggttacaacaggccaacgtggctgtggagcccgaaaccctcaatgctgacatgcagcaggtgctcgaacagcagctcgtgggctgccaggccatgctgacggaaatcgaacacaaggtggcattcctcctggagacgtgtaaggaccagggactcggcgacaatggcgccacccagcatgaagccgaggctctctccctgaaactgaagacggtcaagtgtaatctcgaaaaggtgcagatgatgctccaagagaagcatagtgaagaccaacaccctaccattttaaagaagtcaagtgagcctgagcaccaagaagcattgcaaccagtgaatctatctgaactggaatccatagttaccgaaaggccccagtttagcagacaaaaagacttccaacagcagcaagtccttgaacttaaacccatggagcagaaggatttcattaagttcatcgagtttaacgctaagaaaatgtggcctcaatactgtcaacacgacaatgacaccacccaggagtccagcgcctccaaccaggcctcttcccccgaaaacgatgtgcctgactccatcttgagtcctcaagggcaaaacggggacaaatggcagtatctgcaccatgagttgtctagcaaaattaagcttcctctgccccagttggttgagcctcaggtttcgacgaatatggggatcctcccatcagttaccatgtacaacttccgatacccaactacagaggaactgaagacatacactacgcagctcgaggacctgcgacaggaagcatccaaccttcagacccaggagaacatgacagaggaagcatacatcaatctggacaagaagctctttgagcttttcctgaccctgagccagtgtctcagtagcgtcgaagaaatgctggaaatgccgaggctgtaccgtgaggacggaagcgggcaacaagttcactatgaaacattggcacttgagttgaaaaagctctatttggcccttagcgacaagaagggggatctcttgaaagctatgacctggcccggggaaaacaccaatcttttgctcgagtgtttcgataatctgcaggtgtgcttggaacacactcaggccgccgctgtctgccgttccaagagcctaaaagccgggctggactacaatcgatcctatcagaacgaaattaagagactgtaccaccagctcatcaagagtaagacctcgctgcagcaaagcttaaacgagatctccggacagagtgtggcggagcaacttcaaaaagctgatgcgtacacagttgaactcgagaatgcagagagccgtgtggcaaagctccgcgacgagggggaaaggttgcacttgccatatgccctcttacaggaggtctacaaactggaagacgtgctcgactctatgtggggaatgctccgagcacgctataccgaacttagctctccttttgtgacagagtcccaacaggacgctctcctgcagggcatggtcgaactggttaagatcggcaaagaaaagcttgcccacgggcacctgaagcaaacgaagtcaaaggtagccctccaggcacagattgagaaccataaagtattctttcagaaattggtcgccgacatgcttcttatacaggcgtattccgcaaagattttgccatcactgctccagaaccgcgagaccttctgggccgagcaagtgacggaggttaaaatccttgaggagaagtctcggcagtgtggaatgaaactccagtctttgctgcagaagtgggaagaattcgacgaaaactacgccagtctggaaaaagacctggaaattctgatctcaaccctgccctctgtgtctcttgtggaggagaccgaagagaggctggtggagcgcatttcattctatcagcagatcaaacgcaatatcggaggaaaacatgcacgcttgtatcagaccctgaacgaagggaaacaactggtagcctctgtaagctgcccagaacttgaaggccaaattgcaaaactggaggagcagtggcttagccttaataaaaaaattgaccacgagttgcataggttacaagccctactgaaacaccttctcagctacaatagagactctgatcaattgaccaagtggctggaatcttcccagcacaccctcaactattggaaagaacagagcctgaacgtatctcaggacctggatactatcagatcaaatatcaacaatttctttgagtttagcaaagaggtggacgaaaagtcaagccttaaaaccgccgtgatatccatcgggaaccagctgctccacctgaaagagaccgacaccgccaccttaagagcatctttggcacaatttgagcagaagtggaccatgctgatcacacagctgcccgatatccaggaaaaactgcaccagctgcaaatggaaaagctccccagccggaaggcgattaccgagatgatttcttggatgaacaatgtcgaacaccagacttctgacgaggactctgtccactctccttccagcgccagccaggtaaagcatcttcttcaaaagcacaaggagtttcggatggagatggactacaaacaatggatagtagacttcgttaatcagtctctgctccagttatcaacgtgtgatgtcgagtctaagagatatgagaggaccgagttcgccgagcatctcggggagatgaacaggcaatggcatagggtccacggcatgctcaacagaaagatccagcacctggagcagcttctggagtcaattaccgagtccgaaaacaagattcagattctgaacaattggctcgaggcccaagaggagagactgaaaacactgcagaagccggaaagtgtgataagcgtgcaaaaattgctcctggactgccaggatatagagaaccagttagccatcaagtccaaggcgttggatgagctgaaacagagttatctgaccctggagagcggggcagtccctcttcttgaggacactgcctccagaatcgatgagcttttccaaaagcgctccagtgttctcactcaggtgaaccagttaaaaacctccatgcagtcagtcttgcaggagtggaagatctatgatcagctctacgatgaggtaaatatgatgacaattagattttggtattgcatggagcacagcaagccagtggtactgagtttagagactctgcgctgccaggtggagaacttgcagtccctccaggatgaagccgagagttcagaaggtagctgggagaagctccaggaagttatcggaaaactaaaagggctttgcccatctgtggccgaaataattgaggaaaaatgccaaaacacccataagcggtggactcaggtgaaccaagctatcgccgaccagctccagaaggcacagagcttactgcaactgtggaaagcctacagcaacgcacacggcgaggccgctgctagattgaaacaacaggaggcaaaatttcagcagttggcgaatatttcaatgagtgggaacaatctcgctgagatccttcctcctgccttgcaagatatcaaagaattgcaacacgatgtacagaaaacaaaagaggctttcctgcagaattccagcgtactcgaccgtctgccccagccagccgagagttcgacccatatgctgctgccaggcccactgcacagtctccaacgggcagcctatctggaaaagatgcttctggttaaagcaaatgaattcgaattcgtgctgagccagttcaaggacttcggagtcagacttgaatccctaaaaggactgattatgcacgaagaagagaatctcgacagacttcaccagcaagagaaggagaacccggactcatttcttaaccacgtgttagcgctaaccgctcagtctccagatatcgagcatctcaacgaggtgtctcttaaacttcctttatcggacgtggcagtgaagacgctgcagaacatgaataggcagtggattagagccaccgcgaccgccctggagaggtgtagcgaactccagggtataggcctgaacgaaaaattcctgtattgctgtgagaagtggatccaactgctagagaagatagaggaagctctgaaagtggatgtagctaattcactgcccgagttattagaacagcagaagacctataagatgctggaggctgaagtgagcatcaatcagacaatcgccgacagctatgtgactcagtcgctgcagctgctggacaccacagagatagaaaatcgacccgaattcatcaccgagttctctaagttgactgaccggtggcagaatgcggttcaaggggtgaggcagaggaagggagatgtggatggcttggtgagacaatggcaagacttcacgacgtctgtcgagaatctcttccgcttccttaccgacacctctcatctgcttagcgcagtgaagggtcaagagaggtttagcctgtatcagacccgatcactcatccacgaattaaaaaacaaagagatccatttccagagacgaagaactacatgtgccctgacccttgaagccggagagaagttacttttgactacagacttgaagacaaaggaaagcgtaggacggagaatttcccagctccaggatagctggaaagacatggagcctcagctagcagaaatgatcaagcagttccagagtaccgtggaaacttgggatcagtgtgagaagaaaattaaagaacttaaatcacgcctgcaagtgcttaaagcccagtccgaggatcccctgccagaacttcacgaggacctacataacgaaaaggaactgattaaggaactggaacagtccctggccagctggacacagaatttaaaggaacttcagaccatgaaggccgatctgactcgccacgtcttagtcgaggacgtcatggtactgaaagagcaaatagaacatctgcatagacaatgggaggacctgtgtctacgagtggccatacggaagcaagaaattgaagaccggctgaacacttgggtggttttcaatgagaagaataaggaactgtgcgcttggctggtgcagatggagaataaggtccttcagacagcagacatatctatcgaggagatgattgagaaactccagaaggactgtatggaggaaatcaatttattctctgaaaataagctgcagcttaaacagatgggggaccaactcattaaggcttcgaataagtccagggcggcggagatcgatgataaactgaataagatcaatgaccgttggcagcacttgtttgacgtgatcgggtcaagagttaaaaaactcaaagagactttcgcattcatccagcagctggacaagaacatgtcgaacttgagaacctggctcgcacggatcgagagtgagctgtcaaagccagtggtgtacgacgtctgcgacgatcaggaaattcagaagagactggcggagcaacaggatttacaaagagatattgaacagcactccgccggagtagagagcgtgtttaacatctgtgatgtccttctgcacgatagtgatgcttgtgcaaacgaaaccgaatgtgactccatccaacagactacaagaagcctcgaccgacggtggaggaatatatgtgctatgtctatggagcgccgaatgaagatcgaagagacctggcgcctctggcaaaagttcctggacgattactctcggttcgaagattggttaaagtctgccgagcgaaccgctgcttgcccaaactcaagtgaagttctgtacacctccgccaaggaggaattgaagagattcgaggcttttcagcgccaaatccacgaacgactgactcagttggagctgataaacaagcagtacagacgcttagcacgggaaaatcgcactgatactgcgagtcgcctgaaacaaatggttcatgagggcaatcaacgctgggacaacctccaaagaagggtgaccgctgtacttcgtcgcttgaggcactttaccaaccagcgggaagagtttgaaggaactcgagagtcaatcctagtgtggcttaccgaaatggacctgcagttgactaacgtggagcacttcagtgagtccgacgccgatgacaaaatgagacagctcaatggtttccagcaggaaataaccttgaacactaataagattgatcagctgattgttttcggcgagcagcttatccaaaagtccgagccgttggatgccgttcttatcgaagacgaacttgaagagctccacaggtactgtcaagaggttttcggacgcgtctcccgttttcacagacggctaaccagttgtacaccaggcctggaagacgagaaagaggcctctgaaaatgagaccgacatggaggacccgagagagattcagactgacagctggaggaagagaggggagagcgaagagccttcaagtcctcaatcactgtgtcacttagtcgctccaggacacgagaggtccggttgtgagaccccagtgagcgttgattcaattcctctcgaatgggatcacaccggcgatgtagggggcagcagctctcacgaagaggatgaagagggaccatattactcagccttgtccgacgtcgaaataccggagaaccccgaggcctacctgaagatgactacaaagaccctgaaggcttcatccgggaagagcattagcgatggccactcatggcatgtccctgatagtccgtcctgccctgagcaccactacaaacagatggaaggagaccgcaatgtacccccggtcccgccagcatcgtcaacaccttacaagccgccatatggaaaattgcttttacccccaggtacggacggagggaaagagggccctcgggttttaaatggcaaccctcagcaggaagacggtggccttgccggcattaccgaacagcaaagtggggcattcgacagatgggagatgatccaggcgcaggagctacataacaagttgaaaattaaacagaatctgcagcagctaaactccgacatctccgcaatcacaacttggctaaaaaagaccgaagcggagctcgaaatgcttaaaatggcgaaacccccgtccgacatccaggagatcgagctgcgggttaaacgcctccaggaaatactcaaggcatttgatacctacaaggcattagtggtctccgttaatgtgtcctccaaagaatttctacagacggagagcccagaaagcacagagcttcagtcccggttgcgccaacttagtcttctgtgggaagctgcccaaggtgccgtcgatagttggagaggtgggcttagacagtccttgatgcagtgtcaggacttccatcaactgtcgcagaatttgttattatggctggcatcggcgaaaaataggcgccaaaaggcgcatgtaaccgatccaaaagctgatcctagagcactgctggagtgtaggcgcgaactgatgcagctcgagaaggagctcgtcgagcggcagccgcaagtagacatgctacaggagatctctaatagtctgctgatcaagggccacggcgaggactgcatcgaggccgaggagaaggtgcacgtcattgagaagaagctgaagcagttgagggagcaggtatcacaagatttaatggccctgcaggggactcagaaccccgccagtcctctgccctcctttgatgaagtcgatagcggcgatcagcctccagccacaagtgtacctgcccccagggctaagtttcgcgccgtcaggacaactgagggagaagaagaaacagagtcccgcgtcccagggagcacaaggccacagcgtagcttcctgagtagagttgtgcgagccgcactccccttgcagctcctcctattgctcctcctcctgctagcctgcctcttgcctagttcggaagaggattacagctgcacacaagccaacaactttgcccgctcattttatccaatgctgcgctataccaatggacccccaccaacgtag

SEQ ID NO: 135888 - DNA, 2292 bp, Artificial Sequence
  Description of Artificial Sequence: Synthetic coding sequence
atgtccatggagagaaggatgaaaatcgaggagacttggcggctgtggcagaagttcctggatgactatagtaggtttgaagattggcttaagtctgccgagcgaaccgccgcatgccctaattcatcggaggtgttatacaccagcgcgaaggaggaactgaaacgcttcgaagccttccaaaggcagatccatgaacggttgacacagttagagcttattaataaacaatatcgtcggcttgcaagggaaaaccggacagacaccgccagtcgtctgaagcagatggtccatgaaggaaaccagagatgggataacttacagcgcagggtcactgctgtcctccgacgactgcgacattttactaaccaaagggaagaatttgaggggacaagggagtctattcttgtgtggctgacagagatggatcttcagttaacaaatgtcgaacacttttccgagtccgacgcggacgataagatgaggcagctaaacggatttcagcaggagatcaccctgaataccaataagatcgatcagctgatcgtgtttggcgagcagctcattcagaagagtgagcctctggacgcggtactgatagaggatgaactcgaagaattgcaccggtactgccaggaggtctttggacgagtttctcgattccatcgcaggctgacatcttgcactccaggtctggaggatgagaaggaagctagtgagaatgaaacagatatggaggaccctcgggaaatccagaccgactcgtggcggaaaaggggagagagcgaagagccttcctccccgcagtccctgtgccacctggttgcgccgggccatgaaaggagtgggtgcgaaactccagtcagtgtagatagcatccccctggaatgggaccacaccggcgatgtcgggggcagttctagccatgaagaggacgaggagggcccctactattccgccttgagtggcaagagtatatcagatgggcatagctggcacgtgccggactccccatcttgccccgagcaccactacaagcagatggagggggatcgcaatgtgccgccggttccccctgcgtctagcacaccctataaacctccttatgggaagctcctgctcccgcccggtactgacggaggaaaggagggtccaagggtgcttaatgggaatcctcagcaggaagacggaggtctggcgggcattacggagcagcagtccggcgcgtttgaccggtgggaaatgattcaggcacaagagctccataacaagctaaaaattaaacagaatttgcaacagttgaacagcgatatctccgctattaccacatggctgaaaaaaaccgaggcagagcttgagatgctgaagatggctaagccccccagcgatattcaggagatcgagctgagggtgaaacgtctgcaagagattttgaaggctttcgacacctacaaagcgctagttgttagcgtgaacgtgtcttcaaaggaattcctgcagactgaatcaccagaatcaacagaattacaatcaagattgcgacagctgtctctgttatgggaagccgcccagggggccgtggattcttggaggggcgggctgcggcagtctctgatgcagtgccaggactttcaccagctgagtcagaacttgctgctttggctggcatctgccaaaaacaggaggcagaaagcacacgtgaccgatcctaaagcagatccgagagccttgctggaatgcagacgtgagttgatgcagttagaaaaagagctggtggaacgtcagccgcaggtggatatgctgcaggaaatcagcaattccctcctgattaaggggcatggtgaagattgcatcgaagccgaggaaaaagttcatgtgatcgagaaaaaattgaaacagttaagggagcaggtgagtcaggacctcatggccctccagggaactcaaaacccggcaagcccactcccatccttcgatgaagttgattcgggtgatcaaccccctgcaacttccgtgcctgctccaagggcaaagcaattcagggctgtccggactacagagggagaagaagagacggagagcagagtccctggctccacccggccccagaggtcctttctaagcagagttgtaagagctgccctccccctccagttgctgttgctgctgctccttctgctggcgtgcttgctgcccagctccgaggaggattatagttgcacccaggctaataattttgcccggagcttttaccccatgctgaggtatactaacgggcctccgccaacatag

SEQ ID NO: 135889 - DNA, 7251 bp, Artificial Sequence
  Description of Artificial Sequence: Synthetic coding sequence
atggaacagttccccaaggaaactgtggtggaaagttcaggacctaaagttctcgagacagccgaggagatacaggaacgcaggcaggaggtattgaccagatatcagtcatttaaggaacgggtcgctgaaagggggcagaagctcgaggattcgtaccatctccaagttttcaaacgagatgcagatgatcttggtaaatggattatggagaaggtcaacatcctgaccgacaaaagttatgaggatcccacaaatatacagggcaagtatcagaaacaccagagcctagaagctgaggtccaaacaaagagtcgcctgatgagtgaactggagaagacgcgggaagaaagattcacaatgggtcacagtgcacacgaggagaccaaagcccacatagaggagttaaggcatttgtgggatctgctcttagaacttaccctggagaaaggagatcagcttttgcgggccttgaagtttcaacagtatgtgcaagagtgtgcagacatcttggagtggatcggagacaaagaagccatagctactagtgtggaactgggtgaagattgggagaggacagaggttctgcacaagaagtttgaggattttcaggtagagctcgtcgcaaaggagggccgggtggtggaagtgaatcagtacgccaacgaatgcgccgaggagaaccatccggatctgcccctgatccagtctaaacaaaacgaggtcaacgcagcatgggaacgccttaggggccttgccctccaacggcagaaagccctcagcaacgccgcaaatctgcaaagattcaagcgagacgtaactgaagcaattcagtggattaaagaaaaagagccagttttgaccagtgaggactatggcaaggacctagttgcatccgaaggcctcttccattctcataaaggtctggagcgaaacttagccgtgatgtctgataaagtgaaggagctctgcgccaaggcagagaaactgacgttgagccatccctctgatgcacctcagattcaagagatgaaagaagacctggtgtctagctgggaacatatccgtgccttggccacctctagatatgaaaagctccaagccacatattggtaccatagattctcatccgacttcgatgaactgtctggatggatgaatgagaaaacagcagccatcaacgcagatgaactccccacggacgtcgccggtggcgaagtgctccttgacagacaccagcaacataaacatgaaattgattcttacgacgacaggttccagagcgcagacgagacgggacaggacttggtcaacgccaatcatgaagccagtgatgaggtccgagagaagatggagattttggataacaactggacagccctcctcgaactttgggacgagcgccaccgccagtatgagcagtgtttagatttccatcttttttatcgggatagtgaacaggtggactcttggatgtcacggcaggaggcttttctggaaaacgaagatctggggaattctctcggctctgccgaagcgctgctacaaaagcacgaagacttcgaagaggcatttaccgctcaagaagagaaaattattactgtggacaaaaccgccacgaagctgatcggagacgatcattacgactcagaaaacataaaggccatccgagatggtctgttggcacgccgcgatgccctgagggaaaaggccgctacgcgacggcgattactcaaggagagcctcctgctgcagaagctgtacgaggatagtgacgatttgaagaactggatcaataaaaagaaaaagttggcagacgacgaggattacaaagatatccagaacctaaagtcaagggtccagaagcagcaggtgttcgagaaggaattagccgtgaataaaacgcagttggaaaacattcagaagactggccaggagatgatcgaaggcggacactatgcttcagataatgtgacgacgaggctcagtgaagtggcgagcctttgggaggagctacttgaggccaccaagcagaagggcacgcagctccatgaagccaatcaacagttacagttcgagaacaatgctgaagacctgcagaggtggctggaggacgtggaatggcaggtgactagtgaggactatggaaaaggactggccgaagtgcaaaatcggctgcggaaacacggccttctggagagcgctgtcgcagcacggcaggatcaagtcgatatcttgacagacttagctgcttacttcgaggagattggccatccagactcaaaggatattcgggcaagacaggagagcctcgtctgtcgcttcgaagctctgaaggaacccctcgccacccgcaaaaagaaattactcgatcttcttcatttgcagctcatttgccgtgacacagaagacgaggaagcatggattcaagaaacagagccctctgccacatcaacctatctggggaaggacctgatcgcttcgaagaagctgttgaataggcatcgtgtgatattggagaatattgcaagtcatgagcctagaatccaggaaattacggagaggggcaacaagatggtagaggagggacactttgctgcagaggatgtggccagtcgcgtaaagagtctgaaccagaacatggagagcctgcgcgcgagggccgcccgcaggcaaaacgatctcgaggctaatgtacaattccagcagtacttggccgacctgcatgaggccgagacttggatcagggagaaagagccaatcgttgacaacaccaattacggggccgacgaggaagcagccggggcccttcttaagaagcacgaggcttttctgcttgacctcaacagctttggcgacagcatgaaagccctgagaaaccaggccaacgcttgtcagcagcaacaggccgcccccgttgaaggcgtagccggcgagcagagggtgatggcactctacgacttccaagcgagatcgccccgggaagtgacaatgaagaagggagatgttttgaccctgcttagctctatcaataaagattggtggaaggtggaagccgctgaccaccagggtatcgtgccggctgtgtacgtccgccgcctcgcccatgatgagtttcccatgttgccacagaggcgtagagaggagccaggcaacattacccaaaggcaggagcagatcgaaaaccagtaccgatcacttctagacagagcggaagaacgtcgacggcgcctactgcagcggtacaacgagtttcttttggcctacgaggcaggggacatgctggagtggatccaggaaaaaaaagccgagaatacaggcgtcgaattagatgacgtgtgggaattgcaaaagaagtttgatgagttccaaaaggatcttaataccaacgagccccgactgagagacattaacaaggtggcagatgacttgttatttgaaggtctgttaacccctgagggtgcccagattaggcaggaacttaacagtaggtggggatctctgcagagattggcagacgaacaacgacagcttctgggctcagcccatgccgtggaagtgttccaccgagaagccgatgatactaaggaacaaattgaaaaaaaatgtcaggcactttctgctgcggatccgggttccgatctgttcagtgtgcaggcgttgcaacgacgccatgagggatttgaacgggatttggtacctcttggcgacaaggtgacaatcttgggggagactgccgagcggttatcagagtctcaccctgacgcgactgaggatcttcagcgccagaagatggaacttaacgaggcttgggaggatttacagggtcgcaccaaggatcggaaagagtccctgaatgaggctcagaagttctacctgttcctgtccaaggcgcgcgatttgcagaattggatctcctctatcggcggaatggtcagttctcaggaactggcagaggatctgacaggtatcgaaattctcctcgaacgtcaccaggagcatcgtgctgacatggaagcggaggcacctacattccaggcactcgaagatttctcggccgagctaatcgactcagggcatcacgccagcccggagatagagaaaaagttacaagccgttaagctggagcgagacgacctcgagaaagcttgggagaagcgcaagaaaattttggaccaatgcttggagctgcagatgtttcaaggcaactgtgaccaagtggaatcttggatggttgctagagaaaattctcttcgtagtgacgacaaatctagtctcgattccctggaggcgcttatgaaaaaacgcgacgacctggacaaagcgataaccgctcaggagggcaaaataaccgatttagagcactttgctgagtctctgatcgcggacgagcactacgccaaggaggagattgccacccgtctgcagcgggtgttggaccgctggaaggctctgaaggcccaactaatagatgagcgcactaaactgggagactatgctaatctcaagcagttttaccgcgatcttgaggaactggaagaatggatatccgaaatgctccctacagcttgcgatgagtcatacaaggatgccaccaacattcagcgcaagtacctgaagcaccagacattcgcacacgaggtcgacgggaggtccgagcaggtgcacggcgtaatcaacttaggaaactcactgatcgaatgtagcgcatgcgacggcaacgaggaagcaatgaaagagcagctcgaacagctaaaggaacactgggaccatctcctggagagaactaatgataaaggcaagaagctgaacgaagcatcacggcagcaaaggttcaatacctctattcgagacttcgaattttggttgagcgaagccgagaccttgttagccatgaaggaccaggctcgcgacctggccagcgctggcaacctcttaaaaaagcaccagctgttggaaagagaaatgctggcaagagaggacgctcttaaggacttgaacacgctagccgaggatctactgtcgtccggaacatttaatgtcgaccaaatcgtgaaaaagaaagacaatgtgaataagcgcttcctaaatgttcaggagctcgcggctgcacaccacgaaaaactgaaagaagcatacgcgttatttcaattctttcaggacttggacgatgaggagtcctggatcgaagaaaaactaatacgggtttcttctcaggactatgggagggatttgcaaggtgtgcagaaccttcttaagaagcataaaaggctcgaaggggagctggtcgcacacgaaccagccatccagaacgtacttgacatggctgagaagttaaaggataaggccgcagtcggacaggaagaaattcagttacgtctggcccagttcgtagagcactgggaaaagctaaaggaactggcgaaagcgcgtggcctcaagcttgaggaatccttggaatatctccagttcatgcagaacgctgaggaggaagaagcttggattaacgaaaaaaacgctttggcagtccgaggcgactgcggggacactttagcagccactcagagtctcctcatgaaacacgaggccctggagaatgatttcgcggtacatgaaacgcgagttcagaacgtctgtgcccagggcgaggacattctcaacaaggaagagagtcagaacaaggaaatcagttctaagatcgaggctctaaatgagaaaaccccttccctggccaaggccattgccgcgtggaagctgcagctagaagatgactacgccttccaggagttcaactggaaggccgacgtcgttgaagcttggattgctgataaggaaaccagtctgaaaactaacggcaatggggcagatctcggtgattttctgacgttgttggccaagcaggacacgctggatgcatcgcttcaatctttccagcaagaaagactgcccgaaatcacagacctcaaggataagctcatctcggcccagcacaatcaaagcaaggcaatcgaggagcggtacgctgcacttctgaaacgttgggaacaactgttagaagcaagcgccgtccatcggcagaaactactcgaaaaacagctgccactccaaaaggcagaggatttgtttgtggagtttgcccacaaggccagtgcactgaacaactggtgcgagaagatggaagagaacctctctgagccagtccattgtgtgtcactgaacgagattaggcagctgcagaaagatcatgaggatttcctggcaagcctggccagagcacaagctgacttcaagtgtttattagagctggaccagcagatcaaagcacttggcgttccttcctctccctacacctggttaactgtggaagtcctggagagaacctggaaacacctcagtgacatcattgaggagagagaacaggagttgcagaaggaagaagccaggcaggtgaagaacttcgaaatgtgccaggaattcgagcagaacgcctctaccttccttcaatggatcctcgagacacgcgcttattttttagatggctccctgttaaaagagactggtactctggagagtcagctcgaagccaacaaacgaaagcagaaagagatccaggctatgaagcgacagcttacaaagatcgtcgatctgggagacaacctggaagatgccttgatccttgacattaagtacagcaccatcggtctcgcccagcaatgggaccagttgtaccagttagggcttaggatgcagcacaacctggaacagcagatccaagcaaaggacattaaaggagtaagcgaggagactcttaaggagttcagtacgatctacaagcacttcgatgaaaatctgaccggaaggctgacacacaaagagtttagatcctgtctgagaggattaaactattacctgccgatggttgaggaagacgaacacgagcccaagtttgaaaagtttctggatgctgtggaccccggacggaaagggtatgtgtctcttgaagattacacagccttcctgatcgacaaagaatccgagaatatcaaatctagtgatgaaatagagaatgcatttcaggcattggccgaaggtaaaagctatattacgaaagaggatatgaaacaagccctgactcccgagcaggtgtctttctgtgctactcacatgcagcagtatatggacccgcgagggcgctctcatctgtccggctacgattacgttggttttactaactcctactttggcaactag

SEQ ID NO: 135890 - DNA, 7260 bp, Artificial Sequence
  Description of Artificial Sequence: Synthetic coding sequence
atggagcagttccctaaggagaccgtcgtggagtcgtcaggccccaaggtgctcgagactgccgaggagattcaagaacggcggcaggaggtactgacgcgctaccaatcattcaaagagagggtggccgaacggggccaaaaactggaagatagttatcatttgcaggtcttcaagcgcgatgccgatgatctcggcaaatggattatggaaaaggtgaatatcctgactgataagagttacgaagacccgactaacattcagggcaagtatcaaaaacaccagagcttggaagcagaagtccagaccaagtcacggttgatgtcagaactggaaaagacgcgggaggagcgatttactatggggcattcagcccacgaggagaccaaggcgcatatcgaggagctccgacacctctgggatcttctcctcgagctgaccctggagaagggcgatcagcttttaagggcacttaaattccagcagtacgttcaagagtgcgctgacattctggaatggattggcgataaagaggccatcgccacaagcgtggagctcggagaggattgggagagaacagaggtgctgcacaagaaattcgaagactttcaggttgagctggtggcaaaggaagggcgagtcgtcgaggtgaaccagtatgccaacgagtgtgccgaggagaatcatcctgacttgcccctgatccagtccaagcagaacgaagtgaatgcagcgtgggagcgcctgaggggtctcgctctccaacgccaaaaggccctgagcaatgctgccaacctacagcgattcaaacgtgatgttacagaagctatacagtggattaaggagaaggaaccggtgctgacctcagaggactatggaaaagacttagtggcctccgagggcctttttcacagtcataaaggactcgaacgcaatcttgccgtaatgtccgacaaggttaaggaactgtgcgcgaaggctgaaaagctgactcttagtcacccctccgatgcccctcagattcaggaaatgaaagaagacctcgtgtcttcatgggagcacataagggccctcgctacctctagatatgaaaagctgcaggcgacctactggtatcaccgcttttcgtcggatttcgacgagctgagcggttggatgaacgagaagacagctgctattaacgccgatgaacttccaacggacgtagccgggggtgaagtgttgctggatagacatcagcagcacaagcatgaaattgatagttatgacgataggttccagagtgcagacgagactgggcaggatctagtgaatgcaaatcatgaggcctccgacgaagtcagagagaagatggagatcctggacaataactggacggcactactggagctgtgggatgaacgccaccgccagtatgagcagtgtcttgactttcacctgttttacagggactcagagcaggtggattcctggatgagtcggcaagaagcctttctggaaaatgaggacctaggaaactcgctcgggagcgctgaggctctgctgcagaaacatgaagacttcgaggaagctttcactgctcaagaggaaaagatcattacagtagacaaaacggccaccaagctgatcggcgatgaccactatgacagcgagaatattaaagcgatcagggatggactgttggcccgtcgcgacgccctgcgggagaaggccgccactcgacgtcgccttttaaaggagagtctgttgctgcagaagctctatgaagacagtgacgatttgaaaaattggattaataagaaaaagaaacttgctgacgacgaagactacaaggacatccagaatctgaaaagcagggtccaaaagcagcaagtctttgaaaaggaactggctgtgaataaaacccaactggaaaatatccagaaaactgggcaggagatgattgaaggaggacactacgcctcagataatgttaccacacgactctccgaggtcgcatcattgtgggaagaactactcgaggccaccaaacagaaaggaacacagcttcacgaggctaatcaacagctgcagtttgagaataatgccgaagaccttcagaggtggctcgaggacgtcgagtggcaggttacttctgaagactacggcaagggcctggccgaggtgcagaatagactgagaaaacatggactcttagagtctgcagttgctgccagacaagaccaagtcgacatccttaccgatttagcggcctatttcgaagagatcggccacccagattccaaagacattagggcccgacaggaatccctggtgtgccggtttgaggcactcaaagagcctctggctaccaggaaaaaaaagcttctcgacttgctccatctgcagcttatctgccgagatactgaggatgaagaagcttggattcaagagacagaaccaagcgccacctcaacttatctgggcaaggacctgatcgcatctaagaaactcctcaatagacacagagtgatacttgagaatatcgcatcccatgagcctaggattcaggaaatcaccgaacggggcaataagatggtggaggagggacattttgctgccgaggacgtggcatccagagtaaaatctttgaaccagaatatggagagtctgcgggcacgcgccgcccggagacagaatgaccttgaggctaatgttcagtttcagcagtatctggccgaccttcacgaggctgaaacatggattcgagaaaaagagcctattgtcgataataccaactatggtgcagacgaggaggctgccggagccctactcaagaaacatgaagcttttttgctagacctgaacagctttggcgatagcatgaaggcgctgaggaaccaggccaacgcctgccaacaacagcaggcggctcctgttgaaggagtcgccggggagcagcgagtcatggccctgtatgactttcaggcaaggagtccccgggaggtgacaatgaagaaaggtgatgtgttaactctgctgtcatcaattaataaggattggtggaaagtggaagctgccgaccaccaaggcattgtgcctgccgtgtatgtgcgaagactggcccacgatgaattcccgatgctcccacagcgccgaagggaagaacccggcaacatcacacaaaggcaggagcagattgagaaccagtacagaagcctgctggaccgtgcagaggagcggaggcgcagactgctgcaacgatacaacgaatttctattggcctatgaagccggcgatatgctagagtggatccaggagaagaaagccgagaatacgggcgtggaactggatgacgtatgggagctgcagaagaaattcgatgagttccaaaaggatctgaacacaaatgaacctcggttgagggatattaataaagtcgccgacgacttgctcttcgaaggattactgacccctgagggtgctcagatcagacaggaactaaactccaggtggggatcgctgcagagactcgctgacgaacagagacagctgctgggctccgcccacgctgtggaagtgtttcaccgcgaggccgatgacaccaaggagcagatcgaaaaaaaatgccaggccctaagcgctgctgatccgggctctgatctctttagtgtgcaagcgctgcagcgcaggcatgagggctttgaacgggaccttgtgccattaggtgataaagtgactattttgggcgagaccgctgagagactctctgagtcccacccagatgcaacagaagatctgcaaagacagaaaatggagttaaacgaggcatgggaggatctgcaggggaggacgaaggatcggaaggaatcactcaacgaagctcaaaagttttatctgtttctgtccaaggcacgggatctccagaactggattagttccatcggcggtatggtcagctctcaagaactggccgaggacttaacaggaatcgagatcctcctggagcgacaccaagagcacagagctgacatggaagccgaggctcctacttttcaagctctggaggacttctcagccgagctaattgatagcggccatcacgcaagtcccgaaattgagaagaagcttcaggcagtaaagctggagagggatgatcttgagaaagcctgggagaagagaaagaagatcctcgaccagtgccttgaactacaaatgtttcagggcaactgcgaccaggtcgaaagctggatggtggcacgcgaaaactccctcaggagtgacgataaatcatcccttgactccctggaggctctgatgaaaaagcgggacgacctggacaaagctatcacagcgcaggagggtaagatcaccgatttggagcattttgcagagtctctgattgcggacgagcattacgcaaaagaggaaattgctactaggctccagcgcgtgctggaccgctggaaagctctgaaggctcagttgatcgacgaaagaacgaagctcggtgactatgcaaatctgaagcagttctaccgagacctggaagaacttgaagaatggattagcgaaatgctacctacagcttgcgatgagtcctacaaggatgcgacaaatatccagaggaaatacttgaaacatcagacctttgcccatgaggtggacggcagatctgagcaagtgcacggtgtgattaatttagggaattcgctcatagagtgtagcgcatgtgacggcaacgaggaggcgatgaaggaacaactggagcaactgaaagagcactgggatcatttgcttgagagaacaaacgataagggaaagaaactaaatgaggccagcaggcagcaacgcttcaacacgtctatacgggattttgaattttggttaagtgaggctgagacccttctcgcgatgaaggatcaggccagggacctggcatccgcaggaaacctcctcaagaaacatcagcttctggaacgggagatgcttgcgagagaagatgccctcaaagacctgaacaccctggccgaggatttactgagtagcgggaccttcaacgtggatcagatcgtcaagaagaaagataatgtcaacaaaagatttctgaacgtgcaggagctggcggctgcacatcacgagaagctcaaggaggcttacgctctgttccaattctttcaggatcttgacgatgaggagagctggatcgaggaaaaactcattagagtgtcaagtcaggactacggtcgagatctgcaaggcgtccagaacctgctcaagaagcacaaacgtctggagggcgagctcgtggcccatgaacccgcgattcagaacgtgctggatatggctgaaaaactcaaggacaaagccgcagtgggtcaagaggagatccaacttcggctagcccaatttgttgaacactgggaaaagcttaaagagctcgcgaaggcacggggcctgaaactggaggaaagtctcgagtatttacagtttatgcagaatgccgaagaggaagaggcttggattaatgagaaaaatgctctcgctgttagaggagattgcggcgacacgcttgccgcaacccagagcttgctcatgaagcacgaagcattagagaacgattttgcagtgcatgaaactcgggtccagaacgtctgcgcccaaggggaagacattctgaataaggtgctacaggaagagtcccagaacaaagaaatttcgtcgaagatcgaggcgttgaacgagaagactccctccctcgcgaaggctatcgccgcctggaagctgcagctggaggacgactatgccttccaagaattcaattggaaagccgatgtcgtggaagcatggatcgccgacaaggagacaagtctgaagaccaatggtaatggggccgatctgggagactttctgaccctgttagctaaacaggacactcttgacgcctcgctgcagtcattccagcaggaacgcctcccagagataaccgacctgaaggataagctaatctctgctcagcacaatcagtccaaggccattgaggaaaggtatgccgccttgttgaaacggtgggagcagctgttagaggctagcgccgtgcaccggcaaaagctcctggaaaagcagttaccacttcagaaagcagaagaccttttcgttgaattcgcccacaaagcctccgccctcaataattggtgcgaaaaaatggaggagaatctttccgagcccgtccattgcgtttctctcaatgaaattcggcaattacagaaggatcatgaagatttccttgccagcctggccagagctcaagctgactttaaatgtctgctagagcttgatcagcagatcaaagcgctgggagtccctagctccccttatacctggctgaccgttgaggtcctcgaaaggacgtggaagcatctgagcgacataatagaagagcgagagcaagaactgcagaaggaggaagcccgccaagttaagaattttgagatgtgccaggaattcgagcagaatgcctcaacatttctgcagtggatactcgaaacccgagcctatttcctggatggatcactgttgaaggaaacaggcacactggagtctcagctcgaggccaataaacggaagcagaaggagatccaagctatgaagagacagcttacaaagatagtggatctgggcgataacctggaggatgcgcttattctggacattaagtattctacaatcgggctagcccaacaatgggaccagctatatcaactggggctgaggatgcagcacaatttggaacagcagatccaggcgaaggatatcaaaggcgtctccgaagaaacacttaaagagttctccacgatctacaagcactttgacgaaaacctgacaggccggctgacccacaaggagttccggtcctgtttgagggggctgaattattatctgccaatggtcgaagaagacgaacacgaaccgaagttcgagaagtttctggatgctgttgaccctggtcggaagggatatgtatccttagaagattacacagccttcttgatcgacaaagaaagtgagaacatcaagtcttccgacgagatcgaaaatgcttttcaggctttggcggaaggcaagtcctacatcacgaaggaagatatgaaacaggcactgaccccagagcaggtgagtttttgtgccacccatatgcagcaatacatggacccacgcggacgatctcacctatcaggctacgattatgttggttttacaaatagctatttcggtaattag

SEQ ID NO: 135891 - DNA, 7434 bp, Artificial Sequence
  Description of Artificial Sequence: Synthetic coding sequence
atggacccaagcggcgtcaaagtgctcgaaaccgctgaggatatccaagaaagacggcagcaggtgctggatcgttaccaccgctttaaggagttgtccaccttgcgcaggcagaagcttgaggattcctaccgattccagttctttcagcgagatgcagaggagctggagaaatggatccaggagaaactgcagatcgccagcgacgagaactacaaggacccgacaaaccttcaaggcaagctacaaaaacaccaggccttcgaagctgaagtccaagcgaattccggcgccattgtgaagctagacgagactgggaaccttatgattagcgaaggtcacttcgcatctgaaactatccgcaccagactcatggaactccatcgccaatgggagttactgttagagaaaatgcgggaaaaggggattaaactattgcaggcccagaagctggtgcagtacttgagagagtgcgaggatgtcatggactggatcaatgataaagaagccattgtgacatctgaagaacttggtcaggacctggaacatgtcgaggtgctgcagaagaagttcgaagagtttcagaccgacatggctgcgcacgaagaaagagtcaatgaagtcaaccaatttgctgcgaaactgattcaggagcaacaccccgaagaggaattaatcaagaccaaacaggacgaagtcaatgctgcctggcagcgtcttaaggggttagccttgcagcggcagggaaaactgttcggggcggcggaggtgcaaaggttcaatcgagacgtggatgagaccatttcctggattaaagagaaggagcaactcatggcatctgacgatttcggcagagatctcgctagcgttcaggctctgctccgtaagcacgaggggctggagagggatctggcggcgctggaggataaagtaaaagctttatgcgcagaagcagatcgactccagcaatcacacccactgagcgctactcaaattcaggttaagcgcgaagagttaattaccaattgggagcaaatccgcacgctggccgcggaaaggcacgccaggctcaatgatagctatagactccaacggtttctggcggattttcgggatttaaccagctgggtgaccgaaatgaaggctctcatcaatgcagatgagctcgcctcggatgtggctggcgctgaggcactgctggaccggcatcaggagcacaagggagaaatcgacgcccacgaagatagcttcaagagtgcagatgaatccggacaggcactcctggccgcaggccactatgccagcgacgaagtcagggagaaactcaccgtgcttagcgaggagagagctgctctccttgagctttgggaactgaggcggcaacaatacgagcaatgtatggacttgcagctgttctaccgcgacactgagcaggtcgataattggatgtccaagcaggaggcgttcctccttaacgaggaccttggagattccctggactccgtggaagccctacttaaaaagcacgaagattttgagaagtcccttagtgcccaggaagagaagatcactgccctggacgaatttgccaccaagctcattcaaaataatcactatgccatggaggacgtggccacccgccgggacgccctgttgtcacggaggaacgccctgcacgagcgagccatgagaaggcgagcgcagcttgcagattcttttcacctacagcagttttttcgggactcagatgaactgaaaagctgggttaacgagaaaatgaagaccgccaccgacgaagcttacaaggaccctagtaatttgcaaggaaaggtccagaaacatcaggcgttcgaggccgaactgagcgccaatcagagtcgaatcgacgccctggaaaaggcagggcaaaagctaatcgatgtcaatcattatgccaaggatgaggtcgcggcccgaatgaacgaggtcataagcctctggaagaagctcctcgaagccaccgagctaaaggggatcaagctaagggaagcgaaccagcagcagcagttcaatagaaatgtagaagacatagagttgtggctctacgaggtcgagggccatctggctagcgatgattacgggaaggaccttaccaacgtgcagaatctgcaaaaaaaacacgctttgctcgaagctgatgtggctgctcaccaggatcggatcgatggcattacaatacaggcgcggcagttccaggacgcaggtcactttgacgctgaaaacataaagaagaagcaggaggcattagtggcccggtacgaggccctcaaagagcccatggtggctagaaagcaaaagttagcagattccctgaggctacagcaactcttcagagatgtcgaggacgaagaaacttggataagagagaaggagcccatcgccgccagtacaaaccggggcaaagaccttatcggggtgcagaatcttctaaaaaagcatcaagccctgcaggcggagatagccggacacgagccccgtattaaggcagtgactcagaaaggaaacgccatggtggaggaaggtcatttcgcggcagaggatgttaaggcaaagcttcacgagctgaatcagaagtgggaggcccttaaagccaaggcctcccagcgccgacaggacctggaagatagtctgcaggcgcaacagtacttcgccgacgctaacgaggccgagagctggatgcgggagaaagagccaattgtggggagcaccgactatgggaaagatgaggactccgccgaagcactgctgaagaaacacgaagcattaatgtcagacctgagtgcttatggaagcagcattcaggcactgcgggaacaggcccaatcatgcagacagcaggtcgcgccaaccgacgacgagacaggcaaggaactggtgctggctctgtacgattatcaggaaaagtccccacgggaagtcaccatgaagaagggcgacatcttgacactgctgaattcgactaataaggattggtggaaagtcgaagttaatgatagacaggggtttgtccctgcggcctatgtgaaaaagctggaccctgctcaatccgccagtcgcgaaaacctgctggaggaacagggctccattgcgctgcggcaagagcagatagacaatcagacccgtattactaaagaagcagggagcgtcagcctccgcatgaaacaggtcgaagagctctatcattctctgttggaactcggcgagaagcggaagggaatgctggagaaatcttgtaaaaaattcatgttgttccgggaggcgaacgaactacagcaatggatcaatgaaaaggaggctgccttaaccagcgaggaggtgggcgcagatctcgagcaagttgaggtactgcagaagaaattcgatgactttcagaaggacctcaaggccaatgagtctcgattaaaagatatcaataaggtggccgaggacctcgagtcagaaggcttaatggctgaagaagtccaagcggtgcagcagcaagaggtatacgggatgatgccccgggatgaaacagacagcaaaacagcctcaccatggaaatctgcgcgcctcatggtacataccgtggccacctttaacagcatcaaggaattaaatgagagatggagaagtctccagcagctcgcggaggagcgctcgcagctcctgggcagtgcccatgaagtgcaaaggtttcacagggacgctgacgaaaccaaggaatggattgaggagaaaaaccaggcgttgaataccgacaattatggtcacgacctcgcgagcgtgcaggctctacagaggaagcacgagggttttgagcgggacctggcagccctgggcgacaaggtgaactcattgggagagaccgccgagcgacttatccagagtcacccagaaagtgccgaagatctccaggagaaatgcaccgaactcaaccaggcctggagtagcctggggaagagggcagatcagagaaaggcaaaattaggtgattcacacgatctccagaggttcctgtctgattttcgggacctgatgtcttggataaacggcatcagggggttggtgtcctctgacgaactagcaaaggacgtgacaggggctgaggcgctcctggaaagacaccaggagcataggaccgaaattgacgctcgagcaggcaccttccaggcctttgagcaatttggtcagcaattgctggcccacggacattacgcctcccccgagattaaacaaaaactggatatcctggatcaggaaagagccgacctggagaaagcctgggtgcaacgtaggatgatgctggatcagtgcttagagttacagctgtttcatagagactgtgagcaagcggagaactggatggccgccagggaggcatttttgaacacagaagacaagggcgattcgctggattccgtggaagctcttattaaaaaacatgaagactttgacaaagcgatcaatgtacaagaggaaaagattgccgcgctgcaggctttcgccgaccagctcattgctgcgggccactatgcaaagggggacatcagctcccgtcgcaacgaggtccttgatcgatggaggcgactgaaagctcaaatgatagagaaacgctctaaactcggggagagccaaacgcttcagcagttcagccgagacgtcgacgaaatcgaggcctggatcagtgaaaaactgcagactgcctctgatgagtcctataaagatcctacgaatattcaagtcagcctgatgttgtctaagcatcaaaagcaccaggcgttcgaggccgagcttcatgctaatgcagatcgcatccggggcgtaattgatatgggtaactccctcattgagaggggcgcctgcgctggctctgaggacgctgttaaggctagactggctgccttggcggatcagtggcagtttttagtgcagaagagcgccgaaaagagtcagaaactcaaggaagccaacaagcagcagaattttaataccggtattaaggacttcgacttctggctttctgaggtggaggctctcctcgcctcggaggactatggaaaggatctggccagcgtgaataacctgctcaagaagcaccaactgctggaggccgacatttctgctcatgaggatcgattaaaagacttgaattcccaggccgactcgctgatgaccagctcggcgttcgataccagccaagtgaaggataaacgggacaccatcaacgggaggttccagaaaatcaagtcaatggccgcgtctcggcgagccaagctcaacgagtcacacagactccatcagttttttagagacatggatgacgaagaaagctggatcaaggaaaagaaactcctcgtcggcagtgaggattacggacgggatctcacaggagtacaaaatcttcggaagaagcacaaaagactggaggccgaacttgccgctcacgagcccgcaattcagggagttctcgacaccggaaaaaagttgagcgacgataacacaattggaaaagaggagatccaacagaggctggctcagttcgttgaacattggaaagagctgaagcagctcgccgccgctcgcggacaacgcctcgaagaatcccttgagtatcagcagtttgttgccaatgtggaggaggaagaggcttggattaatgaaaaaatgacattagtcgcgagcgaagattacggcgacactctcgcagctatccagggtctcttgaaaaaacacgaggccttcgagacagattttacagtccataaggacagggtgaacgatgtgtgtactaacgggcaggacctgataaagaagaacaaccatcatgaggaaaacataagctcaaaaatgaaagggcttaatggaaaggtctctgatctcgaaaaagctgcagcccagcggaaggccaaactggatgagaatagcgctttcctgcaattcaactggaaggctgatgtagttgaaagctggattggcgagaaggagaacagtctgaagaccgacgattacgggcgcgatctgagctccgtccagaccttactgactaagcaggaaactttcgacgctggcctgcaggccttccagcaggagggaatcgcgaatattactgccctgaaggaccagctactggctgccaagcatgtgcaatccaaggccatcgaggcacgacatgccagtctgatgaagcgctggtcccagctccttgctaacagcgcggctcgaaagaagaagctcctagaggctcaatcccattttcgcaaggtggaggacctgttcctgaccttcgccaaaaaggccagcgccttcaatagttggtttgagaacgcggaagaggacctgacagaccctgtgaggtgcaatagccttgaagaaatcaaggctctgcgggaagcccacgacgcttttagaagcagcctgtcttcagcacaggcagattttaaccagctggctgaactggatcgccagatcaaaagttttcgggtggcctcgaacccatacacctggttcaccatggaggcacttgaggagacgtggaggaacctacagaaaatcatcaaggagcgggagctggaattgcaaaaggaacagcgcaggcaggaagagaatgacaagctccgccaggaattcgcccaacacgctaatgcctttcatcaatggattcaggagactcgctgtcaacccgcgggggcttcatgcatggtggaggagtctgggacactagagtcccaactagaagcaacaaaacgcaagcatcaggagatcagggctatgcgctcacagctgaagaaaatcgaggacctcggtgccgctatggaggaggccctgatcctggacaacaagtatacagagcactctaccgtaggattagcccagcagtgggaccaacttgatcagctgggaatgaggatgcaacacaacctagaacagcagatccaggccaggaacaccactggcgtcacagaggaggcacttaaggagtttagcatgatgttcaaacacttcgacaaggacaaaagcggcagactgaaccaccaggaatttaaatcctgcctgagatcgcttggttatgacctccctatggtggaggagggggaaccagatccagagttcgaagccatccttgacaccgttgaccccaatcgtgacggacatgtctctctgcaagagtatatggcattcatgattagccgtgagacggagaacgttaagagctccgaagaaatagaaagcgccttccgggccttgtcaagtgaaggaaaaccctatgtgactaaagaagaactgtatcagaatttgacccgcgaacaggctgactactgcgtctctcacatgaaaccttacgtggacggaaagggacgggaattaccaaccgcgttcgattacgttgaattcactcgctccctttttgtgaactag

SEQ ID NO: 135892 - DNA, 7359 bp, Artificial Sequence
  Description of Artificial Sequence: Synthetic coding sequence
atggatccaagtggggttaaagtactggagacggcggaagacatccaggagaggaggcagcaggtactggaccgctatcatcgattcaaggaactgtcaacactacggaggcagaaacttgaagacagttatcgctttcagtttttccagagagacgccgaggagcttgagaaatggatccaggaaaagcttcagatagcctccgatgagaattataaggatccgactaacctccaagggaagttgcagaaacaccaggcctttgaggcagaggtccaggcaaacagcggtgcaatcgtgaagcttgatgagactggtaatcttatgatctcagaaggccattttgcatctgagactatccgtactcgcctcatggagctccaccggcagtgggaactgcttctagagaaaatgcgagaaaagggaattaaactgttgcaggcccagaaactggttcaataccttcgggaatgtgaagatgtgatggactggatcaacgacaaggaggccattgtgacctccgaggagctcggccaggacttagaacacgtagaagtgctgcaaaaaaagtttgaagagttccagacagacatggccgcacacgaagagcgagtgaacgaggtcaaccagttcgccgcaaaactgatccaggaacagcaccctgaagaagagctgatcaagacaaagcaggacgaggtgaatgctgcatggcaacgcctgaagggcctcgcgttgcagcggcagggcaaactgttcggcgccgcagaagtgcagcgcttcaatagggacgtggacgagacaatttcttggatcaaggaaaaagaacagctgatggcgtccgacgacttcgggcgcgaccttgcctcagtgcaggctctgctgagaaaacacgagggactcgagcgagatttagcagcattggaagacaaggtgaaggccctgtgcgcagaggccgacaggctgcagcagtcacacccactctcagccacccagattcaggtgaagcgggaggaactcattaccaactgggaacagatccggacacttgcggcagaaaggcacgctcgtcttaacgatagctacaggctacagaggtttttggctgatttccgagacctgacttcatgggttaccgaaatgaaggctctgatcaacgccgacgagctggcctctgatgtcgccggagcagaggccctcctagatcgacatcaggagcataaaggagagattgatgcccatgaagacagcttcaaaagcgcagatgagtccgggcaggctctgttggccgccggccactatgccagtgacgaagtgagagaaaaattgactgttctaagtgaagaacgggccgctttgctggagctgtgggagctgcgccgtcagcagtatgaacagtgtatggatctgcagctcttctatcgcgacacggaacaggttgacaattggatgtccaaacaagaggccttcctacttaacgaggatctgggggacagtctggattctgtggaagcattgctaaaaaaacatgaggactttgaaaaatctctgagcgcccaagaggaaaagattacagcgttggatgaatttgctacaaaactgattcagaataaccactacgccatggaggacgttgctacacgaagagacgccctactgtctcggagaaatgcactccacgagagagcgatgcgcaggagagctcaactggccgatagtttccatcttcagcagttcttccgcgactcagatgaactcaaatcttgggtgaacgagaaaatgaagaccgcgaccgatgaggcttataaggatccaagcaacctgcagggcaaggtgcaaaagcaccaagcttttgaggccgagctgtcagccaaccagagccgcattgatgccctggaaaaggcaggccagaagctgatcgatgtgaatcattacgctaaagacgaggtggccgctcggatgaacgaagtaataagtttgtggaagaagctgcttgaagctactgagcttaaaggtataaaactaagagaagcgaaccaacagcaacaatttaatcgaaacgtcgaggatattgagctctggctgtacgaagtggagggccatctagcatcagatgattacggcaaagatctgaccaacgtccagaacctgcaaaaaaaacacgctctgttggaggcagacgtggccgcccaccaggacagaattgatggaattacaatccaggccaggcaatttcaagacgccggacacttcgacgctgagaacattaaaaagaaacaagaggcactggtggcacgctatgaggctctgaaagaaccgatggtcgcccggaagcagaaacttgccgatagcctaagactacaacagctgttcagggatgttgaggatgaggagacatggatacgggaaaaggagcccattgccgcatcaaccaaccgaggtaaggacttaattggcgtccagaatctgctgaagaagcatcaggcattacaggctgaaatagcaggacacgaaccacggattaaagccgtgacccagaaaggcaatgcgatggtcgaggaaggacatttcgctgccgaggatgttaaagccaagctgcacgaactgaaccagaagtgggaggccctaaaggcgaaagctagccagagaaggcaggaccttgaggactctctacaagctcagcaatactttgcagatgctaacgaggcagagagctggatgagagaaaaggaacccattgtggggtccacggattacgggaaggatgaagactcggcggaggctctcctgaagaaacatgaagctctgatgagcgacctatcggcgtatggctcatccattcaggctcttagagagcaggctcaaagttgcagacagcaagtggctcccactgacgacgaaaccggcaaggaactggtcctcgcgctgtatgattaccaagaaaagtccccacgagaagtgacgatgaaaaagggggacatactgacattgcttaactctaccaataaggactggtggaaagttgaagtgaatgaccggcagggtttcgtgccggccgcatatgtaaagaaattagatcccgctcaatccgcatcaagggagaatcttctggaggaacagggcagtattgcactgcgccaggagcagattgataaccagtatcactcactgcttgaactgggagaaaaacgcaagggtatgctggagaagagctgcaagaagtttatgctttttagagaagcaaatgagctgcagcagtggattaacgagaaggaggcagctctgacaagcgaggaggttggagcagatctggagcaggtggaagtcctgcagaagaagttcgacgacttccaaaaagatttaaaagccaacgagtcacgactcaaagacatcaataaggtggctgaggacctggagtccgagggactgatggctgaagaggtgcaggcggtgcagcaacaggaggtgtacggaatgatgccccgggatgagacagactccaaaaccgcctctccgtggaagagcgcccgcctaatggtacacaccgttgcaactttcaattcaatcaaggaattgaacgagaggtggcgctctctccagcagttggcagaagagaggtcccagcttttgggttccgcacacgaggttcagcggttccaccgggacgctgacgaaacaaaggaatggatcgaggaaaaaaaccaggcgctcaacactgataactacggtcatgacctagcatctgtccaggccctgcaacggaaacacgaaggctttgagcgggacctcgcggcactgggggacaaggtgaactctctcggtgaaactgctgagagattgatccagtctcaccctgagagtgctgaggacctgcaagaaaagtgtaccgagttgaatcaggcgtggagcagcctaggcaagcgcgccgaccaacgtaaagcaaagctcggagacagccatgatctgcagagatttttgtccgattttcgggacctgatgtcttggattaatggcattcgcggactcgtgtcctctgatgaattggctaaagatgtcacaggggctgaagctctcctggagcggcaccaagaacaccgcacggagatcgacgcgagagcagggacctttcaggcgtttgaacagttcggccagcagcttctggcccatggccactacgcatccccggagattaagcagaaactggacattctcgaccaggagcgggccgacttggagaaggcgtgggtccagcgccggatgatgctggatcagtgcctggaactgcagctttttcaccgggattgcgaacaagccgagaattggatggccgccagagaagcttttctaaacactgaagacaaaggagactcacttgatagtgtagaggcactgatcaagaaacacgaagactttgataaggccatcaacgtccaggaggaaaaaatcgctgcactgcaggcatttgccgatcagctcatcgctgcaggtcattatgcaaaaggggacatatctagccgtagaaacgaggtgcttgaccggtggaggcggctgaaggctcaaatgatcgagaagaggagtaaactgggcgagagccaaacactccagcagtttagcagagacgtggacgagatcgaagcgtggatctccgaaaaacttcagacagcatctgacgagagttacaaggacccaacaaacatccagtccaaacatcagaaacaccaggccttcgaagccgagctgcacgcaaacgcggataggatcagaggtgttatagacatgggcaattccctcatagaacgtggggcttgcgcggggagcgaggatgccgtcaaggctagactggcagcactggctgatcagtggcaatttctcgtacaaaagagcgcggaaaaaagtcagaaactgaaagaggccaataaacagcaaaactttaatactggcatcaaggatttcgatttttggctgtctgaggtggaagctctgctggccagtgaggactatggtaaggatttggcctctgtcaacaatctcctgaagaagcatcagttactggaggcggacatatccgcccacgaggatagattgaaggacttaaattcccaggcagattcattaatgacctcttctgcctttgacacctctcaagttaaggataaaagggataccatcaatggcaggttccagaagattaagtctatggccgcatccaggagggctaaactgaatgaatcccaccgattgcaccagttttttagagatatggatgacgaagaaagttggatcaaggagaaaaagctgctggtgggctcagaggactacggccgcgacctgaccggggtccagaatcttcgaaaaaaacacaagagactggaagctgagcttgccgcccacgagccggcgatccagggagtattggataccggcaaaaagctgtctgatgataataccatcggtaaggaagagattcagcagcgccttgcacagttcgtcgaacactggaaggagttgaagcagctggcagctgcacggggtcagaggctggaggaatctctcgagtatcagcaattcgtggcaaacgttgaggaagaggaagcttggattaacgaaaagatgacactggtcgcaagcgaagattacggcgacacccttgccgcaattcaaggactcctgaagaagcacgaggcattcgagaccgactttaccgtccataaagaccgcgtgaacgacgtctgtaccaacggacaggatctgattaagaagaataatcaccatgaagaaaacatctcctccaaaatgaagggactgaacggcaaggtgtcagatctggagaaggcagcagcgcagcgcaaagcaaaacttgacgaaaactcagcgtttctccaatttaactggaaggccgacgtggtggaatcctggattggcgaaaaagagaactctctgaagactgacgactatgggcgcgacctgtcatctgttcagactctgttgacaaagcaggaaactttcgatgccggtctgcaggccttccagcaggaaggcatcgcaaacatcactgctttgaaggatcagctccttgcagcaaagcacgtgcagtcaaaagcaattgaagcccgtcacgccagcctcatgaaaagatggagccagctgctggcaaacagtgccgctcggaagaagaagctgctagaagcccaatcccactttagaaaagttgaggatctgttcctgacttttgccaaaaaggctagcgcctttaactcctggttcgagaacgcagaggaggacctgacagatcccgtgcggtgcaactcactggaggagattaaggccttgcgggaagcccatgatgcctttcgaagcagtctgagctccgcccaggccgatttcaaccagttggctgagctggatcgtcagatcaagagcttcagagtagcttctaacccctacacctggttcaccatggaagctctggaagaaacttggagaaacctgcagaagattatcaaagaaagggaactggaactgcagaaggaacagcgacggcaagaggagaatgataagctaaggcaagagttcgcccagcacgctaacgctttccaccagtggattcaggagactcggtgtcagcccgcgggcgcctcttgtatggtagaagagtccggcacactagagtcccaacttgaagccaccaaaagaaaacatcaggagatacgggccatgagatctcagctgaaaaaaattgaagacctgggggctgccatggaggaggccttgattttagacaataagtatacggaacactcaactgtaggactggcccagcagtgggatcagttggaccagctggggatgaggatgcagcacaacttggagcaacagattcaggccaggaacacaaccggggtcacagaggaggccctgaaggagttctccatgatgttcaaacacttcgacaaggacaagtccggaaggttgaatcaccaggagttcaaaagttgtctgcgatctctggggtacgatctgcctatggtcgaagagggggaacctgacccagagtttgaggctatcctggataccgtcgaccctaatagggatggacacgtctcccttcaagagtatatggcctttatgatcagtagggagactgagaatgtgaaaagttcagaggaaatcgaatctgcctttagggctctgagttcggagggaaaaccgtatgtgaccaaagaagaactttaccagaaccttacccgagagcaggctgactactgcgtctcccacatgaaaccttatgtggatggcaagggccgcgagctccccacagcctttgattatgtagagttcactagatccctgttcgtgaattag

SEQ ID NO: 135893 - DNA, 1485 bp, Artificial Sequence
  Description of Artificial Sequence: Synthetic coding sequence
atggccgcttcccgtagggccaagcttaacgagtcccatcgcttacatcagttctttcgcgacatggatgatgaggaatcttggattaaggagaagaagctgctcgtcggtagtgaggactatggcagggacctgaccggcgtgcagaatcttcggaagaaacacaagagacttgaggcagagttggctgctcatgagcctgctattcagggcgtactggataccggcaagaaactgtccgacgacaatacaatcggcaaggaagaaatccagcagcggcttgcccaatttgtggagcactggaaggagctgaaacaattagctgccgcccgcgggcagcggctcgaagaatcactcgagtatcagcaatttgtggccaatgtggaagaagaggaagcatggattaatgagaaaatgacactggtagcatccgaggactatggtgatactctcgccgcaattcaaggcctccttaaaaaacacgaagcatttgagacggacttcaccgtccacaaggaccgagtgaatgatgtttgcactaacggacaggacttgattaagaagaacaaccaccatgaggaaaacatctctagcaagatgaaaggcctcaatggcaaagtctcggacttggagaaggcagcagcacaacgcaaggccaagttggatgaaaactcagctttcctgcaatttaactggaaggccgacgtcgtggagagttggataggtgaaaaggaaaactcacttaaaaccgacgattacgggagggacttgtcgtctgtgcagacactgttaacgaagcaggaaacatttgacgcgggccttcaagcatttcagcaagaagggatcgcgaacattacagccctgaaggatcagttactagctgccaagcatgtccaatctaaggccattgaagcacgacacgcatctcttatgaagaggtggagccagctactggccaattctgccgcccgtaagaaaaaactcttggaggctcaatcgcatttccgcaaggtggaagatttattcctgacctttgccaaaaaggcgtccgccttcaatagttggtttgagaacgccgaggaggaccttacagatccagtccgctgcaacagtctggaagagataaaagctctgcgggaggcccatgacgctttccggagctcactgtcctccgcacaagctgacttcaatcaactggccgaactggatcgccagattaaatctttcagggtggcctcaaatccctatacctggtttacaatggaagccctcgaagagacctggcgtaacctacaaaaaatcattaaagagagagagttggagctccaaaaagaacagcgtaggcaggaggagaatgacaaattgcgtcaagagttcgcccagcatgctaacgcctttcaccagtggatccaggaaaccagatgccagaggaaggatggtcagttacagggtggcagggtgggagatccccgaattcccgcgtag

SEQ ID NO: 135894 - DNA, 7419 bp, Artificial Sequence
  Description of Artificial Sequence: Synthetic coding sequence
atggaccccagtggtgtcaaggtgcttgaaaccgccgaggatatccaggaacgtagacagcaggttctggataggtatcaccggttcaaagagctgtccaccctaaggcggcagaagctggaggattcctatcgcttccaattcttccagcgggacgcagaagagctggaaaagtggatccaggagaagctccagatcgcctccgatgagaactataaagatcctaccaacctgcaaggcaagctgcaaaagcatcaggctttcgaggccgaggtacaggccaacagcggcgcaatcgtgaaactcgacgaaacggggaacttgatgatctccgaagggcattttgcttcggaaaccattcgaacgcgactgatggagctacatagacaatgggaactgctcctggaaaagatgcgcgaaaagggaatcaagctcttgcaggcccagaaactggtccagtatttgagagaatgcgaagatgtgatggattggattaatgacaaggaagctattgtcaccagcgaagaattaggtcaggacctggaacacgtcgaggtactgcagaagaaatttgaggagttccagaccgatatggctgcacatgaagagcgtgtgaacgaggtcaatcagttcgctgccaagctgattcaagagcagcacccggaagaggagcttatcaagaccaaacaggatgaagtaaacgcggcgtggcaacgtttgaaggggctggctctgcagaggcaggggaagctcttcggcgccgctgaagtgcagaggttcaacagagatgtcgatgagactatctcttggatcaaggagaaagagcagctgatggcatcagacgattttggcagagacttggctagcgtgcaggcgctcttgaggaaacacgaaggtctggagcgcgatctcgccgctcttgaggataaggtgaaggctctatgcgcggaggccgatcgtcttcagcagtcccaccccctgtctgctacccagattcaagttaagcgcgaagaactcatcactaattgggagcagattcggacactggccgccgagagacatgcacgcctgaatgacagctaccgcttgcaaaggttcctggcagacttcagggaccttacatcatgggtgaccgagatgaaagcacttattaacgcagacgaattggcatccgacgttgctggagccgaagccctgttggacaggcaccaggagcataagggggagatcgatgcgcacgaggactctttcaagtccgcagatgagagcggacaggccctacttgccgctgggcattacgcatctgacgaggtgagggagaaactcacagtgctgtccgaggagcgggctgcattgctcgagttgtgggagttacggagacagcaatacgagcaatgtatggacttgcagcttttttaccgagacacagagcaagtagataattggatgagtaaacaggaagcgtttttgctgaacgaggatctcggcgattcactagattccgtcgaggccctcctgaagaagcatgaagatttcgaaaaatcacttagcgctcaggaggagaagatcacagcgctggatgagttcgccacaaagttaatccaaaataaccactatgccatggaagacgtggccactaggcgtgatgcactattatctaggcggaacgctctgcacgaacgggccatgcgacgccgcgcccagctggccgactcctttcacctgcagcagttttttcgggattctgacgagctgaaaagctgggtcaacgaaaaaatgaagacagctacagacgaagcctataaagatccaagcaatctccaggggaaggtacagaaacaccaggcctttgaagctgaactttccgccaaccaatccagaattgacgcactggagaaggcaggccagaaattgatcgatgtgaatcactacgctaaagacgaggttgctgctagaatgaacgaggtcataagcctgtggaaaaaactgctggaagccacagaactgaaaggaatcaaactaagggaggccaaccagcagcagcagttcaatcggaatgtagaagacattgaactgtggttgtatgaggttgaaggacacctggctagtgatgattacggaaaggacctcacaaacgtgcagaatttacagaaaaagcacgcactgctggaggccgacgtcgcagcccaccaggataggatcgacggaatcactattcaagccagacagttccaggatgcggggcacttcgatgccgaaaacataaaaaaaaaacaggaggcacttgtcgcccgatacgaggcactcaaagagcctatggttgctcggaagcagaagctggcagactctttgcgtttgcagcagctgtttagggatgtggaggatgaagaaacatggattcgagaaaaggagcctatcgccgctagcactaatagaggcaaggacctgatcggcgtgcaaaatcttctgaagaaacatcaggccctgcaggccgagatcgccggacatgagccacgaatcaaagcagtgacccagaaaggcaatgccatggttgaagagggccatttcgctgctgaggatgtgaaggccaaacttcacgaactgaaccaaaagtgggaagccctaaaggctaaggcaagccagagacggcaggatcttgaagacagtttgcaagcccagcaatattttgctgatgccaacgaggcggaatcctggatgcgagagaaggagccgattgtggggtctactgattacgggaaagatgaggattccgcggaagcactgctcaagaagcacgaggcgttgatgagcgatttatcagcctatggcagttctatccaggcgctccgcgagcaagcccaatcttgccggcagcaggttgcacccactgatgacgagactgggaaagaattggttttggcactgtatgactatcaggagaaatcacctcgtgaagtaacaatgaaaaagggagacatcctcactttactgaacagcaccaataaggattggtggaaagtggaggtgaatgaccggcagggcttcgttccggctgcttatgttaagaaactggacccggctcagagtgcttcacgagaaaacctgctggaggagcaagggtccattgcactccggcaagaacagatagataaccaaactcggatcaccaaagaagctggttcagtgtcactaagaatgaagcaggtggaggagctttatcacagcctgctggagctgggggagaagaggaaagggatgctcgagaaatcatgcaagaagttcatgctttttcgtgaggccaacgaactgcagcagtggattaacgaaaaagaagcagcactgactagtgaggaggtgggggccgatctggagcaggtagaagtgctgcagaagaagttcgatgattttcagaaggacttaaaggcaaatgaatctaggctgaaggatatcaataaagttgcagaggacctggagtcggaaggcctgatggcagaagaagtgcaagccgtccagcaacaagaggtatacggaatgatgccacgggacgagactgattcaaagaccgcctctccgtggaagtccgcacggctgatggtgcacaccgttgctactttcaacagcattaaggagctgaacgagcggtggcggtctctgcagcagcttgcagaggaacgctcacagctcctgggttccgctcacgaagtgcagcggtttcatcgggacgctgacgagactaaggagtggatagaggagaaaaatcaggctcttaatactgataattatggccacgacctggcttctgtccaagcactgcagcggaagcacgaaggctttgaacgcgacctggcggccctcggtgataaggtcaactccttgggagagaccgcagagcgactcattcagagtcaccccgagtcggctgaggatctgcaggagaagtgcacagaactgaatcaggcatggtcttcacttgggaagagagccgaccagagaaaagctaaactcggcgactctcacgacctgcaacggtttttgagcgattttagagatctcatgagttggattaatggtatcagaggactagtcagctccgacgagttggctaaagacgttaccggtgctgaagctctgctggaaaggcatcaggagcatagaaccgagattgatgcgcgggccggaacgttccaggctttcgaacagttcggtcagcagctgctggctcacggtcactacgcatcacccgaaataaaacaaaagctcgacatcctcgaccaggaaagagcagacctggagaaagcatgggtgcagcgtagaatgatgcttgaccagtgcttggagctgcagctatttcatagagattgtgaacaagcagagaactggatggcagcccgagaggcatttctaaacacggaggataagggggattcgctcgacagtgttgaggctctgatcaaaaaacatgaggacttcgataaagcaataaatgtccaagaggagaaaatagcagctctccaggcctttgcagaccagttgatagccgcaggccactacgcaaaaggcgatattagctcaagaaggaacgaagtcctggacaggtggaggcgtttgaaggcacaaatgattgagaagcggagtaagctgggtgaatcccagacactgcagcagttcagcagggatgtcgatgaaatcgaagcctggatctctgaaaagctgcagacagcctcggatgagtcttacaaagacccaacgaacatccaatcgaaacatcagaagcaccaggctttcgaagcggagctgcacgccaacgcagacaggatcagaggggtgatcgatatgggcaacagcctcattgagcgaggggcctgtgccggctcggaggacgcagtgaaggcgcggttggctgcactggcggatcaatggcagtttctggtgcagaagtccgccgagaaaagccagaagcttaaagaggccaacaaacagcaaaattttaatacaggcatcaaggacttcgatttttggctctccgaagtggaagcactccttgcgagcgaggactatggaaaagatttagccagtgtgaacaaccttcttaagaaacatcagttacttgaggccgacatttctgcccacgaggataggcttaaggacttaaactcccaggcagattccctgatgacctcgagcgccttcgacacatcacaggtgaaggataagcgggacaccattaacggacggtttcagaagatcaagtcaatggctgcaagtcgccgagcaaagttgaacgaaagtcacagactgcatcagtttttccgagatatggacgatgaggaatcttggatcaaagaaaagaaactgctagtggggagcgaagattacgggagagatttgactggggttcagaaccttcgaaagaaacataagcgcctcgaagcggagctggccgctcacgaacccgcgatccagggggtactggacaccgggaagaagctgagcgacgacaacaccattggcaaggaagagatccagcagcggcttgcccaattcgtggaacactggaaggagctcaaacaactggccgcagcacgtggtcaaaggctcgaagagagtctggaatatcaacagttcgtggccaatgtcgaggaggaagaagcctggatcaatgagaaaatgaccttggtggcttccgaagactatggcgacacgttggcagcgatccaaggattacttaaaaagcatgaggcatttgagacagactttactgtgcataaggacagggtgaatgatgtgtgcacaaacggccaagacctgatcaagaagaacaaccaccatgaagagaatatttcaagcaaaatgaagggactcaacggcaaggtgagtgacttggaaaaagctgccgcccagaggaaagctaaacttgacgaaaactctgcttttctgcaattcaactggaaagccgacgtagtcgagagctggattggggaaaaggagaactccttaaagaccgacgactacggacgcgacctcagctctgttcagacactcctcacaaagcaggagacctttgacgcagggttgcaggccttccagcaggaaggaatagctaacatcaccgctcttaaagatcagctgcttgccgctaagcacgttcagtcgaaagcgatcgaggcccggcatgcctccctcatgaaacggtggtctcaattactggcgaactccgcggcccgaaagaagaaactgcttgaggcccagtcacattttaggaaagtcgaggatctgttccttacattcgcaaagaaagccagtgccttcaacagttggttcgagaatgcagaggaggacctgaccgaccccgttagatgtaactccctagaggaaattaaagctcttagagaagcacatgatgcatttcgttctagcctgtctagtgctcaggctgattttaatcagctggccgagctggacaggcagataaagtcctttagagttgcttcaaacccatacacctggtttacaatggaagccctggaagagacttggagaaatctgcagaagatcatcaaagagcgcgaactcgaattgcagaaggagcaaaggaggcaagaagagaacgataaactgcggcaggagttcgctcagcatgccaatgccttccaccagtggatccaggagacaaggacataccttttggacggctcctgcatggtcgaggagagtggcacccttgaatctcaactcgaagccaccaaacggaaacaccaggagatcagagcaatgagatcccagttgaaaaagattgaagatttgggggcggctatggaagaggcactgattctggataataaatacactgagcacagcaccgtcggattggcacagcagtgggatcagctggaccaattaggcatgcggatgcagcacaaccttgaacagcagatccaggcacggaacacgacaggtgtcacagaagaggccctcaaagagttttctatgatgttcaaacacttcgacaaagacaaatccggtagacttaatcatcaagaattcaaatcttgtctgcggtccctgggctacgatcttcctatggttgaggaaggcgagccagatcctgaattcgaagctatactcgatacagtggacccgaatcgcgacggccatgtgtccctgcaagaatatatggcattcatgatcagccgcgaaacagagaatgtgaagagttcagaggagatcgaaagcgcctttagggctttgtcatctgagggtaagccttacgtcaccaaagaggaactgtaccaaaacctgacgcgggagcaggccgattactgcgtgtcacacatgaagccatacgtggacgggaagggacgtgaactgccaaccgctttcgactatgtggaatttacccggagcctgttcgtaaactag

SEQ ID NO: 135895 - DNA, 7434 bp, Artificial Sequence
  Description of Artificial Sequence: Synthetic coding sequence
atggacccctcaggggtgaaagtcctcgagaccgccgaggacattcaggaacgaagacagcaggttctcgacaggtaccaccgctttaaggaactgagcactctaagacgacagaaactggaggatagctaccggtttcagtttttccagagagatgccgaagagctagagaagtggatccaggaaaagctgcagatcgcatctgacgaaaattacaaggatcccacaaatctgcaaggcaaacttcagaagcatcaagccttcgaagcagaggtgcaagcaaactctggcgcaatcgtgaagttggatgaaaccggcaatcttatgatctctgagggtcacttcgcatcagagaccatccgaacccgtctcatggagctgcatcgccagtgggagctgctcctcgagaaaatgcgcgagaaggggatcaagctcctgcaggcccagaaactcgtgcagtaccttcgcgagtgcgaagatgtaatggactggatcaatgacaaggaggcgatagtgaccagcgaggagctcggacaggatctggaacatgtggaggtcttgcagaaaaagttcgaagagtttcagactgacatggcagctcatgaagaaagggtgaacgaggtgaaccagtttgccgccaagcttatccaggaacagcaccccgaagaggagctgataaagactaaacaggacgaagtcaacgctgcctggcagcggctgaaggggttggcccttcagaggcaggggaaactgtttggggcagctgaggttcagagatttaaccgggacgttgacgaaacaatctcctggataaaggaaaaagaacagctgatggcctccgacgattttggccgagatttggcgtccgtgcaagcccttcttaggaaacacgagggacttgaacgcgatctggccgctctggaggataaagtgaaagcactctgcgccgaggctgaccggctccaacagtcgcaccctctttccgcaacacaaattcaagtcaaacgtgaagagttaatcaccaattgggagcagatccggacactggcggccgaaaggcacgcccgcctgaacgattcttacaggctccagcgtttcctggctgattttcgggatctgactagctgggttactgaaatgaaggccctcattaacgcagacgagctggcgtcggacgtggcaggcgccgaagcactgctagatagacatcaggagcacaagggcgaaatcgatgcgcacgaagatagctttaaatccgcggacgagtctgggcaagctctccttgccgcaggccactatgcctccgatgaggtcagagagaagctgaccgtgttgagtgaggagcgggctgcactgctcgagctctgggaattgcggcggcagcagtacgagcagtgcatggacttacagctattttaccgtgacactgagcaggtggataactggatgagcaagcaggaagctttcctcctgaatgaggacctgggggattctctagactccgttgaggcacttctcaagaagcatgaggactttgagaagagtctgagcgctcaggaggaaaagatcaccgccctggacgagtttgcaaccaagctgattcagaataatcactatgccatggaggatgtggcaactcgaagagatgcactgctcagcaggcggaatgctttacacgaacgcgcgatgagacgtagagcgcaactggccgacagctttcatctgcagcagttttttcgggatagtgacgaattgaaaagctgggttaacgaaaagatgaagacagccactgatgaggcttataaagatcctagcaacttacagggaaaagtccagaaacatcaggccttcgaggctgagctctccgccaatcagagccgcatcgatgcactcgaaaaagcaggccagaaacttatcgatgttaatcactatgctaaggacgaagttgcagcacgcatgaatgaggtaattagtctatggaagaagttactcgaagcaacagaactgaaagggattaagctgagggaagcaaatcaacagcagcagtttaatcgcaatgttgaggatatcgagttgtggctttatgaagtcgagggccacttagccagcgacgactacggaaaggacttgactaacgtccagaatctgcaaaagaaacacgccctgctggaggctgatgtcgccgcccaccaggatagaatcgatggaatcacaatccaggcacggcagttccaagacgctggtcatttcgacgccgagaatattaaaaagaaacaggaggcccttgtggcccggtacgaagccctaaaggagcccatggttgcccgaaagcagaaattggccgatagcctgagattgcagcaattgttccgcgacgttgaagacgaagagacttggatacgagagaaggaacccatcgctgcctcaacaaatcggggcaaagatctgatcggtgtacagaatctgctgaaaaagcaccaggccctgcaagcggaaatcgcaggtcacgaaccacgtattaaagccgtaacacaaaagggaaatgccatggtagaggagggccactttgccgccgaggatgtgaaagcgaagctgcatgagctcaatcagaaatgggaggctttgaaagccaaggcgagccaacgcaggcaagacctggaggatagcttgcaggcccagcagtactttgccgatgctaatgaagcagagagctggatgagggagaaagaacctatagtaggaagcacagattacggcaaagacgaggactccgctgaggccctgctcaaaaaacacgaggcactcatgagcgatctgagtgcgtatggaagctcaatccaggctctgcgtgagcaggcccagtcttgccgacagcaggtcgcacctacagacgatgaaaccggcaaggaactcgtgctcgccctatatgactaccaggaaaagtcgccacgggaggtcacaatgaagaaaggcgatatcctgactctgctcaactcgacaaataaagactggtggaaggtagaagtgaatgatcgtcagggcttcgtgccagcagcttacgtcaaaaagctagaccctgcacagagtgctagtagggagaacctgctggaagagcagggaagtattgccttaaggcaggagcagattgacaatcaaaccaggatcaccaaagaggcgggatctgtctccttgcgaatgaagcaggtggaagaactctatcactcactgctggagttaggggagaaacgaaagggtatgctcgaaaaatcttgtaagaagttcatgctgtttcgagaggccaacgaattacaacagtggatcaacgaaaaagaagctgcgctcacgtccgaagaggtcggcgcggacctagagcaggtggaggtgctgcagaagaaattcgatgatttccaaaaagacttgaaagctaacgagagcagactgaaagacatcaataaggtagcagaagacctggaaagtgaaggtctgatggccgaggaagtgcaggcagtgcaacaacaggaggtctacggaatgatgcctagggacgagacggacagcaagactgctagcccatggaaatccgcccgccttatggtgcacactgtggctacattcaactcaatcaaagagttgaacgaacgctggcgatcactccagcaactggctgaagaaagaagccaattactgggttccgcccacgaggtgcaacgcttccatagggacgcagatgaaaccaaggaatggatcgaggagaagaaccaggcccttaacactgacaattacggacacgacttggcttcggtccaggcactacagcggaagcatgaaggctttgaaagggatctagccgctctcggggacaaggtgaattctctgggagaaactgcagagcggctgatccagagccaccctgagtcggctgaagatcttcaagaaaagtgtacggagctcaatcaggcctggtcctctcttggcaagcgcgcagatcagcgcaaggctaagttgggagatagtcatgacctgcagcgttttctaagcgacttcagagatttgatgtcctggattaacggaatacgtggcctggtttcatcagatgaattagccaaggacgtcaccggcgctgaggctctgttggagcggcatcaggaacacagaaccgaaattgacgccagggccggcacgtttcaggccttcgagcagttcggccagcagcttttggctcatggccattatgcctcccctgaaattaagcagaagctagacattcttgaccaggagcgagcagatttggaaaaggcatgggtgcaaaggagaatgatgcttgatcagtgtctggagctccagctcttccatagggattgtgaacaggcggagaattggatggctgctcgggaggcattcttgaatacggaggataaaggagactccttggactcggttgaagcactaataaagaaacatgaagactttgataaggcaattaatgttcaagaggaaaagatcgccgctctgcaggcttttgcagaccagctgatcgcagctggccattacgccaagggtgatataagttcccgcaggaatgaggtactggatcggtggagaaggctgaaggcacagatgatcgaaaaacggagtaagctgggcgagtcccaaaccctgcagcagttttctagggacgtcgacgagattgaggcctggatatctgaaaagctccaaacagcctctgacgagtcgtacaaggatccaacaaatatacagctgtccaaactcctcagcaagcatcaaaagcaccaggctttcgaagcggagctgcacgccaacgctgatcgaatcaggggagtgattgatatggggaattcactcatcgagaggggcgcatgtgccgggagcgaggatgcagtaaaagcccggttagccgcactcgctgaccaatggcaattcttagtccagaagagcgccgaaaaaagccaaaagctgaaggaggccaataaacagcagaacttcaacacaggcatcaaagatttcgatttctggctgagcgaggtggaagcccttctggccagtgaggactatggaaaagatctcgctagcgtgaacaatctgctaaaaaagcaccagctgctggaggccgatattagcgcccatgaggacagattgaaggaccttaattcgcaggcggatagcctcatgacgagctccgcatttgacactagccaggttaaagacaagagggatactataaacgggagattccagaaaatcaaaagcatggccgcatctcgtagggcaaaactaaacgaatcccaccggcttcaccagtttttccgcgacatggatgacgaggaatcctggatcaaagagaaaaagcttcttgtgggcagcgaggactacggccgggatcttacgggcgtgcaaaatctgaggaagaagcataagaggctagaggccgagctggccgctcacgaacctgccattcagggtgtgctggacactggcaaaaagctgtccgacgacaacaccattggcaaggaggaaattcaacaaaggctcgcccagtttgtggagcactggaaggaattgaagcagttggctgccgctcgggggcagagactggaggaatcactcgagtatcagcagtttgtcgccaacgtggaggaagaggaagcctggatcaatgagaagatgaccctggtggcaagtgaggattacggcgatactctggcagctattcagggccttctgaaaaaacacgaagccttcgaaaccgatttcacggtgcacaaagaccgggtgaacgacgtctgtacgaacgggcaggatctcatcaagaagaataaccaccatgaagaaaatatttctagcaagatgaagggcctcaacggaaaagtgagcgaccttgaaaaagctgctgctcagagaaaggcaaagctggatgagaactccgcatttctgcaatttaattggaaagcggacgtggttgaatcatggattggggagaaagagaattctctcaaaaccgacgattacggccgagacctgtcttctgtgcagaccctgctgactaagcaggagaccttcgacgcgggcctacaggcgttccaacaggagggaatagcaaatatcacagccctcaaagaccagttactggcggccaaacacgtccagtccaaggctattgaagcgcgtcacgcttcactgatgaaaagatggtcccagttgcttgccaactcggccgcccggaagaaaaagctcctggaagctcagtcccatttccgcaaggtggaggacctcttcctcacctttgcgaaaaaggcttccgcctttaattcttggttcgaaaatgccgaagaagacctgaccgatccagtgagatgcaactctcttgaggagattaaggccttacgcgaagctcatgatgctttccgatccagtctctctagcgctcaggctgacttcaaccagctggccgagcttgataggcaaataaagagcttccgagtagcttccaacccttacacctggttcacaatggaggccctagaagagacttggcgcaatctccagaagatcatcaaggaacgggaactcgagctgcaaaaagagcaacgcagacaggaggaaaacgataagctaagacaggaatttgctcagcatgccaacgcatttcaccagtggatacaggaaacgcgaacctacttgctcgacggcagctgtatggttgaagagagcgggacgctcgagagtcaacttgaggccacaaagcggaaacatcaggagatcagagccatgaggtcccagttaaaaaaaatcgaagacctcggcgcagccatggaagaggccctgatcctggacaataagtacactgagcattctactgtcggactcgcacagcagtgggaccagctggatcagctgggcatgagaatgcagcacaatctcgaacagcagattcaagcgcgcaacaccactggggtgaccgaagaagccttaaaagaattttctatgatgtttaagcatttcgacaaggacaaatccggtcggttaaatcaccaggagttcaagagttgcctaaggagccttggatatgatctgccaatggtagaagaaggtgaaccggacccagagtttgaggcgatcctcgacacggtggaccccaaccgcgacggccatgtgagtctgcaggagtatatggctttcatgatctccagggagaccgaaaatgtgaaaagctcagaggaaatcgaaagtgcttttcgtgctttatcttccgaaggtaaaccatacgtgactaaggaggagctctaccaaaacctgacacgggagcaggccgactattgcgtcagccacatgaagccttacgtggatggcaagggacgggaactccccacggcatttgattacgtcgagttcaccagaagtctgttcgtaaactag

SEQ ID NO: 135896 - DNA, 3444 bp, Artificial Sequence
  Description of Artificial Sequence: Synthetic coding sequence
atggaaaacaatcgggacaaagtactctcaccagtggattctgggaacaagcttgtggcagaggggaatctgtattccgacaaaatcaaggaaaaggtgcagttaatagaggaccggcacagaaaaaacaatgagaaggcccaggaagcctcggtgttgcttagagataatctcgagcttcagaacttccttcagaactgccaggagctgactctatggatcaatgacaagctgctgacaagccaagatgtatcatacgacgaggccagaaatctccacaacaaatggttgaagcaccaggctttcgtggctgaactcgcatcccatgaaggttggctggagaatatcgacgccgaaggtaagcagctgatggacgaaaagccacagtttacagctctggtatcacagaagctcgaggcattgcaccgtttatgggatgagcttcaggccacaaccaaggagaaaactcagcacctttcagcggccaggtcatctgatctgcgacttcagacgcatgcagacctgaacaaatggatctcggccatggaagaccagcttaggagcgacgatcccggtaaagatctgaccagcgtgaatagaatgctggccaagctcaagcgggtggaagatcaggtgaacgtgcgaaaagaggaactgggggagttattcgcgcaagtaccgagtatgggtgaggaaggcggagacgcagacctatccatcgagaagcgatttcttgacttgctggaaccattgggaaggagaaagaaacagctagagagctctcgtgccaaattacagatctctagggatctcgaggacgaaactttgtgggtagaagaaagattgcctctggctcaatctgccgactacggtactaacttgcagactgtacaactctttatgaagaagaaccagaccctgcagaacgaaatcctggggcatactccgcgagttgaagacgtcttgcagaggggccagcagctggtggaagccgccgaaattgactgccaggatctggaggagagactcggccaccttcagtcgtcctgggacaggctacgagaggccgcggcaggacgcctacaacgcttaagagacgccaacgaagcccagcagtattatcttgacgccgacgaagccgaagcctggattggtgaacaggagctgtacgtcataagtgacgagatccccaaggacgaggaaggcgccatcgtgatgctcaagcgccacctgcgccagcagcgtgccgtcgaagactacgggagaaatattaaacaattggctagtagagctcagggcctcctgtcagctggccatcctgaaggcgagcagatcatacggctacaggggcaggttgacaaacattatgcagggcttaaggacgttgcagaagaaaggaagcgaaaactggagaacatgtaccacttgtttcagctgaagcgggaaacagatgacctagagcagtggatcagcgagaaagaactggtggcctccagtccagaaatgggccaagatttcgatcacgtcacccttctgcgcgacaagtttagggattttgctcgagagacaggcgcaattggccaagaacgcgtggataatgtgaacgcattcattgagaggcttatcgacgccggacattccgaagcagctaccatcgccgagtggaaagacggtctcaacgaaatgtgggctgatctccttgaattaattgacacccgcatgcagctcctggccgccagctacgatttgcatcgatacttctacaccggcgctgagattctcggcctgatcgacgagaaacatagagagctgcctgaggatgtcggcctggacgcatcaacagcagagagtttccacagggtccataccgctttcgagagagaattacatcttctgggggtccaggttcaacaatttcaggacgttgccactaggctccagactgcctatgctggcgagaaggccgaggccatccagaacaaggagcaagaggtgagtgcagcctggcaagccttgctggatgcttgcgcagggagaaggacacagcttgtagatacggcagacaaattcagatttttcagcatggccagagacttactttcttggatggagagcattatccggcagattgagacacaggagcgaccccgggatgtgagctcagtggaacttctaatgaagtatcatcagggaattaacgctgagattgagacccggagcaagaatttcagtgcttgtctagagcttggggagagtttgttacaaaggcagcatcaggcaagcgaggaaataagggagaagttgcagcaggtgatgtctcgaagaaaagagatgaacgaaaagtgggaggctaggtgggaaaggctgaggatgctcctggaggtatgccaattctcacgggacgctagtgttgctgaggcatggcttatagcccaggagccctacctagccagtggcgacttcgggcataccgtggacagcgtggagaagctgatcaaacgccacgaagccttcgagaagtcgactgctagctgggccgaacgtttcgccgcacttgagaaaccaaccaccctggagcttaaagaacgccagatagccgagagacccgccgaggagacaggtccacaagaagaagaaggggaaactgccggcgaagcacccgtgagccaccacgccgcaacagagcgtacatctccgggcgaggaagaaggtacatggccccagaacctccaacagccccctccaccaggacagcacaaagatggtcaaaagtctacgggcgacgagagacccactactgagccactgttcaaagtgctggatacccctctctccgagggcgacgaacctgctacattgccagcgccccgggatcacgggcagtctgtacagatggagggttatctgggccgcaaacatgatctcgagggtccaaacaaaaaagcatccaatagtaagggtgaggagggcgaggaaaggcgggagacggaggaggaggatgaagaagaagaggagacagagtccgtggccgtggagatgcaacagcacgcatctcacgtctcttggaacaatctgtactgtgtgttgaggaactcagagttgaccttctataaagacgcaaagaacctcgctcttggaatgccttatcatggagaggaaccactcgccctccgacatgcaatatgcgagattgccgccaattacaaaaaaaaaaagcacgtgttcaaacttcgactgagcaacgggagtgaatggctttttcacgggaaagacgaggaggagatgctctcatggctccagggcgtcagcaccgctattaatgagtcacagagtatacgggttaaagcccagtcactcccgttgccaagtctctctggacccgatgcctcacttgggaaaaaggacaaggagaaacgattttctttctttccaaagaagaaatag

SEQ ID NO: 135897 - DNA, 6321 bp, Artificial Sequence
  Description of Artificial Sequence: Synthetic coding sequence
atgacttcagcaacagagttcgagaacgtgggcaaccaaccaccatactcaagaattaatgcccgctgggatgcgcccgacgacgaacttgacaatgataactccagcgcccgattgttcgaacggtctcggattaaagctcttgcggatgagcgggaggtggttcagaagaagacttttacgaaatgggtcaatagtcacttggcgagagtctcctgtaggattacagacttgtacaaggacttacgcgatggtcggatgcttattaagcttcttgaggttctctctggggaaatgctgccaaagcctactaaaggcaagatgaggatccactgtctggagaacgttgacaaagccctacagtttctgaaggaacaacgagttcatctggaaaacatggggtcccacgatattgtggatggaaatcataggcttgttctgggtttgatttggacaattattctgcgatttcaaatacaagatatagtcgttcaaacacaagagggcagggaaacccggtcggctaaggatgctttactgctttggtgtcagatgaagacagccggttacccacacgtgaacgtaacaaacttcacaagcagttggaaggatggcctggccttcaatgcactgatccataaacatagacctgacctaatagacttcgataagctcaaagacagcaatgcgagacacaacctcgagcatgccttcaatgtggctgaacgccaactcggtattataccgctcctcgaccctgaggacgtgtttacagagaatcctgatgaaaaaagtattattacttatgttgtggcattctaccactatttctccaaaatgaaagtgctggctgtagagggcaaacgggtagggaaggtgatcgaccatgcaatcgagactgaaaaaatgatagagaaatattcaggattagcatccgaccttctgacctggatcgagcagaccattacggttctgaattctcgtaagttcgccaatagtttaaccggcgtgcaacagcagttgcaggctttttccacctacagaacagtagagaagccgccaaagttccaagagaaggggaacctggaagtgcttctgttcaccattcagtcccgaatgcgtgcaaacaatcagaaagtatatactcctcacgatggcaagttagtcagcgacatcaatcgcgcatgggaatctctggaggaggcggaatacagaagagaactggcattgcggaatgaattgattcggcaagagaaactcgagcagcttgccagaagattcgacaggaaagccgctatgcgtgagacgtggctgagcgagaatcagcgtcttgtagcccaagacaatttcggctatgacctggccgctgttgaagcagccaagaagaaacatgaggcgatcgaaacagacaccgctgcatacgaggaacgcgtgcgagctctcgaggatcttgcgcaggaactggaaaaggaaaattatcatgaccagaagcgcatcactgctaggaaagacaacatcctgcgcctgtggtcctacttgcaagagctcctacagtctcgccggcaaaggctggagacgaccttagcactacagaagctgtttcaagacatgctgcactccatcgactggatggatgaaatcaaggcacacctcttatccgccgaatttgggaaacacttgctcgaggtggaggacctgctccagaaacacaagctgatggaagccgatattgcaatacagggagacaaagtgaaagccatcaccgctgcaactctgaaattcacggaagggaaaggataccagccatgtgaccctcaggtgatacaagacagaatctcacacctcgagcagtgttttgaggagctcagcaatatggccgctggccggaaagcacagctcgagcagtcgaaaagactttggaagttcttctgggagatggacgaggcagagtcatggatcaaggaaaaagaacaaatttactcttctctcgactatgggaaagatctgactagcgtgctgatcttgcaaaggaaacacaaggccttcgaagatgagttacgaggcttggatgcccatctagagcagatctttcaagaggctcacggtatggtggctcggaagcagtttggacaccctcagatcgaggcccgcattaaggaagtttccgcacagtgggaccaactgaaagatctggccgctttttgcaaaaagaaccttcaggacgctgagaacttttttcaatttcagggggacgccgatgatctgaaggcatggctgcaggacgcacacaggctgctgtctggcgaagatgtgggtcaagacgagggcgccacgcgcgccctgggcaagaaacacaaagatttcctggaggagctggaagaaagtcgtggagtaatggagcatttggaacagcaagcacagggtttccctgaggaattcagagacagtcccgatgtgacacataggctgcaggcgctccgcgagctttaccagcaggtcgtagcacaggccgatctgagacaacagcgtctgcaggaagctcttgatctgtatactgtcttcggtgaaactgatgcatgtgagctgtggatgggagaaaaagagaaatggctcgccgaaatggaaatgccagacacactagaagatctggaagtcgtacagcacaggttcgacatcctggaccaggagatgaaaactttaatgacgcagattgacggagtgaatctcgcggccaatagcctggtggagtccggccaccctaggtctagagaagtgaaacaataccaggatcaccttaacactcggtggcaggcgttccagaccctcgtcagcgagcggagagaggccgtggattccgcgctgagggtccataattactgtgtcgactgcgaggagacatccaagtggattacagataagaccaaagtggtggagtcaaccaaggacctggggagggatctcgctggaattattgccattcaaaggaagttgtctgggctggagcgcgacgtcgccgctatccaagcaagggttgatgcacttgagagggagtcccagcagcttatggactcccaccccgagcaaaaggaggacataggacagagacaaaagcacttggaggaattgtggcagggcctgcaacagtccctgcaaggacaggaggatctcctcggggaggtctcacaactgcaggcctttttacaggatcttgacgacttccaggcctggctgagcatcacgcaaaaagccgtcgcttcagaggacatgccggaatcattaccggaggctgaacaacttctgcagcaacacgccggcatcaaggatgagattgacgggcatcaggactcctaccagcgggtgaaggagagcggggagaaagtcatccagggacagacggaccccgagtacctgttacttggacagagactggagggtctagacacagggtggaatgccctcggacggatgtgggagagtagaagccacactctggctcagtgtttaggattccaggaattccagaaggatgccaaacaggccgaagccatcctcagcaatcaggaatataccctggctcacttggagccacctgacagcctggaggccgcagaagctgggatccgaaaattcgaggacttcctaggaagcatggaaaacaatcgagacaaggttctttctcccgttgattctggaaacaaactagtggcagagggaaacctttactcagataagattaaagaaaaagtccagctgatcgaggaccgccacagaaaaaacaatgaaaaggcacaggaagccagcgtactgctcagagataacctggaattacagaacttcctgcagaattgccaggaactaaccctgtggattaacgataagcttcttacgtctcaagacgtgagttacgacgaggcacggaacctccacaataaatggctgaaacatcaggccttcgtagcggagctggcgtcccatgaaggatggctggaaaacatcgatgcggagggtaaacagcttatggacgaaaagccccagttcaccgccttggtgtctcagaagttagaagccctccacaggttgtgggatgaactgcaagctacaacaaaagagaaaacacagcatctgagcgctgccagaagcagcgacctgaggctccagacacacgctgacctgaacaaatggatttccgcaatggaggaccagctgcggtctgatgaccccgggaaagatttaacttccgtgaacagaatgctggctaaacttaaacgggttgaggaccaggtgaacgtaagaaaggaggaacttggggagttattcgcccaagttccctccatgggcgaagaaggaggtgatgccgacctgagcatcgaaaagcgttttctcgatctcctagagcctctgggccgccgcaagaaacagctcgagtcttcaagggcaaaattacagatcagccgagatctagaagacgagacactttgggtcgaggaacgattgcccctggcccagtccgctgactatgggaccaatttgcaaactgtgcagctgttcatgaagaaaaaccagactctgcaaaatgaaatcttagggcacactccacgtgtggaggacgtcttacagcgagggcagcaattagtggaggccgcagagatagactgccaggatctcgaagagcgactaggccacctgcagtcaagctgggacagacttcgagaggccgcagctggaaggctgcagcgactccgggacgcgaacgaggcccagcaatattatctggatgcagacgaagcagaagcctggattggggaacaggaactctacgtgatttccgacgagatccctaaagacgaagaaggcgctatcgtaatgctgaaacgacacctccgccagcagcgtgcagtagaggactacgggcggaacattaaacagttggcttctcgggctcaaggacttttatctgcagggcaccccgaaggggagcagatcatccgtcttcaaggacaggtggacaagcactacgctggcctgaaggatgtggccgaagagcgaaaacgaaaacttgaaaacatgtatcatctgttccagttaaaacgggaaactgacgacctggagcaatggattagtgaaaaggaacttgtggccagttcacccgaaatggggcaggactttgaccacgttaccctgctccgcgataaatttagggatttcgcccgagaaactggcgccataggccaggagagagtagataacgtgaatgcatttatcgagaggctcatcgacgccggccattccgaggccgctacgatcgcagagtggaaagacgggcttaacgaaatgtgggccgacctgcttgagctcattgacaccagaatgcagctgctggctgcctcatacgacctgcatcggtatttctataccggtgcggaaattctggggctcatagatgaaaaacatagagagcttccggaggacgtgggcctcgatgcttctactgctgaatcgtttcatcgcgttcatactgccttcgaaagagagctacacctgttaggtgttcaggtacaacagttccaggacgtggcgacccgactccagactgcctatgcaggcgagaaagcggaggctatacagaataaggagcaggaggtctcagcagcttggcaggcccttttggacgcatgtgcaggcagacggacgcagctagtcgatactgctgacaagtttcgcttcttctccatggccagagatctgctttcctggatggagtcaatcatccgccaaatcgaaacccaagagcggccacgtgacgtgtcttccgttgagctgctcatgaagtatcaccagggcatcaatgctgagattgagacacgctccaagaactttagtgcctgtctagagctgggcgagtctctgctccagagacagcaccaggctagcgaagagatccgtgagaagttacagcaggtgatgagccggcgcaaggaaatgaatgagaagtgggaggcaaggtgggaacggctccgaatgctgctggaagtatgccagtttagtagagatgccagtgtggcggaggcttggttaattgcacaagagccatatttagcttctggggacttcggccatacagtggacagcgtcgagaagctaatcaagcggcacgaggcattcgagaaatcaaccgcatcctgggccgagcgcttcgctgctttggagaagccaaccaccgccagccgaggagggaggcgggacagccgggggggctcaagttttccgccgtgtggtcatagagagaatgttcctgggcagagtttggtgtcatttgtgtag

SEQ ID NO: 135898 - DNA, 6414 bp, Artificial Sequence
  Description of Artificial Sequence: Synthetic coding sequence
atgacgagcgccacagagttcgagaatgtggggaatcagccgccatactctagaattaatgcgcggtgggatgctcccgatgacgagctagacaacgacaatagtagcgcacggctgttcgaaagaagccgaataaaggctctcgcagatgaacgcgaagttgtccaaaagaaaaccttcaccaagtgggtgaactcgcatctggctcgcgtatcatgtcgcattacagatctctacaaggatttacgcgatggaaggatgctgattaagctacttgaagtactctccggtgaaatgttacccaagccgactaagggaaaaatgaggatccattgcttagagaacgtagataaagctctgcagtttctgaaggagcagagggtgcatcttgaaaatatggggtctcatgacattgtagatggaaaccatcgcctggtcctgggattgatctggaccatcatattacgattccaaattcaggacatcgtggttcagacacaggaggggcgagagacgaggtccgccaaagatgctcttttactttggtgtcagatgaagaccgccggatacccacacgtgaatgtgacgaattttacctcttcctggaaggacggcctcgcgttcaatgcgttgatccataagcaccgccccgacctcatagacttcgacaaattaaaggattcaaacgcccgccataatctagaacatgcgtttaacgtcgccgagcgccagttgggcattatccccttattggatcccgaagacgtgtttaccgagaaccctgatgaaaagagcatcattacttacgtggtcgctttctaccactacttcagtaaaatgaaagtgctcgctgtagagggaaaacgggtgggcaaggtgatcgatcacgctattgaaacagagaaaatgatcgagaagtactcaggccttgctagcgatctgctcacgtggatcgaacaaaccattaccgttctcaacagcagaaaatttgcaaacagcttgactggagtgcagcagcaactgcaggctttctcaacctaccggacagttgaaaagcccccaaagttccaggagaagggcaacttagaggtgctactcttcactattcagtcacggatgagagccaataaccaaaaggtgtacaccccacacgacgggaaactcgttagcgatataaatagagcgtgggagagtttggaagaggccgagtacagacgcgaactggccctgcggaacgagctgattcgacaggagaaactggaacagctcgctcggcggtttgaccgcaaggcggctatgagggagacttggctcagcgagaaccagagactcgttgcccaggacaactttggctatgacttagccgccgtggaggccgcaaagaagaaacacgaagctatcgagacggacaccgccgcctatgaagaacgggttcgtgccttggaagatctcgctcaggaattggaaaaggaaaactaccacgatcagaagcgcatcaccgctcgcaaggataatattctcaggctatggagttacctgcaggaattgcttcagtcaaggaggcaaaggcttgagaccaccttggcgctgcagaagctgttccaagatatgctgcactcaatcgactggatggacgagataaaggcccatcttttatccgccgagtttggcaagcatcttctagaagttgaggaccttctacagaaacataaacttatggaggcggacatagccatccagggggataaagttaaggccatcacggccgctactcttaaatttactgaggggaagggctatcaaccttgtgacccacaggtaatccaggaccggatcagccatctggagcaatgctttgaggagttatcaaacatggcagccggaagaaaagcccagcttgaacagagcaaacgcttgtggaaatttttctgggagatggacgaagccgaatcttggattaaggaaaaggaacaaatctatagcagcttggattacggcaaagacctgacatcagtgcttattctgcagagaaaacataaggcatttgaggacgagctgagaggattggacgctcaccttgaacaaatcttccaggaggcacatgggatggtggctaggaagcaattcggccaccctcaaatcgaagctcgcattaaggaagtgtccgcccagtgggatcagctgaaggatctggcggcattctgtaaaaaaaatctgcaggatgcggagaatttttttcagtttcagggcgatgctgacgatctaaaagcatggcttcaagatgcccacaggcttctctccggcgaggacgtaggacaggatgagggcgctactagggcactcgggaaaaaacacaaggactttctggaagagttggaagaatccagaggagttatggaacatctggagcaacaagcccaggggttccctgaagaatttcgcgactcgccagacgtgacacacagactgcaggccctacgggagctctaccaacaagtagtcgcacaagccgacctccggcagcagcggctgcaggaagcgctggacctttacaccgtttttggtgaaaccgatgcctgcgagctttggatgggcgaaaaagaaaagtggctagctgaaatggagatgcctgacacactcgaagatctggaagtggtgcagcaccgctttgatatcctcgatcaggagatgaaaaccctgatgacccagattgatggtgtgaatcttgcagctaacagtctcgttgagtcgggtcatccaaggagccgagaggttaagcagtatcaagaccacctgaataccagatggcaggcattccagactttggttagcgagcggcgggaggccgtggacagcgcactcagagtacacaactattgcgtggattgcgaggagacatccaaatggatcaccgacaaaaccaaagtggtcgagtctactaaagacctcggtagagacttggccggcattatcgccatacagcgcaagctcagtggtttggaaagggacgtggccgctatacaagcccgtgtcgatgcacttgagcgggagagccagcaattaatggattctcaccctgagcagaaggaagacattggtcagaggcaaaaacatctcgaggagctgtggcaaggtctccagcagtctttacaaggacaggaggacttactgggggaagtctctcaactccaggcatttctccaggacttagatgatttccaggcttggctgtcaattacacaaaaggctgtagcttcagaggatatgcctgagtccctcccagaagctgagcagctcttgcaacaacacgcagggataaaagacgagattgatgggcaccaagacagttaccagagagtaaaggagagcggagaaaaagtgatccaggggcagacagacccagagtacctcttgttaggccagagattagagggcttggatacaggctggaacgccctgggccgcatgtgggagagccggtctcacacactcgcacagtgtctgggtttccaggagtttcaaaaggatgccaaacaagcagaggccatcctgtctaaccaagagtatacactggctcatctggaaccccccgactcactagaggcagccgaggcgggtatcaggaagttcgaggattttctgggctctatggagaacaatagggacaaagttctgagcccagtagattcgggaaataagctcgtggccgagggtaacctgtacagtgataaaattaaggagaaggtgcaactaattgaggatcgacaccgaaagaataacgaaaaggcgcaggaggcatctgtgctcctgcgcgacaacttggaactacagaatttcttgcaaaactgccaggagctgacactctggataaacgacaagcttctcacaagccaggatgtctcctatgacgaagctagaaatctgcacaataaatggctaaaacaccaggctttcgtcgctgagctagcttctcacgaaggatggctggagaacatagatgccgagggcaagcagctgatggatgaaaaaccccagttcaccgccctcgtgtcccagaagttggaggcactgcatcgtctgtgggatgaactacaagcgacaacaaaagagaagacacaacacctgtcagcagctcggagttccgatttgagattgcagactcatgcagatttaaacaagtggattagcgcgatggaagaccagctgaggtcagacgatcccgggaaagatctcaccagcgtgaatcggatgctggccaagttgaagcgagttgaagatcaggtaaatgtgaggaaggaggaactcggagaattattcgcccaggttccatctatgggtgaagagggcggggacgctgatctgtcaattgagaagcgctttctggatcttctcgagccccttgggaggcggaaaaagcaactggagtcctcccgggcaaagctgcagatcagccgagacctggaggacgagaccctgtgggtagaagagcgattaccactggcccagagcgccgactacggaacaaatcttcaaactgtgcaactgttcatgaagaaaaatcagacactgcaaaacgagatcctcggacatacacctagggtggaagacgtgcttcaacgcgggcagcagctcgtcgaagccgctgaaatcgactgtcaagatcttgaggagcgattggggcacttgcagtcttcatgggacagattgcgggaggcagcagccgggcggttacagcggctccgggacgcaaacgaggctcagcagtactatctggacgctgacgaagccgaagcgtggatcggagagcaggaattgtacgtgatctcagacgagatccctaaagatgaggagggcgctattgtgatgctgaagcggcacttacgccaacagagggctgtggaggactacggtcgtaacattaagcagctggcctctagagcccaaggcctgctgagcgccggtcacccggagggcgagcagatcatccgcttgcagggacaggtagacaaacattacgccggcttaaaggacgtggcagaggaaaggaaaagaaaactcgaaaacatgtaccacctcttccaactcaagagggagacagacgatcttgagcagtggatttctgagaaagagctcgtggcttctagccccgagatgggtcaggatttcgatcatgtgactttattgagggacaaattccgcgacttcgccagagaaaccggagctatcggacaggagagggttgacaacgtcaatgccttcatagagcgcctaatcgacgcgggccacagtgaagccgcaacaattgccgagtggaaagacggcttaaacgagatgtgggctgacctactagaactgattgatacacgaatgcagctgctggcagcaagctacgacctgcatcgctatttttatactggcgcagagatactggggctgatcgatgagaagcatagggagctgccagaggatgtcggcctggacgcatccactgctgagtcattccatcgcgttcatacagctttcgagagggagttgcacctgctgggggtacaggtgcaacagttccaggatgtagctacccgacttcagaccgcttacgccggcgaaaaggccgaggcaatccagaacaaggaacaggaggtgtcagcagcctggcaggcattgctggatgcatgtgctggtaggcgaacccagctggtggatactgctgataagtttcggttcttcagcatggctcgggacttgctttcatggatggagagcatcatccggcaaatcgagacacaagagcgaccacgcgacgtgagctcagtggagctgttaatgaagtatcatcagggaataaatgccgagattgagacccgatcaaagaatttttctgcctgcctcgagctgggtgagtcactgctgcagcgccaacaccaagccagcgaagaaatccgggagaaactgcagcaggtgatgtctcgccggaaggaaatgaacgaaaaatgggaagcccgatgggaaaggcttagaatgttgctagaggtgtgtcagttttccagggatgccagcgttgccgaggcatggctgattgcacaagaaccatatttagcaagcggcgattttgggcatacagtcgactctgtggagaagctgatcaagcgtcatgaggctttcgagaagtctaccgccagctgggccgagcgttttgctgctcttgaaaagcctacgactctggaactgaaagagcgccagattgcagaacggccagctgaagagactggtccccaggaggaagagggagaaactgctggcgaggcaccagtctcacatcatgcagcaactgagaggacctctccagtttcactttggagtagactctcatcttcatgggaatctttacaaccagagccatctcatccctattag

SEQ ID NO: 135899 - DNA, 6987 bp, Artificial Sequence
  Description of Artificial Sequence: Synthetic coding sequence
atgacctccgccacagagttcgaaaatgtgggcaatcagcctccttacagtagaatcaacgctaggtgggatgctccggatgacgaactggacaacgacaatagtagcgcaaggctcttcgagcggtcacgaattaaggcactggcagacgaacgagaggtggtgcagaaaaagacgttcacgaaatgggtcaattctcacttagctcgggttagctgcaggatcaccgacctgtacaaggatctgcgcgacggcagaatgttgatcaaattacttgaagtgttaagtggcgagatgttaccaaaaccaactaagggcaagatgaggattcactgtctcgaaaacgtggacaaggctttacagttcctcaaggagcaacgcgtgcacctcgaaaacatggggagccatgacatcgttgatggcaaccatagactcgtgctgggcctcatctggactatcatcctccgcttccagattcaggacatagtcgttcagacccaagaaggcagggagaccagatcagccaaggacgccctgcttctatggtgccagatgaaaaccgccggatatcctcacgtgaatgttacgaattttacctcctcatggaaagacgggctggcctttaatgctctgatccacaagcatcgccctgacctgatcgattttgacaagctgaaagattctaatgctcggcataacctggagcacgccttcaacgtggccgagcgtcagcttggaattatcccactgcttgaccctgaagatgtattcactgagaaccctgatgagaagtcgattattacgtacgtggtggccttctaccactacttctcgaaaatgaaggtgttggccgtggaggggaagagggtgggaaaggttatcgaccatgcaatagaaacagagaaaatgatagaaaaatattctgggcttgcctctgatttgctgacatggatcgaacaaaccatcaccgtgctgaactctcggaagttcgccaacagccttactggagtccagcagcagttgcaggcgttcagcacttacaggactgtcgaaaaaccgcctaagtttcaggagaaaggtaatctggaagttttactgttcacaattcaatctcgcatgagagcaaacaaccaaaaagtgtacacgccgcacgacggtaagctggtctctgatattaaccgtgcctgggaaagtctggaggaggccgagtatagaagggaattagccctgaggaacgagcttatccgccaggagaaactcgagcaacttgcccgacgcttcgaccggaaggcagccatgcgggagacctggctgtcagagaaccaacggcttgttgctcaggacaactttggatacgatctcgcagccgtagaggcggccaagaagaaacacgaggctattgagacggacaccgccgcatacgaagagagagtacgcgctctagaagatctcgctcaggaactggaaaaagaaaactatcatgaccaaaagaggatcaccgcccgaaaagataatatcctgagattatggagttatctccaggagctcctgcagtccaggagacaacgactcgaaacaaccctcgctttacaaaagctcttccaggacatgttgcatagcatcgactggatggatgaaattaaggctcatcttctatctgcagaattcggaaaacacctcctggaggtcgaggaccttctccaaaagcacaagctgatggaggctgatatcgctatccaaggggacaaggtaaaagcaattacggctgccacgctgaagtttaccgaagggaagggctatcagccttgtgacccacaggtcatccaggatagaattagccacttagagcagtgctttgaggaactatcaaacatggccgccggtaggaaggcccagcttgagcagtcaaagcgtctctggaagtttttttgggaaatggatgaggccgaatcctggattaaagagaaagagcagatttactcatccctcgactatggcaaagatctgacaagcgttctaatactgcagagaaagcataaagcgttcgaagacgaactgagaggattggacgctcatctagagcagatttttcaggaggcccacggaatggtggctaggaaacagtttggacatccccagattgaagcccggattaaagaagtttccgcacaatgggaccagctcaaagatttggccgcattttgcaagaaaaacctccaagacgccgagaacttttttcagttccagggtgacgccgatgacctcaaggcctggcttcaagacgcccaccgtctgctgagcggcgaggatgttggacaggatgagggagctacgagggcgctaggaaaaaaacataaggatttccttgaggagctggaagagagcaggggggtcatggaacatctggaacagcaagcccaaggcttccctgaggaattccgcgactcacccgacgtgacccacaggctgcaagccctcagggaactgtaccaacaggttgtagctcaagcagaccttcgacagcagcgattacaggaggcgctggatctgtacacagttttcggggaaaccgatgcttgcgagttgtggatgggcgagaaagagaaatggctggccgaaatggagatgccagatacattagaggacctagaggtcgtacagcaccgttttgacatattggaccaagagatgaagacactgatgacccagatagacggcgttaatttggccgccaatagtctggtggagagcggccaccccaggagccgagaagttaagcaataccaggatcatcttaacaccaggtggcaggccttccaaaccctcgttagcgagcggcgtgaagctgttgactctgcccttcgagtgcacaactactgcgtagactgtgaggagactagcaaatggatcacagataaaaccaaagtggtcgaaagcaccaaggacctgggtcgcgacctggcagggatcattgccattcagcgcaaactatctggtctggaacgggatgtagctgccattcaggctagagttgatgcactggagcgggagagtcagcagctaatggactcacaccctgagcaaaaagaggacataggtcagcgtcagaagcacttagaggagctatggcagggtctacagcagtcccttcagggacaagaggacctcttgggtgaggtgagtcagctccaggcctttttgcaggatttagatgacttccaagcctggctctcaatcacccaaaaggctgtcgctagtgaagatatgccagagagtctcccagaggcagagcagcttctgcaacagcatgcgggcatcaaggacgagatcgacgggcaccaggatagctaccagcgggttaaggagagcggcgaaaaagtgatacaggggcaaaccgatcctgaatacctgttacttgggcagcgtctcgaagggctggacacaggatggaatgctttgggaagaatgtgggaatccaggtctcacaccctggcgcagtgtttggggtttcaggaatttcagaaagatgctaagcaggcagaggctattctcagcaatcaagagtatactctggcccacttggaaccacccgattctctcgaggccgctgaagctggcatccgcaagtttgaggatttcctcggatccatggagaataatagagataaagttctaagtccagttgacagcggcaacaagctggtggccgagggaaacctctactcggataagattaaggaaaaggtccagctaatcgaagatcgccatcggaagaacaacgaaaaggcacaggaagcaagtgtgcttcttcgggataatctggagttgcaaaacttcttacagaactgtcaagagcttactctctggatcaacgacaagctcctaacttcccaagacgtttcctatgacgaggccaggaatctccacaacaagtggttaaaacaccaagctttcgtcgcagagttagccagccacgaggggtggcttgaaaacatcgatgcggagggcaaacagctgatggatgagaaacctcagtttaccgccctggtgtctcagaagcttgaggccctgcatcgcctatgggacgaattgcaggctacaaccaaggaaaagacacagcatttgtcagcagcgcggtcgagtgacctgaggctgcagacgcacgccgacctcaataagtggatctccgcaatggaagaccagctgcggagtgacgaccccggtaaggacctgaccagcgttaaccggatgctcgctaagctgaagcgggtagaggatcaagtcaacgtcaggaaagaggagcttggtgaactttttgctcaggtgcccagcatgggggaggagggcggggatgcagaccttagtatcgaaaagagatttttggacctgctcgagccacttggtcggcgcaaaaaacagctggagagttcaagagcaaaactccagattagccgggaccttgaggatgagacactgtgggtcgaggagcgactccccctggcgcagtccgcagattacggtacaaatttacagaccgtacaattgttcatgaaaaaaaaccaaactctgcaaaacgaaatcttgggacacacgcctcgagtcgaggacgtcttacaacggggtcaacagttagtagaggcagcagaaattgactgccaggatcttgaggagagactgggccacctgcaatccagctgggatagactgcgagaagctgccgccgggcgtttacagcggctaagggacgccaacgaggctcagcagtattacctggacgccgacgaggccgaagcctggattggcgaacaggagctctacgtcatctctgacgaaattccaaaagatgaggagggggccatcgtgatgctaaagaggcatctgaggcagcagcgcgcggtggaagattacggcaggaatattaaacagctcgcctctcgcgcgcagggactgctgtctgccggtcatcccgaaggagagcagatcattagactgcagggccaagtggataagcactatgcaggcctcaaagatgtagctgaagaacgaaagcgaaaacttgaaaatatgtaccacctgttccagctcaagcgagagacggacgatctggagcagtggatatcagaaaaggagttggtagcgagttcccctgagatgggtcaggattttgatcacgttacgctgcttcgtgacaaatttagagacttcgcccgtgaaacaggagcaatagggcaggagagagttgataacgtgaacgcattcattgagcgcctaatcgacgctggacatagtgaagccgccactatcgctgaatggaaggatggactaaacgagatgtgggctgatcttctggagcttatcgacacccggatgcagttgctggccgccagctacgaccttcatcgctatttctatactggagcagaaatactgggcttgatcgatgagaagcatcgagaactcccagaagacgtgggtcttgacgcgtccaccgcagagagctttcatcgcgtgcacaccgcatttgaacgggagctgcatctgctgggcgtgcaggtacagcagtttcaggatgtggccaccaggcttcaaacagcttatgctggggaaaaagccgaagcaatccagaacaaggagcaggaggtcagtgctgcctggcaggccctcttggatgcctgtgccggtcggcggacacagctggttgacaccgccgacaagtttaggttctttagtatggcaagggacctacttagttggatggaatcaataatccggcagattgaaactcaggaacggccacgggacgtgtcttccgttgaactcttgatgaagtaccaccaagggattaacgcggagatcgagacaaggtctaaaaatttttcagcatgcctcgagcttggcgaatccctgttgcagagacaacatcaagcctcagaggagatccgggaaaagttacagcaggtaatgagtaggagaaaagagatgaacgaaaaatgggaggctagatgggaacgcctcagaatgctgctggaggtctgccagttttcacgggatgcaagcgtagcagaggcctggttaatcgcacaagagccataccttgcatcgggggatttcggccacacagtggattctgtggagaagcttattaaacgacacgaagccttcgaaaaaagcacagcctcctgggccgagcggttcgctgccctggagaagcctactactttggaattgaaagaacgccagatcgctgagcgaccagccgaggagactgggccacaggaggaggagggcgaaacagccggggaggcccctgtctcacatcacgccgctacagagcgaacctcacctggcgaggaggaggggacatggccacaaaacctgcagcagccccccccacccggccaacacaaggatggtcagaagtccacaggagacgaacgccccacgactgagccgctatttaaagttttggatacccctctttccgagggagacgagcctgcgaccctccctgcccctagggatcacggccagtctgttcagatggaaggttatctggggaggaagcacgacctggagggcccaaacaaaaaagcatcaaacagaagctggaacaatctgtattgcgtgttacgcaatagtgagctgacgttttataaggatgcgaagaatttggcactcggcatgccctatcacggcgaggaaccactcgctctacgccacgcaatctgcgaaatcgcagccaattataaaaaaaaaaagcacgtgttcaaattgagactgtccaacggctccgaatggctcttccatggaaaggacgaggaggagatgctctcctggctccagggagtgtcaacagccataaacgagtcacagtccattcgggtgaaagcgcaaagccttcctctgccttctcttagcggtcctgacgctagtctcggtaagaaggacaaggaaaaaagattcagctttttcccaaagaaaaagtag

SEQ ID NO: 135900 - DNA, 6999 bp, Artificial Sequence
  Description of Artificial Sequence: Synthetic coding sequence
gaacccgctgacatgacgtctgcaaccgaattcgagaacgtgggcaaccagcccccttactcacgaataaacgccaggtgggacgcaccagatgacgagctggacaatgataatagctcagcaaggttattcgaaaggtctaggattaaagctctggccgacgagagggaagtggttcagaaaaagacatttacaaaatgggtaaactcacacctggctagggtcagctgtaggatcacggacctctacaaggatctgagagatggtcgtatgctgataaagcttctggaagtcctctccggtgaaatgctgcctaagcccactaaaggcaaaatgcgtattcattgcctggaaaatgtagacaaagccctgcagttcctgaaagagcagcgcgtccacctggagaacatgggctcccatgacatcgtagacggaaatcacaggctggtcctgggattgatctggacaattatcctgaggttccagatccaagacatcgtcgtgcagactcaggaagggcgggaaacacgcagcgctaaggatgccttgctgctctggtgtcagatgaaaactgctggctatcctcatgtcaatgtgacgaactttaccagtagctggaaggatgggctggcctttaatgcgctgatccacaagcatcggcccgacctgattgactttgacaaactgaaggatagtaatgctagacacaacttagagcatgctttcaacgtggcagaaaggcagctgggaataataccactgctcgaccctgaagatgtgttcaccgaaaatcctgatgaaaagtccatcattacctacgtggtggccttctaccactacttttcaaaaatgaaggttctggccgtggaaggtaagcgggtgggtaaagttatcgaccacgccatagaaacggaaaagatgatagaaaaatattccggcctggcgagcgatctgctaacgtggatagagcagaccattacagtcctcaatagccggaagtttgcaaactcccttactggcgtacaacagcaactgcaggcctttagtacgtaccgtacagttgagaagccacctaaattccaggaaaaaggaaacctggaagttctcctgtttaccatccagagcagaatgcgcgcaaacaaccaaaaggtatatacccctcacgatggcaagctggtaagcgatatcaaccgcgcttgggagtcattggaagaagcagaataccgccgagaactcgctctgcgcaacgaattgatcagacaggagaagctagaacagttggcccgaagatttgaccggaaagcagcgatgagagaaacatggctgagcgaaaatcaaagacttgtggcacaggacaactttgggtatgatctcgcagcagtggaggcggcaaaaaaaaagcacgaagctatagagacagacactgccgcgtacgaggagcgggtgagggcattagaggatttggctcaggaactggagaaggagaactatcatgatcagaagagaattactgccaggaaggacaatatattgcgcctatggtcatacctacaagaactcctgcaatcgcggcgacaacggctggaaactactctagcgttacagaagctctttcaggatatgttgcatagcatagattggatggacgaaattaaagctcacctgctttccgcagagttcgggaagcatttgctggaggtggaagatctgctgcagaagcataagttgatggaagctgacattgcaatccagggtgataaggtgaaagctatcaccgcagccactctgaagttcacagaaggcaagggttatcagccatgcgatccacaggtaatacaagaccgtatctcccatctggaacagtgcttcgaggagctgagcaatatggccgcggggagaaaagcacagctggaacagtctaagcgcttatggaagttcttctgggaaatggacgaggccgaaagttggatcaaagaaaaggaacagatttacagcagcctggattatggaaaggatttgactagcgtgctgattctccagcgcaaacataaggcatttgaggatgagctccgagggttggatgctcacctagagcagatattccaggaggcacacggaatggtcgctcgcaaacaattcggtcatccccaaattgaagccaggataaaagaggtgtccgcccagtgggaccaactgaaggatctggccgctttctgcaaaaaaaacttgcaggacgctgagaattttttccagttccaaggagatgcagatgatttgaaggcatggctgcaggacgcacatagattgctgagtggagaggatgtcggccaagatgagggcgcgacacgtgccctcggcaagaagcacaaggacttcctggaggagttggaagagtcgaggggggtaatggaacacttggagcaacaggcccaggggtttccagaggaattccgagatagcccggatgtcacacacagactccaggcactccgcgagttgtaccagcaggtagtggcccaggctgatctgaggcagcaacgactacaagaagccctggatctgtatacagtattcggtgagacagatgcctgcgagttatggatgggagaaaaggagaagtggcttgccgaaatggagatgcccgatactttggaggatctggaggtggtccagcacagattcgacatcctggaccaagaaatgaaaactctgatgacccagatcgatggagtgaacctggccgctaatagccttgtggagagtgggcacccccggagccgcgaggtgaagcagtatcaggatcacctgaatactcggtggcaggcctttcagacactggtcagtgaacgccgcgaggctgtggactcggccctgagggttcacaactattgtgtcgactgcgaagagaccagcaagtggattaccgataagacgaaggtggtggagtctaccaaggacctcgggcgcgacctggctggtatcatcgctattcagcggaagctatcggggcttgaacgagacgtggccgccatccaagcgcgagtggatgcactcgaacgggaaagtcagcagctgatggatagccatccagaacagaaggaggatattggacagaggcaaaaacatctggaggagctgtggcagggcctccagcagtcactccaaggccaggaggacttactgggcgaggtgtcccagcttcaggcttttctgcaggatcttgatgacttccaggcttggctgagtatcacacagaaggctgtggcaagtgaagacatgccagaatctcttcctgaagcagaacagctgctgcagcagcacgccggtatcaaggatgaaattgatgggcaccaagacagttatcaaagagtgaaggaatcgggcgaaaaggtcatccaggggcaaaccgaccctgagtatctactgttaggacagcgcctggagggacttgacaccgggtggaacgcacttggcaggatgtgggagtctcgctcccacaccttagcccagtgtctaggcttccaggagttccagaaggacgcgaagcaggcggaggccatcctcagcaaccaggaatacactcttgcacatctggagcctcctgattccctggaggctgctgaagctggtatacggaaattcgaagacttcttagggtcaatggagaacaatcgcgataaggtgctgtcaccggttgactccggaaacaagctggtcgccgagggaaacctgtactccgacaagataaaggagaaagtgcagctgatagaggacagacatcggaaaaataatgaaaaggcacaggaggcctcagttctgttacgcgacaacttagaactgcaaaactttttgcagaattgccaggaattgaccctgtggatcaatgataaactgctaaccagtcaggacgtgagttacgacgaagctcgtaatctacataacaaatggttgaagcatcaggcattcgtggctgaactggcgagtcatgagggttggctggaaaatatagacgccgaaggtaagcaattgatggatgagaagccgcagttcactgccctggtgtcccagaagctggaggcattacaccggctttgggacgaactacaagccacgaccaaggagaaaacacagcatctaagcgccgctcggtcaagcgacctgagacttcagacccatgcggatctgaataaatggatctcagccatggaggatcaactgaggagtgatgaccccgggaaagacttgaccagtgtcaaccgcatgcttgccaaactgaagcgggtcgaagaccaagtgaatgtcaggaaagaggagctaggggagcttttcgctcaggttccaagcatgggcgaagaggggggtgatgccgatctcagcatagagaagaggttcctggatctcttagagcctctcggaagaaggaagaagcagcttgaaagcagccgtgccaagctgcagatttcccgcgatttagaagacgaaactttgtgggtggaggagcgattaccgcttgcgcagagtgctgattatgggaccaatctgcaaactgtgcagctgtttatgaaaaaaaaccagacgctccagaacgagattctggggcacacgccacgcgtggaggacgtactacagagggggcagcagttggtcgaggccgcagagattgattgccaggatcttgaggaacgattggggcatttgcagagtagctgggaccgcctgcgggaagcagcggcggggaggctgcagcggctgcgggatgccaacgaggcccagcagtattacctagatgcagatgaggcggaagcgtggattggagagcaggagctgtacgtcatttccgacgagattccaaaggatgaagaaggcgccatagtaatgttaaaacgacaccttcggcagcagcgagctgtggaggattacggccgcaatatcaagcagctggcaagtcgtgcccaggggttgctgagcgcagggcacccagagggcgagcaaatcatccgtttgcaaggtcaggtggacaagcattatgctggcttgaaggacgtggccgaggagcgtaaacgaaaactcgagaatatgtatcacctgtttcagctcaagagagagaccgatgacctggagcaatggatcagcgagaaagagctggtcgccagtagcccagagatgggccaggacttcgatcatgtaacattgcttcgagataagttccgggatttcgcccgggagactggagctatcgggcaggaacgggtagataacgtgaacgcctttatcgagagactaatcgatgctgggcactctgaagccgcaaccatcgccgagtggaaggacggacttaatgagatgtgggcggatctgcttgagctgattgatactcgcatgcagcttctggcggcatcctatgatctacataggtatttctacacgggggccgaaattcttggtcttatcgacgaaaagcaccgggaacttccagaggacgtcggcctggacgcatccacagctgaatcatttcaccgcgttcacacagctttcgaacgcgaactgcatctgctgggcgtgcaagttcaacaatttcaggatgtggcaaccagactccagactgcctatgccggggagaaggctgaagccatccagaataaagaacaagaagttagcgccgcctggcaggcattgctggacgcctgcgcgggacggcgcacccagctcgtcgatactgccgacaagtttcgatttttctccatggcccgagatcttctctcctggatggagagtattatccgccagattgagacacaggagaggcccagagacgtctcgtcggtggaactcctgatgaagtaccaccagggcatcaacgcggaaattgaaactcggtccaagaacttctccgcttgtctggagctcggggagtctttgctccagaggcagcaccaagcctccgaagagattcgagagaaattgcagcaagtgatgtctcggcgcaaggagatgaatgagaaatgggaggcaaggtgggagagactgcggatgctgctcgaggtctgccagttctccagagacgcaagcgttgctgaggcctggctcatagcccaggagccctatctggcctccggagatttcggccatactgttgacagtgtggaaaaactcataaagcgacacgaggctttcgagaagtcaactgcctcctgggcagaaagattcgctgctttggagaagcccactacccttgaactgaaggagagacaaatagcagaaagacctgctgaagagacgggacctcaggaggaagaaggcgaaactgcaggcgaagccccggtgtcacatcacgccgccaccgaacggacgagccccggggaggaagaagggacttggcctcaaaatctgcagcagcccccacctccgggccagcataaagatgggcaaaagagcacgggtgacgagaggccaaccaccgaaccactgttcaaggtgctagacaccccactctccgagggcgatgagccggcaacactgcccgctcctcgcgatcacggacaaagtgtccagatggaaggatacctcgggaggaagcatgacctcgagggccccaacaaaaaggcttcaaatcgatcgtggaacaacttatattgtgtcctgagaaactcagaactgacattttataaggacgcgaaaaaccttgcactgggaatgccataccacggcgaggaaccactggccctgcgtcatgccatctgtgagatcgcagcaaactataagaagaaaaagcatgtgttcaagctgcgcctctcaaatggtagcgagtggctctttcacggcaaggacgaagaagaaatgctcagttggctgcaaggggtgtccacggccattaatgaaagccagtctattcgtgtgaaagcccaatctctgcccctccctagcttaagcggacctgatgctagtctgggcaagaaagataaagagaagaggttcagcttcttcccgaagaagaaatag

SEQ ID NO: 135901 - DNA, 6414 bp, Artificial Sequence
  Description of Artificial Sequence: Synthetic coding sequence
atgacatctgctacagagttcgagaatgttggaaaccagcccccttattcccgcatcaatgcacggtgggacgcgcccgacgacgaattggataatgataactccagtgctagattatttgaaagaagccggattaaggctctggcggacgagcgcgaagtggtgcagaagaaaaccttcaccaaatgggtcaacagccacctcgcccgcgtttcttgccggattactgacctttacaaggatttgagggatggcaggatgctgatcaaattactggaggtgctgtccggcgaaatgctccccaagcccaccaagggaaagatgaggatccattgcctagagaacgttgacaaggccctgcagttccttaaggagcagcgcgtccaccttgagaatatggggtcacatgacatcgttgacggcaatcaccgactggtgctgggcctaatctggacaatcatcttgcgcttccaaatccaagatatagtcgttcaaactcaggaggggagggagacgcgatcagccaaggatgcactgctgctgtggtgccaaatgaagacggcaggctatccccacgtcaacgtgaccaacttcacatcctcttggaaggacgggctcgctttcaacgcccttattcacaagcaccggccggatctcattgattttgataaattaaaggactcaaacgctcgccataatcttgaacatgcttttaacgtcgccgaaaggcaacttggtataatcccacttctggatccggaagatgtgtttacagagaaccctgatgaaaagagcatcataacctatgttgttgccttttaccattacttcagcaaaatgaaggttctcgcggttgagggcaaaagagttgggaaggtaatcgatcatgcaattgagacagaaaagatgatcgaaaagtactccggcttggcatctgacctcctgacctggatcgaacaaacaattacagtcctcaactcacgcaagtttgctaatagcctaactggtgttcagcagcagctgcaggcgttctctacctaccgaactgtagaaaagccgcctaaattccaagagaagggaaacctggaagtactcctgttcaccattcaatcaaggatgcgagcaaataatcagaaggtttataccccacacgacggcaagctagtttccgacatcaatcgagcgtgggaatctcttgaggaagctgagtatcgcagggagctggccctccggaatgagttaattcggcaggagaaactggagcagctggcacggcgcttcgatagaaaagctgcgatgagggagacttggctgtcagaaaaccagcgattggtagcccaggacaacttcgggtacgatctggccgctgttgaggccgccaagaaaaaacatgaagccattgaaactgacacagcagcctacgaagagagagtaagagctctggaggatctcgcccaagaactagaaaaggaaaattaccacgatcagaaacgcataaccgcacggaaagataatattctgcgcctttggtcgtacctgcaggagctgcttcaatctcgtaggcagagactggagaccacactcgctctgcagaagctgtttcaagacatgctccattctatcgattggatggacgaaattaaagcccatctgctttccgccgagtttgggaaacatctcctggaggtggaggatctgctgcagaagcacaaattgatggaagcagacattgctatccagggagacaaagtcaaggctattacagctgccacactgaaatttacagaaggcaagggctatcaaccatgcgatcctcaggtaattcaggatcgtatctcacacctcgaacagtgtttcgaagagctttccaatatggctgcagggaggaaggcacagttggaacagtccaagcggctctggaaatttttctgggaaatggacgaagctgagagttggatcaaagagaaggagcagatatatagctctcttgattacggcaaagatctgacaagtgttctgatcctccagcgcaaacacaaggccttcgaagatgagctgcggggtctcgacgctcacctggagcagatttttcaggaggcacacggtatggttgcccgcaaacagtttggccaccctcagatcgaggcccgtataaaagaggtgtccgctcagtgggaccagttaaaggaccttgctgcattctgtaaaaaaaatttgcaagatgctgagaatttcttccagtttcagggcgacgctgatgatcttaaagcctggctgcaggacgcccatagattgttgagtggtgaagacgtgggacaggatgaaggtgccacaagagccctcggtaagaagcacaaggacttcctggaagaactggaggagtcccggggtgtgatggagcatctagaacagcaggcgcagggttttccagaagaatttagggattcaccagacgtgacccacaggctccaggctttacgcgagttgtaccaacaggtcgtcgcacaagcagatctgcgtcagcagcgcctccaagaagcactggacctgtatactgtctttggtgaaacggatgcctgcgagctttggatgggggagaaggaaaagtggctggccgaaatggagatgccagatacacttgaggatttggaagtagtgcaacacagattcgacatcctagaccaggaaatgaaaaccctcatgacacagatcgacggagtgaacctggctgcaaattccctggtggaaagtggtcaccctaggtcccgcgaagttaagcagtaccaggaccacctgaacacaagatggcaggctttccagactcttgtctccgagaggcgggaggccgtggatagcgccctgcgagtgcataattactgcgtggattgcgaggaaactagcaagtggatcacggacaaaactaaagtggtggaaagcacaaaagatctgggaagagaccttgcaggaattatagctatccagaggaaactcagtggactggaacgagatgtggctgctattcaagcacgggtggatgctctagaacgcgagagccagcaactcatggatagccatcctgaacagaaagaagatatcgggcagcggcagaagcacctggaagaactctggcagggcctacagcagtctttacagggacaagaggacctcctgggcgaggtgtctcagctccaagcatttttacaggacctagatgatttccaagcctggttgagcataacacagaaggctgtcgcaagcgaggacatgccggaatcactgccggaggcagagcagctcctgcagcaacatgctggaattaaggacgaaatcgatggtcaccaggactcctaccagcgggtcaaggaaagcggtgaaaaagtgatccaaggccagaccgaccctgagtatctccttctgggacagagactggaggggctggatacgggttggaatgcactgggacgtatgtgggagagcagatctcacacactcgcccagtgtctgggattccaggagtttcagaaagatgctaagcaggcagaggcaattttaagcaaccaagagtataccctcgcacatcttgagccacccgattcattggaggccgctgaggcaggaattagaaagtttgaagattttttagggtcgatggaaaacaacagagacaaagtgctctcacctgttgattcgggcaacaagcttgtcgccgaaggaaatctgtattcggataaaataaaagaaaaagtccagctaattgaggatcgacataggaagaacaacgaaaaggcgcaggaggcgtccgtgctattaagggacaatctcgagctgcagaacttcctgcagaactgccaagaacttaccctgtggatcaatgacaagctgctgacaagtcaggatgtaagctacgatgaggctcgaaacctgcacaacaaatggctgaaacaccaggcctttgtggccgagctggcctcacacgagggctggttggaaaatattgacgctgagggcaaacagttgatggatgaaaagccacaattcaccgctcttgtctctcagaagttagaagccttgcatcggctgtgggatgagctacaggctacaacaaaggaaaagacccagcacttaagcgctgcgcggtcttccgacctacgcttgcagacccatgccgacctgaacaagtggatttccgccatggaggaccagctccgcagtgacgacccagggaaagacttgacgagcgtcaatcgaatgctggccaagctaaagcgcgtggaggaccaagtgaacgtgagaaaagaagagctcggcgaattgttcgcccaggtccccagtatgggcgaggagggcggagacgcggatttatcaatcgaaaaaagatttctcgatctcctggagcctcttggccgcagaaaaaagcagttggaaagcagccgggcaaagctccagatcagtcgtgacctggaggacgagaccttatgggtggaagaacgtttacccttagcacagtcagcagactatggaaccaaccttcaaactgtacaactgtttatgaaaaagaatcagacgctgcagaacgagatccttgggcacacaccacgtgttgaagacgtacttcaacgcggccagcagctggttgaagctgccgaaattgactgccaagacctggaagagaggctgggccaccttcagtcaagttgggaccggttgcgggaggccgccgccggcagacttcagcggttgcgcgacgcaaacgaggctcagcagtattatctagacgccgacgaggccgaagcatggattggagaacaggagctctacgttatatccgatgagatcccaaaagatgaggaaggagcgatcgtcatgctgaagcggcacttaagacaacaacgcgcagttgaagactacggacgcaatattaagcagttagcttcgcgcgcacaggggctcctcagcgctggacacccagagggagaacaaatcattcgcctccagggccaggtcgataaacattatgcagggctcaaggatgttgcggaggagagaaagagaaagctagaaaacatgtaccatttgttccagctcaaacgagagacggatgacttggagcagtggattagtgaaaaagagctggtagcttctagcccggagatggggcaggactttgaccatgttaccctgcttcgagacaagtttagggacttcgcgagggaaaccggggcgattggccaggagcgcgtggataatgtgaatgcatttattgaacggcttattgatgccgggcattccgaagccgctaccattgccgagtggaaggatggacttaatgagatgtgggccgatctgctggaactcattgacacgagaatgcagctgctggctgcatcctacgatctccaccgttatttttataccggtgccgagatcttggggctaatcgatgaaaaacaccgcgaactgcccgaagacgtagggctcgatgcctctacggccgaaagctttcatagagtccataccgcgttcgaacgggaactccatctactgggagtgcaggtgcagcagttccaggacgtcgcgacaagactccagacggcatacgcaggtgaaaaagcagaggcaattcagaataaggagcaggaggtgtctgctgcttggcaagcgctgcttgatgcctgtgccggccgcaggacacagctggtggacacagccgacaagtttagatttttctctatggcaagagacctgcttagttggatggagtcaataatcagacagatcgaaacccaggagaggcccagagacgtcagcagcgttgagctcctgatgaagtatcaccaaggcatcaacgcagaaatcgagacgcgcagcaagaacttctccgcatgtttagagctgggcgagagtttgcttcagaggcagcaccaagcatccgaggagataagagaaaagctgcagcaagtgatgagccggcgcaaagaaatgaatgaaaaatgggaggctcggtgggagcgactgcgaatgttgctagaagtctgtcaattctctcgcgacgcaagcgtggctgaggcgtggctgatcgcccaggaaccctacctggctagcggcgactttggtcacactgtggactcagtggaaaagctgattaaacggcatgaagccttcgaaaagtccaccgccagttgggccgagagatttgccgcactggaaaagcctactacactggagttgaaagagagacagattgctgagcggcctgcagaagaaacaggacctcaggaggaggagggagaaactgcaggggaggcccccgtgagccaccacgctgccacagagcgtacatcaccagtctcactgtggtcaagactctcctcttcgtgggaaagcctgcaaccagagccctctcacccatactag

SEQ ID NO: 135902 - DNA, 6987 bp, Artificial Sequence
  Description of Artificial Sequence: Synthetic coding sequence
atgacctctgcaacagagttcgagaacgtgggcaatcagcccccttattcgcggatcaacgcacggtgggacgcccccgacgacgagctggataacgacaactcttcggccaggctgttcgagcggtcaaggattaaagcactggcagatgagcgggaggtggtccagaaaaagactttcactaagtgggtcaattcacatctggcaagggtttcctgcaggattaccgacctgtataaggacctccgcgatgggagaatgctgataaaacttctggaggtcctttccggagaaatgctgccaaaacccaccaaggggaagatgagaattcattgtctggaaaatgttgacaaggctctgcagtttctcaaggagcagcgcgtccatttggagaacatggggagccatgacatagttgacggcaaccacaggcttgtgctgggcctcatctggaccatcatattgcgatttcaaatacaagatattgttgtccagacacaagaggggagagaaacgcggtctgcaaaggatgccctgctgctgtggtgtcagatgaaaaccgccggttaccctcacgtcaatgtgactaattttacttcgtcttggaaggacggcctcgccttcaatgcactcatacacaagcaccggcccgacctgatcgactttgacaaactgaaagactccaatgcccgacacaacctggaacacgcattcaacgtggccgaacgccagctcgggattattccgttgttggatcccgaggacgtctttacagagaaccctgacgaaaaatctatcattacatacgtggtcgccttttaccactatttctccaagatgaaggtgctggccgttgaaggtaaacgcgtaggcaaagtgattgaccacgccatcgagacagagaaaatgatcgagaagtatagcggtttggcgagcgacctcctcacctggatcgaacagaccatcaccgtcctgaactcccgcaagttcgccaatagcctcacaggggtccagcagcagctccaagccttctcaacgtaccgaacggtggagaagccgccaaagtttcaggagaagggcaacttggaggtgctgctttttactattcagtctcgaatgagggctaacaaccagaaggtatatacaccacacgacgggaaattggtctccgacatcaaccgagcatgggagtccttggaggaagcagagtacagaagggagctggcactgaggaatgagttaatccgacaggagaaactagagcaactggcaagacgctttgacagaaaagccgccatgcgcgaaacctggttatctgaaaaccaacggctggtcgctcaggacaatttcggctacgacttggctgccgttgaagccgccaagaagaaacatgaagcaattgaaactgataccgcagcttatgaagagagagtcagagctctcgaggatctcgctcaggagctggagaaagaaaactaccacgaccagaagcgcataacagctagaaaggataatattttgcggctatggtcgtacctgcaggaactcctgcagtcccgccgtcagcgccttgagaccaccctcgctctgcagaaacttttccaggatatgttacactccatagactggatggacgaaattaaggctcatctcttgtccgctgagtttgggaagcatttgctggaggtggaggacctgctgcaaaagcataagctgatggaggcagatattgcaatacagggggacaaagttaaagccattaccgccgccacactcaagttcactgagggaaaaggctaccagccttgcgacccgcaggtaattcaagatcggattagccatctcgaacaatgcttcgaagagttatctaacatggcggctgggcgcaaggcccaacttgagcagtctaagagactttggaaatttttctgggaaatggacgaagcggaatcgtggattaaggaaaaagagcagatttacagctccttagactacggcaaagacctgacatcagtactcattctgcagcgcaaacataaggcctttgaggacgaactgagaggactggatgcacacctggagcagatatttcaggaagctcacgggatggtcgccagaaaacagtttggtcacccacagattgaagctcggataaaggaggtgtccgctcagtgggaccagctaaaagacttagcagctttttgtaaaaagaacctccaggatgcagaaaatttcttccagttccaaggagacgccgacgatcttaaagcttggctgcaggatgcacaccgcctgttgagcggcgaagatgtgggccaggacgaaggagcaacaagagctctcgggaaaaagcataaagactttcttgaggaacttgaggagtctcgtggagtgatggagcatctggagcagcaggctcaaggcttccctgaagagttcagagactccccagacgttacccatagactccaagccttacgtgagctctaccagcaggtcgtggcccaggcagacctacgacagcagcgcttgcaagaggcactcgacctgtataccgtgttcggtgaaactgacgcttgcgagctctggatgggtgaaaaggagaagtggctggctgaaatggaaatgcctgacaccctggaggatttggaggtggtccaacaccgattcgacattctggatcaagaaatgaaaactctcatgacacagattgatggcgtgaacctggcggctaactccctcgtcgagtccggccatcctcgaagccgggaggtgaagcaataccaggaccacctgaacactcgatggcaggctttccaaaccctggtgagcgaacgcagggaagcggtggactctgcgttgagagtgcataattactgtgtggattgtgaggaaacttccaagtggataacagacaaaacgaaggtggtggaatctacaaaggacctaggccgagacctcgcagggattatagcaatccaaagaaagctcagcggtctcgagcgagatgtggcagcaatccaagcccgggtggatgccctggagcgggaaagccagcaactgatggatagccaccctgaacagaaggaagatatcggccagcgccaaaagcatctggaagagctctggcagggcctccagcagtctcttcaaggacaagaagatttactgggcgaggtttctcagctgcaggcgttcttgcaagacctcgacgactttcaggcctggctcagtatcacccagaaagcagtggcttctgaggacatgccagaatctcttccagaggctgaacagctgttgcagcaacatgccggcatcaaggatgagatagatggccaccaggatagctaccaacgagtgaaagagagcggggagaaagtcattcagggacagaccgatcctgagtacctcctcctcggccagcggctagaagggttggacacgggatggaatgcactgggcagaatgtgggagagccgaagtcacacgcttgctcagtgtctcggattccaggagttccagaaagacgctaagcaagccgaagccatcttgtctaatcaggagtatacactggcccatcttgagccacccgactctctggaggcagctgaagccggcatccggaaatttgaagacttcctcgggagcatggagaacaaccgtgataaggtgctgtcacctgtggactctggcaataagctcgtcgcagaaggaaatctgtattcagataagatcaaagaaaaagtgcagctaatagaggatcggcaccgcaagaataacgaaaaggcccaggaagccagcgtgctgttacgggataacttagaactacagaattttctgcagaattgccaggaactcactctctggataaacgacaaactgctgacctcacaggacgtgagttatgacgaagccaggaaccttcataataagtggttgaaacatcaggcattcgtcgctgagctggcctcgcatgaagggtggttggaaaacatcgacgctgagggcaaacagctgatggacgagaaaccacagttcaccgctctggtgtcacaaaaacttgaagcactccacagactgtgggatgaactacaggccaccacaaaagagaaaacccaacatcttagcgcagctcggtctagcgatttgaggttacagacacatgctgatcttaacaagtggatcagcgccatggaagaccaactccggtcagacgatcccggcaaagacctgaccagcgtcaaccggatgctggctaaattaaagagagtggaggaccaggtcaacgttcggaaggaggaactgggagagttatttgcgcaagtcccttctatgggggaagaagggggagacgccgacctgagtatcgagaaacgatttcttgatctgctggagcctcttgggcgccggaagaaacagcttgagtctagtcgagcaaagttgcagatttctagagacctggaagatgagactttatgggtagaagagcgtctgcccctagcccagtcagctgactacgggacaaatctgcaaaccgttcagctgttcatgaagaagaaccaaacattacagaacgaaattttgggacatacgcctagggtagaagacgtgctgcagcgtggccaacagttagttgaggccgcagaaatcgactgccaggatctggaggaacgccttggccacctccagagtagctgggacagattgcgcgaagcagccgccggtcgcctgcagcgtttacgggatgcgaacgaagcccagcagtactatctcgacgcggacgaggctgaggcttggatcggtgagcaggaactatacgttatcagcgacgaaattcccaaagatgaggagggcgcaattgtgatgttaaagaggcacctgaggcagcagcgggcagtcgaggactacggccgcaacattaaacagctcgcttctagggcccaggggctgctgtcggccggacatccagaaggtgagcagatcatcagactgcagggtcaggtggacaagcactacgctgggctcaaggatgttgcagaggaaagaaagcgcaagctagaaaacatgtaccacctctttcagctgaaaagggaaaccgatgatttagaacagtggatcagcgagaaagagctggtcgcgtcttcgcccgagatgggacaggacttcgatcacgttactctgctgagggacaagtttcgcgattttgccagagaaaccggcgcaataggacaagagagggtcgataatgtgaatgcctttatcgaacggctcattgatgcagggcactccgaagccgccactattgcagaatggaaagatggtctgaatgagatgtgggcagatttactggagctcatagatacccggatgcaactgctggccgctagctatgacctgcatcggtatttttataccggagctgagattttaggtctcattgatgagaaacatagagaactcccagaggatgttggtttagatgcatccacagcagagtccttccaccgcgtgcatacagcgttcgagcgggagttgcacctgctcggggtgcaagttcaacagtttcaggacgtggctactagactgcagaccgcttacgccggagaaaaagccgaagccatacaaaataaggagcaggaggtatccgcagcctggcaggctcttctcgacgcctgcgccggaagacgaacgcaactcgtagacacagctgacaagtttaggttcttcagcatggcccgcgacttgttaagctggatggaatccatcatcaggcaaatcgagacccaggagaggcctagagatgtctcctccgtggaactcctcatgaagtaccaccagggcattaacgcagagatcgagacccgaagtaagaacttctccgcctgtctggaattgggagagagcctactccaacgacagcaccaggcttccgaagagatacgcgagaaattacagcaggtaatgagtagacgtaaagaaatgaacgaaaaatgggaggcaaggtgggaaagactgagaatgcttctcgaagtctgtcagttcagccgggacgccagtgtggcagaagcttggcttatcgcgcaggagccatacctcgccagtggagattttggccacacagtggatagcgtggagaaactcataaagcgtcacgaggcattcgagaagagtacagctagctgggcagagagatttgcagccctggagaagcctacaaccttggagctcaaggaacgccagatcgctgaacgtcccgctgaagaaactgggcctcaagaggaggagggggagaccgccggggaggcgcctgtgtctcatcatgccgcaacagaacggacttcccctggggaggaggagggcacatggccacagaatctacaacagcctcctccaccagggcagcacaaagacggtcagaaaagtactggggacgagcgccccacaacagagcccctcttcaaggtgctcgacacccctctgagcgagggcgacgaacctgccacactgcctgctcctcgggaccatgggcaaagcgtgcagatggaaggctatttaggacgcaaacatgaccttgaggggcccaacaaaaaggcctccaatcggagttggaataatctctattgtgtgctcaggaacagtgagttgactttctataaggatgctaagaaccttgccctgggcatgccttaccacggcgaggagcccctcgcgctgcggcatgctatttgtgagatagccgccaactacaagaagaagaagcatgtatttaagctccggctctcaaacggatccgaatggctttttcacggcaaagacgaggaggagatgttgagctggctacagggcgtttcaactgccatcaacgagagccagtccatacgggtaaaggcccagtctctccctttgccctctctgtcgggtccagatgcctcccttgggaagaaagacaaggagaagaggttttctttcttccccaaaaagaagtag

SEQ ID NO: 135903 - DNA, 6468 bp, Artificial Sequence
  Description of Artificial Sequence: Synthetic coding sequence
atggaactgcaacgcacatcctctatttccgggcccttatcccccgcttataccggccaagtaccatataactataatcagctggaaggaagattcaagcagctgcaggacgaacgtgaggcagtgcaaaaaaaaacatttacaaagtgggtcaatagccatttagcgcgcgtatcttgtcgcattaccgatttatatacagatcttagggacggccgtatgctaattaagctgctggaagtgctgagtggcgagcgcctgccaaagcccacaaaaggccgaatgcgcatccactgtctcgagaatgtggataaagcactacagtttttgaaagaacaacgcgtgcatttggaaaatatgggttctcacgacatagtcgatggcaatcataggttgaccctggggctgatttggacaattatcctgagattccagatacaggacatctccgtggagacagaagataacaaagagaagaagagtgcgaaggacgcactgttgttatggtgtcagatgaaaactgccggctaccccaacgtgaacatccacaattttactactagctggagagatgggatggcgttcaacgccctgattcacaaacaccggccagacctgatcgactttgacaagctgaagaagagcaacgcccattataacttgcagaacgcatttaatctggctgaacagcatctgggacttactaaactcctcgaccccgaggatatttcggtggatcatcctgacgagaagtccattatcacgtacgtggtcacctactatcactatttttcaaaaatgaaggcccttgctgtggaggggaagcggattggcaaagtactcgataacgccatcgaaaccgaaaaaatgatcgagaagtacgagtcgctggcttctgacctgcttgagtggatagaacaaactatcattatattgaacaaccgcaagttcgccaacagccttgttggggttcaacagcagctgcaagctttcaatacctacagaactgtggaaaagcctcccaagttcaccgagaaaggaaatctcgaagtgctgctgttcactatccaaagcaaaatgagggcgaataaccagaaggtctacatgccccgagaaggcaaactgatctctgatataaacaaggcgtgggaacggctggagaaagcagagcacgagcgggagcttgccttgagaaacgagctgatacgccaagaaaaactggaacagcttgcccgccgctttgaccggaaagctgccatgcgtgagacttggctgtcagaaaatcagagacttgtgtcgcaagataacttcgggtttgacctgccagctgtcgaagccgcgaccaaaaagcacgaggctatcgaaacagatattgccgcctatgaggagcgggtacaggcagtggttgccgtggcacgtgaattggaggctgaaaactaccacgatattaagcggattactgcacgcaaagacaacgttatccgtctttgggaatatttgcttgagttacttcgtgctagacgccaaaggctggagatgaatcttggcctgcaaaagatcttccaggagatgctctacattatggattggatggacgaaatgaaggtgctggtcctcagtcaggattacggcaaacacctgctgggggtagaggacctgctgcagaaacatacgctggtagaagccgacatcggaattcaggctgaaagggttaggggcgtcaacgccagcgcacagaagtttgccaccgatggagagggctacaaaccttgcgaccctcaggtgattagggaccgcgtggcacacatggagttctgttatcaggagctctgccagttggctgcggaacgccgagctcgcttagaagaaagtagacggctgtggaaattcttctgggaaatggctgaggaggaaggctggattcgggagaaggagaagattctctcctctgacgattacggtaaagaccttacttcagtgatgagacttttaagcaaacatcgtgcattcgaggacgaaatgagtggaagatccggacatttcgaacaggccatcaaggagggggaagatatgatcgccgaagaacatttcgggagcgaaaagataagagaaagaataatctacatacgcgagcagtgggccaatctggagcaactgagtgctatccgtaagaagcgtctggaggaagccagtctgctacaccagtttcaggcagacgccgacgacattgacgcgtggatgctggacatactgaagattgtgtcgtcctcagatgtgggccacgacgaatactctacacaaagtctggtgaaaaaacacaaagacgtggcggaggaaattgctaattaccggccaaccctggatactctgcatgaacaggcttcagccctgcctcaggagcatgctgagtccccagatgtgcgtggtcggttgtctggcatagaggagcgttataaggaggtggcagagttgacccgcctgcggaagcaggcccttcaggacactctcgcactatataaaatgttctctgaagccgatgcctgcgagctatggatcgatgagaaagaacaatggctgaacaacatgcaaattcccgaaaagttggaggatctagaggtcattcaacaccgcttcgaaagtttggaacccgagatgaataaccaggcgtccagagtggcagttgtgaatcaaatcgctcgccagctgatgcactccggacaccccagcgagaaggagattaaggcccagcaggataagcttaacacgcgatggtcacagttccgcgaactcgttgataggaaaaaggatgccttattatcagccttatcaattcaaaactatcatcttgagtgcaacgagacgaaaagttggatccgcgagaagacaaaggtcattgagtccactcaagatttgggcaacgatctggccggtgtgatggctctccagcgcaaactgactggaatggaacgggatcttgttgccatcgaagccaaactgtcagacctgcaaaaggaggctgaaaagctcgagagcgagcacccagatcaggctcaggccattttgagccgattggccgagataagcgatgtgtgggaagaaatgaaaaccactctgaaaaatagagaagccagcttaggcgaggcctccaagctgcagcagttcctgcgggatttggacgatttccaaagttggctgtcccgcacgcaaaccgcaattgcttcggaggatatgccaaacacccttacagaagctgaaaaacttctgacgcagcatgagaacatcaagaacgagattgacaattacgaggaggattatcagaaaatgagagacatgggcgaaatggtgacacagggccaaaccgatgctcagtacatgtttttgcggcaacggctacaggccttggatactggttggaatgagcttcacaaaatgtgggaaaatagacagaacctcctgtctcagagccacgcctaccagcagttcctgcgcgacaccaaacaagctgaggccttcctgaataaccaagagtatgtgcttgcgcacactgaaatgccaacaacattagaaggagccgaggctgctatcaagaagcaggaagacttcatgaccactatggatgcaaatgaagagaagattaatgccgtggtagaaactggaagacgcctcgtgtccgacgggaatataaatagtgaccgaattcaggaaaaagtcgacagtatcgatgataggcaccgaaaaaaccgtgaaaccgcatctgagctgctgatgaggctgaaggacaaccgcgacctgcaaaaatttctccaggactgccaggaactgagcctctggattaatgagaagatgctgaccgcccaggacatgtcatatgatgaagcccgtaacctccactcaaagtggctcaagcatcaggccttcatggctgagctcgcaagcaacaaagagtggctagacaagatcgaaaaggagggaatgcagctgatctctgaaaaacctgagaccgaggccgtagtgaaggagaagcttactggcctacacaaaatgtgggaggtgctcgagtccactacccaaaccaaggctcagaggctcttcgatgccaacaaggctgagctattcactcagagctgcgccgacttggataaatggctacacgggctcgagtcccagatccagagcgatgactacggtaaggatctgaccagcgtcaacatcttactcaagaaacaacagatgctggagaatcagatggaggttaggaagaaagaaatcgaagagctgcagtcccaagcacaggcactgtcccaagaagggaaaagtactgatgaagtggactccaaaagattgaccgtgcagacgaaatttatggaactccttgagccacttaacgaacggaagcataatttgttagcctcaaaggaaatccaccagttcaatagagatgtggaagatgaaatcctgtgggtgggcgagagaatgcccctggccacttccaccgaccacggccataatctgcagacagtgcaactcctcattaaaaaaaatcaaacactgcaaaaagaaatccaagggcatcagccgcggatcgatgatatttttgagcgatcccagaacatcgtgactgacagttctagcctgtctgctgaggccatccgacagaggctggccgatttgaagcaactctggggattactcatcgaggaaaccgagaaacggcatagaagactcgaagaggctcatagggcacagcagtactacttcgacgccgctgaggctgaggcctggatgagcgaacaggaactgtacatgatgtccgaggaaaaggccaaggatgagcagtcagctgtctctatgctgaaaaaacaccagatcctcgaacaggccgtggaagactacgcggagaccgtgcaccaactgtcaaagacgtctagagcattggtcgccgactcacaccccgagagtgaaagaatcagcatgcggcagtccaaagttgacaagctctatgctggactgaaagacttggccgaggagaggaggggcaaattagatgaaagacaccggctgtttcagttgaatcgggaggttgatgatttggagcagtggattgccgaaagggaggtggttgctggatctcatgaactcgggcaggactatgaacacgtcacaatgctgcaggaaaggtttagggaattcgcaagggataccggtaacattggccaggaacgtgtggacactgttaatcatttggccgatgaacttatcaatagcgggcacagcgacgcagccaccatcgccgaatggaaggatggcctgaacgaagcctgggctgacctgctggaacttatcgatactcgtacccaaattctggcggcatcttacgaactccataagttctatcacgacgctaaggagatttttgggagaatccaggataagcataaaaagctccctgaagaacttggccgcgaccaaaataccgttgaaacgttgcagagaatgcataccactttcgaacatgatatacaggcccttggaacacaggtacggcagctccaggaagacgccgctcggttgcaggccgcctatgccggcgataaagccgatgacattcagaaaagggagaacgaagttctagaagcttggaaaagtctcttagatgcctgtgaatctagaagagtgcggcttgttgatactggggacaagtttcgcttcttctccatggtgcgggatctcatgctctggatggaagatgtcatcagacagatcgaggctcaggagaagccgcgggacgtgagctctgttgagctcctgatgaataatcaccagggaatcaaggcagagatcgacgccaggaatgattcattcacaacctgtattgaattaggcaagagccttttggccaggaaacattatgcttccgaggagatcaaggagaaactactccagctgacggagaaacgaaaggaaatgatcgacaaatgggaggataggtgggagtggctgcgactgattttagaggtccaccaattcagcagagacgcaagcgtggcagaggcatggttgctgggccaggagccctacctttccagcagggaaataggccaatcggtggacgaagtagagaagttgatcaagcgacatgaagcttttgagaaaagcgcagctacttgggacgagcgcttctcagcccttgagaggttaaccaccctggagctgctggaggtcaggaggcagcaggaggaagaggaaaggaaaaggcgacctccatcgcctgaacctagcaccaaggtgagcgaagaagcagagtcacagcagcagtgggacacttccaaaggggaacaagtctcccaaaacgggctccctgccgagcagggttcaccccgggtctcgtatcgctcccagacataccagaactacaaaaacttcaactcacggcgcactgcatccgaccaaccctggagcggcctttag

SEQ ID NO: 135904 - DNA, 7095 bp, Artificial Sequence
  Description of Artificial Sequence: Synthetic coding sequence
atgaccacgaccgtcgcaacagattacgataatatcgagatccagcagcagtactccgacgtgaataacagatgggacgtggatgactgggacaacgaaaattcatctgctcggctgttcgaacgtagcaggattaaagccctggctgacgagagagaggccgtgcagaagaagacctttaccaaatgggtaaacagtcaccttgccagagtgtcatgccgaatcacagacctgtataccgaccttcgcgatggacggatgctgattaaactcctcgaggtactgtcgggtgagagactgcccaagcccaccaagggcagaatgagaatccactgtctcgaaaacgtagataaagctctgcagtttctcaaggagcagcgagtccatttggagaacatgggcagccatgacatcgtagatggaaaccatcgactcaccctggggctaatatggactatcatcctgaggtttcagattcaggacattagtgttgagacggaggacaacaaggagaaaaagagcgctaaagatgctttgctgctgtggtgccagatgaaaactgctgggtatcccaatgtgaatatccataacttcacaaccagctggagggatggaatggcctttaatgcactcatccataaacacaggcctgaccttattgacttcgataagctaaagaagtcaaatgcccattacaatttacaaaacgcatttaatcttgcagaacagcaccttggtttgactaagctcctggatcccgaagacatttcagtcgatcaccctgacgagaagtcaattataacgtacgttgtgacatactatcactatttttcaaagatgaaggctctcgccgtcgaagggaagcgcattggaaaggtcctggacaacgctatcgaaacagaaaaaatgatagagaagtacgagagcctggcttcagacctcttagagtggatagaacaaactatcatcatactgaataaccgaaaatttgctaattcccttgtaggagtgcaacagcaactccaggcgttcaacacatatcggaccgttgaaaaaccacccaagtttactgaaaaggggaatctcgaagtgctgctgtttaccatccagtctaagatgcgagccaacaatcagaaagtatacatgcctcgcgagggcaagctcatttccgatatcaataaggcgtgggagcggcttgagaaggccgagcacgaacgggagctcgctctgaggaatgagcttatcaggcaggagaaattagaacagctggcccgccggttcgaccgtaaggcagctatgagggaaacatggctctcagaaaaccagcggctggttagccaagataatttcgggtttgatctgccagccgtcgaagccgccaccaagaagcacgaggctatcgagactgacatcgccgcctacgaggagagggtgcaggcagtggtcgctgtcgctagggaactagaggcagagaactaccacgacataaagcggatcacagccaggaaagacaatgtgattcggctgtgggagtacctactggagctgttgcgcgctcggagacagaggttggagatgaatcttggactgcaaaaaatcttccaggagatgttgtacataatggattggatggacgagatgaaggtcttggtactctctcaagattatggtaaacatctcctaggagtggaggacctactgcaaaaacacacccttgtagaggcggatattggcatccaggctgagcgtgtcagaggtgtgaacgcctccgcgcagaagtttgctacagatggggagggatacaaaccttgcgacccacaggttattagagacagagttgcccacatggaattctgctatcaggaactctgccagctcgcagccgaacggagggcacggctggaggagtccagacgcttatggaaatttttctgggagatggcagaagaagagggttggattagagagaaagagaagatactatcctccgatgactacggcaaggatctcacttcagtcatgaggttgcttagtaaacaccgggcttttgaagacgagatgtctggtagatctggtcatttcgagcaggcaattaaggaaggcgaagacatgatcgcagaagagcacttcggcagtgagaaaatccgcgaacggattatttacattcgagagcaatgggccaacttagaacagttaagcgccattcgcaagaaacggctggaggaggccagtcttctgcaccagtttcaagcggatgccgatgatattgacgcctggatgctggacatccttaagattgtaagctcgtccgatgtggggcatgatgagtactccactcaaagtttggtgaaaaaacacaaggatgtggccgaggaaattgcgaactatagaccaacactcgacaccttgcatgaacaggcatccgctctcccacaagagcacgctgagtctcctgacgttcggggccgtctcagcggcatagaggagcgctataaagaggtggcggaactgactcggcttcggaaacaggctctacaggacacacttgcgctctataaaatgtttagtgaggccgatgcgtgtgaactgtggattgacgagaaagagcagtggctgaataacatgcagatcccggagaagctggaagacttagaggtgattcagcaccggttcgagtccctcgagcccgagatgaacaatcaggcctctcgggtcgccgtggtgaaccagatcgcccggcagttgatgcatagcggtcatccctccgagaaagaaattaaagcccagcaggacaaactgaatacccgctggtcccagttccgggagctcgtggatcgaaagaaggatgcgttgttgtcagccctgtccattcaaaactaccacctggagtgtaatgagaccaagagctggattcgtgaaaaaacgaaagttatcgagtcaactcaggacctggggaacgacctcgctggtgtcatggccttgcagcggaagttaacaggcatggaacgcgatctagttgctatcgaggctaagttgagcgacctccagaaggaagctgaaaagctcgagtccgagcatcccgatcaggcccaggcgatcctctctcgtcttgctgaaatttctgacgtctgggaggagatgaagaccacactcaagaaccgagaagccagcctgggagaggccagcaagttgcagcagtttctgagggatctagatgacttccaatcctggttgtcgaggacccagacggccatagcgtcggaggacatgcccaatacactaaccgaggccgaaaagctgcttacgcagcatgaaaacattaaaaatgagatcgataactatgaggaggattatcagaaaatgcgggacatgggagagatggttactcagggacagacggatgcccagtatatgtttctgaggcagcggctgcaggcccttgatacaggttggaacgaactgcacaagatgtgggagaataggcagaatttgctgtctcagtcccacgcttaccagcagttcctgcgagatactaagcaagccgaagcttttctaaacaatcaggagtacgtcttggcccacactgaaatgcccacaaccctggagggcgcagaagccgctatcaagaagcaagaggactttatgaccactatggacgcaaacgaggagaagattaacgccgtcgtggaaaccggtagaaggcttgtgtctgacggtaacataaactcggaccgcatccaggagaaagttgacagcatagacgatcggcatagaaaaaatcgcgaaactgcctccgagcttctgatgcggttaaaagacaacagagatctgcagaaattccttcaagattgccaggaactttctctgtggattaatgagaagatgctcaccgcccaggacatgtcatacgatgaggctcgcaaccttcattccaaatggttgaagcaccaggcatttatggccgaactggcgagtaataaagaatggttagataagatcgagaaagagggcatgcagctcatctccgagaagccagagactgaagccgtggtgaaagagaaactgactgggctgcataagatgtgggaggtgctggagtctaccacacagaccaaggcccagagattgtttgacgccaacaaggccgagctgtttacgcagtcttgcgccgacttggataagtggctgcatggactggagagccagatccaatccgacgactacggcaaggatcttacatcggtaaatatcctgctgaagaagcaacaaatgctcgagaatcaaatggaggtgcgtaagaaggagatcgaggagctgcagtctcaggcacaggctctcagtcaggagggtaagtcaaccgatgaggtagacagcaaaagattgaccgtgcagactaagtttatggagctgctggaacctttgaatgaaaggaaacataatctactcgccagcaaggagatccaccagttcaatagggatgtggaggacgaaatcctgtgggtcggtgaacgcatgccactggcaacctccacagaccatgggcataatctgcagaccgttcaactcctgattaagaaaaatcagacactccagaaggaaattcaaggtcaccagccccgaattgacgacatatttgaacggagccagaacattgtaacggattcttcatctctctcagcggaagccatacggcagcgcctggccgacttaaagcagctatggggcttgcttattgaggaaaccgaaaaacgacatcggagactggaggaggcccatcgtgcacaacagtattatttcgacgcagccgaggctgaggcctggatgagtgagcaagagctatatatgatgtccgaagagaaagctaaagacgagcagagcgctgtcagtatgctgaaaaagcaccagatcctcgagcaggctgttgaggactacgcggagacggtgcatcaactgagcaagacaagtagagccctagtggccgactcccatccggaatcagaaagaatctccatgcgccagtcaaaggtagataaactgtatgcaggcctcaaagacctggctgaggaaagaaggggcaaattggacgagcggcatcggctgtttcagctgaatagagaagtagatgatctcgagcagtggattgccgaacgtgaggttgtggctgggtcacacgaactggggcaggattatgagcacgtaactatgctgcaggaacggtttcgcgagttcgcccgcgacacaggaaacatcgggcaggaaagagtcgatacggtcaaccacttggccgatgaattaatcaactctggccacagcgatgcagcaactatagccgaatggaaagacgggttgaacgaggcctgggcagatttacttgaactcattgataccaggactcagatcctcgccgccagttacgaattgcacaagttctaccacgacgctaaggagatcttcggccgaatacaggacaaacacaagaagcttccagaggaactcggtagagaccagaatactgtcgagactctgcagcgaatgcacacaacctttgagcacgatatacaggctctaggaacgcaggtgaggcagctgcaagaggatgctgcaagactgcaggccgcttacgccggagacaaagcagacgacattcagaaacgagagaatgaggtattagaagcttggaagagtttgcttgatgcatgtgagtctaggcgagtcaggcttgtcgataccggtgacaaattccgattcttttcaatggtgcgggatctgatgttatggatggaggacgtcatccggcaaatcgaagcacaggaaaagccacgcgatgtgtcaagtgtcgaactcctcatgaataatcaccaggggattaaagccgaaatcgatgcccgcaacgattctttcactacctgtatcgagctggggaagtccctcctagcaagaaaacactacgcatctgaagagatcaaggagaaacttctgcagttgacggaaaagaggaaggaaatgatcgacaagtgggaagaccgttgggaatggcttaggcttatcctcgaagtccaccagttcagcagggacgcctcggtagccgaggcctggcttttgggccaggagccctacttatcttctagagaaattggacagagcgtcgacgaagtagagaagttaatcaaacgacacgaagcattcgagaagtctgcagcaacctgggatgagagattctccgcccttgagcgccttaccacactggagcttctggaggtgaggcgccagcaggaggaagaagagagaaagcgccgccctccatcccccgagcccagcacaaaggtatctgaggaagccgagagtcaacagcagtgggacacaagtaagggagagcaggtttctcaaaatgggctgcccgccgagcaggggtcaccccggatggcggagactgtggacacttctgagatggtaaatggcgccactgagcagcggacgtcctcaaaggagagctccccaataccaagtcctacttcagatcgaaaggccaagactgccttaccagcccaaagcgctgctacactgcctgctagaactcaggagaccccatccgcacagatggaaggcttcttaaacaggaagcacgagtgggaagctcataataagaaagcgtcatcccggagttggcacaacgtgtattgcgtaataaacaaccaggaaatgggattctacaaggatgccaagaccgccgcaagtggtattccttaccattccgaagtgcccgtcagcttaaaggaggccgtgtgtgaggttgccttggactataagaaaaaaaaacacgtgttcaaactgcgtcttaatgatggcaacgaatacctgtttcaggcaaaggacgacgaagaaatgaacacctggatccaggctatcagttccgctatctcttcagataagcacgaggtgtctgcttccacccagtctacccccgccagttcccgtgcgcagacccttcccacgtcagtggttacaattacatcagagagctctcctggcaaaagggagaaggataaggagaaagacaaagagaaacgcttctcgctattcggcaagaagaagtag

SEQ ID NO: 135905 - DNA, 2073 bp, Artificial Sequence
  Description of Artificial Sequence: Synthetic coding sequence
atgacaaccaccgtggcaactgactacgataacattgagatacaacagcagtattcagatgttaacaatcgttgggatgtcgacgactgggataacgagaactccagcgccagactctttgagagaagccgcatcaaggccctcgccgatgaaagggaggcagttcagaaaaaaacgttcaccaaatgggtcaactcccacctggcacgggtgagctgcaggatcacggacctctataccgacctgcgggatggacgaatgttgataaagctgttggaggttctaagcggcgagcgcctcccaaagcccaccaagggcaggatgcgcattcactgcttggagaacgtcgacaaggccctgcagtttctgaaggagcaaagggtccatcttgaaaatatgggtagccacgacatcgtggatgggaaccatcgcttgactctggggttgatctggacgatcatcctcaggttccagattcaggatatctctgtggagacggaagacaacaaggagaagaagtccgccaaagatgctctgttactgtggtgccaaatgaaaaccgcgggttatcctaatgttaatatacataatttcactacatcatggcgggatggtatggcatttaacgccctcatacacaaacatcgtccagacctgatcgatttcgataagctaaagaaaagtaatgcccactataatctacagaacgcattcaacctggccgagcaacacctgggactgactaaactgctcgaccccgaagatatctcagttgatcacccagatgaaaagtctattatcacctacgtggtaacctactaccattacttctccaaaatgaaagcccttgctgtcgagggcaagcgaataggcaaggtacttgacaatgctattgaaacagaaaagatgatcgaaaagtacgaatctttggcaagtgacctcctggagtggatcgaacagaccatcataatactgaacaaccgcaagttcgcaaatagccttgttggcgttcagcagcagcttcaggccttcaatacgtatcgtacagtggagaaaccgcccaagtttactgagaaaggcaacttagaagtgttgctcttcaccatacaaagtaagatgcgggcgaacaatcaaaaggtgtacatgccaagagaggggaaactgatttcagatatcaataaggcttgggagaggctggaaaaagccgagcacgagagagagttggccctaaggaacgagcttatcaggcaggaaaaactagaacagctggcaagaagatttgatcggaaagccgccatgcgcgaaacatggctgagtgagaatcagagactggtctcccaagataactttggctttgatctgcccgccgtggaggcagccacaaaaaagcacgaagctatcgagacagacatcgccgcttacgaggaaagagttcaagcagtcgtggctgtggctcgggagctggaggctgaaaactaccacgacatcaaaaggataaccgcacgtaaggacaacgtgatacgcttatgggaatacctcctcgaactcctgcgagcccgcagacaacgactggagatgaatttaggactacagaaaatattccaggagatgttatacatcatggactggatggacgagatgaaggtcttggtgctgtcgcaggattacgggaagcacctcctcggggtcgaagacttgctgcaaaaacacaccctggtcgaggcagacattggtatccaagcagaacgagtgagaggcgtcaatgcatccgcccagaagtttgccacagacggggaagggtacaagccctgtgacccccaagtgattcgggaccgggtggctcatatggagttctgctatcaggaactatgccagctcgccgccgaacgacgggctaggctggaggagtctcggcggctgtggaagtttttctgggagatggctgaagaggaagggtggattcgcgaaaaggagaagatcttgagtagtgatgattacggcaaagatttgacttcagtgatgcgactgctttccaagcaccgtgctttcgaggatgaaatgagcggcagatag

SEQ ID NO: 135906 - DNA, 7173 bp, Artificial Sequence
  Description of Artificial Sequence: Synthetic coding sequence
atgtcgagcacacttagtccaaccgatttcgatagcctcgagattcaggggcagtactctgacatcaacaacaggtgggacttgcccgactccgactgggacaacgattctagcagcgcacggttattcgagaggtctcgaataaaggcactcgccgatgagcgtgaagccgtccagaaaaagactttcacaaagtgggtgaactctcaccttgctcgcgtcacttgtcgagtgggtgacctatattccgatctaagggacggaagaaacctgctgaggctcctcgaggtgctatctggcgaaatcctcccgaaacctacaaagggccgcatgaggatacactgtctcgagaatgtggataaagccctgcagttcctgaaagaacagaaggtccatctcgaaaacatgggttcgcatgatatagtggacggaaaccacaggctgactctgggcctagtgtggacaattatcctgcgcttccagatccaagatatatctgttgagaccgaggataacaaggagaagaaaagcgctaaggacgccctattactgtggtgccagatgaaaaccgctggttatccaaatgtcaatgtgcacaacttcaccacctcatggcgggatgggctcgctttcaatgcgatcgtgcacaaacacagaccggacctgctcgacttcgaaagcctgaaaaagtgcaatgctcattataacttgcaaaatgctttcaacctggctgaaaaggagctgggcttgacaaagctcctggaccccgaagatgtgaatgtagaccaacccgacgaaaagtcaataatcacttacgtggctacatactatcattactttagcaagatgaaagcattggctgtggaagggaaacggataggcaaggtgttggatcacgctatggaagccgagcggttagtggagaagtacgaatcccttgcgagcgaattgctccagtggattgagcagaccatcgtcacactcaatgacagacaactggctaacagcctctcgggagtacagaaccaactccagagtttcaacagctatcgtacggtggagaaaccaccaaaattcacagagaagggcaatctggaggtcttgctgttcaccatacaaagcaaactgagagccaataaccagaaagtctacacccctcgcgaggggcggctcatctcagatatcaacaaggcttgggagagactggaaaaagcagaacatgagcgtgagctggctcttcggaccgaactgatccggcaggagaagttggaacagctagcagcccgcttcgataggaaagcggccatgagagaaacttggttgtctgaaaatcagagactcgtaagccaagacaactttggtttagaactggcagcggtcgaggccgccgtgcggaagcacgaagccatcgaaacagatatagtggcctatagtggcagagtgcaagcagtggatgcagtagcagcggaactggcagctgagcgttatcatgatatcaagaggatagcggcccgacagcataacgtcgctcgcctctgggactttctccgtcagatggtcgcagcccgcagagagaggctgctgctcaatctcgaactgcagaaggtgtttcaagacctgctttatttaatggattggatggaggaaatgaaggggaggctgcagtctcaggacctcggacgccatctcgccggagtagaggacttgctccagcttcacgaattagttgaagccgatattgctgtgcaggccgaacgtgttagggctgtctcagcctctgccctgagattttgcaaccctggcaaagaatacagaccctgcgacccccagctggtgtccgagagagtagcaaaactggagcagagttacgaagcactgtgtgaattggctgcagcccggagagccagactggaggaatcacgtcgtctgtggaggtttttatgggaggtcggtgaggccgaggcatgggtaagagagcagcaacacctactcgcgagcgccgatactggcagggatctgacgggcgctctgcgcctgctgaacaagcacacagccttgaggggggaaatgtctggacgccttggcccattgaaactgaccctggagcagggccagcaattagtggccgaaggtcacccgggagcatcacaggccagcgcccgggccgcagaactgcaagcccagtgggagagacttgaggccctcgccgaggagcgagctcagcgcctagctcaggccgcaagcctgtaccagttccaagccgacgcaaacgatatggaggcctggctggttgacgctctccggcttgtcagctctcctgagcttggtcacgatgaattctccacccaagccttagcgcgccagcaccgtgctctggaagaagagatacgcagccataggcctacactggatgcccttagagaacaggccgccgcattgcccccaacactgtctcggactcctgaggttcagagccgggtgcctacgctggaaaggcattacgaggaattgcaagcaagggccggtgaacgcgcccgggctctcgaagcagctctggctctgtatacaatgttaagtgaagcaggagcatgtggactgtgggtggaggaaaaggagcagtggctgaatggactggctctcccagaacgcttagaggacctggaggtggttcagcagcgctttgaaacactggagcctgagatgaacactctggctgctcaaatcacagctgttaatgacatcgctgagcagctgttgaaggcaaatccccctgggaaggacagaatcgtgaatacacaggagcaactcaaccacaggtggcagcagtttcgacgcttagccgatggcaaaaaggcagcgttgacctctgccctgtctatccagaactaccatcttgagtgcaccgagactcaggcttggatgcgtgagaagacgaaagtaattgaaagcactcaagggctgggaaatgatttggccggagttttagccctgcaaagaaaactggcgggaaccgagagggatcttgaggcaattgcagctagggtgggagagttaacgcgagaagctaacgccctggccgccggtcatccggcccaagctgtcgcgattaacgcccgtcttcgggaggttcagacaggctgggaagacctgagagctactatgaggaggcgggaagagtcgctcggtgaggccaggaggttgcaggacttcttgcggagccttgatgatttccaagcatggttggggaggacgcaaacggcggtggccagcgaggagggccccgcgaccctgcccgaagccgaagctctgctggcccaacatgccgctttgcgtggcgaagtcgagcgcgcccagtccgaatattctagattgcgcgccttgggtgaggaggtgactcgcgaccaggccgacccccagtgcctgtttcttcgccagcggctggaggctctggggacagggtgggaagagctcgggagaatgtgggaaagccgtcagggacgcttagcccaggcacatggctttcaggggtttcttcgagacgcaagacaagctgagggcgtcctgtcctctcaggagtacgtgctttcccacacggaaatgcccggcacgctccaggccgccgatgctgccatcaagaaactggaagacttcatgagcaccatggacgctaatggcgagagaatccatggccttcttgaggctggtagacaactggtttccgagggcaacatccacgctgacaagattcgcgagaaggctgacagtatagaacggcgtcacaagaaaaaccaggatgccgcacagcagtttctggggaggctccgggacaatagggagcagcagcactttctccaggactgccacgagcttaaactgtggattgacgagaagatgttaaccgcccaggatgtgtcttatgatgaagccaggaacctgcataccaaatggcaaaaacaccaagcctttatggccgagctggccgcaaacaaagattggctggacaaggttgataaggagggcagggaactgacacttgagaagcctgaactcaaagctctggtgagtgagaagttacgggacctccaccgcaggtgggatgagctcgagacgacaacccaagctaaggcaagatcacttttcgatgccaaccgcgcagagctgttcgcgcagagttgctgcgccctggaatcatggctggagagccttcaggcgcagttgcactctgatgactatggcaaggacctcacgtccgtgaacattctcctcaagaaacaacagatgttggaatgggagatggcggtgagagaaaaggaggttgaggccatccaagcgcaggcaaaagccctggcccaggaggaccagggtgccggtgaagtggaacgtactagcagggccgttgaagaaaaatttcgagcactctgtcagcctatgcgggagcgttgcaggcgattgcaggcttcccgcgagcaacaccaatttcatcgagacgttgaagacgagattctatgggtgactgagcgcctgcccatggcaagttctatggaacacggcaaggacctgcctagcgtgcagctccttatgaagaaaaatcagaccctgcaaaaggaaattcagggacacgagccaaggattgccgaccttcgagagaggcagcgggcgctaggcgcagcggccgccggccccgagttagccgagttgcaggaaatgtggaagcgcctcgggcacgaactcgaactgcggggcaaacggctggaagacgctctgagggcccagcaattctatcgcgatgccgctgaagctgaagcttggatgggggaacaggaactccatatgatgggtcaggaaaaggccaaagatgagctttccgctcaggccgaagtgaaaaagcatcaagtgcttgaacaggctctcgccgattacgcgcaaacgattcaccagctggctgcttcgtcacaagacatgatcgaccatgagcacccagaatcaacccggatctctataaggcaggcccaagtggacaagctgtatgcaggcctcaaggagttggccggggaacgcagagaaagactccaagagcatctcaggctgtgtcagcttagaagggaattagacgatcttgagcaatggattcaggaacgagaagtcgtcgctgcatcgcacgagttgggacaggactatgagcacgttacgatgctgcgcgacaagttcagagaattcagcagagacactagcacaatcgggcaggagagagtcgattctgccaacgctctggcgaatgggctgattgcaggtggccacgccgcacgggctacagtggctgagtggaaggactccctgaacgaggcatgggctgacctgttagaactcctggatactagaggacaggtactcgctgcagcatatgagctccagagattcttgcatggtgctcggcaggctctcgctcgcgtccagcacaagcagcagcagctgcccgacggcactgggcgcgatttgaatgcagcagaagcactgcagaggaggcactgcgcatacgagcatgacatccaggcgctctcaccgcaagtacagcaggtgcaggatgacggacaccggctccaaaaggcttacgcaggagacaaggccgaggagatcgggaggcatatgcaggctgttgctgaagcttgggcacagctgcagggcagttccgcagctaggagacaacttctcctggacaccacggacaaatttcgtttttttaaagctgtcagggagctgatgttgtggatggatgaggtgaatcttcagatggacgcccaggagcgacccagggatgtgtcttcagccgacctggtaataaaaaaccagcagggaataaaggccgaaatcgaggcgcgggctgacagattttccagctgtattgatatgggaaaagagctgctggcgcgttcccattatgctgctgaagagatcagcgaaaagctctcacagttgcaggcaagaagacaggagactgccgaaaaatggcaggagaaaatggactggttacagctggtccttgaagtacttgtattcggccgcgatgcagggatggccgaggcatggctgtgcagccaggagcccctggtgaggagcgccgagcttgggtgtaccgttgatgaagttgagagtctgatcaaaagacatgaagcttttcaaaaaagcgcggtcgcatgggaggagcgcttctgcgccctcgagaaattgaccgctcttgaggagagggagaaagaacgcaagagaaaaagggaagaggaagagaggcggaagcagccccccgctcccgagcccacggcaagcgttcccccgggcgatctggtgggcggccagactgctagtgacactacttgggacggcacacagccccgcccccctcccagtactcaggcgccatccgtgaacggtgtgtgtaccgacggtgaaccgtcccaaccactgttggggcagcaacgcctggaacacagcagtttccctgaagggccaggccccggcagtggagatgaagctaacgggcctaggggcgagagacaaacccggaccaggggtccagctccttccgcaatgccacaatccaggtcaactgaatctgctcacgcagcaaccttaccccctcgtggccctgagccctcagcacaggaacagatggaaggaatgttgtgcaggaagcaggagatggaagctttcggtaagaaagcagctaacaggagctggcagaatgtgtactgtgtgctccgaaggggatccctaggcttttataaagacgctaaggccgctagcgccggtgtgccctatcatggtgaggtgcccgtctcgcttgccagggcgcagggtagcgtggcgtttgattaccggaaacgcaagcacgtatttaagcttggactacaagacggaaaagaatatctgttccaggcaaaagacgaggctgagatgagtagctggctgagagtggtgaatgccgcgattgcaactgctagcagcgccagtggggaacccgaggagcccgtagtgcccagcaccacacgtggcatgaccagggcaatgacaatgccccctgtgagcccggttggtgctgaagggcccgtggttctgcgcagtaaggatgggagagaacgtgagcgggagaagagattcagcttctttaaaaagaataagtag

SEQ ID NO: 135907 - DNA, 2805 bp, Artificial Sequence
  Description of Artificial Sequence: Synthetic coding sequence
atgtcgtccacgcttagcccgacggattttgatagccttgagatccagggacagtattcagacataaacaaccgatgggacttgccggacagtgattgggataacgattcttcctctgctcgcctatttgagcgctcgaggatcaaagcactcgccgatgagcgagaagccgtgcagaaaaaaacattcactaaatgggtgaacagccatcttgcacgagtgacttgccgggttggtgatctttactctgatctccgggatgggaggaatctcctccgcctgctggaagtattgagtggcgaaatcctgccgaagcctaccaagggccgcatgcggatacactgtctggagaatgttgacaaagccctgcagtttctgaaggaacagaaggttcacctcgagaatatggggtcccatgacattgtagacggtaaccaccgtttgaccctgggactagtatggactatcattctgcgcttccaaattcaggacatctccgtggaaacggaggataacaaggaaaaaaagtccgctaaggacgcactgctgttgtggtgtcagatgaagacagctggatatccaaacgttaacgtccataattttactacctcttggcgggacggcctcgcttttaacgcgatagtgcataagcaccgccccgatctcttagactttgaatccctgaagaagtgcaatgctcattataacctccagaacgccttcaatctggccgaaaaggaactgggcctgacaaaactcctggatccagaagatgtgaacgtcgaccaaccggatgaaaaaagtataattacatacgttgcaacatactatcactacttctcgaagatgaaagcgttggccgtggaggggaagaggattggcaaggtgttagaccacgccatggaggccgaacggctggtagagaagtatgaaagcttagcctccgaactgcttcagtggattgaacagactattgttaccctcaacgaccgccagctggccaattcgctgtcaggagttcagaatcagctccagagctttaattcttatcgcacggtagagaagccccctaaattcaccgaaaagggaaacctcgaggttctgctgttcactattcaatctaagctgagggcaaacaaccagaaagtgtacactcccagggaggggaggcttattagcgacatcaataaagcatgggagcgactggagaaggctgagcacgaaagagaactcgccctacggacagaacttatccggcaagagaagttggagcagctggcagcccggtttgaccgtaaggccgctatgagagagacatggttgtctgaaaaccagaggctagtgtctcaagataacttcgggttggagttggccgccgtcgaggctgccgtgaggaaacatgaagcgattgagactgacatcgtggcatactccgggcgcgtgcaagccgtggatgcagtggccgccgagttagctgccgaaagatatcatgatatcaagcgcatagcagcgagacagcataacgtggccagactctgggactttctgcggcagatggtggccgccaggcgggagaggctgcttctgaacctcgaattgcagaaagtgttccaggatctgctgtacctgatggactggatggaggaaatgaagggaagactccagagtcaagacttgggcaggcatctggccggagtggaggacttactccaactgcacgaacttgttgaagcagatatcgctgtgcaggctgagcgagtgagggctgtctctgccagtgctctgagattttgcaacccaggcaaggagtacaggccctgcgacccgcagctggtgagcgagagagtggctaagcttacagcactcgaagagagggagaaagagaggaaacgaaagagggaggaggaggagcgacgtaagcagcctccagcccccgaaccgaccgcctctgtgccgccaggcgatctggtgggtggacagacggctagcgacaccacatgggatggcacacagcctcgcccccccccttcgacacaggcgccatcggttaacggagtttgcacggatggagagccaagccagcctctgttagggcagcaacgcttagaacatagcagcttccctgagggccctggccccggtagtggcgatgaggccaacggcccgcggggcgagcgtcagactaggactagaggacctgctccttccgctatgccccaaagtcgctcaaccgaatccgcacatgccgccacattgccacctcggggacccgaaccaagcgctcaagaacaaatggaaggcatgctgtgtagaaagcaggaaatggaagcttttggtaagaaagctgccaatagaagctggcagaacgtttattgcgtgctcaggcggggttccctgggattttacaaggatgcaaaagcggcaagcgccggagtcccgtaccacggcgaggtgccagtttcactggcccgggcgcaggggagcgtggcgttcgactatagaaagcgtaagcatgtttttaagctaggactccaggatgggaaggagtacttattccaagccaaggacgaggccgagatgtcctcttggctgagggtggtgaacgccgcgattgccaccgcttccagcgcctcaggggagcctgaggagccagttgtcccatctaccaccagagggatgacaagagccatgactatgcctcctgtgagccccgttggagctgaagggccggtggtcttgcgctccaaggatggccgcgagcgggagcgggagaaacggttctctttctttaagaaaaacaagtag

SEQ ID NO: 135908 - DNA, 354 bp, Artificial Sequence
  Description of Artificial Sequence: Synthetic coding sequence
atgtcttccaccctgtccccgacagactttgatagtctagaaatccaaggccagtatagcgacatcaataaccgttgggatctccccgactcagattgggacaacgatagttcgagtgctcgtctgttcgagcgctctcggattaaagccctggcagatgagagggaggctgtgcagaagaagaccttcaccaaatgggtcaattcccatttggccagggtgacttgccgcgtgggtgacctgtactccgacctgagggacgggcggaatctgctgcgactgctggaagtgctgtccggagaaatactgcctaaaccgacaaaaggtagaatgcgaattcattgtctggagtag

SEQ ID NO: 135909 - DNA, 7098 bp, Artificial Sequence
  Description of Artificial Sequence: Synthetic coding sequence
atgagtagtaccctaagccccacagacttcgactcgctcgagattcaaggccagtacagcgatatcaacaatcgttgggaccttcctgactccgattgggataacgacagttcctccgctcgcctgtttgagcgctcccggatcaaagccctggccgatgagagagaggccgtccagaaaaaaacgttcacgaagtgggtgaactcacatctagctcgagtaacatgtcgcgtgggagacctgtactccgatttgcgagacggtaggaatctgctccgcctgttggaggtcctctctggggagatccttcctaaaccgacaaagggacgaatgcgaattcactgccttgagaacgtcgacaaggctctgcagttcctgaaggaacagaaagtccatctggaaaacatgggaagccacgatatcgtggatggcaatcaccggctaacattggggttggtgtggacaatcatccttagatttcagatccaagatattagcgttgagaccgaagataacaaagaaaagaagagcgctaaggatgccctgctgctatggtgtcagatgaagacagctgggtatcccaatgttaatgttcataatttcactacttcttggcgcgatggcctggccttcaatgcaattgtccacaagcaccgccctgatctcctggactttgagtccctcaagaaatgtaatgctcattataatctgcagaacgcatttaacctggccgagaaggagttgggactcacgaagctgctcgacccagaggatgtgaatgtcgaccagccagatgaaaagtcaatcattacctatgtggctacctactatcactacttcagtaagatgaaggctttagccgtcgaaggaaagaggatcggcaaggtactggaccacgcaatggaagctgagagactggtggaaaagtacgaatccttagcatccgagttgttacagtggattgaacaaaccattgtgacactgaatgataggcagctggccaattctctttccggcgtgcagaaccagttgcagagcttcaatagctatcgcactgtcgagaaacctccgaaattcacagaaaagggaaatctagaggtccttctcttcacgatccagtcaaaacttagagccaataaccaaaaggtatatacccctagagagggcagacttatttccgacatcaacaaagcttgggagcgcctggagaaggccgagcatgaaagagaactcgcccttaggacagaattgatccgtcaggaaaagctggagcagctagcagcgagatttgaccgtaaggccgctatgagggagacttggttgtctgaaaatcagcggctggtttctcaggataatttcgggttggaattggccgccgtcgaggctgccgttaggaagcatgaggcgattgaaaccgatattgtggcctatagcggaagggtgcaggctgtcgatgcagtggcagccgaactggctgccgagcgctatcatgatatcaagcgcatcgccgcccggcagcataatgtcgcccggctgtgggacttccttaggcagatggtcgctgccagaagagaaaggctgctgttgaatctggagctccagaaagtattccaggatctactgtaccttatggattggatggaggaaatgaaggggagattacagtcccaggatctcggtcggcacctggcaggggtggaagatctgctgcagctgcatgagctcgtcgaggctgatattgcggttcaggcagaacgagtccgggccgtgtccgcttctgcactgagattctgtaatccaggaaaggagtatcgaccttgcgacccccagctcgtgtcagagagagtggctaagctagagcaaagctacgaggccctttgcgagctggcagccgctcgcagggcccgcctcgaagagtctcgccgactgtggagattcctctgggaggtcggggaggcggaagcttgggtgagggaacagcagcatcttctggcttctgccgacactggtcgcgatttaactggcgccttacgactcctgaacaaacacactgccctgagaggcgagatgtccgggagattgggccccctcaagctaaccctggaacagggacagcagctggttgctgagggacatcctggggcctctcaggcttccgctagagccgctgagctccaggcacagtgggaaagactggaggccctagcagaggaacgagcccagagactggcacaggctgcttcactgtatcagtttcaagcagacgctaatgatatggaggcttggctggtagacgcactgcgcctggtgtccagcccggaactggggcacgatgagttcagcacccaggctttggcgagacagcacagagccctagaagaagagataagaagtcatcgacccacccttgacgcgcttagagaacaggcagccgccctaccacccacacttagccggacccccgaggttcagtcccgtgttcccacattggaaagacattacgaggagctgcaggctcgagcgggcgagagggctagagcactggaagcggctctcgcgctgtacacaatgttatctgaagcaggagcttgtgggctgtgggtcgaggagaaggaacaatggctgaatggcttggcccttccggaacgcctggaggacctggaagtagtccagcagcgttttgaaaccctcgagcccgagatgaataccctcgccgctcagatcacagctgtgaacgatatcgctgaacaactgcttaaggcaaacccccccggtaaagacaggatagtaaacactcaggagcagttgaatcacagatggcagcaattccgtaggctcgccgacggaaagaaagcggcactgacgagcgccctgtcgattcagaattaccatttagaatgtactgaaactcaggcctggatgagagagaaaactaaggtaatagaaagcacacaagggcttgggaatgatctggcgggggtattagcgctgcagagaaaactcgccgggactgagcgcgacctcgaggcaatcgctgcgcgtgtaggcgaactgactcgggaggcaaatgctctggccgctggacaccctgcacaggctgtcgctataaacgctcgtcttcgggaggtgcagactggatgggaagatctgcgcgccactatgaggagacgggaggagtcactgggggaggcccggcggctccaagactttctgagatcgctagacgacttccaggcctggcttggcagaacacaaacagctgttgcgtcagaagagggtccagccactctgccggaggctgaggctctactcgcccaacacgctgccttaagaggtgaggtggagagagctcagtccgagtattctaggctgcgcgccttaggcgaagaagtgacccgggaccaagctgatccccagtgtctgtttctgaggcagaggcttgaggcactaggtacgggctgggaagaactgggtcgtatgtgggagtccaggcaaggccgtcttgctcaggcgcatgggtttcagggctttttgagggatgctaggcaggcggaaggtgttctgagcagtcaggaatacgtgctgagccacacagagatgccgggtaccctgcaagctgctgacgcggcgatcaagaaactggaggatttcatgtcaacgatggatgcgaacggcgagcgaatccacggattattggaagccggtcgacagctggtcagcgagggcaacattcacgcagataaaataagagaaaaagcggattctattgaacgccgccataaaaagaatcaggatgcagcccagcagttcctcgggcgacttagggacaaccgagaacagcagcactttctgcaagactgtcacgaactaaagctgtggattgacgaaaagatgcttactgcccaagatgtgagttatgacgaagcaagaaatcttcatactaagtggcagaaacatcaggcgttcatggcggagctggctgcgaacaaggattggctggataaggtcgataaagaggggagggagttgaccctggagaagcccgagttaaaggctctggtctctgagaagctgcgcgatttgcatcggcgctgggatgagcttgagaccactacccaggctaaggctaggtctctgtttgacgctaaccgggccgagctgttcgcccagagctgttgtgcgctagagagctggctcgaaagcttacaggcgcagctgcactctgatgactatggcaaggacctgactagtgtgaacattctgctaaagaaacagcaaatgctggagtgggagatggctgtaagagaaaaggaggtggaggcaatccaggcacaggcaaaggcgttagcccaggaagaccagggcgccggcgaggtggagaggacgtctagagctgtggaagaaaagtttagagcattatgtcagcctatgagggaacgctgtagacggttgcaagctagcagagagcagcatcagtttcatcgcgacgttgaggacgaaatcctgtgggtgaccgaaagactccctatggctagctcgatggaacacggtaaagatcttccctcggtccagctcttaatgaaaaaaaaccaaaccttacaaaaagagatccaagggcacgaacctagaattgccgacctcagggagcgccagcgagctcttggcgctgccgccgccggcccggagctggcagagcttcaggaaatgtggaagcgtctggggcacgagctcgaactgcgagggaaacggttagaagacgccctgcgggctcaacaattctatcgggatgccgctgaggccgaagcatggatgggagagcaagaactgcatatgatggggcaggagaaagcaaaggatgaacttagtgcacaggccgaggtgaagaaacatcaagtgcttgaacaggcccttgccgactatgctcagaccatacaccagctcgcagcaagctcacaggacatgatagaccacgaacacccagaatccactcggatctccatcagacaagctcaggttgacaagttatatgcaggtctcaaggaattggcgggcgagaggcgcgaacgcctgcaggaacatcttcgcctgtgccagctcaggcgcgaactcgatgatttggaacagtggattcaggagcgtgaggtcgtggctgcctcccatgagctcgggcaagactacgagcacgtgacaatgttgagggacaagttccgagagtttagcagggatacatctactataggacaagaacgggtggattctgctaatgccttggctaacgggctgattgccggtgggcatgccgcaagagcaactgtggctgagtggaaagattctctcaatgaggcctgggcagacctgctcgagcttctggacacacgtgggcaagtgctggctgcagcttacgaactacagaggtttctacatggagcaaggcaagctttagccagggtgcagcacaagcagcaacagctgcctgacggaaccgggagagacttgaacgccgcagaagctttacagcggcgccattgtgcctatgaacacgacatacaagccctgtcgccccaagttcaacaggttcaggatgacgggcaccgcttgcagaaggcctatgctggcgacaaagccgaagagattggccggcatatgcaggctgtggccgaggcctgggcccaactccagggctcaagcgcggctcgtagacaactgctgctcgatacaaccgacaaattccgatttttcaaagcagtacgcgagctcatgctctggatggacgaagtgaacctgcaaatggacgcgcaagagagaccccgcgatgtctcctcagctgatctggtcattaaaaatcagcaaggcattaaggccgaaatcgaagctcgcgctgatagattcagcagctgtattgacatgggcaaggagctcctggctcggtcccattatgccgccgaggagatttctgagaagctgtctcagctgcaggcacgccggcaggaaaccgcagagaagtggcaggagaagatggattggctgcagttagtgttggaagtgctagtgttcggccgcgatgctggaatggccgaggcttggctttgttcgcaagagcctctggttaggagtgctgaactagggtgtaccgtggacgaggtcgagtccctcatcaaacgtcacgaagcttttcagaaatcggctgtggcttgggaagagaggttctgcgctttagagaagctcacagccctcgaggaaagggaaaaagaacgtaagcgcaagcgggaagaggaagaacggcggaagcagccacctgcccctgagcctaccgcctccgtacccccaggagaccttgtgggcggtcaaactgcgtccgatacaacttgggacggcacccagccccggcccccacccagcacgcaggcgccttctgtgaacggtgtatgcacggatggggaaccgtcccagccattgctggggcaacagcggctggagcatagctcatttccagagggccccggacctgggtcaggcgatgaagctaatggcccgcgaggggagaggcagactcggacccgtggaccagctccatccgctatgcctcagtcaagatccacagaatcggcccatgccgcgactttacctcctcgtggcccagagccaagtgcgcaggagcagatggagggcatgctctgccgaaaacaggagatggaggccttcgggaagaaagccgccaacagatcttggcagaacgtgtactgcgtactcagacgcggctcactggggttttataaagacgcaaaagcagcatcagctggcgtgccataccatggtgaagtgccagtttccctcgctagagctcagggatctgtggcctttgattaccgtaagcgcaaacacgtattcaaactgggcttacaggacggcaaagagtacctttttcaggccaaagatgaggtctcctgcccttcctgttcgagcctaagtgttcccttccagaagctgcccgctgcggattcgccctcatttccggtgctcccactgtttccaggcctcgtcctatgcggcaagaccggatgcgtgaggaggccacatcaggccgccctgcccgtctag

SEQ ID NO: 135910 - DNA, 7173 bp, Artificial Sequence
  Description of Artificial Sequence: Synthetic coding sequence
atgagctcgacgctaagtcctaccgacttcgactcattggagattcagggccagtactcagacatcaacaaccgctgggacctgcccgactctgactgggataacgatagcagttccgcaaggctgtttgagcgaagtagaatcaaagctctcgctgacgagagagaggctgtgcagaaaaaaaccttcacaaaatgggtcaactcccacttagccagggtcacatgcagggtcggggacttatacagcgacctgagggacggccgcaaccttctgcgcctcttagaagtgctgagcggcgagattctccccaagcctactaaaggacgtatgagaatccactgcttagagaatgtagacaaggctctgcaatttctcaaggagcagaaagtgcacctcgagaacatgggctctcatgatattgtagacggaaatcataggctcaccttgggacttgtgtggaccatcatcctgcggttccagatacaggatatatctgttgaaacagaagacaacaaggaaaaaaagagtgcgaaggacgcgctgctgttgtggtgccagatgaaaaccgcaggctatcctaacgtgaatgttcataatttcaccacgagttggagggacggtttagcctttaacgctatagtccataagcatcggccggatctactggactttgaatctttgaagaagtgtaacgcccattataacctgcaaaacgcctttaacctggccgagaaggagttgggcctgactaaactcttagacccagaagacgttaacgtagaccaacctgatgaaaagtccatcataacctacgtcgccacatactatcactacttttcgaaaatgaaagccttggcagtagaagggaaacggattggaaaagtcttagaccacgccatggaggccgagcgcctggttgagaagtacgagagcctagcttctgaattgcttcagtggatcgaacagactattgtaacactgaatgatcggcaactagccaattccttgtcgggagtgcagaaccagttgcagtcttttaactcttaccgaacggtggagaagccccctaagttcacggagaagggtaaccttgaggtattgctgttcaccatccagtcaaaactgagagccaataatcagaaggtctataccccgcgcgagggccgactgatctcagacataaacaaggcctgggagcgcctggagaaagcagagcatgagcgtgagctcgccctgcgaaccgagctcattcgacaggagaagctggaacaactggctgcacggtttgaccggaaagcagctatgcgggaaacctggttgtcggagaatcagaggcttgtatctcaggacaattttggactcgaactcgcagccgttgaagcggccgtgcgtaaacacgaggcaatagaaactgatatcgttgcctacagtggccgcgtacaggctgtcgacgccgtggcagcagagctggctgcagagaggtaccacgacatcaagagaattgctgcaagacagcacaacgtcgctcgcctgtgggactttttaaggcaaatggtagcggctcgccgcgagagactcctgctgaacctcgagctgcagaaagtattccaggatctgctgtatctaatggattggatggaagagatgaagggaaggctgcagtctcaggatctgggccggcaccttgcaggcgtggaggatctcctgcaactgcacgagctagtggaggctgacattgccgtgcaagcggagcgggtacgcgccgtgtcagcttcagcgttgcggttctgcaaccctgggaaggagtatcggccttgcgaccctcagttggtcagtgaacgcgttgcaaaactcgaacaatcttatgaggccttgtgtgagctggcagcagcgcggcgggcccgactggaggaatcacgacggctctggcgctttctgtgggaagtgggagaggctgaggcctgggttagagaacagcagcatctcctggctagcgccgacaccgggcgcgaccttaccggcgcactccggttgcttaataagcatacagccctgaggggtgaaatgagcggacggctgggaccactaaaattgacactagagcagggccaacagctcgtggctgaagggcaccctggagcatctcaagccagtgcacgcgccgcagaattgcaggcacagtgggaaagactcgaagccctcgctgaggaaagagctcagcgtctggctcaggctgctagcctgtatcagtttcaagctgatgccaatgatatggaagcctggctcgtggatgctctgcgcctagtgagttcccctgagctagggcacgacgagttctccacccaagcgctggctagacaacacagagctttggaagaagaaattcgcagtcataggcccacgctggatgccctcagggaacaggcagcagccttacctcccacactgtctcgtacccccgaggtgcagtcaagggtgccaaccctcgaaaggcattacgaagagctgcaggccagggcaggcgaacgcgctagagctttagaggcagccctggcactatacactatgctcagtgaggctggcgcctgtggactctgggttgaggagaaggagcagtggctcaacggtctggccctaccagagcgactggaggacctcgaggtcgttcagcagcgattcgagacactggagcctgagatgaacacactggcagcacaaataaccgccgtgaatgatatagctgagcagcttctcaaagccaatcctccagggaaagacaggattgtaaacactcaggaacagctgaatcatagatggcagcagttccgtcgtctggctgacgggaaaaaggccgctctgactagcgctttgagcattcaaaactaccacctcgagtgcacggaaacacaggcctggatgcgtgaaaagaccaaagtcatcgagagcacgcagggcctgggcaacgacctggctggcgtgctcgccctgcagagaaagctcgccggcaccgagcgggacctggaagccatcgccgccagagtgggagagctgacacgagaggcaaatgcactggcggccggccatcccgcccaggccgtggctattaatgcgcgcctgcgagaagtccagaccggctgggaagacctgcgagccaccatgcgtagacgcgaagagagcctaggcgaggctagacggctacaggattttcttaggagtctggatgatttccaagcatggcttggccggacacagactgcggttgcatcagaggaagggcccgcaacgctgcccgaggcagaggcccttctggctcagcatgcggcgttaagaggagaggtggagagggctcaaagcgaatactcaagactccgcgccctaggagaggaggtcacgcgggatcaggccgatcctcagtgtctgttccttaggcaacgattggaggcgctgggaaccgggtgggaagaactggggcgaatgtgggagtcacggcagggacgcctggcgcaggcccatggattccaagggtttctgcgtgatgcccggcaagcagagggcgttctgagctcccaagagtatgtgctctctcacacggagatgccaggcacactacaggcagcggatgctgccatcaaaaagctggaggactttatgagcactatggacgctaatggcgagcgcattcacggcttgcttgaggccggtcgtcagctcgtgtcagagggaaacattcatgcggataaaatcagggaaaaggcagactcaatcgagaggaggcataaaaagaatcaagacgccgctcagcagtttctaggccgtctgagggacaaccgcgagcagcagcacttcctgcaggattgtcatgagctgaagctctggatagatgaaaaaatgctcacagcgcaagatgtgtcctatgatgaggcccgcaacctccacaccaagtggcagaaacatcaggcttttatggctgaactcgcagccaataaggactggctggacaaagtggacaaggaaggccgtgaactaaccttagaaaagcccgagctaaaagccttagtcagtgagaagctgcgggacctgcacagaagatgggatgaactggagaccacgactcaagccaaggcgcgttctctcttcgacgctaacagagctgagctgtttgcccagtcctgctgtgcattggaatcgtggctcgaaagcttacaggcccagcttcatagtgatgattacggcaaggatctgacctctgtgaacattcttcttaagaaacagcagatgcttgaatgggagatggcagtccgcgagaaggaggtggaggccattcaggcacaggcaaaggcactggcccaggaagatcagggtgcaggggaggttgagcgaacctcacgggctgttgaggagaagtttcgagctttgtgtcaacctatgagggagaggtgtagaagactgcaggcctcacgggaacagcatcaattccaccgggatgttgaagatgaaatactgtgggtcactgaaaggttgccaatggcatcctccatggagcatggcaaagatttgcctagcgtccaacttctgatgaagaaaaaccagaccttacagaaggaaatccagggccacgaacctaggatcgccgatcttcgtgaacgccaaagagccctgggtgccgccgccgccggtccagaattggccgaactgcaggagatgtggaagagactgggacacgaattggagctgcgtgggaagaggttagaggacgccctgcgtgctcagcagttttaccgagacgccgcggaggcagaggcctggatgggggaacaggagttgcacatgatggggcaggaaaaggcaaaagatgagctgagtgcacaggcagaagtgaaaaagcaccaagtgctcgagcaggcccttgccgactacgctcagaccattcaccaactggctgcctcatctcaagatatgattgaccacgagcacccggagtcaacccgaatatcaatcaggcaggcccaggtcgacaaactgtacgcaggacttaaagagctggccggggaaaggcgagaacgtttgcaggaacacctccgtctctgtcaactcagaagagaactcgacgatctcgaacagtggatccaggagagagaagtggtcgccgccagtcacgagctcgggcaagattacgagcacgttacaatgttgcgggataagttcagggagtttagtagagacacttctacgattggtcaagagagggtggatagtgccaacgcgctcgcgaacggtctgattgcgggaggccacgccgcgagggcaacagtggccgagtggaaggattcactgaatgaagcatgggctgacctgctggaactcttggacacccggggccaggttctggccgccgcctacgaactccagcggttcttgcatggagcacgacaggccctggcccgcgtccaacataaacagcagcagttacccgacggtacaggccgggatctgaatgctgctgaggccttgcaacggcgacactgcgcttatgaacatgatatccaagccctgagcccacaagtccagcaagtgcaagacgacggccatcggctgcagaaagcctacgctggcgacaaagccgaagaaattggaaggcatatgcaggccgtggcagaagcctgggcccagcttcaggggtcttcagcggcacgccggcagctgctcctagatactacagataagtttcgcttcttcaaagccgttcgcgaactcatgctgtggatggacgaggtcaatcttcagatggacgcccaggaaagacctcgtgacgtgtcatcagcagatctcgtcatcaagaatcaacaaggtattaaagctgagattgaagcacgtgctgaccgtttttcgtcctgcattgacatgggcaaagaattactggctcggagccattacgctgcagaagaaatctccgagaaattaagccagttgcaggctcgccgccaggagactgccgagaagtggcaggaaaaaatggattggctgcagctcgtcctcgaggtactggtatttggacgtgacgccggaatggccgaggcttggctctgcagccaagagcctctcgtgcgttcagctgaattgggctgcactgtcgacgaagtggaatcactgatcaagcgacatgaggctttccagaaatctgccgtggcctgggaagaacggttctgcgcattagagaagcttaccgccctcgaagagagagaaaaggagaggaaacggaagagagaggaggaagaacggaggaaacagccaccggccccagaacccaccgcaagcgtgccccccggtgacctggtggggggacagactgcctcagataccacatgggacggcacccagcctcgtccaccacctagcacccaggcccccagtgtcaacggagtctgcactgacggagaacccagccaacccttgctgggccagcagcggctggagcactcatcctttcctgagggaccaggcccaggatccggggacgaggccaacgggccgaggggtgagcggcagactcgcacccgtggtcctgccccctctgccatgcctcagtctcggagtaccgagtctgcccatgccgccactctgcccccgagaggccctgagccttcggcccaggagcagatggagggcatgttatgtcgtaagcaagagatggaagcctttgggaaaaaggccgctaacagatcttggcaaaacgtctattgcgtccttaggagggggtcattagggttctataaggatgcaaaggcagcttcagctggggttccctaccacggggaggtgcccgtcagcctcgcccgagctcagggctctgtggccttcgactacagaaaaagaaagcacgtttttaagctggggctgcaggacggaaaggagtacttgtttcaagcaaaagacgaggctgagatgagctcatggcttagagtggtgaacgcagcaattgcaacagcatcttcggcctcaggtgagcccgaggaaccggtcgtgccaagcacaacaaggggtatgactcgagcgatgaccatgccacctgttagtccagtgggagccgaagggcccgtggttctgcggtccaaggacgggcgggagagggagcgagagaagaggtttagcttcttcaaaaaaaataagtag

SEQ ID NO: 135911 - DNA, 6465 bp, Artificial Sequence
  Description of Artificial Sequence: Synthetic coding sequence
atggcacaagttccaggcgaagtggacaacatggaaggcctgcctgcgcctaacaataacccggccgcacgttgggaatcgcccgatagagggtgggagcgagagcagcctgccgcctcgacagccgcagcctctttatttgagtgttcccgtattaaggcgctcgccgatgagagagaggccgtacagaaaaaaaccttcactaaatgggtcaacagccacctggcccgtgtcggatgccatataggcgacctgtacgtggatctgcgggacggtttcgtcctcacacggcttctggaagtgctatcaggtgaacagctaccccgacctacaaggggccggatgagaattcatagcctggagaatgtcgacaaagcgttgcagttcctgaaagaacagagggttcacctagagaacgtagggagtcatgacatcgtggatggtaaccacaggttgaccctgggccttgtctggacgatcattctgaggttccagatccaagtgatcaaaatcgagactgaagataatcgagaaacccggtccgctaaagacgccctcttgctctggtgccagatgaaaacagccgggtatcccgaagtgaacatccagaactttaccacttcatggcgggacggtctcgctttcaacgccctaatccatcgccaccggccggacctggtagatttctctaaactcactaagtccaacgctaactataatctgcagcgggccttccgaactgctgagcaacacttggggctggctcgactgctagatcctgaagatgtcaacatggaggccccggacgaaaagtcaatcatcacctacgtggttagtttctatcattatttcagcaagatgaaagctctcgctgtggagggtaaacgcattggaaaggttctggatcaggtattagaagtcggaaaaatcattgaaaggtatgaagagctggcggcagagctgctggcctggatccaccgtacggtaggactgatcagcaatcagaagttcgctaactccctttctggagtgcaacagcagctgcaagccttcactgcctactgtacccttgagaagcctgtcaaatttcaggagaagggcaacctggaggtgctgctgttctctattcagtcaaagttaagggcatgtaaccgcagactgtttgttccgagggagggatgtgggatctgggatattgacaaagcctggggagagctagaaaaagccgagcacgagcgggaagccgctctgagagctgagctcattaggcaagagaaactggaactcctggctcaaagatttgaccacaaagtggcaatgcgggagagctggctgaacgagaaccaaagactcgtcagccaggacaacttcgggtacgagttgcccgcagtcgaggcagctatgaagaaacacgaagcaatcgaagccgatatcgcagcttacgaggaacgcgtccagggtgtggcggagctggcccaagctttagctgcggaggggtactacgacatcaggcgggtggcagcacagagagattccgtcctccggcagtgggctctgcttactggcctggttggcgcaaggcgaactcgcctagaacagaatcttgcactccagaaggtgttccaagaaatggtgtacatggtggattggatggaggaaatgcaggctcaacttttgtcgagggagtgcggtcagcacctagtggaggctgacgacctcctgcagaagcacggactactcgaaggcgacatcgcggctcagtcggaaagggtggaagccctgaatgcggccgcgcttagattcagccaactacaggggtaccagccctgtgaccctcaagtcatatgtaatcgtgtcaaccatgtgcacggatgcctggccgaattgcaagaacaggcagctaggcggcgcgcagaactggaagccagcagaagcctgtgggctctactgcaggaacttgaagaggcagaatcttgggcccgggacaaggaaaggttgctggaggccgcgggcggaggcggtgcggccggcgccgctggagctgccggcacggctggcggagcacacgatctctctagtaccgcaaggctgctcgcccagcacaagatcctgcagggtgagctcggaggcaggcgggcgcttctccagcaagccctccgttgtggagaagagctggttgcagcgggtggagccgttggtcctggtgcggacaccgtccatcttgtagggctagcggagagagccgcatccgccagacgccggtggcagcgattagaggaggccgcggcccgtcgggagcgtcgcctgcaggaggcccgtgcccttcaccagtttggcgccgacctcgatgggcttcttgactggttgcgagacgcataccgtttagccgctgcaggcgatttcgggcacgacgaggcctcttcccggagactcgcaaggcagcatagggcactcacgggggaggtggaggcccaccggggcccggttagcggtctccgtcgacagctagccaccctgggcggagcttcgggagccggccctctggttgtagctctccaggtaagggtggtggaggccgagcagttgttcgcagaagtgaccgaagtcgccgcacttcgccgtcagtggctgcgggacgctttggctgtctatcggatgtttggtgaggtgcacgcctgcgaactgtggatcggtgaaaaggagcagtggctgttgagtatgcgcgtacccgacagcctcgatgatgtggaggttgtgcagcatagattcgagagcttagatcaagagatgaacagcttaatgggacgggtgctggacgtcaatcacaccgtgcaggagctggtggaaggcggacacccaagttccgatgaggttcgaagttgccaagatcacctgaactctcgctggaatcgaattgtagaactcgtggagcaaagaaaagaggagatgagtgcggtgctcctagtggaaaaccacgtattggaagtggctgaggtccgggcgcaggttcgggagaaacgacgtgctgtggagtccgcacctcgcgctgggggagcattgcagtggcgcctgagcggactggaagcagccttacaagctctggagcctcggcaggcagctttgctggaggaagcagccctgctggcagaaaggttccccgcccaggctgcgagactgcaccagggggccgaggagctgggcgcggagtggggagccctggccagcgccgcacaagcttgcggcgaggccgtggccgctgccggtagattgcagaggttcctgcacgacctggacgcgttcctcgattggctggtgagagctcaagaggcagccgggggctccgagggacctctgcctaacagcctggaggaagcggatgctttactggcccgccacgctgccctaaaggaggaagtggatcaaagggaagaggactacgcccgaatagtggctgcctctgaagccctgttggctgcagacggcgccgaactcggccccggactagcactggatgagtggcttccacacctcgagttaggctggcataagctgctgggcttatgggaggcacgtagggaagcattagtgcaggcccacatctaccaattgttcctgagagacctccgccaggctctggtcgttttacgtaatcaggagatggctctatccggagcggagctgcctggcactgtggaaagcgtggaagaggccttgaaacaacatcgcgattttctgacaacaatggaactgtctcagcagaaaatgcaagtcgcagtccaggcagctgaggggcttcttcggcagggcaacatctatggggaacaagcccaggaggctgtgaccagacttctcgaaaagaaccaagagaaccagctacgggcccagcagtggatgcagaaactccacgatcagttagaactccagcattttcttcgagattgtcatgaattggacgggtggatacatgaaaaaatgttaatggccagagatgggacccgcgaggacaatcacaagctccacaagcgctggcttaggcatcaggccttcatggccgagttggctcagaataaggagtggcttgaaaaaattgaacgagagggacagcaactgatgcaggaaaagcccgagctggcagctagcgtcagaaagaaactgggggagattcgccagtgttgggcagagctggagtccactacacaggccaaggcaagacaactgtttgaggcatctaaggccgaccagctagtgcaaagcttcgctgaactggataaaaagctgctccacatggagagccagctgcaggacgttgaccccgggggcgatctggcgacagttaatagccagctgaagaagctccagagcatggagtcccaggtcgaagagtggtatagggaggtgggtgaactacaggcccaaacagccgcactgcctttggaaccagcctcaaaggagctcgtgggtgagaggcagaatgccgtaggcgagcgcctggtccgtttattagaacctctgcaggagcgccggcgcctactcttagcctccaaagagttgcatcaggtggcccacgacctcgacgatgagctcgcatgggtgcaggagaggctgccactcgccatgcagactgagagagggaatggactgcaggctgtccagcaacatattaagaagaatcagggactgcggcgtgagatccaagcccacgggccgaggttagaggaagttctagaacgggcaggagctctggcatctctgaggtccccagaggccgaagccgtgagacgggggctggagcagctccagtcggcatgggctggactacgagaagcggcagagcgtagacagcaggtgctagacgctgcatttcaggtggaacagtattactttgacgttgccgaagtggaggcctggttaggggaacaggagctgctgatgatgtcagaagacaagggaaaggatgaacaaagcacgctacagcttttaaagaagcatcttcaattagagcagggcgtggagaattacgaggagtctattgcccaactatcgcgccaatgccgcgcactactcgaaatggggcaccctgacagtgaacagatcagtcggcgacagagccaggtggatagactctatgttgcactcaaagagctgggagaagagcggcgcgtagctcttgagcaacagtattggctatatcaactgtcccgtcaggtgtcagagctggagcattggatcgcagaaaaggaagtagtggccggctcccctgagttggggcaggactttgaacacgttagtgtgcttcaggaaaagttcagcgaattcgcgtcggagactggcatggcagggcgcgaaaggctcgccgccgtgaatcagatggtagacgagctgatcgagtgtgggcacaccgctgctgctaccatggcagagtggaaagacggtctgaatgaagcctgggccgaattactggaactgatgggcacaagagcccaactcctggcggcaagcagggagctgcacaagttcttctctgatgccagggaacttcagggccagatcgaggagaagcggagacggttgccaaggctgaccactccccctgagccacggccatctgcctcttccatgcagcggaccctccgagccttcgagcacgatctccaactgctggtgtcccaagtgagacagctacaggagggagccgcccagcttcggaccgtgtatgccggcgagcatgcagaagcaatcgcctcccgcgaacaagaggtgttgcaagggtggaaggagctgctgtcagcctgtgaggatgctcgcttgcacgtctctagcacggctgacgctctccgattccattcacaggttagggatctactatcgtggatggacgggatcgcatcacagattggagcggccgataagccccgggatgtgtcttccgtcgaggtcctcatgaattaccatcagggcttaaagacagaactcgaggccagagtgccggagctcacgacctgtcaagagctcggccgatccctgctcctgaataagagcgccatggcagatgaaatccaagcacaacttgataaactagggacaagaaaagaggaggtgagcgaaaagtgggacagacactgggaatggcttcagcagatgctcgaggttcaccagttcgcccaggaagctgttgttgcggacgcatggctcactgcccaggagccactgttacagagcagagaacttggctcttccgtcgacgaggtggagcaacttattcggcggcatgaagccttcaggaaagccgctgcagcatgggaggagcggttctcaagtcttcggaggttaacgacccccagaagggaggatcacctcaatcctggggtgcaggatcaaccatggcagcacaccgagaaaccatcattacctaaaccaaaagcaaacaaggagaaaactgcacgccgcgacggcacttgcctttag

SEQ ID NO: 135912 - DNA, 3930 bp, Artificial Sequence
  Description of Artificial Sequence: Synthetic coding sequence
atggcgcaagtacccggggaagtcgacaacatggaaggtctgcccgctcctaataacaatcccgcggcaagatgggaatctcccgacagaggctgggagcgtgagcagcctgccgctagcacagcagctgcttccctgttcgagtgctctcgcatcaaggccttggctgacgagcgtgaggccgttcagaagaagacattcaccaagtgggtgaattctcaccttgcccgggtgggctgtcatattggcgatctttatgtggaccttcgcgacggcttcgtgcttaccagactccttgaggtcctgtcgggagagcagctgcctcgtcccaccagggggcgaatgagaatacactccctcgagaacgtggataaggccctgcagtttctaaaggagcagcgagtccatcttgaaaatgtcgggtcgcacgacattgtggacggaaatcacagacttaccctgggactggtctggacaattattctgaggttccagatccaagtgatcaagatcgagaccgaagacaatagagagacccgtagcgccaaggatgctctcctgctctggtgccaaatgaagactgcagggtaccccgaagttaatatccagaatttcacgacatcctggcgagatgggttagcgtttaacgcactgatacacagacacaggcccgatcttgttgacttcagtaaattgactaagtccaatgcaaactataatctccaacgcgcgtttagaaccgccgagcagcacctcggcctggcccggcttctagatccggaggacgttaatatggaggctccagacgagaaaagtataatcacatacgtggtatcattctaccactatttctccaaaatgaaggctctagctgtagaaggcaaacgaataggcaaagtgctggaccaggtgctcgaggtgggcaaaatcatcgagcgctatgaagaactggcagccgagctgttagcctggatccatcgcaccgtaggcctgatttccaaccagaagtttgccaattctctgtcaggggtgcaacagcaattacaagcatttaccgcttactgtacgttagaaaaaccagtcaagtttcaagaaaagggcaacttggaagtgctgttgtttagtattcagagcaagctacgggcctgtaatcggaggctgtttgtacccagggagggctgtggcatctgggacatcgacaaagcttggggcgagctggagaaggctgaacacgaaagggaggccgcgcttcgtgcagaattaatccgccaggaaaagttggagctgctcgcccagcggtttgaccataaggtcgctatgcgggagtcctggcttaatgagaaccagagactcgtgtctcaggataattttgggtacgagctccctgccgtggaagcggcgatgaaaaaacatgaggcaattgaagctgatatcgccgcctatgaggaacgtgtccagggtgtagccgagttggcgcaggccttggccgctgaggggtattacgatatccggcgagtcgcagcacagagggattccgtgctgagacagtgggccctcctgacaggattggtcggggctagacgaacaaggcttgaacagaatctggcgcttcagaaggtgtttcaggagatggtctacatggttgattggatggaagagatgcaagcccagctcctgtcccgggaatgcggccaacacctggtagaggctgacgacctgctgcaaaaacacggcctgttggaaggagacatcgcagctcagtcagaacgtgtggaagctcttaacgccgccgctctgcgctttagccaattgcaaggctatcagccttgtgaccctcaggtaatctgcaaccgagttaatcacgtgcatggctgcttagcggagctgcaagagcaggccgcaagacggagggccgagctagaggcaagccgctccctttgggcgctgctgcaggagttagaagaggctgagtcctgggccagagacaaggagcggctgttggaagctgcaggtggtggaggagctgccggggcagctggggcagccggaaccgctggcggagcccacgaccttagctccacggcgcgactactcgcccagcataaaatcctccagggcgaactcggtggacggagggccttgcttcagcaggccctgcgatgcggcgaagagttagtcgcggccggcggcgcagtcggcccaggcgctgatactgtgcacctggttggtctggcagaaagggccgcctctgcaaggcgaaggtggcaaagactggaagaggccgcagctcgtagagaacggaggttgcaagaagctagggctctgcaccagttcggagccgacttggatggactcctggactggctgcgagatgcatacagattagccgccgccggcgatttcgggcacgatgaggcatcttcccggcgccttgcaagacagcaccgagcactaacgggggaagtggaggcccatagggggcccgtttctggcttaaggagacagttggccacactggggggggcctcaggggctggcccactggttgtggctctgcaggtccgcgtcgtcgaggctgagcagctctttgccgaggtgacagaagtagcggcactcaggcggcagtggctgcgagatgccctcgccgtgtatcggatgtttggtgaggtgcatgcatgcgagctatggattggagaaaaggagcagtggttgctgagtatgcgagtccctgactctctggatgacgtggaagtcgtacagcacagattcgagagtctagatcaagagatgaattctctcatgggccgggtgctggacgttaaccatacagttcaggaactggtagagggtggacatccgagtagcgacgaagtaaggagctgccaggaccatctaaactctagatggaatcggatagttgagctcgtcgagcagcggaaagaggagatgtccgctgtactgcttgtggagaatcacgttcttgaggtcgctgaagtgcgggcacaggttcgggaaaaaagaagggcggtagagagcgcgccccgggctggcggcgccctgcagtggcgcctctccggattggaggccgccctccaggccttggagcctagacaggccgccctgctggaggaggccgctcttctggccgaacgcttccccgcacaggcggctcgcctccaccaaggagccgaggagttaggcgccgagtggggcgctttggcttcagccgcccaggcttgcggagaggcagtggctgccgccggacgcctgcaacgcttcctgcacgacctcgatgctttcctggattggctcgtgcgcgctcaagaggccgcaggtggaagtgagggccctctgcccaatagcctggaggaagccgatgccttgctagcaagacatgccgctcttaaggaggaagtggatcagagagaagaagattatgccaggattgtggctgccagcgaagccctcctggcagccgacggcgccgagctgggacctggcttggcattggatgaatggctccctcatctggaactgggatggcacaagctgctgggtctttgggaggcccgtcgcgaggccctggtacaggcgcacatataccagctgtttctccgcgacctgcgtcaagctttggtagtcttgaggaatcaggagatggctctgtctggggccgaacttcccggtactgtagaatccgtcgaggaagctctgaagcagcatagggattttctcaccaccatggagttgagtcagcagaaaatgcaagtagctgttcaggccgccgagggtcttctgcggcagggcaatatttatggagagcaggctcaggaggcagttaccagactcctcgagaaatgcctgattattcatccagccctgctgcaccccccatgggaacccccagaccttccacgaagctcaagctag

SEQ ID NO: 135913 - DNA, 7695 bp, Artificial Sequence
  Description of Artificial Sequence: Synthetic coding sequence
atggcccaggttcctggcgaggtggataatatggagggactgcccgcccctaacaataacccagccgcccgctgggaatctcctgacaggggttgggagagagagcagcccgctgcttctaccgctgccgcctccctctttgaatgcagcaggatcaaagccctggcagatgaaagagaggccgtgcagaagaagaccttcacgaaatgggtaaattcccatcttgcgagagtagggtgtcacattggagacttgtacgtagatttgagggacggattcgtgctgacccgactgttggaggttctctctggggaacagctcccccggccaaccaggggccgcatgaggattcattctctcgaaaatgttgataaggctttacaatttctcaaggagcagagggtgcacttggaaaatgtcggatctcacgacatcgtggacggcaatcatcggctaacactgggactcgtgtggaccattatccttaggtttcaaattcaagtgattaaaatcgagacagaagacaaccgagaaaccaggtccgcaaaggacgccttgctgctatggtgccagatgaagaccgccggctatccggaagtgaatatccagaattttacaacctcctggagggacggcctggccttcaatgctctgattcacaggcatcgaccggatttagtggatttcagtaaactgacaaagtcaaatgctaactataacctccagagagcctttaggactgccgagcagcacctgggactggcacgactacttgaccccgaagatgtgaacatggaggccccagatgaaaagtctattatcacatatgtcgtaagcttctatcactacttcagcaaaatgaaagccctggcagtggaaggaaagaggatcggaaaagttcttgaccaggtgctggaggtgggaaagattatagaacggtatgaagaattggcagcagagctcctagcgtggatccaccgtaccgtgggcctcatctctaatcagaagtttgccaattccctgtctggggtgcagcagcagttgcaggccttcacagcctactgtaccctagagaagcccgtgaaattccaagaaaagggcaatttagaagttctgctgttcagcattcagtccaaacttagggcgtgcaaccgccgactcttcgttcctagggaggggtgtgggatttgggatatagacaaagcttggggtgagctcgagaaggcagaacacgagagagaagctgccctgagggccgagctcatcaggcaggagaaacttgaattactggcccagcgatttgaccacaaagtcgcaatgcgagagtcttggctgaacgaaaaccagagactggtgtcgcaggacaattttgggtacgaacttcccgcagtcgaagctgctatgaagaaacacgaggcgatagaggctgatatcgccgcctacgaagaacgggtgcagggggtggccgaactggcccaggccctcgccgcagaagggtactacgatatccgcagggttgccgctcagcgcgactccgtgctacgccaatgggcattactgaccggccttgtcggcgcccgcagaacacgacttgaacaaaatctggcgctacagaaggtgtttcaggagatggtctacatggtcgactggatggaggaaatgcaggcgcagctgctctccagagaatgtggccagcacctggtggaggccgatgatttactgcaaaaacacggactgctagagggagatattgccgcacagtccgaaagagtggaggctcttaacgccgccgccctaaggttttctcagctccagggctatcaaccatgtgacccacaggtgatctgcaatagggtgaatcacgtacatggttgtcttgctgaactccaggagcaagccgcccggcgcagggcagaactcgaggctagcaggtctctgtgggctctgctccaggaacttgaggaggccgaaagctgggcacgagataaagaacgcctgctggaggctgcaggaggcggcggtgccgccggggccgcaggcgccgctgggacagcaggaggggcccatgacctgtccagtaccgcacgcctgctggcacagcacaagatacttcaaggtgagttgggcggaaggagggcactcctccagcaggccctgcgatgcggcgaagagctggtggccgcaggtggcgcagttggcccgggcgccgataccgtgcacctcgtgggcctggctgaaagagcggcgtctgctcgccggcgttggcagcggctcgaagaggcagccgcaagacgcgagcggcgccttcaggaggcgcgtgctctgcaccagttcggggccgatctggacggtttgctcgactggctacgggacgcgtacaggttggctgctgccggcgatttcgggcacgatgaagcgtcaagtaggcgccttgcacgtcagcaccgcgccctgacaggtgaggtggaagcccatagaggccccgtgtccggccttaggcgacaactggccaccctgggcggagcatctggcgccggaccgttagttgtcgcattgcaggtgcgcgtcgtagaggccgaacagttgttcgctgaagttaccgaggtggccgccctcagacgccaatggctgagagatgcactggcggtctatcgaatgttcggcgaggtgcacgcatgtgaactgtggatcggagaaaaggaacagtggctgctatctatgcgcgttccagacagcctagacgatgtcgaagttgtgcaacaccggttcgaaagtctcgaccaggaaatgaattccttgatgggcagggtgctggacgtgaaccacacagtccaggagctcgtggaaggagggcacccaagttccgacgaggttcggagctgccaggaccatttgaactctcgatggaacaggatcgtggagctggtcgagcagcgtaaggaagagatgagcgccgtgctgctggtggagaatcatgtcctcgaggtggctgaggtacgagcccaagtgcgggagaaaagaagggccgtggagtcagcgccgagggccggtggcgcacttcagtggagactcagcggcctggaggcggcgctgcaagccttggaacctcggcaggccgcactgttagaggaagccgccctcctggcggagcgctttcccgcccaggctgcacgcctgcaccagggcgccgaggagctcggcgcagagtggggtgccctggccagtgctgctcaggcttgcggcgaggccgtcgcagcagctggaaggctgcagaggttcttacatgacctggatgcattcctagactggctggtgcgggcacaggaggccgccgggggttccgagggacccttgcccaactctctcgaagaggcagatgcgctccttgctcgccacgccgctctcaaggaggaagtggatcagagagaggaggactatgcaagaatagttgccgccagtgaggctctgcttgcggcagacggagcggagctaggcccaggcctggccctggatgagtggttgccccatcttgagctaggctggcacaaattgctggggctgtgggaagccaggcgagaggcacttgtgcaagcacatatataccagctctttttgagggacctaagacaggctcttgtggtcctcagaaaccaggagatggctctgtctggcgccgaactgcctgggactgtggagtccgtggaggaggctttaaagcaacaccgcgatttcctgaccactatggaactcagtcagcagaaaatgcaggtagctgtgcaggccgctgagggcctactgaggcagggcaatatttacggagaacaagctcaggaggcggtaacccgcttgctagagaagaatcaggaaaatcagctacgggcgcaacaatggatgcagaagttgcatgatcagttggaactccagcatttcctccgagattgccatgaactcgacggatggatacacgaaaagatgctgatggcccgagatggcacacgcgaggataatcacaagcttcataaacgctggctcagacaccaggcctttatggctgagctcgcacaaaacaaggaatggctcgagaagatcgagcgagaagggcagcagctcatgcaggaaaagcccgagcttgctgcctccgtccgtaaaaagctgggggaaatcagacaatgttgggctgagcttgaaagtacaacccaggcaaaagcccggcagctttttgaagctagtaaggctgatcagcttgttcagagcttcgctgaactggataaaaaattactccatatggagtcacagcttcaggatgtcgatccaggaggcgatttggccacagtaaactcccagttaaaaaagcttcaatcaatggagagccaggtcgaggagtggtacagagaggttggtgagctccaagcccaaactgctgctcttcctcttgagcctgcgagcaaagagctagtgggggaacgccaaaacgccgtaggagaaaggcttgtcaggctgctggagcccctacaggaacgacggcggctgctcctcgccagcaaagaactgcatcaggtggcccatgacttagatgacgagttggcttgggtgcaggagaggctcccgctggcaatgcaaacggagagaggtaacggcctccaggccgtgcagcagcatattaagaagaaccaaggtctgcggagggaaatccaggcacacggcccacggcttgaagaggtgctggaaagggccggcgccctggctagtctgcggtccccggaggcagaggcagtgaggagaggcctggaacagctgcagagtgcctgggccgggctcagggaggcagctgagaggcggcagcaggtgctggatgctgccttccaggttgagcagtattactttgacgtcgccgaggtcgaagcctggttgggcgaacaggaactactgatgatgagtgaggataaagggaaggatgaacagagcacactgcaactacttaaaaaacatctccagctcgaacagggggtggaaaattacgaagagagcatagcccaattaagtcggcaatgtagagccctgttggagatggggcaccctgatagcgaacagatctcccgacgacagtcgcaggtggatcgcctgtatgtagccctgaaagaactcggcgaagaacggcgggtggcccttgagcagcaatactggctctatcagctctctaggcaggtctccgaattggaacactggatcgccgagaaggaagtcgttgccggtagccccgagctgggacaggatttcgagcacgtgtcagtgctgcaagaaaaattttccgagttcgcttccgagaccggcatggctggacgcgagagattggccgctgtcaatcagatggtggatgagctgatcgagtgtggtcacaccgcggccgccactatggcagagtggaaagacgggctcaacgaagcctgggccgagctcctggagctcatggggaccagagcccagcttctggctgccagtcgtgaactccataagttcttcagcgacgctcgggagctccagggccagatcgaggagaagcggagaagactgccccgacttacaactccaccagagcctcgcccatcagcatcctctatgcaaaggaccttgagggcgtttgaacatgacctgcagttactcgtctctcaggttaggcagcttcaggagggcgctgcacagttgcgaaccgtgtacgccggcgagcacgctgaggccatagcaagccgggaacaagaggtcctgcaaggttggaaggaactcctgtccgcatgcgaggatgcccgtctgcacgtttcatcgacagcggacgccctccggtttcattcgcaggtgcgagacctgctcagctggatggacggaatcgcatcgcaaataggcgccgcagacaaacccagagatgtgagtagcgtggaagtgctgatgaactaccaccagggactgaaaacagagcttgaagcccgggttcctgaactgaccacctgccaggagctggggagaagccttttgctgaacaagtctgccatggccgacgagatacaggcccagcttgacaaacttggaaccaggaaggaggaagtatccgaaaaatgggatagacattgggagtggctccaacagatgcttgaagtgcatcagttcgcacaagaggccgttgtggccgacgcttggctgactgcccaggagcccctgctgcagagcagggagctgggatcctctgtggatgaggtggaacaactgatacgccgacacgaagcatttcggaaagccgcagcagcttgggaggaaaggttttcatcactgagaaggctaaccaccattgagaaaataaaggcggagcagtcaaagcagccgccaacccctctcctggggagaaagttctttggagaccccacagaactagccgctaaggctgcacctctgctgagacccggcggatacgagcgtggcctggagcccctcgcccgaagagctagcgatacgctgtcagctgaggtgagaaccagagttgggtacgtgcgccaggagctcaaaccagagcgcttgcagcccaggatcgaccggctgcccgagattcctggacgtgtagaaccagctgcactgcctgcagcacctgaggatgctgctgagacaccagcaacacccgctgcagcagagcaggtcagaccacggccggaaagacaggagagcgccgatcgggcggaagaactgccccgccggaggagaccagagagacaggagtctgttgaccagtccgaagaagccgctagacgcagaaggccagaaagacaagagagtgcagaacatgaggccgcacattcactcaccttgggtcggtatgaacagatggaacgccggcgggaaagacgggaacggcggcttgaaaggcaggagagctccgagcaagaaatgcccatcagaggcgatctggtaaagggcaaagccacgctggcagatatcgtggaacaacttcaagaaaaggaagccgggcctggcctgcccgccggcccctctttgccccagcccagagaactgcctccgggtaggctgccaaacggcctggaacttcccgaacggaccccccggcctgatcggcctcgggctcgggaccgtcccaagccccgaaggaggcccaggccacgagagggtggggagggaggtggaagtcgccgtagccgtagcgccccggctcagggggggagtgccccggcccctccaccaccaccaactcacaccgtgcagcacgaggggttcctgctccgaaaacgggaactggacgcgaaccgaaagtcatcaaaccgctcctgggtctctctctattgcgtgctgtcgaagggcgagctgggtttttataaggatagcaaggggccggcctcagggtccacgcatgggggggagcccctgctctcactgcataaggccacaagcgaggtggcctcagactacaaaaagaagaagcatgtctttaagctacaaactcaggacggctctgagttcctcctgcaggcaaaggacgaggaggaaatgaatggctggttggaggccgtggcttcaagtgttgctgagcacgccgagatcgcccggtgggggcaaacgctgcctacgactagctctacagacgagggcaatcccaagcgagagggcggggacagacgcgccagcggtagacggaagtag

SEQ ID NO: 135914 - DNA, 2037 bp, Artificial Sequence
  Description of Artificial Sequence: Synthetic coding sequence
atgctcatggctagggatggcacccgggaggataaccataagctgcacaagcggtggctgagacatcaggcattcatggccgagctggctcaaaacaaggaatggttagagaaaatcgagcgcgagggccaacaactgatgcaggaaaagccagaactcgcggcgagcgtaaggaaaaagctcggcgaaatacgtcaatgttgggccgagttggaatcaactacccaggcaaaggcaagacagttatttgaagcctctaaagcagaccaactggtgcagagctttgcagaactggataagaaacttctgcacatggaatcccagctgcaagacgtggacccaggaggcgaccttgctacagtcaactctcagctgaaaaagctgcagtctatggaatcccaggtcgaagaatggtatagagaagtgggggaacttcaagctcagaccgcggccttgccactggagcctgctagcaaagagcttgtgggagagagacaaaacgcggtcggagaaagactcgtgcggctccttgagccactgcaggaaagaaggcggctgttgcttgcctcaaaggaactgcatcaggtggcccatgacctggacgatgagcttgcatgggttcaggaaaggctcccactcgctatgcagactgaaagaggcaatggtttgcaggcagtgcaacagcacattaaaaaaaaccagggactgagaagggagatccaggcacacgggcccaggcttgaggaggtccttgagcgagcaggcgcccttgcttctctccgctctccagaggctgaggcggtgcggcgaggactggaacagctccagtccgcctgggctgggctgcgagaggctgcagagaggaggcaacaggtgttggacgctgccttccaggttgagcagtactattttgatgtggcggaggttgaagcttggttgggcgaacaggagctgctgatgatgagtgaggacaagggtaaagacgagcagtcaactctgcagctgctcaaaaagcatctgcagctggagcagggcgtggagaactacgaggagtccatagcccagctcagccgtcagtgccgcgcacttctagaaatgggccaccccgattcagaacagatctccagacgacaatcccaagtggaccgcctttacgtggcccttaaggaactgggcgaggagaggagggtcgctctggagcagcagtattggctctatcagctatcacggcaggtcagtgagctggaacactggattgccgaaaaggaagtagttgcgggctcgccagagctgggacaggacttcgagcacgtaagtgtgctgcaggagaaatttagcgaattcgcctcagagacaggcatggccgggagggagaggctggcagccgtgaaccaaatggtggacgagcttatcgaatgtggccacaccgccgcggcaacaatggcagagtggaaagatggactgaatgaggcgtgggcagagctgttggaactcatgggcacgcgagctcagctgttggcggcatccagagaactgcataaattcttcagtgacgcgcgtgaactgcaaggtcagatcgaggaaaagagacgccgcctgccccgactgaccacaccaccggaacctaggccctccgcttctagtatgcagcgcactctgagggccttcgagcacgacctgcagttgctcgtgtcccaggtcagacagctgcaagaaggtgctgcccaactccgcacggtttacgctggggagcatgcggaggcgattgcttcacgagagcaagaagtcctgcagggttggaaggaactgttatcagcatgtgaagacgccaggctacatgtgtcgtctacggccgatgccctgcggtttcacagccaggttagagatctgctgagctggatggatgggatagcctctcagatcggagccgcagacaaaccccgctgcccatcaagcttgttggggctgccagcatccccgtggtggccaacgcctgctacgccatcccccctgacagccccctttagtatggagtag

SEQ ID NO: 135915 - DNA, 3924 bp, Artificial Sequence
  Description of Artificial Sequence: Synthetic coding sequence
atgccccactatccctcctgtagtagcgcgccatccctggggactccgagaccgccccagattcagcagctggaagcccgccatcgcaatcaggagaatcaactgcgtgcgcaacagtggatgcaaaaactgcacgaccagctggagcttcagcattttctccgtgactgccatgaattggacggctggattcatgaaaagatgcttatggcgagagacggcacccgagaagacaatcataagcttcacaagcgctggctgagacaccaagctttcatggccgagctcgcacagaataaagagtggttggaaaaaattgaacgggagggtcagcagttgatgcaggagaaaccagaactggccgcatccgtaagaaaaaagctgggagagattaggcagtgttgggcggagctcgaaagcactacccaggcaaaagcaaggcaattattcgaagcctcaaaggccgaccagctggtgcagtcattcgcggaattggataaaaagcttttacacatggaatctcagctccaggatgttgacccaggcggcgatctggccacagttaattctcaactcaagaagctccagtctatggagtcgcaggtagaagaatggtatagggaggtgggggagctacaggcccagactgccgctttgcccctggagccagcgtccaaggaactcgtgggggaaaggcaaaacgccgtaggggagcggttggtccgcctcctcgagccactgcaggagaggaggcggcttctgttggcctctaaagagctacatcaagtggcacacgatctcgacgatgaactggcctgggtccaggaacgtttaccactggctatgcaaaccgaaagggggaacggattacaggccgtgcagcagcacatcaagaagaaccagggcttaaggagggaaatccaagctcacggaccacggcttgaggaagtgctcgaaagagccggtgcactcgcaagcctgaggagccctgaagccgaggccgtcagaagggggttggagcagctgcaatccgcatgggccggactcagagaggctgcggaaagacgacagcaagtgctagatgcagccttccaggtggagcagtactactttgatgtcgccgaagtggaggcctggcttggagaacaggaattgctgatgatgtccgaagacaaaggaaaggatgaacagtcaactctacagttgctgaaaaagcatctgcagctcgaacaaggcgtagaaaactatgaagagtctattgcccaactgagtaggcaatgccgcgctctgctggaaatggggcatcccgactccgaacagatttctcgtaggcagagtcaagtggatcggctatacgtggccctgaaggaattaggggaggaacgacgagtggctctcgaacagcagtactggctgtatcaactgagcagacaggtgtccgagttggaacattggatagctgagaaagaagtggtggcgggaagccccgaactcggacaagattttgaacacgtttcagtgctgcaggaaaaattctctgagtttgcgtccgagacaggaatggctgggcgtgagcggctcgccgccgtcaaccaaatggtagatgagctcatagagtgtggccatactgcagccgctaccatggctgagtggaaagatgggttaaacgaagcttgggcagagctgctagaattgatgggtacccgcgcccagctcttagcagcttctagggaacttcacaaatttttttcagatgcccgagagcttcagggtcagattgaagagaaaaggcggcggctgccacgactgacgacccccccagaaccacgcccatcagccagctccatgcaaagaacactcagagcctttgaacacgacctccagctcctcgtgagccaagtgcgacagctgcaagagggtgcagcccaattgcggactgtgtacgccggggaacacgcagaagctatagcaagtcgcgagcaggaagtcttgcagggctggaaagaactcttatccgcctgcgaggatgcaaggctgcacgtgtcctccaccgccgacgcgctccgattccacagccaagtcagagaccttttgtcatggatggacggcattgctagtcagataggggccgcggacaagccacgggatgtgagctcagtggaggtgctgatgaactaccatcagggactcaaaaccgagctggaggcccgcgtgcccgaactcacgacctgtcaggaattgggccggagcttgttgttgaacaaaagtgccatggcggacgaaatccaggcccagctggataaactcggaactcggaaggaggaagtgtcagagaagtgggatcgacactgggagtggctgcaacagatgctcgaagtgcatcagttcgcccaggaggcagtagtcgctgacgcttggctcacggcccaagagcccctgttgcaatcaagagaattgggatcgtctgttgacgaggttgaacaacttattcgacgccacgaagccttccggaaggcagctgccgcctgggaagagaggttctcctcccttagacggctgaccaccatagagaagatcaaggccgagcagtccaagcagcctcccactcccctgctcgggaggaaatttttcggtgatccgacagaactcgccgcaaaggctgcacctctgctacgtccaggtgggtacgagagggggttagagccactggcccgccgtgcttctgacactttatctgccgaagtcagaacacgggttggttacgtccgacaagaactaaagcccgagcggctgcagcctagaatcgatcgcctgcctgagattcccggaagggtagaacccgcagcgcttcctgctgcacccgaggatgcagcggagactccggcgaccccagctgcagcagaacaggttcgcccccgaccagagaggcaggagtccgctgatcgggcggaagagctgcctagacgtcggaggccagaacggcaggagagcgtcgatcagagcgaggaagcagctcgcaggcgacgcccagagcgtcaggagtctgccgagcacgaggcggcacacagccttaccctcggtaggtacgaacagatggaacggcgcagagagcggagagagaggcggttagagcggcaggaatcatcagaacaggaaatgccaatccgcggagacttagttaagggcaaggcaactttggcggatatcgttgagcagctgcaggagaaagaagcaggaccaggactgcccgcaggaccttctctgcctcagccaagggagctccccccgggccggctgcctaatggtctggagctgcccgagcgtacaccacgaccagatcgtcctagagccagggatcgacctaagcctagaagaagaccccggccaagagaaggtggagaggggggtggcagtaggcgcagccggtcagcgccagcacagggaggcagcgctccagccccgccccctccaccgacacatacagttcagcacgaaggatttttgctaagaaagagagagcttgacgcaaaccggaaaagcagcaaccggtcttgggtgagtctctattgcgtgctgtcgaagggggagttgggtttttacaaagactcaaaaggtcctgcgagcggctctactcatgggggcgaaccgctgctcagcctccacaaggccacaagcgaggtcgctagcgattataaaaagaagaagcatgtgtttaaattacagacacaggacgggtccgaattcctccttcaggctaaggatgaggaggagatgaatgggtggttggaagcagttgctagctccgtggctgagcacgctgagatcgctagatggggtcagaccctgcccaccactagtagcacagacgagggaaatccaaaaagggaaggaggggataggcgggctagcggcaggcggaagtag

SEQ ID NO: 135916 - DNA, 7695 bp, Artificial Sequence
  Description of Artificial Sequence: Synthetic coding sequence
atggcccaggttcccggagaggtggacaacatggagggcctgcccgccccaaacaataatcccgctgctagatgggaaagccccgaccggggttgggagagagagcagcccgccgccagtacagccgctgcatctctcttcgaatgttcccgaataaaagccctggctgacgagagagaggctgtgcaaaaaaagacttttacgaagtgggtcaattcccacctggctcgcgtcgggtgccacataggggatctttatgtggatctgagagacgggttcgtgcttactaggctcctggaagttctgagcggtgaacaactaccacggccaacgagagggaggatgcggatccactccctggaaaatgtcgacaaagctctgcagtttctgaaagaacagcgggtacatttggaaaatgtcggatcccacgacatcgtggacggcaaccataggttgacactcggacttgtctggacaattatcctgcggtttcagattcaagtcataaagatcgaaaccgaagataaccgggagacacggtcagcgaaggatgcgttattgctatggtgtcagatgaaaactgccggatatcctgaggttaatatccaaaactttaccaccagctggcgagatggtctggcttttaatgccttgatccacaggcataggcctgatctcgtggacttcagcaaattaacaaagtcaaatgcaaactacaaccttcagcgggccttccggactgccgagcagcatctaggattggctcgcctgttggacccagaagatgtgaacatggaggcacccgatgagaaatccatcataacttacgtggtgagtttttatcactacttcagtaaaatgaaggccctcgcggttgagggcaagcgaattgggaaggtgttggaccaggtgctcgaggtgggcaagattattgaacgctatgaggaattagcagccgagcttctcgcttggattcatcgaacggtgggactgatctccaaccagaagttcgccaactcgctctccggggttcagcagcaactgcaagcttttaccgcctactgcacactcgaaaagcccgtaaagtttcaggaaaaagggaacctggaggttctcctcttcagcatccagtccaagctgagagcttgcaacaggaggctgttcgtaccgcgagagggttgcggaatatgggacatcgacaaagcctggggggaactcgagaaggctgagcacgaacgcgaggctgctctgcgcgccgagcttatccgacaggaaaagctggagctgctggcccagcgattcgatcataaggtagcgatgagggaatcttggcttaatgaaaaccagaggcttgttagtcaagataatttcggctatgagcttcctgctgtggaggccgccatgaaaaagcatgaggcaatcgaggccgatatcgccgcgtatgaagaacgggtccagggggtggccgagctggcgcaggccctggccgccgagggatactatgatatccgccgtgtggccgcgcagagagactcagtgctgcgccaatgggctttgctgaccggtctcgttggagctagaagaactcgcctagagcagaacctggcactccaaaaagtgtttcaagagatggtgtatatggtggactggatggaggagatgcaggctcagctgctatccagagagtgtggccagcacctggtggaggccgatgacttgctgcagaaacatggcttgctggaaggagatatcgctgcgcaatccgaacgtgtcgaggcattgaacgccgcagctctgaggttttcccagctccaaggctaccaaccttgtgatccacaggtgatttgcaaccgagtgaaccatgttcacggttgtctcgccgagctgcaggaacaggctgccagacgtagggctgaactcgaggcttccaggagtttgtgggcactcctgcaggagcttgaggaggctgagagttgggccagggataaggaaagactgctggaggccgccggaggcggaggcgccgctggtgccgcgggtgcagcggggacagcagggggagctcacgacttgtccagcaccgcacgactgctggcccagcacaaaattcttcagggcgaactgggagggcgcagggctcttttacaacaagcgctcagatgcggggaggagctggtcgccgcaggaggcgccgtgggtcctggggctgacaccgtgcacctggttggcctggccgagcgggcagccagcgcacgacgtagatggcaacgccttgaagaagcagcggcccggagggagaggaggctccaggaagcccgggccttgcaccagtttggtgcagacttggacggactccttgactggctgagagacgcctatagactcgccgctgcaggtgacttcggacacgacgaagcaagttctaggcgactcgctcgccagcaccgggcgctcaccggtgaggtggaggcccacaggggaccagtctcaggcttgcgccggcagcttgcaactctcggaggggccagcggcgccggtcccctggtcgtggcattgcaggtgcgcgtagtggaagctgagcagctctttgccgaggttacggaggtggccgctctcaggagacagtggcttagagacgcactggccgtgtacagaatgttcggagaggttcacgcttgcgaactgtggatcggggaaaaggaacagtggctattgagtatgcgagtgccggactctctggacgatgtagaggtggtgcaacaccggtttgagtccctggaccaggaaatgaactctctaatgggcagggtgctggatgttaatcacaccgtccaggaattggtggaaggggggcacccctcttccgatgaagtccgcagttgtcaggaccatttaaacagcagatggaaccgaattgtggaactggtagagcagcgaaaagaagagatgtccgcagtgttgctcgtcgaaaaccatgtactggaggtggccgaggtccgtgctcaagtccgcgagaagaggcgcgccgtggagtctgctccacgcgccggtggggcgttgcaatggcgcctgagcgggctggaggcagcgctccaggccctggagcctcgtcaggccgccctgctagaagaagctgctctgttggccgaacgtttcccagcccaggcagccaggctgcaccagggggccgaagagctgggagctgaatggggggccctggcaagcgctgcccaggcctgcggagaagcggtcgcagccgctggtagattgcagagatttctgcatgatctggacgcatttcttgactggcttgtaagggctcaggaagccgccgggggctctgagggtcccctgccaaattcgctggaggaggcagatgccctcttggcacggcacgcagcactcaaagaggaggtcgatcaacgcgaggaggattatgctcggatagtggctgccagcgaagcacttctggccgccgatggcgccgagctggggccaggactcgccttggatgagtggctgccccatctggaactcggatggcacaagctattggggctgtgggaagctcggagggaggccctcgtgcaggcccatatctaccaactcttcttgagggaccttcggcaagctttagtggtcttgagaaaccaggaaatggcactgtccggagccgagcttcctgggacagtagagagtgtggaagaggccctcaaacagcaccgggacttcctaaccaccatggagttgagccagcagaagatgcaggtggccgtgcaggccgcggagggcctcttacgtcaaggaaatatctatggcgagcaggcccaggaggctgttacccggctgttggagaagaatcaggaaaatcagttacgggcccagcaatggatgcaaaagctccatgaccagctggaactgcaacactttctgagagactgtcatgagcttgatggttggattcacgaaaagatgttaatggcacgcgatggtactagagaagataaccacaaactacacaaaagatggttgaggcaccaagcattcatggctgaactcgcccagaataaggaatggcttgagaaaatcgaacgggagggacagcaactgatgcaggagaaaccggaacttgctgcctcagtaaggaaaaagctgggagaaatcagacagtgttgggccgagctcgaatccaccacacaggctaaagcccgccagttgttcgaggcctctaaggctgaccagcttgtgcagtccttcgcagagctagataaaaagctgctgcacatggaatcccagcttcaggacgtagatcccggtggcgacctcgcaactgtgaatagtcagcttaagaagcttcagtcaatggaatcacaggtggaagaatggtatagagaggttggcgaactccaagcccagacagccgctctgcctctggagcctgcatcaaaagaattggtaggggaaaggcagaacgcagtgggagagagattggtacggttactggaacccctgcaagaacgacggagactgttacttgcgtcaaaggagctgcaccaggtggctcacgattggactacgagctgggcctgggtgcaagagaggctccccttagctatgcaaacagagcgaggtaacgggctgcaagctgtccagcagcacatcaagaagaaccagggtctgagacgagaaatccaggctcacggacctcgtttggaagaggtcctggagagggccggagcactggctagcctgaggagccccgaagcagaggccgtacgtagaggactggagcagctccagagcgcctgggctggactcagagaggcagcggagaggaggcagcaagtcttagacgccgcattccaggtggagcagtactatttcgacgtagccgaagtagaagcatggctcggggagcaagagttgctcatgatgtccgaagataaaggcaaggatgagcaatccaccttgcaactcctgaagaagcatcttcagctggaacagggtgtcgagaattacgaggagtcaatcgcacagctgagcaggcaatgtcgcgcccttttggaaatgggacacccggatagcgaacagatcagtaggagacagagtcaggtggataggctttatgtcgctttaaaagagcttggagaggaacgccgcgttgcgctcgagcaacagtactggctgtaccagttaagccgccaagtttcggaactcgagcactggatcgccgaaaaggaggtagtcgcaggcagcccagagctgggccaggatttcgaacatgttagtgtactgcaggagaagtttagcgaattcgccagcgagaccggcatggcaggccgggaaaggcttgctgccgttaatcagatggtcgatgaattaattgaatgtggacataccgcagccgctactatggctgaatggaaagacgggctgaacgaggcatgggccgaactcctcgagctgatgggcacgcgagctcagttgctcgctgctagcagagagctgcataaattttttagtgacgctagagaacttcagggacaaattgaggagaagcgaaggagactaccaaggctaacgacccccccagaaccccgccctagcgctagctctatgcagaggacacttcgagcgtttgagcacgacctccagctccttgtcagtcaagtgcgtcagttgcaggagggggccgcgcagctgagaactgtttacgctggcgaacacgcagaggccatcgcttcaagagagcaggaagtactgcagggatggaaagaactgttatccgcctgtgaggacgcccgactgcatgtgtcaagcacagcagacgctctgagattccatagccaggtgagagacctgctttcgtggatggatggcatagcgtctcagataggagccgccgacaaacctcgagatgtcagctctgtggaagtgctgatgaactaccatcaaggacttaaaaccgaactggaagctcgggtgcctgagctcaccacttgtcaggaactgggcaggagcctgctgctgaacaagtccgcaatggctgatgaaattcaggcccagttggataagctggggaccagaaaggaggaagtctctgaaaagtgggaccgccactgggaatggcttcagcaaatgctagaggtacaccaatttgctcaggaggcagtggtagctgacgcatggctcactgcgcaggagccactgctccaaagtcgcgagcttgggtcttcagtggacgaagtcgaacaactcattagaaggcatgaggcctttcgcaaagctgctgctgcttgggaagaacgtttttcgagcttgagacggctgacaacgatcgaaaagatcaaagcagaacaatcaaagcagccacccacacccctccttggtcggaaatttttcggggacccgaccgagctcgctgcaaaggccgcccccctcctgcggccagggggatatgaaagaggtctggaacccctggctcgacgcgcgtccgatactctcagcgctgaggtccgaaccagagttgggtacgttcgccaggagctaaagccagagaggctgcaacctaggatagacagactcccagagattcctgggcgagtcgaacctgcagcactgcctgccgccccagaagatgctgcagaaaccccagcaacccccgctgctgccgagcaggtgcgcccacgccccgaaagacaggagagcgccgaccgcgcagaagagcttcctagacgcagaaggccagagcgtcaggagtccgttgaccagtcagaagaggccgcacgccgacggagacctgagcgtcaggagagtgctgagcatgaagctgcgcatagcctgacactagggcggtacgagcagatggagaggcgcagggagcgccgggagagaaggctggagcggcaggaatctagtgaacaggaaatgccaatccgtggggacctcgtcaaggggaaggctacccttgcagacatcgttgagcaacttcaggagaaggaggccggccctggccttccagctggaccctcgttaccacagccaagagaactgcctcctggcagactgcctaacggcctagagttgcctgaacggactcctagaccagatagaccaagagccagggatcgtccaaagcctcgacgacgaccacgtccccgggagggaggcgaaggtggtgggagtaggcgcagtcgaagcgcccctgcccaggggggcagtgctcccgcccctcctcccccacctacgcacaccgttcagcatgaaggcttcctgttacggaaacgcgagctggacgctaaccggaaaagctctaaccgctcttgggtgtcgctgtactgcgtcctgtccaagggcgaactgggattctacaaagactctaaaggccccgcctctggtagtacgcatgggggcgagcctctgctgtcgcttcacaaagccaccagcgaagtcgcttcagactataaaaaaaaaaagcacgtctttaagctccaaacccaggacggctccgagttcctcctccaggccaaggatgaggaggagatgaatgggtggctcgaggcggtggcatcatctgtcgcagaacatgccgagatcgccaggtggggacaaaccctgccgaccacctctagcaccgatgaagggaatcctaaaagagaggggggggacagaagggccagcggacgacgaaaatag

SEQ ID NO: 135917 - DNA, 11025 bp, Artificial Sequence
  Description of Artificial Sequence: Synthetic coding sequence
atggctggccagcctcacagcccacgagaactgcttggagccgcaggacatcgctcacgcaggccaagtaccgagctgagagtgcccccttctccctccttaaccatggactcccagtacgaaacggggcacattcgcaagctccaggccagacatatgcaaatgcaagagaagacttttaccaaatggatcaataatgtatttcagtgtgggcaggccggaatcaaaataaggaacctgtatacagagctggccgatggcatccacctgctgcgcctgctggagctgatctctggggaggctttgccacccccctcaaggggacggcttcgagtccactttctcgagaactcatctcgagcgctggcctttttacgggccaaggtaccggttcctctaatcggtcccgaaaatatcgtcgacggggatcagaccctgatacttgggctgatttgggttatcatcttgcggtttcagatttcacacatctccctcgacaaggaagagtttggagcgtctgcagcacttctgtcaaccaaggaggcactgctggtctggtgtcagcgcaagacagcatcatacacgaacgtaaacattacagatttcagtcgctcatggtccgacggcctgggattcaatgcactgattcacgctcaccggcctgatctgcttgactacggctcacttaggcctgacagaccactgcacaatctcgccttcgcatttttggttgccgagcaggagctaggcatcgcccagctcctcgatcctgaggatgtcgccgccgctcagcccgatgaacggtctatcatgacctatgtcagcctctattatcactattgcagccgcctgcatcagggccagacagtgcaacggaggctgaccaagatcctattacagttgcaggaaactgagctattgcagacacagtacgagcagctggtcgcagatctccttcgctggattgcagaaaaacagatgcagttggaggcacgcgatttccccgactcattaccagccatgcgccagctgctggcagcttttactattttccggacgcaggagaaacctcctagacttcagcagagaggtgccgcagaggccctgcttttcagactacagacagctcttcaggcccagaaccgccgaccatttctgcctcacgaaggcctgggccttgccgagttgtcacaatgttgggccggtctggagtgggccgaggccgctcggtcccaggccttacagcagagacttttgcagctccagcgtcttgaaaccctggcccgtagatttcagcacaaagcagccctgcgagaatcattcctgaaagacgctgagcaagtgctcgatcaggcccgcgccccccccgcttctcttgccactgtcgaggccgctgtccagcgtctggggatgctggaagccggcatcctgcctcaggagggccgtttccaggctttggccgagattgctgatattctgaggcaggaacagtaccactcatgggcagacgtggcacgccgccaggaagaagtgaccgtgagatggcaacgattacttcagcatctgcaggggcagcgcaagcaggttgcagacatgcaggcagtcctgtctctcctgcaggaagttgaggcagccagtcatcagctcgaggagttgcaggagcccgccaggtcaaccgcctgcggacaacagcttgcggaggtggtggaactgcttcagaggcacgatcttctggaggcgcaggtctctgcccatggtgcacatgttagccacctggctcagcagactgctgagctcgacagcagtctgggcaccagtgtggaggttcttcaggcgaaagccaggaccctcgcccagctgcaacagtccttggtcgcactcgttagggcccggagagcattactagagcagactctgcagcgcgcggaatttctgaggaattgcgaagaagaagaagcatggttgaaagagtgtgggcaacgggtaggtaatgccgctctaggacgcgacctgagccagatagcaggcgcgctgcaaaaacataaggcgctagaggccgaggtgcacaggcatcaggcagtgtgcgtagatctggtgcggagaggacgagacctctccgcaagacgaccccccactcagccagaccccggcgaacgggctgaggccgtgcagggcggctggcagctgctgcaaactcgcgtggtcgggcgcggggcgcggctgcagactgctctgttggtgctacagtactttgctgatgcggctgaagccgcgagctggctcagggagagacggtcctcccttgagcgcgccagctgcggccaagatcaggccgccgctgagaccctgctacggaggcacgttaggctggagagggtccttagagccttcgctgctgaactgcgcaggcttgaggaacagggaagagccgcgagcgcccgggcttcactttttaccgtgaacagcgccttgtcaccacccggggagtctttgaggaaccccggtccctggtcggaggctagttgccatccaggccctggcgacgcttggaagatggcgctgcccgcagagcccgatcctgatttcgacccaaatacaatcctacagacccaggatcatctgtcccaggactacgagagcctcagagccctggcccagttgagaagagcaagacttgaggaggcgatggcgcttttcggcttttgcagttcatgtggtgagcttcagctctggttagagaagcaaacagtgctcctgcaaagagtacaaccacaggctgatactcttgaggtgatgcagctgaaatatgaaaactttctcactgccctggcagtggggaagggcctgtgggccgaagtttcctctagcgctgagcagctgcggcagaggtatccaggaaattcaactcagattcagcgccagcaagaagagttgtctcagcggtggggccagctggaggccctgaaaagagaaaaggctgtgcagctggcccactcagtagaggtttgctcctttttgcaggaatgcggcccaactcaggtccagttgagagacgtcctgcttcagttagaggcacttcagcctggaagcagcgaagatacttgccatgctctccagctcgcccaaaaaaagacgctagttctggagcgtagagtacatttcctgcaatctgtcgtggtgaaagtagaagagcctggctatgccgagtcccagccactccaggggcaggtggagaccttgcaaggactgctgaaacaggtgcaggaacaagtagcgcagcgcgcccggagacaggctgagacacaggccagacagtcattcttacaggagtctcagcagcttctcttgtgggctgagagtgttcaagctcaactgaggagcaaagaggtctctgtagatgtggcgtctgctcagcggctgctgcgggagcatcaagatttgctggaggagatccacctatggcaggaaagactccagcaactggacgcccagagtcagccaatggcagccctggactgcccggacagccaagaggttccgaatactctccgagtgttaggacaacagggacaggagctgaaggtgctgtgggagcagaggcaacagtggctgcaggaaggactcgaactgcaaaagttcggtcgggaagtcgacgggtttaccgccacatgcgcgaaccatcaagcatggcttcacctggacaacctcggagaagacgtcagggaggccttgagcctgctgcagcaacatcgggaattcggtaggctcctgtctaccctgggacctagggcagaagccctacgtgcacatggagaaaagctggtgcaatctcagcacccagccgcccacaccgtgcgggagcagctacagagcattcaggcgcagtggacacggttacaggggcgcagcgagcagagacgccgccagcttctggcttctctgcagctgcaggagtggaagcaggacgtcgcggaattgatgcaatggatggaggagaaggggctgatggcagctcatgagccatctggcgccagaagaaacattctgcagacgctcaaaaggcatgaagccgctgagtccgaattgctcgctaccagacggcacgtggaagccctgcagcaggtaggccgcgaactgctgagtcgtagaccatgcgggcaggaggacatccagacgaggctccagggcctgcgctccaagtgggaggcactgaatcgcaaaatgaccgagcggggtgacgaactccaacaagctggccagcaagagcagctgctgcggcagcttcaggatgcaaaggagcagcttgagcagctcgagggggctctgcagtcatcagaaaccggccaggatctgcgctctagccagcggctgcaaaaaaggcatcagcagttggaatcggaatctagaactctggcagcaaaaatggccgctctcgccagcatggctcatggaatggctgccagccccgcaattctggaggaaacacagaaacatctgcggagactcgaactgttgcaggggcacttggccataagggggttgcagcttcaggcatctgtcgaattgcaccagttctgtcacctatcaaatatggagcttagctgggtagccgaacacatgcctcacggatctcctacctcttacactgaatgcctcaacggagcacaaagccttcatagaaagcacaaagagctgcaagtcgaagtgaaggcccaccagggacaagtacaacgggtcctgagctccggcaggagcctggccgcaagtggccaccctcaggcccagcatattgtggagcagtgccaagaacttgagggtcactgggccgaactggaaagagcctgcgaggcaagagcccagtgtttgcagcaggccgtaacttttcaacagtatttccttgacgtctccgaactagaaggatgggtggaggaaaaacgaccattggtctccagcagagattacggaagggatgaagccgcgacactccgacttattaataagcaccaggctcttcaggaggagctggctatctactggagttcaatggaagagctggaccagactgctcaaacactcacgggccccgaagttccagagcaacagcgcgtagtgcaggagagacttcgtgaacaactccgggcattacaggaactcgccgcgacccgagaccgcgagttggagggcacactgagattgcacgagttcctgcgcgaggcagaggacctacagggctggctcgcctcgcaaaagcaggcggctaaaggcggcgaatcactgggggaagatcctgagcacgcccttcacctctgcaccaaatttgcaaaattccagcatcaggtggagatgggctctcagcgtgtcgctgcatgccgtctcctggctgagagcctcctggaacgcggccactctgccggtcctatggtaaggcaaagacaacaagatctgcagacggcctggtccgagctctgggagctcacccaggcacggggccacgctctgcgcgatacagagaccaccctgcgggtacacagagacctgttggaggtgctgacccaggtccaagaaaaggcaacttcattgcctaataacgtggctagagacctgtgtggcttggaggcccaattgcgcagtcatcagggactggaacgcgaactggttggaactgagcgtcagcttcaggagctgttggagaccgcaggaagggtgcagaaactctgccctggaccgcaggcccatgctgtccaacagcgccagcaggcggtgactcaggcctgggctgttctgcagcgccgaatggagcagcgcagggcgcaattggaacgggcgagactgttggcacgcttccggacagcagtgcgagactacgcatcctgggctgccagagtacgccaggaccttcaggtcgaggaatcgagccaggagccttcctctggccctctgaaacttagtgcccatcagtggctgcgggctgaacttgaggccagggaaaagttgtggcaacaggctacacaattaggccagcaggctctgctggcagcaggaactccaacaaaggaggtgcaggaagaactccgggccttgcaggaccagagagaccaggtgtaccagacctgggcccgaaagcaggagagactgcaggctgagcaacaggagcagttgtttctgagagagtgtggccgcttggaagagatactcgctgcccaagaggtctctctcaagacctccgctctgggcagctccgttgaggaggtcgagcagttgatacgaaaacacgaggtttttctgaaagtgctcactgctcaggacaagaaagaggccgcattgagggaaaggttgaagactctgcgacggcctcgggtacgggatcgccttcctattctgctacagcgtagaatgcgagtgaaagagctggccgagagtaggggtcatgctctccacgctagcttgctgatggcgagcttcacccaggctgccacacaggccgaggactggattcaggcctgggcgcagcaactgaaggaaccagtccctcctggggacctcagggataaactcaaaccactgctgaaacatcaggccttcgaagcagaagtgcaggcacacgaggaagttatgaccagtgttgcaaagaaaggcgaggccctgctggcacagagtcacccccgggcaggggaagtgagtcaaagactacagggactccgcaagcattgggaagaccttagacaagctatggctctgcgcggccaggaacttgaagatcgccggaatttcctcgagttcctgcagagagtcgacctggctgaggcctggatacaggagaaggaggtcaaaatgaacgtgggggacctaggacaagatttggaacactgcctgcaattgaggagaagattgagggaatttagaggtaattctgccggggataccgtgggcgatgcctgtattcgcagtatctccgacctgtcactgcagctgaaaaatagggaccccgaggaggtaaagatcatttgccagaggcgctcccagctgaataacagatgggcttctttccacggaaacctgttgcggtatcagcaacagctggagggcgcacttgagattcacgtgttgagtcgggagttggataacgtgactaagagaatccaggagaaggaagcactgatccaggcactggattgcgggaaggacctggaaagtgtacaaaggcttcttaggaagcacgaagagctcgagagagaggtccaccccatacaggctcaggtggagagtctggaacgagaggtgggccgtctatgtcaaaggagtcccgaggccgcacacggattgcgccatcgccaacaagaggtagcagaaagttggtggcaacttcggagtagagctcaaaaacgaagggaagctttggacgctctccaccaggcccagaagctgcaggctatgcttcaggagctgttagtatctgctcagaggttgcgggctcaaatggataccagtcccgcgcctcgcagccccgtggaggcccgacgtatgttagaggagcatcaggagtgtaaagccgaactggacagttggaccgatagcatctcgctggcaagatccaccggccagcaacttttgaccgcgggccaccccttttcctctgacatccgacaggttctcgctggattagaacaagagttgtctagtttagaaggagcttggcaggaacatcagttacagctgcaacaggcattagagctccaactatttctcagttccgtggaaaagatggagcgctggctttgttctaaagaggatagcttagcatctgaaggtctgtgggaccccctggctccaatggagcccctgctttggaaacacaaaatgctggagtgggacttggaagtccaagcgggaaagatctcagccctggaggctaccgcccgtgggctgcaccagggaggccaccctgaggcccagagcgccctgggccggtgccaagccatgctgctaagaaaggaggcgcttttccgccaggcgggcacaagacgacacagactggaggagttgaggcaactacaagcattcctacaggactctcaggaagtggccgcttggctgagagagaagaacctcgtcgctctagaggagggactgctagacactgccatgttacccgcccagctgcaaaaacagcagaactttcaagcagagctagatgcatcaatgcatcagcagcaagaattgcaaagggaaggtcagcgtttactccagggaggccatcccgcgtccgaggctatacaggaaaggctggaagaactgggcgctctctggggcgagctgcaggacaattcacagaaaaaggtggcgaaactgcagaaggcctgtgaggctctacgcctgcggcggtcgatggaggaattagagaattggcttgagcctatagaagtggaactccgtgcaccaaccgtggggcaggcccttcccggagtgggcgagctcctcgggacacagcgtgagctggaggccgccgtggataagaaggcaagacaggcagaagccctcttggggcaggcccaagccttcgtccgggaagggcattgcttagctcaagacgtggaagagcaggcacgccggctcctgcaaagattcaaaagtttgagggaacctttacaggagagaagaacagccctggaagcgcgctcgctactgctgaaattttttagggatgctgacgaggagatggcctgggtccaagaaaaattacccctggcagctgcccaggattacggccagtctctgagcgcggtccgccacctccaagaacaacaccagaatctggaatctgaaatgtcttctcacgaagcactgactcgcgtggttcttgggactgggtataagttagtgcaagccggccatttcgcagctcatgaggtggctgcaagagtgcagcagctggagaaggctatggcgcacttaagagccgaagctgcaagaaggcgcctcctgctccaacaagctcaggaagcccagcaattcctgactgaactgctcgaagctggatcttggctcgctgaacgtggtcacgtgctcgattccgaggatatgggccatagcgcagaggctactcaggcgctcctaagaagattagaggcgacaaaaagggatcttgaagcgttctcccctcggattgaacggttgcaacagactgccgccctcctggagtccagaaagaatcctgaaagccctaaggtgttggcccaattacaagcggtcagagaggcccacgccgaacttctgcggcgtgcagaggccagggggcatggcttgcaggaacagctccagcttcatcagctggagcgagagactttgttattagatgcctggctcactacaaaagccgccaccgctgagagccaagattacggccaggatctggagggcgtgaaggttctcgaagagaagtttgatgcattccgaaaggaggttcagtctctgggacaggcaaaagtatacgcgctgcgtaaactggccggcaccctcgagaggggggcacctcggcgctatccacacatccaggcacagcgctcccgcattgaggccgcctgggagcggttagaccaggccatcaaagctcggacggaaaatctcgctgctgctcacgaggtgcatagctttcagcaggccgccgccgaactgcaggggcgaatgcaagagaagacggcgctcatgaaaggcgaagacggcggccattctctgagttccgtccgcactttgcagcaacaacaccgccgactcgagcgagaattagaggccatggagaaagaggtcgctcggttgcagacagaagcgtgccgactgggccagctccatcccgccgcgcccggaggactggccaaagtgcaggaagcctgggccaccttgcaggcaaaagcacaggaaaggggccagtggctggctcaggcagcccaggggcacgcattcctcgggagatgccaagagcttttagcgtgggcgcaggagaggcaggagctggctagctctgaggaactggcggaagatgtggcaggggctgagcagctgttgggacagcacgaagagcttggccaggagattcgagaatgccgcctgcaggcccaggacctccgtcaggagggacagcaactcgtcgacaattctcattttatgagcgctgaggttactgaatgcctgcaggaactggagggccgccttcaggaactggaagaagcctgggccttgcgatggcagaggtgcgccgagtcatggggtctgcagaagttgcgtcagcgactcgagcaagccgaagcttggctcgcttgttgggaaggattgcttcttaaacctgattatggtcatagtgtatccgacgttgagctgctgctgcaccgccaccaggacctggaaaaattgctggccgcccaagaagagaagttcgctcaaatgcagaaaacggagatggagcaggaactgctactccagccccaggagctaaaacctgggagggcagggagctccctcacttccttccaatggcgaccatccggccaccagggcttgggcgcacaacttgccgaaacaagggatccccaggacgccaagggcacaccaacaatggaagggtctttagagtttaagcagcatctccttcctggcggccgacagccatcctccagttcctgggattcgtgccggggtaatttgcaggggtcctctttgtctctttttctcgatgagaggatggccgctgagaaggtggcgtccatcgccctcctggacttgactggagcccgctgcgagcggctcaggggccggcatggccgaaaacacaccttcagcctgcgtcttacatctggagctgaaattctctttgcagctccaagtgaggagcaggccgaaagctggtggagagccctggggtctactgcagcgcagagcttaagtccaaagcttaaggctaaacctgtgagctccctcaatgaatgtacaacgaaggacgcaagaccaggttgcttgttgaggagcgatccatag

SEQ ID NO: 135918 - DNA, 942 bp, Artificial Sequence
  Description of Artificial Sequence: Synthetic coding sequence
atgcggcacaatcagatgtgttgcgagacacccccaaccgtgactgtctacgtcaagtccggcagtaaccgctcacaccagccgaagaagccaattacactcaagcgtcctatctgtaaggacaattggcaggccttcgagaaaaacacacacaacaataataagagcaagcgtccgaagggaccgtgtcttgtgattcagaggcaggatatgaccgcattcttcaaactattcgacgatgacctgatccaggatttcctctggatggactgttgctgtaaaattgccgataaatatctcctcgcaatgaccttcgtatattttaagagagctaaatttactatcagtgagcacaccagaattaacttctttatcgctctgtatctcgcaaatacagtcgaggaggatgaggaggagactaaatacgagattttcccttgggctctggggaagaattggcgcaagctgttccccaactttctgaagctccgggatcagctctgggaccgcattgattacagggcaattgtgtcaaggagatgctgcgaggaggtcatggctatcgcccccacacactatatttggcagagggaaaggtccgtacatcatagcggagccgtgcgcaactataatcgcgacgaagtgcaactcccaagaggcccgagcgctacgcccgtcgactgtagtctatgcgggaaaaaaaggaggtacgtccggctgggcctatcctcttcctcctccctgtcatctcacaccgctggcgtgaccgagaaacatagccaagactcctataacagtctcagcatggacatcattggagaccccagccaagcatatacgggttccgaggtcgtgaatgaccaccagagcaacaagggtaagaaaactaactttctgaaaaaggacaaatccatggagtggtttaccggaagtgaggagtag

SEQ ID NO: 135919 - DNA, 942 bp, Artificial Sequence
  Description of Artificial Sequence: Synthetic coding sequence
atgcgacataatcagatgtgttgtgagactcctcccacggtcaccgtctatgtgaagagcgggagcaaccgatctcaccagcctaagaagcccattacccttaaaaggccgatttgtaaggataattggcaggcgtttgagaagaacacacataacaataataagtcaaaacgccctaaaggtccctgcttggtaattcagaggcaggacatgaccgcctttttcaagctgttcgacgatgatttgatccaggacttcctttggatggactgttgttgtaagatagccgataagtacctcctcgcgatgacgtttgtgtacttcaaaagagcaaaatttaccatcagcgaacatacgcgcattaatttttttattgcactttacctagcaaacacagtcgaagaggacgaggaggagaccaaatatgagatctttccctgggcattgggaaagaactggcggaaactctttcctaatttcctgaagttgcgggatcagctctgggataggattgattatagagccatcgtctcaaggaggtgttgcgaggaagtcatggctatagcccctacacattatatctggcagcgggaaaggtccgtccaccatagcggggcggttcgtaattataatagggatgaagtgcagttgccgcgagggccctccgcaaccccagtggattgttcactctgcggtaagaagcgtcggtacgtgcggcttgggttatcctctagctcctccctgagcagtcatactgcaggggtgacagaaaaacatagccaggactcttataacagtctcagcatggacatcatcggcgatccctctcaggcttatactggcagtgaagttgtcaacgaccaccaatcaaacaagggcaagaaaacaaattttctgaagaaggataagagcatggagtggttcactggaagcgaagaatag

SEQ ID NO: 135920 - DNA, 384 bp, Artificial Sequence
  Description of Artificial Sequence: Synthetic coding sequence
atgagacacaaccagatgtgctgtgagacgcctcccacggttactgtttacgtgaagagtggttctaatcggtcccatcaaccgaagaagcccatcacgcttaaaagaccgatatgtaaggacaactggcaggcttttgaaaaaaacacacacaacaacaacaaatccaagaggcccaagggaccatgccttgtgatccagcggcaggacatgacagcttttttcaaattatttgacgacgacctgattcaggatttcctgtggatggactgttgttgtaaaatcgctgacaaatatctgttagctatgacattcgtgtattttaagagagccaaattcaccatcagcgagcataccaggatcaacttttttatcgccttatag

SEQ ID NO: 135921 - DNA, 882 bp, Artificial Sequence
  Description of Artificial Sequence: Synthetic coding sequence
atgttgtgggctataccggagctcggatccccctgcccgatatcgatctcttacgaaatgtccgactcccaggatcctaccacttcacccgtcgtgaccactcaagtcgaacttggcgggtgcagccgacaaggaggaggtaacggatttctgcgcttcagacagcaccaggaggtgcaagcatttctgtcgctcctggaggatagctttgtgcaggaatttctctctaaagacccttgcttccagatttcggataagtacttgctggctatggtgctggtttatttccagcgagcccacctaaagcttagcgagtacacgcactcctcactgttcttagctctgtatctcgccaatgacatggaagaagatcttgaaggtcctaaatgcgagatttttccctgggccttggggaaagattggtgcctcagggttggcaaattcttgcaccagcgagataaactgtgggctcgcatgggattcagggcggtcgtgtctagacaatgttgtgaagaggtgatggctaaagagccttttcactgggcctggaccagagatcgccggcctcatcatgggggtgtgcagcgcgtgtgtccccaagttccggtgaggttaccaagaggacccggtctttcccccccacactgctctccctgtggtctcccacagcactgctctagccatttactcaagcccgttagctcaaaatgtccgtccctgaccagtgaatgtcatcggccaccatcccagaattacctgtctcgcgtaaagaatgcttgggggggggatttcctcatagtgctaccccctcaaatgcagctggagccaggaacctacagtctgcgcatatttcccaaaccacctgctagacccggtcactag

SEQ ID NO: 135922 - DNA, 1122 bp, Artificial Sequence
  Description of Artificial Sequence: Synthetic coding sequence
atgaacgtggacaagtttttaattgtgtgctaccttaagaaagaagtgtggggctttgagagctattccctgtcagggacaacgtgtttccagtggaattatttcgtatggtctctgcgattctttttttcttgtggttcttccaaatatcacttgactccgctaccaattaaaaaagtagattacccacacaagcgcgggcagaactggggctcgtacgtgcacaattctctgccgcggttcaattgggactatcgatcatgttttcacacctggaagcgcgcctcggataacagggaaagagcctatgagcattcagcatatggacaccacgaacgtgggaccgggggatttgacagaactagacattacgatcaggactactacagagatcccagggagagaacccttcagcacgggctttactatgcctcaaggtctaggtcccctaatcggttcgatgctcatgatccaagatacgagccccgagcaagagaacagttcactctgccatccgttgtgcatagagatatctaccgagacgacataactagggaagtgcggggaaggcggcccgagaggaactatcagcattccaggagtagatcgccgcattcatcacagtcacgaaatcagtcaccacagcgcttggctagtcaagcgtcacggcctacacgctccccaagcggttccgggagccggtctaggtcaagttccagtgactccattagcagctcatcctcaaccagctctgacagtagcgacagtagctcatcctcgagtgatgattcccccgcacgcagcgtgcagtccgccgcagtgccagctcccacttcccaactgctctcatcactcgaaaaggatgagcctaggaagtcctttggaatcaaggtacagaacttacccgtgcgttcaacggatacttccctgaaggacggcctattccacgaattcaaaaaattcggcaaggtgacaagcgtgcagatccacggcaccagcgaggaaaggtacgggctggtgttcttcaggcagcaggaggaccaagaaaaggctctgaccgccagtaaaggaaaactgttctttggtatgcagattgaagtgacggcctggataggcccctag

SEQ ID NO: 135923 - DNA, 10995 bp, Artificial Sequence
  Description of Artificial Sequence: Synthetic coding sequence
atggttagagagactcgccacctatgggtgggcaacttgccagaaaacgtgagagaagagaagataattgaacactttaagagatacggacgtgtagaaagcgtgaaaattctgcctaagcgcggctccgagggaggcgtggctgcattcgtggactttgtggacattaaatctgctcaaaaggcccacaactctgttaacaaaatgggcgatcgcgacctacgcacagattacaacgaacccggtacaatacctagcgcagcaagaggactagacgacacagtatccatcgcctctcggtcgcgggaggtgagtggtttcaggggcggtggggggggccccgcctatggaccacccccatccctccacgcacgagaggggcgttacgaacgacgccttgatggggctagcgacaacagagagcgggcttacgagcactcagcctatgggcatcatgaacggggaaccggaggcttcgaccggaccagacactacgatcaggactactaccgggatcctagagagagaacattgcagcacggcctgtattacgcatcacggagcagatctccaaatcggttcgatgctcacgatcctaggtacgaacctagagcgcgagagcagttcactctgccatcagtggtccatcgcgatatctacagagacgacattacacgggaggtcagaggccgccgaccagagcgcaattatcagcatagcagatccaggtctcctcatagctcccagagcaggaaccagtcaccacagaggcttgcgtcgcaagcatcccgtccaacccgttccccgtcgggctccggcagcaggagccgctctagctccagcgatagtatctcctcgagctcaagtacatcctccgacagctctgattcctcatcctcatcgagcgatgacagtcccgcccgatcagtgcagtcagcagccgtccccgcccccacaagccagcttttaagtagcctggagaaagatgaaccgcgaaagtctttcggaatcaaagttcagaatctccccgtgcgctccacagatacctctttgaaagacgggctgttccatgagtttaaaaagttcggcaaagtgacatcagtccagatccacgggacaagcgaggaacgatacggcctcgtcttctttaggcagcaggaagatcaagagaaggctctcactgcctccaaaggaaaactgttttttggcatgcagattgaggtgacggcttggatcggtccggaaactgagtctgaaaatgagtttcgacctttggatgagagaatcgacgaattccatcccaaagcgacacgtacccttttcatcggaaacctggagaagaccacgacttatcacgatctgagaaacatcttccagagatttggggagatcgttgatattgacattaagaaggtcaacggggtccctcaatatgcctttctgcaatactgtgatatagcgtctgtgtgcaaggccattaagaagatggacggagagtacttggggaacaataggctgaagctggggttcggaaaaagcatgcccaccaattgtgtttggctggatggcttgtcctctaatgtgagcgatcagtacctgacccgtcatttttgtcggtatggcccggtcgtgaaggtggtgtttgataggctgaagggtatggccctcgtgctgtataatgagatcgagtatgcccaagccgctgtaaaggaaacaaaaggccggaaaattggggggaacaaaataaaggtggacttcgctaatcgtgaaagccaactagcattttaccactgtatggagaagagcggccaagatataagggatttttacgaaatgttagcagagagaagagaagagcgcagagcgtcatacgactataaccaagacagaacttattacgaaagcgttcggacacccggcacttaccctgaggactcaaggcgggactacccagcaagaggtcgcgaattttactctgagtgggagacgtatcagggcgactactatgaaagtcgttactatgatgaccctagggagtatcgggactaccgcaatgacccctatgaacaagacattagagagtacagctataggcagcgggaaagagagcgcgagcgagaaagatttgaatccgatagggatcgggatcatgagcgcaggcccatagagcgatcacagtctccagttcatttacgcagaccccagagcccaggagctagcccctcacaggcggagcggctccctagtgattctgagcgcagactctattctcgaagttccgaccgctccggctcctgtagctcgttatctccaccgaggtacgaaaaactcgacaaaagcagactggagcgttacaccaagaatgagaagactgataaggagagaactttcgacccagaaagagtcgaacgcgagcgaagactaatcagaaaggaaaaagtggagaaggataaaaccgacaagcaaaagagaaaaggcaaggtccattcacccagtagccagtctagtgagaccgatcaggaaaacgagagggagcagtcccccgaaaaaccaagatcatgcaataaactctctcgagaaaaagccgacaaggagggaattgctaagaatcgtctagaactcatgccctgtgtcgtgctaacgagggtgaaggagaaagaagggaaagtcatcgatcatacaccagtcgagaaacttaaggctaaactcgataatgatacggtgaaatccagtgccttggaccagaaactccaggtttcccagaccgagcccgctaagagcgacctatctaagttagagtctgttagaatgaaggtccctaaagaaaaaggactgagctctcacgttgaggttgttgagaaagaaggacgtctgaaagcacgtaaacaccttaagcccgagcaaccagccgacggtgtgtctgccgtcgacttagaaaagctcgaagcccgaaaacggcgctttgccgacagcaatttgaaggctgagaaacaaaagcctgaggtgaagaagtcgtcccccgagatggaggatgcgcgagttttgagcaagaagcagcccgacgtaagctccagagaagtaatccttcttagagagggcgaggccgagagaaagcccgttcgaaaggagatactgaagcgagaatcgaagaaaatcaagctggaccggcttaacacagtagctagtcccaaggactgccaagagctcgcttcaatttctgtcggttctggctcgaggccctcatcagacctacaggcaaggctgggcgaactggccggggagagtgtagaaaaccaggaggttcagtcaaagaaacctataccatctaagccccagttgaagcagctccaagttctggacgaccaaggacctgaaagagaagacgtgcgcaagaattattgctcccttcgggacgaaactcccgagcgtaaaagtggccaggagaaatctcacagcgttaacacagaggagaagatcggcatagacatcgaccacacacagagctatcggaaacagatggagcagtcacgccgcaagcaacagatggagatggaaatagctaagagcgaaaagttcggttcaccaaaaaaggatgtggacgaatacgagcggcggtctctagtgcatgaggtgggcaaacctccgcaagatgtcacagacgatagcccaccaagcaagaaaaaacgcatggaccacgtggacttcgacatttgtacgaagcgcgagaggaattatcgcagcagcaggcaaatctcggaagattctgagaggactggggggtcaccatctgtgcggcatggatccttccatgaggacgaagacccaatcggctcccctcgacttctgtcggtgaaaggcagtccgaaggtggacgagaaggtgctgccctactcaaatattacagtcagggaagaatccctcaaattcaacccttacgactcgagtaggcgcgagcagatggcggacatggcgaaaattaaactgagtgtgctcaatagtgaggatgagttaaatcgatgggactcccagatgaagcaggacgccgggagattcgatgtttctttccccaattccattatcaaacgggatagtttgcggaagcgtagcgttcgggatctggaaccaggggaggtgccttctgacagtgacgaagacggggagcacaagagtcatagcccccgagccagcgctctgtatgaatcctccaggttgagttttctgctacgcgatagggaagataagttgcgcgagagagacgagagattatccagcagcctggaacgcaataaattctattctttcgctctggacaaaactatcactcccgataccaaagctttgttggaacgagctaaatcgctctcatccagtcgggaggaaaattggagtttcctcgattgggattcacggttcgcaaattttagaaacaataaggataaagagaaagttgatagcgctccgcggcccatcccttcctggtacatgaaaaaaaagaaaattcgtaccgattctgaaggtaagatggatgataaaaaggaggatcataaggaggaggagcaggagaggcaggagctctttgcgagcaggtttctacacagcagcattttcgagcaggatagtaagagattacagcacttagaaagaaaggaggaggattcagatttcatctccgggcgaatttatggaaaacagacttccgagggcgccaactctacaacagactccatacaggagccagtagtattgtttcattcgaggtttatggagctgacccggatgcagcaaaaagagaaggagaaggatcaaaagcctaaagaggtggagaaacaggaagacactgagaaccatcctaagactcctgaaagcgcacctgaaaacaaagatagtgagttaaagactccaccgagtgtggggccgccctccgtgaccgtggtcaccttagaatctgccccttcagcactcgagaagacaactggcgacaaaactgtcgaggctcccctcgtgactgaagaaaaaactgtggagccggctaccgtgtccgaagaggccaaacctgcctccgagcccgcacctgcacccgtcgagcagctggagcaggtggacctcccgccaggtgctgatcctgacaaagaagccgcaatgatgccagcaggcgtggaagagggatcctccggagaccaaccaccatacctcgacgccaagccacccactcctggggcgtcatttagccaggctgaatccaatgtggatcctgagcccgacagcactcagcccttgtctaaaccagcccagaaaagtgaagaagctaacgaacctaaagcagagaagccagacgccactgctgatgccgagcccgatgccaaccagaaagctgaagccgccccggagagtcagcccccagcctcagaggatttggaagttgatcctcctgtcgcagctaaagacaaaaagcctaacaaaagcaaaaggtctaaaacacccgttcaagccgctgcggtgtccattgttgaaaagcccgtgactcgtaagtcggagcgtatcgatcgtgaaaagctgaagcggtccaactcccctaggggggaggcgcagaaactactagaattgaaaatggaagctgaaaagatcactcggactgcgtctaagaattctgcagcggaccttgaacatcctgagcctagtttacctctctctcggacccggcgtcgcaatgtccgaagcgtgtatgccacaatgggagaccatgaaaaccgttccccagtaaaggagcccgttgagcagccccgcgtgacacgcaagagacttgaacgggagctgcaggaggccgccgccgtccctaccacgccacggaggggacgtccccccaagactcgtagacgcgcggacgaggaggaggagaatgaggctaaggagcccgctgagacacttaaacctccggagggttggcgtagccctagatctcagaagaccgccgctggcggcgggccgcagggaaagaagggtaaaaatgagcccaaagtcgacgccacaagaccagaagccaccactgaggtcggcccacagataggggtcaaggagtcctcaatggaacctaaggctgccgaggaagaggccggctccgaacagaaacgcgaccgcaaagatgcgggaacagataaaaatcctcccgaaacagcaccagtcgaggtggttgaaaaaaaacctgctcccgagaaaaactccaaatctaaacgcgggcgatctcgcaattctcggctggcggtggacaagtccgcctctctgaaaaacgtggatgccgcggtctcacccagaggcgctgccgctcaggcaggagagcgggaatctggcgtggtagctgtgagcccggagaaatccgagagcccacagaaggaggacgggctgtcgagtcagctgaaatctgaccccgtggatcccgacaaggagccagaaaaagaggatgtcagcgcctctggcccatcaccagaggctacccaactggccaaacagatggagctagagcaggccgtcgaacatatcgccaagttggctgaggcttccgccagcgccgcttataaggcagatgctccggagggtctcgcccctgaggaccgagataagcctgcccatcaggcttctgagacagaactggccgccgcaatcgggagcattattaatgacatttccggggagccggagaactttcctgccccgcctccttacccaggcgaatctcagacagacctccaacccccggcgggggcccaggcgttgcaaccaagcgaagaaggaatggagaccgatgaagccgtgtccggtatactggagacagaagctgcaacagaatcgtcaaggcctcccgtgaatgcaccagacccctctgctggcccaaccgatactaaagaagcgcgcgggaacagctccgagacttcccattcagttcctgaggccaagggaagtaaagaggtcgaagtgacgcttgtccgcaaagataaggggcggcagaaaacaaccaggagtcggagaaagagaaacacgaataaaaaggtcgtggcaccggtggaaagtcacgtcccggaaagcaatcaggcccagggcgaaagcccggcagccaacgaaggaacgacagtgcagcatccagaagctccccaggaggagaaacaatccgaaaagccacacagtacgcctccccaaagctgcacttctgatctcagcaagataccatctacagaaaactcctctcaggagatttctgtagaggaacggacgcccaccaaagctagcgtgccgcccgatctgccacctccaccccagccggcccccgttgatgaggagcctcaggcacggttcagagtgcattcaattattgaaagcgacccagtgacgcctccttcggacccatcaatccctatcccaactctcccttccgtgaccgctgcaaagttaagtccacctgtggccagcggtggcattccacatcagagcccgcctacaaaagtcactgagtggattacgagacaggaggagccacgagctcagagcaccccttcccccgccctaccacctgacactaaagctagtgacgtcgatacctcctctagcaccctgcggaaaattctgatggatcctaagtacgtgagcgcaacttctgtgacctctacttctgtgaccactgctatcgccgaaccagttagtgcagctccttgtctgcacgaagccccaccccctccagtcgacagcaaaaagccattggaggagaagaccgctccaccagtaaccaacaattctgagattcaggcttccgaggttctggtggcagctgataaagagaaggttgcccccgtgatagcgccgaagatcacttccgttatttcccgtatgcccgtgtcaatcgacttggaaaactcccaaaaaatcaccctggccaagcccgctcctcagacactaaccggcttggttagtgctctgactggcctggttaacgtgtctttagtgccagtcaacgctttaaaaggtccggtcaaagggtcggtaaccaccctgaaatccctggtaagtacccccgccggaccagtcaatgtcctgaaagggccggtcaatgtcctcaccgggcctgtaaacgtgctgacgacccccgttaatgccacagttgggaccgtcaacgccgcgccgggaacggttaatgcagctgcctccgccgtgaatgcgacagccagcgcggtcactgttacagcaggcgcagtgactgcagccagcggaggcgtcactgctacaaccgggacagtcactatggctggggctgtgatcgcccctagcacaaagtgtaagcagagagcaagtgctaatgagaattctagatttcacccagggtctatgcctgtcatcgacgatcgccctgccgacgctgggtcgggcgccggtttgcgggttaatacatcggaaggtgttgtcttgctgagctactccggacagaagaccgaggggccacagcgcatctcagctaaaatctcccaaataccccctgcatctgcaatggatatcgagtttcagcagagtgtgagtaaatcccaggtcaagcctgacagcgtgaccgccagtcagcccccttccaagggtccccaggctccggcagggtatgccaatgtagctactcatagcactttggtcctgaccgcccaaacctacaatgcctcccccgtaatttccagtgtgaaagcagaccggccatctctcgagaaacccgagcctatccatttgtccgtgtctactcccgtgacccaaggtggcaccgtgaaagtcctgacgcagggcataaacacccctcccgtcctggttcataatcagctcgtcttgacacccagcatagtcactaccaataagaaattagccgacccagtcactttgaagatagagacaaaagtgctgcagccggcgaatttgggcagtactctgacccctcaccacccccctgcccttccgagcaaactgcctactgaagtcaaccatgtcccaagtggccccagcatcccagccgaccgcactgtgtctcatctggcggccgctaagttggacgcgcactcccctagaccatccggacccggaccatcatcttttccgcgtgcctcccatccttcgtcaactgcatccaccgcgttgtcgacaaacgccactgtcatgctggcagctggcatacctgttccccagttcatatcgtccattcaccccgagcagtcagtaatcatgcccccccatagtatcacacaaaccgttagtttgagccacctgtcacagggcgaggtgcggatgaatacccccaccctgccttccattacctacagtatccgcccagaggctcttcactccccccgcgctcctttgcaacctcagcaaattgaggtcagagctccacaaagagcttctaccccacaaccagctcctgccggggtgcctgccctggcgtctcagcatccaccagaggaggaagttcattaccacttgcctgtggctcgagctacggcccccgtgcaaagtgaagttctggtcatgcagtccgagtaccgtcttcacccttataccgtgccgcgtgacgtacgcatcatggtgcacccacatgttacagcagtgtccgagcaaccgcgggcagccgatggggttgtcaaagtgccccccgcaagcaaggctcctcagcagcccgggaaggaggccgcaaagacaccagacgccaaggccgcaccgacaccaactcccgcgccggtgccagttcccgtgcccctgcccgctccagcacccgccccgcatggggaagcccggatcctcacagtgacacctagcaaccagctgcagggtctccccctcacacctcctgttgttgttactcacggggttcagatcgtacactcaagcggagagttgtttcaggagtaccgctatggcgacattagaacatatcaccctccggcacaactcacccatacacagttccccgcggccagcagtgtgggcctcccaagtagaacgaagaccgccgctcaggggccaccccccgaaggcgaacccctgcagcctccccaacccgttcagtctactcagccagctcagcccgcccctccatgccctccgtctcagcttggccagcccggtcagccaccatcttctaagatgcctcaggtatcccaggaagctaaagggacccaaaccggtgtggagcagcctcgactgccagcaggcccggctaatagacctccagaacctcacacccaagtgcagcgcgctcaggccgaaacagggcctacatccttcccaagtcccgtcagcgtgtcaatgaagcctgacctccccgtctccctaccaactcagaccgcacctaagcaacccctcttcgtgcctacaaccagcggtcctagtactcccccaggtttggtcctgccccacactgagtttcaacccgctcccaagcaagactctagcccacatctcaccagccagaggcctgtggacatggtacagctgctgaagaaatatcccattgtgtggcagggtctgcttgccttaaagaatgacactgccgctgtccagctccattttgtctctgggaacaacgtgttggcccaccgtagcctgccactcagcgaaggtggaccccctctaagaatagcccaacggatgcggcttgaggctacccagcttgaaggtgtcgcccgaagaatgacagtggagacagactactgtttgttactcgctcttccctgcggaagggatcaggaggatgtagtttcccagaccgagagtcttaaagcagcgttcatcacgtatctgcaggctaagcaggcggcaggcatcatcaacgtgccaaaccccggaagcaatcaacccgcatatgtgctacaaatcttccctccatgcgagtttagtgagtctcacctttcccgcctggcaccagacttgctggccagtatctcaaacatctcaccgcacttgatgatcgtgattgcttctgtgtag

SEQ ID NO: 135924 - DNA, 1122 bp, Artificial Sequence
  Description of Artificial Sequence: Synthetic coding sequence
atgaacgtggataaatttttaatagtctgttacctgaaaaaagaggtgtggggctttgaatcatactcacttagcggtacaacttgttttcagtggaactatttcgtgtggtccctccgcttttttttctcttgtgggtcctctaagtaccaccttactcccctgcctatcaaaaaagtggactatccacataaaaggggccagaactgggggtcttacgtgcacaactcgttacccagatttaactgggactaccgcagttgctttcatacgtggaagcgcgctagcgacaatcgggaaagggcatatgaacacagcgcttatgggcaccacgagaggggcacaggcggctttgacagaaccagacattacgaccaggattactatcgggatcctcgcgaaagaactctgcaacacggtttatactacgcctctagatcacgttctcctaatagattcgatgcacatgatcctaggtacgagccccgcgcccgggagcagtttactctgccttcagtagtccatcgcgacatctatcgcgatgatattaccagggaggtcagaggaaggcgacctgaacggaactaccagcactctcggtctagatccccacactcctcccagtcccggaatcagagcccccaaaggttagcttcccaagcgtcacggcccaccaggtcgccttccggctccggatcgagaagcaggagctcatccagcgatagtattagctcatcttcgtcgactagctcagattcctccgacagctcatctagctcctcagacgacagccctgcccggagcgtccagtcagccgcggtgcctgcccctaccagtcagctgttgagctctctcgaaaaagatgaaccacgcaagagttttgggattaaggtccaaaacctccccgttagaagcaccgatactagcctcaaagacggcctctttcacgagttcaagaaatttggcaaggtcaccagtgtgcaaattcacgggacctcagaggagcgatacggcctggtgttcttcagacaacaagaggatcaggaaaaagctttaacagcatccaagggcaagctgttcttcgggatgcagatcgaagtgacagcgtggatcgggccttag

SEQ ID NO: 135925 - DNA, 894 bp, Artificial Sequence
  Description of Artificial Sequence: Synthetic coding sequence
tgacaagcatctaggccaactcgtagcccttcagggtcaggtagcagatcccgcagttccagctccgatagtatctcaagtagcagtagcacctcgtcagacagtgattcttcctcctcaagctcagatgactcccccgccagatccgtgcaatctgccgcggtgccagcacctacatctcagctactgtctagcttagagaaagatgaaccacggaagagcttcggtatcaaggtgcagaatctccctgtgcggtcaaccgacacatccctcaaagatggattgttccacgagttcaagaagttcggaaaagtgacaagcgttcagatccacggcacatcggaggaacgctatggactggtgttctttcgacagcaggaagaccaggagaaggccctgacagctagtaaggggaaactgttcttcgggatgcagatagaagtcactgcctggatcggcccagagacagagtccgagaacgaatttagacctcttgatgagaggatcgatgaatttcatcccaaagcgacacggaccctgtttatcggcaacctggagaaaaccacgacctatcatgacctccgcaatatctttcagcgcttcggggaaatagtggacattgacatcaagaaagtcaacggggttccccaatatgcattcttgcagtattgcgatattgcttccgtttgcaaggctataaaaaaaatggacggagagtatctgggaaataaccggctcaagctcggatttggcaagtctatgcccacaaactgtgtctggctggacggactcagttcaaacgtgtccgaccagtatctgaccagacatttctgtagatacgggccagtggtcaaggttgtttttgatcgtcttaagggtatggccctggtctag

SEQ ID NO: 135926 - DNA, 885 bp, Artificial Sequence
  Description of Artificial Sequence: Synthetic coding sequence
atgagtcccagagggaccgggtgctctgctggtctgctcatgaccgtcggttggttgctactggcaggtttacagagtgcacgcgggacaaatgtgactgccgctgtacaggacgcaggcctcgcccatgagggcgagggagaggaagagaccgaaaataatgacagcgaaaccgctgaaaactacgcgcctcccgaaacagaagatgtgagtaaccggaacgttgtgaaagaggtggagttcggtatgtgcacagttacctgcgggatcggggtgcgagaggtgatcctgactaacggctgccccggcggcgagtcaaaatgcgtggtgagagttgaagaatgtcgtggacccacagattgcgggtggggaaagcctatctccgaaagtctggagtctgtgcgcttggcatgcattcacacaagtcccctgaacagattcaagtatatgtggaaactgctcagacaggaccaacaatccataatcctggttaacgactctgctatccttgaggtaaggaaagaaagtcacccccttgccttcgagtgcgatacattggataacaacgagatcgtggctacgataaagtttacggtgtatacttccagcgagctgcagatgaggaggtcatcccttccagcaaccgacgcagctctgatcttcgtactgactatcggagtgataatctgtgtgttcatcattttcctgctcatcttcatcatcatcaattgggcagcagtgaaggctttctggggcgccaaggcatccacacccgaggtgcagagtgagcagagtagcgtgcggtataaagatagcacttccctcgatcagctgcctaccgaaatgccaggggaggatgatgcactttccgaatggaacgaatag

SEQ ID NO: 135927 - DNA, 648 bp, Artificial Sequence
  Description of Artificial Sequence: Synthetic coding sequence
atggtctctgccttaagaggcgctccccttatccgggtgcattccagtcccgtgtcctcaccttcagttagcggccctcgccgactggtgagctgcctcagtagccaatcaagcgctctgtcacagtccggggggggctcgacttccgccgcggggatcgaggctagatctagagcactgcgtagaagatggtgtcccgccggaataatgttgttagcactcgtgtgtcttcttagctgcctcctcccctccagtgaggcgaaactctatgggcggtgcgaactggctcgagtcctgcacgatttcgggttggacggctatcgcgggtactccctggcagattgggtgtgcctcgcatacttcacgtccggttttaatgccgccgcacttgactatgaggctgacggtagtacaaacaacgggatatttcagattaatagccgaagatggtgtagtaatttgactcccaacgtgccaaacgtctgtaggatgtattgctccgacctgctgaatcctaacttaaaggataccgtgatttgcgccatgaaaatcacacaggagccacagggcctggggtactgggaagcctggcgccaccattgtcaggggaaggatctgactgagtgggtggatgggtgcgatttttag

SEQ ID NO: 135928 - DNA, 627 bp, Artificial Sequence
  Description of Artificial Sequence: Synthetic coding sequence
atgatccaggaggaccatgagggaagccaggatggtggagtgcactcctcccccgtcagcagcccctctgtgagtgggcctaggcgactcgtatcttgcctttccagccagagcagtgccttgagccaatccggagggggctccacctctgccgcaggcatagaagcgcgaagtcgggctctcaggcggaggtggtgccctgccggaataatgctcctggcactcgtgtgcctactcagctgcctgcttccatcctcagaggcaaagttatacgggcgctgcgagttagctcgcgtcctgcatgattttggattagacggctataggggatacagcctggctgactgggtctgtcttgcttacttcacgtcaggttttaatgcggctgcgcttgattatgaggcggacggatctaccaataatggaatcttccaaatcaactccagaagatggtgttcgaacctgacccctaatgtccctaatgtctgccggatgtactgcagcgatttgctgaatccgaacttaaaggacacagtgatctgcgcaatgaaaatcactcaggagcctcaaggccttgggtactgggaggcctggcgccatcattgccaggggaaggacctgacatag

SEQ ID NO: 135929 - DNA, 339 bp, Artificial Sequence
  Description of Artificial Sequence: Synthetic coding sequence
atggtgtccgccctacgaggcgccccacttatccgcgtgtgcctggcttacttcacaagcggtttcaacgctgccgccctggactatgaagctgatgggtcaactaacaatggaatctttcaaatcaacagccgacgttggtgtagcaatctaacgcctaatgtcccaaacgtttgccgtatgtactgcagtgacctgctaaatcccaacctcaaagacaccgtaatttgcgcaatgaaaatcacgcaggagccccagggcctgggctattgggaagcctggaggcaccactgccaggggaaggatctgaccgaatgggtggacggctgtgacttttag

SEQ ID NO: 135930 - DNA, 372 bp, Artificial Sequence
  Description of Artificial Sequence: Synthetic coding sequence
atgacaagtggatggaccgacaccggtgataccgcctggctgacagcatacgccctgccttacgctggtgtctgtctggcctactttacatcagggtttaatgccgccgccctggactatgaagctgacggatcaactaacaacggcatcttccagatcaatagccggcgatggtgctctaacctgacgcctaacgttccgaacgtgtgccgaatgtattgttcagaccttcttaatcctaacctcaaggacacagtgatctgcgctatgaagatcacacaggagcctcaaggactgggttactgggaagcttggcgccaccactgccagggcaaggatcttactgaatgggtggatgggtgtgacttctag

SEQ ID NO: 135931 - DNA, 375 bp, Artificial Sequence
  Description of Artificial Sequence: Synthetic coding sequence
atggtgctctgctggctgctcctgttagtaatggccctccctccaggaaccactggagtcaaggattgcgtcttctgtgagctgaccgacagcatgcaatgccctggaacatacatgcactgcggtgacgacgaagattgcttcaccggacatggagtcgccccaggtactggcccagttattaataaggggtgtctgagagctacctcctgtggactggaggaaccagtgtcttatcggggtgtcacatattcactgaccactaactgttgtacgggccgactctgcaaccgggctccttcctctcaaacagttggcgcgaccacaagcctggctctcgggctcggtatgttacttcctccccgcctgctgtag

SEQ ID NO: 135932 - DNA, 480 bp, Artificial Sequence
  Description of Artificial Sequence: Synthetic coding sequence
atgaaagcctggggcaccgtggtagtcacgctggcgaccctgatggttgttaccgtcgatgccaaaatctacgaacggtgtgaattagcagccaggctggagagggcaggccttaatgggtacaaggggtatggggttggagactggctctgcatggctcattacgagagcggcttcgacaccgcctttgtcgaccacaatcctgacggaagctctgagtatggcatttttcagttaaacagcgcttggtggtgtgacaatggaattacccccaccaaaaatctctgccacatggattgccatgacttgctcaataggcatattttggatgatattcggtgcgctaagcaaatcgtgtccagccagaacgggctttcggcctggacatcttggcgcctgcactgttccgggcacgaccttagcgagtggctgaaaggctgtgatatgcacgttaagatcgacccaaagatccacccctag

SEQ ID NO: 135933 - DNA, 480 bp, Artificial Sequence
  Description of Artificial Sequence: Synthetic coding sequence
atgaaagcttggggcacagtggtcgtaactctggctaccctgatggtggtaacagtagatgccaagatctacgagcgctgcgaacttgccgcccggctagagcgagcaggactcaacggttacaaggggtacggtgtcggggattggttgtgtatggctcactatgaaagcggtttcgatacagcctttgtggaccataaccctgacggaagcagtgaatatggcatcttccaattaaactcggcctggtggtgtgacaatggtattacaccgaccaaaaatctgtgtcacatggattgccacgacctgctcaatcgtcacatcttagatgacatccgctgcgcgaagcagatagtgagctcccagaatggactgagcgcctggacgagttggaggttacattgttcaggtcatgatctgtctgaatggctaaaggggtgtgacatgcacgtgaaaattgatcccaaaatccacccgtag

SEQ ID NO: 135934 - DNA, 3207 bp, Artificial Sequence
  Description of Artificial Sequence: Synthetic coding sequence
atgagatctgccgctaagccctggaatccagctattcgtgccggcgggcatgggcccgacagggtgaggcccctcccagctgcctcttctggtatgaagtccagtaaaagttccacatctctggcattcgaatcgcgattgagccgcttaaagcgagcaagcagtgaagatacactaaacaaacccggcagtacagcagcctccggtgtggttcgactgaaaaagactgctacagcgggggctatcagtgaacttactgagtcccggttacggtccgggaccggcgctttcaccacaaccaaacgcaccggtatccccgcccctcgagaattcagcgttactgtgtcaagagaaagatccgtgcctagggggccatctaacccaaggaagagcgtctcctctccaacgagtagcaacactcccacgcccaccaaacatctgaggacaccttccactaagccaaagcaggagaatgaaggcggagaaaaagcagcccttgaaagccaggtgcgtgaactgctggccgaagcgaaagcaaaggattcagagatcaacagattgagatcagagctgaaaaagtacaaagaaaagcgtactttgaatgctgaaggcacagacgcattaggacccaacgtggacggcacaagtgtcagtcctggggataccgagcccatgattcgtgctcttgaagaaaaaaataagaatttccagaaagaactttccgacctggaagaggaaaacagagtcctcaaagagaagcttatctatctagaacactctccaaactcagagggcgccgccagccacactggcgacagcagttgccctaccagcataacacaggagagttccttcggttcgcccacaggtaaccagatgagttcagatattgatgaatacaaaaagaacatccatggcaacgcattaaggactagtggctcctcttcttccgacgtgaccaaagcttctctgagcccagacgcctcggacttcgagcatatcaccgctgagactccaagccgtcctctctcgagcacaagcaatcctttcaagagctcaaaatgttcaacggctggaagctcccctaattcggttagtgagctgtcacttgcctcattgactgaaaagattcagaaaatggaggagaatcatcacagcaccgcagaggaacttcaggcaaccttgcaggagctgagtgatcagcaacagatggtgcaggagcttacagcagagaacgagaaactggtagatgagaaaacaattcttgagactagctttcaccaacacagggagagagccgagcagttgtctcaagagaatgagaagctaatgaacctcctccaggagcgggtcaaaaatgaggaacctacaacccaagaggggaagatcatcgagctggagcagaaatgtaccggaatcctggagcagggacgtttcgaaagagagaagttactgaatatccagcagcaactcacgtgctccttgcgcaaagtcgaggaagaaaatcagggagcacttgagatgataaagagactgaaagaagaaaatgagaaactcaacgagttcctcgaattggagcgccataataataatatgatggctaaaacgttggaggaatgcagagtcaccctggagggcctcaagatggagaacggctctttaaagagtcaccttcaaggtgaaaaacagaaagccaccgaagctagcgctgttgaacagaccgccgagagctgcgaggttcaggaaatgcttaaggtggcaagggccgagaaagatttgcttgagctgagttgtaatgagttgcgacaggagctgttaaaagccaatggtgagatcaagcatgtatcatctctactcgccaaagttgagaaagattactcttacctgaaggaaatttgcgaccatcaagccgagcaactgtctcggacttccttaaaactgcaggaaaaagcatccgaatccgacgccgagattaaggatatgaaagagaccatattcgagctggaggaccaagtggagcagcatcgagccgtcaaactgcataataaccagcttatatctgaattggagagtagtgtgattaagttagaggaacagaaaagcgatctggagcgtcagcttaaaactctcacaaagcagatgaaggaagaaactgaggaatggcgacgatttcaggccgacctacaaactgccgtggttgttgctaatgatattaaatgtgaggcacagcaggagttgaggacggtgaagcgcaagctgctggaggaagaggagaaaaatgcacgcttgcagaaagaactcggagatgtgcaggggcacggccgggttgtaacgtctcgcgcagctcctccgcccgtggacgaggagcctgagagctctgaggtagatgcagccggaagatggcccggcgtgtgcgtctctcggaccagcccaacacctcccgaaagcgccacaacagttaagtctttgatcaaatcctttgacctgggcagaccaggtggagcgggccagaatatttctgtgcataagacccctcgctcgcccttgagcggcattcccgttagaacagccccagccgccgcagtcagccccatgcagcggcactctacatactcttccgtccggcccgcctcccggggtgtgacgcagagactagaccttcccgatttaccactgagtgatatactgaaaggaagaacggagaccctgaagcccgatccacaccttcgtaagtctcccagtttagagagcctgagtagaccacccagcctgggcttcggagacacacggctgctttcagcatccactcgggcatggaagccacagtccaaactgagcgtcgaacggaaggaccctctcgcggctttggctagggagtacggagggagcaaacgaaacgcacttttgaagtggtgccaaaaaaaaactcagggctacgccaacatcgacataaccaacttttcttccagttggtccgacggcctggctttctgtgcgctactccatacatatttgcctgctcacatcccctatcaagagctgaactcccaagagaaaaagagaaatttgctcttagcttttgaggccgcagagtctgtcggcatcaaaccgtctttggagctgagcgaaatgctgtatacagaccgcccggactggcaaagtgttatgcagtatgtggctcaaatctacaagtatttcgaaacgtag

SEQ ID NO: 135935 - DNA, 2112 bp, Artificial Sequence
  Description of Artificial Sequence: Synthetic coding sequence
atgggtaaccactccggccgcccagaggatcctgaacccggagcattcaccaccacaaaaagaacggggattcctgcaccccgagagttcagcgtcaccgtgagccgtgaacggtccgtgcctcgtggacctagcaacccacggaaaagcgtgtcaagcccaacctcttctaatactccaactcccacaaagcacctgcgaacgccatccactaaacccaagcaggagaatgaaggaggcgaaaaggcagctcttgaatcacaagtgcgagagctgctggcagaggccaaagctaaagactctgagataaaccgactgaggtctgagctgaagaaatacaaagaaaagagaacactcaacgcggagggaactgatgcgctggggcccaacgtggacggtacatccgtttcacctggcgataccgaaccaatgatccgcgcactagaagagaaaaacaaaaactttcaaaaggaactgtctgatcttgaagaggagaaccgagtactaaaagagaagctgatataccttgagcactcacctaattctgaaggcgccgcatcgcataccggcgactcgagctgccccacatccatcacacaggagtcctcttttggatctccaactgggaaccagatgtcctccgatattgatgaatataagaaaaacatacacgggaatgccttgaggacgagtggatcaagctcatctgacgtaacaaaggcatctctctcgcctgacgcttctgattttgagcacataaccgctgaaacgccatctcgtccgctgtcgtctacgagcaaccctttcaaaagcagtaagtgctcaacagcaggctcctcacccaacagtgtctcagaactcagtctggcttccctgaccgaaaaaatccagaagatggaggagaaccaccactcaaccgcagaggaactgcaagccacattacaggagctgtccgaccagcaacagatggtgcaagagctcacagctgaaaacgagaagttggtcgacgaaaagaccatcctggaaactagctttcaccaacatcgcgaaagggcagaacagctcagccaggaaaacgagaaattgatgaatttactccaggaaagggtaaagaatgaagagccaaccacccaggaaggcaagatcatcgagcttgagcaaaagtgcactggcatcctggagcaggggcggtttgagcgggaaaagttattgaacattcaacagcagctgacctgtagcctgcggaaagtcgaggaagaaaaccagggggccctggagatgatcaagagattgaaagaggagaatgagaaactgaatgagttcttagagctggaacgccataataataatatgatggcaaaaactctcgaggaatgtagggttacactggaggggctcaagatggaaaacggaagtctgaagtctcacctgcagggtgagaaacagaaagctaccgaagcgtccgccgttgagcagactgcagaatcatgtgaagtgcaggaaatgttgaaagttgctcgcgcagagaaagatttgctggagttgagctgcaacgagttacggcaggaactactcaaagctaacggcgagattaaacacgtgagtagcctgctcgccaaagtggagaaggactactcttaccttaaggagatttgtgaccaccaggcggagcagctaagtaggacaagcctaaagctacaggagaaggcatccgaaagtgatgcagagatcaaggacatgaaggaaactatcttcgaactggaagaccaagtggagcagcaccgcgccgtaaaacttcacaacaaccagctcatttctgagctcgaatcaagtgtcataaaattggaggaacagaagagcgacttggaacgccaactcaagacgcttaccaaacaaatgaaggaagaaacagaggagtggcgacgctttcaggcggatctgcaaaccgccgttgttgtagcaaatgatatcaaatgtgaagctcagcaggagctccgcactgttaagaggaagctcctggaggaggaggaaaaaaacgctagactacagaaagagttgggagatgtacagggtcatggccgagttgtcacaagccgggccgctccaccttag

SEQ ID NO: 135936 - DNA, 2130 bp, Artificial Sequence
  Description of Artificial Sequence: Synthetic coding sequence
atgggaaatcattcagggcgcccagaggacccagagcccggagcgttcaccacaaccaaaagaacaggcattcccgctccccgagagttctccgtgacagtgtctcgagagcgatccgtcccacggggtccctctaacccaaggaaatcggtctctagtcccacctcgagtaacacgcccactcccacaaagcacctccgaacgccctcaactaagccaaaacaagagaacgagggcggggagaaagccgctcttgaatctcaggtacgtgagttactggctgaagctaaagcgaaggacagcgagatcaacaggctcaggagcgaactgaaaaaatacaaagagaagcgaactttaaacgcagaagggaccgatgctctcggtccgaacgtagacgggacctccgtgagccccggcgataccgagcctatgattcgagctctcgaagaaaaaaacaagaactttcaaaaagagcttagtgacttagaagaagagaatcgcgttctcaaagagaagcttatctacctggagcactctcccaactcggagggagcagcttcccatacgggcgactctagctgcccaaccagcatcacacaggaatccagcttcggatctcctacgggcaaccaaatgagcagtgatattgatgagtacaagaagaacatacatggaaatgccctgcggacctcaggatcgtctagttctgacgtgacaaaagccagtctgagcccagacgccagtgatttcgagcacataactgctgagacaccctctagacccctctcatcgacctcaaaccctttcaagtctagcaaatgctctaccgcaggatcttctcccaattccgtgagcgaactcagtctggcctccctgacagagaagatccagaagatggaagaaaaccatcacagcacagctgaggagctgcaagcaactctccaggagttgtccgatcagcaacagatggtccaagagcttaccgccgaaaacgaaaaactagtcgatgaaaaaacgatcctggaaacatcctttcaccagcaccgtgagagagctgaacaactgagccaggagaacgagaagctcatgaacttgctccaggaaagagtcaaaaacgaggaaccgacaactcaggaggggaaaatcatagaactggaacaaaagtgtactgggatcctcgagcagggtcgatttgagagagaaaaactgctcaacattcagcagcaactcacttgcagtctaaggaaagtagaggaagaaaaccagggcgcactagaaatgatcaagagactcaaagaggagaatgagaaacttaatgaattcctagagctggaacgtcataacaacaacatgatggccaagactctggaggagtgccgggtgacactggagggactgaagatggagaacggctccctgaaatcgcatctccagggcgagaagcagaaggcaacagaagccagcgccgtagaacaaacagccgaatcctgcgaagtccaggaaatgcttaaggtggctagagcagagaaggacctgctggagctctcatgcaatgagctccgccaggagctcctgaaagcgaatggcgaaattaaacatgtcagcagtctgcttgcgaaggtggagaaggattattcatacctgaaggaaatctgtgaccatcaggcagagcagctgagtcgcaccagcctgaagttacaggagaaggccagcgagagcgatgccgaaattaaggacatgaaggagaccatctttgaactggaagatcaagtcgagcagcaccgagctgtcaaactccataataatcaactgatctcagaactcgaatcctcggtcatcaagctcgaggaacagaaaagcgatctcgagcgccagctgaagactttaactaaacagatgaaagaggaaacagaagaatggcgcaggttccaggccgatctgcaaacggccgtggtcgtggcgaacgacatcaaatgcgaagcgcagcaggaactgagaacggttaagaggaagttgcttgaagaggaagaaaagaacgccagactgcagaaagagcttggcgacgtccaggggcatggtagagttgtgacgtcccgcgccgcccctccttcactgggatcagtatcttag

SEQ ID NO: 135937 - DNA, 2964 bp, Artificial Sequence
  Description of Artificial Sequence: Synthetic coding sequence
atgggaaaccacagcggacgccctgaagatcccgagccgggggccttcactaccactaagcggaccgggatccctgcccccagggagttttcagtcaccgtttcccgcgaacgctccgtccccagaggtccgagtaaccctcgcaaatccgtttcctcccctaccagctcaaataccccaacaccaacaaaacatctgcgaaccccctccaccaaaccaaagcaagaaaacgaggggggggagaaggctgctctggaatctcaggtgcgcgaactgttggccgaggcaaaagcaaaggattcggagattaataggctgaggagtgagctcaagaagtataaggagaagcggaccctcaatgcagagggcaccgacgcactgggacctaatgttgatggcacctcagtctcacctggggatactgagccgatgatacgggcgctggaagagaaaaacaaaaactttcagaaggaactgtcagacttagaagaggaaaaccgagttttaaaagaaaagctaatttacctggaacacagccctaacagcgaaggcgccgcctctcacaccggagatagttcgtgccctacttcaatcacccaagaatcgagctttggtagtcctacaggcaaccagatgtcaagcgatattgacgaatacaagaagaacattcacggaaacgccctgcgaacctccggaagtagttcaagcgacgtcactaaggccagtctgtccccggacgctagcgactttgaacatatcaccgcagagactccctcacggcccctctcttcaacgagcaatcccttcaaatcctctaagtgttccaccgccggctcttcccctaattctgtctctgaattaagcctagccagcttgacagaaaaaatccaaaaaatggaagaaaatcatcactctactgccgaagagctgcaggctactctccaggagctgagcgaccagcagcaaatggtgcaagaattaacagccgagaatgaaaaactagtggatgaaaagacaattctggagacctccttccatcagcacagggagagggcagagcagctcagccaagaaaacgaaaaacttatgaacctgcttcaggaacgagtgaaaaacgaggagccaacaacacaggaaggcaaaatcatcgaactcgagcagaagtgtactggcattctagagcaagggcggtttgagagggagaagctgttgaatatccagcagcagctgacctgttctttgaggaaagttgaggaggagaatcagggtgccctggagatgatcaaacgtctgaaagaagagaatgaaaagttgaacgagttcctggagctcgagcgtcataacaacaatatgatggccaagactttagaagagtgccgcgttacacttgaggggctgaaaatggagaatgggagtctgaagtcccacctccaaggcgagaaacagaaagctaccgaggcttcagcagtcgaacagacagcggagagctgcgaagtacaagaaatgctcaaagtagctcgggcggagaaagatctgcttgagctgtcctgcaacgaactcagacaggaattactcaaggctaatggagaaatcaagcatgtttcctcactcctggccaaggtggaaaaagattattcttatctcaaagagatctgtgatcaccaggccgagcagcttagcagaacatctctgaagttacaggagaaggcttcggagagcgacgcagagatcaaggatatgaaggagacaatatttgaattggaagatcaggtagaacagcatagagctgtgaagttgcacaataaccagctcatcagtgaacttgagtcgtcagtgatcaagctcgaagagcaaaagtctgacctggagcgccaactcaagaccctcactaagcagatgaaggaagagacagaggagtggagaaggttccaggctgatctgcaaacagcggttgttgtcgccaatgacatcaaatgcgaagctcagcaggaacttcggaccgtcaagcggaagctactcgaggaagaggagaagaacgctagattgcagaaggagctgggagacgtacagggccacggacgcgttgtgacttcacgtgccgcccctccgcctgtggacgaggaaccggaatccagtgaggtcgatgccgccggcagatggccaggcgtgtgcgtctcccgtaccagccccacacctcccgaaagtgccacaactgtcaaatccctcataaaaagttttgatctcggccgtcccgggggggctggtcagaacatctctgtgcacaagacgccgcgctccccactctctggtattccggtccggactgcccctgccgcggctgtgtccccgatgcaaagacattccacctattcgagcgtccgcccagcctctaggggcgttacacagagacttgacctgccagatttgcccctgtctgacatcctgaaaggcagaaccgagactctgaaacccgatccgcatctgagaaagtctccatcattagaatcactgtctagaccgcccagcctcgggttcggagacacacggctactgagcgcttcaacacgagcttggaagcctcaatcgaagctcagcgtggaacgcaaagacccattggccgcccttgccagagaatatgggggttcaaaacgaaatgccctactgaagtggtgccagaaaaaaacccaagggtacgccaatatcgacatcaccaacttttcctcctcatggagcgacgggttagccttctgcgcgctgctgcatacctacctgccagctcatataccataccaagagcttaactcgcaggaaaaaaagcgcaaccttctgctcgcgtttgaggccgctgaaagtgtggggataaagcccagtttggagttgtctgagatgctctacacagatcgacccgattggcagagcgttatgcagtacgtagcacagatctataaatatttcgagacatag

SEQ ID NO: 135938 - DNA, 2373 bp, Artificial Sequence
  Description of Artificial Sequence: Synthetic coding sequence
atgcggtccgcagctaagccctggaaccccgcaattcgcgctgggggtcacggccccgaccgtgtgagaccactgccagccgcatcgagtggcatgaagtcctcaaagagctccaccagcctcgccttcgagtctcggctgtcacgcttgaaaagagccagctccgaagacacattaaacaaacccgggagcactgctgcctccggcgtggtacggctgaagaagacggccaccgccggcgcaatttctgagctgacagagagcagactgcgaagcggcacgggcgcctttaccacaaccaaaaggaccgggattcctgccccacgcgaattctctgtaaccgtgtcgcgggaaagaagcgtgcccagaggcccctccaatccgaggaagagtgtaagttcgccaacttcttccaatacaccaacccctactaaacaccttcgcacaccttcaacgaagccgaagcaggaaaacgaggggggcgagaaggccgctttggagagccaggtaagagagcttctcgcagaggctaaggccaaagactccgaaattaacagattgaggtctgagctgaagaaatacaaagagaagagaaccctgaatgctgaaggcacggacgcgttgggacccaacgtggacggcacctctgtctctcccggggacaccgaacccatgatccgggctctggaggagaaaaataagaacttccagaaagaactgtcggacctggaggaagaaaatcgggtgctgaaagaaaagctcatatacctggaacatagcccaaactcagagggcgccgcatctcacacaggggactccagctgtcccacttcaattacccaggagtcctcttttggaagtcccacaggtaatcaaatgagctcagatattgacgagtataaaaagaatatccatggcaacgccctgagaactagcggctccagtagcagcgatgttacaaaggcctctctgtcccccgacgctagcgactttgaacacatcacagctgagaccccgtcccgtcccctcagttcaacgtcaaacccgtttaaatcaagcaagtgctctaccgccggctcatctcccaattccgtaagcgagttgagcctggcaagcctgaccgaaaagatccagaaaatggaggaaaatcaccatagcaccgccgaagaattacaagctaccttgcaggagctttcagatcaacaacagatggtccaggaactcactgccgaaaacgagaaacttgtggacgagaaaacaatcctggagacaagtttccaccaacatagggagcgcgccgagcaactgtctcaggagaacgagaagcttatgaatctactccaggagcgcgtgaagaacgaagagccgacgacccaggaggggaagataatagaattggaacagaaatgtaccggtattctggagcagggtaggttcgagagagaaaagctgctgaacattcagcagcagcttacctgctcccttcgcaaagttgaagaagagaatcagggagccctggagatgatcaagaggctgaaagaagaaaacgagaaactcaacgagtttttggaactggagcggcacaacaataacatgatggccaaaacactggaggagtgtcgcgtgacactggagggcctgaagatggagaacggctcactgaagagtcacctgcagggcgagaagcagaaggctactgaagcatcagcagtggagcaaacggctgagagctgtgaggtgcaggaaatgctcaaagtcgcccgcgctgaaaaggatctgctggagctgagctgtaatgagttgcggcaggaacttttaaaagccaacggtgaaatcaagcacgtgtccagtctgctggccaaggtcgagaaggactactcctacctcaaggagatttgtgatcaccaggccgaacagctgtcccgaaccagtctcaagctgcaggaaaaggcctccgagtctgatgctgaaataaaggacatgaaagaaacaattttcgaactggaagatcaggtcgaacagcatagggccgttaagcttcacaataaccagctgatctcagaactggagagtagtgtgattaagctggaggaacagaagtccgatttggaacggcagctgaagaccctcaccaagcagatgaaggaggaaacagaagaatggcgcaggtttcaggccgatctgcagaccgccgttgttgtggccaacgatatcaagtgcgaggcccagcaggaactccgcaccgttaagcggaagcttcttgaggaggaggaaaaaaacgccaggctccagaaagagctgggcgatgtgcagggacatggcagagtcgtcactagccgggccgcgcctccgagccttggctcagtgtcgtag

SEQ ID NO: 135939 - DNA, 3090 bp, Artificial Sequence
  Description of Artificial Sequence: Synthetic coding sequence
atgagatctgccgcgaaaccctggaaccctgcaatccgggccggcgggcacgggccagacagggtccgccccctacctgcggcctcctctggaatgaaaagcagtaaatcctccaccagcttagcgtttgaatccagactgtcccgactgaaaagggcctcttcagaagacacactgaataaacctggcagtaccgcagcctccggcgttgtaagactgaagaaaaccgccactgcgggcgccatatccgaattgactgaatcgagactgcgatctggcacgggagcttttaccactaccaagcgcaccggaattcctgcccccagagagttctcagtgaccgttagcagagagcgcagcgtgccccgtggcccttccaaccccagaaaaagcgtgtccagccccacctccagcaatacccccaccccgactaagcacctgcggaccccttcaaccaagcctaaacaggagaatgagggcggtgagaaggccgcactggaatctcaggtcagagagctgctggcagaagcgaaggccaaagactctgagataaacaggctgcgctcggagttgaagaagtataaggaaaagagaacgctgaacgctgaggggacagacgcactcggccctaatgtggacggaacaagcgtcagccccggggataccgagcctatgatccgcgctctggaggagaagaacaaaaacttccagaaggagctcagcgatctggaggaagagaatagagtgttgaaagagaagctgatatacctggagcattcccctaatagcgagggggctgcgagccacaccggggattcaagctgcccgacatcaattacgcaagagagctctttcggctctccaactgggaaccagatgtcaagtgacattgacgagtataagaagaatatccacggcaacgccctcagaacgagcggcagttcctcgagcgacgtgaccaaggcctctctaagtcctgacgcaagcgatttcgagcatatcacggctgagaccccctcccgcccattgtcaagcaccagtaatcctttcaagagcagtaaatgctcaaccgctggctcatcacctaacagtgtatcagagctctccctggccagtctcaccgaaaaaattcagaaaatggaagagaatcaccattcgaccgcagaagagctacaagcgaccctgcaggagctctcagaccaacagcagatggtccaagagcttacggcggaaaatgagaaattggttgatgagaaaaccattcttgaaacaagttttcatcagcacagggagagagcagaacaactgtctcaggagaatgagaagctgatgaacctgctgcaagagagggtgaagaacgaggaacccacaacccaggagggcaaaatcattgaacttgagcagaagtgtacaggaattcttgagcagggacgcttcgagcgcgagaaactccttaacatccagcagcaattaacttgcagcctcagaaaagtggaagaagaaaatcagggcgccttagagatgatcaagcgcctcaaagaggaaaacgagaaacttaacgaattcttggagcttgagcgtcacaataacaatatgatggcaaaaacactggaggagtgtcgcgtcacactggagggattgaagatggagaatggatcgctaaagtctcatctgcagggcgaaaaacagaaagccaccgaggccagtgcagtcgaacaaaccgcagagtcttgcgaagtgcaagaaatgctaaaggtggccagagcggaaaaagatcttttggagctgtcatgcaatgagctccgccaggagctccttaaggctaatggagaaatcaagcatgttagcagtctcctggccaaagttgagaaggactactcctatctgaaggagatttgcgaccaccaggcagagcagctgtcccgaaccagccttaagcttcaggagaaggcatctgagtccgacgccgaaatcaaggatatgaaggagaccatctttgagttagaggaccaagtcgaacagcacagggcagtgaagctgcataataaccagctgattagtgaactggagtcttccgtaataaagcttgaagaacagaagtcagacctcgaaaggcagttaaaaactctgactaaacagatgaaagaggaaaccgaggaatggcgacggttccaggccgacttgcagactgctgtagtcgttgccaacgacatcaaatgtgaggcccagcaggagctgcggactgtgaagagaaagctgttggaggaggaggaaaagaacgcccgcctgcagaaggagctcggggacgttcagggacatggccgggtggtgacctcaagggcggccccaccccccgtcgacgaggagcctgaatcatctgaggtggacgccgccggcagatggccaggcgtctgcgtgtctcgcacatctcctactccccccgaatccgccacgaccgtgaagtcccttattaagagctttgacctcggacggcccggcggagccggacagaatatctccgtccataaaacaccaagatcacccctgtcaggcatacctgtgcggaccgcaccagccgctgcggtgtcacctatgcagagacactccacttattcatctgtgcggcccgcctctcggggtgtgacccagaggctggatctgcccgacttgccactctctgatatccttaagggcaggaccgagactttaaagcctgatcctcatctgcgaaaatcaccgagcctggagtcgctgtccaggccgccctcgttgggctttggcgatacaagactgctgagcgctagcacccgggcctggaaacctcagagcaaactcagcgtggagcggaaggaccccctggctgcacttgctcgagagtacgggggctctaagaggaacgccctcttaaagtggtgtcagaagaagacacaggggtatgctaaaagaaaccttctgcttgcattcgaggcggcagagagtgtaggcatcaagccatcactggaattgtccgagatgctgtacactgacagaccagactggcaatctgtaatgcagtacgttgcacagatctacaaatactttgagacctag

SEQ ID NO: 135940 - DNA, 237 bp, Artificial Sequence
  Description of Artificial Sequence: Synthetic coding sequence
atgcgctctgccgctaagccttggaaccccgccatccgggcaggaggccatgggcctgatcgggttagaccattgcccgctgctagtagcggtatgaagagtagtaagtcatcaacctctctggcatttgaaagccgcttgagccgtctgaagagagccagcagcgaggacactcttaataaacctggctcaactgccgccagcggtgtggtacgcttgaagaagactgctacctag

SEQ ID NO: 135941 - DNA, 1227 bp, Artificial Sequence
  Description of Artificial Sequence: Synthetic coding sequence
atgaaggaaaccatctttgaattggaggatcaggtggagcagcacagagccgtgaagttacataataaccagctcatcagcgagcttgagtcatctgtaatcaagctggaggagcagaaatccgacctagagcgacagctgaagactctcacgaagcagatgaaagaggagacagaagagtggaggcggttccaggctgatttgcagacagccgtggtggtcgccaacgacatcaagtgtgaggcccagcaggagcttaggaccgttaaaagaaagctactggaagaagaagaaaagaatgcgagactgcagaaggaactcggtgatgtgcaaggccacgggagggtcgtgaccagcagagcagccccacctccagtcgacgaggaacccgagagttctgaagtagatgctgctggcaggtggccaggagtctgcgttagccgcacatcacccacaccgcctgaatctgccactacagtgaaatctctgatcaaatcgttcgatctgggaagaccaggcggcgcaggtcagaacatctccgttcataagacaccccgctcacccctcagcggcattcctgtgaggaccgctcccgccgctgcagtatctccgatgcagcggcactctacctactccagtgtgagacctgcttctcgaggcgtcactcagaggctcgatttgcctgacctgcctctgtccgacatacttaaggggcgcactgagacactgaagccagatccgcatttaaggaaatcgccttcgctagaatcactgtcccgccctccttcattgggattcggtgacaccaggcttttgagcgcctctactagggcatggaaaccacagtctaaactatcggtcgagcgcaaggatcccctagcggccttggccagagagtatgggggatcaaagaggaacgcattgctgaagtggtgccagaagaagacacagggatacgctaatatcgatatcaccaacttttctagtagctggagtgatggcctcgccttttgtgctctgctgcacacgtatctgccagcgcacatcccctatcaggagctgaacagccaggaaaagaaaaggaatctgcttctcgcatttgaagcggcggagtctgtcggcattaagccctcgctcgaactgtcagagatgttgtatacagatcggcctgactggcaatctgtcatgcaatacgtggcccagatatataagtactttgaaacctag

SEQ ID NO: 135942 - DNA, 3354 bp, Artificial Sequence
  Description of Artificial Sequence: Synthetic coding sequence
atgaaaaaggccagcaggagcgtgggctccgtacccaaagtgtctgccatttccaagacacagaccgccgagaagatcaaacctgaaaatagtagctctgcatccaccgggggcaagctcgtgaagcctgggaccgcagcttccctaagtaaaacgaaatcatccgacgacctccttgccggcatggcgggaggcgttaccgtaacaaatggcgttaaggggaagaaaagtacatgtcctagtgctgctccgagcgcctccgctccggctatgaccacagtcgaaaacaagtctaagatatcaactgggacggcaagttccactaagcgttccacttccacaggaaataaagagtcttcatctaccagggagaggctacgcgaacggactaggctgaatcagtctaagaagctacctagtgctggacagggagcgaacgatatggccctcgcaaagcgctcccgctctcgcactgccactgagtgcgacgtgaggatgtcaaagtcaaaatcagataaccagataagcgatcgggcggccctcgaggcaaaggtgaaggacttgttaaccctggcaaagacaaaagatgtagagatactgcatctccgcaatgagctacgggatatgagagctcaactagggattaatgaagaccatagcgagggggatgagaaaagtgagaaggagaccattatggcgcaccaacctacagacgtagagtctacactgctccagttgcaggaacagaacaccgccattcgcgaggagttaaaccagctcaaaaacgagaatagaatgttaaaagaccgcctgaatgcccttggctttagccttgagcagcgtctggacaactccgagaagctctttgggtatcagagcctgtctcctgagattacgcctgacaaccaatcagatggcggcggcaccttgacttcttccgttgaggggtcagcgcccggcagcgtcgaagatctgttgagtcaggatgaaaacaccctgatggatcatcaacattcgaattccatggataatctcgactctgagtgctccgaggtgtaccaacccctaacttccagcgacgacgcgctcgatgctccttcaagctcggagtctgagggcatcccttccatcgaaaggtcaagaaagggatcttctgggaacgcgagcgaggtgtctgtcgcttgcctcactgagcgaattcatcagatggaagagaaccagcattctactagcgaagagctgcaagccactctccaggagctggccgatctccagcagatcacacaggagttaaattccgagaatgagagactgggcgaagaaaaagtcattctgatggagtccttatgtcaacaaagtgacaagctagagcatttcagtaggcagatcgagtattttcggtcactactggatgaacatcatatcagttacgtcattgatgaagacgttaaaagtggccggtatatggaactagagcagcgttacatggacctggctgagaacgcccgttttgaacgcgaacagctcctgggggttcagcagcaccttagcaatacacttaagatggccgaacaggataacaaagaagcccaggagatgatcggagcgctgaaagaacgtagtcaccacatggagaggatcatcgagtccgaacagaagggcaaagcggcacttgctgccacgctggaggaatacaaggccaccgttgccagcgatcaaatcgagatgaatagactgaaggctcagctggaaaacgagaagcagaaagtcgctgagctatactctattcataacagcggagataagagcgatatacaggacttactggagagcgttcggttggacaaagaaaaggctgagactctagcctcatccctgcaggaggacttggcccacactagaaacgatgcgaaccgtctccaggatgccatagctaaagttgaagacgagtacagggcctttcaggaagaagccaaaaagcagatcgaagatttgaacatgacgcttgagaaactgcggagcgacctggatgagaaagagactgaacgctcggacatgaaggagacaatcttcgaactcgaagacgaggtggaacagcaccgcgctgtgaagctccatgacaatttaatcatttctgatctggaaaacacagtcaaaaagctgcaggaccagaagcacgacatggagcgagagatcaagacgcttcatcggcgactgagagaagaatccgcagaatggcggcagttccaagcggacctccaaacagccgtagtcattgccaatgatatcaagagcgaagctcaagaagaaataggcgatctgaaacgcagactgcacgaggcccaggagaagaatgaaaagctaacaaaggagctcgaagagatcaagagcaggaaacaggaagaagagagaggccgcgtgtataattacatgaacgcggtggaacgagatctggcagcgctgaggcaaggtatgggactaagtaggcgctcatctacctcctccgaacccacacccaccgtgaaaactctgatcaagagctttgactctgccagccaggtccccaatcccgcagccgctgccattccacggacaccccttagcccatcacccatgaaaacaccgcccgccgccgccgtctcacccatgcagcggcattctatcagtggcccgattagcactagcaaacctcttactgccttatccgacaagcgccctaattacggcgagatccccgtccaggagcatctgctccggacttcctctgcaagcagaccagcatctcttccccgcgtccctgctatggaaagcgccaaaactctgtctgtgagtaggcgttcttccgaggaggtcaagagagatatcagcgcccaggagggggccagcccggcatcactgatggcaatggggaccacaagtcctcaactgtccctcagttcttcccccacagcttcagtgacgccgaccacgaggtcccgaataagggaggagcggaaggaccctctgtccgcgcttgcccgtgaatatggagggagtaaacgcaatgcactgctgaaatggtgccagaagaagacggagggataccagaacatcgatatcactaatttttccagcagctggaacgacggcctggcattttgtgctctgctccacacgtatttgcctgctcatatcccctatcaagagcttaacagccaggataagaggaggaactttatgctcgcttttcaggcagcagagtccgttggcatcaagagcactcttgatatcaacgagatggttaggactgagaggccggattggcagaacgtcatgctatacgttactgctatctataaatattttgagacttag

SEQ ID NO: 135943 - DNA, 2820 bp, Artificial Sequence
  Description of Artificial Sequence: Synthetic coding sequence
gtacctgaagcagtcaggtggggatatttcatccctgagcaatctcaatttgcctgtaagtgtattaccaaacggcagccgcggatgaaaaaggcctcaaggtctgtgggtagcgtgccaaaggtttctgccatcagcaagacccagactgccgagaagattaaacctgagaatagtagctccgcatcaactgggggcaaacttgtgaagccagggaccgccgcctccttatccaagactaaaagttccgacgacctcttagcgggcatggctgggggagtaaccgtgacaaatggagtcaagggcaaaaagtctacatgcccctctgccgccccttccgcatctgccccagctatgaccaccgtggagaacaaaagtaaaatctccacaggaacagccagttcaaccaagaggagtacctccacgggtaataaagagtcctcatccacgcgagagaggcttcgggagcgcaccaggcttaatcagtccaagaaacttccaagtgccggccagggtgctaatgatatggccctggctaagcgttcccgaagccgcaccgctaccgagtgtgacgttagaatgagcaaatctaaaagcgacaatcagatttccgatagagctgcgttagaagctaaggtgaaggatctgctgacactagccaagacaaaggatgtcgagattctccatctgcggaacgaactcagggatatgcgcgctcagctgggcattaatgaggatcacagtgagggagatgaaaaatccgagaaggaaactataatggcccaccagcccacagatgttgagagcacattgctgcagttgcaggagcagaataccgcgatccgtgaggagctaaatcagctgaaaaacgagaacagaatgttaaaagatagactcaatgctctgggattttcccttgagcagcgactagataactccgagaaactttttggctaccagagtctgtccccagaaatcacccccgataaccagagcgatggcgggggtactctaacctcaagcgtggaggggtctgcccctggttctgtggaggacttgctgtcccaagatgaaaatacgctgatggatcatcagcattccaatagcatggataatctcgattctgagtgctcggaggtgtatcaaccactgacctctagcgacgacgctctggacgccccgtctagcagtgaatctgagggaatacccagcatcgagcggtcaaggaagggttcaagtggcaatgccagtgaagtgtccgtggcctgtcttactgagaggatacatcaaatggaagagaatcagcacagcacttccgaggaactgcaggccacacttcaggagctggcagaccttcaacagatcacccaagagctgaacagcgaaaatgaacggttaggcgaggaaaaggtaattttgatggaatctttgtgtcaacagtcagacaaattagagcactttagtagacagatcgagtacttccgctctctgttagatgaacaccatatctcctacgtgatcgatgaggatgttaaaagcgggagatatatggaactggaacagcgttatatggatctggcggagaacgcgaggtttgaacgggaacagctattaggggtgcagcagcatctgtccaatacgctcaagatggcagagcaagataacaaggaggcgcaggaaatgatcggcgctctgaaggagaggagtcatcacatggaacgcataatcgaaagcgagcagaagggtaaggctgctctggctgctacgctcgaggagtataaagccaccgtggcctcagaccaaattgagatgaatcgcctgaaggcccagctcgagaacgagaagcagaaggtggcggagctctacagcattcacaactctggagataagagtgacatccaggacttgctggagtccgtgcggctggataaggaaaaggctgagacgctggcctcctccctgcaagaagaccttgctcatactcgtaatgacgcaaataggctacaggacgcaatcgctaaagtggaggatgaatatcgagcttttcaggaggaagcaaagaagcagattgaagatctaaacatgaccttggagaaattaaggtccgacctggacgagaaagaaactgagcggagcgacatgaaggaaacgatctttgagctggaggatgaggtcgaacagcatcgggccgtcaaattgcatgataatctcataatctcagatctcgagaataccgtcaagaagctgcaagatcaaaagcacgacatggagagggagataaagacactacaccgtcggctgagggaggagagtgctgagtggagacaattccaggccgacctccagactgcggtggtgattgcgaacgatataaagagtgaggcgcaggaagagatcggggacctcaagcgccgcctgcacgaagcccaggaaaaaaacgaaaagctgacaaaggaattagaagagatcaagagtagaaagcaggaggaggaaaggggtcgggtgtataattacatgaacgccgtggaaagggacctggcagccctgcgacagggcatgggcctatcccggcggtcaagtaccagtagtgagccaacccccaccgtcaaaaccctgattaagtcattcgattctgccagtcaggttccaaatcctgccgctgccgctattcccagaacacctctgtccccctctcctatgaaaacaccgccggcagccgccgtgtcacctatgcagatggagtccagctcagtggcccatgcagggatgcaatggcgtgatcttggaagtctccagcctctccccccaggatttaaatag

SEQ ID NO: 135944 - DNA, 2370 bp, Artificial Sequence
  Description of Artificial Sequence: Synthetic coding sequence
atgaagaaagcttcccgctcagttggctcggttcccaaagtaagcgcgatttcaaagactcaaacagctgaaaagatcaagcccgaaaattcaagctccgctagcaccgggggcaaactcgtgaaacctggtaccgcagcgtcactatctaaaaccaaaagcagtgacgacctactcgccggcatggctggaggggtgaccgtcaccaacggagtgaaaggaaagaagagcacatgtccgtctgctgctccgagtgcctctgctcctgccatgaccactgtggaaaataagtctaagatctctaccgggaccgcctccagcacgaaacggtccaccagcacgggtaacaaagagagcagctcaaccagggaaagactcagggagaggacacggctgaatcaatctaaaaagctgccctctgctgggcaaggagccaacgacatggctctggccaagcgctcccggagccggaccgccacggagtgcgatgttagaatgtccaagtctaaatcggataatcaaattagcgatagagccgccttagaagccaaagtgaaagatctactgaccttggcaaagaccaaagacgtggagatcctgcacctcaggaacgagttgcgcgacatgcgcgcacaacttggtattaatgaggaccattcagaaggcgatgaaaaatcggaaaaagagaccattatggcccatcaacccacagacgtcgaatctactcttttacaactccaagagcaaaacacagcgatccgagaggagcttaaccaacttaagaacgagaatcggatgctgaaggatcgcctgaatgcgttgggcttcagtttggagcaaaggctggacaattcagagaagctgttcggctatcagtcactgtctcccgagatcacaccagataatcagtccgacgggggggggacactgacctcatccgtggagggcagcgcccccggcagtgtggaggacctcctctcgcaggatgagaacaccctgatggaccatcagcatagtaacagtatggataacctggactcagagtgctctgaggtttatcagccgctgacctctagcgacgacgcactcgacgcaccatcatcctcggagtcggagggtatcccttccatcgaacggtctaggaaagggtcttccggaaatgctagcgaggtgtctgtcgcctgcctgactgagagaattcatcagatggaggaaaaccagcacagcactagtgaagagctgcaggcaaccttgcaagaattagcagacttacaacagatcacacaagagcttaactcagagaacgagagactgggagaggagaaggtgatcctcatggaaagcctgtgccagcagagtgataaacttgagcacttctctcgacagattgagtatttcaggagcttattggatgaacaccatatcagttatgtcattgacgaggatgtcaagagtggacgatatatggagttggagcagcgctacatggatttggcagagaatgcccgcttcgagagggaacaactgcttggggttcagcaacatctgagcaatacccttaagatggcggaacaggataacaaggaggcacaagaaatgattggcgcattaaaagaaaggtcgcaccacatggagagaatcatagagagcgaacaaaagggaaaggcagccctggcagcgacactcgaagagtacaaagctacagtggcttcggatcaaatcgaaatgaatagactcaaggcacagctggagaacgagaagcagaaggtggccgagctctacagcatacataactccggcgacaaaagcgatatccaggaccttttggagtcagttaggctggataaagaaaaggccgagacgctcgctagtagcttgcaggaagatctcgctcatacgaggaatgacgcgaacaggcttcaggacgctattgctaaggttgaggacgagtatagagcatttcaggaagaagcaaagaagcagatcgaagacctgaacatgaccctagagaaactcaggtctgatttagatgaaaaagagactgaaaggtctgacatgaaggagaccatcttcgagttagaggatgaagtggaacagcatagagccgtgaagctgcatgacaatctcattatcagtgacctcgagaacacagttaagaaacttcaggatcagaagcacgatatggaacgggagatcaaaaccttgcatcgccggcttcgggaggaaagcgcggaatggcgccagttccaagctgatctccagactgccgtggtgatcgcaaatgatatcaagtctgaagcacaggaagagataggcgatctcaaacgcaggctccacgaggcgcaggaaaaaaatgagaagctgacatag

SEQ ID NO: 135945 - DNA, 3354 bp, Artificial Sequence
  Description of Artificial Sequence: Synthetic coding sequence
atgaagaaagcgtctcggagtgtgggttctgttcccaaggtcagcgctatcagcaaaacacaaaccgcagaaaaaatcaagccggagaacagcagcagcgctagcacaggaggtaagcttgtgaaacccgggaccgcggcaagtctgagcaagaccaaaagttccgacgaccttttggccggaatggccggaggggtaaccgtcacaaatggggtgaaaggcaaaaagtcaacatgtccatccgccgctccaagtgctagtgctcctgctatgacgaccgtggagaacaaaagcaagatctccactgggactgcaagctccacaaaacgctctacaagtactggtaataaggagtcttcttctactcgggagcgtctccgcgagaggacccggctgaatcaatccaaaaagcttccttcagccgggcagggcgccaatgatatggccctcgcgaaacggtcaagatctcgtacagccaccgagtgtgatgtgcgaatgtctaagtcaaagtccgacaatcagatctccgatagagccgccctggaagctaaggtgaaggaccttttgaccttagcaaagactaaggacgtcgaaatcctgcacctgagaaatgaattacgcgacatgcgcgcccaactgggcattaacgaggaccactcagagggtgacgaaaagagcgagaaagaaacgataatggcacaccaacccaccgatgtagagagcactctgttgcagttacaagagcagaacactgccataagggaagaattgaaccaactcaaaaatgagaaccggatgctcaaggataggttgaacgccctggggtttagcctggagcagcggctagacaactccgagaagctgtttgggtaccagtcactgagtccggagatcaccccggataaccagtcagatggtggggggactctgacaagttcagttgaggggtccgctcctggatccgttgaagatctgttgagtcaggacgaaaataccctcatggatcaccagcactcaaacagcatggataacttggactccgagtgtagcgaagtgtaccaaccactaacatcttctgacgatgcactcgacgccccatctagtagcgagagcgagggtataccctcgattgagcgctccaggaagggtagctccggcaacgcatcggaagtgagcgtcgcgtgcctcactgagagaatacaccagatggaagaaaaccagcatagcacatcagaagaactccaggcgaccctacaagaacttgcagatctccaacagattactcaggagctcaactccgagaacgagcggctaggcgaggaaaaggtgattctcatggagagcctgtgccagcagagcgacaagctggagcacttttcacggcaaattgaatactttcgttccctgttggatgagcatcatatcagctacgtgattgacgaggatgtgaagtcaggacggtacatggagctggagcagaggtacatggatcttgccgaaaatgctcgatttgaaagagagcagctattgggcgtccagcagcatctgtcaaatacactgaaaatggccgaacaggacaataaggaagcccaagaaatgataggcgcgctgaaggagagatcacaccacatggagcgcattatcgaaagtgagcagaagggaaaagcagctctggcagcaactcttgaggaatacaaggccaccgtggcctcagatcagatcgagatgaataggttaaaggcccagctggagaacgagaagcaaaaagttgccgagctgtactctatacacaacagtggggataaatcagacatccaagacttactggaatcagtacgactggacaaagagaaggctgagacgctggccagctccctacaggaagatctcgcccatactagaaatgacgccaatcgactccaggacgccatagcaaaagtagaagacgagtatagggctttccaggaggaagccaagaagcaaatcgaagatctgaacatgacacttgagaaacttcgatccgaccttgacgaaaaggaaactgagaggtccgatatgaaggaaacaatttttgaactcgaggatgaggtggagcaacacagggcagtgaagctacacgacaacctaattatctctgacctggaaaatactgtgaaaaagttacaagaccaaaagcacgatatggaacgtgagattaaaacactccacagaaggctaagggaggaaagcgcagagtggagacagttccaggcagacctgcagacagcagtcgtaatcgccaatgatatcaagagcgaagcccaggaggagatcggcgacctgaaacggcggctgcatgaggcccaggaaaagaatgagaagttgacaaaagagcttgaagaaattaagagtcggaaacaggaggaagagcggggaagagtgtacaactacatgaacgccgtggaacgggatctcgctgctctccggcaggggatggggctgagccgtcggtcctctaccagcagtgagccaacacctaccgtgaagacattaattaaaagttttgattccgcctctcaagtgccaaaccccgctgctgccgcaatcccgaggacgcccctgtccccatcacctatgaagaccccacctgctgctgccgtgtcgccaatgcaaaggcacagcatcagtggacccatctctactagcaagccactgaccgccctcagcgacaaacgtcctaactatggggaaattcccgttcaggagcacctgcttaggacctccagtgcttctaggcctgcctccctgccccgggtcccagccatggaatccgctaaaacccttagcgtgtcaagaagatcttctgaagaggtcaagcgggatatcagcgcgcaggagggggctagtcctgcttctctgatggctatgggtactacgtccccacagctgtccctctcaagttcacccacagcatctgtcaccccgactacccgctccagaattagagaagaaaggaaggatcccctgtcagcacttgctagggagtacggcgggtcgaaaagaaacgctctccttaaatggtgccagaaaaaaacggaaggatatcagaacattgacatcaccaacttttcatccagctggaacgacggcctcgccttctgtgccttgctccatacatatctgccggcccacattccataccaggaattgaacagtcaggataaaaggcgcaatttcatgctggcctttcaggcagccgaatctgttgggattaagtctacattggatattaacgagatggtgcgcaccgagagacctgactggcagaacgttatgctgtatgtgactgccatctacaaatatttcgagacatag

SEQ ID NO: 135946 - DNA, 3237 bp, Artificial Sequence
  Description of Artificial Sequence: Synthetic coding sequence
atgaaaaaggccagtagatccgtaggatctgtccctaaggtgtccgccatttctaagacccaaaccgccgagaagatcaagcctgagaacagcagcagcgctagcacaggtggaaagctcgtgaaaccggggactgccgccagtctcagcaaaaccaaatcctctgacgacttgcttgccggcatggctggaggggtgaccgtcaccaatggtgttaagggaaaaaaatcaacatgcccatcagccgcacccagcgcaagtgctcccgccatgaccacagtggaaaacaagtccaagatttccaccggcactgcctcctccactaagcggagcacctctactgggaacaaggagagttctagtacacgcgagagattgcgtgaaaggacccggctaaaccagagcaagaagcttccaagcgcaggccagggggcgaatgacatggcgctggcgaaacgcagccgcagtaggacagccacggaatgcgacgtgcggatgagcaagagcaagtctgacaatcagatcagcgatcgggcagccctggaagcaaaggttaaggatctgttgaccctggctaaaacaaaagatgtggagatcctgcacctgcggaatgagttgagggatatgagggcccagctgggaattaacgaggaccattcggagggagacgagaaatcagagaaggagactataatggcacaccaaccaacagatgttgaatctaccttgttgcaactgcaagagcagaacactgctatccgagaggagctcaaccagttgaaaaacgagaaccggatgctgaaggataggttgaatgccttgggcttttccctcgaacagagactggacaactccgagaaactatttggataccagtccctgtctccagagatcacacccgataatcagagcgacggcggcggaacactgacctcatctgtggagggcagcgcaccaggctcggtcgaggatctgctgtctcaagatgagaacactctgatggatcaccagcattcaaacagcatggacaatttggatagcgaatgctccgaagtgtatcagcctctgacaagcagcgacgatgcacttgatgcccccagctcttccgagtcagaagggattccaagtatcgagagatctagaaagggttcatcgggaaacgcctcagaggttagcgtggcgtgtctgaccgagaggatccaccagatggaagaaaatcaacactctacaagcgaagagctgcaggccaccctccaggaactggccgacctacagcaaattacccaagagctgaatagtgagaatgagcgcctcggggaggagaaggtcatcctgatggagtccctgtgtcaacagtccgacaaattggagcacttttcacgccagattgagtattttagaagccttctggacgaacaccacatatcctatgtaattgatgaagatgtcaagtccgggagatatatggaattagagcagaggtacatggacttggctgaaaacgcccggttcgagcgtgagcagctcttaggggtccaacagcatttgtcaaataccttgaagatggctgagcaggataacaaagaggctcaggagatgattggcgccctcaaggagaggagtcaccatatggagcggataattgaatccgaacagaagggaaaagctgccttagcggcaacccttgaggagtacaaagccactgtggctagcgaccaaattgagatgaaccggttaaaggcgcaattggagaatgagaagcagaaggttgccgagctatacagcatccataattcaggtgacaagagcgatattcaagacctcctagagtcagtgagactcgataaggagaaagcagagactctggcgagcagcctgcaagaggacctggcccacaccaggaacgatgcaaatcggctccaggatgccatcgctaaggttgaggacgagtaccgcgcatttcaggaggaggccaagaagcagatcgaggaccttaatatgacacttgagaagctgagatccgatctagatgagaaggagactgagcgatccgacatgaaagagacaatctttgaacttgaggacgaggtcgaacagcaccgcgctgtgaagctacacgacaatttaatcatctcagatcttgagaacaccgtcaagaaactgcaagaccagaagcacgacatggaacgcgaaataaaaacattgcatcgcagattgcgggaggagagcgctgaatggaggcagttccaggccgatctccagactgccgtagtgattgctaacgacattaagtcagaagcccaggaggagattggagatctgaagcgaagactgcatgaggcccaggagaaaaacgaaaaactcaccaaggaacttgaggagatcaagtctagaaagcaagaagaggaaagaggcagagtgtacaactacatgaatgccgtagagagggacttggcagccctcagacaggggatgggtctgtctagacgaagcagcacgagcagcgaaccaaccccaacagtgaagactttgattaagtcgttcgacagtgcttctcaggtccccaaccctgctgccgccgctattccaaggactcccctgagcccatctcctatgaagactcctcccgcagccgctgtgagccctatgcagcgccattctatcagtgggcctatttcaaccagcaaacccctgaccgccctcagtgataagcggcccaattatggcgagattcctgtacaggagcatctcctgagaaccagcagtgcctctaggcctgcctcactgcctagagtgccggccatggagtccgctaagacattgtcagtgtcaaggcgctccagcgaggaagtgaaacgggacatctctgcccaggaaggcgcttctcccgcctctttgatggctatgggcaccactagccctcagctgtcactgtcttctagccccacggccagtgtcacccccacaacaaggagcagaatcagagaagagagaaaagaccctctcagcgcacttgcaagagagtacggcggcagtaagcgcaacgcactcctgaagtggtgccaaaaaaagacagaaggctaccagagacgcaactttatgctggcgtttcaagcagccgagtcagttgggattaagagcaccttggatatcaacgagatggttcgcacggaacggccagactggcagaatgtcatgctatacgtcacagcaatttataagtactttgaaacatag

SEQ ID NO: 135947 - DNA, 2781 bp, Artificial Sequence
  Description of Artificial Sequence: Synthetic coding sequence
atgactacgaaagattacccctccctgtgggggttcggcaccacgaagacatttaagattcctattgagcatctggattttaagtatattgaaaagtgctcagacgtgaaacacctagagaagatcctgtgcgtgttgaggtctggcgaggaggggtactaccctgaactgactgagttctgtgaaaaacaccttcaggccttagctcctgagagcagggcccttagaaaggacaagccggccgcaacggcagcgagcttcactgccgaagagtgggaaaaaatagacggcgatattaagtcatgggtgagcgagattaaaaaagaggaggataagatgcacttccacgaaacagagaccttcccagctatgaaggataacctaccacctgtgcgcggtagcaacagttgcctgcatgtcggcaaggagaaatatagcaaaaggcctactaagaaaaagacaccacgagattatgctgagtgggacaagtttgatgtagaaaaggagtgtcttaaaatcgatgaagattacaaagagaaaacagttatcgacaagagccatctgagtaagatagagacccgtatcgacaccgccggactcaccgaaaaagagaaagactttctggctacccgggaaaaggaaaagggcaatgaggcattcaatagtggcgattacgaggaagcggtcatgtactatacccggagcatctcagcgctgcccaccgtcgtcgcttacaacaacagagcacaggctgagatcaaactgcaaaattggaacagcgcctttcaagactgtgagaaagtcctcgagctggaacccgggaacgtgaaggccttgcttcgcagagcaactacctacaagcaccaaaataaattgagagaggcaactgaggacctgtctaaggtgctggacgtcgagcctgataatgacctggcaaaaaaaacgctctctgaagtggaacgagatttgaaaaactcagaagcagccagcgagactcagacgaaggggaaaagaatggtgattcaagagatcgaaaactctgaggatgaagaggggaagtctgggcgaaaacacgaagacggaggcggcgacaaaaagcctgccgagcctgctggtgccgcaagagccgcccagccttgtgttatgggcaacatccaaaaaaagctaactggtaaggccgagggaggtaaacggcccgcccggggtgccccccaaagggggcagactccagaggcaggagcagacaaacgcagtccaaggcgcgcgtctgctgcagcagcagcaggcggcggcgctactggacaccctggaggcgggcaaggggcagagaacccagctggactgaaatctcaggggaacgagctcttccggtcgggacagtttgccgaggccgcggggaagtacagtgcagcaatcgctcttcttgagccagccggatcagaaatcgccgacgacctatccatattgtacagtaacagggcggcttgttatcttaaggagggcaattgtagcggctgtattcaagactgcaatcgagcacttgaattacacccgttctctatgaagccgctgcttcgacgcgcgatggcatacgaaactttggagcaatatggcaaggcctatgtcgactacaaaaccgtgctgcagatagactgcgggttacagctcgcgaacgatagtgttaatcgacttagtcgtattctcatggagctggacggaccgaactggagggagaaactatcccccatacccgctgtgcccgccagtgtgcccctgcaggcttggcacccggccaaagaaatgatttccaagcaggcaggcgatagctcttcgcaccgccagcagggcataacagatgaaaagaccttcaaggccctaaaggaagaggggaaccagtgcgtaaatgacaagaactacaaggatgcgctgagcaaatatagcgagtgtctgaaaatcaacaataaggagtgtgcaatctacaccaatagggccttatgttatttgaaactttgtcaatttgaggaggccaagcaagattgcgatcaggccctacaacttgcagacgggaacgtaaaggccttctaccgccgggctctggcccacaagggccttaagaactatcagaaatctttgatcgatctgaataaggtcatcctgctggatcctagcatcattgaagcaaaaatggagttggaagaggtgactcggctcctcaatcttaaggacaagacggccccatttaacaaagagaaagagaggaggaagatagagatccaggaggtcaatgaaggcaaggaagagccggggcgcccagctggcgaagtttccatgggctgcctcgctagtgagaaaggaggaaaaagttctagatccccggaggacccagaaaagttgccaattgcaaaacctaataatgcttacgagttcggacagatcatcaacgccctcagcacccgcaaggataaagaggcctgcgcacacttattggccattacggctccaaaggatcttcccatgttcctgagtaacaaattagaaggggacacattcctgttactcatccagtcactgaagaacaatctgatagagaaagacccctcactggtctaccagcacctgctttacctgagcaaagccgaaaggttcaagatgatgctcaccctcatctctaagggtcagaaagaactcatagaacagctcttcgaagacctgtccgacacgccgaacaatcatttcaccctggaggacatacaagccctgaaaaggcagtatgagttgtag

SEQ ID NO: 135948 - DNA, 2781 bp, Artificial Sequence
  Description of Artificial Sequence: Synthetic coding sequence
atgacaacaaaagactaccctagtctgtggggttttgggaccaccaaaacctttaagatacctattgagcatctagactttaaatatatcgaaaagtgtagtgatgtgaagcacctggagaagatcttatgcgtgctgagatctggtgaggaaggatattatcccgaactaacggagttctgcgaaaagcacctgcaggcactagcccccgagtcccgagcgctgcgcaaagacaagccagctgccacggccgcgtcttttaccgcagaagagtgggaaaagatcgatggggatataaagtcctgggtatccgagatcaaaaaggaagaggacaaaatgcatttccacgagacggaaacgttcccagcaatgaaggataatctgcctcccgtgcgagggtcaaatagttgtttacacgtgggaaaggagaagtactctaaaagaccaacaaagaagaaaactccacgagactacgccgagtgggacaaattcgatgtggagaaggagtgcctaaagatcgacgaagattacaaggagaaaactgtgattgataagagtcatctctcaaaaatagaaactcgaattgacacagccggactcacagaaaaagaaaaggacttcctggccactagagagaaggaaaagggaaatgaggcattcaactccggggattatgaggaagccgtgatgtactacacaaggagcattagtgccctccctacagtggtcgcctacaataatagagcacaagctgaaattaagctgcagaattggaattctgcttttcaggactgcgagaaagtgctggaactggaaccaggcaacgtgaaggcccttctaagaagagctaccacatataagcatcagaataagctgagggaggcgaccgaggacctgtctaaggttctagatgtggagccagacaacgatctggctaaaaagacattatctgaggtggagcgagacctcaagaacagcgaagcggcgagtgaaacacagaccaaagggaagagaatggttatccaggagatagaaaacagcgaagatgaagaggggaagtccggccggaagcatgaggatggcgggggagacaagaaaccagcagagcccgcgggggccgctagagccgcacagccctgtgtgatgggtaatatccagaaaaaattgactggcaaagcagaaggaggaaaacggccagcccgtggtgctccacagagaggccagacacctgaggccggcgccgataagaggtccccccgtcgggccagtgcggctgctgccgcgggtgggggcgccactggacacccaggcgggggccagggcgcagagaaccctgcgggactcaaatctcagggcaacgaactgttccggtccgggcagttcgctgaagccgctggaaaatacagcgctgctattgctttgttagaaccagcaggctctgagatcgccgacgacttgagtatactctactctaatcgtgcagcctgctatctgaaggaaggtaattgctcggggtgtatccaggattgcaatcgggccctggagctgcaccccttttcaatgaagcctctgcttcgaagggcaatggcatatgaaaccctagagcagtatggcaaggcgtacgtcgattataagactgtcctgcagattgactgtggattgcaacttgccaacgactccgttaaccgcctgtccagaatcctgatggagctagacgggcccaactggagggagaagctgagccccattcccgccgtccctgcttccgttcctctgcaagcatggcatcccgccaaggaaatgatctctaagcaggctggcgattccagcagtcacagacagcagggaattacagacgagaaaacctttaaagctttgaaagaggagggtaaccagtgcgtcaatgacaagaactataaggacgcgttatctaaatacagcgaatgcttaaaaattaacaacaaggaatgcgccatctatactaatagggccctgtgttacttgaaactgtgccagtttgaggaggcgaagcaggattgcgaccaggcactacagttagcagacggtaacgtcaaagcgttctacaggagggctctcgcccacaaaggacttaagaattatcagaagagccttatagatctgaacaaagtcatcttactagatcccagtattatagaagctaagatggagttggaagaagttacacggctgctgaacctcaaagacaagacggctccttttaacaaggagaaagaacggcgaaaaatcgaaattcaggaggttaatgaggggaaggaggaacccggacggccggctggcgaagtgagcatggggtgtctggcttcagagaaaggcggcaaaagctctcgatcacccgaagaccccgaaaaactaccaattgcaaagcccaacaacgcctacgaatttgggcaaatcataaacgccctctcaacccggaaagacaaggaagcctgcgctcatttactggctatcaccgccccaaaggatctgcccatgtttctgtctaataaactagaaggcgacacatttctactactgattcaatcgctcaaaaacaacctgattgagaaggacccctcattagtgtaccagcatctactttatctgtccaaagccgaaagattcaaaatgatgcttacacttatttccaaaggccaaaaagaattaatagagcaactgtttgaggacctgagcgacacacctaacaaccatttcactctggaagatatccaggccctgaagaggcagtatgagctgtag

SEQ ID NO: 135949 - DNA, 1044 bp, Artificial Sequence
  Description of Artificial Sequence: Synthetic coding sequence
atggcggcgcagaggggaatgccctcctctgccgtgagggtcctcgaagaggctctaggtatgggcctcacagcagcgggcgatgcccgcgatactgcagacgctgtggcagccgaaggagcctattatcttgaacaagtgacaattacagaagctagcgaagacgattacgaatatgaagagatccccgacgacaacttctccattcctgaaggtgaggaagatctggctaaggcgatccagatggcacaggaacaagctacagatactgagatactagagcgcaagacggtcctaccaagcaaacatgccgtgccagaggtgattgaagacttcttgtgcaacttcctgattaagatggggatgacgcgcaccctcgattgcttccagagcgagtggtatgaattgattcagaaaggggtgacggaattgcgaaccgtgggcaacgtcccagatgtgtatacccaaataatgctcctcgagaacgaaaataaaaatctgaagaaagatctcaagcactacaagcaagctgccgataaggcccgggaggacctcctcaagatccaaaaggagagagattttcataggatgcaccacaaaagaatcgtccaggaaaagaacaaactgattaatgatctgaaaggcctgaaactccactacgcaagttatgagccaacgatcagagtgctccatgaaaaacatcacactctcctcaaagagaaaatgctgacctccctggagcgggacaaagtcgtcgggcaaatttctggcttgcaggagactctgaagaaacttcaacgagggcacagctatcacggtcctcaaattaaggtggatcatagccgggagaaggagaacgctccagagggccccacgcaaaagggcctacgggaggcgcgggaacaaaacaaatgtaagaccaagatgaagggtaataccaagcagtggaccgggaactctcaaacttggaataagactgtgccgctacaagataccatcggaagaagacaggagaataatagcgcccaccagcacatcgactag

SEQ ID NO: 135950 - DNA, 1896 bp, Artificial Sequence
  Description of Artificial Sequence: Synthetic coding sequence
atggccgcgcagcggggaatgccttcgagcgccgtgagggtgctagaggaagccctgggaatgggcctgaccgccgccggagacgctcgcgatacggcagatgctgtcgccgcagaaggagcgtattacctggagcaggtaactatcacagaggcctccgaagatgattatgaatacgaagaaatcccggatgacaatttcagtatcccagagggcgaggaggacctggctaaagccatccaaatggcgcaggagcaggccacggataccgaaatcctggaaaggaagactgtgctacccagcaagcatgctgtccctgaggttatagaagactttttgtgcaactttctcattaagatgggtatgactcggaccttagactgtttccagtcagaatggtacgagctgattcagaaaggggttactgagctgaggacagtgggtaatgtccctgacgtgtatacccagattatgctgctggaaaatgaaaacaaaaatctgaagaaagacctgaaacactacaaacaggctgccgacaaagctcgcgaggatctactgaaaatccagaaagagagggatttccaccggatgcatcacaagcgtatcgtgcaggagaagaataagttaataaatgatcttaaggggttgaaactacactacgcctcctatgaaccaaccatccgggttctgcatgagaagcatcataccctgcttaaagagaagatgcttacctctttggagagagacaaggtagtcggtcagatatccggactgcaggaaacgctgaaaaagctccagcgcgggcactcttatcatgggccccagatcaaggtcgaccattcaagggagaaggagaacgccccagaaggtcccacacagaagggactgcgggaggcacgagagcagaataagtgcaagactaaaatgaaggggaataccaaagatagcgaatttcccattgatatgcagcctaacccgaacctgaacgtcagtaaggagagcctgtctcccgccaagtttgattataagctcaaaaacatcttccggcttcacgaattgcctgtgagttgtgtttcgatgcaaccacacaaagacatcctggtttcctgcggagaggaccgcctgtggaaggtactgggacttcctaaatgcaatgtgttgctgacagggtttggccataccgactggctgtctgactgttgttttcatccatccggagataagcttgccacctcctcaggcgataccactgttaaactgtgggacctctgtaaaggcgactgtatcctgaccttcgagggacacagcagggccgtgtggagttgcacctggcattcatgtgggaacttcgtggcttcaagctcactggacaaaactagtaagatctgggacgtgaacagcgaacgctgccggtgtacgctctacggacacaccgactcagtaaattccattgaattcttccctttctcaaataccttgctgaccagctccgccgataaaaccctgtcgatctgggacgctcggaccggaatttgtgaacagtctctttacgggcacatgcatagcataaacgacgccatcttcgatcctagagggcatatgatcgcaagttgcgatgcatgcggggtaactaaactgtgggatttccggaagctgcttccaatagtctccatagatatcggaccctcacccggtaatgaagtcaactttgatagctcaggaagggtcctggcacaagcttccggtaatggcgtcatacaccttctggatctaaagagtggcgagattcacaaacttatgggccacgaaaatgaggctcacacagttgtgttctctcatgatggggagatcctattcagcggcggctcagatggtaccgtgcgcacatggtcttag

SEQ ID NO: 135951 - DNA, 1614 bp, Artificial Sequence
  Description of Artificial Sequence: Synthetic coding sequence
atgactatgaacatgaagcgttatcaaatgacaattttagcgtctcaaaaggttaagaaaatatggcaaaagcaatttagatggcccaagaacagattacagattctcaaattctggtacgaactcattcagaagggcgtcacagagctgcggacagtgggaaacgtgcctgacgtgtacacccagataatgttgttagagaatgaaaacaagaatctgaagaaagatctcaaacattacaaacaggccgccgataaagcccgcgaagatctgctgaagatccagaaggaacgggactttcaccggatgcaccacaaacggattgtgcaggagaagaataagctcatcaatgacctgaaaggcctcaagctgcactatgcatcctacgagccaaccattcgggtacttcatgaaaaacatcacacattactgaaggagaaaatgctgacctctctggaaagggataaagtcgttggccagatctcgggtctacaggagactctgaaaaagctacaacgtggccattcataccatggcccccaaatcaaagtggatcacagccgggaaaaggaaaatgcacctgaaggtccgactcagaagggactccgagaggcgagagagcaaaacaaatgcaaaacaaaaatgaagggcaacaccaaagactctgagttccccatcgacatgcagcccaatccgaacttaaatgtgtctaaggaatcacttagccctgctaaatttgattacaagctgaagaacattttccggctgcacgagctgcctgtgtcgtgcgtctcaatgcagccacataaggatatcttggtctcttgcggggaggatcggctctggaaggttttgggtcttcccaagtgcaatgtgttgctgactggttttggccatactgactggctcagcgattgttgcttccacccatccggagacaaactcgccaccagctccggcgatactacggtcaagctttgggacttgtgcaagggggattgcattttgaccttcgaaggccactcgcgggctgtgtggtcctgcacatggcacagttgcggcaattttgtagcctctagttccctggacaaaaccagcaagatttgggacgtgaattctgaacgatgtcgctgtacgctgtatgggcacaccgacagcgttaactccatcgagtttttccctttttctaacacactgctcacttccagcgcagataagacactgtccatatgggatgctcgcacgggaatttgtgagcagtcgttgtatggccacatgcacagtattaatgatgctatttttgaccccagaggacatatgatcgccagctgcgatgcttgtggcgtgactaaattgtgggattttcgaaaactgcttcctatcgtcagtatcgacattggccccagccctggcaatgaagtcaatttcgattcaagcgggcgtgtgctagctcaggccagcggaaatggagtgatccacctgctggatctgaaaagcggtgaaatccacaaactgatggggcatgagaatgaggcccatacagtcgttttctctcacgacggcgagattctgttttctggcgggtcggatggcacagtgcggacctggtcctag

SEQ ID NO: 135952 - DNA, 756 bp, Artificial Sequence
  Description of Artificial Sequence: Synthetic coding sequence
atgggagtgggcacaaaagctagagcttcacactggcggcggctgctgtcccttggtgcgacgccagaggagcctttgctggatttcaagattccagacgacaacttcagcatcccagagggagaggaagatctcgcaaaggccatccaaatggcccaagagcaggctaccgatacggaaatattagaacgaaaaaccgtgttgccatcaaagcacgctgtacctgaagtaatcgaggactttctgtgtaactttctcatcaaaatgggtatgactagaacattagactgcttccagagtgagtggtacgaactgattcagaagggggtgaccgagttgcggacggtaggaaacgtacccgacgtttacacacagattatgctgctggagaatgaaaataagaatttgaagaaggacctcaaacattataagcaggcagccgacaaagcccgggaggacctgctgaagatccagaaagaacgggactttcatcgaatgcatcacaaacgtatcgtgcaggagaaaaataagttgatcaatgacctcaagggtttgaaactccactacgcttcgtatgagcccacaatacgcgttttgcatgaaaagcatcatacactgctgaaagaaaagatgctcacgtcactggagcgggacaaagttgtgggacagattagtggattacaagaaactctcaagaagcttcaaaggggtcattcctatcacggaccacaaattaaaggcaagtgcaagatgtag

SEQ ID NO: 135953 - DNA, 552 bp, Artificial Sequence
  Description of Artificial Sequence: Synthetic coding sequence
atggcggcccaacgaggtatgccgagttccgccgttcgagtcctcgaagaagcccttgggatgggcctcactgccgcgggtgacgcccgcgacacagctgatgcagtcgcagccgaaggggcatactatctcgaacaggtgacgatcacagaggccagcgaggatgattacgagtatgaagaaattcccgacgataattttagtatccccgagggagaagaggacctggccaaggctatccaaatggcgcaggagcaggcaacggatactgagatactcgagcgcaaaaccgttctgccaagcaagcacgccgtgccagaggttattgaagatttcttatgtaatttcctgatcaaaatggggatgacaaggaccctggactgttttcagtctgagtggtatgagctgatacagaagggggttacagagttgcgcaccgtgggcaacgttcccgatgtctacacccagatcatgctcctggagaatgagaacaagaatttgaagaaggatctcaagcattacaagcaagctgcagagtacgtcattttttag

SEQ ID NO: 135954 - DNA, 768 bp, Artificial Sequence
  Description of Artificial Sequence: Synthetic coding sequence
gatagcgagttcccaattgatatgcagccaaacccaaatctgaacgtttccaaggagtctctctcccccgctaaattcgattataaacttaagaatatttttagactccacgaattacctgtgtcttgcgtctcaatgcagccccacaaggacatccttgtctcctgcggtgaggacagattgtggaaggtgctcggactacctaaatgcaacgtcttactgactggctttggacacaccgattggctgtccgactgctgtttccatccgtctgaacgctgtcgttgcacattgtacgggcataccgacagcgtcaacagtatagaattcttcccattttccaacactctgctgacttcttctgccgataaaactctcagtatatgggacgcccgcaccgggatctgtgaacagagcctgtatggccacatgcatagcatcaatgacgctatatttgacccgagaggccacatgattgcatcctgcgatgcatgtggtgtgacaaaactctgggacttcaggaagctgctgccaatcgttagtattgatatcgggccaagccccggaaacgaggtgaatttcgacagcagcggtagagtgctcgcacaggcctcggggaacggggtgattcatctgctggacctgaagagcggagagatacacaagcttatggggcacgaaaacgaggcacacaccgttgtgttctcacacgacggcgagattctgttttccgggggctctgatggtaccgtgcggacttggtcctag

SEQ ID NO: 135955 - DNA, 1314 bp, Artificial Sequence
  Description of Artificial Sequence: Synthetic coding sequence
atgaggcgctctagcaggccaggctccgcatcatctagtagaaagcataccccgaatttcttttctgagaattctagtatgtcgattactagcgaggattctaaggggcttaggagcgccgagcccgggcccggggagcctgagggcaggagggcacggggcccgtcatgtggcgaacccgccttatctgccggtgtccctggcggcacgacctgggctggcagtagccagcagaagcccgcgccaaggagtcacaattggcagaccgcctgtggcgctgccacagtgagaggtggggcaagcgagcctactggttcaccagtggtttccgaagagcctttggatctgctgcccaccttggatctgaggcaggagatgcctccgcctcgggtctttaaaagctttttatctcttctgtttcaaggcctgtctgtactgctgtctcttgccggagacgtgttggtgtcgatgtaccgggaggtctgtagcatccgcttcttatttactgccgtgtccttactgtccctgttcctgtcagccttctggcttggcctgttgtatctggtgtctcctctggagaacgagcccaaagagatgctgaccctaagtgaataccatgagcgcgtgaggtctcagggtcagcagctgcagcaattacaggctgagctggacaaactccataaagaagtgagcactgttagagccgccaattccgaaagagtggcgaaacttgtgttccagcgactgaatgaggacttcgtgaggaagccagactacgccctgagctcagtgggggcgtccatcgacctacagaagacaagtcatgactacgccgatcggaatactgcttatttctggaaccgattttccttctggaactacgcccgcccacccacggtcattcttgagccacacgtgtttccaggtaactgttgggcattcgagggcgaccagggacaggtagtgatccagctgcctgggcgagttcagctcagtgacataactctgcagcatccaccaccgtcggttgaacacaccggtggagcaaacagtgcccccagagactttgcggtgtttggactccaggtctatgacgagaccgaggtgtccctcgggaaatttacattcgacgttgagaaaagtgaaatccagaccttccaccttcagaacgacccccccgcagcctttcccaaggtgaagattcagatcttgagtaattgggggcatcctagattcacctgcctttatcgggtcagggctcacggagtgcggacaagtgaaggcgctgaggggtctgcccagggcccgcattag

SEQ ID NO: 135956 - DNA, 1377 bp, Artificial Sequence
  Description of Artificial Sequence: Synthetic coding sequence
atgtctcagagacaggttctccaagtgttcgagcagtatcaaaaagcacgaacacagttcgtgcagatggtggctgaactggctactaggccccaaaatatcgagaccttacagaatgccggcgtcatgagtttgctccgcaccctgctgctggacgtcgtgcctaccatacaacagacagcagccctagccctggggaggctagcaaattacaacgacgacctggccgaggccgtcgtgaaatgcgacatccttccgcagctcgtgtactctttggcagaacagaaccgcttctacaaaaaggccgctgcatttgtgttgcgtgccgtgggcaaacattcaccgcagctggcccaggctattgttgactgtggagcgctggacaccctggttatttgtctggaggactttgaccctggagtaaaggaagctgcagcctgggccctgcggtatattgccaggcataatgccgagttgtcacaggccgtggtcgacgccggagccgttcctttactagtgctttgcattcaggagcccgagatcgctctgaaacgcatcgccgccagtgccctatcagacatcgccaagcactcacccgagctcgcccagaccgttgttgacgcaggggctgtggcccatcttgcccagatgatcttaaacccagatgcgaagcttaagcatcagatactctctgcactcagccaggtgagcaaacactcagtagacctagctgagatggttgtggaagccgaaatctttcccgtcgtcctcacgtgtcttaaggataaggatgagtatgtgaagaagaacgcttcaacgttaataagggaaatcgctaaacacacacccgaactttctcagctcgtggtaaacgccggcggtgtggccgctgtaattgattgcatcggaagttgcaagggcaatacaaggctcccaggcattatgatgttgggctacgtggctgcacactcagaaaacttggccatggctgtgattatttccaagggcgtaccccaactgtccgtgtgcctcagcgaggagccagaagatcatattaaggcagccgccgcctgggcactggggcagatcgggcgacacacccccgagcatgcgagagctgtcgccgtgactaacaccctgccagtgctgttatccctctacatgtcaacagagagctccgaggacttacaggtcaaaagtaagaaggcaattaagaacattttgcaaaaatgcacatatctgccagccttagagccgtttctgtatgatgccccacccaatatcctgaaacacgtggtgggccagttctctaaggttctgttcccttggatttttaggtacacctcggccgagggcggacagctgtcgacaacttag

SEQ ID NO: 135957 - DNA, 813 bp, Artificial Sequence
  Description of Artificial Sequence: Synthetic coding sequence
atgtcccaaagacaggttctgcaggtgttcgaacagtaccagaaagcaaggacccaattcgtacagatggttgccgagctcgcaacccgccctcaaaacatcgagacattgcagaacgccggagtgatgagtttgttgagaactctgctcctggatgtggtcccaactatccagcaaacagccgctctcgcactgggacggctagctaattataacgacgacttggccgaagcggtggttaaatgtgatatcctgccccaactggtttatagtctggctgagcagaacggcgtgcctcagttgtccgtatgtctaagcgaggagcctgaggatcacatcaaagcagccgccgcttgggcgctgggtcagatcggaaggcacactcccgagcatgcccgggctgtcgctgtgacaaacacactgccagtgctgctctcgctctatatgtctacggaatcaagtgaagacctccaagttaaatctaagaaggctatcaaaaacatcctgcaaaagtgcacttatctgcctgcactagaaccgttcctttacgacgcaccgcctaacatccttaagcatgttgtaggccagttctctaaggttctaccccatgactctaaagcccgccgactgtttgtgacgtccggcggtctcaagaaggtgcaggaaattaaagctgagccgggcagcttacttcaggaatacatcaactccatcaactcctgctacccagaggagatcgtccgatactactcccctgggtactcagacacactcttgcaacgggtagattcttaccagccgcttaacaattag

SEQ ID NO: 135958 - DNA, 1758 bp, Artificial Sequence
  Description of Artificial Sequence: Synthetic coding sequence
atgagccagcggcaggtattacaggtatttgagcagtaccagaaagctaggactcagttcgtccagatggtagccgagttggctacccggccccagaacatcgaaacactgcagaatgccggtgagcccggcgctcgaactcccgtggcccctcgcgccctatccccccgcaggctgagacccgcagccctcccagtcgaactgttgggctcacgctccgttggcaccggggtgaggaagagcatccacagcttccagcgggtgtttgggggacaggctgaacgagttaaattgcccgatgggtgtggccggtgcgccttaagcttgttcccgtcaagccttcacacgggggtgatgtcactcttgcgtactctgttgctggatgtagtgcccactatacagcaaaccgctgcactggctcttggtcggctcgcaaactacaacgacgacctggctgaagccgtggtcaagtgtgacatcctgccccagctagtttattcactcgcagaacagaatcgcttctataagaaagctgctgcgtttgtcctgcgtgctgtgggcaaacactctccacagctggcacaagcaatcgtcgactgtggtgccctggatacactggtgatatgtttggaggattttgatccaggtgttaaagaggctgctgcctgggcgctgcgctatatcgcccggcacaatgcagagctgtctcaagccgtggtggacgctggagctgttcctctgcttgtcctgtgtatccaggagcccgagatagctctcaagcgcattgcagcctccgctctgagtgacatcgcaaagcattcccccgaattggcccagaccgttgtcgacgctggagccgtggcccacttggcacagatgattctcaaccccgacgctaagctgaaacaccagattctgtccgccttgtctcaggtgtccaaacattccgtggatttagctgaaatggtggtggaggccgaaatattccctgtggtgctgacatgtctgaaggataaagacgagtatgtgaaaaaaaatgcaagtaccctgattcgtgaaatcgcaaaacacaccccagaactgtctcagctcgtggttaatgcagggggcgttgctgcggttatcgactgtattggcagctgcaagggaaatacgcgcctgcccggaatcatgatgttgggatatgtcgctgcccatagcgagaacctggctatggctgtgatcatctctaagggtgtgccacaactcagtgtctgtctgtccgaggagcccgaagatcacattaaagccgccgctgcatgggctttaggacagataggacgccacaccccagagcatgcaagagccgtggcagtgacaaacaccctccctgtgctcctgagcctgtacatgagcacggagagtagcgaagacctgcaggtcaaatccaagaaagcaattaaaaacatcctgcaaaagtgcacttaccttccagctctcgagccctttctctatgacgctcctcccaatattctcaaacatgtggtcggccagttttcgaaagtcttaccacatgacagcaaagcccggagactgttcgtgacctccggcggcctcaaaaaggtccaggagattaaggcagagcctgggagcctgctccaggagtatattaattctattaatagttgctacccagaggaaatcgtccgatactattccccggggtattctgacacactactacagcgggtcgatagctatcagccactcaacaattag

SEQ ID NO: 135959 - DNA, 1530 bp, Artificial Sequence
  Description of Artificial Sequence: Synthetic coding sequence
atgtctcagcggcaggtgctgcaggtattcgaacagtaccagaaggccagaacgcagttcgtccagatggtggctgagctcgcaactaggccccaaaacattgaaactctgcagaacgccggagtaatgtcactgttacgcactctcctgcttgacgttgtgccaacgatccagcaaactgcagctcttgccctgggtcgcttggcaaattataacgacgacctggcagaagccgtcgtgaaatgcgatatcctgccccagctggtgtactccctggcagaacagaacagattctataaaaaagccgcagccttcgtacttagggcagttggtaagcatagcccacaactggcacaggcgatcgtggattgtggcgcactcgacaccctggtcatatgtctggaagattttgacccaggtgtaaaagaggctgccgcctgggccctgcggtacatcgctcgccacaacgcggagctcagtcaggccgtcgtggacgctggcgccgtgcctctcctggtgctttgtatccaggagcctgaaattgccttaaaaagaatcgccgcctctgcgctgtccgacatcgctaagcattcccccgaactggcccagacagttgtggacgccggggcggtcgctcaccttgctcaaatgatcttgaatccagacgccaaactcaagcatcagattctctcagctctgtcgcaagtgagtaagcacagtgtggatctggcagaaatggtggtcgaagcggagatcttccctgtcgtgttaacatgtctgaaagataaggatgagtacgtaaagaagaacgccagcacacttattagggagattgcaaagcacacccctgagctttcccagctagttgtgaatgctggtggcgtggctgccgtcatcgactgcatcggcagctgtaaagggaatacacgcctccccgggatcatgatgcttggttacgtcgccgctcactccgaaaaccttgccatggctgtgataatctcaaagggggtccctcagctgtccgtgtgcctctctgaagagcccgaagaccacatcaaggcagctgccgcctgggcattgggccaaattggccgtcatacacccgaacacgctagagctgtggctgtgaccaatactctgcctgttttactgtctttgtacatgtcgacagaatcatcagaggacctgcaagtaaaatcaaaaaaagcaattaagaatatcctccagaagtgtacgtatctacccgcactggaaccattcctgtacgacgctcctcccaacatcctgaaacacgttgtaggccagttttccaaagtgctacctcatgacagtaaagcccgccgactgttcgttacctctgggggtctcaagaaggtacaggagattaaagccgaaccaggctcccttttacaggaatatatcaactcgatcaatagctgctaccccgaggagattgtacggtactactccccgggttattctgatacccttctgcagcgcgtcgactcttatcagcctttaaacaactag

SEQ ID NO: 135960 - DNA, 741 bp, Artificial Sequence
  Description of Artificial Sequence: Synthetic coding sequence
atgtcacagcgccaggttctccaggtgttcgaacagtaccagaaagctagaactcagttcgtgcagatggtggccgaactcgcgaccagaccacagaacattgagactctccaaaacgccggtgaacctggagcccgcacacctgttgctccccgcgctctgagcccccgtcgcctgaggcctgccgccctacctgtggaactgttgggctctagaagtgtaggtactggagtgcgaaagtccattcactccttccagcgggtgtttggggggcaggcagaaagggtgaaactacccgacggatgtggccggtgtgccctgtctttgttcccttcctcactgcatacaggcgtgatgtccctgctccggacacttctcttggatgtcgtgccaaccatccagcagactgccgctctggccctggggcggctggccaactacaatgatgatctggcggaggcagtggtgaaatgtgacatccttccacagctggtctattccctggccgagcagaataggttttacaagaaggctgccgccttcgttctgcgggctgtaggcaaacactctccacaactggcccaggccattgtcgactgcggggccctcgatacactggtcatttgcctggaagacttcgaccctggtgtgaaagaggcagcagcttgggctctgagatatatcgctcgacacaatgccgaacttagccaggccgttgtggacgccggggccgttccatag

SEQ ID NO: 135961 - DNA, 576 bp, Artificial Sequence
  Description of Artificial Sequence: Synthetic coding sequence
atgagccagcgacaggtcctccaagtgtttgagcagtaccagaaagcacgcactcaattcgtgcagatggtggctgagttggctactaggccgcaaaacattgaaactttacagaacgcgggcgtgatgtctcttctgaggaccttgctgctggacgtcgtaccaaccatccagcaaactgcggccctagccttaggacggctggccaattacaacgacgacttggcagaagccgtggtgaaatgtgacatattgcctcagttggtttattcactagcggaacagaacggcgtgcctcagctatccgtttgcctgtccgaagaacccgaggatcacataaaagcggctgcagcttgggccctcggccagattgggcggcacaccccggagcatgcaagggccgtcgctgtaaccaacacgttgcctgttcttctctccctgtacatgtctacggagagctctgaggacctgcaggtgaagagcaagaaagctatcaagaacatcctgcagaaatgcacttacctgcctgccttagagcccttcctgtatgatgcgcctccaaacattctgaaatag

SEQ ID NO: 135962 - DNA, 1455 bp, Artificial Sequence
  Description of Artificial Sequence: Synthetic coding sequence
atgcacagtcttacaatggatctctggatccccaacgggcaagccggcgtgatgagtctgctgaggacactgttgttggacgtggtaccaactatacagcaaacagccgccttggccttaggacgcttagccaactataatgatgacctggccgaagccgtcgtcaagtgtgatatcctgcctcaactggtttatagcctcgcggagcagaatagattttataaaaaggcagccgcatttgtgctgagggctgtcggaaagcacagcccccagctggcgcaggcaattgtcgactgcggtgccctcgacacccttgtcatttgcttggaggattttgacccaggcgtcaaggaagcagctgcttgggccctgagatatatagctagacacaacgcagaactgagccaggcagttgtggacgcaggggccgtcccgctgttagtcttatgcatccaggagccagaaattgccttaaagcgaatagccgcttcagcgctgtccgatatcgcaaagcactcacctgaactggcccagacagtagtcgatgcaggcgccgtcgcgcatctggcccaaatgatcctgaatccagacgccaaattaaagcaccagatactgagcgctttatcgcaagtctccaagcatagcgtagatcttgccgaaatggtggtggaggctgagatatttcccgtcgtgcttacttgtctgaaggataaagacgagtatgtgaaaaagaacgctagtactctgattcgggagatcgctaagcatacacctgaactttcacagctggtcgtcaatgccggcggcgtggccgctgtgattgactgtatcggaagctgcaaaggtaacacccggctcccgggtattatgatgctgggctatgtggctgctcatagcgagaacttggccatggctgttatcatatccaaaggagtgcctcagcttagcgtctgcttgagcgaagagccagaggaccacattaaagctgccgctgcctgggccctgggacaaatagggcgacatacaccagagcatgcacgcgcagtggccgttactaacacactgcccgttctcctgtcactctatatgtcaactgagagttccgaggatcttcaggtaaaaagcaaaaaggccattaagaacatcctccagaaatgcacatatttgccagccctggagcccttcttatatgatgcgcccccaaacatactgaaacacgttgtaggccaattcagtaaggtgctcccacatgattcaaaggccagaaggttgtttgtgacgagcgggggactgaagaaggtgcaagaaatcaaggccgagcccggctctctgctgcaggagtacattaactcgatcaattcctgctatcccgaagaaatcgtgcggtactattcccctggctattctgatactctgttgcagcgtgttgactcgtatcagcctttgaataattag

SEQ ID NO: 135963 - DNA, 1506 bp, Artificial Sequence
  Description of Artificial Sequence: Synthetic coding sequence
atggagacaaatgagagtacggagggctcccgttcacgtagcaggtctctcgacattcaaccctcttctgaaggcctcggcccgacctcagagccgttcccttcatcagatgattctccacgtagtgccctcgccgccgctacagccgcggctgcagccgcggcgtcagccgcagctgccacagccgcctttactaccgccaaagccgccgccctgtctacaaaaacacctgcaccgtgcagtgagttcatggagccctcttctgacccttcactattgggggagccgtgcgccgggccaggcttcacccataacatagcccacgggtccctgggctttgagcctgtttacgtaagctgcatcgctcaggatacctgtactaccactgatcactcttccaatcccgggcctgtgcctggttcttccagcggaccagtcctaggatccagcagcggcgcgggccacgggtctggcagcggcagtggtcccgggtgcggatcagtgcctggatctgggagtggccccggacctggctctggacccggcagtgggccaggtcacgggtctggctcccaccccggaccagcgtccggacccggccccgacaccggaccagactctgaactctccccttgtatccccccaggctttcggaatctggtggcagatcgcgtgcctaattacaccagctggtctcagcattgtccctgggagcctcagaagcagcccccatgggagtttctgcaagttctcgaaccaggggcgcgaggcctttggaaaccaccggatatcaaaggcaaactgatggtgtgctacgaaacgttgccccggggccagtgtctcctatacaattgggaggaagagagagcaacaaatcatctggaccaggtcccttctatgcaggacggatccgaatctttcttctttagacacggacaccgcggtcttctgacgatgcaattgaagtctcctatgccaagctccacgacccaaaaggattcatatcagcccccgggtaatgtttactggcccttacgcggaaagcgcgaagcgatgctggaaatgctgctacagcatcaaatctgtaaagaggtgcaggctgagcaggaacccactaggaagctgttcgaagtagagagcgtcacccaccacgactaccgcatggagcttgcccaggcggggactcctgccccaaccaagcctcacgactatagacaagaacagccagagaccttttggattcagcgcgccccacaactgcctacgtggtggccgctccccacacaggttccagcagcggaagactatttaacgtggaaggagtggggttttaccggtgtgcaagaggtgttaagtgccctgctccgggcaacgccaggagaatattccgtcaatatctgcggaatgaatgaacacccggtgtgctctcgtacatggacaaatcgcctatgccatcaggagatgggttctaagaagaccgtcacccaggaggatagaggttggtag

SEQ ID NO: 135964 - DNA, 1458 bp, Artificial Sequence
  Description of Artificial Sequence: Synthetic coding sequence
atggaaaccaatgagtcaacggagggcagccggtcaagaagccgttcacttgacattcagccctcaagcgagggactgggacccacttctgagcccttcccaagctcggacgattcaccccgcagtgcgctggccgctgctactgccgctgccgccgccgccgcctctgccgccgccgccactgccgccttcacaacagctaaggctgctgcccttagtaccaagaccccagcaccatgcagcgagttcatggaaccgtcatcggacccatctttgcttggtgagccatgcgctgggcctggcttcacccacaacattgcacacggatcacttgggttcgagcccgtgtatgtgtcctgtatcgcccaggatacgtgtacaaccacagaccactcttcaaacccgggaccagtgcctggcagttcatcaggacctgtcctgggaagctcctcaggagctggccacggatcgggctcgggctcaggccccggctgcggttcagtgcccggctctggatctggacctggacctgggagcggtcctggctcaggaccaggccatggcagcggtagccatccaggaccggcttccggcccagggcctgataccgggcctgactcagaattgtccccatgcatccccccagggtttcggaacctagttgccgatcgagtgcctaattataccagttggtcacaacactgtccatgggagcctcaaaagcagccgccttgggagttccttcaagtcctggaacccggcgcccgaggcctttggaagccccctgacatcaaggggaaacttatggtgtgctacgagaccctaccacggggccaatgcctcctctataactgggaggaggagcgcgctaccaatcaccttgatcaggtgcctagcatgcaggacggctctgagtcttttttctttagacatggccatagaggactcctgaccatgcagttgaaatctccaatgcccagtagcacgacccagaaagactcataccagcctcccggcaatgtgtattggccacttcgcggtaagcgggaagccatgctcgaaatgttgctgcagcatcagatttgcaaagaagtgcaggccgaacaggagccgacaaggaagctgttcgaggtggaaagtgtgacccatcacgattacagaatggagctggcccaggctggaacccctgccccaaccaagccccacgactaccggcaggagcagcctgaaacgttctggatccagcgcgctcctcagcttcctggcgtgtcgaatatcaggactctcgacaccccatttagaaagaattgctcgttctcaacccctgtgcctctctccctggggaagctgctgccatacgagcctgaaaattatccctatcagctgggagagattagctccctgccatgtcccggaggccggctggggggtggaggtggcagaatgacccccttttag

SEQ ID NO: 135965 - DNA, 1281 bp, Artificial Sequence
  Description of Artificial Sequence: Synthetic coding sequence
atggaaacaaatgagtccactgagggatccaggtcacgcagtcgaagccttgacatccagccaagctcagagggcctcggtcctacgtccgaaccctttccgtctagcgacgactcccctcgtagcgcgctggccgcagctaccgcagccgcagcagccgccgccagtgcagcagctgccactgccgcatttaccacggcaaaagcagccgccctgtctaccaagacccccgctccttgttcggaatttatggaacctagtagcgatcctagcctgctgggtgaaccgtgtgccggtcccggtttcacacacaatattgcccacggttctcttggatttgaaccggtgtatgtgagttgcatagctcaggatacatgcaccacaacagaccattcttcaaatcctggccctgtgcctgggagctcctcaggccccgtgttgggctcttcgagcggcgctgggcacggtagcggatctggttccggccctggatgcggatctgtgcccggttccgggtcgggacctggacccgggagtgggccgggctccggacctggacacgggtcaggcagccaccctggccccgcatccggccctgggcccgacaccggtcccgattccgaactgtcaccttgcatacctccaggattcagaaatttggtcgcagaccgggtgcccaattacacctcctggtcccagcattgcccttgggagcctcagaagcagccgccttgggagttcctccaagtgcttgaacctggtgcaagagggttgtggaaaccgccagatattaaggggaagctcatggtctgctacgagaccttgcctagaggtcagtgtctgctctataactgggaagaggaacgggcaaccaatcacctggaccaggtcccctccatgcaggacggttccgaatcattctttttcaggcacggccaccggggcctgttgaccatgcagttgaaatctcccatgccctcttcaacgacccaaaaggatagctaccaacctcccggaaacgtttattggcctcttaggggtaaacgtgaggcgatgctagaaatgcttctgcagcatcagatctgtaaggaggttcaggccgagcaggagccgaccagaaagcttttcgaggtcgagtccgtgacacaccacgactaccgcatggaactcgcccaggctgggacgcctgcgccgaccaaaccccatgactataggcaggagcaaccagagaccttctggattcagcgggctccgcagcttcctgtatgtgagggggattag

SEQ ID NO: 135966 - DNA, 3966 bp, Artificial Sequence
  Description of Artificial Sequence: Synthetic coding sequence
atggaactggaagatggcgttgtgtaccaggaggagcctggcgggagtggggctgttatgagtgaaagagtgtcagggctagctggctcaatttatagagaattcgaacgactaattggccgttatgacgaggaagttgtgaaagaactgatgcccttggtggtggccgttctggaaaatctcgattccgtctttgctcaggaccaagagcaccaggtcgaattagaactattacgcgatgacaacgagcagctcattacccagtacgagagagagaaggcccttcggaaacacgctgaggagaagtttatcgaattcgaggactcacaggagcaggagaagaaggacttgcagacaagagtcgagtctctggagtctcaaacacggcagctggagctaaaagctaaaaactacgccgatcagatcagtagactcgaagagagagaggccgaactgaaaaaagaatacaatgcgctgcaccagcgccatacagaaatgattcacaactacatggagcacctcgagagaacaaaacttcaccagctaagtggctccgaccagttggaatccacagcccactccaggattcggaaagagagacccatttcgctcgggatcttccctttgcccgcaggggacgggcttctcacgcccgacgctcagaaaggcggggagacccctggttcagaacagtggaagtttcaggaattgtctcaaccgcgaagtcacacctccctcaaggtaagcaattcacctgagccacagaaagcagtggagcaggaagacgaactgtccgatgtttcccagggaggttctaaagccactaccccggccagcaccgccaactcagacgtcgccaccatcccaaccgatactccactgaaggaggagaatgagggattcgtgaaggtcacagacgcgccgaacaaaagcgaaatttcgaagcacatcgaggtgcaggttgctcaggaaacgagaaacgtgtccacaggcagcgccgaaaacgaagaaaagtcagaagttcaggctattatagagtctactccagagctggacatggataaagacttgagcggatataaaggatcaagcactcctaccaaggggattgagaataaggcctttgatcgaaataccgagagtctctttgaggaactgtcaagcgccgggagtggcttaataggcgacgttgatgaaggtgctgacctcttgggtatgggtcgtgaagtggaaaatctgatcctggagaatacccaactgttggaaactaaaaatgctctgaacatagtgaaaaacgatttgattgccaaagtggatgaattgacctgtgagaaggacgtgcttcagggtgaacttgaagccgttaagcaagccaaactgaagctggaagagaagaaccgagagctggaggaggaactgagaaaggcgagggccgaagcggaggatgcacgccagaaggccaaggatgatgatgatagtgatatccccaccgctcagcggaaacggttcaccagagttgagatggctcgagtcctgatggagagaaatcagtataaggagcggttgatggagttacaagaagccgtacgatggaccgagatgattcgggcctcgcgcgagaatccagccatgcaggagaagaaacgcagctccatctggcaattcttctcccgtctcttctcctcgtctagcaacacaacaaaaaaaccggaaccacctgtgaaccttaaatacaatgctcccacctcacacgtgaccccctcagtaaagaagcgctcaagtacgttatcgcagctccctggagacaagagcaaagccttcgacttcctttcagaggagaccgaagcctctctggcatctcgccgggagcagaagcgcgagcagtaccgtcaggtaaaggcccacgtgcagaaagaagacggccgtgttcaggctttcggctggtcactccctcagaaatataagcaggttacaaatggccagggcgagaacaagatgaagaatcttcctgtgccggtttacctgcggccacttgacgagaaagatacctctatgaagctctggtgcgccgtgggcgtcaatctgagcggtggaaagacccgcgacgggggctcggtggtgggcgccagcgtcttctataaggacgtggccggtcttgacacagagggatccaagcagagatcagcatctcagtctagccttgacaaactcgaccaagagttgaaggagcagcagaaggaactgaagaaccaggaagagctgtcttcactcgtctggatttgtacaagtacccacagcgctaccaaggttttgataattgatgctgtccaacccggtaatatcttagatagctttactgtgtgtaactcccatgtcctgtgtatcgcctccgtcccaggagcaagggaaactgactatcccgccggcgaggacctgtcagagagtggccaagttgacaaggcttccctgtgcgggtctatgacgtccaacagtagtgctgaaaccgattccttgctcggcggcattaccgttgtgggttgctccgccgagggtgtgaccggtgcggccacttcaccctcgacaaacggcgcgtcacctgttatggacaagccccccgagatggaagcggaaaacagcgaagtcgacgaaaacgtgccaactgctgaggaggccaccgaggccacagaggggaatgctgggtctgcggaggataccgttgatataagccagaccggcgtctacacggaacatgtctttaccgaccctctcggtgtgcagattcctgaggatctttcacctgtataccagtcatccaacgacagcgacgcatataaggaccagatttctgtgttgcccaacgaacaggatcttgttcgcgaggaggcccaaaaaatgtccagtctcctgccaacaatgtggctaggtgcacaaaacggttgcctctatgtccactccagtgtcgcccagtggcggaagtgtctacacagtattaagcttaaagattctattctctcgatagtgcacgtcaaggggattgtgcttgttgccttggctgatggaacactagcaatttttcaccgcggtgttgacggacagtgggacctgtcgaactaccacttactggatctcggacgtccccaccactccatcaggtgtatgactgtggtgcacgacaaggtgtggtgcggataccgcaataagatctacgttgtgcagcccaaggccatgaagattgaaaaatcctttgatgctcatcctcgcaaggagtctcaggtgcgacagctagcatgggtgggcgacggggtgtgggtttctattcggctcgactcaacactgcgtctctatcacgcacacacataccagcacctgcaggacgtagatattgaaccatatgtgagcaaaatgttgggcaccgggaagttaggattttctttcgtacgtatcacagccctgatggtctcgtgcaataggctgtgggtgggaactgggaatggtgtgatcatctccatcccgctgacagaaaccaacaaaacctcaggagtcccgggtaatcgtcccgggtctgtcatccgagtttacggcgatgaaaacagcgataaggtgacccccggtactttcatcccatactgttccatggctcatgcacaactttgttttcacgggcacagagacgctgttaaattcttcgtcgctgtaccaggacaagttatcagccctcagtccagcagctcggggaccgacctgaccggagataaggcggggccgtctgcccaggagccaggaagtcagacaccgctgaagtccatgctggtcatctccggtggcgagggctatattgacttcagaatgggtgatgaggggggtgagagcgagctcctcggagaggacctaccattagagccatccgtgacaaaagctgaacgatcccatttgattgtttggcaggtgatgtatggaaacgagtag

SEQ ID NO: 135967 - DNA, 3924 bp, Artificial Sequence
  Description of Artificial Sequence: Synthetic coding sequence
atggagctcgaagacggcgtggtgtaccaagaagaacccggaggcagcggggccgtgatgagtgagagagtgagcggcctcgctgggtccatttaccgtgaattcgagaggctgatcggaagatacgatgaggaggtcgtcaaagagctgatgcctctggtcgttgcggtgctggaaaatctggacagtgtatttgcccaggatcaggaacatcaggtggagctggagctgctgagggatgataacgagcagttaatcactcagtatgagagggagaaggccctgagaaaacacgctgaggagaagtttattgaattcgaagactcccaagagcaggagaagaaggacctgcagactagggttgagagccttgaatcccagacaaggcagttagagctgaaagcgaaaaactacgccgatcagattagccgcctggaagagagagaagcagaattgaaaaaagagtacaacgctctacaccagcggcataccgaaatgatccacaactatatggagcacctcgaaaggaccaaactccaccagctcagcggcagtgatcagcttgagtccaccgcacactcacggatccgcaaggaacgcccgatttccctgggtatcttccctctgccagccggcgatggactgctcactcccgacgctcagaaaggcggcgagacccccggtagcgaacagtggaagttccaagaactaagtcagcctagaagccatactagcctcaaggatgagctgagcgatgtttcccagggtggctccaaagcaaccacccccgcgagcaccgcaaattccgatgtggccacaattccgacagatacccctctgaaagaggagaacgaggggtttgttaaagtgactgacgcccccaacaagtccgagatttctaaacatatagaggtgcaggtggctcaggaaacgcgcaacgtgagcacagggtccgcggaaaacgaggaaaagagtgaagtgcaggctatcattgagtctactccggagttggacatggacaaggatttgtctggctataagggttcttctactcccaccaagggtatcgagaacaaagcttttgaccggaatacagagagtctgtttgaagagctgtcctcagcaggatccggtctcataggagatgtcgacgagggggctgatctgctggggatgggcagggaagtcgagaacctcatcttggagaatacgcagcttctggagactaagaatgcccttaacatcgtgaaaaacgaccttattgcaaaggtagacgaattgacctgcgaaaaggacgtgcttcagggcgagctggaagcagtgaagcaagctaagctgaagctggaagaaaagaacagagagctggaggaggaacttcggaaagctcgtgcagaagccgaggacgccagacaaaaggccaaagatgacgacgatagcgatatacctaccgcccagaggaagagattcacgcgtgtcgagatggcaagagtactaatggagcgtaatcagtacaaggagagattaatggagctacaagaggcggtgaggtggaccgaaatgatccgcgcctcacgtgagaaccctgcaatgcaggagaaaaaacgttccagcatatggcagttctttagcagattattttccagctcctctaatactacgaaaaagcccgaaccaccagtgaacctgaaatacaatgctccgacgtcccacgtgacccctagcgtaaagaaaaggagctcgaccctgagccagttgcccggcgacaaaagcaaggcattcgacttcctgagcgaggaaaccgaggcctccctagcttcgcgccgggaacagaagagagaacaatatagacaagtgaaagcacacgtccagaaagaggatggccgcgttcaggccttcggatggagcttgccccagaaatacaagcaggttacgaatggccagggagaaaacaaaatgaagaacctcccggtaccagtatacctccgtccgctggatgagaaggatactagtatgaaattgtggtgtgccgtgggtgtgaacctctctgggggaaagaccagagatgggggcagcgtggtgggcgcatcagtgttctacaaagatgtggcaggattggataccgaaggaagcaagcagcgttctgcctcccagtcgtccctggataagctggaccaagagttgaaggaacagcagaaggagctgaagaatcaagaggagctatctagcctggtctggatatgtacctccacgcactcggcaacaaaagtcctcattattgacgcggtgcagcctggcaatattctggacagctttacagtgtgtaattctcatgttctttgcattgcaagcgtccccggagcaagagaaacggattacccggccggagaagatcttagcgagagcggacaagtagataaggccagcctatgcggatctatgactagcaactcgagcgcagagaccgactcactactggggggcatcactgtggtgggatgctccgccgagggagtgaccggggcggcaacctctccatccactaatggcgctagccctgtgatggataaaccaccggaaatggaagctgagaactctgaagtggatgagaacgtgcctaccgcagaagaggctacggaggcaaccgaggggaatgccgggtcagcggaagacacagtagacatatctcagacaggagtttataccgaacacgtattcaccgaccccctgggtgtgcagatcccagaagatctttcccctgtgtaccagagcagcaatgactcagatgcctataaagaccagattagtgttttgcctaacgagcaggacttagtgcgagaagaagcccagaaaatgagcagtttactgccgacgatgtggctgggtgctcagaacgggtgtttgtacgtgcactcaagtgtcgctcagtggagaaagtgtttacacagcatcaagctcaaggatagtattttgagtatcgtgcacgtcaaaggaatcgtgctggtggcattggctgacggcacactagccatctttcatagaggggtagatggccagtgggacctctctaattatcacttgctcgacttaggtcggcctcatcactcaattaggtgtatgacagtggtgcatgacaaagtgtggtgcgggtatcggaacaagatctacgttgtgcagccaaaagcgatgaaaattgagaaaagtttcgatgcacaccctaggaaggagagccaggtgagacagttggcctgggtcggcgatggggtgtgggtcagcattagactcgattctactctacgcttatatcacgcgcatacataccagcatctgcaggatgtcgatatcgagccttatgttagcaaaatgcttggaacaggcaagttgggattcagcttcgttcgaatcacagctcttatggtgagctgtaaccgcctatgggtgggaacgggcaacggcgtgattatctccatcccgctgacggaaaccaataagacctccggtgttcctggaaatcggcccggttcagtcatcagggtctacggggatgagaattccgataaagtcactcccggaacatttatcccgtattgctctatggctcacgctcaattgtgttttcatgggcatcgggacgccgttaaatttttcgtcgctgtgcctggacaggtgatctcgccgcagtccagttcaagcgggacagaccttaccggggacaaggctgggccgtctgctcaggaacccggatctcaaactccacttaagtctatgctggtgatcagtggcggcgagggatacatagacttccgaatgggcgacgaaggcggagagtctgagcttttgggtgaagacctaccattggaaccttcagtcacaaaggcagagcgctcacacctcatcgtgtggcaggtgatgtatggcaacgagtag

SEQ ID NO: 135968 - DNA, 1908 bp, Artificial Sequence
  Description of Artificial Sequence: Synthetic coding sequence
agcttgaaggatgagttgagcgacgtgagtcagggggggtcaaaggcgaccacccccgcttctaccgccaattccgacgtagctacaatccccactgatacgccgttgaaggaagagaacgaaggtttcgtcaaggtgaccgacgccccgaacaaatcagagatttctaagcacattgaggtacaggtggcccaggagactaggaacgtgtccaccggatctgcagagaacgaggaaaaatctgaggtgcaggctataatagagtctacacccgagctagacatggataaggatctgtcagggtacaagggaagctcgaccccaaccaaggggatcgaaaacaaagctttcgatcggaatactgaatctttgtttgaaaaacgtagttctaccctcagtcagttacccggggacaaaagcaaggctttcgatttcttgtccgaagaaaccgaagcatccctcgcatcacggcgcgaacagaaacgggagcagtatcgccaggtgaaagctcacgtgcagaaggaggatggaagggtacaagcattcggctggtcactaccgcagaaatataagcaagtcactaatgggcaaggcgaaaataagatgaaaaacctgcctgtgcctgtctatttgagacccctggacgagaaagatacttccatgaaaaaactgtggtgtgccgtgggcgtgaatctttccggagggaaaactcgagatggcgggtctgtggtgggggctagcgtgttttacaaagacgtggcaggcttggacacagaaggatctaagcaacgatcagcgtctcagtcatcgctagataagctggaccaggagctaaaagagcaacagaaggaattaaagaatcaagaagaattgtcaagcttggtgtggatctgtacaagcactcatagtgcaaccaaagtattgatcatcgacgcggtacagccagggaatatcctagatagttttacagtttgtaactcccacgtactttgtatagcgagcgtgccgggcgcccgggagaccgactatccagcaggcgaagatctgtccgaatctggccaggtagacaaggccagtctctgcggttcaatgacaagcaactccagcgcagagacggatagcctcctgggcggtattaccgtggtaggatgtagtgctgagggcgtaaccggagcagccacatctccatcaaccaatggcgctagtcccgtcatggataaacctccagaaatggaagcagaaaatagcgaggtggacgagaatgttccaactgcagaagaagctactgaggctaccgaggggaacgccggatccgctgaggacactgtggatatttcccagaccggggtatacactgagcatgtttttaccgatcctcttggtgtccagataccagaggacctctcaccagtgtatcagagcagtaacgacagtgacgcttataaggatcagatcagcgtcctgccaaatgagcaggacctcgtacgcgaagaagcgcagaagatgagctcattgctcccaactatgtggctgggggctcagaatggctgtctctatgttcacagctccgtggctcagtggcggaagtgcctgcatagcatcaagctgaaggactccattttatctatcgttcacgtgaaaggaattgtacttgtggctctggctgatggcacattggcgattttccacagaggtgttgatgggcagtgggacctgtcgaattaccacctgctggatttagggcgtccacaccatagtattaggtgtatgaccgtggtccatgacaaagtgtggtgcggctacagaaataagatttatgtgctgcactcaagccttggcgacggggcccgaccatgcctaaaaaccgataaacaggccaaaaaccgtttgaagtctgggtttcattag

SEQ ID NO: 135969 - DNA, 3207 bp, Artificial Sequence
  Description of Artificial Sequence: Synthetic coding sequence
tcactgaaagacgagctttcggatgtgtcccagggcggctctaaggccacaacgcctgcgtctacagctaacagcgacgtcgccacaattccaacggatacacctctcaaagaggagaatgaaggtttcgtgaaagttaccgacgccccgaataagtcagagatctccaaacacatcgaagtacaggtggctcaggaaacccggaatgtctctacaggcagcgctgaaaatgaggaaaaaagcgaagttcaggccatcattgaatccactccagagctggacatggataaagacctgtccggctacaaagggtctagtacccccacaaaggggattgaaaacaaggcgtttgatcgtaacaccgaaagtttgttcgaggaactctccagcgcaggcagcggactgattggcgacgtagatgagggcgctgacttgctcgggatggggagggaagtagagaacctgatattagagaatacacagctgttggagactaagaacgcactgaacattgtgaagaatgatctgattgccaaggtggacgagctaacttgtgagaaggacgtactacaaggggaacttgaggcggttaagcaggccaaactcaagcttgaggaaaaaaatcgggagctagaagaagaactccgcaaggcccgcgctgaagctgaggacgcccgccagaaagccaaggacgacgatgactcagatatccccacagctcaacggaagaggtttacacgggtggagatggctcgcgtgcttatggaacggaatcagtataaggaacgtctcatggagctacaggaggccgttagatggactgaaatgatcagggcctcgagggagaaccccgccatgcaggagaagaaacgaagcagtatctggcagttcgtccccacccgctttagtagactgttctcctcttctagcaataccactaagaaaccagagccccctgtgaacctgaaatataacgctcccaccagccacgtgaccccatcggtgaagaagcgcagtagtacgctatcgcagcttccaggcgacaagtctaaggccttcgatttcctgagcgaggagacagaggccagcttagcatctcgccgggagcaaaaacgcgagcaataccgacaggtgaaagctcacgtgcagaaggaagacgggcgcgtccaggcctttggttggtctttgcctcagaaatataaacaggtgacgaacggacaaggtgaaaataaaatgaaaaatttgcctgtgccagtatatcttcgccctttagacgagaaggacaccagtatgaaaaagctctggtgcgctgtaggcgttaacctctcaggaggaaagacccgtgacggagggtcagtggtcggcgctagtgtgttttacaaggatgttgccggccttgacactgaggggtctaaacagcgatctgcctctcaatcttctctagataaattggatcaggaactcaaggaacagcagaaggaattgaaaaaccaggaggagctcagcagcctggtgtggatctgtacatccacacacagtgcaacaaaagttctcatcattgacgccgtacagccaggtaacatccttgatagcttcaccgtgtgtaactcacatgtactgtgtatcgcaagcgtgccaggggctcgggagacggactatccagcaggggaagacctgtcagaaagcggacaagtagacaaggccagcctgtgtggcagtatgacaagcaactcctcggctgagacggattccctgcttggcggtatcacagttgtcggatgcagcgcagaaggagtcaccggagctgcgacaagccccagtaccaatggggcaagtcccgtgatggacaaaccccccgaaatggaggccgagaatagtgaggtggacgagaatgttcccacagctgaggaggccaccgaagccacagaaggcaatgccggcagcgccgaagacactgtagatattagccagacaggggtctatacagagcacgtattcactgatcctctgggggtccaaatccctgaagacctgagtcccgtgtatcaaagctctaacgacagcgatgcctacaaagatcagatttccgtgctgcctaacgagcaggatctagtgcgagaagaggctcagaaaatgagcagtctactgcctactatgtggttgggagcccagaacggctgtctttacgttcactcaagtgtcgcccagtggcgcaaatgtctacactcaattaagttgaaagatagcatcctgagtattgtgcacgttaaaggcatcgtactggtggcactggccgacggaaccctcgcgatctttcacaggggagtggacgggcagtgggatttgtcgaattaccacttactggatttggggcgcccacatcattcaatacgatgcatgaccgtggtgcatgataaggtgtggtgtggctacaggaataagatctacgttgtgcagcctaaggcaatgaagattgagaagagtttcgacgctcatcctcggaaggagtcacaagtgcgccaacttgcctgggtgggggacggcgtgtgggtgagcattcgactcgattcaacactgcgactgtaccacgcccacacctaccagcaccttcaggacgtggatattgagccttatgtttcaaaaatgctgggcacagggaaactcgggttctcttttgtccggataaccgcattaatggtgtcgtgcaacagactatgggtggggaccggtaatggcgtgatcatctcaataccgctgaccgaaactaataagacatctggggttccggggaaccgacccggatccgtcattcgcgtttatggagacgagaactctgataaagtaacacccgggactttcatcccctactgttctatggcacatgcccagttgtgcttccacggacatagggacgctgtcaaattctttgtcgccgtgcctggtcaggtcatatcaccccagagtagcagtagcggaacagacttgacgggggataaagcggggccttctgctcaggagcctggctcacagactcctctaaagtccatgttggtgatcagcggaggggaaggttatatagacttccgtatgggggatgaaggcggagaatccgagctattaggcgaggatttgccactcgagccatccgtgacgaaagcggagcgcagccatctgatcgtgtggcaggtgatgtacgggaatgagtag

SEQ ID NO: 135970 - DNA, 3237 bp, Artificial Sequence
  Description of Artificial Sequence: Synthetic coding sequence
tctgtgaaagtgtctaacagcccggaacctcaaaaggccgtggaacaagaggatgagctttcagatgtctcacagggcggctccaaggctaccactccagcttccactgctaactctgatgttgccactattccaacagatacacctttgaaagaggaaaacgaagggtttgtgaaagttaccgacgccccaaataaatcagagatttcgaaacatatcgaggtacaagtggcccaggagactcgcaatgtctctaccgggtctgcagagaacgaggagaaatccgaagtacaggcaatcattgagtctacgccagaactcgacatggacaaggatctgagcggatacaaagggtcttcaacgccgaccaagggaattgagaataaagcattcgatcggaataccgaaagtctctttgaggagctgtcgtccgccggctccggccttattggggacgttgacgagggtgctgacctgctggggatgggaagggaagtggaaaatttgatcctggagaatactcagctgttggaaactaagaacgcactgaatattgttaagaatgatcttatagccaaagtggatgagttgacatgtgagaaggatgtcctacagggagagttagaggccgttaaacaggccaagctaaaactcgaggagaagaatcgggagttagaggaagagctgcggaaagctagagccgaggccgaggacgcacgccagaaagctaaggatgacgatgacagcgacatccctacagcccagaggaagcgtttcacccgagtagagatggcacgggttctcatggagagaaaccagtacaaggaaaggttgatggagctgcaggaagcggttaggtggacggaaatgatcagggcttcacgcgaaaatcccgccatgcaggagaagaagaggtcctccatctggcagttcttctctaggttgttctccagcagcagcaacacaaccaagaagccagagccacctgttaaccttaaatacaacgcccctaccagccatgtgacgccttcagtgaagaagcgctcttctactctaagtcagcttccaggagataaatcgaaggcatttgactttttgtccgaagagaccgaggccagtctggcgtccagacgcgaacagaagcgagagcagtaccgacaggtcaaagctcacgttcagaaagaagatggtagagtgcaggctttcggctggagtctccctcagaaatacaagcaagtcaccaatggacagggggaaaataaaatgaagaaccttcctgttcccgtgtatctcagaccacttgatgagaaggacacttccatgaagaagctgtggtgcgccgtaggcgtgaatctgtcgggggggaaaacccgcgatggaggatcagttgttggcgcctcggtgttctataaggacgttgcaggacttgacaccgaaggaagtaaacagagatctgcaagtcagagcagtctcgataagttggatcaagaactgaaagaacagcagaaggagcttaaaaatcaggaagaactctccagcctcgtctggatttgcaccagtacccatagtgcaactaaggtcttaattatcgacgccgtacaaccaggaaatatccttgatagtttcaccgtgtgtaattcccatgtgttatgtatagcctccgtccctggcgcgcgggaaaccgattacccagcaggagaagacctgtctgaatcagggcaggtcgataaggcctccctgtgcggttccatgacgtccaattcaagcgctgagactgactctttactcggcggaatcaccgtcgtcggatgcagcgcagaaggcgtcactggggccgccacttcccccagtacaaatggcgcatcccctgtgatggataagccacctgagatggaggctgagaactcagaggtagatgaaaacgtgccgactgctgaggaggccaccgaggctacagaaggcaacgctgggagcgccgaagatacagttgatatttctcagactggagtgtacaccgagcatgtgttcactgaccccctgggcgtacagatcccagaggatctgtccccggtgtaccaatcctccaatgattctgacgcatacaaagatcagatctctgtcttgcccaacgaacaagatctggtgagggaggaggctcaaaaaatgtcctctcttttgcctactatgtggttaggggcccagaacggctgtttgtacgtccatagcagcgtcgcacagtggcgaaagtgcttacactctataaagcttaaggattccatcctctcgattgttcacgtgaagggcatagtgttagtcgcgttggctgatggtacgttagctatatttcatcgtggtgtggacggccagtgggatctgtcaaattatcaccttctggacttgggtcgccctcaccatagcattaggtgcatgaccgtggtgcacgacaaggtatggtgcggctatcgaaacaaaatttacgtggtgcagcctaaagcgatgaagatcgagaagtcctttgatgcccatcccagaaaggaaagccaggtgcggcagctggcatgggtaggcgacggggtgtgggtctccatcagactcgattccaccctgcgcctgtaccacgcccacacctaccaacacctgcaggatgttgacattgaaccatacgtgagtaagatgttaggtactgggaagctcgggttctcttttgttcgaataaccgctctgatggtttcctgtaataggctttgggttggcaccggtaacggcgtcatcatcagcattcccttaacagagactaacaagacatccggggtcccaggaaatcgtcctggatcggtcattagggtgtacggtgacgagaactctgataaggttactccgggaactttcatcccatactgtagcatggcccatgcacagctgtgcttccacggccaccgtgatgctgtcaagttctttgtggccgtgcccggtcaagtcataagtccacagtcatcgtcttcgggtacagacctgacgggggacaaagctggtccaagtgcgcaggaacccgggtcccaaacccctctaaagtcaatgctcgtgatcagcggaggcgaggggtacattgatttccggatgggagatgaggggggtgaatccgagctgctgggtgaagatttacccctggagccctctgttactaaagcagagagaagccatcttattgtttggcaggtgatgtatggaaatgaatag

SEQ ID NO: 135971 - DNA, 3936 bp, Artificial Sequence
  Description of Artificial Sequence: Synthetic coding sequence
atggagctggaagacggcgtcgtctatcaagaggagcccggaggatccggcgcggtaatgtccgagcgagtgtctgggcttgcaggctcaatctatcgggagtttgaacgactcattgggaggtatgacgaggaggtggtcaaagagctgatgcctctggttgtagcggtgctggagaacctggacagtgtcttcgcacaggaccaggagcatcaggttgagctcgaattgttacgtgacgataatgagcagctgattacccagtatgagcgagagaaggcgctcaggaagcacgctgaggagaagtttattgagtttgaggactctcaggaacaagaaaagaaggacctacagaccagagtagaaagtctggaatctcagactcgacagctagagttgaaggccaagaactatgcggatcagatctccaggttagaagagcgagaggccgagctcaaaaaagagtataacgccctccaccagagacacacagagatgatacacaattacatggagcatcttgaacgaacaaaactccaccagctcagcggtagcgatcagttggagagtaccgcacactcgagaattaggaaggaaaggcctatatcacttggtatttttccgcttcctgctggcgatgggttacttactcccgatgctcagaagggcggtgaaacccccgggtcggagcagtggaagtttcaggaactaagccagcctaggtcccataccagcctcaaggacgaactgtccgatgtcagccaagggggctcaaaggctaccacgcctgctagcacagctaactctgatgtggctactatcccgacggatactccactgaaggaagaaaacgaaggatttgtaaaggtaaccgacgcgccaaacaaatctgaaatatctaagcacatagaggttcaggtcgcgcaagagacacgtaatgtctccaccggatctgccgagaacgaagagaagtccgaagtccaggctatcatcgagtccacgccagaactggatatggataaggacttaagcggatacaaagggagtagcacacctaccaaagggatcgagaataaggcattcgaccgtaatacagagtcattgtttgaggaactctcatccgctggtagcgggttaatcggcgatgtggatgagggtgccgatctgttgggtatggggcgcgaagtcgaaaaccttatcttggaaaacactcaattattggaaacaaagaatgccctaaatatcgtcaagaacgatttaatcgccaaggtagacgagctgacctgtgaaaaagacgtgctgcagggagaactagaagcagtgaagcaggccaaacttaaactcgaggagaaaaaccgcgagctagaggaagaactgagaaaggcaagagctgaagctgaggatgcacgccagaaggctaaagatgacgatgacagtgacatcccaaccgcgcagagaaagagatttacacgggtcgagatggctagggtgctcatggagaggaaccagtataaagaaagattgatggagctgcaggaagccgtgaggtggactgagatgatacgggcgtctcgggaaaaccccgccatgcaggagaaaaagcggagctccatttggcaattcgttcctaccaggttttcccgcttgttctcttctagctctaatacgaccaagaagcctgaacctcccgtgaatttgaagtataatgctcctactagtcacgtgacccctagtgtgaagaagcgatcaagcacactgagccaactgcctggcgacaagagtaaggcattcgatttcctctcggaagaaacagaagccagtctagccagtagacgcgaacaaaagcgcgaacagtatcggcaggtgaaggcccatgtccagaaggaagatggtcgcgtgcaggccttcggctggagcctacctcaaaagtataagcaagtcacaaacggacaaggagagaacaagatgaaaaaccttcctgtgccagtctaccttagacctctggatgaaaaagatacttctatgaagttatggtgtgccgtcggtgtaaacctctcaggaggcaagactagggatggcggcagcgtggtgggggccagtgtgttctataaggacgtcgccggcctggatacagaaggaagtaagcaacgatccgcgtcccagtcaagtctcgataagttagaccaagaactcaaggagcagcagaaggagctgaagaaccaggaggagttgagcagcttagtatggatctgtacttccactcatagtgctaccaaagtgcttattatcgatgcggttcaaccaggaaacattctggatagctttactgtttgcaacagccacgtcctgtgcatagccagcgtgcccggggcacgtgaaacggactaccccgccggtgaagatctgtccgaatccgggcaggtcgataaggctagcttatgcggttctatgacaagcaattcgagcgcagagaccgattccctgctgggaggtatcacagtcgtcggttgtagcgccgagggcgtcaccggtgccgccacttctccttcaactaacggcgcctccccagtgatggacaagccaccagagatggaggctgagaattccgaggtcgatgaaaacgtgcctaccgcagaagaagcaacagaagctacagaaggtaacgctggctctgcagaagatacggtagacatatcccagacgggggtttacactgaacacgtctttacggatccgctcggggtccagatccccgaggatctctcacccgtctatcagagctccaacgattcagacgcttataaggaccagatatccgttctgcccaacgaacaggacttggtcagagaagaggctcagaaaatgagcagcctacttcctacgatgtggctgggtgctcagaacgggtgcctttacgttcactcctctgtggctcagtggaggaagtgcctgcattctattaagttgaaagattcaattctttctattgtgcacgtgaaaggcatcgtcctggttgctctcgcagacggcacgctcgccatttttcatcgaggagttgacggccagtgggatttgtcgaactaccacctccttgatctgggcagaccgcatcactccatcagatgcatgaccgtggtacatgacaaggtttggtgcgggtaccgcaacaagatctatgttgtgcagccaaaggcaatgaagattgaaaagtcatttgacgcacacccaagaaaggagagtcaagttagacaactcgcttgggtcggtgacggagtctgggtatctatcagacttgattcgacgctgcgtttgtaccacgcacatacgtaccaacacctacaagatgtggacatcgagccttacgtctcaaagatgctgggaaccggtaaactcggattcagctttgtgagaattaccgccctgatggtgtcctgcaaccgactgtgggttggcaccgggaacggggtgattatctcaatccccctgactgaaaccaacaaaacctcaggggtgccaggcaaccgaccgggttctgtgatccgggtgtacggggatgagaatagcgacaaggtcactcctggaacatttatcccctattgttctatggcccatgcccagctttgctttcatggccatcgagatgcagtgaagttcttcgtcgccgtaccaggccaggtgatttccccccagtcctcttccagcggtactgatctgactggagacaaagcaggtccaagtgcccaggagcccggatctcagaccccgctaaagagtatgctggttatctccggaggcgagggctacattgactttcgaatgggagacgagggaggtgaatccgagcttctgggcgaggatctcccgctagaaccatccgtgacgaaagccgagcgaagtcacctcatcgtttggcaagtgatgtatgggaacgaatag

SEQ ID NO: 135972 - DNA, 3534 bp, Artificial Sequence
  Description of Artificial Sequence: Synthetic coding sequence
atgtcccccggctgcatgctcctgttcgtcttcggcttcgtggggggcgccgtggtcatcaactcagccattctagtgtcgctttctgtgctgctactggtccacttcagtatctccactggcgtgcctgccctgacccagaacttacctcgtattctcaggaaggagcggcctatctctttggggatatttcctctgccagcaggggacggactcttgactccggacgcacagaaggggggcgagacaccggggtcagagcaatggaagttccaggagctctctcagcctcgctctcacacgagcctgaaggatgagctgtctgacgtgtctcagggggggagtaaagcgaccacacccgcctccactgccaatagcgacgtggctactatcccaactgatacacccctgaaggaggagaacgagggattcgtgaaagtgactgacgcccccaataagtctgagatcagcaaacacattgaggtccaggtggctcaggaaactcgcaatgtcagtactggttcggccgagaacgaagaaaaatctgaggtgcaggctatcatcgagtccacacccgaactcgatatggacaaggatttgtcaggttacaaaggaagctcaactcctaccaagggtattgagaataaagcatttgaccggaatacagaaagtctctttgaagagctgtcgtccgctggatctggcttgattggggacgtggatgagggcgccgacctcctggggatggggcgtgaagtcgagaatctcatcctggaaaacacgcagctgcttgaaacaaagaacgcactcaacatcgtgaaaaatgacctcatcgccaaagttgacgagctgacatgtgaaaaagacgtcctccagggcgagctcgaggcagtaaagcaagctaagcttaagctggaagaaaagaacagggagctcgaagaggagctgaggaaagcaagagccgaggcagaggatgctagacagaaagctaaggatgacgacgatagtgatattcccacagcacagagaaagcggtttaccagagtcgagatggcacgcgtgctgatggaaagaaatcaatacaaggaacgcctgatggaactacaagaagccgtgagatggactgagatgatccgtgcttcccgtgagaaccctgccatgcaggaaaaaaagcgctcttctatctggcagttcttctctagactgttctcttccagctctaacaccaccaaaaaacctgaaccaccagtgaacctcaagtataacgcccccaccagtcatgtaacaccatctgtcaagaaaaggagcagcacgctcagtcaactacctggtgacaagtctaaagcatttgattttttgagtgaagagacggaagcctccttggcatcccgtagagaacaaaagagagagcagtatcggcaggtaaaggcgcacgtgcagaaagaggatgggcgcgtacaagcgttcggttggagcctcccgcagaagtacaaacaggtcacaaacggtcaaggcgagaacaagatgaagaacctccccgtcccggtctacctgcggcccctggatgaaaaggatacatcaatgaagttatggtgtgccgttggggtcaatctgagcggcggaaaaactagagacggaggttccgtagttggagccagtgttttctacaaggatgtggcaggcctggacactgaggggtcaaagcagaggtccgcatcccagtcctctctggacaaactggatcaagagttgaaggagcagcagaaggagcttaagaaccaagaggaactgtccagcttggtttggatttgcacttcaacccatagtgccaccaaggtcttgatcattgatgcagtccaacccggcaacatcttggatagcttcactgtgtgtaatagtcacgtgttgtgtattgccagtgtcccgggtgcacgggagacggattaccccgcaggggaggatctctctgaatctggccaagtcgacaaggcatctctttgcggcagcatgacttcaaatagttctgctgagacagactcgctgctcgggggtataacagtcgttggctgcagcgcagagggcgtcacaggagctgcaacatccccctccacgaacggagcaagtccagtgatggacaagccccccgaaatggaagctgagaacagcgaagttgatgagaatgtcccgacagccgaagaggctaccgaggcaacagagggcaacgctgggagtgccgaggacaccgtcgacatctctcaaactggcgtttacaccgagcatgtgttcaccgatcctctgggtgtgcagataccggaggatttaagccctgtctaccagtcaagtaatgacagcgacgcctacaaagaccagataagcgtgctgcccaacgagcaggatttggtgagggaagaggcacaaaagatgagctcgctcctgcctacaatgtggctcggtgctcagaatgggtgtttgtacgtacattcttcggttgcccagtggcgaaaatgtttgcattctattaagctgaaagactccatcctgtccatagtgcatgtcaaggggattgtgctcgtggctctggcagatggaactctggcaatatttcatcgtggtgtcgatggccagtgggacctctccaactatcacctgctggacctgggtagaccccaccacagcatcagatgtatgaccgtggtgcatgataaggtgtggtgtggctatcggaataagatttatgtcgtgcaacctaaggcaatgaaaattgagaaatctttcgacgctcatccccgaaaagaatcccaagtaagacagctggcatgggtcggggatggcgtgtgggtcagcatcaggctggattcaacgctgaggctgtaccatgcccatacttaccagcatctgcaggatgtcgacattgagccatacgtgagtaagatgctgggcaccggtaagctcggttttagcttcgtccgtataactgcactgatggtcagctgcaaccgactttgggttggcaccggcaatggcgtgattatttcgatccctcttaccgagactgtaatattgcaccagggccggctcctggggctgagggcaaacaagacttctggcgtacccggcaaccgcccgggatcagtaatcagggtgtatggggatgagaacagtgataaggtcacaccggggactttcattccttattgttcaatggcacacgcccagttatgcttccacgggcacagggacgctgtcaagttttttgtggcagtgccgggacaagttatctcccctcaaagctcgtctagtgggactgatctgactggtgataaagccgggccttccgcccaggagcccgggtcacagacaccactaaagtccatgctggtgataagtgggggagagggctatatcgactttagaatgggagacgagggtggggaaagtgaactcctgggtgaggacctccccctcgagccatcagtcaccaaggcagagagatcacatctcatcgtctggcaggtgatgtatggcaatgagtag

SEQ ID NO: 135973 - DNA, 2760 bp, Artificial Sequence
  Description of Artificial Sequence: Synthetic coding sequence
atggtcatgagatggggcgagaggaatgatgtgatagcttgggagctgcttcaggatggtgtggagaatgcgctgaacatagtgaaaaatgatctgattgctaaagtggacgaactaacttgcgagaaggacgttcttcagggcgagctggaggctgttaagcaggccaagttgaagctggaagaaaaaaaccgagagctcgaggaagagttaagaaaagcccgagccgaggcagaagatgcccgacagaaagcaaaggacgacgacgactcagacatccccacagcacagcggaaacgctttacaagagttgaaatggccagggtactgatggagcgtaatcagtataaggagcggctcatggagctgcaagaggcagttaggtggaccgagatgatccgcgccagcagagagaaccctgccatgcaggaaaaaaaacgttcttctatctggcagtttttcagccgcctgttctcatcatcatccaacactacgaaaaagcctgagcctcccgttaacctgaagtataatgcccccacgtctcacgtgacccctagcgtgaagaagcgctcttctaccctttcccagctgcctggcgataagtccaaagcttttgatttcctgagtgaggagaccgaggcgtcactggcctccaggagagaacagaagagggaacaatatagacaggtaaaagcacacgtgcagaaggaagacggccgtgtccaggcatttggctggtcactgccacagaagtacaagcaggtcacaaatgggcaaggagagaataaaatgaaaaacctcccagtccccgtgtacctgcgcccacttgacgagaaggacactagtatgaagctctggtgtgctgtcggcgtgaatttgtctggcgggaaaacacgcgacggcggcagcgttgtcggagcctccgtcttttataaagacgtagccggtctggacactgagggctccaaacagaggagtgcctcacagtcttccctggacaagctcgatcaggagcttaaagaacagcaaaaggaactgaaaaatcaggaggagctctcatcgctcgtgtggatctgtacctcaacccattctgccacaaaggtgctaattatagatgcagtgcagcccggcaacatcttagatagttttaccgtgtgcaattcacatgtcttatgcattgcatcagtccctggagcccgcgaaactgattatcccgccggtgaggatctctctgagagcggccaggtggataaagccagtctctgtggctctatgacgagcaattcatctgcagaaaccgatagccttctcgggggcattaccgtggtgggctgcagtgctgagggcgtgaccggagcagccaccagcccttctacaaatggagcctcccccgtgatggataaacctcctgagatggaggccgaaaactcagaggttgacgaaaacgttcccaccgccgaagaggcaactgaggcaactgaggggaatgccggctcagcagaagataccgtggacatttcccagactggcgtgtatacagaacacgttttcacagatccgctaggcgtccaaatcccagaagatctgtcgccagtttaccagagcagcaacgacagcgatgcttataaggatcagatctcagttcttccgaacgagcaggacctagttagagaagaagcccagaagatgtccagtttgctgcccaccatgtggctgggagctcagaacggttgcctgtacgtgcacagttctgtcgcacagtggaggaaatgtctccattctattaaacttaaagactccattctgagcatagtgcacgtgaagggcatcgttctagtagcccttgccgatggtaccctggccatcttccaccggggcgtcgacggtcagtgggatctttcaaactatcatttgctggaccttggacgcccacaccacagtatcagatgcatgactgtcgttcatgacaaagtgtggtgtggttacagaaataagatatatgtggtccagcctaaagccatgaagatcgaaaagtccttcgacgcccatcctaggaaagaatctcaggtgcgccagctggcatgggtgggagatggggtgtgggtgtccattaggctggacagtacccttaggctgtatcatgcccacacctaccagcacttacaggacgtggacatagaaccatacgtcagcaagatgttagggaccgggaaactgggcttttctttcgttcgaatcacggcgttgatggtttcttgtaacagactgtgggtaggtacaggtaacggcgtaataatcagcatccccctgactgaaacaaataaaacaagtggggtgcctggcaataggcccggttctgtcatccgcgtgtatggcgacgagaactctgacaaagtgacacctggaacttttattccgtattgctctatggcccacgcccagttgtgtttccatggacacagggacgccgtgaagttcttcgttgccgttcctggccaagtgatatcccctcagtcaagcagttcaggcacggatctgactggagataaggccggcccctccgcacaagagcctggtagccagactccccttaagtccatgctcgtaatttccgggggcgaaggttacatagattttagaatgggcgacgagggcggcgagtcagagctgctcggcgaggatttgcctcttgagcccagcgtaacgaaggccgaaaggtcgcatttaatcgtgtggcaggtgatgtacggcaatgaatag

SEQ ID NO: 135974 - DNA, 825 bp, Artificial Sequence
  Description of Artificial Sequence: Synthetic coding sequence
atggagctcgaagatggcgtggtttaccaggaggaaccaggcgggagcggagctgttatgagtgagcgggtttcagggctggccggatccatctaccgagaatttgaacgactcatcggtcgctatgacgaagaagtggtgaaggaactcatgccactcgtggttgccgtgctggagaacctggactccgtgtttgcgcaggaccaggagcaccaggtggagctcgagctgttgagggacgacaacgagcagctgatcacacagtacgaacgggagaaggcgctgcgcaagcatgcggaggaaaaattcatcgagttcgaagactcacaagagcaggaaaaaaaagacctgcagactcgcgttgagagcctggaatcccagacccggcagctggagttgaaagcaaagaactacgccgatcagtctgcaatgagccctggatgcatgctgctgttcgtttttgggttcgttgggggtgccgttgtgatcaactctgcaatcttggtatctctctcagtgctgctgctggtgcacttcagcatctctaccggcgtgcctgccttgacacagaacttaccgcgtatactgcgcaaagagcgtcctatttccttaggcatctttccgttgccggctggcgatggactgctaactcctgatgctcaaaaaggaggcgagacgcccggttccgaacagtggaaattccaagagctgagtcagcctcggtcccacacaagtctgaaggtgtctaattcacctgagcctcagaaagccgtggagcaggaggttcgcatggtgttgctaaatattctgcagaaggtgtactag

SEQ ID NO: 135975 - DNA, 1053 bp, Artificial Sequence
  Description of Artificial Sequence: Synthetic coding sequence
atgaaaccgctggtgttgttagtcgcactgctgctttggccaagctctgtgccagcctacccatccatcacagtgaccccagacgaagaacagaatctcaatcattatatccaggtattagaaaacctggtcaggagcgtaccctctggcgagcctggtagagaaaagaaatccaactcccccaagcatgtttattcaattgccagcaagggatccaagttcaaagagttggtaacccacggggatgctagcaccgagaacgacgtgcttacaaaccccatatccgaagaaacaacaacattccctacaggcggatttacacccgagatagggaagaaaaagcacacagagtccacccctttttggagcattaagcctaataacgtgagcattgtccttcatgccgaagaaccatatatagagaatgaggaaccggagccagaacccgaacccgcagccaagcaaactgaggctcccaggatgctgcccgtggttacagagtctagcacgagcccgtacgtgacgtcatacaagtcaccggtgaccaccctggacaaatcgaccgggataggcatctctacggagtccgaggatgtacctcaactgtccggcgagactgctatcgagaaacctgaagagttcggcaagcatcctgaaagctggaacaatgacgacattctgaagaaaatcttggacattaactcccaggtacagcaggctctgctgtctgacacttctaatcctgcctatagggaggatatcgaggccagtaaggaccatttgaaacgatccctcgcgttagctgcagctgccgagcacaagctaaaaaccatgtacaagtcccaactgctaccggtagggcgcacctcaaacaaaatcgacgatattgaaaccgtgataaatatgttgtgtaattccagatctaaactgtatgaatatcttgatattaagtgcgtgcctcctgagatgagggagaaagcagcaacagtattcaacaccttgaagaatatgtgccggtcaagacgagttaccgccttgctgaaagtctattag

SEQ ID NO: 135976 - DNA, 711 bp, Artificial Sequence
  Description of Artificial Sequence: Synthetic coding sequence
atggcatcttcagtggatgaagaggcgcttcaccagctctatttgtgggtagataacatcccactgagtcggcccaaacgcaacctgtcaagggatttcagtgacggcgtgctggttgcggaagtaatcaaattctacttccccaagatggtggagatgcacaactatgtgcccgccaatagcctccagcagaagttgtcaaattgggggcacttaaaccgcaaggtgctgaaacgcctcaacttcagtgtccctgatgatgttatgagaaaaattgcccagtgtgccccaggcgtagtagagctcgtgttgattcccttgaggcagcgcctcgaggagaggcagaggaggagaaagcaaggggccggctcccttcaggagctagccccgcaagacggcagcggctatatggacgttggagtgtcccagaaggcaaggggggagggtgttccagatcctcagggtggggggcagctgtcatgggatagaccacctgccccccgtcctccagcctacaacagagctctgcagggcgatccaagttttgtgttgcagatagctgagaaggagcaagagctgttggcttcacaggaaaccgttcaagtcctgcagatgaaggtccgcagactcgaacacctgctccagcttaaaaacgtccgtatcgaggatttgtcccggcggttacagcaggcagagcggaagcaacgctag

SEQ ID NO: 135977 - DNA, 351 bp, Artificial Sequence
  Description of Artificial Sequence: Synthetic coding sequence
atgtgcgaccaaaccaaacattccaagtgctgtcccgccaaaggtaaccagtgttgcccaccccagcagaatcagtgttgtcagtcaaaagggaaccaatgctgccctccaaagcagaatcagtgttgtcagcccaaaggatctcagtgttgcccccctaaacacaaccactgctgccagcctaaaccaccatgttgcatacaggcgcgttgctgtggactggaaaccaagccggaagtgtctccccttaacatggaaagcgaacctaattcaccacaaacacaggacaagggatgccagacgcagcagcagccccacagtccccagaacgagtcacgcccatccaagtag

SEQ ID NO: 135978 - DNA, 294 bp, Artificial Sequence
  Description of Artificial Sequence: Synthetic coding sequence
atggacaagcagtcctcggctggcggagtgaaacggtcggtgccttgcgatagcaacgaagccaatgagatgatgcccgagaccccaaccggcgactcagacccccaaccagcccccaagaagatgaagacgtcagaaagcagtaccatcctagtggtgcggtataggcggaacttcaagcgcacctcgccagaggaactgctgaacgaccacgctagggaaaaccggataaatcctttgcaaatggaggaggaagaattcatggagattatggtcgaaatcccagctaagtag

SEQ ID NO: 135979 - DNA, 2019 bp, Artificial Sequence
  Description of Artificial Sequence: Synthetic coding sequence
atgagatccattagatctttcgctaacgacgatcggcacgttatggtgaagcattcaactatctatccttcccccgaggagcttgaggcagtccaaaatatggtctccaccgttgagtgcgcacttaagcatgtatcagattggttggacgaaacgaacaagggcacaaagaccgagggcgaaacagaagtcaagaaggatgaagctggtgagaattattcaaaggaccagggcgggcgaaccctgtgcggagtcatgcggataggattggtggcaaaaggtctgttaattaaggacgatatggacctcgaactggtgcttatgtgtaaggacaagcccactgagaccctgttaaacacggtgaaggacaatctgcccatacagatccagaagcttacagaagagaaatatcaagtcgagcagtgcgtgaacgaagctagcattattatcagaaacaccaaggaaccaacactcacactgaaagtgatacttacatcaccgctgatacgggatgagctggagaagaaagatggcgaaaatgtgagcatgaaggacccgcctgacctccttgatagacagaagtgcctcaatgctttagcaagcctgcgacacgccaaatggtttcaggcgagagccaacggattgaaatcctgtgtgattgtactacgtatactaagggatctctgcaacagggtccccacctgggctcctctgaaggggtggcctctcgagctcatttgcgagaaatctattggaacctgcaaccggcccctcggggcgggcgaggcattgagaagggtgatggagtgcctagccagcggaattctcctcccaggaggtcccggtctgcacgatccttgtgagcgcgatcctactgatgctcttagctacatgactattcaacagaaggaagacatcactcatagcgcacagcatgctctgagactaagcgcattcggccagatctataaggtgctggaaatggaccccctgccatcctctaagccattccagaagtactcctggtctgtgaccgacaaggaaggcgccggctccagcgcactgaagaggccctttgaagacgggctgggagatgataaagaccctaacaaaaaaatgaagaggaacctccgaaaaatactggacagcaaggcaattgatttgatgaatgctctgatgcggctcaaccagatacgcccaggcctgcaatataaactccttagtcagtcagggcccgtccacgcacccgtatttactatgtcagtggatgtcgacggtaccacctacgaggcctccggcccgagcaagaaaacagctaagctgcatgtagcggtgaaagttctgcaggcaatgggctacccaactggcttcgatgccgacatcgaatgtatgagcagcgatgaaaagagtgacaacgagtcgaagaacgagacggtttcttctaattcatctaacaacacaggcaacagcactaccgagacgtcctcaacactggaggttcggacccagggtcccatcctgaccgccagcggtaaaaatcccgtgatggaactcaacgagaaacgcagggggttaaagtacgaactgatttcagagactggggggtcacatgataagcgttttgtgatggaggtagaggtggatgggcagaagtttcgaggcgcagggccaaacaaaaaggtggccaaagcatccgcagccttggccgccctagagaagctgttctctggcccaaatgcagcgaataacaagaagaagaagattatcccccaggcaaagggggtcgtgaacactgccgtcagcgccgctgtgcaagccgtgaggggtcggggccggggcacgctcacaagaggggcttttgtcggtgccaccgcggcccccggatacatagcaccaggatatggaaccccctatggatactcgacagcggcaccagcctatggcttgccgaaacgcatggtcctactgccagtgatgaaatttcctacctatcctgtcccccactactcatttttttag

SEQ ID NO: 135980 - DNA, 1977 bp, Artificial Sequence
  Description of Artificial Sequence: Synthetic coding sequence
atggtgaagcactcgacaatctacccttcccctgaagaattggaggccgtccagaacatggtatccaccgttgaatgcgcccttaagcacgtgagcgactggttagacgaaacgaataaaggaacaaaaaccgagggtgagaccgaagtgaaaaaagacgaggctggggagaattatagcaaagatcagggaggtagaaccctgtgcggggtaatgagaatcggcctcgtggccaagggtttgttgatcaaggatgacatggacctggaactggtgctaatgtgcaaggataagcctactgagaccctgctcaatactgtgaaggacaacctgccgatccaaattcagaagttgaccgaggagaaatatcaggttgagcagtgcgtgaacgaggcctccatcattatccggaacacaaaggagcccaccttgacactgaaggtaatcctgacgtcacctctcatccgtgacgagctggaaaagaaggatggcgagaacgtgagtatgaaggacccacccgacctcctggacaggcaaaagtgtcttaacgctctagcctcccttagacatgcaaagtggttccaggcacgtgcaaatggcctgaaaagctgcgtaattgtcctgcgcatcttgcgcgatctgtgcaaccgcgtcccgacctgggcaccattgaagggctggcccttagagctgatctgcgaaaagtccattggcacctgtaaccggccactgggtgcaggggaagcgttgcggagggttatggagtgcctggcctctggcatcttgttaccagggggacccggtttgcacgatccatgcgaaagggatccaacagatgcactgagctatatgacgatacagcaaaaggaagacattacccattccgctcagcatgctctgaggttaagtgccttcgggcagatctataaggttttagagatggacccactgcccagctcaaaaccgtttcagaagtatagttggtctgtgaccgacaaagaaggcgccgggtcatcagccctgaagaggccgtttgaagatgggctgggtgacgataaggatcctaacaagaagatgaagcggaacctgagaaagattctggatagtaaagctattgacctcatgaacgcactcatgcggttaaaccaaatcagaccgggcttgcagtacaaattactctcccagtcagggcccgtgcacgcaccagtgtttacgatgtcagtggacgtggacgggaccacatacgaagccagcgggccatccaaaaaaaccgcgaagctgcacgtggccgtcaaggtgcttcaagcaatgggctatccaacaggttttgatgccgacatagagtgtatgtcctcagatgaaaaaagcgataatgagtctaaaaatgagaccgtgagctctaatagtagcaataacaccggcaactctactaccgagacaagtagcaccctggaggttcgcacacagggtccgatcctgacagcgtctggtaaaaatcccgtgatggagctgaacgaaaaacgacggggtctgaaatatgagttgatatctgagacaggcggaagccacgacaagaggtttgtgatggaagtggaggtagacggacagaaattcaggggcgccggtcccaacaaaaaagtcgccaaagcttccgctgctttagccgccctggagaagctgttttcagggcccaacgccgctaacaacaaaaaaaaaaaaattatcccccaggctaaaggggtggtcaacactgccgtgagcgccgccgtacaagccgtgcggggtaggggcaggggaacactgactcgaggcgcgtttgttggcgcaacagctgcgcccggatacatcgcccctggatatggaactccttatggttattctaccgcggccccagcatacggactgcccaagcgcatggtattactaccagtcatgaaattccccacctaccctgttcctcactactcatttttttag

SEQ ID NO: 135981 - DNA, 285 bp, Artificial Sequence
  Description of Artificial Sequence: Synthetic coding sequence
atgcgaagcattcgctcgtttgctaatgatgatagacacgtcatggtcaaacacagcaccatatatccctctcctgaggaactggaggccgttcagaacatggtgtcgaccgtggagtgcgcactgaagcacgtgtccgattggttagacgagacaaacaaaggaacaaagacagagggcgaaacagaggtgaagaaggacgaagcgggagaaaactacagtaagtggtctgacatcgtctggtgtaacgaagactggccaggctgcaagcgcctggccgattag

SEQ ID NO: 135982 - DNA, 2019 bp, Artificial Sequence
  Description of Artificial Sequence: Synthetic coding sequence
atgaggagcatccgctcctttgcaaacgacgacagacatgtgatggtcaaacattccaccatctacccctctcccgaagaacttgaagctgtgcagaacatggtgtctaccgtcgaatgtgctctcaaacacgtgagtgattggcttgatgaaacgaacaaagggactaaaaccgagggagagaccgaggtgaagaaggatgaagctggagaaaactattccaaagaccaaggaggcagaacgctgtgtggggttatgagaataggcctggtggcaaagggactgcttataaaagacgatatggacttggagctcgtgctgatgtgtaaagacaagccaaccgagacgctcctgaacaccgtaaaggataacctgcctatccagattcagaagctgaccgaagagaagtatcaggtggagcagtgcgtcaatgaggcgagtatcatcatccggaacacaaaagaacccacactgacccttaaggtgatcctaacctcacctctgatacgggacgaactggagaaaaaggacggcgagaacgtctcaatgaaagacccccctgatctactggacaggcaaaagtgcctgaacgccctggctagcctccgccatgccaagtggtttcaggcccgtgctaatggtctgaagagttgtgtgatagttcttcgcatcctgcgggatctttgtaacagagtccctacatgggcccctttaaaggggtggccactggagcttatttgcgagaagtccattggcacatgtaatagaccactgggagccggtgaagctttgaggcgggtgatggagtgcctagcctccggcatccttttacctgggggacctgggttacacgacccttgcgaaagggatcctactgacgctctaagctatatgaccatacagcagaaggaagatatcacacatagtgcccagcacgcccttcggttatctgcattcggtcaaatttacaaggtgttagagatggaccctctcccttcttcaaagcccttccagaaatactcttggtccgtcacagacaaggagggcgccggtagctcggctctgaagaggccttttgaagatggcttaggggacgataaggatcctaataagaagatgaagaggaatttacgtaaaattcttgactcaaaagccatcgacctgatgaatgctttgatgcggttaaatcagatccgccctgggctgcagtacaaactgctgtctcagagcgggccggtgcacgcccctgttttcacgatgtccgtggatgtggatggcactacttacgaggcatcagggcctagcaagaaaacagcaaaactgcatgtggccgtgaaggtccttcaggccatgggctaccccaccggattcgatgccgacattgagtgcatgagttcagacgaaaagtctgacaacgagtccaaaaacgagacagtttcctccaatagcagcaacaacacaggaaactctacaaccgaaaccagtagcactctcgaggtacgcacgcagggccccatactcacggcctctgggaaaaaccccgttatggaactgaatgagaaacggcgaggcctgaagtacgagctgatcagtgaaacaggcggaagtcacgacaagagattcgtcatggaagtcgaggtcgacggacagaaattcagaggcgctggacctaacaagaaggtggctaaggcctccgctgctctcgcagcactggaaaaactgttttccgggcccaacgctgcaaataacaagaagaagaagattatccctcaggctaaaggcgtagtgaatacagccgtttccgctgcagtgcaggccgtgcgcgggcgtggccgtggcactctgacacgcggcgctttcgtaggtgccactgccgcaccaggctatatcgccccaggctatggcaccccttacgggtactccactgccgcccccgcatatggtcttcccaagcggatggtgctgctgccagttatgaaattccctacttacccagtgccccattattctttcttctag

SEQ ID NO: 135983 - DNA, 225 bp, Artificial Sequence
  Description of Artificial Sequence: Synthetic coding sequence
atgagatccattagatcctttgccaatgacgatcggcatgtcatggtgaagcatagtaccatctatccgagtcctgaggaactagaggcagtgcagaatatggtgagtactgtagaatgcgccctaaagcatgtgtcagactggctggatgaaacgaacaaagggaccaaaactgagggggaaacagaggtgaaaaaagacgaagcaggggaaaactattcctag

SEQ ID NO: 135984 - DNA, 1776 bp, Artificial Sequence
  Description of Artificial Sequence: Synthetic coding sequence
atgtcccttctcactaattatgaaggtttgcgacatcagatcgaaaggctagtgagagaaaatgaagagctcaaaaagctcgtaagattgatcagagagaatcacgaactgaagagcgccattaaaacgcaggctggaggtctgggcattagtggctttactagcgggctgggggaggcaacagccggcttgtcctcacgccagaataacggagtttttttgcctccatcccctgctgtggcaaacgaaagggtgctcgaggaagttggaattatggccctagcccctctcgcagaaatgttaacgtctctgcagcccagcgccaccccgggaagcctgatgtctccactaaccggaacgctatccaccctgctgtcagggccagctcctacttctcaatcaagccccttaacatcgttcctcacatcgcctatcgcggggccactcactggcaccctggctagttcattaggcctcccctctaccggcacccttactcccagcagcctggttgcgggacctgtggctatgtcccagagctctcctttaattgcaccggtgatggggaccgtagccgtttccctatcctcgcctttgctctcttcgacagccacaccccctggggttagccagaacttattagctaaccccatgagtaatctggtgctgcctgaggcgcctcggctgagactggcagagccccttcgcggaggcccaacaggtccacaaagccctgcttgcgtggttcctacggctaccactaaagttcccctatcgactgagcctccccagagcacgcaggatcctgagcccctgtccatggccttcgcaggggcccctttacagacatctacacccataggggctatggggactcctgctcccaaaacggctttcagctttaatacatcagatacacaggcccagccttctgccgctcaggaacaggtggtgccggcttctgttccaacgtctcctacgacaagtcccactgtgacagtcctggcctcagctcctgccctcgcaccgcaggtggccacgagctacaccccatcgtcaactacacatatagcccaaggggctccccacccaccatcacgtatgcataattccccaacccagaacctccctgtgcctcactgcccccctcataacgcccacagcccgccccgtacaagctccagcccagcatctgtgaacgacagcaggggcccccgaaccacagaaccgtctacaaagtccatgatggaagtagagcgcaagttagcccacagaaaaaccagcaaattcccggaaaatcctagagagagtaaacaattggcatgggaacggttggtgggagagatagcctttcagctggaccgcagaatcttgagcagtattttcccggaaagagtgcgcctctacggtttcaccgtcagcaacatcccagaaaagatcatccaggccagtcttaatccttctgatcataagcttgatgaaaagttgtgtcagcggctcacacaacggtacgtgtcagtgatgaacaggctccagtcccttggctataatgggcgggtgcatcccgcactaaccgagcagctggttaatgcctacggaattctccgcgaaaggcccgaacttgcagcctcagaggggggcccctacactgtggacttcctgcaaagagtagtggtggagacagtgcatccaggcatgctggcggatgcgctactgttactctcttgtcttagtcagctagctcatgacgacggcaagcctatgtttatctggtag

SEQ ID NO: 135985 - DNA, 1326 bp, Artificial Sequence
  Description of Artificial Sequence: Synthetic coding sequence
atgagcctactaaccaactatgaggggttgcgtcatcagatcgaaagacttgtgagggaaaacgaagagttgaaaaagctggttcggctcatccgcgagaatcacgaactcaagagtgctatcaagacacaggccggcgggttagggatcagcgggttcacaagtggtctgggcgaggctacagccgggctgtccagtagacagaataatggggtatttctcccaccaagtccggctgtggctaacgaaagagtgttggaagaggtgggtatcatggcgctggcccctctcgctgagatgcttacaagcctgcagcccagcgctacaccggggtctttgatgagcccactgaccgggacactaagcaccctgctaagcggacctgcacctacgtcgcagtcatccccactcacgtcgttcctcacttcacccattgctgggcccctgactggaaccctggcaagctctctaggtctgccgagtacagggacactgaccccgtcaagcctggtggcaggaccggtggccatgtcccagagctcccctctgatcgcccctgtgatggggacagtggccgtgagcctctcttctcctctgctgagctcaacggcgactcctcctggagtgtcccagaaccttctggccaatcctatgtctaatctggttctgccagaagcgccacgcctgcgcctggctgagcccctacgcggaggacccaccgggccccagagccctgcttgtgtcgtgcccacggcgactacaaaggtcccactgtccactgaaccacctcagtcaacgcaggatccagaacccttgtccatggccttcgcaggcgccccacttcaaacatcaaccccaattggcgccatgggcacgccagctcctaagacagccttcagttttaatactagcgatacacaggctcagccatctgcagctcaggagcaggtagtccccgcctcagtccctactagtcctactacttcacctacggtgaccgtcttggcctctgcaccagccctcgcgcctcaggtggcaaccagctacacaccgagcagcactacccacattgcacagggcgccccacacccaccttccaggatgcataatagcccgacacagaacctgcctgtcccccattgcccacctcataatgcgcacagtccgccacggaccagcagctcccccgccagcgtgaacgattctaggggcccgcgcaccaccgaaccatctacaaagagtatgatggaggttgaacgaaagctggcccatcgaaaaactagcaagttccctgagaaccccagaggctttccggagccccagtag

SEQ ID NO: 135986 - DNA, 573 bp, Artificial Sequence
  Description of Artificial Sequence: Synthetic coding sequence
atgtcttcttcagcattaacatgtggatcaactctagagaagtctggggatacctgggagatgaaggctttagacagttcaaggctggtcccttggcctcctcgaggattagggtcctcgacccagcacccaaacaagcctcattgcgccctcgcgtcttgccagggccctggagtgctacctggtgccgccagcgcactgcctgaacttacttttcagggtgatgtgtgtcagagtgaaacatgtcaacgctatctgcaagccgccatcagtctagacatcgccgtctcccagataaacctcctgggtagaccatcttctcctcctgctctgcttatccagcagggatcctgtgaacaagtcatccacaatagtacacctcagtttttgggaatggaggatggggataacgagcggacaactggctggctatggcggctatgcgaagacatcgacgcggagcccagctctactggctgtagccgatcaaaccagcttaccttcaccgaggggtgtttcgtcaggtccttatccacagtctactcaaacacccacattcacactcatctgtag

SEQ ID NO: 135987 - DNA, 1791 bp, Artificial Sequence
  Description of Artificial Sequence: Synthetic coding sequence
atgggattcataattcatattcagcaggtgaagaaacagcgcaaaaagctggaccagggactgatcctcaagaaggagaagtatagaaaggagaagaaatgtgcctctctgtcctttgaagtatccagcgacgggggaactgaaccatcggccttagtggacgataatgggtcggaggaggacttttcctacgaagacctgtgtcaggcctctcctcgctatctgcagccgggaggcgagcaactggcaataaacgaacttataagcgacggcaacgtcgtgtgcgccgaggccctttgggatcatgtcactatggacgaccaggaactggggttcaaagctggggatgtgatccaagtgctggaggcttctaacaaggattggtggtggggccgatccgaagacaaggaggcatggttccccgcatctttcgttagactcagggtcaatcaggaagagctgtccgagaattcctcgagcacgccatccgaagaacaagacgaggaagcttcccaaagtagacaccgacattgcgaaaataagcaacagatgcggactaacgttattcgtgaaattatggatacggaaagggtatacataaaacacctgagggatatctgtgagggatacatccgtcagtgcaggaagcacactggaatgtttactgttgcccagcttgcaacaatctttggcaatattgaggatatttataaatttcagcggaaattcctgaaggacctcgagaagcagtacaacaaagaagaaccgcacctatcagaaatcggctcctgttttcttcaaaaccaggaaggctttgcaatatacagcgaatactgcaacaaccacccaggagcctgcctggagctcgctaaccttatgaagcagggcaaataccgacattttttcgaggcttgcagacttttgcagcagatgatcgatatcgccatcgacggcttccttctgacccccgtccagaaaatctgcaaatatcctctccagctagcagaactgctgaaatacactacccaggagcacggcgattactccaacatcaaagcagcctatgaagcaatgaagaatgtagcatgtctgattaacgagcggaaacgcaaactggaatctatcgacaaaattgccaggtggcaggttagcattgtgggttgggaggggttggatattttggaccggtcgtccgagctgattcacagcggcgagctgaccaagattaccaaacagggaaagtcacagcagcgcacttttttcctgtttgatcatcagctggtgagctgcaaaaaggaccttttgagaagagatatgctctattataaaggacggctggatatggatgagatggaactggtggatttaggagacggaagagacaaagattgcaacctgtctgtgaagaacgcattcaagcttgtgtcccggaccaccgatgaggtgtatctgttctgtgccaagaaacaggaggacaaagcgagatggttgcaggcttgtgccgatgagagacggcgggtacaggaggacaaggagatggggatggagatctcggagaatcaaaaaaagttggctatgctgaatgcgcagaaagctgggcatggaaaatccaagggctacaatcgctgccccgtcgctccgcctcaccaggggcttcaccccatccatcaacgccatataaccatgcctacttctgttccccagcagcaggtgttcggcctggctgaacccaagcgcaagagtagcctgttttggcatacattcaaccgactgacaccctttagaaagtag

SEQ ID NO: 135988 - DNA, 1959 bp, Artificial Sequence
  Description of Artificial Sequence: Synthetic coding sequence
atgacttcagcctctccagaggaccagaacgcgccagtggggtgccccaaaggggcccggcgcaggcggcctatcagcgtaatcgggggcgtgagtctctacggtacaaatcagactgaagaactggacaatctgcttacccagccagcatctcgtccccccatgcctgctcaccaggtcccaccctacaaagccgttagcgctaggttccggccgttcactttctctcagagcacccctatagggctagaccgagtgggacgtcggcggcagatgcgtgcaagcaacgtgtcctcagatggtggcaccgaacctagcgctcttgtagatgacaacggctcagaggaagacttctcttatgaagacctgtgtcaggccagccctcgctatctgcagcccggtggggagcagctagctattaacgagctgatatctgacggcaacgtggtgtgcgccgaagccctctgggaccatgttacgatggacgaccaggagctcggatttaaggccggcgatgtcatccaggtactggaggctagtaacaaagattggtggtggggaagaagcgaggataaagaggcctggtttcccgcctcattcgtcaggcttagggtaaaccaggaggaactgagcgagaacagtagctccacccccagcgaagagcaggatgaagaggcgtcacaaagcagacacagacactgcgagaacaagcaacagatgaggacgaacgttattagggagatcatggacacagagcgggtgtatatcaagcacttgcgggatatctgcgaaggatatatccgccaatgtcggaaacataccggaatgttcacagtggcccagcttgcgacaatttttggtaacattgaggacatctacaagtttcagcggaagttcttgaaggatttggagaaacagtacaacaaggaagaaccccatctctctgagatcgggtcctgcttcctgcagaatcaggaaggattcgcaatatacagtgaatactgcaacaatcacccaggagcatgcctggaacttgcaaatttgatgaagcaggggaagtatcgccacttctttgaggcctgccgcctcttgcagcagatgatcgatatcgcaatcgacggcttcctgctgacacccgtgcaaaaaatatgtaagtaccccctccaattggcagagctcctcaagtacacgacacaggagcacggtgactactcgaacattaaagctgcgtatgaggcaatgaaaaacgtagcttgcttgataaatgagaggaaacggaaacttgagtctatcgacaagatcgctcgctggcaagtgagtattgtgggttgggagggcctggacatcttagaccgcagtagtgagctgattcactccggagagctgacaaagatcactaaacaggggaaatctcaacaaaggaccttctttttgttcgatcaccagctggtgtcttgtaagaaagacctgctccggagggatatgttgtactacaaggggagactggacatggatgaaatggagctcgtagatctgggcgacggacgggataaggactgtaacctttctgttaagaacgccttcaagctggtctcacgcacgacagatgaggtatatttgttctgcgcaaagaaacaggaggacaaggctcgttggttgcaggcatgcgctgacgagaggaggcgcgtgcaggaggataaagagatggggatggaaattagcgagaaccaaaaaaagttagccatgttgaacgcgcagaaagccggacatggaaagtccaagggctacaaccgctgccccgtcgcacctccccatcaaggacttcacccaatccaccaacgacacataaccatgccaacttctgtgccccagcagcaggtattcggactcgcggaacctaaaagaaagagctccttgttctggcacacctttaatagacttacaccctttaggaagtag

SEQ ID NO: 135989 - DNA, 3834 bp, Artificial Sequence
  Description of Artificial Sequence: Synthetic coding sequence
atgacgcaagcagcggttcggccctgggcgccgtgtttggaaaacatgactacagcaccaaacggtcttggacccggaccagctgcaccatgtgccggctctgacctcaaggatgccaagatggtcaccagcctcgcatgcggcaacggcgtctgtggctgttcacccggaggagatactgacacccaggaagcaaaactctcaccggccaagctcgtgaggcttttttctaccagccggaaaagaactggagcccacccagagcggcctcatagtatggtgttggtcggcaactcgtctacatggaatacccttgcatcatttcgcaagatgggatcatttaagaagcttaagtctagtgtgctgaagggcatccagagtcgcgaaggttctaacgcctgctccaagggcgaggcatctgagcatgggctgggaaaaagcattccaaatggggctgtcccaggcgctcaggcctcacggggaagtcccctcgctccaggcccggcgtgtggcgcactgcgcccggcagagtggggaacacttgatggctccgatctggaggacacagatgatgcgttccagaggtcgacacaccgctcgagatctttgagacgggcttacggtctgggccgtatttgcctgcttgacgcgccacagaatcacgccacccccactatcgctactggccaagtccccgctgtctgtgaaattctggtgcgggacccagagaacaatagcatgggatataggaggagcaagagtacggataacttagcgttcctaaagaaatcttcttttaaaagaaaatctacgtccaacctcgcagatttgcgcactgctcatgacgcacgcgtgccacagagaaccctctcaagtagctcaactgacagtcagaaacttggcagtggccggaccaagcggtggcggtcacctatcagggcaaaggattttgaccgggtgttcaagctggtgagcaacgtgacggaggctgcttggcggagagagagcccaaggtctggtgcaccatcgccaggcgaggcatcactgaggctgcaggctcactctcggttgcacgacgactattccaggcgtgtgagccggagtaccgaacaagattctagacgtggcggtgccgtgatgcatggcaccacggctacctgcaccgtagcgcccggcttcgggtctgcaacaagcaaaggtccgcatctggacgccgatacggctgtgttccctttagagacaaagagttcatgggcagtggaaagcgattccagttgtacctgctcctcactgccaagtcccatcgtacaggatgtgctgtctaaagactcctgtgatccgaatgctggttctcagctgacctttgaccctgagcagccccccaccccgctacggccgaccactcccaaaccccagagccctcaatctcctcagagtcccggcgcgggctctgcatcatgtcattccaaccacagcgccctgtccgccaactcggaggagtccgaagggcgggccgaggagcccgcccaaagggagcccggacctgtgtctttacaagacccactagaggccacccacggagacgagggctctaaagaccttctcgtcaatatcggggttgctgccgggccagaggagaaggagaaggaggaagtcgttccggacggcccctggagacgcagctcttctcaggacgaagaacggaccgaagcacagcgcaccccgaagcgacgctggggctcaggaaggcgaccccgcccacgcccattttcagactatggacaacttgcgtctcggtccctctcaatacccgaggacagtgttgctgcagatcctcagaaggaggacagagttgatgaagacccccaggctagcatgaccagcgctagccctgaggaccagaacgccccagtgggctgtcctaagggggcaaggaggaggcggccaatcagtgtcatcggaggagtgagtctttacggtaccaatcagacagaggaactggacaatctgctgacgcagcccgcctcaagaccacctatgcccgctcaccaggttcctccttacaaggcagtttccgcccggttccgcccatttacattttctcagagtacgcccatagggcttgatagagtcgggaggcggcggcagatgcgtgccagcaatgtgtcctctgacggcggtacagaaccatcggccttagtggacgacaatggatctgaggaggacttctcatacgaggacctgtgccaagcaagcccaaggtatctgcagccaggaggtgaacagctcgccatcaatgagctgatatccgacggcaatgtcgtttgtgccgaggcgctgtgggatcacgtgaccatggacgatcaggaactcgggttcaaggctggggacgtgatccaagtactcgaagcctcgaacaaggattggtggtggggcagatccgaagataaagaagcttggtttcctgcttcttttgtcagactccgcgttaaccaagaggagctgagcgaaaactctagtagcactccctcagaagaacaagacgaagaggcgagccagagccggcaccggcactgtgagaacaagcagcagatgaggactaacgttatccgggagattatggatactgagcgggtgtatataaaacatctgagagacatctgcgagggatatatccgccagtgccggaagcataccggaatgtttacagtcgcgcaattggcgaccatcttcggcaacatagaggatatatataaattccaaagaaagttcctcaaagacctggaaaaacagtacaataaggaggaaccccatctgtccgagattggcagctgctttctgcagaatcaagaaggattcgctatctacagcgagtattgtaataatcaccccggcgcttgtttggaactcgccaatttgatgaagcagggaaagtatcgccacttcttcgaggcctgtcgtctactacagcaaatgattgatatcgctattgatggcttcctgcttacccccgtgcagaaaatttgcaaataccccttacaactggccgaattactgaagtatacaacacaggaacacggagactactctaacatcaaggccgcctatgaagcaatgaaaaatgtggcctgcctgatcaatgaaaggaagcgcaaactggagtccatcgataaaatcgcccgttggcaggtgagcatagttggttgggagggtctagatatcctggacagaagttccgaacttattcacagcggcgagcttaccaagatcacgaaacagggcaaaagtcaacagcggacgtttttcctatttgatcatcagctggtttcatgtaaaaaggacttgctccgtagggacatgctgtactataagggcagattagacatggatgaaatggaacttgtggatttaggtgatgggagggacaaggattgtaatctcagcgtcaaaaatgccttcaaactcgtcagcagaaccacagatgaggtttatctgttttgcgcaaaaaaacaggaagataaggcccgctggctgcaagcgtgcgctgatgaaagaaggcgcgtgcaagaggataaagaaatgggaatggaaattagtgagaaccagaagaaattggccatgcttaacgcgcagaaagccggacatgggaaatccaagggctacaaccggtgccctgtcgcgcctcctcaccagggactccatcctatacaccagcggcatattactatgcccacctccgtcccccagcagcaggtcttcggcttggccgaaccaaagcgaaagtcttcccttttctggcacacctttaaccggctcactccatttagaaagtag

SEQ ID NO: 135990 - DNA, 3948 bp, Artificial Sequence
  Description of Artificial Sequence: Synthetic coding sequence
tgacccgtggcaactcaggaacccgatgtacaggggaggtgtgagtgtcaagacgggatcccaggcgatgaaggcctggagctcaggagcgcagattccgcagtcccggtagccatgacacaagcagccgttaggccttgggccccatgtctggagaacatgacaactgctcccaatggactgggccccgggcctgcagctccatgcgctgggtctgatctgaaggatgctaaaatggtgacctccttagcgtgtggcaacggggtatgcggctgttcccccggcggagacaccgacacacaggaagctaaattgtcgcctgctaaattagtgcggttgttctcaacctcgagaaagcgaacgggagcccaccccgaaaggcctcacagcatggtgttagttgggaacagtagcacatggaatactttggctagttttagaaaaatgggatcctttaaaaagctgaagagctccgttctgaaaggcattcaatccagggagggaagtaacgcttgttccaagggggaggcgagcgaacacggactcggcaagtccattcctaacggcgccgtccccggggcacaggcttcaagaggaagcccgctcgctcccggtccagcctgcggtgccctgcggcccgctgagtggggtacactggatggctctgacctcgaggatacggatgacgcttttcagcggtccacccaccgcagccgatcacttaggcgggcatacggcctgggaaggatctgtttattagatgctccccagaaccacgccacgccaaccatcgccactgggcaagtgcccgctgtgtgtgaaatactcgtacgagacccagagaacaattctatgggctataggaggtccaaaagcacggacaatctggcattcttaaaaaagtcatcgtttaagagaaagtctacttccaatctggctgatcttcgcacagcccacgacgcgagggtgccccaaagaactctgagctcctcaagtactgatagccaaaagctgggatccggtcggaccaagaggtggaggtctccaatccgcgctaaggactttgacagggttttcaagcttgtatccaatgtgacggaagcggcctggagacgagagtccccaagatccggtgccccttcaccaggcgaagcaagcctgagattgcaagcacattcccggctccacgatgactactctcgccgcgtaagcagatcaacagaacaggacagccggagggggggtgcggtaatgcacggtaccacagccacctgtactgtcgccccggggttcggatcagccactagcaaggggccccacctcgacgccgatactgcagtctttcctctggaaaccaagagtagttgggctgttgagtccgatagtagctgcacttgctcttcattgccctcccctattgttcaggacgttctgtccaaagattcatgcgacccaaacgccggcagtcagctgacctttgaccctgagcaacccccaacgcccctgcggccaacgacgccaaaaccgcaaagcccccagtcccctcagtcacctggagcaggaagtgcctcatgtcactccaaccacagcgccctgtccgccaatagcgaagagagcgagggtcgggctgaggaacccgcgcaacgtgaaccgggccccgtgagcctccaagacccgttggaggccacacacggagatgagggatccaaggacctactcgtgaatatcggcgtggcggcagggcctgaggagaaagagaaggaggaggtggtcccagacgggccatggcgacgctcttcaagccaggatgaggagcgaactgaagcgcagaggacccctaaacgccggtgggggagtgggcgtagacccaggcctcggcccttttcagattacggtcaactggccagccgttcgttatccattccggaagacagcgttgccgccgaccctcagaaggaggatagagtggatgaggacccacaggcgtccatgaccagtgcctcccccgaagatcaaaatgctcctgtcggctgtccaaagggagcgcggcgaagacggcccatttctgtgatcggaggagtgtcattgtacgggaccaaccagactgaagagctggataatctgttgacgcagcccgcaagtagaccacccatgcccgctcatcaggtgcccccttacaaagcggttagcgcacgatttcgtccttttactttcagtcaatcaacacccatcgggctggaccgagtcggccggagaagacagatgagagcgtcaaacgtgtcctctgatggtggtacagagcctagcgcactcgtcgatgataatggatccgaggaagactttagctacgaggatctttgccaggctagccccaggtacctccagcctggtggggaacagttggcaatcaatgagctcatcagcgacgggaatgtcgtctgtgcggaggccttatgggatcatgtcaccatggatgatcaggagctaggcttcaaagccggagacgtgatacaggtgctggaggcatctaataaagattggtggtggggcaggagtgaggacaaagaagcctggtttcctgcatcctttgttcgattacgggtaaaccaggaggaactgtccgagaactcttccagcaccccatccgaggagcaggatgaggaagcctcgcaatctcgccaccgccattgcgagaacaagcagcagatgcgcaccaacgtcatccgggaaattatggacaccgagagagtttacataaaacacctaagggatatctgcgaaggatatattaggcagtgccggaaacatacagggatgtttaccgtcgcacagctagccactatcttcgggaatattgaagacatctataagtttcaacgcaaatttcttaaagacttagaaaaacagtataacaaggaggagccgcatctaagcgaaatcggaagctgcttcctgcaaaaccaggaaggatttgcgatctacagcgagtattgcaacaaccaccctggggcatgcctggagttggcgaacctgatgaaacagggcaaatacaggcatttctttgaggcttgccgtctgctacagcagatgatcgatattgcaatcgatggtttcctgcttactcctgtgcaaaaaatctgcaagtaccccctccagctcgcagagctgcttaaatatacgacacaggagcacggtgactattctaacattaaagcggcatatgaggccatgaagaatgtggcctgtttgataaacgagcggaaacggaagctggagtcaatcgataagatcgctcggtggcaggtttctattgtggggtgggaagggctggacattctggatcgttctagtgagttgatccatagcggtgaattaaccaagattactaagcagggtaagtcgcagcaaaggacttttttcctgttcgatcatcagctggtgtcgtgcaagaaggatttgctgcggagggatatgctgtactataaagggagactagacatggatgagatggagctggttgacctcggagatgggcgagacaaagactgtaacttatccgttaagaacgcctttaaactggtaagtaggacaactgacgaagtgtatttattttgtgccaagaaacaggaggataaggctaggtggctgcaggcctgtgcagatgagagacgccgcgtacaggaggacaaagagatgggcatggagatcagcgagaatcagaagaagctcgctatgctgaatgcgcagaaggcgggtcatggcaagagtaaaggatacaaccgatgtccggtggcccccccacatcaaggtctgcacccaatacaccaaaggcatattacaatgcctacttctgtgccacagcagcaggtttttggtcttgcagaaccaaaacgcaaatctagccttttctggcatactttcaacagactcaccccttttcgcaaatag

SEQ ID NO: 135991 - DNA, 1851 bp, Artificial Sequence
  Description of Artificial Sequence: Synthetic coding sequence
atgcctgctcatcaggtcccaccctataaagccgtgagcgcccggtttagaccctttacgttcagtcagagcacccccataggtctggatagggtgggaaggcgtcgccagatgagggcctctaatgtctcatcagatgggggaactgaaccttctgcacttgtggacgataacggatccgaggaggacttcagctacgaagacctgtgccaagcgagtccccgctatctgcaacccggaggagagcaactggcgattaacgagcttatatctgatggcaacgtcgtctgcgcagaggcgttgtgggaccacgtgaccatggatgatcaggaattagggttcaaggccggggatgtcatccaggtgctggaggcctccaataaggactggtggtgggggcggtctgaggacaaggaagcatggtttccagcaagctttgtccgcttgcgggtgaaccaggaggagctgagcgagaatagttcaagcaccccctccgaagagcaggatgaggaagccagtcagtcccgtcaccgtcactgtgagaataagcaacaaatgaggactaacgtcatacgggagattatggacacagaaagggtttatattaagcacctgagggatatttgtgaaggatacattcggcaatgcagaaaacacacaggaatgtttacagtagctcagcttgcgaccatattcggcaatatcgaggatatctataagtttcaacgcaagttcctcaaagacttggagaaacagtacaacaaggaagaaccgcacctctcggagatcggcagttgcttccttcagaatcaggagggtttcgccatctattcagaatattgcaataaccatcctggcgcttgtctcgaactggccaacctaatgaagcagggcaaatacagacatttctttgaggcttgccgcctactacagcagatgattgacattgcaatagacgggtttctactgactcccgtgcagaagatctgtaaatatcccctccagctagcagagttgttgaagtacactacacaggagcatggtgactattcaaatattaaggcggcctacgaggccatgaagaatgtcgcgtgtctcatcaatgagaggaagcggaagctggaatctattgacaagattgcccggtggcaggtgtctatcgtggggtgggaagggctcgacatactggatcggtcctccgaactaatccattcaggtgagttgactaagatcacaaagcaggggaagtctcagcagcgcactttcttcctgtttgatcatcagctcgtctcctgtaaaaaggacctgttgcgtcgcgatatgctgtattataagggtagactggatatggacgagatggagttggttgacctcggggatggcagagacaaagactgtaatctgagcgtgaaaaatgccttcaagctcgtgagtaggaccaccgacgaagtctatctcttttgtgccaagaagcaagaagacaaggccaggtggctccaagcctgcgcagatgagagaaggcgcgtccaagaagacaaagaaatgggaatggaaattagcgagaatcagaagaaacttgccatgttgaacgcacagaaggccggtcatggtaaatcaaaggtgaggttacagcaagttccatgtgggcccacagccccgggccccgccccccatccgcccgccccgcatcactacgctcacaagcgcccccctgccgccgggctatggccaggcggcacccaggaagaagtgcttgccctactcgcgcatttgcaacaggcccacccactgccagagatgaagaccggcgggtgtgccagcatggaactcggggtcaagaggcggaactag

SEQ ID NO: 135992 - DNA, 1710 bp, Artificial Sequence
  Description of Artificial Sequence: Synthetic coding sequence
atggatgcaggcagctcgcgtagtctggaaaatgcagtgaacagaatctaccatgaccagctagtgcccaaaatcaacacgtcaaagaagatgagcacactggctcatccgcctaacattcttgagatgagccaggaaatcaaaaagaattgcggaggaaagcaagttgaaattactttggagaggaccaaaatgacgaagggcatcaaagagaaacagtccaatgatttggaaaaagccgctttcaaaagaaaggcagaaggagaagaaaaacctaccagaaagaagcaagcaaagatcaccgagctcgacaaccagctcattaccatgcccctgcctcatattcctctcaagaacatcatggatgtggagatgaagctagtgtatatcgacgaaatgggcgtacgatacgagttcgtagagtccttcatgagcacaggaagccagcctacttgccaggctgctgagatcgtggatccactgtccgtacataacttcagttttctccctcaaattgacaaatggttacaggtcgcactgaaagacgccagttcttgctaccggcagaaaaaatacgccttggctgcaggccagtttaggaccgcactcgaactgtgttctaaaggcgctgtgctaggcgagccctttgacgcccctgccgaggatattgcttcggtggcaagctttatcgagaccaaactcgttacatgttacctccgcatgcgtaagccggatcttgctttgaatcacgcacacagaagtattgttctgaacccggcttacttccgtaatcaccttaggcaggctaccgtttttcgttgcctagaacggtactctgaagctgcaaggtccgccatgatagctgactatatgttttggctcggaggcggtcgagaggaaagtatttcgaaactcatcaaattatattggcaggctatgattgaagaggccattaccagagccgagtctttttccgtaatgtacacccctttcgcaaccaaaattcgcgcggataagatcgagaaagtcaaagatgccttcactaaaacccaccctgcctacgccgaatacatgtatactgacctgcaggctctgcatatgttaccacagacagtggattggtcctccttcccacctcaacagtatctgctgacgctgggcttcaaaaataaagatgacgggaagtttttggagaagatatcgagtcgaaagttgcctatctttaccgaacataaaacaccctttgggctgacccgtgaggacactgttagacagatggaaacgatggggaagagaatcctccctatcctggactttatcaggagcactcagttaaacggctccttccccgcctcctcaggcgtgatggagaagctgcaatatgccagcttgctttcacagttgcagcgagttaaggagcaaagtcaggtgatcaaccaagccatggctgagctggctaccataccatacctgcaggacatctcccagcaggaggctgaattactacaatccctcatggctgacgctatggatacactggagggccgaaggaataataatgagcgtgtatggaatatgattcagaaagtgggacagatcgaggacttcctttatcagttagaggatagctttctgaagacaaaaaaactgaggaccgctcggcggcaaaaaactaagatgaaaaggttgcagacagtgcaacaaagatag

SEQ ID NO: 135993 - DNA, 1086 bp, Artificial Sequence
  Description of Artificial Sequence: Synthetic coding sequence
atggctaccttggcgcgactgcaggcgaggtctagcaccgtgggtaaccagtactactttcgcaacagcgtggttgaccccttccgcaagaaagagaacgacgcagccgtaaaaatccagtcatggtttcgaggttgccaagtccgggcatatataagacaccttaaccgcatcgtgaccattatccaaaagtggtggcgaagttttctgggtagaaagcagtaccagctcaccgtgcaggtggcatactacacgatgatgatgaatctttacaacgccatggcggtgcggatccaaagacgctggcggggctacagggtgcgaaaatacctcttcaattactactatctgaaggagtatttgaaggtagtaagtgagacgaatgatgccatcagaaaggcattagaagaatttgctgagatgaaagagagagaggagaaaaaagcaaatttagagagggaggagaaaaagagggactatcaggcacgcaagatgcattacctgctgagcaccaagcaaatccctggcatatacaacagccccttccgcaaagagccagacccctgggaacttcagctccagaaggccaagcctctcacacacaggcggcccaaggtcaagcagaaagactccacctccttaactgactggttggcgtgtacctctgctaggtccttcccacgctccgagatcctgcctccaatcaacagaaaacagtgccagggccccttcagagatatcaccgaagtgttggagcagcgctaccgccccttggagcctacactccgggtcgccgaacctatcgatgaactaaagttggctagggaagagttacgcagggaagagtggcttcagaatgttaatgacaatatgttcctgcccttttcctcgtatcacaaaaacgaaaagtatattccgtcaatgcatctttcgagtaaatatgggcctataagctacaaagagcaattccggagtgagaaccctaagaaatggatctgcgacaaggatttccaaactgtcctgcctagtttcgaattattttctaagtacggaaagctctactcaaaggccggccagattgtatag

SEQ ID NO: 135994 - DNA, 1617 bp, Artificial Sequence
  Description of Artificial Sequence: Synthetic coding sequence
atggcagagaatctgaagcgactcgtatcaaatgagacattgagaaccctgcaggaaaagctagacttttggttgaaagagtataatacaaatacttgcgaccaaaatctcaaccactgcctcgaactgattgaacaggtcgccaaggttcagggacagcttttcggaatccttactgccgcggcacaggaaggcggtagaaacgacggggtggaaacaattaagagtcgactgctgccctggcttgaggcatccttcaccgccgcttccctgggcaagtcggtggactcaaaagtgccttcactgcaggacacctttgatcgggaacgtcacaaagatcctagcccaagggatcgagacatgcagcagcttgactctaacttgaattcaacccgatcacagtgcaatcaggtccaggacgatctcgtggaaacagaaaaaaacctcgaggaatcgaaaaatcgtagcgcaattagcttgctggccgccgaggaagaaattaatcagcttaagaagcaactcaaaagcctgcaggcacaggaggatgcacggcaccggaacactgaccaacgctctagcgagaacagacgctctgagccttggagccttgaggagcgtaagcgcgagcaatggaactctctcaaacagaacgccgaccagcaagatactgaggcaatgtcggactataaaaagcaacttagaaatcttaaagaagagattgctgtgctttcagccgaaaagagcgcgcttcaaggtcggtcatctcgcagccgcagtccaagccctgcacccagatctaggagttgcagccgttctagatctgcgtccccttctaccgctgtgaaggttagacgtccgagccccaaccggtccaaactgtccaatgtggcccgcaaagccgcccttctaagccggttctctgattcctattcccaggccaggctcgacgcccaatgcttactgcgcaggtgcatcgacaaagccgaaaccgtgcagcggatcatctacattgccactgtggaagcgtttcacgtcgccaagatggcattccggcacttcaagatccatgtcagaaagtctctgacacctagctacgtgggtagcaacgacttcgagaacgccgtcctggactacgttatatgccatctcgatctttacgactcacagtcttctgtcaacgacgtgatccgtgcaatgaatgtcaatccgaagatctcatttccgcctgtggttgatttttgcttactatccgacttcatccaagaaatctgttgtatagctttcgccatgcaggctctggaaccgccactggacatcgcctacggagccgatggagaggtattcaacgactgtaaatatcgtcggtcatacgactccgacttcacagcgcccctcgttttgtatcacgtctggcccgcactgatggaaaacgactgcgttattatgaaaggcgaggctgtgacaaggagaggagccttctggaattctgtccggtccgtgtctaggtgtcgatctcgatctctgtcccctatatgcccgagatcacagatcggactgaacacaatgtcccgctcacgaagccccagtcccattagatgcgggttgcctcgcttttag

SEQ ID NO: 135995 - DNA, 504 bp, Artificial Sequence
  Description of Artificial Sequence: Synthetic coding sequence
atgataattacgacttggatcgtgtatatcctggcacgcaagggggttggtctgcccttcctccctattacttcctctgatattgacgtggtagagtctgaagctgtatctgttcttcatcactggctgaaaaagactgaggaagaggcctcccgaggtatcaaggaaaaacttagcattaatcacccctctcaaggtgtgagggaaaaaatgtccacagatagcccccccacgcacggtcaggacattcatgtgacacgtgatgtcgtgaaacaccatttgagtaagagcgatctgttggccaatcaatcgcaggaagtcctagaggaacggactcgtatccagttcatccggtggtctcatacaagaatttttcaggtgccctccgagatgactgaagatatcatgcgagaccggatagaacaagtgcgtcggtctatttcccgcttgaccgacgtaagcgctcaggacttctcaatgaggccttcttccagtgattgttag

SEQ ID NO: 135996 - DNA, 504 bp, Artificial Sequence
  Description of Artificial Sequence: Synthetic coding sequence
atgatcattactacatggattgtttacattttggcccggaagggagtgggtctgccctttctgcctattacttcatccgatattgacgtggtagagtccgaagccgtgtcagtcctgcatcactggctcaagaaaactgaggaagaagcaagtagaggtattaaggaaaagctgagcataaatcatccgtcacagggcgtaagagaaaaaatgtctaccgacagcccccccacccacggccaggacatccatgttactagggatgtagtgaagcaccacttatcaaagtccgatctactggccaatcagtcacaagaagtcctggaggaacgcaccaggattcagtttatcagatggagccacaccaggatattccaggtgccctccgagatgacggaggacatcatgcgagatagaatcgagcaggtgcggagatcaataagccggctgaccgacgtgtccgctcaagacttctcaatgcggccctcaagtagcgactgttag

SEQ ID NO: 135997 - DNA, 1563 bp, Artificial Sequence
  Description of Artificial Sequence: Synthetic coding sequence
atgggcaagccatctagtatggatacgaagtttaaggacgacctattccgaaagtatgtgcagttccatgagtcaaaggttgacacaactacctctaggcagcggccaggaagcgacgagtgcttgagagtcgcagcttccactctattgtctctccataaggtagatcccttttacaggtttagactaatccagttctacgaggtggtcgagtcctcgttgcgctctcttagtagctcatccttgagggcgttacatggtgcgttttcgatgctcgagaccgttgggatcaatctgttcctgtacccttggaaaaaagaattcaggtctatcaaaacgtatacaggtccgtttgtgtattacgtgaagagtacactgcttgaggaagatatcagagccattttgtcgtgcatgggatacacccccgagctcggcaccgcctataaactaagagaactggtggagactttgcaggtgaaaatggtcagttttgaactgtttctcgctaaagttgagtgcgaacaaatgctcgagatccatagccaggtgaaagacaaggggtacagcgagttggacatagtgtctgagcggaagagtagtgcagaggatgttcggggttgcagtgatgccctccggcgtcgcgccgagggccgagagcatttgaccgctagcatgagtagagtcgccttgcagaagtcagcctccgagagggccgccaaggactactacaaacctcgtgtcacgaagccctcaaggtctgttgacgcttacgacagctattgggagtctcgtaagccgccgctcaaagcatcactgtcgctgcgcaaggagccagtcgcgacagacgttggtgacgatcttaaggatgaaatcatcaggccttcccccagcttgttgacgatggcctcatcccctcacggcagtcctgacgtactgcctcctgcttcccccagcaatggcccagctctgctgcggggcacctacttcagtactcaagacgatgtggatctctataccgattcagagccccgagccacataccgaaggcaggacgccctcaggcccgatgtatggctgttgcgcaatgatgcgcattccctgtatcataaacgctctcctcccgcgaaagagagtgccttaagtaaatgccaaagctgtggcctatcatgcagttccagcctgtgtcaaagatgtgattccctgttaacttgcccccccgcctccaaaccatctgccttcccaagtaaggcgagtacacatgattccctggcccacggagcatcattgcgggaaaaataccctggccaaacacaaggcctggatcgcctgccacacctccactccaaatccaagccttcgacaacccccactagcaggtgcggattctgcaacagacctggcgcgacaaatacttgcacccagtgctctaaggtgtcctgtgatgcatgcttatcagcctaccattatgacccctgttataagaaaagtgagctacacaagtttatgccaaataatcagttaaactataagtcaactcaactttcacatcttgtttaccgctag

SEQ ID NO: 135998 - DNA, 1563 bp, Artificial Sequence
  Description of Artificial Sequence: Synthetic coding sequence
atgggcaagcctagctccatggacacgaaattcaaagacgatctgttccggaagtatgtgcagttccacgaatcaaaggtggataccaccacaagtcgccagaggccaggaagcgatgaatgtcttagagtggctgcaagtacccttctctctctgcataaggtggatccgttctatcgttttcgactcatccagttttatgaagtcgtggagagttccctgcggagcctgtcctcaagcagtctgcgcgctctccacggcgccttctccatgttggagacagtgggcatcaacttattcctatacccctggaaaaaggagttcagatccataaaaacctacaccgggcccttcgtgtactacgtgaagagcacgcttctcgaggaagatatcagggccatactgagctgtatgggatacacccccgagctgggcaccgcttataagttacgcgagctggtggaaacacttcaggtgaaaatggtgagcttcgaactcttcctggcgaaggtggagtgtgaacagatgcttgagattcacagccaggtcaaggacaaaggatatagcgagctcgacatcgtctcagaacgtaagtcgagtgctgaggatgtcagagggtgttctgatgctctcaggcggcgagccgaggggagggaacacctcactgccagtatgagtcgagtggctctccagaagagcgcatccgagcgcgctgccaaagattattacaagcccagagtgaccaagcccagcagatcagttgatgcatacgattcctactgggaaagtcgtaaaccacctttgaaagcctcattgagcctgcgaaaagagccggtggctaccgatgtcggagatgacctgaaggatgaaatcatcagaccctccccctctcttttaaccatggcctctagcccacacggctcgcctgatgtccttccacccgcatccccctccaacggcccagccctgctgaggggtacctacttcagcacacaagatgacgtagacctgtacaccgactcggagccaagagctacctaccggagacaggatgctctgcggccagatgtgtggctgctgaggaacgacgcccacagcctctaccataaaagatcccctcctgctaaagagtcagctcttagcaagtgccagagttgcgggctatcttgcagttcatctttgtgccaacgatgcgacagcctgctgacctgtccacctgcttcaaaaccgagcgccttccctagcaaggcctcaactcatgacagcttggcccatggcgcctccctacgagagaaatatccgggacagactcagggtctggatcgcctgccgcacctccactctaaatcaaagccttctacaactcctacttctagatgcggtttctgcaatcgtccaggggcgaccaacacatgtactcaatgttccaaagtgagttgcgacgcgtgtctgtctgcctaccactacgatccatgttataaaaagagcgagcttcacaaatttatgccgaataatcagctgaattataaatcgactcagttaagtcaccttgtttatcggtag

SEQ ID NO: 135999 - DNA, 1152 bp, Artificial Sequence
  Description of Artificial Sequence: Synthetic coding sequence
atggggtatacacccgaattagggactgcctataagctgagagagctggtggagacattgcaggtcaaaatggtctcttttgagttattcctcgccaaggtcgagtgcgaacagatgctcgagattcatagccaggtgaaggacaaagggtactccgaattagatatagtctcagaaaggaagtccagtgccgaggatgttcgggggtgtagcgatgcgctcaggcgtagagctgagggccgagagcatctcaccgctagcatgtcaagagtagctctccaaaaatcggcatcagagcgcgcggcaaaagattactacaagccacgggtgacgaagccttcccggtcagttgacgcttacgacagctactgggaatctcggaaaccaccgttgaaggccagcttatccttaagaaaggagcccgtcgcaaccgacgtgggcgacgacctcaaagacgaaatcatacggcccagtccaagtctgcttaccatggccagtagcccccacgggtcgcccgatgtgctgccaccagcctccccgtccaatggcccagccctacttcgcggaacctatttctcgacacaggacgatgttgatctttatacagacagcgaacccagggcaacctataggaggcaggatgctctaagaccagacgtgtggttattgcgaaacgatgcccacagtctctatcacaagagaagtccgccagccaaagagtccgcgttaagcaaatgtcagagctgtgggctctcatgttcaagctccttgtgccagcgctgcgactcattactgacctgtcctcccgcaagcaaaccttcagccttcccctctaaagcatccacccacgattcgctcgcccacggcgcttctttgagggaaaaataccccggtcagacccaaggcctggaccggctacctcatctccactcgaagagcaaacccagtacgacgcccactagccgttgcggcttttgcaatcggcccggcgccactaacacgtgcacccaatgctcaaaggtgtcctgtgatgcttgcctgtccgcctaccattatgatccttgctacaaaaagagtgaattgcacaaattcatgcctaataatcagttgaattataagtcaacccagctgtctcacctggtctacaggtag

SEQ ID NO: 136000 - DNA, 2409 bp, Artificial Sequence
  Description of Artificial Sequence: Synthetic coding sequence
atgttaggagctcgtgcatggctggggagagtactattgctgccacgagctggagctggtctagccgccagcaggagatgtccgggagtgtggccacggacctggcctcatcgtagcccgagtagagggagcagtagtagggacaaggatcgctccgccacagtgtccagtagtgtgccgatgccagccgggggaaagggttcccacccttcttctaccccccaaagggtgccaaaccggttgatccatgagaagtccccatatcttctccagcatgcttacaaccctgtggactggtacccatggggtcaggaggcttttgataaagcacggaaggaaaataagcctatattcctgtccgttggctattcaacgtgtcattggtgccacatgatggaggaggaaagcttccagaatgaagagattgggcggctgctgtctgaggacttcgtgagtgtcaaggttgaccgggaggagcgccccgatgtggacaaggtttatatgacattcgtccaggcaacaagtagcgggggcggctggcctatgaatgtttggctaacccctaacctccagccttttgttggggggacctatttcccgcctgaagacggactgactagggtcggctttcgcactgtgcttttgcggatacgagagcaatggaaacagaataagaatacacttttggaaaatagccagcgtgtcaccacagcactgctggcccgttccgagatctcagtgggagaccgtcagcttcctcctagcgcggccaccgtcaacaaccgatgtttccaacagttagacgagggatacgatgaagaatatgggggcttcgcagaagcacccaagttcccgacgcccgtcatcctctctttcttattttcttactggctgagccataggttgactcaagacggcagcagagcccagcagatggccctgcatacactgaagatgatggctaatggaggaatcagggaccatgtcgggcagggttttcacagatacagcaccgatcgtcagtggcacgtgcctcacttcgagaaaatgctgtacgaccaagctcagttggccgtggcctatagtcaggcctttcagctgagtggggatgaattctacagcgacgtagctaaagggatcctccagtatgtggccaggagcctgtcgcatcgctccggcggtttctattctgctgaggatgcagacagcccacccgaacgggggcaaagacctaaggagggtgcatactatgtgtggacggtgaaggaggtgcagcagcttttgccagagccagtccttggcgctacagagccactgacatcaggacagctgcttatgaaacactatggcctcacagaagcagggaatatctctccttcacaggatccgaagggagagttacaaggccagaatgtcctgaccgtgcgatactctctggagcttaccgccgcgcgttttggactcgacgtcgaagcggtacggaccctcctcaacagcggactcgaaaagctattccaggctaggaagcatagaccgaagccccacctcgatagtaagatgcttgccgcctggaatgggctgatggtcagcggttatgctgtcacaggcgccgtcctggggcaggaccgcctaattaattacgccacaaatggggctaagttcctaaaacgtcacatgttcgatgttgctagtggtaggttaatgcggacctgttacactgggcctggcgggaccgtggaacacagcaaccctccatgttggggcttcctcgaagattatgcattcgtagtacgtggactgttagacctctacgaagcctcgcaggagtcggcctggctagaatgggcgctccgcctgcaggacactcaggataagcttttctgggacagccagggaggcggttacttctgctctgaggctgagttgggggctgggctgccgttacgtctcaaggatgatcaggatggtgctgaaccttctgcaaacagcgtgtcagcgcataatttgttgcgtttacacggattcactggccacaaggactggatggacaagtgtgtgtgtctgttaacagccttctcagagaggatgcgccgagtgcctgtggctctcccagaaatggtcagggccctcagcgcccagcagcagaccctcaagcagatagtgatatgtggcgacagacaggcaaaggacaccaaggcgctagtgcagtgtgtccactctgtgtacattcctaacaaagtgttgatactggccgacggggaccctagcagctttctgagcaggcaattgccttttttgagcacactccggcggttagaggaccaagcgacagcctacgtgtgtgagaatcaggcctgctccgttcccatcactgacccgtgtgaactcagaaagcttctgcacccatag

SEQ ID NO: 136001 - DNA, 2361 bp, Artificial Sequence
  Description of Artificial Sequence: Synthetic coding sequence
atgctcggggccagggcatggttagggagagtcctgttgttgcctagggctggagccgggctggccgcttctcggcggggctcttcttctcgggacaaagaccgctccgcgacggtctcaagctccgtgcccatgcctgcaggaggaaagggcagccatccctcttctaccccgcagagagttcccaatcgactgatccacgagaagtccccttacttactgcagcacgcatacaacccagttgactggtatccatgggggcaggaagctttcgacaaagctaggaaggaaaataaacctatttttctgtccgtaggctactccacttgtcactggtgtcacatgatggaggaggagtcctttcaaaacgaggaaattggccgactgctgtctgaggacttcgtcagcgtcaaggtcgacagggaagagagacccgacgtggacaaggtgtatatgacctttgtacaggcaacgtcctcgggtggcggctggcccatgaatgtgtggcttacaccaaacttacagcccttcgtgggaggaacatactttcctcctgaggatggcttgacccgggtcggcttccggactgtgctgctcaggattcgcgaacagtggaagcagaataagaatactttactcgagaattcccaaagggtcacaaccgccctgcttgcacgatcagagatttctgtgggggataggcaattgcccccatctgccgccacggttaacaaccgctgttttcagcagctggacgaaggttatgacgaggagtatggaggattcgcggaggcgcccaaattcccaactcccgtgattctgtcctttctcttttcctattggctgtcccatcgattaacacaggatggttctcgggcgcagcaaatggccctacatacactcaagatgatggcaaacggaggcatcagggaccacgtcgggcaggggttccaccgttactcaacagaccggcagtggcacgtcccacactttgaaaagatgctgtacgaccaggcacagctcgccgttgcctactctcaggccttccaactgagcggggacgagttctatagcgacgtggcaaagggcatactgcagtatgtggcgcgtagtttgagtcaccgatcaggaggattttactcagctgaggacgcagattcgcccccggagcgagggcagcggcccaaggagggagcctattatgtgtggacagttaaggaagttcagcaattgctgccagagccggtattaggagccacggagcctctcacttctggtcagctgctaatgaaacactacggactaacagaggctggaaatattagcccatcgcaagatcctaagggagaattacagggacagaacgtccttactgttcgatattcccttgagctgacagctgccagattcgggctggatgtcgaggccgtgcgcacactgctgaattcaggacttgaaaagctcttccaggccaggaaacatcgacctaaacctcacctcgattccaagatgctcgccgcttggaacggactgatggtctccggctatgccgttaccggtgcagtgctcggccaggacaggctcatcaattacgcaaccaatggcgccaagtttctcaagaggcacatgtttgatgtcgcgagtggtaggctgatgcgtacctgctatacaggaccaggcggtactgtggaacatagcaatcctccatgctggggcttcctggaagactacgcatttgtagtccgcggtctgttagatctttacgaagccagtcaggaatccgcctggctggaatgggccctgcgtctccaggacacacaggataagttattttgggatagtcagggcggcgggtatttctgtagcgaagcagaactgggggccggcctgccattgcgcttgaaggatgatcaagatggcgcagagccaagcgctaattccgtatcagctcacaaccttctgcggttacacggtttcacaggccataaggattggatggacaaatgtgtgtgtctgctgactgctttcagtgaaagaatgagaagggtccctgtggcccttcccgagatggtgcgggctctgtctgcccagcagcaaacactaaaacaaatcgtgatctgcggcgatcgccaggctaaggataccaaggctctggtccagtgcgtgcattcagtgtacattccgaacaaggtgctcatactcgccgatggtgatccaagctcattcctgtctcgacagttaccattcctgtccaccttgagacgtctcgaagaccaggccaccgcgtatgtgtgcgagaaccaggcctgcagcgtcccgattaccgatccctgcgagctgaggaagttgttacacccatag

SEQ ID NO: 136002 - DNA, 2229 bp, Artificial Sequence
  Description of Artificial Sequence: Synthetic coding sequence
atgccggccggcgggaagggcagtcacccctccagtaccccgcagagagttcctaatcgtctaatccacgagaaatccccttacctgttgcagcatgcttataatcctgtcgactggtacccctggggacaggaggccttcgataaggctcgcaaggaaaacaagcctatcttcctctctgtgggctattcaacatgccattggtgccacatgatggaggaggagtcttttcaaaacgaagaaatcggcagactattgtcagaagacttcgttagtgtgaaggtggatcgagaggagaggcccgacgtggataaggtctacatgacgtttgtacaggctactagttctggcggcgggtggccgatgaacgtgtggctgacaccgaacctccagccctttgtgggcggaacttatttcccacccgaagatgggttgaccagagtgggcttcagaacagttctattgcggatcagagagcagtggaagcagaacaagaatacactgcttgaaaattcgcagcgagtgacaactgctcttcttgccaggagcgagataagtgtgggagatcgacagttacccccctcagctgccacagtgaacaatcggtgcttccagcagctggacgaaggctacgatgaagagtacggtggctttgctgaggccccaaagtttccaacgccggtgattctgagctttctcttctcgtactggttgtcacatcgcttaactcaggacggctctagggcccagcagatggccctacacacccttaagatgatggccaacgggggaattcgggatcatgtcggacaggggtttcataggtactcaactgacagacaatggcatgtaccccatttcgagaaaatgttatacgatcaggcacaacttgctgtcgcttactcccaagcctttcagctgtctggcgatgaattttactccgatgttgccaaaggaattctgcagtatgtggcccgttccctgtcacacagatcaggggggttctatagcgccgaggatgcggactcacccccggaacggggtcagcgaccaaaagagggagcctattacgtttggaccgttaaggaggttcagcaattgctcccagaaccagtgctgggcgccactgaaccgttgacatccggccagctactgatgaaacactatgggctgacggaagcggggaatatttccccatcacaggatccaaagggggagcttcagggacagaacgttctaacagtacggtactcgttagaattgaccgctgcacggttcgggctcgatgtggaggcagtccgcaccctattgaattctggcctggaaaagctcttccaggctcgaaagcaccgacccaaacctcatctggacagtaagatgctggcagcatggaacggactcatggtgtcgggttacgccgtgaccggggcagtgttgggtcaggatcgactcatcaactatgccaccaatggcgctaaattcctcaagcgacatatgttcgacgtagcttccgggagactgatgagaacatgctatacgggacctggagggacagttgagcactcaaacccaccctgctggggcttcctggaagattatgcctttgtagtccgagggctgctagacctgtatgaggcctcacaggaaagcgcgtggctggagtgggctctccgcctgcaggatacacaggataagttgttctgggatagccagggtgggggctatttctgcagtgaagcggagctgggtgcgggcctgcccttgaggcttaaagacgaccaggacggagcagagccctctgcaaactctgtcagtgcccacaaccttctcagactccacggctttaccggccacaaggattggatggacaaatgcgtttgcctattgacagctttcagtgagcggatgaggagagtacccgttgccctgccagagatggttagagcgctgtctgcacaacagcagaccctaaagcaaatcgtgatctgcggcgacaggcaggcaaaggacaccaaggccctggttcagtgtgtccactctgtgtacatccccaataaggtgctgatcctagccgatggggacccaagtagttttctgtctcgtcagctgcccttcctgtctacactgcggagactcgaagaccaggccactgcttatgtgtgcgaaaaccaggcttgctctgtcccgataacagacccttgcgagcttcgaaaattgcttcatccctag

SEQ ID NO: 136003 - DNA, 228 bp, Artificial Sequence
  Description of Artificial Sequence: Synthetic coding sequence
gggcagggacaccagggtcccgggcagtgcgttcactctgtctacatcccaaacaaagtgctgatcctggctgatggagaccccagctcttttctgagtcgccagctaccatttctaagtacactgaggcggctggaagaccaggcgactgcttatgtttgtgaaaatcaggcatgttccgtgcccatcacagacccttgcgagttgcgtaaactgttgcatccatag

SEQ ID NO: 136004 - DNA, 132 bp, Artificial Sequence
  Description of Artificial Sequence: Synthetic coding sequence
atgctgggcgccagagcctggctgggtagggtgctgcttctgcctcgggctggcgcgggcttagctgccagccgcaggtctgcatgttcccctactagcaggcttaacagcctccgctcactgattccttag

SEQ ID NO: 136005 - DNA, 918 bp, Artificial Sequence
  Description of Artificial Sequence: Synthetic coding sequence
atggcagccgccgggcaggagaagggttatctcacacagaccgctgccgccctggacaagtctccgtctctgtccccacagctcgcagccccgatacgagggagacctaagaagtgccttgtgtaccctcatgctcctaaatccagtcgactgtcgcgttctgtgctgcgttggttgcagggtctcgacctttcattttttccacgtaacattaatcgcgatttttcaaatggcttcctgatcgccgagatattctgtatctactacccctgggaactggagctgtcttcctttgaaaacggcacaagtcttaaagtgaagctcgacaactgggcacagctcgagaaattcctggcacggaagaaatttaaactgccaaaggagctcatccatggtactatccattgcaaggctggcgtgcccgaaattctgattgaggaggtatacacgttgcttacacaccgcgagattaagagtattcaggatgatttcgtaaacttcacagactatagctaccaaatgcggttaccgcttgtttcgcgctcaacagtgtcaaaatccatcaaagacaacataaggctgtccgagctcttgtcaaaccctaatatgcttaccaacgagttgaaggccgagttcttgattctgctgcatatgctccaaagaaaacttgggaggaagctgaatcctgagtggttcgacgtcaaacctacggtgggcgaagttaccttgaaccaccttcccgctcaggctagcggtagacgctacaatttgaaagttaagcgtggtagggtagtgcccgtgctgcctaatatcggatcaggtggttcaagtcacagggaaatccacgtgaaacaggcaggccagcactcttactactccgcaatgaagcccatccggaacatggataaaaagccatag

SEQ ID NO: 136006 - DNA, 2682 bp, Artificial Sequence
  Description of Artificial Sequence: Synthetic coding sequence
atgtcctccaaaaagaaccgcaaacgcttaaatcagtctgccgagaacggatcatccttgccgtcagcagcatcctcctgtgctgaagcgagagcaccctccgcgggctccgacttcgctgccacctccggtacccttacggtgacaaacctgctcgagaaggtggatgacaagatcccaaaaacttttcagaattctctcattcatctggggttgaataccatgaagtctgccaacatctgtataggccggccggtacttttgacatcattaaacggcaaacaggaggtttataccgcatggccgatggccgggttccccgggggaaaggtcggcttgagtgaaatggcacagaaaaacgtgggagtgcgccctggtgacgccatccaggtgcagcctcttgtaggggcagttttacaagccgaggagatggatgtggctctgagtgataaagatatggagattaacgaggaagagctcactggatgtatcctgcgcaaactggatgggaagatcgtgttacctggaaacttcctctattgcactttctacggacggccttacaagctgcaggtcctgcgcgtcaaaggcgctgatggcatgattcttgggggccctcagagtgattccgacaccgatgcccagcggatggcttttgagcagtcttccatggaaacctccagcctcgaactctccctgcagctgagccagctggatctggaagatacacaaattcccacctctaggagcactccgtataaaccgattgatgacagaattactaacaaggccagcgatgtcttgctcgatgttacacagagcccaggggatggctccggtcttatgcttgaggaagtgacaggcctcaaatgcaactttgagtccgccagagaggggaatgagcagctgacagaggaggagagacttctgaagttcagtattggggccaaatgcaacacagacacattctacttcatcagctcaactacacgggtcaattttacagaaatagacaagaatagcaaggaacaggacaatcagtttaaggtcacctatgatatgattgggggcctgagtagccagctcaaagcaatacgcgagattatcgaactgcccctgaagcagcccgagctttttaaatcctatggcatccccgctcccaggggcgtgcttctctatgggccgcccggaactggaaaaaccatgattgcccgagcagtcgccaatgaagtaggagcctacgtgtctgttatcaatggtcccgagattatctccaagttctacggagagacggaagccaagttaaggcagatctttgcagaggccaccttacgccacccatcaatcattttcattgacgagctcgatgccctctgccccaagagggagggcgcccagaacgaggtcgagaagagggtcgttgcctctttgctcacactgatggatggcatcggctctgaggtctctgaaggacaggtactagtgcttggcgcaaccaacaggccccacgctcttgatgcagcacttagacggccagggagatttgacaaggagatagaaatcggtgtgccaaacgctcaggaccgcttggatattcttcagaagttactgaggagagtgccccacctgcttaccgaagctgagctgcttcagctggcaaactctgcgcacggctacgtgggcgccgatctgaaagtgctctgtaatgaggctggcctctgtgccctcagacggattctgaaaaaacaaccgaatctacccgatgtgaaagtcgccggcttggtcaagatcaccttaaaggatttcttacaggcaatgaacgatatcagacctagtgcaatgagggagatcgccatcgatgtccctaacgtctcctggagcgacatcggaggactggaatccattaaactcaaactggaacaagctgtcgagtggcccctgaaacacccagaatcatttatacgcatgggcatacagcccccgaagggggttctgttatatggcccccccggatgctccaagactatgatcgccaaggccctggctaatgaatccggactgaatttccttgctatcaaagggccagagctgatgaataaatacgtgggagaatctgaacgcgccgtcagggagacgtttaggaaggcccgtgctgtggccccttcaatcattttctttgatgaactggatgcgttagccgtggaacgcggcagttctctcggggccgggaatgtggccgaccgggtcctggcccaacttctgacagaaatggatggcatcgaacagctcaaagacgtgacaatccttgccgctaccaatcgacctgataggatagacaaggcgctcatgcggcccggaagaattgaccgcattatttacgtaccactgcctgacgccgccacccggcgggagatcttcaaactccaattccactctatgccagtctccaacgaggtcgacttggacgagttaattctccagaccgacgcctattctggggcagagatagtggcagtttgccgggaggcagcactgctggctctggaagaagatatccaggccaaccttattatgaagaggcattttactcaggccttgtccacagttacacctcggatcccggaaagtctccgtcgtttttacgaggattaccaggaaaagtccggcttgcacaccctgtag

SEQ ID NO: 136007 - DNA, 750 bp, Artificial Sequence
  Description of Artificial Sequence: Synthetic coding sequence
atgcagctggacaagttcatctatcatctggcaccggtcgaaaagtctcatgggagactccagaaccgtacgagccgatcgcagaaaaagaaatccaaaagcccggagcggagcaagtactgtatcaacgccaaaaactacgagcagcctactatttcctcaaagagtcactctccatctccttacacaaaacggcgaatgtgtgagttgagcgaggatacccggcgaaggctggcgcacctgaacctaggaccctacgagtttaagaaagagaccgacaagcctcctttcgtgatccggcacgtggatcctccttcgcctcgggcagatactctgttgggctcctcaggcagggattgcgaaagggacggctggagcagggtacacaacgaccacagtcatcttggctgctgccgtccaaaggactataaagttataaggacaccccacggcagagactttgatgactctcttgagaaatgcgaggaatatctgtctccgaggagctgtagcaagcctcgccactcggcccgtacacttctcgtccactctgcccctagcacaatgcccaaacacagcccctctccagtgcttaaccgagcctcgctgcgagagcggtttcattcagactggtgttcgccaagcaactgtgatgaaatacacgacagagatgagagggatttggaaaaggacgatgagttagaacttaagcgctccttgctgtgcagagactcggcctatgactcatag

SEQ ID NO: 136008 - DNA, 1419 bp, Artificial Sequence
  Description of Artificial Sequence: Synthetic coding sequence
atgcccaaagtgaaggcactgcagtgcgctctggccttagagatctcatccgtgacttgtccgggagtggtgttgaaagacaaggaggacatttacttaagcatttgtgtctttggccagtacaagaagacccaatgtgttcctgcaacatttccccttgtgtttaacgccaggatggtcttcgagaaagtgttccctgacgcagttgatccgggtgatgtggttacccaactcgagtatgatacagctgtgttcgaactgatccaactggtcccccccgttggcgagacccttagtacatatgacgaaaacactcgcgacttcatgtttcccggcccaaaccagatgagcgggcatcacgattcaaacagacaggtgaccatgcggagaataagtggcctgcgcggtaacgcccctagacttgaattcagcacaaccagcgtgatcactgagtgtctcatcagctcccggaagtgccacacccaagacaagtttatatatcaccttgcgcccgtggagaaaagccatggacgactgcagaaccggacatcacgcagccagaagaagaaaagtaagagcccggagagatctaaatactgcattaacgccaagaactacgagcaacccaccatttcgagcaagtcccactcacccagtccgtacaccaagagacgaatgtgcgaattgtcagaggatactagacggcggcttgcccatctgaatctgggaccctatgagtttaagaaagagacggacaagcccccctttgtgattcgacacgtagacccgccctccccaagagcagatacactcctgggctcaagtgggagggactgcgaaagagacggatggtctagagtccataacgatcactcccacctagggtgctgtaggcccaaggattacaaggttattagaaccccacacggaagagactttgatgacagcctggagaagtgcgaggaataccttagtcctcggtcttgctcaaaaccccggcactcggccaggacactactggtgcacagcgcacccagcaccatgccaaagcactcccctagtcccgttctgaatcgggcgtccctaagggaaagatttcatagcgactggtgcagcccatctaactgcgatgagatccatgaccgtgatgagagagacctggaaaaggacgatgagctagaattaaagaggtctttgctttgtcgagattctgcatatgatagcgatccggaatattcgtcttgtcaacaaccacgtggaaccttccatctggacgacggcgaatactggtcaaaccgtgccgcaagctataagggcaaaagccaccggcccatcttcgaaaatagtatggacaaaatgtaccggaatctctataagaaggcatgtagttcggcttcccacacacaggagtccttttag

SEQ ID NO: 136009 - DNA, 1467 bp, Artificial Sequence
  Description of Artificial Sequence: Synthetic coding sequence
atgcccaaagtcaaggccctacagtgcgcattagctctggagatatcatccgtgacgtgccccggtgtcgttttgaaggataaggaggacatttatctcagcatctgcgtcttcggacaatacaaaaaaacccaatgtgtcccggccacatttcccctagtattcaatgcacgcatggttttcgagaaggtgtttcctgatgcagttgatccgggagacgttgttactcaacttgaatacgacacggcagtttttgagctgatccagctggtcccgcctgtgggcgagaccctcagtacctatgacgagaatacaagggatttcatgttccctgggccaaatcaaatgtctggtcatcacgactcgaatcggcaagtaactatgagacgaattagcggactgcgcgggaatgctccaaggctagaattcagcacgacctcagttatcacggaatgcctgatatcaagtaggaaatgtcacacacaggacaaattcatataccatcttgctcctgtggagaaaagccatggcaggctccagaaccggacatcacgcagtcagaaaaaaaagtccaagagccctgagagaagtaagtactgcattaatgccaagaattacgagcagccaacaatctcctccaaaagccattccccctctccatacaccaagagacgtatgtgcgagctgtcggaggacacacgaagaaggctggctcacctaaatctcggtccttatgaattcaaaaaggaaactgataaacccccctttgttattagacacgtggacccgcctagcccccgcgccgataccctacttggatcttccgggcgcgattgcgaaagggacggctggtctagggttcataatgatcacagccaccttggatgctgcaggcccaaagactataaagtgatcaggactccacatggacgggactttgatgatagtctcgaaaaatgcgaggaatatctctctcccaggagctgttccaagccacgccactccgcacgaactctgctcgtacattccgcgcctagcaccatgcctaagcactccccctcccctgttttgaaccgcgctagcctgagagagcgtttccactctgattggtgttcaccaagtaactgcgatgagatccacgacagagtgaagaacgtgcttaaatctcatcaggcacaccagagacatctatatgatgagcgggatctcgaaaaagacgacgagctagagttgaaaaggtctttactgtgccgtgattcagcatatgacagcgatcctgaatacagcagttgtcagcagcctagaggcactttccatctggatgatggtgagtattggtctaatagagccgctagctataagggcaaatctcatcgaccaatcttcgaaaatagcatggataagatgtatagaaatctatataagaaagcctgttcttcagctagccatactcaggagtccttctag

SEQ ID NO: 136010 - DNA, 1251 bp, Artificial Sequence
  Description of Artificial Sequence: Synthetic coding sequence
atggtgttcgagaaggttttccctgatgcagtcgaccctggcgacgttgtgacccagctcgagcttggcgaaacactttctacgtatgatgagaacactcgagatttcatgttccctgggccaaaccagatgagtgggcatcacgactccaacagacaggtgaccatgcgcagaatttcaggcctcaggggcaatgctcctaggctcgagtttagtacaactagcgttattacagagtgcctgatctcaagtcgcaagtgccatacccaggacaaattcatctaccacctcgccccagtggaaaagagccacggccggctgcagaacaggactagccggtctcagaagaagaagagcaaatctcctgaacgatcaaagtactgcattaacgccaagaattacgagcagcccaccatcagtagtaaaagccattctcccagcccttacactaaacgccgcatgtgtgaactgagcgaagacactcgcagacgactggcacatctgaaccttggaccttatgaatttaagaaggagacagataagcctccttttgtcatccgccatgtggacccgccctctccgcgagctgacacactcttgggttccagtggacgggattgcgaaagagatggctggagcagggtgcacaatgaccactcccacctgggctgctgtcgccccaaggattacaaggtgataagaaccccgcatggtagagattttgatgactccctggaaaagtgcgaggagtacctgtcacctcggagttgctcgaagcctagacacagcgccagaactctgctagtgcattctgcaccgtctaccatgcccaagcatagtccatcacccgtcctcaatcgggcctccctccgtgagcgcttccacagtgactggtgctccccatcaaactgtgatgagatacatgatagagtaaagaacgtgctgaagagtcatcaggcacaccagaggcacctgtacgatgaacgcgacctggagaaggacgacgaactggaactcaaacggtcgttactgtgtcgagattctgcgtacgatagtgaccctgagtatagcagttgccaacagccgcgcggaacatttcacctggacgacggagaatattggtcaaaccgcgccgcatcctataagggtaagagccaccggccaatattcgagaactctatggataagatgtacaggaacttgtataagaaggcctgtagcagcgctagccacacgcaggagagcttctag

SEQ ID NO: 136011 - DNA, 1377 bp, Artificial Sequence
  Description of Artificial Sequence: Synthetic coding sequence
atggatggcagtagacgggtgcgggcaacctctgtcctcccacggtacggaccaccatgtctgttcaaggggcacttgtcgacgaaaagtaacgccttttgcacagatagttcttctctgcgattgtcaaccctgcagctagtgaagaatcatatggctgtgcactacaacaagatcctgagcgccaaagcagccgtggactgttcagtgcccgtttctgtgagcacgagcattaaatatgcagatcaacaacggcgcgagaaactgaaaaaggaactggcccagtgcgagaaggagttcaaattgaccaagactgccatgcgggccaattataaaaacaatagcaaatccctgtttaatacgttacagaaacctagcggcgaaccccagattgaagacgatatgctgaaagaagagatgaacggtttctccagttttgcacgaagcctcgtccctagcagcgagcgactgcaccttagcctccacaagtcatctaaggtcatcactaacggccctgagaagaacagctcgtcctctccgagttctgtcgactatgctgcgtcgggtcccaggaaactgagcagcggagccctctatggcaggcgtcccagatctaccttccccaactctcacagattccagttagtgattagtaaggccccatccggcgacctgttggataagcattctgaactgtttagcaataagcagctgccctttacaccacgaacattaaagactgaagccaaatctttcctgagtcagtacaggtactatacccccgccaagcgcaaaaaggacttcacagaccaaaggattgaggcagagacccagaccgaattgtcattcaagtctgagttgggcacagctgagaccaagaatatgaccgacagtgagatgaacattaagcaggcatctaattgcgtgacctatgacgccaaagaaaagatcgcccccttaccactggaggggcatgactctacctgggacgagatcaaagatgacgccctccagcactcttctccgcgagccatgtgccagtactctctaaagccgcccagcacccgcaagatctacagcgacgaggaggagctcttgtatctgtccttcatagaggacgtgacggacgagattttaaaattgggacttttttctaatcgtttcttagagcgcctttttgaaagacatataaagcagaacaagcacctcgaagaggagaaaatgcgccacctgctgcatgttctcaaggtggatttagggtgcaccagtgaagagaactcattttcttcagttaagggcgataacaatcatgacatggagctgtccacactgaagatcatggagatgagtatcgaggactgcccgctcgacgtctag

SEQ ID NO: 136012 - DNA, 1704 bp, Artificial Sequence
  Description of Artificial Sequence: Synthetic coding sequence
atggacggctcaaggagagtgagagcaacgtctgttctacccaggtacggccccccctgtttatttaagggccatttgtctacaaaatctaacgcagctgtggactgtagtgtgccagtatccgtcagcacgagtatcaagtatgcagaccagcaacggagggagaagctgaaaaaggagctcgctcagtgtgagaaggagtttaagttgacaaagactgcaatgcgagccaactacaagaacaactcgaaaagcctgttcaacactcttcagaagccttctggagaaccccaaattgaagatgacatgctcaaggaagaaatgaacggcttctcaagttttgcccgatcattagtcccaagttctgaacgcctgcacctgtcactccacaagtctagcaaggtcatcacaaacgggcccgagaaaaactcctcttcttctcccagcagcgtcgattatgctgcgagcgggcccagaaaactgtccagcggtgccttatacgggcgacggcctcgttccacattccccaattcccatcggtttcaacttgtgatctcaaaagctccctcaggagacctgctggacaagcacagcgagctgttttcaaataaacaactgccatttacaccgcgtactctgaagacggaggccaagtcattccttagccagtaccgctattatacgcctgccaagcggaagaaagactttacagaccagaggatagaggccgaaacacaaaccgagttgtcattcaaaagcgaacttggaactgctgagactaaaaatatgaccgattcggagatgaatataaaacaagccagcaattgtgtcacctacgacgctaaagagaagatcgccccacttccactggaagggcatgactcaacgtgggatgagataaaagacgatgccctccagcatagttctcctcgggctatgtgccagtattcccttaagccaccttctacccgcaaaatttactccgacgaggaagagctcctgtacctatcttttattgaggacgtgactgatgagatcctgaaactgggacttttctctaatcgctttctggagagactcttcgagagacacatcaagcagaacaagcatttagaggaagagaagatgaggcacttgctccatgtgctcaaggtggacctcgggtgcaccagcgaggagaactccgtaaagcaaaatgatgtcgatatgctgaatgtattcgacttcgaaaaggcaggcaactctgaacctaacgagctgaagaatgagtctgaggtcaccatccagcaagaaagacagcagtaccagaaggccctggacatgctactgagcgccccaaaagatgagaacgaaatatttccgagtccaacggagttcttcatgcccatatacaagtcaaaacacagtgagggtgttataatccagcaagtcaatgacgagacaaatcttgagacttcaactttggacgagaaccatccatctatctcggacagtctcaccgatcgcgagaccagcgtgaatgtgatcgagggtgactcggatcctgagaaggttgagatttcaaatggcctctgcgggctaaatacctcgccaagccaaagtgtgcagttctcatccgtcaaaggagacaataatcacgacatggagctttctacactcaaaataatggagatgtccattgaggactgccctttggatgtttag

SEQ ID NO: 136013 - DNA, 1800 bp, Artificial Sequence
  Description of Artificial Sequence: Synthetic coding sequence
atggacggttcaagacgggtgagagccactagtgttctccccaggtatggacccccctgtttgtttaaaggtcacctgtccaccaaaagcaatgccttttgcacggattcttcttcattgagactctccacgctccagctggtcaagaaccatatggccgttcactacaataagatactgagcgcaaaagcggccgttgattgcagcgtccccgtctctgtgagcacctcaatcaaatatgctgaccagcagcgtagagaaaagctcaaaaaggagctggcccagtgcgagaaggaatttaaactgacaaagaccgcaatgagagccaactataaaaacaattccaagtctctgtttaacacgctccagaagccatctggcgaaccacagatcgaggacgacatgctcaaggaggaaatgaatggcttttcctcattcgcccggagcctggtgcccagctcagagcggctgcacctttccctgcataaatcatccaaggtgattactaacgggcccgaaaaaaattcaagctcctctccttcatcagtggattacgcagctagtggcccgagaaagttgtcgagcggagctctgtacgggcggaggccgcgctcaacgttccctaatagccaccggttccagctcgtgatctccaaggcgccgagcggtgaccttctggacaaacattctgaactcttcagcaataagcagcttccattcactcccagaacccttaaaacagaggctaagtcattcctttctcagtatcgatactatacaccagctaaacggaaaaaggatttcacagaccagcggattgaagccgagacgcaaaccgagctgagctttaagtccgaactcgggaccgcagagactaaaaacatgactgacagtgaaatgaatattaaacaggcttctaactgcgtgacttacgatgccaaagagaaaatcgctccattaccactggagggacatgattctacgtgggacgaaattaaggacgatgccctccagcattccagccctcgcgcaatgtgtcagtattccttaaagcctccatcaacaagaaagatctactcggatgaggaggagctgctgtacctgtcctttatcgaagatgtcaccgacgagatcctgaaactcggtctcttcagcaaccggtttttggagagactatttgagcgccatattaaacagaacaaacacctcgaggaggaaaaaatgcgacatctgttgcacgttttgaaagtggatcttggctgcacatcagaagagaatagtgttaaacagaatgacgtcgacatgctcaacgtgtttgacttcgagaaggcagggaactccgaacctaatgagctcaagaatgagagtgaggtaactatccagcaggagcggcaacagtatcagaaggctttggacatgctgctttctgctccaaaagacgagaatgaaattttcccgagcccaactgagtttttcatgcccatatacaagagtaagcacagtgaaggagttatcatccagcaggtgaacgatgagactaatctggaaacgagtacactggacgagaaccacccaagtatctcagactctctaactgacagggaaacatctgttaacgtgattgagggggactctgatcccgagaaggtggaaatttctaatggtttgtgtgggctcaacactagcccttcccagtccgttcagttttcgtctgtgaagggtgacaataatcatgatatggaactctctactctcaaaatcatggaaatgtccattgaagactgccctcttgatgtttag

SEQ ID NO: 136014 - DNA, 1704 bp, Artificial Sequence
  Description of Artificial Sequence: Synthetic coding sequence
atggacggcagtcgaagggtgagggcaaccagtgtgttaccgcgctacgggcctccttgtctgtttaaaggccacctttccaccaagtcaaatgcggctgtggactgctctgtgcctgtcagcgtctctacaagtattaaatatgcagaccagcagcgtcgagagaagctgaagaaagagctcgcgcagtgcgagaaagagttcaagctgactaaaacagcgatgcgcgcaaattataaaaataactccaaatcacttttcaatacactgcaaaaaccttccggagaaccacaaatcgaggacgatatgctcaaggaagaaatgaacggatttagctcattcgctcgcagtctggtgccgtcttcagagaggttacacctgtcactccataagtcctcaaaagtgataaccaacggtcccgaaaagaattccagttcctccccctcatctgtggattatgcggccagcggtccacgaaaactgtcatctggggccttgtatggccgcagaccacggtctaccttcccaaacagccatcgatttcagttggtaattagtaaggccccttcaggcgacctgctcgacaagcactctgagttattttcaaacaaacagctgccattcacccctcggaccctaaagaccgaggctaaatcctttctgtcacagtaccgctactacacccctgctaagaggaaaaaggactttaccgaccagagaatcgaggccgaaacacagaccgagctgtcttttaagtcagagcttggaaccgccgagacgaagaatatgaccgattccgaaatgaacataaagcaggcctccaactgtgtcacctacgatgcgaaggagaagatcgccccgctgcctctcgaaggccacgacagcacctgggacgaaatcaaagacgacgccctccaacacagctcccctagggctatgtgccaatatagtctgaagccgccatctacgaggaagatctactccgacgaagaggagctgttgtacctctcttttatagaggatgtcacagacgagatattgaaactagggctgtttagtaacagattcttggaaagactcttcgagcggcacatcaaacagaacaaacacctcgaagaggagaaaatgcgacatctgttgcacgtgttaaaggtggatctggggtgcactagcgaggagaacagcgtgaaacagaacgatgtggatatgctgaatgtgtttgacttcgaaaaggcaggcaatagcgaaccgaacgagctgaaaaacgaaagtgaggtgaccatccagcaggagaggcagcagtaccaaaaagctctggatatgcttctgtctgctccgaaggacgaaaatgaaatattcccaagtcccaccgagttttttatgccaatctacaagtcaaaacactccgagggtgtaatcatccagcaggtaaacgacgagacaaatcttgagactagcactttggatgagaaccacccctctatctccgattccctaactgaccgtgagacgtcagttaatgtcattgagggtgactctgaccctgagaaggttgagatttccaatggattatgcggtctgaatacctctcctagtcagtccgtgcaattttctagcgtcaaaggcgacaacaaccatgatatggagctctccacccttaaaataatggagatgagtatcgaagactgtccactggacgtgtag

SEQ ID NO: 136015 - DNA, 318 bp, Artificial Sequence
  Description of Artificial Sequence: Synthetic coding sequence
atggcaccagcaggcatgtccggtgcccaagataactcctgtttataccaggagatcgctccatcttttcagagactcccatgccctcggacatcctctagacatttttcagaggccatgacatgcccctgcgggtggcgcccgtttaagggggggcccggtggcctgaagggtcccgtttggccagcgaaggaggagaactcttgcagccacgggcgaatccagcgtgtgcagaggagacgcgttccatccgcaagtccgcttatacagaaaatcaatcggcgttctgttctatttcatccatactgctggagttag

SEQ ID NO: 136016 - DNA, 1638 bp, Artificial Sequence
  Description of Artificial Sequence: Synthetic coding sequence
atgtcccgcaagcagaaccagaaagattccagcgggttcatttttgacctgcagtctaacactgttctggcacaaggtggggccttcgaaaatatgaaagaaaagattaatgccgtgagggccattgttcccaataagagcaacaacgaaatcatcttggtcctccagcactttgacaattgcgttgacaagaccgtccaggcttttatggaaggtagcgcctcagaggttctgaaggaatggacagtcacaggaaagaaaaagaataaaaagaagaaaaacaaacctaagccggccgccgaacccagtaatggcattcctgattcatctaagtcagtttctatccaggaggaacagtccgctccaagctctgaaaaggggggtatgaacggctaccacgtgaacggggccatcaatgatactgaaagcgtggactctttaagtgagggtctcgaaacgttatccattgatgccagagaactggaagatcctgaatcagcaatgcttgatacgctcgatcggacaggatctatgctccagaacggcgtctccgatttcgaaacaaagagcctcactatgcacagtatccataacagccagcagcctcggaacgctgcaaagagcctgagccggccaaccacagaaacccagttcagtaatatgggcatggaagacgtcccactcgccacatccaaaaaactttcgtctaatatagaaaaatctgttaaagatcttcagaggtgcactgtctccctggcgagatatagggtggtggtcaaagaggaaatggacgcatcaatcaaaaagatgaaacaagcctttgcagagctggagagctgcctgatggatcgcgaagtcgcactcctagctgagatggacaaggtgaaagccgaggctatggaaatactactaagccgccagaagaaggccgagctcctgaagaaaatgacacatgtggccgtgcagatgtcagagcaacagctggtggaactgcgggctgacatcaagcactttgtttcggagcggaagtatgatgaggacctggggagagtcgcgaggtttacatgtgacgtggaaactctcaagaagtctattgatagcttcggtcaggttagccatcctaagaatagttatagtactcgatcaaggtgcagttccgtcacctctgtatctctgtcaagccctagtgacgcctccgcagcatcctccagtacttgcgcctcacctccttctcttacctccgctaataagaagaatttcgcccctggcgagaccccggcagcgatcgccaactcgtctgggcagccgtaccaaccgctgagagaggtcctccccgggaaccgaaggggtgggcagggttacaggccccagggacagaagtcaaacgaccctatgaaccaaggaaggcatgactccatgggcagatatagaaactcgtcctggtattcatcaggatcccggtaccaatctgcaccaagccaggcaccagggaacacaatcgaacgaggtcagacacactctgccgggacaaacggcaccggagtgagcatggagccatctccccctacccccagcttcaagaaaggactgccacagcggaaaccccgcacaagccaaactgaagccgtgaattcgtag

SEQ ID NO: 136017 - DNA, 1638 bp, Artificial Sequence
  Description of Artificial Sequence: Synthetic coding sequence
gtaagcaaaaagaaaaaaaagaaggactccagcgggttcatcttcgatctacaatctaacacagttctggcccaggggggtgcattcgagaatatgaaagagaaaatcaacgccgtgcgcgccattgtgcccaataaaagcaacaacgagattatcctggttctgcaacacttcgacaactgcgtcgacaagaccgtgcaggcctttatggagggctctgcttccgaagtcctcaaagaatggacagtgacaggaaaaaaaaagaacaagaagaaaaagaacaagcccaagcctgctgccgagccaagtaacggaattcccgacagctcaaaaagtgtgagcattcaggaagaacaaagcgccccatctagcgagaaaggaggtatgaatggctaccacgtcaatggcgccattaacgacaccgaatcagtggacagtttgtccgaaggactcgaaactctgtcgattgatgcgcgggaactcgaagatcccgaatccgccatgctggacacacttgatcgcacgggttcaatgctgcagaatggcgtgagtgacttcgagaccaaatcattgacgatgcatagtatacataattctcagcagccgcggaacgccgccaagagcttgtctagacctacgaccgaaacacagttttccaatatgggaatggaagacgtccccttggctacttctaagaagctgtcctcaaacattgaaaagtctgtcaaagacttacaacgctgtactgtttccttggccaggtacagggtcgtggtcaaagaggaaatggatgcctcgatcaagaaaatgaagcaggcgtttgctgaactggaatcatgcctgatggaccgtgaggtagccctcctagcagagatggacaaggtcaaagctgaggccatggaaatcctactttcccgccagaagaaagcagaactacttaaaaaaatgacccacgtcgcagttcagatgtccgagcaacagctggttgaacttcgcgccgacattaagcattttgtgtccgaaaggaagtatgatgaagatctggggcgggtggccagattcacctgcgatgtggaaacactcaagaagtccattgattccttcggccaggtgagccaccctaaaaacagctactccactcggagcaggtgctcctccgttacaagcgttagtctaagctccccgagcgacgcctccgccgcaagtagtagcacttgtgccagcccccccagcttgacaagcgccaacaaaaagaactttgctcccggcgagacccccgctgctatagcaaattctagtggccagccttaccagcccctgagggaagttctaccaggaaatcgcaggggcggccaaggctatcgcccacagggccaaaaaagtaatgacccgatgaatcagggacgccacgattcaatgggaaggtatcgcaacagttcttggtactctagtggctcacggtaccagagtgccccctcacaggcccccggcaatacaatcgagaggggccaaacacacagtgccggcaccaacgggacaggagtatctatggagcccagcccacctactcccagtttcaagaaaggcctcccacagcggaagccccgcacatcccagaccgaggccgttaactcttag

SEQ ID NO: 136018 - DNA, 27 bp, Artificial Sequence
  Description of Artificial Sequence: Synthetic coding sequence
atgtcccgcaagcagaaccaaaaatag

SEQ ID NO: 136019 - DNA, 27 bp, Artificial Sequence
  Description of Artificial Sequence: Synthetic coding sequence
atgtctcgcaagcaaaaccagaaatag

SEQ ID NO: 136020 - DNA, 204 bp, Artificial Sequence
  Description of Artificial Sequence: Synthetic coding sequence
atgtcgaggaagcagaaccagaaggattcctccgggttcatctttgatttgcagtctaataccgtgttagcacagggtggcgcattcgagaacatgaaggagaaaatcaacgccgtgagagcaatagtgcctaataaatctaataatgaaattattttggtcctgcagcacttcgacaattgtgtcgataaaaccgtgcagtag

SEQ ID NO: 136021 - DNA, 102 bp, Artificial Sequence
  Description of Artificial Sequence: Synthetic coding sequence
atgtccaggaagcaaaaccagaaggactcaagtgggttcattttcgatttacagtctaataccgtcctggcacagggcggcgcttttgagaatatgaagtag

SEQ ID NO: 136022 - DNA, 18 bp, Artificial Sequence
  Description of Artificial Sequence: Synthetic coding sequence
atgagtagaaagcaatag

SEQ ID NO: 136023 - DNA, 111 bp, Artificial Sequence
  Description of Artificial Sequence: Synthetic coding sequence
atgtcccggaagcagaatcaaaaagattcatccggtttcatttttgatttgcagtcaaataccgtgctcgctcaggggggcgctttcgagaatatgaaagagaaggtttag

SEQ ID NO: 136024 - DNA, 201 bp, Artificial Sequence
  Description of Artificial Sequence: Synthetic coding sequence
atgtcaaggaagcagaaccaaaaagatagctcagggttcatcttcgatcttcagagcaataccgtgttagcccagggcggcgccttcgaaaatatgaaagaaaagataaacgccgtgagagctatcgtccctaacaaaagtaacaacgaaattatcttggttctgcagcactttgacaattgcgtggacaaaactgtgtag

SEQ ID NO: 136025 - DNA, 105 bp, Artificial Sequence
  Description of Artificial Sequence: Synthetic coding sequence
atgtcaaggaagcaaaatcaaaaggatagcagcggtttcatcttcgacctgcagagcaacaccgtgttggcccagggcggtgcctttgagaacatgaaggagtag

SEQ ID NO: 136026 - DNA, 297 bp, Artificial Sequence
  Description of Artificial Sequence: Synthetic coding sequence
atgagtcgaaaacagaatcagaaagactcaagtggatttatattcgatctgcagtctaacaccgttctggcccaggggggggcattcgagaacatgaaagagaagatcaacgcagttcgggctatcgttccaaataagtccaataacgaaattattctcgtgctgcagcacttcgataattgcgtggacaagactgtgcaggctttcatggagggcagtgcttccgaagttctcaaagaatggaccgtcaccgggaagaaaaaaaataagaaaaaaaagaacaagcccaaaccctag

SEQ ID NO: 136027 - DNA, 225 bp, Artificial Sequence
  Description of Artificial Sequence: Synthetic coding sequence
atgagtagaaaacaaaaccaaaaggacagctccggattcatattcgacctgcagtcgaatacggtgctggcacaaggcggggcttttgagaatatgaaagagaagataaacgcagtgagagccatcgtgcctaacaaatctaataacgagataattctggttctccaacattttgacaattgcgtagataagacagtacaggctttcatggaagggagcgcttag

SEQ ID NO: 136028 - DNA, 33 bp, Artificial Sequence
  Description of Artificial Sequence: Synthetic coding sequence
atgagccgaaagcagaatcagaaagactcctag

SEQ ID NO: 136029 - DNA, 1638 bp, Artificial Sequence
  Description of Artificial Sequence: Synthetic coding sequence
atgagcaggaagcagaaccaaaaggatagctcaggtttcatattcgaccttcaaagtaacactgttctcgctcagggtggagctttcgaaaacatgaaggagaaaataaatgccgttagagcgattgtgccaaataagtcaaacaacgagattatacttgtcttacagcacttcgataattgcgtcgataagactgtacaggcctttatggaggggtctgcctccgaggttcttaaggaatggacagtgactgggaaaaagaagaataagaagaagaaaaacaagccgaagcccgcagcagagcccagcaatggcataccggattcatccaagtcagtgagtattcaggaagagcagtctgcgccaagctccgaaaaaggggggatgaacggctatcacgtgaacggggccatcaatgacacagaatccgtagatagtctttcagagggtcttgagacactctcaatcgatgctcgcgagcttgaggatcccgagagcgcgatgctggacaccctcgatagaactggctcaatgctgcagaacggggtcagtgatttcgagacaaagtctctaacaatgcattcaatccataattctcagcagcccaggaacgctgccaaatccctgtccagacctactacggaaactcagttctctaacatgggaatggaagatgtgcccctggctacttcaaagaaactgagcagtaatatcgagaagtctgtgaaagatctgcagaggtgcactgtcagcctagcacggtatcgcgtggtcgttaaggaggaaatggacgctagcataaagaaaatgaaacaagccttcgcggaactggagtcctgtttaatggaccgcgaggtcgccctccttgctgagatggacaaagtcaaggccgaggcgatggagattttgcttagtcggcagaagaaggcagagttactgaagaaaatgacccacgttgccgttcagatgagcgagcaacagctcgttgaactgcgggctgacataaaacacttcgtctctgaaaggaagtacgacgaagatctgggaagggttgcccggtttacatgcgatgttgagacattgaaaaaatccatcgattcctttggtcaggtgtcacatcccaaaaattcttacagcactcgaagcaggtgtagctctgtgacatccgttagcttatcaagtccgtctgatgcctccgcggcctcttcctccacctgtgccagccccccttctctgacatccgccaacaaaaagaatttcgcgcctggtgagacaccagctgcaattgcaaactcctcgggccagccatatcaacccctgagggaggttctcccagggaatcggaggggcgggcagggatataggcctcaaggtcagaaatcgaacgaccccatgaatcagggcaggcatgactcaatgggtaggtacaggaattcttcttggtatagctctggcagtcgatatcagtcggccccctcccaggctccaggtaatacaatcgaacgggggcagactcactctgcgggtaccaatgggacgggggtgagcatggaaccttctcctcctaccccctctttcaaaaagggactcccacagaggaaaccccggacgtcacagacggaagccgtcaattcctag

SEQ ID NO: 136030 - DNA, 1638 bp, Artificial Sequence
  Description of Artificial Sequence: Synthetic coding sequence
atgtccagaaaacagaatcaaaaggactcctccggcttcattttcgatctgcagtccaatactgtgctcgcccaaggtggagcctttgagaatatgaaggagaagatcaatgcagtgcgggcaattgtgcctaataaatccaacaacgaaataatccttgtcctacagcacttcgataactgcgtcgataaaactgtgcaggcttttatggaaggaagcgccagtgaggtgctcaaagaatggaccgtgacaggtaagaaaaagaataaaaagaagaagaataaaccaaaacccgctgctgaacctagcaatggaattccagatagtagcaagtccgttagcattcaggaggagcagtccgcgccatctagcgaaaagggtggcatgaatggctatcatgtgaacggtgctatcaacgacacagagagtgtcgactctctcagtgaggggcttgaaacactgtccatcgatgcccgcgagcttgaagatccggagtctgctatgttggatactctggataggacggggtcgatgctgcagaatggggtgtccgactttgaaacaaaaagtctcacgatgcatagcatccacaactcccagcagcccaggaacgccgctaagtctctttcacgccccaccacagagacacagttctctaacatgggaatggaagacgtgccccttgcaacctcaaagaagctgtctagcaacatagagaaatcagtcaaggatctgcaacgatgcaccgtgagcctggccaggtatcgggtggtggtgaaggaagagatggacgcaagcatcaaaaagatgaagcaggcattcgctgagctagaatcttgtcttatggacagggaagtggctctgctggctgagatggataaagtcaaggctgaagccatggagattctcctgtcccgacagaaaaaggccgaacttctcaagaagatgacgcacgtcgccgtgcagatgtcagagcagcaactggtggagttgagggccgacatcaaacattttgtgtccgagcgcaagtatgatgaggacctaggccgggtggccaggttcacctgtgatgttgagacactaaagaagtcaattgactctttcgggcaagtttcccacccaaagaatagctatagcaccagatccagatgttcctcagtcactagcgtcagcctcagtagcccgtcagacgccagcgcggctagcagctccacttgcgccagtccaccgtccctgactagcgctaacaaaaaaaactttgctccgggagaaacaccggcggccatcgccaatagcagtgggcagccttaccagccccttagagaggtgctgccaggaaataggaggggggggcagggatatcggccccaaggacagaagtcaaacgatccaatgaaccagggccgccacgatagtatgggccgttaccgcaacagcagttggtacagctccggatcgaggtaccagtctgcccctagccaggcgcccgggaatactattgagagaggtcagacacattctgccggaacaaatggcactggcgtgagcatggaaccttctccgccaacccccagcttcaaaaaaggattgcctcagagaaaaccaagaacatcacagaccgaggctgtgaactcatag

SEQ ID NO: 136031 - DNA, 1677 bp, Artificial Sequence
  Description of Artificial Sequence: Synthetic coding sequence
atggctgaactgaacacccacgtcaacgtgaaggagaagatctatgccgtccgctccgtcgtgccaaataagagcaacaatgaaatcgtgttggtactccagcagttcgatttcaatgtggacaaggctgtacaggcctttgtggatggttctgctatccaagtgctcaaggagtggaacatgactggtaaaaagaagaacaacaaacggaaacggtctaaaagcaagcagcaccaggggaacaaagacgcaaaggacaaggtggaacgccctgaggcaggtcccctccagccgcaacctccccaaattcagaatggccctatgaacgggtgcgagaaagattcatcaagtaccgacagtgccaatgaaaagcctgctctaataccccgggaaaagaagatctccattctagaagagccgtctaaggcccttagaggagtgactgaagggaatagactgttacaacagaaactaagtctcgacggtaatcctaaaccaatccacggtaccactgaacgctccgacgggttgcagtggtcagccgaacagccctgtaatccttccaagcctaaggccaaaaccagcccggtcaagtccaacacccctgctgcccacctggagataaaacccgacgagctggcaaagaagcgcggacccaatattgagaagtccgttaaggacctacagaggtgcactgtctctttgacaaggtacagggtaatgataaaggaggaggtcgacagttcggtgaagaaaatcaaggcggctttcgcagagttgcataattgtatcatagataaggaggtgtccctcatggccgagatggacaaggtgaaagaggaagccatggaaattctgaccgcaaggcagaagaaggccgaagagttgaagcggctcactgacttggctagccagatggcggagatgcagttagctgagcttagagccgagattaagcacttcgtcagcgaaagaaaatacgacgaagagctcggcaaagcagctcgattttcttgcgacattgaacagctcaaagcccagatcatgctttgcggggagattactcatcccaagaacaactattcctcccggactccttgttcatcacttctccctcttttaaatgcacacgctgccaccagcggaaaacagtcaaatttctcacgcaagagctctactcacaacaagccctccgaaggcaaggcagccaatcctaaaatggttagctccctgccctcaacagcagatccctcccatcaaaccatgcctgccaacaagcagaacggaagctccaaccagcgacgacgttttaatccacagtatcataataatcgtctcaacggacccgccaaatctcaggggtccggaaacgaagcagaacctctcggcaaagggaatagccgccatgagcatcgacggcagccacacaacggcttccgacctaaaaacaagggcggggctaaaaaccaggaagcttctctcggcatgaagaccccggaagcccccgctcattcggagaaaccgcgcaggcgccagcacgctgcggacaccagtgaggctcgcccattcaggggtagtgttggacgcgtttcccagtgcaacttgtgcccgaccaggatagaggtgagtactgatgccgccgttctgtcagtccccgcagtcacactcgtagcttag

SEQ ID NO: 136032 - DNA, 1470 bp, Artificial Sequence
  Description of Artificial Sequence: Synthetic coding sequence
atggccgaactcaacactcacgtcaatgtaaaagagaaaatttatgcagtgcgatctgttgtccctaacaagtcaaataatgaaattgtactggttctgcaacaattcgactttaacgttgacaaggccgtgcaggctttcgtggacgggtccgcaatccaagtgctgaaagaatggaacatgacaggcaagaagaagaataacaaaaggaagcgaagcaaatctaaacagcatcaggggaacaaagacgcaaaggataaagtggaacggcctgaggcagggccactgcagccacagccaccacagattcagaatgggcccatgaacggatgtgagaaagacagttcatctacagactcagccaatgagaagcccgcactgattccacgagagaagaagatctctatactggaggagccgagcaaagcgctgcgaggcgtgactggacctaacatcgaaaagagtgttaaggatctgcaacgttgcactgtgtctcttacaaggtacagagtgatgattaaggaggaagtggattctagcgtcaagaagataaaagctgctttcgctgaactgcataattgcattatcgataaggaggtatccctaatggccgagatggacaaggtcaaggaggaggccatggagattttgactgcacgtcaaaagaaggctgaagagttgaagaggctgacagatctcgcctcacaaatggccgagatgcagttagctgagctgcgagctgagataaaacatttcgtgtccgaaagaaagtacgatgaggaattaggcaaggcagcaaggtttagttgtgatatcgaacagctgaaggctcagataatgttgtgtggagagatcacccatcctaaaaataactactcctctcggactccatgttccagcttgctccccttgctgaatgctcacgcggccactagtggcaaacaatcgaacttcagccgcaagtcctccacacacaacaagccatcggaagggaaagcagcaaatcccaagatggtctccagccttcctagcactgcagacccctcccatcagactatgcccgccaacaagcaaaatggctcctccaaccagaggcgaaggttcaatcctcaatatcacaataacagactgaacggtccagccaaatctcagggctctgggaacgaggccgagccactggggaaggggaatagccggcatgagcacagaagacagccacacaatgggttccggcctaagaacaaaggtggagccaagaaccaagaagccagcctcggcatgaagaccccagaagccccagcccactcggagaaacccagaagaaggcaacatgcggccgatactagcgaggctaggccattccggggatccgtcggtagagtgtcccagtgtaatctatgtccaacacgcatagaagtgtccaccgatgctgctgtcctcagcgtcccagcagtaaccttggtggcgtag

SEQ ID NO: 136033 - DNA, 1677 bp, Artificial Sequence
  Description of Artificial Sequence: Synthetic coding sequence
atggcggaactaaatacacatgttaacgtgaaagagaagatatatgcagttcggagcgttgttccgaataagagtaacaacgagatcgttctcgtgttgcagcagttcgatttcaatgtcgacaaggccgtccaagcttttgtggatgggagcgccattcaggtgttgaaggaatggaatatgacggggaagaaaaaaaataataaaaggaagagatccaagtccaaacagcaccaaggaaataaagatgccaaagataaggttgagcgacctgaggcaggtccactacagccacagcctccgcagatccagaacggacccatgaatgggtgtgagaaagattcaagctcaaccgattcagctaatgaaaagccagctcttattcccagggagaagaagatctcaatactggaagagccctcaaaggccctacggggagtgacggaaggcaatcgcttgcttcaacagaagctctccctggatggaaatcccaagcccatccacggcactacagaaagatccgacggtcttcaatggagcgcagagcagccgtgtaatcccagtaagccaaaggccaaaacttcgcccgttaagtcaaacaccccagcagcccacttggaaatcaaacccgacgaactcgccaagaagcgcgggccaaacatagagaaatccgtcaaagatttgcagcggtgtacagtcagccttactcgctacagagttatgatcaaggaagaagtggacagttccgtaaaaaaaatcaaggccgctttcgccgagctgcacaactgcataattgacaaagaggtatctttgatggccgagatggacaaagttaaagaagaagcaatggaaatcctgactgccaggcagaaaaaggctgaggaacttaagagactgacagatcttgccagtcagatggccgaaatgcagctcgccgagctgagggccgagattaaacactttgtgtcggagagaaaatatgacgaagagctcggtaaagctgcccggttcagctgcgacatcgaacagcttaaggcacagattatgctctgcggtgagatcactcatcccaagaacaattatagtagccgcaccccatgcagctcactcctgccactgctaaacgctcatgccgccacatccgggaaacagtccaacttcagccgcaagtccagcacgcataacaaaccctctgagggaaaagctgccaaccctaagatggtaagcagcttgcctagcacagccgatccctcccatcaaactatgcccgcaaacaaacagaatgggtcctcaaaccagcgacgaagattcaacccccagtatcacaacaaccggctcaatggtccagccaagagccaggggtccgggaatgaggctgagccgctgggcaaagggaattccaggcacgaacacaggcgacaaccgcacaacgggtttcggcccaagaataaggggggagcgaaaaaccaggaggcatcactcgggatgaagaccccagaagctcctgctcactccgagaaaccaaggcggcggcagcatgccgccgacacctctgaggcacggcccttccgtgggtctgtcggtcgtgtatcccagtgtaacctgtgtcccacacggatcgaggtctctaccgacgcagccgtcctctctgttcccgccgtcacgttagtcgcttag

SEQ ID NO: 136034 - DNA, 1701 bp, Artificial Sequence
  Description of Artificial Sequence: Synthetic coding sequence
atggcttatagtactcggtcgaaaatggccgagctcaatactcatgtgaacgtgaaagagaagatttacgcagtgcgctcagtggtgccaaataagagcaataacgagatagtgctggtgctgcagcagtttgatttcaatgtagacaaagccgtccaggctttcgtagatggcagcgctattcaagtcctcaaggagtggaacatgaccggaaagaagaaaaacaacaaacggaaacgctctaagtcgaaacaacatcagggcaataaggacgctaaggataaagtggagcgccctgaggccggaccacttcaaccgcagcccccccagatccagaacggcccaatgaacgggtgtgaaaaggacagtagtagcacagatagcgccaacgagaagcccgctttgattcctcgggaaaagaaaatttctatcctggaagagcccagcaaggccctgagaggcgttacagagggaaatagactgttacagcagaaactgtccctggatggtaacccaaaacctattcacggtacaacagagcgcagtgatggactgcagtggagcgccgagcaaccctgtaacccctcaaagcctaaggccaaaacctcacccgtaaaaagcaacacgccagcagcccatctggagataaaacctgacgagcttgctaaaaaacggggacctaatattgagaagagcgtgaaggacctccaacgatgtacagtgagcctgacacgataccgcgttatgattaaagaagaggtagattcatcagtgaagaaaattaaagcagcgtttgcggagttgcacaactgcattatcgataaggaggtcagcctgatggccgagatggacaaagtgaaggaagaggccatggagatcttgacagctcgccagaagaaggcagaggaattaaagcgcctgacagaccttgcgtcccagatggccgagatgcagctcgccgaactgagagctgaaataaagcactttgtgtccgaaaggaagtacgatgaggagcttggaaaggctgccaggttctcttgcgacatcgagcagctgaaggctcagatcatgctatgcggggagataactcatcctaaaaataactacagctcaagaactccatgctcatccctgctgccactcctgaacgcgcacgctgccacgagcggaaaacagtccaacttttccagaaaaagttccacccataataagccatctgaagggaaggccgccaatccgaaaatggtctccagtctgccttccaccgcagatcctagtcatcaaactatgcctgcaaataaacaaaatggtagcagtaatcagcggagacggtttaacccacagtatcacaacaacaggttaaatggtcctgccaaaagccaggggagcggtaatgaagccgagcctttgggaaaaggaaattcacggcacgagcatagaaggcagccccataacggcttccgacccaaaaacaagggcggggcaaaaaaccaagaggccagtcttgggatgaagacaccagaggcgccagcccattcagagaagcctcggcgccgtcagcacgccgccgatacaagcgaggcgcgccccttcaggggctcagtgggcagagtcagtcagtgcaatctttgtccaacacgcatcgaagtctccactgacgcggccgtgcttagcgttccagccgtgacactagtggcatag

SEQ ID NO: 136035 - DNA, 801 bp, Artificial Sequence
  Description of Artificial Sequence: Synthetic coding sequence
atggcagagctcaacacccatgttaatgtgaaagagaaaatctacgcggttagaagtgtggtgcccaacaaatcaaacaatgaaatagtgctcgttctgcagcagttcgattttaacgtggacaaggcggtgcaggccttcgtggatgggtccgcaatccaagtgcttaaagagtggaacatgacagggaaaaaaaagaataacaaacggaaacgatccaagagtaagcagcatcaggggaataaagacgcaaaagacaaagtggaacgccccgaggctggccctttgcagccacagccgccacagattcagaacggccctatgaatggatgtgaaaaggactctagttcaaccgacagtgctaacgaaaaacctgctctgatcccgagagagaagaaaatctccattctggaggagccaagcaaagctcttcggggtgtcacaggtcccaatatagagaaaagtgtgaaagatctccaacgctgcacggtgagcctgactcgctatcgagtgatgatcaaagaagaagtggacagctctgttaagaagataaaagcagcttttgctgagttgcacaactgcattattgacaaagaagtttcactgatggccgaaatggacaaagtgaaggaggaggccatggaaattctgacggctagacagaagaaagccgaggagttgaaacgcttgaccgacttggcctcccagatggcagagatgcagttggccgagctgcgagccgaaattaaacactttgtgtctgagagaaaatacgatgaggagctggggaaagctgcttag

SEQ ID NO: 136036 - DNA, 1677 bp, Artificial Sequence
  Description of Artificial Sequence: Synthetic coding sequence
atggctgagcttaatactcacgtgaacgtgaaagagaaaatatacgcagtgcgttcggttgtgccaaacaaatccaacaacgaaatcgtgctcgtgttgcaacaattcgattttaacgttgacaaggcggtccaggcattcgttgatggctctgccatccaagtactgaaggagtggaatatgaccggcaaaaagaagaataataagcggaaaaggtccaaaagcaaacaacaccaggggaataaggacgcaaaggacaaggtcgagcgaccagaggccgggccgctgcagccgcagcccccccagattcaaaacggtccaatgaacggctgcgaaaaggattcttcttccaccgactccgccaacgagaaacccgcattgatacctcgcgagaagaagatttccatcctcgaggaaccctcaaaggcattaaggggggtgaccgaagggaatcggctactacaacaaaaactctctttggacggcaacccaaagcccattcacggaaccaccgagcgttcagacggactgcaatggtctgcggaacaaccatgcaacccaagcaagcctaaggccaaaacttctcccgtcaagtctaatactcccgctgctcacttagaaattaaaccagatgagctggccaaaaagcgcgggccaaacatagagaaaagcgtcaaagacctgcaacggtgcactgtgtctttaacccgctatagggttatgatcaaggaggaagtggacagctctgtgaagaagatcaaagctgcatttgctgaactccacaattgtataatcgacaaagaggttagcctgatggccgaaatggacaaagtgaaggaagaggccatggaaattctgacggcgagacaaaagaaggccgaggagcttaagagactgactgatctggcgtctcaaatggccgagatgcagctggccgagctgcgcgccgagataaaacacttcgtgtctgagaggaaatatgatgaggagctagggaaggcagcccgcttttcctgtgatatcgaacagctgaaggcccagattatgctgtgcggggagatcacccacccaaaaaacaactatagcagccgaaccccttgctccagcctgctcccattgttgaacgctcatgctgctacttcgggcaagcaatccaacttttctaggaagtcatccacacacaacaagccatcagaaggtaaggctgcaaatccgaaaatggtgtcatccctgccctcaacagcagacccttctcaccaaacaatgccggctaacaaacaaaatggctctagcaaccagcggcgccgatttaatcctcagtatcataataaccgactgaatggcccagcaaagagtcaggggtcaggcaatgaagctgagcccttgggtaagggcaactctcgacacgaacatcggcgacagccccacaacgggtttagaccaaagaataaaggcggggcaaagaatcaggaggcttcactggggatgaaaactcccgaggctcccgcccactctgagaaaccacgccggagacaacacgcagctgacaccagcgaagcgaggccctttcgaggaagtgttggtcgggtctctcaatgcaacctgtgcccaaccagaatcgaagttagcaccgatgcagccgtgctcagcgttccagccgtcaccctggttgcctag

SEQ ID NO: 136037 - DNA, 1767 bp, Artificial Sequence
  Description of Artificial Sequence: Synthetic coding sequence
atggacccgttttgccactcatcctccgagacaaggctgctatcgggcaccctgctgtggatcccacgggcatatagtacaaggagcaaaatggccgagttgaacactcacgttaatgtgaaagagaaaatttatgctgtacgtagcgtggtcccaaacaaatcgaacaatgaaattgtacttgtgttgcaacagtttgacttcaacgtcgataaggcagttcaggcttttgtggacgggagtgccattcaggtcttgaaggagtggaatatgaccgggaagaagaaaaataacaaaagaaaacggtctaagtctaaacagcaccaggggaataaagatgccaaagataaggtggaacgccccgaagcgggacctttgcaacctcagcccccgcagatccagaatgggcctatgaatggctgtgaaaaagacagtagtagcacagactctgcgaatgagaaaccggcccttatccccagggagaagaaaattagtatcctagaggaaccttccaaagcactcaggggggttaccgaaggcaacagactcctccaacagaagctgagtctcgatggcaatcccaaacccattcatggtactaccgaaaggtcagacggattgcaatggtcggccgaacagccatgtaatccctcgaagcccaaagctaagacctctcccgtcaagtcgaacacacccgctgctcacttggagatcaagcctgacgaactagctaaaaaacgaggccccaatatagagaagagcgtgaaggatctgcaacggtgcaccgtgtccttaacgcggtatcgggtgatgatcaaagaggaggtggactcctctgtgaagaaaatcaaggccgccttcgcggagctccacaattgcatcattgataaggaggtctcactgatggccgagatggacaaggtgaaagaggaagctatggagatcctaaccgcacggcaaaaaaaagcagaagaactgaaacgcctgacggacttggctagccaaatggcagaaatgcagctggcggagcttcgggctgaaataaaacatttcgtctcagaaagaaaatacgatgaagagttggggaaagccgccagattctcttgtgacatcgaacagttaaaggcccagattatgctttgtggcgagattacccatcctaaaaacaattacagcagccggaccccctgcagttccctgctgcccctattgaacgcacatgcagcaaccagcggcaaacagagcaacttctccaggaagagctctacacacaacaagccttccgaaggaaaggctgcaaaccctaagatggtgagcagtctgccgagcactgccgatccaagccatcaaacgatgccagcgaataaacaaaatggcagctccaatcagcggcgccgattcaacccgcagtaccataacaaccgtttgaatgggcctgctaaatcccagggctccggcaatgaggccgaaccattggggaagggtaacagcaggcacgagcatcgcagacagcctcacaatggcttccgtccaaaaaacaaggggggcgccaaaaaccaggaagcctccctgggcatgaagactcccgaagctccagcccacagtgaaaagccaaggaggaggcagcatgccgctgatacatccgaagcacgcccattcagggggagcgtggggagagtttcacagtgcaatctgtgtccaaccaggatcgaggtgtctacagatgcagcagtgctgtctgtaccggctgtcacgctagtggcgtag

SEQ ID NO: 136038 - DNA, 1677 bp, Artificial Sequence
  Description of Artificial Sequence: Synthetic coding sequence
atggcagagctcaacacccatgtgaatgtaaaagagaaaatttacgctgtgcgttctgtggttcccaacaagtcaaataacgaaatcgtcctcgtccttcaacagtttgacttcaatgttgataaggcagtgcaggccttcgtagatggaagcgctatacaggtcctgaaggagtggaacatgaccgggaagaaaaaaaataacaagagaaaacggagcaaatctaagcagcaccaaggcaacaaagatgctaaggataaagtggagagacccgaggccggccccttgcagcctcaacctcctcagatccagaacggtccaatgaatggctgtgaaaaggattctagcagcactgattccgcaaatgagaaacccgctctgattcccagggagaagaaaataagcattctggaagaaccttcaaaggcccttcgaggtgtgaccgaggggaacagactcttgcaacagaagctgtccctggacggcaacccgaagccgattcatggcacaactgagcgctccgacgggctgcagtggagtgctgaacagccctgcaacccttccaaacctaaggcgaaaactagtcccgtgaagtccaacactccagccgctcacctggaaatcaagccagacgaactggccaaaaagaggggcccaaacatagaaaagtcagtcaaggatttacagagatgcactgtatcactcaccaggtatcgggtgatgatcaaggaagaggtggactcatctgtgaagaagattaaagcagcgtttgccgagttacacaactgcatcatcgataaggaggtcagcctgatggccgagatggacaaagtcaaggaggaagcaatggagatcctcaccgccagacagaaaaaggctgaggagctcaagaggctgacggacctcgccagccagatggccgaaatgcagctcgcagagcttagggccgagattaagcattttgtgtcggagcggaagtacgacgaggaactggggaaagctgcacgtttctcctgtgacattgaacaacttaaggctcagatcatgctatgtggggaaatcacccatccaaaaaacaactacagcagtagaactccttgttcttctttgctgcctttgctgaacgcccacgctgctactagtggaaaacagagtaacttctcccgcaaatcatcaacgcataataaaccatcagaaggtaaagctgccaatccaaagatggtgtcctccctgccatctacagctgacccttcacaccagactatgcctgctaataagcagaacggtagcagtaatcaaagaagacggttcaacccccagtatcataacaacaggttaaatggtcccgctaagagccaggggtcaggcaatgaggccgagccactggggaaaggcaattccagacatgaacaccgtcgtcagcctcacaacggctttaggccgaaaaataagggcggcgcaaaaaaccaggaagcatctctgggcatgaagacacctgaggcaccagcccattcagagaagcctcggaggcggcagcacgctgccgatacatcggaggcacgtccgttccgcggttcggttggaagagtgtcccagtgcaacctgtgccccacacgcatcgaagttagtactgatgcggcggtgctgagcgttccagctgtcaccttggtggcgtag

SEQ ID NO: 136039 - DNA, 465 bp, Artificial Sequence
  Description of Artificial Sequence: Synthetic coding sequence
atggccgagctaaacacgcacgttaacgtgaaagagaagatttatgcagtgagaagtgtggtgcctaataagagtaacaatgaaatcgttctggtgctccaacaatttgatttcaatgtggacaaagctgtccaggcttttgtcgacgggtccgccattcaggtgctaaaagaatggaacatgacaggcaagaagaaaaacaacaagaggaagcgctccaaatctaaacagcaccaaggcaataaggacgcaaaggacaaggtggaacggcccgaagcagggcccctgcagccccagccaccacaaatacagaacggaccaatgaatggttgcgagaaggatagctcgagtaccgattcagccaacgaaaagccggcgttgattcctcgagaaaagaaaatctctattctcgaggagccctctaaggctttgcgaggcgtcactgaagggaatcgacttctctag

SEQ ID NO: 136040 - DNA, 423 bp, Artificial Sequence
  Description of Artificial Sequence: Synthetic coding sequence
atggctgagctaaatacacacgtgaacgtcaaggagaagatttacgcggtcagatctgttgtaccgaataagtctaacaatgaaatcgtccttgtgttacagcaattcgattttaacgtcgacaaagcagttcaggcttttgtagatggttccgcaatccaggtgctgaaggaatggaatatgactggtaagaaaaaaaataacaaacgcaagcgcagcaagtccaagcagcaccaagggaataaagacgcaaaagataaagtggagcgacctgaggcaggacctctgcagccccagcctcctcaaattcaaaacggcccaatgaacggatgcgaaaaggattcatcatctactgactcagctaacgagaaaccagctttaattccccgggaaaaaaagatttcaatcctggaggagccctag

SEQ ID NO: 136041 - DNA, 42 bp, Artificial Sequence
  Description of Artificial Sequence: Synthetic coding sequence
atggctgagctcaacactcacgtgaatgtcaaggagaagtag

SEQ ID NO: 136042 - DNA, 285 bp, Artificial Sequence
  Description of Artificial Sequence: Synthetic coding sequence
atggccgaactaaatacacatgtaaacgtgaaagaaaagatttacgccgtgaggtcagtcgtgccaaataagagtaataatgaaatcgtgctcgtgctgcagcagtttgacttcaatgttgataaggctgtacaagctttcgtcgatggatccgctattcaggtgcttaaggagtggaatatgactggcaagaaaaagaacaataaacgcaagcgctccaaatcaaaacagcatcagggaaacaaagatgcgaaagacaaggtggaaagaccggaagctggatag

SEQ ID NO: 136043 - DNA, 348 bp, Artificial Sequence
  Description of Artificial Sequence: Synthetic coding sequence
atggcggagctgaatacccacgttaacgtgaaggaaaagatatacgcggtgcgctcagtcgttcctaacaaaagtaataacgagatcgttctcgtgctccagcagttcgacttcaatgtggacaaagccgtgcaggccttcgtggatgggtccgccatacaggttttgaaagaatggaacatgacaggaaagaagaaaaacaacaagcgcaaaagatccaagagtaagcaacaccagggcaataaagatgctaaggacaaggtcgagcgacccgaagccggtcctcttcagccgcagcctccacaaatacagaatgggccaatgaatggctgtgagaaggatagttag

SEQ ID NO: 136044 - DNA, 72 bp, Artificial Sequence
  Description of Artificial Sequence: Synthetic coding sequence
atggcggaactcaatacacacgtcaacgtgaaagagaagatctacgccgtcagatctgtcgttcccaactag

SEQ ID NO: 136045 - DNA, 522 bp, Artificial Sequence
  Description of Artificial Sequence: Synthetic coding sequence
atggccgagctaaatacccatgtaaacgttaaagagaaaatctacgcggtcagaagtgtcgtcccaaataagagtaacaacgagattgtgctagtcctacagcagttcgatttcaacgtcgataaggccgtgcaggcctttgtcgacgggagcgctattcaagtcctgaaggagtggaacatgaccggtaaaaaaaagaacaacaagaggaaacgcagtaaatccaaacagcaccaaggaaacaaagacgctaaagacaaagtggaacgcccggaagccggcccattgcagcctcagcctcctcagatccagaacggacctatgaacgggtgcgaaaaggatagcagcagcacagatagcgcaaacgagaagccagctttaatcccacgggagaagaagatcagtattctagaagagcctagcaaggccctgcgcggagtgaccggcccaaacattgaaaaaagtgtcaaagacttgcagcgctgcactgtgtcgctcacccgctatagggttatgatctag

SEQ ID NO: 136046 - DNA, 1677 bp, Artificial Sequence
  Description of Artificial Sequence: Synthetic coding sequence
atggcggaactcaatacccacgtgaacgtgaaggagaaaatctatgctgtacgtagcgtcgtgcccaataagtccaacaatgagattgtcttggtccttcagcagtttgatttcaacgtggataaggctgtccaggctttcgtggatggcagcgcaatacaggtgctcaaggagtggaacatgacgggaaaaaagaagaataataagcggaaacgaagtaaaagtaagcaacatcagggaaacaaggatgcaaaagacaaagtggagcggccagaggcaggtccactccaaccccaaccacctcagatacagaacggcccgatgaatggatgtgagaaggactcttccagtactgactcggctaatgagaagcccgctctgattccccgcgagaaaaagatttctattctcgaggaaccatctaaagcattaagaggtgtgaccgaaggtaataggcttctgcagcagaagctgtcactagatggaaacccaaaacctatccacgggacaacagagaggtcagacggccttcagtggagcgccgagcagccttgtaacccatccaagcctaaggccaaaaccagccccgttaagtctaatactcccgcggcccacctggagatcaaaccggatgagctcgcaaagaagaggggccccaacattgagaagtctgtgaaggatttacaaagatgcactgtctctctcacaagatatagagtcatgataaaagaggaggtggactcgtccgttaaaaagataaaagccgcttttgccgagttacacaactgtattatcgataaagaggtctcgctgatggcggagatggacaaggtcaaggaagaggctatggaaattttgacagctagacaaaagaaggcagaagagctcaagcggttgactgacctggcttcccagatggctgagatgcagctggcagagctgcgggccgagatcaaacatttcgtgtctgaaagaaaatacgatgaggaacttggtaaagcggctcggttctcttgcgacatcgaacagctaaaggcccagataatgctatgtggagaaatcacccacccaaagaataactactcctcccggaccccttgctcatctctccttcctttgctgaatgcccatgccgctaccagtgggaagcagagtaacttttcccgcaagtcatctacccacaataagcccagtgaaggcaaagccgccaaccccaagatggtgagttcactcccctcgactgccgatccgtctcatcagaccatgccagccaacaaacagaacggtagctccaaccaacggcgtcgctttaacccgcagtaccacaataatagactgaatggtcctgccaaaagccagggctctggcaatgaagctgaacctttaggcaaagggaactctcgacatgagcatcggagacagccccataatggttttagaccgaagaacaaggggggagctaagaaccaggaggcaagcttgggcatgaagactcctgaggctcccgcccactccgaaaaacccaggcgaagacaacatgcagcagacacctcagaggctcgaccatttaggggctccgtcgggagagtgtcccagtgcaatctgtgtccaacccggatagaagtaagcaccgacgcagcagtcctgtccgtgccagctgtgaccctggtggcctag

SEQ ID NO: 136047 - DNA, 567 bp, Artificial Sequence
  Description of Artificial Sequence: Synthetic coding sequence
atggccgagctcaatactcacgttaatgtgaaggagaaaatttacgccgtccgatcagtggtgcccaacaagtctaacaatgaaatcgtgctggtgctgcaacaattcgattttaacgtggataaagcggtccaggcttttgtcgatggcagcgcaatacaagttctcaaggaatggaacatgacaggaaagaagaagaacaacaagaggaagagatcaaagtccaaacaacatcaaggaaataaagacgcgaaggacaaggtcgagcgcccagaggcagggccactgcaaccccagccaccccagatccaaaatggacctatgaatggttgcgagaaagactcctcatcaacagattctgcaaacgagaaaccagccttgatccctagggagaaaaagatctccatcttagaggaaccctcgaaggccttacggggcgttaccgaggggaacagactgctgcagcagaaactttcccttgatggaaatcctaagcccatccacggcactacagagcggtcagatggcctccagtggagtgcagaacagccctgcaatccctcatag

SEQ ID NO: 136048 - DNA, 909 bp, Artificial Sequence
  Description of Artificial Sequence: Synthetic coding sequence
atggaaccgggcccagacggacccgctgccagcgggccagctgcaataagggaaggctggttccgcgagacatgtagtctgtggccagggcaggctctttcactgcaggtggagcagctgctccaccaccgcaggtcccggtaccaggacattctggtgtttcgaagcaagacctacggaaatgtcctcgtgctagacggggtgatccagtgtactgagcgggatgaattctcctatcaggaaatgattgctaacttgcccctgtgctctcaccccaaccctaggaaggtactgattattggcggcggagacggcggggtacttagggaagtggtgaagcacccgtccgtggaatccgtagtccagtgtgaaatcgatgaagatgtaatccaggtctctaaaaaattccttcctggaatggcaataggctactccagctctaaacttactctgcacgtgggtgacggcttcgaattcatgaagcagaatcaggatgcgttcgacgtcattatcacagactcatccgaccctatggggcccgctgagagcctatttaaagagtcatactaccaattaatgaaaactgccctgaaggaggatggggtgctgtgttgtcagggcgaatgtcaatggcttcaccttgacctgatcaaggagatgcggcagttctgccagtctctgttccctgttgtcgcatacgcgtattgtactatccctacataccccagcggacaaattggctttatgctatgtagtaaaaacccgtctacaaacttccaggaaccagtgcagccactgacccagcaacaggtcgcccagatgcaacttaagtactataattccgacgttcacagagctgcctttgtcctgccagagtttgcccgtaaggcacttaatgacgtctcatag

SEQ ID NO: 136049 - DNA, 600 bp, Artificial Sequence
  Description of Artificial Sequence: Synthetic coding sequence
gaggagcccccgcccccaacagtccaagttcagggccccggccctcaacgggaggagaaacagaaaacaaagatggccaagttcgttattagacccgctaccgcagcagactgctccgacatccttagacttatcaaagaacttgccaaatacgaatatatggaagagcaggtgatactcacagaaaaggacttactcgaggacgggttcggggagcatcctttctatcattgcctggtggctgaggtgcccaaagagcactggacgcctgagggcaatccctcccccttccccgaggcccgcgaaaccaaatgctattattttacttatgacccctggataggcaagctgctgtatctcgaagacttcttcgtcatgtctgattacagaggtctttggcaccgcattagaaatagcgaggagagcaagcctgggtgtaatgaggtttccctcgcagcctgcactagttgggctgagtggaatgagccgtccattaatttttataaacggcgcggcgcaagcgacctaagtagcgaggaaggatggcgtctgtttaaaatagacaaagagtacctgttaaaaatggccactgaagagtag

SEQ ID NO: 136050 - DNA, 453 bp, Artificial Sequence
  Description of Artificial Sequence: Synthetic coding sequence
atggctaaatttgtgattcggcccgccaccgccgcggattgttctgacattctacgtcttatcaaagagctggcaaagtatgagtatatggaggaacaagtcatactgactgagaaaggcaattctactgttgctggccgaggaacttcagttagatgtctatcacccagtccccgcccgctgcccccactgctcccactgctcgctgacttgctggaggatgggtttggtgagcatcctttctaccactgtttggtcgccgaagttccaaaggaacactggactccagaggggaatccttccccctttccagaggcccgcgaaactaagtgctacgtgaggagctcagtcgggtgcgtggaacccctgactacacaggcagaggttactgaaaaccttgaccggaagaactcacagcaggtgtttaagctcttaagaaaaaagaagaactag

SEQ ID NO: 136051 - DNA, 363 bp, Artificial Sequence
  Description of Artificial Sequence: Synthetic coding sequence
atggcaaagttcgtgatacgccccgccacagccgccgactgttcagatatcctcaggctcattaaggaactggctaaatatgagtacatggaggaacaagtgattctcaccgaaaaagacctgctcgaagatgggttcggcgaacatccattttatcactgcctagtcgccgaagtgcccaaagagcactggacccccgagggaaatccctccccttttcccgaggcccgcgagaccaagtgctatgttcgcagcagtgtgggctgtgtagagcctcttaccactcaggcagaagtgaccgaaaatctggataggaagaattcccagcaggtgttcaagctgctccgcaagaaaaagaactag

SEQ ID NO: 136052 - DNA, 432 bp, Artificial Sequence
  Description of Artificial Sequence: Synthetic coding sequence
atggctaagtttgtcattcgtccagcaaccgccgccgattgttcagacattttgaggcttatcaaagaacttgccaaatacgaatatatggaggagcaggtgatattgactgagaaaggacactctattgtgggattcgccatgtactattttacctatgatccgtggatcggtaagcttttatatctagaggattttttcgtaatgagcgattaccgaggcttcggtattgggagcgaaatcttgaagaatctaagccaagtggccatgagatgcaggtgctcgtcaatgcatttcctcgtggccgaatggaacgagccctctattaacttctataagagaaggggagccagcgatctgtctagtgaggagggctggcgcttgttcaagatcgataaagaatacctgctgaagatggcaactgaggagtag

SEQ ID NO: 136053 - DNA, 516 bp, Artificial Sequence
  Description of Artificial Sequence: Synthetic coding sequence
atggcaaagtttgtcataaggcccgcaaccgctgctgactgcagcgacatccttcgtcttatcaaggagctggctaagtatgaatatatggaagaacaggtaattttgacagaaaaagacttgctggaggacgggtttggcgagcatcccttctatcactgtcttgtcgccgaggtgcctaaggagcattggacacccgagggccattccattgtggggttcgccatgtactatttcacatatgatccatggataggcaaactgctctacttggaggactttttcgtgatgagtgactatagagggttcggcatcggttccgaaattctgaaaaacctatctcaggtggcaatgagatgccgctgctcctcaatgcattttctggtggcagagtggaacgagccttctattaacttctataagaggcgcggagccagcgatctcagtagcgaggagggctggcgactattcaagatcgacaaggaatatctcttgaagatggccactgaagaatag

SEQ ID NO: 136054 - DNA, 513 bp, Artificial Sequence
  Description of Artificial Sequence: Synthetic coding sequence
atggccagcgtgcgaattagggaggctaaagagggggattgcggggacatccttcggctcatccgtgagttggctgagttcgagaagttaagcgaccaagtgaagatttccgaggaagctctcagagccgacgggttcggggacaatcccttttaccactgtcttgtcgcagaaatactgcccgcaccgggaaagcttctcggtccatgcgtggtggggtatgggatctattactttatttacagcacttggaagggaaggaccatctaccttgaggatatctacgttatgcctgaatatcgagggcaagggattgggagtaagattatcaaaaaagtggccgaagtcgcactcgacaaaggatgctcacagttccgactggcggtgctggactggaaccaacgcgccatggacttatataaagccctcggagctcaagacctgaccgaagccgaaggctggcattttttttgctttcagggtgaggccacaagaaaactagcgggtaaatag

SEQ ID NO: 136055 - DNA, 750 bp, Artificial Sequence
  Description of Artificial Sequence: Synthetic coding sequence
atgcccgggcagagaatcgccagtttagcttattccttactgccttacggagctggcattcccgcaccccttacgcggccgcgcttgccgaggcgcccgccccggctgcccccgcctcgaagcctccgactctttagaattcaggtgaggagaccattcaaagggagttcctgtaggctccgcgggccagggactttagtgcctgattccggagaccccgatggctttagagccgatccccgtggccagggcggtagattatggcgttacccagaggccgactccggcgaagattgccgtcctgaacttgctgaattcgagaaactgagcgaccaggtcaaaattagcgaggaagcactgcgcgccgacgggtttggagataatcctttttatcactgccttgttgccgagatcctgcctgcaccgggaaaactcttgggtccgtgtgtggtggggtacggaatttattatttcatctacagcacctggaaagggcgcaccatctacctggaagacatctacgttatgcccgagtaccggggtcaagggatcggatcaaagattatcaagaaggttgcagaggtggctctggacaagggttgttcacagtttaggctggcagtgttagattggaaccagcgggccatggatctgtataaagccctgggagcccaggacctaacggaagccgaagggtggcatttcttttgctttcagggcgaagcaactcggaaattggctgggaagtag

SEQ ID NO: 136056 - DNA, 942 bp, Artificial Sequence
  Description of Artificial Sequence: Synthetic coding sequence
atggccgctgctcggcatagtacactggatttcatgttgggagccaaggccgacggcgaaaccattctgaaaggcctacaatctatctttcaggagcaagggatggctgaaagtgtgcacacatggcaggaccacggttatctcgcaacctataccaacaagaacgggcggcttccacccatcgtacgaggtggagctattgacagatattggccaacagccgatggcaggctagtagagtatgatattgatgaagttgtttacgatgaggattcaccctatcaaaatattaaaattttacatagcaagcaattcggcaatatactgattttgtctggggacgtgaatcttgcagagagcgatcttgcatacaccagagcaattatgggatccggcaaggaggattacacaggaaaggacgtgctaatcttggggggaggagacggcggaatcctttgtgaaatagtgaagctgaagcctaagatggtgacaatggtcgaaatcgaccagatggtgattgatggctgtaagaagtatatgaggaaaacctgtggtgacgtgctggacaatttaaagggggactgttatcaggtgctgatagaagattgtatccccgtgctgaaacggtacgcgaaggaggggcgggaattcgactacgtcatcaacgacctgaccgccgtgcccataagcacaagcccagaggaggactctacctgggagtttcttaggctgattctagacctatcaatgaaggtgctgaagcaggacgggaaatacttcacgcagggaaactgcgtgaacctaaccgaggccctgagtctgtacgaggagcagttgggtcgactgtactgtccggtggaattctcgaaagagatagtgtgcgtgccttcatatctggaactctgggtgttctatactgtgtggaaaaaagcaaagccatag

SEQ ID NO: 136057 - DNA, 1101 bp, Artificial Sequence
  Description of Artificial Sequence: Synthetic coding sequence
atggcagccgcccggcacagtacgctggattttatgctgggggccaaggctgacggcgaaacaattctcaagggactgcagagtattttccaagaacaaggcatggccgagagtgtccatacctggcaagaccacggatacctggcaacgtatactaataagaacggctcctttgcaaatctgaggatataccctcatggacttgttcttctggatctacagtcctatgacggcgatgcccagggaaaggaggaaatagactcgatcttgaataaagttgaggagagaatgaaagaattaagccaggactcgactggccgagtgaagcgcctcccccctattgttcggggaggagccatcgataggtattggcctacggccgacggaaggctcgttgaatacgacattgacgaggttgtctatgatgaggattccccttaccagaacataaagatattacacagtaagcaatttggaaacattctcattcttagcggggatgtcaatctggcagagtccgacctggcctatacgagggctattatgggctcaggtaaggaagactacaccggaaaggacgtgttgattttgggcggaggtgacggcggcatactctgtgagattgtgaagctaaagccaaagatggttacgatggtcgagattgatcagatggttattgacggttgcaaaaagtatatgagaaaaacatgtggcgacgttctagacaatttgaagggggattgctatcaggtcctgatcgaagactgtatcccagtcctgaagcgatacgcgaaggaaggccgggagtttgattacgttataaacgatctcaccgctgtccccatctcaacctctccagaagaggactcgacgtgggagttccttcgtctcatcctggacttatctatgaaagtgctgaagcaggacggtaagtacttcacccaaggcaattgtgtaaatctgaccgaagccttaagtctatatgaagagcagctgggtagactgtattgccccgtggagtttagcaaagaaatcgtctgtgtgccttcatatctcgagctgtgggtattttataccgtgtggaaaaaggcgaagccctag

SEQ ID NO: 136058 - DNA, 828 bp, Artificial Sequence
  Description of Artificial Sequence: Synthetic coding sequence
atgaaagaactgtctcaggattccactggccgggtaaaaagattacctcctatagtcagaggtggggccatagacagatactggcccactgcagatggtagactcgtggagtatgacatagatgaggtcgtgtacgacgaggactcaccataccagaacataaagatcctgcactcaaaacagttcggtaatatccttatcctttccggggatgtgaatctcgcagagagcgacctggcgtatacccgagccataatgggcagtgggaaagaggactacaccggcaaggatgttctgattctcggaggaggagatggcgggattctgtgtgaaatcgtgaagctgaagcctaaaatggtcacaatggtcgagatagaccagatggtaattgacggttgcaaaaagtatatgaggaaaacatgcggcgatgtcctagacaacctgaaaggcgactgttatcaagtgcttatcgaggactgcattcccgttctgaaacgttatgccaaagaggggcgcgaatttgactatgttataaatgatctcaccgctgttcccattagcaccagcccagaagaagacagtacatgggaattcctccgtctcattttggatttgtccatgaaggtgctgaagcaggatgggaaatacttcacacagggcaactgcgttaatctgacagaagccctgtccctctacgaggagcagctaggtagactctactgccctgtagaattctcaaaggaaattgtctgcgttccaagctatctcgagctgtttctgctccagttttggcgcgtgagaagcagtaagtgtgcactggaaggttag

SEQ ID NO: 136059 - DNA, 936 bp, Artificial Sequence
  Description of Artificial Sequence: Synthetic coding sequence
tgaggcggtagggcagaggccgcactgcttctggccccgaggtccgtgcccgcagcagcccgtggtctgcagggacagagccgggttcctgccgggagagccgctcttccaggcccaggaagacctcccgctcttccgaggggacttgccgccttcgctcttcccctcggcgagtccccgggttgccgggcccgcgccgacccaccttgggatgaagggtgtagggattgcgggggcgcccgtcgcgacccccgaggagaacccggcctcggcgcctgcgcagagcggggttgcccccgagatctgtttctttttctccaggccgcggacggcgaaactattctgaaaggactccagagcattttccaggaacagggcatggccgagtccgttcatacttggcaggaccatggatacctcgccacctataccaacaagaacgggagcttcgctaatctgaggatttatcctcacggcttggtgttattggatcttcaatcatacgatggcgatgcccaaggaaaggaagagatcgacagcatcctcaataaagtggaggaaaggatgaaggagctgagccaggactcgacgggcagagttaaacgcctccccccaatcgttagggggggcgctatcgacaggtactggcccactgctgatggcagactagtggagtatgatatagacgaagtggtgtacgatgaggacagcccataccaaaacattaaaatactacattctaaacagtttgggaacatacttattctgtccggggacgttaacctggccgagtccgacttagcttacacacgcgcgatcatgggctctggcaaggaagactacacgggcaaagacgtcttgattctcggagggggtgatggcggcatcttgtgcgagatcgtcaagctgaaacctaagatggtgaccatggtgtag

SEQ ID NO: 136060 - DNA, 3801 bp, Artificial Sequence
  Description of Artificial Sequence: Synthetic coding sequence
cgtgaggctacccccccactgcgggggctgccagcgcccccgcggcatgcccccttccccgctggacggtttgagccacctagaacgaaacagggaggacgaggatcccacaccccgtgggtgtacgtcattaacgacttgggtatcgaggagaacctgaagaacgacggaaaaccgaagtgccagacagggggaaaatcgaaacgaactatccaaggtactcataagacaactaagcagcagagcaccgctgttgattgcaagattacctcttctaccacaggagacaagcattttgacaagagccctactaagactaggcacccaagaaagattgatctacgggctaggtactgggcctttttattcgacaacctcaggagggcagtggacgaaatctatgtgacgtgcgagtctgaccagtccgtagttgaatgtaaggaagttctgatgatgctggacaactatgtgagggattttaaggccctgatagactggatccagctccaggaaaagctggaaaagacagacgcacagagccggccaacatctctggcttgggaggttaaaaagatgagcccgggccgacacgtcatccccagcccatccactgaccgaattaatgtgaccagtaacgccaggaggtccctaaatttcgggggtagcacagggactgtgccagcaccccgcttagcaccaaccggcgttagctgggcagacaaggttaaggcccaccataccggctccacagcgagttcagagatcacgccagcccagtcgtgcccacctatgactgtgcagaaagcttctaggaaaaacgagcgcaaggacgctgagggttgggaaaccgtgcagcggggcaggcctatcaggagcagatctactgcggttatgcccaaggtgagtctggctactgaggccacccgcagtaaagatgactcagacaaagaaaatgtgtgtctgttgcctgatgagagcattcagaaaggacagttcgtaggtgatggcacatccaacaccattgagtcacaccctaaagacagcctccactcctgcgaccatccactggcggagaagacacagttcactgtttctaccctggatgatgtaaagaacagcggctctatccgggataactacgtgaggacaagcgagatttcagcggtgcatatcgacaccgagtgtgtgtctgttatgctgcaggcagggacccctcctcttcaagtgaatgaagagaagttccccgctgagaaggcaaggattgaaaacgagatggacccttctgacatctccaacgtgtccgcagcaaacctttctatggccgaggttctcgctaagaaggaggagcttgctgaccggttggagaaagccaatgaggaggccatcgcctccgccattgcggaagaagagcagctcacgcgggaaatagaagccgaggagaacaacgacattaacatcgaaaccgacaacgatagcgacttctctgcttcaatgggatccggatctgtttccttttgtggaatgagcatggattggaacgatgtcctcgccgattacgaggctcgtgaaagctggcgccaaaatacatcctggggagatatcgttgaggaggagcctgcccggccccccggccacggcattcatatgcatgaaaagctgagcagtccctcccgcaagcgtactattgcagaaagcaagaaaaaacacgaagagaaacagatgaaagcccagcagctgagggagaagcttagggaggagaagaccttgaagcttcagaaattgctagaacgggaaaaggatgtcagaaagtggaaggaagaactcttggaccagagacgtcgaatgatggaggagaaactcctacacgctgaattcaagcgcgaggtacaactgcaggccattgttaaaaaagctcaagaggaggaggctaaggttaatgaaatcgcctttatcaacacacttgaggcccagaataaaagacatgatgtactgtccaaacttaaagagtatgaacaacgcctcaacgagttgcaggaagagcgacagagacgtcaggaagagaagcaagccagagatgaagcggtgcaggagcggaaacgcgcattagaggctgagcggcaggcccgtgtagaagagcttctaatgaaaaggaaagaacaggaggcccggatagagcagcagcgacaggaaaaggagaaggcccgcgaggacgccgctcgagagcgggcccgtgatagagaagagcgccttgccgcactgaccgccgcccaacaagaagcaatggaggaactgcaaaagaaaattcagctgaagcacgatgagagcattcgcaggcacatggaacaaatcgaacagaggaaggagaaagccgctgagttgagctcaggccgtcacgctaacaccgattatgcacctaagctcacaccgtatgaaagaaaaaaacagtgcagtttatgcaacgtcctgatctcaagcgaggtgtacctgttttctcatgtaaagggacgtaagcatcagcaggcggtgcgcgagaacactagtatccagggaagagaactatctgatgaagaagtggagcatttgagcctgaaaaagtacatcatcgatatagtggtcgagtccaccgctcccgcggaggccttaaaggatggagaagagcgtcagaaaaataaaaagaaggcaaaaaaaatcaaagccagaatgaacttccgggctaaggagtacgagagccttatggaaaccaagaatagtggatcagactctccctataaggcaaaattgcagaggttggccaaggacctcctgaaacaggtgcaagtgcaggactctggaagctgggctaataacaaggtgtccgccctggacaggacactcggcgagatcacacggatcctggagaaggagaacgttgctgaccagattgcgtttcaggcagccgggggcctaacggctctagaacatatcttgcaggccgtcgtcccagcgacaaatgtcaacactgtgctgaggatcccccccaagagcttgtgtaacgccataaatgtctataatctcacttgtaacaattgctcagagaactgcagcgacgtgctgttctctaataaaatcacgtttctgatggatcttctgatccatcagttaaccgtgtacgtaccagacgagaacaacactatactcgggcgcaacacaaataagcaggtgttcgagggccttacaactggtctgttgaaggtcagtgctgtggtgcttggctgtctgattgcaaatcggcccgatggaaattgtcagcctgcaactccaaagatccccacccaggagatgaaaaacaagcctagccagggtgatccattcaacaaccgcgttcaagacctaattagttacgtggtgaatatgggactcattgacaagttatgcgcctgctttctctctgtgcagggacctgtggatgagaacccaaagatggctattttcctgcagcacgctgccggcctgcttcacgcaatgtgtaccctctgttttgcggtgacgggccgcagttattcaatattcgataataacaggcaggatcctactggacttacagcagccctacaggctacagatctcgccggtgtcttacacatgctctattgcgtcctgtttcatggcaccattctggatccgagcacagcctcgcccaaggagaactatacccagaatacaattcaagtggcaatacagtcacttcgattttttaacagctttgcggcccttcatctgcccgcgtttcaggtgccctctatcgggctgtaccgatgttag

SEQ ID NO: 136061 - DNA, 4203 bp, Artificial Sequence
  Description of Artificial Sequence: Synthetic coding sequence
atgatggcatcatttcagagatcaaactctcacgataaggtccggaggatcgtcgccgaggaaggtagaacagcccgcaatttgatagcatggtccgtcccattagaatctaaagacgatgacggcaaacccaagtgccagacgggtggaaagtcaaagcgaaccatccagggaacacacaagacgaccaagcagtccacagctgttgattgcaagatcacctccagtaccactggggacaaacattttgacaaaagccccacaaagacccggcatccacggaaaatcgacctgagggccagatattgggcgttcctctttgacaatctacgaagggcagtggatgagatctatgtgacgtgcgagtcagaccagtccgtggtcgaatgtaaagaagtccttatgatgctcgataattacgtgcgggattttaaagccctgatagattggattcagctccaggaaaagttagaaaaaaccgatgctcagagccgcccaacaagccttgcctgggaggttaaaaaaatgtccccaggccggcacgttatcccatcaccctcaacagatagaattaacgtgacctccaacgctagacgttcactcaatttcggcgggtctacaggcacagtgcccgcacctcgactcgcgcccaccggtgtgtcgtgggctgacaaggtaaaagctcaccacaccggtagcactgcctcttctgagatcacccctgcgcagagctgtcccccaatgactgttcagaaggccagtcggaagaacgaaaggaaggatgcggaggggtgggagactgtgcaacgcgggcgccctattagatcccgttcaaccgctgtgatgcccaaggtctcactggcgacagaggctactcgcagtaaggatgatagtgataaggaaaacgtgtgcctgctgcccgacgaaagtatccagaaggggcagtttgtcggagacggcacgagcaataccattgaaagccatccaaaagattccctccatagctgtgaccacccgctggcggagaaaacgcaattcactgtctctaccctggacgacgtaaaaaattctggctctatccgcgacaattatgtccgcaccagtgaaatttccgccgtgcacattgacaccgaatgtgtgagcgtgatgctccaggctgggaccccacccctgcaggtgaacgaagagaagtttccagccgagaaagcccgcatcgagaacgagatggaccctagtgatatcagcaatagtatggctgaagtgctcgctaaaaaggaagaattagctgaccgattagagaaagccaatgaggaggcgatcgcttcggcaatagccgaggaggagcaactgacgagagaaatcgaagccgaagagaacaatgatatcaacatcgaaaccgacaacgattccgatttctctgccagtatggggtctggcagcgtgtccttctgcgggatgtctatggactggaacgacgtgctggctgactacgaggcccgagagtcctggcgacagaacacttcctggggtgacattgttgaagaggaacccgcgagacccccagggcacggcattcacatgcatgagaagctgtcatcaccatcccggaagcgaaccatagccgaaagtaagaaaaaacacgaggaaaaacagatgaaagctcagcagttaagggaaaagctgcgtgaggagaagaccctgaaactgcagaagctgctcgaaagagaaaaagatgtgcgaaaatggaaggaagagttactcgatcaacgaagaagaatgatggaggaaaagcttctgcatgcggagtttaaaagagaagtgcagttacaagctattgttaagaaggcccaagaagaggaagcaaaagtgaatgaaattgcctttatcaatacactcgaagcccagaacaaaaggcatgacgtgctaagtaagcttaaagaatacgaacagaggctcaatgagctacaggaagaaaggcaacgccgtcaagaagagaaacaggcccgcgacgaagccgtccaggagagaaaacgcgcactagaggctgagcgacaggcaagggttgaagagctgctgatgaagcggaaagaacaagaggctcgtatagaacagcaaaggcaggagaaggaaaaggctcgggaggacgctgccagggaaagggcccgggatagggaagagaggctagcggccctgaccgcagcccagcaggaagcgatggaagaactgcaaaaaaaaatccagctgaagcacgatgagagtattagacggcatatggagcagatcgagcaacggaaggagaaggcagccgagctcagtagcggaagacacgccaacactgactatgcccccaagttaacaccatacgagaggaaaaaacaatgttctttgtgtaatgtattaatttccagcgaggtctatcttttcagccacgtaaagggtcggaagcatcagcaggccgtgcgggaaaatacttcaattcaaggaagggagctctccgacgaagaagttgaacatctgtcactgaagaagtacattattgatattgtggtggaatccacagctccagcagaggccctgaaggatggggaagagcggcaaaaaaacaaaaagaaagctaagaagatcaaggcccggatgaacttccgggcgaaggagtatgaaagcctgatggagactaagaattctggctctgactccccctataaagccaagctgcaaagactggccaaagacctgctcaagcaagtgcaggtgcaggatagtggatcttgggctaataacaaagtctctgccctcgacagaaccctcggggagattacaagaatattagaaaaggaaaatgtcgcagatcagattgccttccaagcagccggggggcttacagcactcgagcacatcctccaggcggtagtgcctgccacgaacgtcaataccgtccttcggataccgcccaaatcactatgcaacgcaatcaacgtgtataatctgacatgcaataactgttcagaaaattgcagcgacgtgctcttttccaataaaatcacttttttgatggatctgttaattcaccagctcaccgtttacgtgcccgatgagaacaacacaatattgggcaggaacaccaataagcaggtgtttgaaggccttactaccggtctactgaaggtgtcggccgtggtgctgggctgtctgattgccaaccgccccgacggcaactgccagcctgctactcctaagatcccaacccaagaaatgaagaacaaaccttcccaaggggatccctttaacaaccgggtgcaagacctgattagttatgtggtcaacatggggttgattgacaagctgtgtgcctgttttcttagcgtgcaaggaccagtcgacgagaacccgaagatggccatctttcttcagcacgctgccggtctgttgcatgccatgtgcactctatgttttgcggtcacaggacgctcctattctatcttcgataacaacaggcaagacccaactggcctgacagccgctttacaagccactgacctggccggggtcttgcatatgctgtactgtgtgttattccacggcactattttggacccctcaacagccagtcccaaagagaactacacgcagaacacaatccaggtggcgatccaaagcctccgcttctttaactctttcgctgctttgcatctgccggcttttcagtcaatcgttggagccgaggggctgagcctggcgttccggcatatggcctcttctctgttaggccattgttcccaagtgtcctgcgagagtctcttgcacgaggtcatcgtctgtgtgggctacttcacagtgaaccaccctgataatcaggtgatcgtgcagtccggcaggcatcccacggtcctccagaaactttgccagttgccttttcaatacttctctgatccccggctgatcaaggtgctgtttccaagtctcattgccgcctgctacaacaaccatcagaataagattattctcgagcaggaaatgtcctgcgtcctgttggccaccttcattcaagatctggcccagacacccggacaggccgagaatcagccctatcaaccaaagggaaagtgtctgggcagccaggactatctggaacttgccaaccgctttccacagcaagcatgggaagaggccaggcaatttttcctgaagaaagaaaagaaatag

SEQ ID NO: 136062 - DNA, 3465 bp, Artificial Sequence
  Description of Artificial Sequence: Synthetic coding sequence
atgaagactaagtacattttctgcaacattaccgaaaggaaggatgccgaaggctgggagaccgtccagcgtgggcgcccaattcggtctcgctccaccgcagtcatgccgaaggtttctctcgccaccgaggctacccgatctaaagacgattccgataaagaaaatgtgtgcctcctgcctgacgagtctattcagaaagggcaattcgttggcgacggcacgtctaataccatcgagtctcacccaaaggattcgctgcattcatgtgatcatccactggccgagaagacccagttcaccgtatccaccctggacgatgtaaaaaacagtgggtctattcgcgacaattatgtcaggacaagtgaaatcagcgccgtgcacatcgacacagagtgtgtttccgtgatgctccaagcgggaacacctccgctacaggtgaatgaggaaaagttccccgcggaaaaagccaggatagagaacgaaatggatccctctgatatctcgaactcaatggctgaggtgctggccaaaaaggaagaactggccgatcgactggagaaagccaatgaggaggccatcgccagcgctattgccgaggaggaacagttgacgagagagatcgaggcagaagaaaataacgatatcaatatcgaaacagacaatgacagtgatttttcggcctcaatgggttccggatctgtgtcgttttgcggtatgagcatggactggaacgacgtcctagccgattatgaagcgagagagtcctggcggcagaataccagttggggggacattgtggaagaagagcccgcgaggccacccggacatggcatccacatgcacgaaaaactttcttcccccagtcgaaagcgcacaatcgccgagagcaagaagaaacatgaagaaaaacagatgaaggcccagcaactgagggagaagctgcgggaggaaaagacgctgaaactgcagaaactgctggaacgcgaaaaagatgtccgcaagtggaaggaggaactcctggatcagagacgcagaatgatggaggagaaactgcttcacgctgaattcaaaagagaggtccaacttcaggctatcgtgaagaaggcccaggaggaggaagcgaaagtgaacgagatagcgttcatcaacaccctcgaggcccagaataaacgccatgatgtgctgtccaaactgaaagaatacgagcaaaggcttaacgaactgcaggaggaacgccagcggaggcaggaagagaagcaggcacgggacgaggccgtccaggaacggaagcgggccctggaagccgagcgacaggccagggtagaggaactgctgatgaagcgcaaggagcaggaggccagaatcgagcagcaaaggcaggaaaaggagaaagccagggaggatgccgcaagggaacgtgcaagggaccgggaagagaggcttgccgccctgacagctgcacagcaggaggcaatggaagagctgcaaaagaaaattcagcttaagcatgatgaatccattagacgccacatggaacagatcgagcagagaaaggaaaaagccgccgagttgagcagcggcaggcacgccaatactgactacgcaccaaaactaactccctacgaaagaaagaaacagtgctccttgtgtaatgttctgatcagctccgaagtgtacctgtttagtcatgttaaaggtagaaagcaccagcaggcagtgcgcgagaacacatccatccagggaagggaactaagtgacgaggaagtggaacatctctcgctgaaaaagtacatcatcgatatagttgttgagtccacagcaccagccgaagctttgaaagatggcgaagagcgccagaagaacaaaaaaaaagctaagaaaatcaaggctagaatgaactttcgggccaaagagtacgaaagcctcatggagacgaagaatagtggttcagattcaccttataaagccaaactacaacggctcgccaaggacttgctgaagcaggtgcaggttcaagattccggttcatgggctaataacaaggttagcgctcttgaccgcaccttgggagaaataacccggatcctggagaaggaaaacgttgccgaccagatcgcgtttcaagcagcaggaggtctcaccgctctggagcatatccttcaagctgtcgtgccagctacaaatgttaatactgtgttacgcattcctcctaagtcactgtgtaacgccataaatgtatacaatctgacatgcaacaattgctctgagaactgtagcgatgtactgtttagcaacaagataacatttctgatggacctgctcattcaccaattgactgtgtatgtacctgacgagaataataccatcctcggcagaaacaccaataagcaggtgttcgaagggttgactaccggactgttgaaggttagtgcagttgtgcttggttgcctaatcgccaatcggccggacggcaattgccagccagctacgccaaaaatccccacacaggagatgaaaaacaaaccctcccagggggacccattcaacaacagagtacaggacctgattagctacgttgtgaatatgggtctcatcgacaagctttgcgcatgtttcctgagtgtccagggtcccgtcgacgagaaccccaaaatggccatctttcttcagcacgcagcaggcttgctgcatgccatgtgcactctgtgctttgcggttaccgggaggagctattctatcttcgacaacaaccggcaagaccccactggacttactgccgctctgcaagcgactgatttagccggcgttctgcacatgctctattgcgtgctgtttcatgggaccatcctcgatcccagtactgcatctccaaaagagaactacacacagaataccattcaggtggctatacaatctctgaggttcttcaattcatttgccgccttacacctgccagccttccagagcattgtgggcgccgagggcttaagcctcgcttttcgccacatggcgtcctctctccttggacactgtagccaggtgagctgcgaatcccttctgcatgaggttatcgtgtgcgtgggctacttcactgtcaatcaccccgacaatcaagtcattgtacagagtggtcgccatcccaccgtcctgcaaaaactttgccaattacccttccaatacttctctgacccccggttaattaaggttcttttccccagtctgatcgccgcatgctacaataaccatcagaacaaaattattctagaacaggagatgtcttgcgtccttctggcaacctttattcaggatctggctcagacgccgggtcaagctgaaaaccaaccttaccaaccaaaaggcaaatgtctaggcagccaagattacttagagctggcaaatcggtttcctcagcaggcctgggaagaggctcgacagttttttctgaagaaagaaaagaagtag

SEQ ID NO: 136063 - DNA, 4203 bp, Artificial Sequence
  Description of Artificial Sequence: Synthetic coding sequence
atgatggcctccttccagaggtcaaactcccatgacaaagtccgtcggattgtcgcagaggagggtcggacagcccggaacttaattgcttggtctgtcccacttgagagtaaagacgacgatgggaagcctaaatgccagacaggtggaaaatccaagagaactatccagggcactcataagaccaccaagcagtccacggccgtggactgtaagattacaagctcaactacaggggataaacattttgacaagagccctaccaagacccgacacccacggaaaattgatttgagagcgcgctactgggccttcctgttcgacaatctccgtcgcgctgttgacgagatatatgtgacatgtgagagcgaccagtccgttgtagaatgtaaggaagtgctcatgatgctcgacaattatgtgcgtgactttaaggctctaatcgactggatccagttgcaagaaaagctggagaagactgacgcacagtcaagacccacatctttggcatgggaggtcaagaaaatgagcccgggacgtcacgtgattccatctccctccaccgatcgcatcaacgtgacaagcaatgccagacggagcttgaatttcggcggttccaccggcactgtccccgccccacggttagctccaaccggagtcagttgggctgataaggtgaaagctcaccatacaggatcgactgccagctcggagattacaccagcgcaatcttgcccccctatgaccgtccaaaaagcttccagaaaaaatgaaaggaaagacgctgaggggtgggagacagttcagcgaggcaggcccatccgaagccggagtaccgccgtcatgcctaaggtgagccttgctacagaggccacgaggtctaaagacgactctgataaggaaaacgtgtgtttactgccggatgaaagtatacaaaaggggcagtttgtgggggacggaacatcaaataccatcgagtcccatcccaaagactccctccattcttgcgaccaccccctggccgaaaaaacccaattcactgtgtccaccctcgatgacgtcaagaattcggggagcatccgcgacaactacgttcggaccagcgaaatcagcgcagtccatatcgacacggagtgcgtcagtgtgatgctccaggccggtaccccaccgttgcaagtgaatgaagaaaaattccctgccgaaaaggccagaattgagaatgagatggatccgagtgatatctcgaattctatggccgaagtcttagcaaaaaaagaagaacttgctgacaggctggaaaaagccaacgaggaagctatcgccagtgcaatcgcagaagaagagcagctcacccgcgaaatcgaggccgaagaaaacaacgacatcaatatcgagacggacaatgattctgatttttctgcttcaatgggatcaggatcagtctctttttgtgggatgagcatggactggaatgacgtgctggccgactacgaggccagagaatcgtggcggcagaacacaagctggggcgacattgtggaggaagaacccgcgcgaccacccggccatggaatccatatgcacgaaaagctgtccagtccttcgcgtaaaaggacgatcgccgagtctaaaaagaagcatgaggaaaaacagatgaaggctcagcaacttcgtgaaaaactccgagaggagaagaccctgaaacttcagaagctcctggagcgagagaaggatgtgcgcaagtggaaagaagagttgctcgaccaaagacgtcggatgatggaagagaagctgctgcacgcggagtttaagagggaagtccagttgcaggccattgttaaaaaggcccaagaggaagaggcaaaagtaaatgaaatagcctttatcaacactcttgaagcccagaataaacggcacgacgtgctgtccaagctgaaagagtacgagcaaagattgaacgagctgcaggaggagcggcagcggcgccaggaagagaaacaagctcgggatgaagccgtgcaggaaaggaagcgtgctttagaagcagagcgacaagctcgggtcgaggaactccttatgaagaggaaagaacaagaggccagaatcgaacagcaaagacaggagaaggaaaaggccagagaggatgctgcacgggagagagctagagatcgggaagagaggctggccgctctgactgccgctcagcaagaggcgatggaggagctacaaaaaaagattcagctgaagcatgatgagagcattcggcggcacatggagcagattgagcagaggaaagaaaaagcagccgagctgtccagcgggcggcacgccaataccgattacgctccaaaactgactccctacgaaaggaagaagcagtgcagtctttgcaacgtgcttatctcttctgaggtgtatctattctctcatgttaaaggcagaaaacaccagcaagcggtacgggaaaacacatccatccagggccgggaactttcggacgaagaggttgaacacctgtcacttaagaagtatatcattgacattgtggtggagtccactgcccctgcggaagctctgaaggacggagaggagcgacagaaaaacaaaaaaaaggctaagaagatcaaagcccgaatgaatttcagggccaaggaatacgaaagcctgatggagacaaaaaattcaggaagcgattcgccatacaaagcaaaactgcagcgcctcgccaaagatctgctgaagcaagtccaggtccaggattctggatcatgggctaacaacaaggtgagcgccctggatagaacactgggagagattaccaggatacttgaaaaggagaacgtggcggatcagatcgcctttcaagctgctggtggcctgaccgccctagagcatatattacaagctgtagtgcctgcaacaaatgtaaataccgtattgcgcattccacccaaatccttatgtaatgcaattaatgtgtataacctgacctgcaataactgtagtgagaattgttccgacgtgttgttttccaataaaataacattcctgatggatctgttgattcatcaacttaccgtttacgtgccagacgaaaacaacacaatcttaggacggaacaccaataagcaggtctttgagggcctcactaccgggcttttgaaggtgtctgcagtagtgctcggctgcctgatcgcgaaccggcctgacggcaactgtcaaccagcaacgcccaagattcccacgcaggaaatgaagaacaagccatcccagggcgaccccttcaataaccgagtccaggacctcatctcatacgtggtgaatatgggattgatcgacaaactttgcgcatgcttcctgagcgtccagggccctgtggatgagaatccaaaaatggcaatcttcctccagcatgccgcgggattgcttcatgccatgtgcactttgtgtttcgctgtaacaggacggtcttatagtatattcgataacaaccgtcaggatcccacaggattgactgctgcattgcaggccacggacttagccggcgtactacacatgctgtactgcgtccttttccatgggaccattctagatcctagtaccgccagtcccaaagaaaactacacccaaaatacgatacaggtggctatccagagcctcagattttttaactcgtttgccgcattgcacctgccggcctttcagtcaattgtcggcgccgaggggctctcactcgcattccgacacatggcctcctctttactgggccattgctctcaggtctcctgcgagtccctgctgcacgaagtaatcgtctgcgtgggatattttactgtcaaccaccctgacaaccaagtcatcgtgcagtctggacggcaccccaccgtgttgcagaagttgtgtcaactgccattccagtatttctcagatccccgacttattaaggttttatttcctagcctcatagccgcatgctacaacaatcatcaaaacaagatcatcctggaacaggagatgagctgtgtgctactggcgacctttattcaagatctggctcagaccccagggcaggccgagaaccagccttaccaaccaaagggcaagtgcctcggctcccaggattatctggaactggcaaatagattccctcagcaagcctgggaggaagctagacagttcttcctcaaaaaagaaaaaaaatag

SEQ ID NO: 136064 - DNA, 1233 bp, Artificial Sequence
  Description of Artificial Sequence: Synthetic coding sequence
atgcatagaaagcacctccaggagattccagatctgtcctcgaacgttgccacgtcatttacttggggttgggactcgtcaaaaacttccgagctcctgagcggaatgggcgtgtctgcactggaaaaggaggaacccgacagcgaaaacattccccaggagctgctgagcaacctgggacatcccgaatccccaccaagaaaacgcctcaagagcaaaggctcagacaaggatttcgtgattgtccggcggcctaagctgaaccgggaaaactttcccggtgtttcgtgggattcactgcctgacgagttactgcttggcatattttcctgtttatgcctccctgagctgttgaaggtaagtggagtgtgcaaacgctggtatcggctggcatctgacgaatcactctggcagaccctcgacctgacaggcaaaaaccttcatcctgatgtgactggtcggctcctatctcagggggtgatcgcattccggtgcccacgtagttttatggaccagcccctggcggagcacttctcgccattcagggtacagcatatggatctctcaaactctgtgattgaggtttccactctccacggtatcttatcccagtgttcaaagctgcagaatctctctctggaagggttgcgtctgagcgaccccatcgtgaacaccctggcgaagaattcaaatctggtccgcctgaacctcagtgggtgttccgggtttagcgagtttgccctccagactctcctgtccagctgttccagactcgatgagctgaatctgagctggtgcttcgacttcaccgagaagcatgtgcaggtagccgtggctcacgtcagcgaaaccataacccagctgaatctcagtggctatcgcaagaatctgcaaaaatccgatctctccacactagtgagacgctgtcccaaccttgtacacctggatctgagtgacagcgtgatgttgaagaacgattgtttccaggaatttttccaactgaattatctgcagcatctgtctctttcgcgctgctacgatattatacctgagactctgctgctagtaactcgggcgggagtacgcatccgccttgactctgatatcgggtgtccacagacatatagaacttctaaactcaaatcaagtcataagttattttgccaacatgttcgggttatttgcatttttgtatgcgacttttacttctaccggttggtgttaaagcagtag

SEQ ID NO: 136065 - DNA, 1275 bp, Artificial Sequence
  Description of Artificial Sequence: Synthetic coding sequence
atgcaccggaagcacctgcaagagatccctgacctatcaagcaacgtggccacgtcattcacatgggggtgggatagttcaaagacaagtgagctgcttagcggcatgggggtctctgctttggagaaggaggaaccagattctgagaacattccccaagaattgttgtccaacctgggccaccctgaatcccctccaaggaaacgattgaagagcaagggctctgacaaggacttcgtgatcgttcgtaggcccaagctgaaccgggagaactttcccggcgtaagctgggactctctcccggatgagttgctcctaggcatcttttcctgcttatgtctccctgaactgttgaaagtgagcggggtgtgcaagcggtggtaccggctcgcctcagacgagagcctctggcagacgctcgatctgactggcaaaaacctgcatcctgacgtgacagggagactgttaagccaaggcgtcatcgctttccgttgtccaagatccttcatggaccagcccttggctgaacattttagcccatttcgcgttcagcatatggatctgtccaacagtgttattgaggtaagcaccctccacggaattctgtcccagtgttccaagttgcaaaatctgtccttagaaggcctgaggctgagtgatccaatcgtcaataccctggccaagaactcgaatctggtaagactcaacctgtctgggtgctccgggttctcagagtttgccctgcagaccttactgtcaagctgttccagacttgacgaacttaatctcagttggtgcttcgattttacagagaagcacgtccaagtggcggtagcccacgtctctgaaactattacccagcttaatctgtccggctacagaaagaatttgcagaaaagcgacctttctacccttgtcagacgctgtcccaatctggtgcatttggacctgtcagactcagtgatgctgaagaatgattgctttcaggaattcttccagctaaattacctccagcatctgagcctgagccggtgttatgacattatccccgagacactgctcgagctgggggaaattccgacgctgaaaactctgcaggtcttcggaattgtaccagacggcactctccagctcctgaaggaagctttgccccatctacaaatcaattgcagccacttcactacaattgcccggccgaccatcgggaacaagaaaaaccaggagatttgggggataaagtgcagattaaccctccagaagcccagctgtctgtag

SEQ ID NO: 136066 - DNA, 1173 bp, Artificial Sequence
  Description of Artificial Sequence: Synthetic coding sequence
atgcatcggaagcacctgcaggagaaggaagaaccggatagcgaaaatattccccaggaactgttgagcaatttgggtcacccagagtcgcctccgcgaaagcggcttaaatcaaagggtagtgacaaggacttcgtcatcgttagaaggccgaagctaaacagagaaaattttccaggagtgtcttgggacagtttgcccgacgaattgctgttggggattttctcctgtctgtgcctcccagaactgctgaaagtctccggcgtgtgcaagagatggtacaggctagcctcggatgagtctttatggcagactcttgatctcactgggaaaaatctgcaccccgacgtgacgggacgacttctgagccagggcgtcatcgctttccgatgcccgcggtcttttatggatcagccactcgcggagcactttagccccttcagagtacagcatatggacctgagcaactccgtgatagaggtgtccaccctccatggcattctcagccagtgctcaaagctgcagaatctttctcttgaaggcctgcgcctgtcggaccccatcgttaatactctcgccaaaaatagcaatttggtaaggttgaatctctccgggtgcagtggcttttctgaattcgccctccagactctgctctcttcatgctcaagactcgatgagctgaatctaagctggtgtttcgattttaccgaaaagcatgtccaggtggccgtggcacacgtgagcgagaccattacacagctcaatctttccggctaccgaaaaaacttgcagaaatcagatctcagtacactggtgagacgctgtccaaatctggttcacctggatctgagtgacagcgttatgctgaaaaatgattgcttccaggagttttttcaactgaattatctgcagcatttatcgcttagcaggtgttatgacataatccccgaaacgcttttggaactcggcgagataccaaccctgaagaccctccaggtgttcggaatcgtacccgatggaacgctccagcttctcaaagaagctttgcctcacctgcaaattaactgttcacactttacgacaatagcccgaccaacaattggcaacaagaaaaaccaagagatttggggtatcaaatgtcggctgacactgcaaaaaccctcctgtctgtag

SEQ ID NO: 136067 - DNA, 633 bp, Artificial Sequence
  Description of Artificial Sequence: Synthetic coding sequence
atggaccagcccctcgcggaacatttctctaccctggccaaaaactccaatttggtgcgccttaacctgagtggctgctccggattctctgagttcgccctgcagacacttcttagttcatgcagccgactggacgaattaaacttgtcttggtgttttgacttcaccgaaaagcacgtgcaggtagccgtcgcgcatgtgtccgagactatcacacagttgaatctctctggataccgcaaaaatttacaaaaaagtgatttgtccaccctggtgcggagatgtcctaacctcgttcacctcgacttgtctgacagcgtcatgttgaaaaacgactgctttcaggagttcttccagctcaattaccttcagcacctgtccctgagcagatgctacgatatcatccctgaaacactgctggaacttggcgaaatcccaaccctgaaaaccctgcaggttttcgggattgttccagacggaaccctgcaacttctaaaggaagctttaccgcacctgcagatcaactgctctcacttcaccaccatagccagaccgaccattggtaacaaaaagaaccaggagatctggggaattaagtgccggctgactttacagaaaccctcctgtctttag

SEQ ID NO: 136068 - DNA, 1362 bp, Artificial Sequence
  Description of Artificial Sequence: Synthetic coding sequence
atggccctcgtccgcgcccttgtgtgttgcttactgaccgcctggcattgcaggagtggactggggctgcctgtcgcccctgctggtggtcgcaatccccccccagctatcggacagttttggcatgtcacagatcttcacctcgacccaacttatcatatcacagatgatcacactaaagtgtgtgctagcagtaaaggtgctaatgcaagtaatcctgggccctttggagacgtgttgtgtgactctccataccagcttattctctcggctttcgattttataaagaactctggccaggaggcatcattcatgatatggactggcgactctcctccccatgtgccagtgccagaactgagtaccgacaccgtcatcaatgtgatcaccaatatgaccacaacgatccaaagcctgtttcccaacctgcaggttttccctgcccttgggaatcacgactattggccacaggatcagctgcctgtagtgacttcgaaagtctacaacgcggttgccaacctttggaagccctggcttgatgaagaggcaatctcgacattgcgaaaaggcggcttttatagtcagaaggtgaccaccaaccctaacctgagaattatcagccttaatacaaatctttactatgggcccaacatcatgacattgaataagacagacccggcaaaccagttcgagtggctcgagtctacactcaacaattcccagcagaacaaggagaaagtctacattattgctcacgtgccagtcggatacttaccatcctcacagaatataacagccatgagagagtattataatgaaaagctaatcgacatattccaaaagtattccgacgtaatcgccgggcagttttatggccacactcacagagacagcatcatggtattgagtgacaagaagggatccccggttaattccttattcgtcgctcccgccgtgacacctgtgaaatctgttctcgagaaacagactaacaaccccggtatccgcttattccagtacgatcccagggattataagctgctcgacatgctacagtactatttgaacttgacggaggccaatcttaagggggaatctatttggaaattagagtacatactgacgcagacatacgatatcgaagatcttcagccagagagcctctatggactggccaagcaattcacaatactcgactctaaacagtttatcaagtactacaattactttttcgtgtcttacgacagttccgtcacatgtgacaaaacgtgcaaagcgtttcaaatatgcgcaattatgaatctagacaatattagctatgctgattgcttgaaacagctctatattaaacataactactag

SEQ ID NO: 136069 - DNA, 969 bp, Artificial Sequence
  Description of Artificial Sequence: Synthetic coding sequence
atgacaacaacgatccagtctttgttccccaatctgcaagtgtttcccgccctggggaaccacgattactggccacaggaccagctgcctgtggtcacctccaaggtgtacaatgctgtggcaaatctgtggaaaccttggctggacgaggaagcgatatccactctgaggaaagggggtttttacagccagaaggttacaaccaatccaaatttacggattatctcacttaacactaacttatattacggacccaatattatgactttgaacaaaaccgatccagccaaccagtttgagtggctcgagtcaacactaaataacagccagcagaacaaggagaaggtttacatcatcgcacacgttcccgtaggctatctcccttcatcacagaatattaccgcaatgagggagtattacaatgagaaactcatcgatatctttcagaagtattcagatgtgatagccgggcagttctacggacatacacaccgggactcaattatggtcctcagtgacaaaaaaggaagcccagtgaactctttattcgtcgctccagcagtcactcccgtgaagtcagttcttgaaaagcagactaataaccccggcatccggctgtttcagtacgacccacgagactataaactcctcgatatgctccagtactacctgaatctgacagaggcaaacctgaaaggagagtcaatatggaaattggaatatatcctgactcagacttatgatatcgaagaccttcagccagagtcactatatggcctggctaaacagttcacgattttagactctaaacagtttattaaatattataactatttcttcgtgagctatgacagctctgtgacctgtgacaaaacatgcaaggcgttccagatctgcgccatcatgaacttggacaatattagttatgcggactgcctgaaacagctctacattaagcacaactattag

SEQ ID NO: 136070 - DNA, 726 bp, Artificial Sequence
  Description of Artificial Sequence: Synthetic coding sequence
atgaaggaggtcgtctactggtcccctaaaaaagtggctgactggttgcttgaaaacgccatgccagaatactgtgaacctctcgagcatttcacgggccaggacctaataaacctgacgcaggaagactttaagaaacctcccctgtgccgcgtgtcgagcgacaacggccagaggttgctggacatgattgagacactaaaaatggagcaccaccttgaagcccataagaatggccatgccaacggccatctcaacataggagtggacatcccgactcccgatgggagcttcagtatcaagattaaacctaatggcatgccaaatggctatcggaaagagatgattaaaatccccatgcccgagctggaaaggagtcagtacccaatggagtgggggaaaacctttcttgcctttctgtatgccctcagctgtttcgtcctgacaactgtgatgatttctgtcgtccacgagcgggttcccccgaaagaggtgcaacctcccctcccggacacattcttcgatcacttcaatcgagtgcaatgggcctttagcatatgtgagatcaatgggatgatccttgtgggactatggcttatacaatggttgctgctgaaatataaagacgtggggaatgagagccgagttgttatgatctttctctccatcgtccatccggttttgctgttgggctccattgccggctttctctctctgagtttgtag

SEQ ID NO: 136071 - DNA, 1242 bp, Artificial Sequence
  Description of Artificial Sequence: Synthetic coding sequence
atgaaggaggtggtgtactggtctcctaagaaagtggccgactggcttctggagaatgccatgcctgaatactgcgagcccctggaacatttcaccggtcaggacctaatcaacctgacccaggaagatttcaaaaaaccaccactctgtagagttagtagcgacaacggccaacgactcctggacatgattgagaccctaaagatggagcaccatctcgaggcgcacaagaacggccacgccaatggccatctcaatatcggagtggatatcccaacacctgacggaagtttctccataaaaatcaagcccaacggtatgcccaatgggtaccgcaaggagatgatcaaaattccaatgcccgaactcgagcgctcgcagtaccctatggagtgggggaaaacctttctcgcctttctctatgctctgtcttgtttcgtgctaaccaccgtaatgattagcgtcgttcatgaacgggtaccacccaaagaagtgcagcctcctctgcctgacaccttcttcgaccattttaacagggttcaatgggctttctcaatttgtgagatcaatggcatgatcctggtcggattatggctcatacagtggttgctgttaaaatataagtcgatcatttccaggcggttcttctgtatcgtcggtacactgtacctctaccgatgtataactatgtatgtgacaacattgcccgtacccggcatgcacttcaactgttcccctaagctattcggcgattgggaagcacaactgcggcggattatgaagctcatcgccggtggcggcctctcaatcactggctcacacaatatgtgcggggattacctgtactcaggtcatactgtcatgctgaccctgacctacctcttcataaaggagtactctcctagacggctctggtggtaccactggatctgttggttactgtcagtggtgggaatcttttgcatcctcctggcccatgatcactatactgtggacgtggtggttgcctactatataacaacacgcctgttttggtggtatcacacaatggcaaaccaacaggtgttaaaagaggcctcccagatgaaccttctcgcacgagtgtggtggtaccgcccttttcagtacttcgagaaaaacgtgcaggggatcgtacctagatcataccattggccattcccatggccagttgtccatctctctcgacaggtgaaatactcgcgcctcgtaaacgacacatag

SEQ ID NO: 136072 - DNA, 642 bp, Artificial Sequence
  Description of Artificial Sequence: Synthetic coding sequence
acttatatgtatatctcaaataagagtatcattagtcgaaggtttttctgcattgttggaacattgtatctgtaccgctgcataacgatgtatgttactacgcttcccgtgccaggaatgcactttaattgctctcccaaattgttcggagactgggaggcacagctccgcagaatcatgaagctgatcgctggcgggggcttgagtatcaccggtagccacaatatgtgtggagattacctctattccgggcacactgtcatgctgacacttacctatttgttcattaaagaatattctcctaggaggctttggtggtaccactggatctgctggcttttgtccgtggtcggaattttctgcatcctgctcgctcacgaccattatacagtcgatgtcgtggttgcctactacatcaccacgcgactgttctggtggtaccatactatggcaaaccaacaagtgttgaaggaggcaagccagatgaacttgctcgctcgagtctggtggtataggcctttccagtactttgaaaaaaatgtgcagggaatcgtgccccgtagctaccactggccatttccctggccagtggtgcacctgagtaggcaggtgaaatattcacgcctggttaatgatacctag

SEQ ID NO: 136073 - DNA, 735 bp, Artificial Sequence
  Description of Artificial Sequence: Synthetic coding sequence
atgggcggtagagggggggggggccgctcccgccagttgcctgggcgctttagagctcctgcagcccggtggccaggaggccggtggctaccaggagctccacgtactgttacttggtcaataatttccagacggttcttttgcatagtcggtacactgtacctctatcgttgcatcactatgtatgtaacgacactccctgtccctggaatgcactttaactgctccccaaaattatttggcgactgggaagcacagctgcggagaattatgaagctcatagcaggcggaggtttgtcaatcacagggtcacacaacatgtgcggcgattacctgtattccggtcacaccgtaatgttgacccttacttacctctttattaaagagtattctccccgacgactgtggtggtatcattggatatgctggctcctgagtgtcgttgggattttctgcattttgctggcccatgaccactatactgtggatgtggtggttgcatactatataacaacccgtctgttctggtggtaccatacgatggcgaatcagcaggtgctgaaggaagcgtcacagatgaatttgctggcccgcgtgtggtggtatcggccctttcagtattttgagaaaaatgtccaggggatagttcctaggagttatcattggccgtttccctggcccgttgtgcacctttcgagacaggtgaaatattcgaggctagtaaacgacacctag

SEQ ID NO: 136074 - DNA, 1098 bp, Artificial Sequence
  Description of Artificial Sequence: Synthetic coding sequence
atggatatcatagaaaccgcaaagctcgaggaacatctcgagaaccaaccgtccgacccgacaaatacatatgcgagacccgccgaacccgtggaggaagagaacaagaacggaaatggaaaacctaaatccctgtcttctggcttaaggaagggaaccaagaaatatcctgactacatacagatcgccatgccaactgagagtaggaataaatttcctctggagtggtggaaaactggtatagcatttatatatgcagtgtttaatctcgtgctgacaactgtgatgattaccgtggtgcatgaaagggtaccacccaaagagctgtctccacctctgcctgacaagttcttcgattatattgatcgcgtcaagtgggcctttagcgtgtccgaaatcaacgggatcattctggtgggactgtggatcacacaatggttatttcttagatacaagtccatcgtaggaagaaggttctgctttattatagggacactctacctataccggtgcattacaatgtacgtgaccaccctgcccgtccctggtatgcacttccagtgcgcccctaagctgaatggagattcgcaagccaaggttcaaagaatattacgactgatttcaggcggtggcttgtccattaccggctcacacattctctgtggcgacttcctcttctctgggcacaccgtgacgctcaccctgacatatctcttcattaaggaatattctccaagacatttctggtggtaccacctgatttgctggctgctgagtgctgctggaattatctgcattttggttgcccacgagcattacaccatcgacgtgatcatagcttattacatcactacacgtctgttttggtggtaccatagtatggccaacgagaagaaccttaaggtgagctctcagaccaacttccttagcagagcctggtggttccctattttctatttttttgagaaaaacgtccagggctcgatcccttgctgttttagctggcccctgagttggcccccagggtgcttcaagagctcatgcaagaaatatagcagagtccagaagatcggcgaggacaatgagaaatccacatag

SEQ ID NO: 136075 - DNA, 1098 bp, Artificial Sequence
  Description of Artificial Sequence: Synthetic coding sequence
atggacattatcgagaccgcaaagctcgaagaacatttggagaatcaacctagtgatcccaccaacacttacgccagaccggccgagccagtggaagaggagaacaaaaacggaaatgggaagcctaagtccctaagtagcgggctccgcaaggggactaaaaaatatcctgactatatacagatcgccatgcctacagaatcaaggaacaaatttcccctcgagtggtggaagacggggattgcattcatttacgctgtgtttaatttagtgctgaccacggtcatgatcaccgtggtgcatgagagggttccccctaaagaactgtctccacccttgcctgacaagttcttcgactacattgatcgagttaaatgggccttctctgtgtccgagattaacggtattattctcgttggactctggatcacccagtggctcttcctgagatacaaaagcatcgtcggtaggagattctgttttatcatcggtacactgtatttgtaccggtgtatcacaatgtatgtcactaccctgccagttcctggtatgcatttccagtgtgcccccaagctgaacggggactcacaggccaaagttcagcggattttgagactgatctcaggaggcgggctaagtatcactggatcgcatatcctatgtggcgacttcctgttctctggccacacggttaccctcactctgacatatcttttcattaaagaatacagcccacgccatttctggtggtaccacctgatctgttggttactatctgctgcggggataatctgcatcttggtggcccacgaacattataccattgacgtaataattgcttactacattaccacaaggttgttctggtggtaccacagcatggccaacgagaagaacttgaaggtaagttctcagacaaactttctgtcccgggcctggtggtttcccattttctactttttcgagaaaaatgtgcagggatccattccctgttgcttcagctggccccttagctggcctcctggatgctttaagtctagttgcaagaagtactcacgtgtgcaaaagatcggggaagataatgagaaaagtacatag

SEQ ID NO: 136076 - DNA, 1098 bp, Artificial Sequence
  Description of Artificial Sequence: Synthetic coding sequence
atggacatcatagaaacggccaagctggaggagcaccttgagaaccagccaagtgaccccaccaatacctacgcccggcctgcagagccggtggaggaagaaaataagaacggtaacggaaaacctaaatccctttcttcaggactcaggaagggcaccaaaaagtaccctgattatatccaaattgccatgcctaccgaaagccgcaacaagtttccacttgaatggtggaaaactgggatcgcctttatttatgcagtgtttaacctagtcctgactactgtgatgatcaccgtcgtacacgagagggtcccgcctaaagaacttagtccgccgcttccagataaattctttgactacatagatcgggtgaaatgggcattctccgtgtctgaaattaacgggattatcctggtcggcctgtggatcacccaatggctgttcttgcgctataagagcatagtagggcgaaggttctgttttatcattggaactctctacctataccgatgtatcaccatgtatgtaactacactacctgtgccagggatgcattttcagtgtgctcctaagctcaatggtgacagccaggctaaggtgcagcggatcctgcggcttatttctggaggcggtctgtcaattaccgggagccacatcctctgcggcgatttcctgtttagcgggcataccgttactttaacactgacctatctgttcattaaagaatacagcccgagacacttctggtggtatcacctgatttgttggctgctctctgccgccggcattatctgcattttagtagcccatgaacactacacgatcgatgtgatcatcgcttattacatcaccactaggctgttctggtggtaccactccatggctaacgagaagaatttgaaggtctcatctcagaccaattttttatcaagagcctggtggttcccaattttctattttttcgaaaaaaatgtccaaggaagtattccttgttgcttctcgtggccgctatcctggcccccaggttgttttaaaagtagttgcaaaaagtacagtcgagtgcaaaaaattggcgaagataacgagaaaagcacctag

SEQ ID NO: 136077 - DNA, 135 bp, Artificial Sequence
  Description of Artificial Sequence: Synthetic coding sequence
atggacattattgagactgccaaactggaggaacacctggaaaaccagccgtcagacccaacaaacacatacgctaggcccgcagaaccagtcgaagaagagaacaagaatggcaacggcaagccaaagagctag

SEQ ID NO: 136078 - DNA, 105 bp, Artificial Sequence
  Description of Artificial Sequence: Synthetic coding sequence
atggatatcattgaaacagcaaagctagaggagcatctcgagaaccagcccagcgaccctaccaacacatacgcgagacctgctgagccggtggaggaggaatag

SEQ ID NO: 136079 - DNA, 1326 bp, Artificial Sequence
  Description of Artificial Sequence: Synthetic coding sequence
atgtctcttcgtcagcggctagcacagctggtgggcaggctgcaggatccccagaaggtagcccgttttcaacggctgtgcggtgtcgaggctccccctaggcgatccgctgataggcgcgaagacgaaaaagcggaagcccctcttgccggtgacccaagactgcggggaagacaacctggtgctcctggcggtccccaaccacctgggagcgaccgcaaccagtgccccgcaaaacccgatgggggcggcgctccgaacggcgtcaggaatgggctcgctgcagagcttggtccagcctcacccagacgagcaggagctctcagaagaaactcacttacgggcgaagaaggccagttggcgagagtttcaaattggcccctgtattgtcttttttgtttcggaacagagctaggcaacgagctgttttatattttgttcttccctttttggatttggaatctggatccgctcgtgggcaggagactggtggtaatttgggttttagtgatgtatctgggacaatgcaccaaggatatcatacggtggcctaggccagcttctcctcctgtggtaaagctggaagttttttataacagtgaatactcgatgccctcaacacatgcaatgagcggtactgccatcccaatatccatggtattgcttacctacggacggtggcaatacccgcttatttacggcctcatcttaatcccatgctggtgttccctcgtctgtctgtctaggatttacatggggatgcattcaattcttgacatcattgcagggtttctgtacacgatccttattctggcggtgttctaccctttcgttgatctcatagacaacttcaaccagactcacaaatatgccccgttcatcatcattggactccacctagccctggggatcttttctttcactctggatacctggtctacctctaggggcgatacagccgagatcctcggctcgggagctggtattgcatgcggcagtcatgtcacatataatatgggcttggtgctggacccatccctagacactctgccgcttgcgggccctcctataaccgtcactctgttcggaaaagcgattcttcggatcctgattggcatggtttttgtgctgatcatacgcgatgtgatgaagaagattaccatccctctcgcatgcaaaatatttaacattccttgtgatgatattagaaaagctcgacagcatatggaagtcgaactcccataccgctatattacctacggaatggtgggattttcaatcaccttcttcgtgccatacatattctttttcattggcatctcctag

SEQ ID NO: 136080 - DNA, 1200 bp, Artificial Sequence
  Description of Artificial Sequence: Synthetic coding sequence
atggccgagctgctacgcagccttcaggacagccaacttgtggcccggtttcagcggaggtgcggactctttccagcacccgacgaaggtccaagagagaatggggctgacccaactgaacgtgccgccagggtgcccggcgttgagcaccttccagcagccaacgggaagggcggcgaggcgccagctaacggcctgagacgggcagctgctcccgaggcctatgtccagaagtacgtagtgaagaattatttctactattatttatttcagttctctgcagccctggggcaagaggtattttacatcacgttcctgcccttcacccattggaacatcgacccctatctgtcgcggaggctgatcatcatatgggttctcgtgatgtatatcggtcaggtggcgaaagacgtgctcaagtggccaagaccctccagccccccagtggtgaaattagagaagagactgatcgccgaatacgggatgccgagtactcacgccatggcagctaccgccattgcgtttaccctactcatctccacaatggataggtaccaatacccttttgtgctcggactggtcatggcagtggtattttctacactggtgtgtttgagcagactgtacaccggcatgcacaccgtactggatgtgctcgggggggtgctgatcactgccttgttgattgtcctgacctatccagcctggacctttattgattgtctcgacagcgcctcacctctcttccccgtgtgtgtcattgtggttccgttcttcctctgctacaactatcccgtctcagattattactccccaacaagagcagataccactactatcctggcagccggtgcaggcgtcaccattggcttctggatcaaccacttctttcagcttgtgtccaagcctgctgagtctctccctgttatacagaatattcctcccttaaccacctatatgttagttcttggcctgaccaagtttgctgtggggatcgtgctgatcctgctcgtcaggcaactggtgcagaacctgtcgctgcaagtactctacagctggtttaaggtggtaacccgaaacaaagaagcacgtcggagactagagattgaggtcccatacaaattcgttacgtatacatcggtgggcatttgtgctacaacctttgtcccaatgcttcatcgctttctgggcctaccctag

SEQ ID NO: 136081 - DNA, 1062 bp, Artificial Sequence
  Description of Artificial Sequence: Synthetic coding sequence
atgggcagcctctattccgaatacttgaaccccaataaagtgcaggaacattataactacactaaagagactctggaaacccaagagactacatccagacaggtggcttcagcgtttatcgtgatcctgtgttgcgccatcgtggttgaaaatctgcttgtgctgatagctgtggcaagaaactcaaagttccattctgcgatgtatctctttctaggtaatctggcagctagtgatctcttggcaggcgtggcctttgtggccaacactctgctctcaggaagcgtcactctacgtctaacgccagttcagtggtttgcgcgggaaggtagcgcctttatcacccttagtgcctccgtgtttagccttctggctattgcaatcgagagacacgtggccatcgcaaaggttaaactatatggatcagataagagttgcagaatgctgctgctgatcggcgcatcgtggttaatatccctagtgctgggggggctccccatcttgggttggaactgcctgggccacttagaggcatgcagtaccgtgctccctctgtacgcaaaacactacgtcctgtgtgttgtcactatattcagtatcatattactggctatcgtggccctatacgtgaggatctactgcgtcgtgaggtcctcacatgccgatatggccgctcctcagactcttgccctgctcaaaacagtgacgatcgtactgggagtgtttatcgtatgctggttacctgcgttttccatcctgctgctagattacgcctgtcccgtgcatagttgtccgatactctataaagcccattactttttcgccgtctcaacactgaactccctcctgaatcctgtgatctacacctggcgcagcagagacctgagaagagaagttctgagaccgctgcagtgctggagaccaggtgtgggcgtgcaagggcggcgccggggaggaacaccaggccatcatctgctgcccctccgatccagctcatctctcgaacgcggaatgcacatgccaacttctccaacctttctggaaggtaatactgtcgtatag

SEQ ID NO: 136082 - DNA, 1137 bp, Artificial Sequence
  Description of Artificial Sequence: Synthetic coding sequence
atggcaactgccctgcctcctcgtcttcagccggtcagggggaacgagacactgagggagcattaccaatatgtgggcaaactggcaggtcgtttaaaggaagcatcagaggggagcactctcactaccgtgctgtttttagtgatctgctctttcatagtgttggagaatctcatggtactgatcgccatctggaaaaataacaagttccacaacaggatgtacttttttatcgggaacctggccctatgcgacttgctggctggtatagcatacaaggttaacatcctgatgtccgggaagaaaactttctccctgagcccaactgtgtggttcttgagggagggcagtatgtttgtcgcgctgggcgcttcaacttgtagtctcctggccattgcgatcgaaagacacctcactatgataaagatgcggccttatgacgccaataaacgccatcgcgtgtttctgctgattgggatgtgttggctcattgccttcacattaggcgctcttcctatcctgggctggaattgtcttcataacttgcccgattgctctactattttacctctgtatagcaagaaatacattgccttttgcatttcaatatttactgcgatactggtcactattgtgatcctatatgctaggatatacttcttagttaagagctcgagcagaaaagtggccaaccataataactccgagcgctcgatggctttgttaagaacggtggtgatagtggtttctgtgtttattgcgtgctggtcccccctctttatcctgtttctcattgacgtggcctgccgtgtgcaggcttgcccaatactcttcaaggctcagtggtttatcgtcttagcagtccttaactctgctatgaacccagtgatctatacattagccagcaaagaaatgagaagagcattctttaggctggtttgtaactgtttggtcaggggcaggggggcccgagccagccccatccaacccgcactggatccatcaagaagcaagagcagctcatctaataattccagtcattcccctaaagtgaaagaggacttacctcacactgctccttcttcctgcatcatggataaaaatgctgcactccaaaacggcattttttgcaattag

SEQ ID NO: 136083 - DNA, 1137 bp, Artificial Sequence
  Description of Artificial Sequence: Synthetic coding sequence
atggccacagcccttcctccccgactccagccagttcggggcaatgagacattgagagagcactaccagtatgtaggtaagctcgcaggaaggctaaaggaggcaagcgaaggtagcacactgacaactgtcctgtttctggtgatttgctcttttatagtgcttgagaacttgatggttttgattgctatttggaagaataataaatttcataaccgcatgtacttcttcataggcaatttggccctgtgcgatctgttggcaggaatcgcctacaaagttaacatcttaatgtcaggcaaaaagactttcagcctgtcaccgaccgtgtggtttctgcgtgaagggagtatgtttgtagcactcggagcatctacatgttccctcctggccattgctattgaacggcacctgactatgattaaaatgcgcccttacgatgctaacaagagacatagagtgtttctcctcataggcatgtgttggcttattgctttcactctgggcgctctgcctattcttggttggaactgcctgcataacctgcctgattgcagcaccatcctcccactgtatagtaagaagtacatcgccttttgcatttccatatttacggccatcttggtcacaattgtcattctctacgcgcgcatttacttccttgtgaaaagttcctcacgtaaggtggccaaccataataatagcgaaagatcaatggctctcctgaggaccgttgtgatcgtcgtctccgtcttcatcgcctgctggtctcctctgtttatcctgttcctgattgatgtcgcttgccgcgtgcaagcgtgccccattcttttcaaggctcagtggttcattgtgttggcggtgctgaattcagccatgaatcccgtgatctacacactggcaagcaaggaaatgagaagagcattctttaggttagtgtgtaattgcctcgttagagggaggggcgcacgcgcgtcccccattcagcccgcattagatccatcaagatcaaagagttcaagctccaataatagcagccactctcccaaagtaaaggaggaccttcctcacaccgcaccctccagttgtatcatggataaaaatgcggcactgcaaaatggaattttctgtaactag

SEQ ID NO: 136084 - DNA, 1155 bp, Artificial Sequence
  Description of Artificial Sequence: Synthetic coding sequence
atgaatgctacaggcaccccagtagcaccagaaagttgtcagcaactagccgccggcggtcattcaagattaattgtgctgcactataatcactccggccgactggccggccgcggaggtcctgaagatggcgggctgggcgcactgagggggctgagcgtggccgcctcatgcttagtggttctcgagaatctgctagttctggccgccatcacttctcacatgcggtcccgtagatgggtttattattgcctggtgaatattaccttgtcggatctgttgaccggggctgcatatcttgctaacgtcctcttaagcggcgcccgcactttccgcctcgcgcccgctcagtggttcctccgcgagggcctcctctttacagctctggccgccagcacattctcattgctattcacagctggggaaagatttgccaccatggtgaggccggttgccgaaagcggcgctaccaaaaccagtcgcgtctacggttttataggtctatgttggctgttggccgccctgcttggtatgttgccgctgctgggatggaactgcctgtgtgcctttgatcggtgtagctccctgctcccactgtacagcaaaagatacattttgttctgcctcgtgatatttgctggtgttttggccactattatgggactctatggcgcgattttccgccttgtgcaggctagtggtcaaaaggccccccggcctgcagcccgtcggaaagcgcgtcgccttctgaaaactgtgttgatgatcctccttgcgtttctcgtctgttggggacctctcttcgggctgcttctggcagacgtttttggctctaacctgtgggctcaggagtatctgcgcgggatggattggatcctagcgctggcggtactcaacagtgcagttaacccaattatctattctttccggagccgggaggtttgtagggcagtcttgtcttttttatgttgcgggtgtctgcgtctggggatgagaggccctggcgactgcctggcccgcgctgtcgaagcacactccggtgccagcaccaccgactcctcactgaggccacgcgactccttccggggttcccgatcattgagcttccgaatgcgagagccgctgagttctattagtagcgttagatcaatctag

SEQ ID NO: 136085 - DNA, 1197 bp, Artificial Sequence
  Description of Artificial Sequence: Synthetic coding sequence
atggaatccggccttcttcgacctgcgcctgtgagcgaagtcatagtgctgcactacaattatactgggaaattacggggcgcccgataccaacctggagccggtctcagggccgacgccgtcgtctgcctggcagtctgcgcattcattgtgctagagaaccttgcagttctcctggtgctgggtagacaccctcgttttcacgcccccatgttcttgttattgggcagcttaaccctatctgacctgcttgccggcgctgcttatgcggccaatatcttgctctccggcccactgactctaaagttatcccccgctctctggtttgctcgcgaagggggggtttttgtggctcttactgcctcggtgctttccctcttggcaattgccctcgaacgatctctgaccatggcccgacgcgggcccgcccccgtgtcctctcggggtcgaaccttggccatggccgctgctgcctggggggtgagcctgctactaggccttctgcccgctttaggatggaattgcctggggcgcctcgacgcgtgctctacagtgctccctctttatgctaaagcctatgtcttgttctgtgtgttggccttcgtgggtatcctggccgcaatctgtgcactgtacgcaagaatctactgccaggtgcgagccaacgcacggagactgcctgctagacccggcactgctggaacaacctccaccagagccaggcgtaagcctagatcccttgctctcctgcggacactgagtgtcgtccttctggcattcgttgcttgctgggggcccctttttcttctgttactcctggatgtggcctgtcctgcaaggacatgtccagtactgcttcaggcggaccctttccttggactcgcaatggccaacagtctcctcaacccaatcatttataccctgacaaacagagacctcaggcatgcgctcctccgactcgtgtgctgtggcaggcattcatgtgggcgggatcccagtggatctcagcagagcgccagcgcggccgaggcctcaggcggtctgagaaggtgtctgcctccaggacttgacgggagtttctccggcagcgaaagatcttccccacagcgcgatggcctggacacatctggctcaaccggcagtcccggcgctcccacggccgcccggactttagtctctgagccggctgcagactag

SEQ ID NO: 136086 - DNA, 933 bp, Artificial Sequence
  Description of Artificial Sequence: Synthetic coding sequence
atggaatcagggcttctgcggccagccccagtatcagaggtgatagttctgcattataactacaccgggaagcttcgtggagcaaggtaccaaccaggcgctggattacgcgccgatgcggtggtatgtctggccgtctgcgctttcattgtcctcgagaacctcgctgtgcttttagtgttggggcgacatccacggttccatgctcccatgtttttgctgctgggaagcctcacgctcagtgatctgctcgccggagccgcctacgctgctaacatcctcttgtccggacccctcaccttaaagctatctcccgccctctggttcgcgcgtgaagggggagtatttgtcgctctgacagctagcgtattaagcctgctcgctatagctctggaacgctccctgacaatggcaaggcgcggtcccgcaccggtatctagccgtgggagaacgctcgctatggccgcagcagcatggggtgtgtcgctcctgctcggacttctccccgctttggggtggaactgcttggggaggctagacgcttgttctaccgtactccccctttacgctaaggcgtacgttctcttctgcgtgctggcctttgtcggaatactggcagctatctgcgcactctacgccctggccggtctagccgcccatgctcaacgtggtgcccccgggctgtgtggtatgctgggacccccactgcccgccgcagtggctcggagaggggttccaggtgcacacctgagctgtaccccagccgggcggagcctccccggaaccggacacggtcaactcacaagcgaaccgcaccacctgcacgctcaccagcccaggcccgcaccccgtgctccggcacccgggttgctacggacacccttactcagacagcgcccagagtggctcccagccgtgggagaacggggttag

SEQ ID NO: 136087 - DNA, 1197 bp, Artificial Sequence
  Description of Artificial Sequence: Synthetic coding sequence
atggaaagcgggctcctaaggcctgcgccagtgagtgaagtcatcgtgctgcactacaactacacaggcaaattacgaggcgcaagataccagccaggtgcgggcctgagagcggatgccgtggtttgcctggctgtttgcgcttttattgtgcttgaaaatcttgcggtcttgcttgtattgggacgtcacccaagatttcatgccccgatgtttctcctcttgggttctttgacactgagcgacctgctcgctggggccgcctatgccgctaacatactgctgagcggtcccctgactcttaaattgtccccagccctctggttcgctcgcgagggaggcgtgtttgtggctctaaccgcttccgtgctgagcctgctggcaatcgctctcgaaagatccctcacaatggccaggcgcggccccgcccctgtctcctctcggggacggaccttagcgatggctgctgctgcatggggagtgagcctgcttctcggactcttgccagcccttggctggaactgcttggggcgcctggatgcttgttctacagtcctcccgctttatgccaaagcctatgtattattttgcgtacttgctttcgtcgggatcctggcagccatttgtgctctttacgccagaatatattgccaggtaagagccaatgcccggcggctaccggctcgcccaggcactgccgggacaacttctaccagagctaggcgtaagccccgctccctggccctactaagaacactcagcgtggtgttattggcgttcgtggcttgctggggacccctgttcctgctcctcctcctggacgtcgcctgccctgctagaacttgcccagtgctcttgcaagctgacccttttctaggattagcaatggctaacagcttgctgaaccccattatctacacccttacaaaccgcgaccttcgccacgctctgctgcgtctcgtctgttgtggccggcattcatgcggtcgtgacccgtctggctcccagcagtccgcaagtgctgccgaagcttccggtggacttcgcaggtgcctccccccgggactcgacgggagcttttcaggctcagaaagatctagcccacagcgcgatgggcttgacacctcaggaagcacaggttccccaggcgctccaactgcagcacgaactcttgtttcagagcccgccgcagattag

SEQ ID NO: 136088 - DNA, 5016 bp, Artificial Sequence
  Description of Artificial Sequence: Synthetic coding sequence
atggacggcaactctctgctgagcgtgccatcaaatctggagtcttccagaatgtacgatgtgctggagcctcagcaaggtcgcggctgtggctccagcggcagtggcccaggcaactcgattacggcctgcaagaaggtgttgcgcagcaactccttactcgagagtacagactactggcttcaaaaccagcggatgccctgccagatcggattcgtcgaggacaaaagcgaaaattgtgctagtgtctgcttcgtgaaccttgatgtgaataaggacgaatgcagcacagaacacctgcagcagaagctggtgaatgtgtcccccgatcttcccaagttgatcagctcaatgaacgtgcagcagcctaaggagaatgagatcgttgtgttaagtggcctggcgagcggaaatcttcaggctgatttcgaggtgagccagtgtccctggctgcccgacatatgtctggtgcagtgcgccagggggaatagacctaacagcacaaactgcatcattttcgagattaataaattcctgatcggcctcgagctggttcaggaacgacagctgcatttagagacaaatatactgaagctcgaagacgacacaaattgttctctgagttccatcgaggaggattttttaaccgcttctgagcatttagaagaagagagcgaggtagatgaatcccgcaacgattatgagaacatcaacgtgtccgccaatgtactcgaaagtaaacagctaaagggagctactcaagtggaatggaattgcaataaagagaagtggctttatgctcttgaagataagtacatcaataaatatcccacacctctaataaaaactgaaaggtctcctgagaacctgactaagaacaccgccctgcaatcactcgatccatccgcaaagccctctcaatggaagcgggaggcagtgggtaacggaaggcaggcaacccactattaccactccgaagccttcaaaggacagatggaaaagtcccaggccctctatattcccaaagatgcatacttttccatgatggataaggacgtcccttccgcgtgtgcagtggctgaacagaggagcaaccttaatcctggcgatcatgaggatacaagaaatgccttacctcctagacaggacggagaagtcaccaccgggaagtacgccactaacctggccgagagcgtgttgcaagatgcttttatccgactgtctcagtcccagtctacgctgccccaggaaagcgctgtttcagtgtcggtcggctcctcactgttgccaagctgttatagcaccaaagatactgttgtatcgcgttcttggaatgagctcccaaagatcgtcgtggtgcaaagcccagatggttcagatgctgccccccagcccggaatctcatcctggcccgaaatggaggtttcagtggagacgtccagcattctcagcggagagaactctagtagacaaccacaatccgccctagaggtggccctcgcatgcgctgcaaccgtgatcggaacgatcagtagccctcaggctacagaacgcctcaaaatggagcaggtggtctcaaactttcctcccggatcgtccggcgctctgcaaactcaggccccacagggattgaaggagccttctattaacgaatattccttcccatctgcactttgcgggatgacacaagtcgcttccgccgtggcggtatgcggcctcggcgagcgcgaagaagtcacgtgctctgtcgctccatcaggcagtctgcccccggccgccgaagcgagcgaggctatgccacctttgtgtggcctggctagcatggaattagggaaggaggccatcgccaagggcttgttgaaggaggctgcacttgttctgaccagaccaaatacgtattcttccataggggatttccttgactccatgaatcggcggattatggaaacggcctcaaagtcccaaaccctgtgctcagaaaacgtggttaggaatgagctggctcacactctgagcaatgttattctgcgacactcgatcgatgaagttcatcacaagaatatgatcatcgacccaaacgataatcgccacagttccgaaatcctcgacaccctgatggaatctactaaccagctgttgctggacgtcatctgttttacatttaaaaaaatgtctcacatcgttcgcctcggggagtgccccgctgtgctatctaaggaaacaatccgtagacgcgagaccgagcctagctgtcagcctagcgacccaggtgccagccaggcttggaccaaggccaccgagagctcttcctctagccctctgtctaatagtcacaataccagcctcgtgatcaacaatttagtggacggaatgtatagcaaacaagacaaggggggggtccgcccaggcctctttaagaaccctactctgcaatcccagttatccaggagtcatagggtgccggacagcagcacagccaccacctcaagcaaagaaatctatttgaaagggatcgccggagaggatacaaagagtcctcaccactccgagaacgagtgtcgcgctagttctgaaggacagcgcagccccaccgtctcacagtctaggagcggatcccaagaagccgaagagtccatccacccaaatactcaagaaaaatacaactgcgcaacctccaggatcaacgaggtccaggtgaacctgtctcttctaggcgacgatctgctattgccagcacagtccacgctgcaaaccaaacaccctgacatctattgcatcaccgatttcgcagaagagctcgcagatacagtggtgtccatggctacagagatcgcagctatttgtctggacaattcttctggcaagcaaccctggttctgtgcctggaagagaggctcagaatttcttatgacaccaaacgtcccatgtcggtcattgaagaggaagaaggagtcccagggatctgggactgccgttcggaaacacaaacctccccgactgagcgagattaagaggaaaactgacgaacaccccgaactgaaggaaaagctaatgaatcgagtagtcgacgaaagtatgaatctggaggacgtgccagactcagttaacctttttgctaatgaagtggcggccaagatcatgaaccttacagagttctcaatggttgatggcatgtggcaagcccaggggtatccgaggaatcgcctccttagcggggataggtggtcacgactgaaggcctcatcttgcgagagcatccctgaagaggattccgaggcacgtgcctacgtgaacagtctcgggttgatgtctacgctgtctcagccggtctcccgtgcatcctcagtgagtaagcagagctcctgcgaatctattacggacgagttctccaggttcatggtgaaccagatggagaacgaggggcgtgggttcgagctgcttctagactactacgccggtaagaacgcttcttcgatcctcaattccgcgatgcagcaggcttgtagaaaatctgaccacctcagcgtccgccctagttgcccctcaaaacaaagtagcaccgagtcaattacagaagagttctacaggtatatgctaagagatattgagcgcgatagcagggagagtgcctccagccgaaggtcaagtcaggattggaccgctgggttgttgagtccatccctgagatcaccagtctgtcatcggcagtccagtatgcctgactcccgctctccatgtagccgtctgactgtgaacgttcccataaaagccaactcattagacgggttcgcacagaattgtccacaggatttcctctctgtgcagcctgttagttctgctagcagctctggactttgcaaatctgatagctgtctgtacagaagggggggcactgatcacattactaacatgttgatccacgagacatgggcttcatctatagaagcactgatgagaaagaataaaataatagttgacgacgccgaggaagccgacactgagccagtgtctggaggctcccccagccaggcagagaagtgcgctaaccgactggcagcctctaggatgtgtagcggcccaactctgcttgttcaagaaagcctcgactgtcctcggaaagactcagtcaccgagtgcaaacagcctccggtgtcatccctaagtaaaactgcttctcttacaaaccactcccccctggacagtaagaaggaaacatcttcatgtcaggaccctgtgcccattaatcacaaacggagatccctgtgtagtcgggaggtgcccttgatacagatagagacggaccaaagagaagcctgcgcaggtgaaccagaaccctttctgtcgaaaagctcactgctggaggaagccgaaggtcatagtaacgataagaacatcccagacgtggttcgaggcggcgacacagctgtgagtgcctgccagattcatagcgattcactggacactagagatgtcccagaagccgaggccagcactgaggccagggcccctgacgaagcaccaaaccctccatcctcatcagaggaaagcacaggcagttggacgcagttggcaaatgaggaggataaccccgatgatacctcttcattcctccaattgtccgaacgatccatgtccgagcttgtagaagagaagaaaatcctgaagggccaaagcgaatctacagaagctcctgcctcgggtcctccgacagggacggccagtcctcagcgttctcttttagttatcaattttgatctggagcctgagtgccccgatgcggagcttcgagccactttgcagtggatagccgcatccgaactgggtattccaacaatttactttaagaaatctcaggagaatcgaatcgagaagtttttggatgtggtgcagctagtgcaccggaagagctggaaggtgggcgacatcttccacgcagtcgtgcagtattgcaagatgcacgaagagcagaaggatggccgcctgtctcttttcgactggctgctcgagctcgggtag

SEQ ID NO: 136089 - DNA, 5103 bp, Artificial Sequence
  Description of Artificial Sequence: Synthetic coding sequence
atggatggcaacagtctgctgagtgtgcccagcaatctggaaagttctcgcatgtatgacgtcctagaaccccaacagggcaggggctgcggctcctccgggtctggcccaggaaactctatcactgcttgtaaaaaggtgctcagaagcaactctctgctggaatcgaccgattattggttgcagaatcagcggatgccttgtcagatcgggttcgtggaagataagtccgagaattgtgcgagtgtgtgctttgtcaatttggatgtgaacaaagatgagtgcagcactgaacacttacagcagaagctggttaatgtaagccccgacctacccaaacttatctccagtatgaacgtgcagcaacccaaggagaacgagatagttgtcctctccggcctggccagtgggaacctgcaagcagattttgaggtgtcacagtgcccgtggctccctgacatttgtctcgtgcagtgcgctcggggcaatcgaccaaacagcactaattgtataattttcgagattaacaaattcttgattgggctggagttagttcaggaaaggcagctgcatctggaaactaacatactaaagctggaggatgataccaattgtagtttatcgtcaatcgaagaggattttctaaccgctagtgaacacttggaagaggaatcagaggtggatgagtcaaggaacgattacgagaacatcaacgtgagcgccaatgtcctggaatccaaacagttaaaaggtgcaacccaggtggaatggaattgcaacaaagaaaagtggctgtatgctctagaagacaaatacattaacaagtaccctacacccttgatcaagaccgagcgcagccccgagaacctgaccaaaaacacagcattacaaagcctcgatccctctgccaagccttctcagtggaagcgggaggccgtgggtaacgggaggcaagccacccattattaccactccgaagctttcaaaggccaaatggagaagtcccaggcgctgtacatccccaaggatgcctatttctctatgatggacaaggatgtgcccagcgcttgcgctgtggcggaacaacggtctaatctcaaccctggagatcacgaggatacgcgcaacgctctcccacccaggcaagacggtgaggtgactacgggaaaatacgccacaaacctggcagaaagcgtgctgcaggacgccttcatccgtctgtcgcagtcccagagcactctgcctcaggagtccgcggtcagcgtctcagttggctcgtcactgctgccttcctgctattcaactaaagacaccgtggtcagtcggtcatggaacgaactccctaagatcgtggtggtccagtcccctgacggatctgatgctgcaccccagcccggtatcagtagttggcccgagatggaggtgtcagtggagacgtcctcgatcctgagcggagagaacagcagccgccaacctcagtctgcactagaggtggcgctggcgtgcgctgcaaccgtgataggcacaatttcatccccacaggcgacagaacggctgaagatggaacaggtggtctctaacttcccacctggctcctccggcgcgcttcaaacacaggctcctcagggccttaaagagccaagcatcaatgagtattcttttccttctgctctgtgtggtatgacacaggtggcttcggccgttgccgtatgtggcctgggcgaacgagaggaggtgacatgctcagtcgccccgtccgggtctcttccccctgcggccgaggctagcgaggctatgcctcccctctgcggcctcgccagtatggaactgggtaaggaggccatcgcaaagggtctgctgaaggaggccgccctggtgctgacccgcccgaacacttacagctcaatcggagacttccttgactctatgaataggaggatcatggaaactgcttcgaaatctcagacactctgcagcgaaaatgtcgtgcgcaacgaacttgcccatactttgtccaatgtcatcctgaggcactcaatcgacgaggtacaccacaagaacatgattattgatcctaatgataaccggcactccagcgaaattctcgataccttgatggaaagcacgaatcagctgctgctcgacgtcatatgcttcactttcaagaagatgtcccacattgtccggctcggcgaatgccccgcagtcctgtctaaagagacgatccgacgacgcgagacagagcctagttgccagccctctgatcccggagccagccaggcctggacaaaggcaaccgagtcctctagctctagccctctgagtaattcacataacacgtccctcgtgattaataatctggtcgacggcatgtactccaagcaggacaaagggggcgtacgccctggcctgtttaagaacccaaccttacagtctcagttgagcaggtcccatagagttcctgattccagtactgccaccacttcctctaaggagatttacctcaagggcatagcaggggaagacacaaaatctccacaccacagcgagaatgaatgcagagcatcatccgaagggcagagaagtccaaccgtcagccaatctcggtctgggtcccaggaagctgaagagagcatacaccctaatactcaagagaagtataattgcgcgactagcaggattaatgaagtccaggtaaacctaagtctgctcggcgacgatttgcttctacctgcccaatccacactgcaaacaaaacacccagacatctattgcatcactgacttcgctgaggaactggctgatactgtggtcagcatggctaccgagatagccgctatttgtctcgataatagcagcggcaagcagccttggttctgtgcctggaagcgcgggtctgagtttctgatgacccccaatgtcccatgtcggagcctgaagagaaaaaaggagtcacagggttcaggaacagctgttaggaagcacaagccccctagactttcagagattaaaagaaaaactgatgagcaccctgagctcaaagaaaaattgatgaatcgggtcgtagatgagtcaatgaacctggaggacgtaccagatagcgttaacttgtttgccaacgaagtcgctgcaaaaatcatgaaccttacagagttttcaatggtggacggcatgtggcaggctcaggggtacccaagaaataggttgctcagcggggacaggtggagccggctcaaggcctcaagttgcgaaagtatccctgaggaagactcagaggctcgagcttatgtgaattctctgggccttatgagcacgctctcccaacccgtcagccgtgccagctcggtgtccaaacagagctcatgtgaatcgatcaccgacgagttctctcgattcatggtgaaccaaatggaaaatgagggtcgagggtttgagctcctgctcgattattatgctgggaagaacgcatcttcaatcctgaatagtgctatgcagcaggcgtgccggaaaagcgatcacctgtctgtgaggccaagctgcccctcgaaacagtccagcacagaatccattactgaagagttctaccggtacatgcttcgggatatcgagcgagactcccgagagtctgcctcaagcagacgctctagccaggattggaccgctggcctgctgtccccctctcttcgcagtccagtgtgccaccggcagtcctccatgcccgactctcgatctccctgtagcagactcaccgtgaatgtgccaatcaaagctaattcactcgatggcttcgcccagaactgtccccaggacttcctgtcagtccaacccgtgtccagtgcgagctctagcggcctgtgcaaatccgactcttgcctgtataggcgtgggggtactgaccatattacgaatatgcttatccatgagacgtgggccagcagtatcgaggccctcatgcgtaagaacaagattattgtggacgacgcggaggaggcagacaccgaacctgtatctggcggaagcccgagtcaagctgagaaatgtgccaatcggttagccgctagtcgcatgtgctccggaccaacactgctggttcaggagtccttggactgcccaagaaaagacagcgtgaccgaatgcaaacaaccgccagtctcctctttgtctaaaaccgccagcctgacgaaccacagccccttagatagtaagaaggaaacatcgagctgccaggatcccgtgcctataaaccacaaaaggcgatctctgtgtagtagggaggtgcccttgatccagattgagaccgatcagagggaggcctgcgccggggaacccgaaccatttttgtcaaagtcctctttactcgaggaggctgagggacacagcaacgataaaaatatccctgatgtggttcgggggggtgatacagccgtcagcgcctgccagatccatagtgatagcctggatacccgcgatgtccctgaggcagaagccagtactgaggcaagagcccccgatgaggcaccaaacccgcccagctcttccgaggagagtacagggagctggacacagctggcaaacgaagaggacaatccggatgacaccagctcatttttgcagttgtcagaacgatcaatgtccaacggcaacagtagcgctacttcctctttgggaatcatggatcttgacatctaccaggaatctatgccatcttctcccatgatcaacgaacttgtggaggagaagaaaatcctgaaaggacaaagtgaaagcacggaggcacccgcatcagggccaccgaccggaaccgcgagccctcaaagatctttacttgtgattaatttcgatcttgagcctgaatgccctgacgcagagctcagagccaccctgcagtggatagcagcctcagaactggggattccaaccatatacttcaaaaagtctcaggaaaatcgtattgaaaagtttctggatgtggtccagcttgtgcacagaaagtcttggaaggtgggcgatatatttcacgcagtggtgcagtattgtaaaatgcatgaggaacagaaagatgggcgcctgagcctttttgactggttactggagctcggctag

SEQ ID NO: 136090 - DNA, 789 bp, Artificial Sequence
  Description of Artificial Sequence: Synthetic coding sequence
atgctggcactcgaggccgctcagcttgacggtcctcacttttcgtgcctctatcccgacggggtcttctacgacctggatagttgtaaacactcctcttaccctgactctgagggggctccggacagcctttgggattggactgtggcccctccagtgcccgcaacaccttacgaggcatttgatcctgctgctgcagccttctcccaccctcaggccgcccagctttgctatgagccgcctacttactccccagccggaaacttagagctcgccccttctctggaggccccaggcccagggttaccggcctatcccaccgagaattttgcatctcaaaccctggtgcctccagcttacgctccctacccttcacctgtactctccgaggaggaagacttgccactcgatagtcccgctctggaggttagcgattctgagagcgacgaggctctggtcgctggccctgagggtaagggctccgaagcaggtaccaggaaaaaactgcggctgtaccagttcctgctcggattgctgacgaggggagacatgcgagaatgtgtctggtgggtcgagccaggagccggggtgttccagtttagctcaaagcacaaagaacttctggcaaggcgctggggtcagcaaaaggggaaccgcaaacgaatgacttaccagaagcttgcacgagccctccgcaactatgcaaagaccggggagattaggaaagtaaaacgaaagctcacttaccagttcgattctgctctgttacccgccgtgcgcagagcctag

SEQ ID NO: 136091 - DNA, 516 bp, Artificial Sequence
  Description of Artificial Sequence: Synthetic coding sequence
atggcctctagtatgacatggacggccgccagcatacctgcaacgctcattcagagaggcctcctgaccctggtcccacctgcctatgccccatatccatcaccggtcctttcggaagaggaagacctccccctggatagccccgccctggaggtgtcagattccgagtctgacgaagcactggtggccggtcccgaaggaaaggggagcgaagccgggacgagaaagaaattaagactttaccagtttcttttgggattattaacgaggggggacatgcgtgagtgcgtctggtgggtcgagccaggggccggggtgttccagttctccagcaaacacaaagaactcctcgctagacgatgggggcagcagaaaggcaatcgcaagagaatgacatatcagaagcttgcacgggctttaagaaattacgccaaaacgggcgagatacggaaagtgaaaagaaagctgacataccagttcgactccgcactgcttcccgccgttcggagggcgtag

SEQ ID NO: 136092 - DNA, 747 bp, Artificial Sequence
  Description of Artificial Sequence: Synthetic coding sequence
atgacctgtgtcgagcaggataaactgggacaggcatttgaggacgcattcgaagttctgcgacagcatagcacaggggatctccaatatagtcctgactaccgaaattatctggcactgatcaatcaccggcctcatgtgaaaggtaatagctcctgctacggcgtcctgccaacggaggaacccgtttataattggagaaccgtgattaacagcgcagcagacttttacttcgaggggaacattcatcagtcgctgcagaatatcactgaaaatcagcttgtgcaaccgacactactacaacagaaggggggcaagggtcggaaaaagcttcgattattcgagtatctgcacgaatccctatacaaccccgagatggcttcttgtattcagtgggtggataagactaagggaatcttccagtttgtgagcaaaaacaaagagaagctggcagaactgtggggcaaacggaagggaaatcgcaagacaatgacataccagaaaatggcaagagcacttagaaattatgggcgtagcggagagatcacaaagatccgacgcaaactgacgtaccagttctcggaggctatactgcagagactgtcaccgtcatacttcctggggaaggagatattttattcccagtgcgtgcagccggaccaggagtacctgagcctgaacaattggaacgccaactataattatacttatgccaactaccacgaactcaatcatcatgactgctag

SEQ ID NO: 136093 - DNA, 747 bp, Artificial Sequence
  Description of Artificial Sequence: Synthetic coding sequence
atgacgtgtgtcgagcaagacaagctaggccaggccttcgaggatgctttcgaagtgctcaggcagcactccacgggagacctgcagtatagccccgattataggaattatcttgcgctcattaaccaccgcccccacgtaaagggcaattcaagctgctatggcgttctgcccactgaggagcctgtgtataactggaggacagtcattaattctgccgctgatttctatttcgagggtaatatccatcagagccttcagaatattacagaaaaccagttggttcagcccacgttattacagcaaaagggtggaaaggggcgcaaaaagctgcgcctgtttgagtaccttcacgaaagcctttataatcccgagatggcgtcttgcatccagtgggtcgacaagaccaaggggatttttcagtttgtgagcaagaacaaagagaaactggctgaactctggggcaagcgcaagggtaacagaaagaccatgacttaccagaagatggctcgcgccttgcgcaattatggccgatccggggaaattaccaaaatacggcgtaagctcacataccagttctctgaagccatcctccaacggctgtcccccagttattttctgggaaaggagatcttttactcccagtgtgtgcaaccagatcaggagtacctaagtttgaataactggaatgccaattacaactacacatatgccaattatcatgaactgaatcaccacgactgctag

SEQ ID NO: 136094 - DNA, 2568 bp, Artificial Sequence
  Description of Artificial Sequence: Synthetic coding sequence
atgagcttcgtccgcgtgaacagatgcggaccacgcgtaggagttaggaagacaccaaaggttaagaagaagaaaacctctgtgaagcaggaatgggataatacggtcacagatttaacagtgcaccgagccactccagaggatcttgtgagaagacatgagatccacaaatccaagaaccgggcgctagtgcactgggagctccaagagaaagccctgaagagaaagtggcggaaacagaagcccgagacacttaatctcgagaagcgccgcctgagtatcatgaaggaaatcctgtcagatcaataccagatgcaggacgtgctcgagaagagtgatcacctcatagccgcagcgaaggagctgtttcctcggaggcgaactgggtttccaaatgtaaccgtcgcccccgatagcagtcagggccccatagtggtgaaccaggatccaatcacccagtcaatcttcaacgagtctgtcattgaacctcaggctcttaacgacgtcgacggggaagaggagggaacagttaattctcagagcggggagagcgaaaacgaaaacgagctggacaatagcctgaatagccagtcaaacaccaatactgatcgctttctgcagcaattaactgaagagaatttcgaattgatctccaagctgtggaccgatatccagcagaagattgctacccagtcccagatcacaccgcccggcacaccctcatctgcactatctagtggcgagcagcgagccgctcttaacgctactaacgcagtcaagaggttgcagacgagactgcagcctgaggagtctaccgagacactcgattccagctacgttgtgggccacgttctgaatagccgcaagcaaaaacagctccttaacaaggtgaagcgcaaacccaacctgcacgccctgtccaagcctaagaagaacatctccagtggcagcacaacttcagccgacctgccgaatcggacaaacagcaacctggacgtgctgaagcatatgatacacgaggtggaacatgagatggaagagtatgagcgatggaccggaagagaagttaaagggcttcagtcaagccagggattgacaggattcaccctgtccctggttagttccctttgtcgtctggtgcgctatctcaaggagagcgagatccaactgagaaaggaagtggagacaagacagcagctggagcaggtgctgggggatcacagagaacttatagatgccctgactgcagagatactcaggctgcgagaggaaaatgccgccactcaggctaggctgcagcagtacatggtcactacagatgagcagctgattagtttgacacatgccattaagaattgccccgtcataaataaccgacaggaaattcaagcttctgagtcaggtgctaccggccgcagagtgatggactctcccgagaggccggtagtaaacgccaatgtatcagtgcccttaatgtttagggaggaagttgctgagttcccccaagaggaattgccggtcaaactgagtcaggtgcctgatccacctgacaacatgaaccttgccaagaactttccagctcatatttttgaacccgccgtcttactgacccccccccggcagaaatccaatttgaagttctcccccctacaagacgtccttcgtcgtacagtccaaacaagacccgccccgcgcctcccacccaccgtggaaatcatagagaaggaacagaactgggaagaaaagacgcttccgatcgacactgacatccagaatagttcagaggagaatcggctgttcactcagcggtggagagtgtcgcacatgggggaggacctggagaacaagacacaagcaccttttgtgaacctgagtcagcctctatgcaactcacattccaacacgcagcagtccaggagtcctacattctcagaggaactccctgtcttgggggacgggcagcagctccgcacgaatgagtctctgattcagcgtaaagatattatgacacgaattgctgacctaacattgcagaactccgctattaaggcacatatgaacaacatcatcgaaccccggggcgagcagggcgacgggctgagagaactcaataagcaggaatctgcctctgacatgacttcgactttcccagttgcccagagtctgactccagggtcgatggaagaaaggattgccgagcttaacagacagtctatggaagcccgaggaaagttgttgcagctcatagagcagcagaaactcgtgggccttaacctgtcaccacctatgtcgccagtgcagttacccctgcgcgcttggactgagggcgcaaagcgcactatagaggtttccatacccggagcagaagcgcctgaatcctcgaaatgctccaccgtttccccagtctcaggaattaatacgaggcgctcctccggcgctacaggcaactcttgtagccctcttaatgctaccagcggaagtggaagattcaccccgctaaacccccgggctaagatcgagaagcagaatgaggaagggtggtttgctcttagtacccacgtctcttag

SEQ ID NO: 136095 - DNA, 483 bp, Artificial Sequence
  Description of Artificial Sequence: Synthetic coding sequence
atgtcattcgtgcgtgtaaatcgatgcggcccgcgcgtgggagtgcggaagacccctaaggtgaaaaaaaagaaaacgtccgtcaaacaagagtgggataatacggtcaccgacctcaccgtacacagggcaacacccgaggacctggttagacggcatgagatccataagagcaagaacagggcccttgtgcactgggagctgcaggagaaagcgttaaaacggaaatggcggaagcaaaagcccgagaccctcaatctcgaaaagcggaggctttctattatgaaagaaatcctgtccgatcagtatcaaatgcaggatgtattagagaaatcagaccatctcatcgctgcagccaaagaattattcccccgcaggcgtacaggatttccaaacgtgaccgtggccccggatagctcccaaggcccaatcgtcgtgaaccaggatcccattactcaaagtatttttaatgaaagcgtgtag

SEQ ID NO: 136096 - DNA, 522 bp, Artificial Sequence
  Description of Artificial Sequence: Synthetic coding sequence
atgagtttcgtccgggtcaaccgatgtggacccagggtcggagtcagaaaaacacctaaagtgaagaaaaagaaaacctcagtcaaacaggagtgggataacaccgtaactgatcttacagttcaccgcgccaccccggaagacttagtcagaagacatgaaatccataaaagcaagaatagagctttggtgcattgggaattgcaggagaaggctctaaaaaggaagtggagaaaacagaaacctgagacattgaacctggagaaacggaggctgtccatcatgaaagagatattatccgatcagtaccaaatgcaggacgttctcgagaaatctgaccacttaatagcagccgcaaaggagttgtttcctaggcgaagaactgggtttccaaacgtaactgttgcacccgactcatctcaggggcctattgttgtgaaccaggatcctatcacccagagtatctttaacgagtctgtgattgaaccgcaggccctgaacgatgtggacggcgaagaatag

SEQ ID NO: 136097 - DNA, 60 bp, Artificial Sequence
  Description of Artificial Sequence: Synthetic coding sequence
atgagtttcgtccgcgtgaatagatgtggaccccgggtcggtgtccggaaaactccatag

SEQ ID NO: 136098 - DNA, 789 bp, Artificial Sequence
  Description of Artificial Sequence: Synthetic coding sequence
atgaaaactccctttgggaaaactcccggccagcgcagccgggcagacgctgggcatgccggagtgagcgccaatatgatgaagaagcgaacctcacataaaaaacacagatcttccgtgggtccatccaaacccgtgtcccaacctaggcggaatattgtgggctgtagaattcagcatgggtggaaggaggggaatggaccagtgactcagtggaagggcacagtgctggatcaggtaccagtcaatcccagcctatacctgataaagtatgatggctttgattgtgtctatggcttagagctgaacaaagacgagcgagtttccgctctcgaagtcctccctgatagagtggccaccagcagaatatctgacgcccacctagcggataccatgattggaaaggctgtagagcatatgtttgagaccgaggacggcagcaaagacgagtggcggggaatggtgttggcccgggcccccgttatgaacacttggttctatatcacttacgaaaaggacccagtgctctacatgtaccaacttcttgacgattataaagagggtgacctccgaattatgcctgacagcaacgacagcccacccgccgaacgggagcctggggaggtggtcgactcactggttggtaaacaggtggagtacgctaaggaagacggttcgaaacggacaggaatggtgatacaccaagttgaggcaaaaccctccgtgtattttatcaagttcgacgatgacttccacatctacgtttacgacctggtgaagacctcttag

SEQ ID NO: 136099 - DNA, 789 bp, Artificial Sequence
  Description of Artificial Sequence: Synthetic coding sequence
atgaaaaccccttttggtaaaacgccagggcagcgcagtcgggccgatgccggacacgctggcgtgtcggctaacatgatgaaaaaaagaacgtcccataaaaagcaccgatcttccgttggcccatcaaagcccgtttctcaacccaggagaaacatagttggctgtagaatccaacatggatggaaggaaggcaatgggccagtcacacagtggaagggtactgtgctggaccaggtgcctgtgaatccatctctatacctgatcaaatacgatggatttgactgcgtgtatggattggagctcaataaggatgagagggtgtccgctctggaagtgctgccagatcgggtcgccaccagcagaatcagtgacgctcatctggcagataccatgataggcaaggccgtcgagcacatgttcgaaacagaagacggttcgaaggacgagtggcgcggtatggtcctggcacgggcccccgtaatgaatacatggttctatattacatatgaaaaggaccccgtgctgtatatgtatcagctgttggatgattacaaagaaggtgacctgaggataatgcccgatagtaacgacagtcctcccgcggaaagagaaccgggcgaggtagtcgactccctggttgggaaacaagtggaatatgcaaaagaggacggttccaagcggactggcatggtcattcaccaggtggaagctaagccatcagtatactttattaaattcgacgacgacttccacatctatgtttacgacctcgtgaaaacttcttag

SEQ ID NO: 136100 - DNA, 1587 bp, Artificial Sequence
  Description of Artificial Sequence: Synthetic coding sequence
atggctggctcagatactgctcccttcctaagccaggctgacgatcctgacgacgggccggtgccaggtacgcccggcctccctgggtcgaccggcaaccctaagtctgaggagccggaggtgccagaccaggaaggcctgcagcggatcacaggcctttcccctggtcgctctgccctgattgttgcagttctttgctacattaatctactgaactatatggatagattcacggtggccggggtgctgcctgacatagaacagtttttcaacattggcgactcatcttcggggctcatccagactgtcttcataagcagctatatggttctggctcccgtgttcggatacctcggcgaccgatataatcgcaagtacctgatgtgtggagggatcgctttctggtccctagtcacattagggtcctcttttattcccggggaacacttctggctcttgttgctaacccgcggtctggtgggtgtgggcgaggcctcctattctaccattgcccctaccctcattgccgatctctttgttgcagaccaaaggtcccgcatgcttagtattttctacttcgcaattccagtgggatctggactcggttatatcgccggcagtaaggttaaagacatggccggagactggcactgggcactacgagtcacaccaggcctaggtgtagtggcggtgctgctgttgttcctggtggtaagagagccccctcgcggcgcagttgagaggcatagtgatctgcctccattgaatcctacttcatggtgggccgacctgcgggctctggcccgcaacccttcctttgtccttagtagcttaggatttacagccgtagcatttgtgaccggcagtttagccctttgggccccggcgtttctcctgcggtcgcgcgtggtgctgggtgaaacacctccttgtctccctggagattcgtgctccagtagcgacagtctgatcttcggactcatcacctgcttgaccggggtgttgggggtggggctgggggtcgaaatcagtcggaggctgaggcacagcaacccacgagcagaccctctcgtctgcgctaccggactgctggggtcagccccttttctgttcttgtctcttgcttgcgcacgagggtcaattgtggctacatacatcttcatatttatcggagagacgctgttgtccatgaattgggccattgtcgcggacatactgctctacgtggtgattccaaccagaagatccaccgcggaggcgttccaaattgtactgtcccacctgctgggcgatgccggcagtccgtatttaatcgggctcattagcgacagactgagacggaattggccgccttcctttctctccgagttccgggccctccagttcagccttatgttatgtgcatttgtgggagcgctgggcggcgcagcttttctcggcaccgccatatttattgaggcagaccggcggcgggcgcaattgcacgtgcaagggcttctgcacgaggccggaagtacagacgatcgaatcgtagtaccccaaagaggccggtcgacaagagtgcccgtggccagtgtgctgatctag

SEQ ID NO: 136101 - DNA, 1368 bp, Artificial Sequence
  Description of Artificial Sequence: Synthetic coding sequence
atggatcggtttacagtagccggagtattacccgacattgagcagttcttcaacattggggactcttcttcagggttgatccagaccgtgttcataagcagctatatggtcctggctcctgtgtttggctatcttggcgataggtacaaccggaaatatctcatgtgcgggggaatcgcattctggtctctcgtcaccctagggtctagttttatacctggcgagcatttctggttacttttactgactcgtggtctggtgggagtgggagaggcttcctacagcaccattgctcccacactgatcgcggacctcttcgtggccgaccagcggtcaaggatgctttcgattttttacttcgcgattcctgtgggctccgggttaggctatatcgccggctccaaagtaaaggacatggccggcgactggcactgggcactgcgggtcacacctggccttggagtagtcgcagtgctgctgctctttctagtggtgcgagaacctccacggggcgcggtcgagcgacacagtgacctgcctcccctgaaccctacctcatggtgggctgatcttcgcgcgcttgcacgaaatccctcttttgtgctgtcttctttgggcttcacagcggttgctttcgtgactggaagcctcgctctgtgggctcctgcatttttgttgaggagtcgagttgttcttggagagacaccaccttgcctgcccggcgactcatgcagttcttcagatagcttgattttcgggctgatcacgtgcctgacaggcgttctgggagtgggtctgggggtggagatttcccgcaggttacggcacagcaacccaagggcggatcccctcgtgtgtgccaccggtctgctgggttcagccccatttctcttcctgtcgttagcttgtgcccgcggtagcatcgtagctacgtatatatttatctttattggagagacgcttctgagcatgaattgggcgatcgtcgccgacattctgctgtacgttgtcattccaacgcggcggtcgacggcagaagcctttcagatagtgctcagccacctccttggcgacgctggaagtccatacctgataggcctgatttccgatcgcctcaggcgcaactggccacccagttttttgtctgagttcagagccctccaatttagtctaatgctgtgtgcctttgtcggcgccctcggcggcgcagccttccttggcactgcgatctttatagaggccgataggcgaagagcccagctgcatgttcagggattattacacgaggctgggtccacggatgataggatagtcgtgccccaaagaggaaggtccacacgggttcctgtggccagtgtgcttatctag

SEQ ID NO: 136102 - DNA, 1431 bp, Artificial Sequence
  Description of Artificial Sequence: Synthetic coding sequence
atggccggcagcgatactgcgccgtttctgagtcaggctgatgatcccgacgatgggccagtccccgggaccccagggctgcccgggtccaccggaaatcccaaaagtgaagaacccgaggtgcctgatcaggaggggctgcaacgaatcaccggcctgtctcccggacgctctgccctcatcgttgcggttttatgctatatcaatctcctcaattatatggacagattcaccgtggctggagtgcttcctgacatcgaacagtttttcaatataggcgactcctctagcgggcttatccagacagtgtttatctctagctatatggtcttagcccctgtttttggctacctgggcgatcgttacaatagaaagtatctaatgtgtgggggtatcgcgttctggtcgctggttacacttggaagctccttcattcctggggagcatttttggctgctactcctgactaggggccttgtgggggtcggagaggcgagttattctacaatagccccaacactgattgccgacctgttcgtagcagaccagagaagccgtatgttatcaattttttacttcgccatccccgttggatccggtcttgggtacatcgctggttctaaggtgaaggacatggcaggtgactggcactgggccctcagggtcacccccggtctcggcgtcgttgcggtgcttcttttatttctcgttgtcagagaaccaccacggggggccgtggagcgacacagcgatttgcccccgttgaacccgacttcctggtgggctgatctgcgtgccctcgccagaaatctgatctttggtctcatcacttgtctgactggggtactgggtgtgggcttgggggtggagatcagccggagactgcgccactccaatccccgagctgacccattagtgtgcgcaactggcctacttggctcagccccattcctcttcctgtcgcttgcctgtgcgagagggagcatcgtagccacctacattttcattttcataggtgagacacttctgagtatgaattgggcaatagtcgcggatatcctcctctatgttgtgataccgactaggagatctactgccgaggcctttcagattgtcttaagtcatctgttgggggatgcaggttcgccttatctgataggcttgattagtgacaggctgaggcggaattggcctccgtcctttcttagcgagttcagagcattgcaattcagtctgatgttgtgcgccttcgtgggggctctaggaggcgccgcttttttaggcactgcgattttcattgaggctgaccgccgcagagctcagctgcacgtgcagggactgctgcacgaggcagggtccactgatgatagaatcgttgtcccccaaaggggtcggtctacacgggtacccgtggccagcgtgcttatttag

SEQ ID NO: 136103 - DNA, 1365 bp, Artificial Sequence
  Description of Artificial Sequence: Synthetic coding sequence
atggccggtagcgataccgctccttttctgtctcaggccgacgatccagacgacggtccagtgcctggcacccctgggctgcccggcagtaccggaaatcctaagtccgaagagccagaggtgcctgatcaggaaggactccagaggattacaggactgagtcctggccgcagcgctctgattgtggccgtcctatgctacatcaatctgcttaactacatggaccgtttcacggtggcggtgttcatctcatcatacatggtgttagctcccgtattcggctacttgggcgaccgctataataggaaatatttaatgtgtggtggaatcgccttttggagcttagtgacattaggttctagtttcattcccggtgagcacttctggctcctgctgctgaccaggggcctcgtgggagttggagaggcctcttacagtacaatcgccccaactctgatagccgatttattcgtcgccgatcagaggagtagaatgctcagcatcttctacttcgccatacccgtgggctccggcttgggctacattgccggttccaaagtgaaggacatggccggagactggcattgggccctgcgggtgacacccgggctgggtgtcgtggctgtgctcctgttgttcttggtggtgcgtgagccaccccgcggcgctgtggaaaggcattctgacctgccgccacttaacccaacgtcttggtgggctgatcttcgagccttagccagaaatcttatctttggccttatcacctgcctaaccggagtgctcggtgtgggtctgggggtggagattagtcggcgacttcgtcacagcaatccccgcgccgacccgctcgtttgcgcaactggtctactcgggagcgcacccttcctgtttctgtcacttgcctgtgcgaggggatctatcgtcgccacctatatattcatctttataggcgaaaccctgctgagcatgaactgggcaatcgtcgctgacatcttgttgtacgtggtcatccccaccagacggtctactgcggaggctttccagatagtcctgtctcaccttctgggagatgcaggatcgccatatcttatagggctgatcagcgatcggctccggcggaattggcctcccagtttcctgtctgagttcagagctctgcagttcagcttgatgctgtgtgcctttgtcggcgcactggggggagccgctttcttgggaaccgccatcttcatagaggcagaccgaagaagggcgcagctccacgtgcaaggtctgctccacgaagccggcagcacagatgatagaatcgtagtgccccagcgcggacgaagtacacgcgttcctgttgcatctgtgcttatctag

SEQ ID NO: 136104 - DNA, 1650 bp, Artificial Sequence
  Description of Artificial Sequence: Synthetic coding sequence
atgatgtgcctggagtgcgccagtgccgcagccgggggggcagaagaagaggaggcggatgctgagcgacggcggcgaagacgaggagcccagcgaggcgcaggaggctcaggctgttgcggtgccaggggcgccggcggggccggagtaagcgcggccggcgacgaagtgcagactctttccggctccgtccgtcgcgctccaaccgggcctccaggcacgccagggacaccagggtgtgccgcaaccgctaaaggaccaggagctcaacagcctaagcccgcctcactaggtcgtgggcgcggcgccgccgccgccatattgtcactggggaacgtcctcaattatttagacaggtataccgtcgcaggggtgcttttggatatccaacaacactttggagtcaaagaccggggggcaggccttctccaatctgtgttcatctgtagttttatggtggcagcacccatttttggctacctgggggacagattcaatcgaaaggtgatccttagttgcggtatctttttttggagcgcagtcaccttctctagttccttcattccacagcagtacttctggctgctggttctgagccgaggcctggtgggtatcggcgaggcttcatactcaacaatcgctccaaccataataggcgatctgtttaccaaaaacacgcgaaccctgatgctttctgtgttctattttgctataccactcggctccgggttggggtacataacaggttccagtgtgaaacaagccgccggcgattggcactgggccttgcgcgtgagtcccgtactgggcatgattactgggactttaatattgattcttgtcccagccacaaaacgggggcacgctgatcagttaggcgaccagttaaaagcccgtactagttggcttagagacatgaaagctctgattcgaaatagatcatatgtcttctcttctcttgccacaagcgctgtatcttttgccacgggtgccctgggaatgtggatacccttatatttgcaccgcgcacaggttgtgcagaaaaccgcagaaacttgcaactcccccccatgtggggcaaaagactccctgatctttggcgcaataacctgcttcacaggattcctcggggttgttacaggcgctggcgcaactaggtggtgccgcctcaaaacacagcgggcagatcctctggtgtgcgctgtgggcatgttgggaagcgcaatcttcatatgcctcattttcgtagcagccaagagctctatcgtgggtgcctacatatgcatttttgtgggtgagacactgttgtttagcaattgggccataacagctgacattctgatgtacgtcgtcattccaacacgtcgtgccactgcagtcgcgctccagagcttcacttctcacctgctcggagatgcggggtccccctatttgatcggttttattagtgacttaatcagacagtccactaaggattctcctctgtgggaattcctatcccttggttacgccctgatgctatgtccattcgtggtcgtgctcgggggcatgttctttcttgccacggcactgttttttgtgagcgacagggccagagccgaacagcaggtgaatcagttggcaatgcccccggcttcagttaaagtatag

SEQ ID NO: 136105 - DNA, 1158 bp, Artificial Sequence
  Description of Artificial Sequence: Synthetic coding sequence
atgttagtgtgctttcgtctctattcctggctgttcttcctcagtaggggtattgtgggcaccggctctgcctcttactcgaccattgcaccaacagtacttggagacctcttcgtccgggaccagcgtacccgagttctcgcggtattttatatctttatccctgtggggagcgggctgggttatgtgctggggagtgccgtgactatgctcactggaaactggcgatgggccctaagagtgatgccatgccttgaggcagttgccctgattttgctgattctgcttgtgccagacccacctagaggggctgccgagacccaaggcgagggggcagttgggggcttccgttctagctggtgcgaggacgtgagatacctgggaaaaaattggtcattcgtgtggagcacgctcggtgtgacagcaatggcgtttgtgaccggagccctgggattttgggcgcctaagttcctgctggaggctcgggtggtccatggccttcagccgccttgtttccaggaaccgtgctcaaatccggattcattgatcttcggcgcgctgactatcatgacgggggtcataggcgtaatactgggggcagaagccgcccggcgatacaagaaggtgatccccggtgctgagcctctgatttgcgcctccagcctcctagcaaccgcgccatgcttatatctcgctcttgtcctagctccaaccacgttgttagcttcttatgtgtttttaggactgggagagctgctgttgtcttgtaattgggctgtggttgccgatattcttctttccgtagtggtgcctaggtgccgaggcacggctgaagccctgcaaatcactgtcggccacattcttggagatgccgggtccccttacctcacaggcctcatctcttccgtgctgcgggcgagaagaccagacagctatctgcagaggttcaggtcgctccagcagagcttcttatgctgcgcatttgtcattgctctgggggggggctgtttcctgctgacagccctgtacctggagcgcgacgaaacccgagcatggcagccagtaacggggacacctgactcgaatgacgttgactccaacgatctggagagacagggtctactttctggagcaggcgcatccaccgaggaaccgtag

SEQ ID NO: 136106 - DNA, 1539 bp, Artificial Sequence
  Description of Artificial Sequence: Synthetic coding sequence
atggctggcgggatgtccgccgagtgtcccgaaccaggtccaggcggcctccagggtcagtcgccaggccccggacgccaatgcccccctcccattacacctacctcttggtccctgcctccatggagggcctacgtggcagcggccgtgctgtgctatatcaatctgctgaattacatgaactggtttattatcgcaggcgttttactcgatatccaggaagtgttccagatatctgataaccacgcggggctgctccagaccgttttcgtttcctgcctgttacttagcgcccccgtgttcggatacctgggtgataggcactcacgaaaagcaacgatgtcattcggaattctgctgtggtctggcgccggacttagcagcagcttcatctctccacggtatagctggttattctttctctcaagaggcattgtgggcacgggatctgccagctacagcacaattgcgccaactgtgctgggagatttatttgtgcgggatcagcgaacccgagtcctggctgtgttctacatcttcatcccggtcggctcggggttggggtatgtgctcggtagcgctgtgacaatgctaactggcaactggcgctgggctttgcgtgttatgccttgcctggaggcagtggcacttatcctgctgatactgctcgttcccgatccacctagaggagctgcggaaacccaaggtgagggggctgtcgggggttttcggtctagttggtgtgaagacgtcaggtatctgggtaaaaattggtctttcgtgtggtctaccctgggcgtaaccgctatggctttcgtgacaggagctcttggtttttgggctcccaaattcctgctcgaagctcgagtggtgcacggcctccagcctccgtgctttcaggaaccgtgttcgaacccggatagcctcatatttggcgcccttactattatgacaggagtgataggcgtgattctcggtgccgaggccgcgcgcaggtacaaaaaagttattcccggtgccgaaccccttatatgtgccagcagccttctggctacagccccttgcctgtatctcgccttagtgcttgctccaacaactctactggctagctatgtctttctcggactgggagaactgttgttaagctgcaactgggccgtggtcgctgatattctcttgagcgtggtggttccaagatgtagaggcaccgctgaggcacttcagatcaccgtgggtcatatcctaggggatgctggctctccctacttgactgggctgatctccagcgttctaagagccagaagacccgacagctacctgcaacggttcagatcacttcagcagtcttttctctgttgcgcatttgtgattgcactgggcggtggatgttttctgttgacggctctgtacctggagagagacgaaacccgggcttggcagcctgtcacaggaacccctgacagcaacgatgtagacagtaacgacctcgagaggcaagggcttctgtccggggccggtgctagcaccgaagaaccatag

SEQ ID NO: 136107 - DNA, 249 bp, Artificial Sequence
  Description of Artificial Sequence: Synthetic coding sequence
atggggcagactgctctggccggggggtcctcttcaaccccaactccgcaagccctgtacccggatctgagctgccccgaagggctggaagagctgcttagcgccccacccccggatcttggcgcacagaggcgccacggctggaacccaaaggattgcagcgagaatattgaagtaaaagaaggtggcctctactttgagcggcgaccagtagcacagtccacggacggggcccgcggaaaacgctag

SEQ ID NO: 136108 - DNA, 792 bp, Artificial Sequence
  Description of Artificial Sequence: Synthetic coding sequence
atgggccagaccgccctcgccggcggtagttctagtacgccaactccgcaagccctgtaccccgacctgtcctgcccggaaggactggaggagctgctttccgcccccccacctgatctcggagctcagcggaggcacgggtggaatcccaaggattgctcggagaatattgaggtgaaagagggcggcctatattttgagagaaggcccgtagcccagtcaacagatggtgccagggggaagcgggggtactcccggggtcttcacgcgtgggaaattagctggccacttgagcagaggggcacacatgctgtcgtcggcgtcgctacagccttagctcccctgcagaccgatcactatgcggccctcctaggttccaattccgaatcttggggatgggacatcggaagaggcaagttataccaccaaagtaaaggacccggagcgccccaataccccgccggcactcaaggtgaacagcttgaggtccctgaacggttgttagtggtgctggacatggaagaggggactctgggctatgcaattgggggaacatacttggggcctgccttcagagggctgaagggtagaacgctctaccccgccgtcagcgccgtctggggtcagtgccaggttcggattcgctatctaggggagcgcagagccgagccacacagcctgcttcatctcagccgtctttgtgtgcgccacaatctgggagacacacggctcgggcaggtgtcagcattgcctctccccccggccatgaaacgatacctcctatatcaatag

SEQ ID NO: 136109 - DNA, 792 bp, Artificial Sequence
  Description of Artificial Sequence: Synthetic coding sequence
atggggcagactgcactggccggaggtagtagcagcacgccgactccgcaggcgctctatccagatctgtcatgtcctgaggggctggaagaactgttatcggcaccaccaccagatctcggcgcccagaggcggcacgggtggaatccaaaggattgtagcgaaaacatagaggtcaaagagggtggactgtactttgagcgccgccccgtggctcagtcaaccgacggcgcgaggggaaaaaggggttacagtagaggcctccacgcttgggagatcagctggccacttgaacagcgcggcacgcacgccgtggtaggtgtggctacagcgctcgctcctctgcagaccgaccattacgccgctctgctcggctctaattctgagtcctggggctgggatattggaaggggtaaactttaccatcagtctaagggcccaggcgcaccacagtatcccgcagggacgcagggagaacagctggaggtgccggaacgattactagtggtgttagacatggaggaagggacgctgggttacgcaattggggggacttatctgggaccagcatttaggggcttaaaaggaaggaccctgtatccggccgtgtctgccgtgtggggtcaatgccaggtgcgaatccgctaccttggagagaggagagcagagcctcacagtctgttgcatctctcccggctgtgcgtgcggcacaatttaggcgatacgcgtctcggccaggtaagtgccctgcctctgccccccgccatgaaacgatatctgttataccagtag

SEQ ID NO: 136110 - DNA, 1068 bp, Artificial Sequence
  Description of Artificial Sequence: Synthetic coding sequence
atggctaggcgcccacgaaactctagggcatggcactttgtactcagtgctgcaagacgcgatgccgacgccagggccgtggctttggcggggtcaactaactggggctatgactccgatggccagcactccgacagcgatagcgaccctgagtacagcactctcccgccttctattccaagcgccgttccagtaaccggagaatcattttgcgactgtgccggacagtccgaagctagtttctgttccagcctgcacagcgcccaccgcgggcgagattgcagatgtggagaggaagacgagtactttgattgggtatgggacgacctaaataaatccagtgcgaccctcctctcctgcgataaccggaaagtcagttttcatatggagtacagctgcggtacagcagcaatccgcgggaccaaagagctcggagaaggccagcatttttgggaaattaagatgacaagcccagtatacgggacagacatgatggtggggatcggcaccagcgatgtggatttggataagtaccggcacacgttctgctctttactgggacgagacgaggactcttggggactaagctacacaggattactgcaccacaaaggcgacaagactagcttctccagccgttttggccaggggagtataatcggtgtgcacctcgatacctggcacggcacactcactttttttaaaaataggaagtgcatcggcgtggcagcaaccaaattgcaaaataaaagattttacccaatggtgtgctcgacagctgctcggtcatctatgaaggtcactcggtcatgcgcaagcgcgaccagtctccaatatttatgctgtcacaggctcaggcagcttcggccggattcaggcgatactctggaaggactccctctgccacctggcctgaagcaggtgcttcataacaaactgggatgggtgctgtctatgagctgttctaggagaaaagcaccagtgtccgatccgcaggccgccacctctgcccacccctcatcgcgtgaacctcggccctgtcagaggaaaaggtgcaggcgcacctag

SEQ ID NO: 136111 - DNA, 480 bp, Artificial Sequence
  Description of Artificial Sequence: Synthetic coding sequence
atggaatattcatgtggtactgccgccattcgagggacgaaggaactcggagaagggcagcacttctgggaaatcaagatgaccagccccgtgtatggcacactgactttttttaagaatcgtaaatgcatcggggtggctgctacaaaattacagaataaacggttctaccccatggtctgctcgacagccgctcgctccagcatgaaggtcactcggtcttgcgcctcagccacatcgttacaatacctgtgttgccaccgactgcgccagctgaggccagacagcggggatacactggagggcctccctcttcctcccggactcaaacaagtgctgcacaacaagctgggctgggtcctctcgatgagctgtagccgacggaaagccccagtgtctgatccccaagctgctaccagcgctcatccctccagtcgcgaaccccgcccatgccaaaggaagcgctgtcgcagaacatag

SEQ ID NO: 136112 - DNA, 1068 bp, Artificial Sequence
  Description of Artificial Sequence: Synthetic coding sequence
atggccaggcggccaagaaatagccgggcctggcactttgtgctcagcgctgctcggcgtgatgctgacgctcgtgccgtcgcattggccggcagtacaaattggggatacgactctgatggacaacactctgactctgattccgatcctgaatacagcactttgccaccttccataccttcagctgtgcctgttaccggggaaagcttctgcgactgtgcaggccagtctgaggcatcattctgctcctctctacactcagctcataggggcagggactgcaggtgtggtgaggaagatgagtacttcgactgggtctgggacgacttgaataagtcgtctgccaccctacttagctgtgataaccggaaagttagttttcatatggagtactcatgcggcacggccgcaatccgcggaaccaaggagctcggggagggacaacacttttgggaaataaagatgacctctcccgtctacgggaccgatatgatggtggggattgggacttctgatgttgatctggataaatataggcacactttctgttccctgttggggcgcgacgaggactcctgggggctgtcatacaccgggctgctccaccataagggtgacaaaacatcttttagttcaagattcggccagggtagtattataggtgttcacctggatacatggcatgggacgctgaccttctttaagaacaggaaatgcatcggcgttgccgccactaagttacagaataaaaggttctatccaatggtgtgttctaccgccgcaagaagtagtatgaaggtgacacggtcctgcgcctctgccacctctctacagtatctctgctgtcatagactcaggcagctcaggcctgactctggcgatactcttgagggcttgccgttacctcccggtctgaagcaggtgctccacaataagctggggtgggtactcagcatgagttgtagtcggaggaaggctcctgtgagcgacccgcaggccgccacctccgcccatccctcctctagagaacctcgcccgtgccagagaaagcggtgtcgccggacctag

SEQ ID NO: 136113 - DNA, 822 bp, Artificial Sequence
  Description of Artificial Sequence: Synthetic coding sequence
atgggtcaaaagttgtctggctccctgaaaagcgtggaagtgcgggagcctgcactccggcctgccaaacgggaactgaggggagcggagcccggccggcctgcacgccttgatcagctgctggacatgccagccgctgggctcgccgtacaacttaggcacgcctggaacccggaggacagaagcctcaatgttttcgtgaaggatgatgatcggctcacattccaccgccacccggtcgctcagtccaccgacggcatccgaggaaaggtaggacacgctcgaggcctacacgcctggcagatcaactggcctgctcgacagaggggcacccacgctgttgtgggggtagcgacggcccgggctcccctgcactcagtgggatacacagcattggtcgggtccgacgcagagagctggggatgggatctgggccggtcacggctctatcacgacggcaagaatcagcccggggtagcttatcccgctttcctcgggcccgatgaggctttcgccctgccggacagtctattggtggtgctggatatggacgaaggcacattatcatttatagtcgatggccagtatttgggtgttgcattcagagggctcaaaggcaaaaagctgtatcccgttgtttctgccgtctgggggcactgtgaggtcactatgagatatatcaatgggctcgacccggaacctctgcccctaatggacttgtgccgccggtctattaggtcggcacttgggagacagcggttacaagatatctcgtctttgcccctgccgcagtcactcaagaactacctgcagtatcaatag

SEQ ID NO: 136114 - DNA, 1908 bp, Artificial Sequence
  Description of Artificial Sequence: Synthetic coding sequence
atggctagctctggaatggcagactctgctaatcacctccctttctttttcggcaacatcaccagagaggaggcggaggattatctagtacagggcggaatgtccgatggactttacctgttacggcagtctcgcaattaccttggcggattcgcgctctccgtggcgcatggacggaaggcccaccattacacgatcgagagggagcttaatgggacctacgccatcgccggtggccggacccacgctagccccgctgatctttgccattaccacagccaagagagtgacggactagtctgtctcctcaaaaaacctttcaacaggccacaaggcgttcagcccaaaactggaccattcgaagaccttaaggaaaacctcataagagaatacgttaagcagacctggaatttgcagggacaagccctcgagcaggcaataatttctcaaaagccacaactggagaagttgattgccactaccgcacacgagaagatgccttggttccatggcaagatttcacgggaggagagtgagcaaatagttttgatcggatccaagacaaatggtaaattcctgatacgggccagggacaataacggatcctacgcactgtgcttattgcacgagggcaaggtgctccactatcgcattgacaaggataaaacaggcaagctttctattcccgagggaaagaagtttgataccctgtggcaactcgtggagcattactcctacaaagcagacggtctcttgcgggtgctgaccgtgccatgccagaaaattggtacacaggggaatgtgaattttggcggaagacctcaactgcctggtagtcaccccgccacttggtccgcaggtggtattattagtcggataaagagctatagcttccctaagcccggccatcgaaagtcctctccagctcagggcaacaggcaggagagtacggtgtctttcaatccctacgaaccagaacttgcaccctgggccgcggacaagggccctcagcgagaggctctcccaatggacaccgaggtgtacgagagcccgtatgcagatcctgaggagatcaggcccaaggaggtctatcttgaccgcaagcttttgactctggaagacaaagagctaggatctggtaacttcggcaccgtaaagaagggctactatcagatgaagaaggttgttaagaccgtggccgtcaagatcctgaaaaacgaagccaatgatcccgctttgaaggacgaactcttagccgaggccaacgtcatgcagcagcttgataacccatacattgttcgcatgattggtatctgcgaggcagaatcttggatgctggtgatggaaatggctgagctggggccattaaataaatacctgcagcaaaatcggcatgtgaaggataagaacatcatcgagctggtccatcaggtgtcaatgggtatgaaatatctggaagaatccaactttgtacaccgggacctggcggcccggaacgtgcttctggtgacacagcattacgccaagatctccgattttggtttaagtaaagctctgcgcgccgatgagaattattacaaagctcaaacccatggaaagtggcccgtgaagtggtacgccccagaatgtataaattattacaagttctcatccaagagcgacgtatggtcattcggagtgctgatgtgggaagccttctcttacgggcaaaagccataccgtggaatgaaaggctccgaggtcaccgccatgctcgaaaaaggcgaacgtatgggctgccccgcgggatgcccacgggaaatgtatgacctgatgaatctgtgctggacatatgatgtggaaaacaggcccggtttcgctgctgtggagctccgccttagaaactactactacgatgttgtgaactag

SEQ ID NO: 136115 - DNA, 1839 bp, Artificial Sequence
  Description of Artificial Sequence: Synthetic coding sequence
atggccagctccggcatggccgattccgccaatcacctcccatttttcttcggcaacatcacacgggaggaggccgaggattacctagtgcaagggggcatgtccgatgggctgtatttgctgcgacaaagccgcaattacctgggtgggtttgctcttagcgtggctcacggaagaaaagcacaccattatactatagagcgcgagctgaatggcacctatgccatagccgggggccggacacacgcttctccagctgatctctgccattaccacagtcaggagagtgatggacttgtatgtttactgaagaaaccatttaatagaccccagggagtgcagcctaagacagggcccttcgaagacctcaaagagaacctgatacgggaatatgtgaagcagacatggaacctgcaagggcaggcgttggaacaggctattatctcccagaaaccacagcttgaaaaactaattgccacaactgcgcacgagaagatgccttggttccacggaaagatatctcgcgaggaatccgagcaaatagttctaataggcagcaagaccaatggaaaatttcttataagagcccgcgataacaatggctcctacgccctatgtttattacacgaaggtaaagtgctgcactacagaatcgacaaggataagactggcaaactgagtatcccagaaggcaaaaaatttgacactctttggcagcttgtagaacactacagctacaaggcagacgggctgctgcgtgtgctgaccgtaccatgtcagaagatcggaacccagggaaacgtcaactttggaggaaggccgcagctgcccggtagtcacccagcgtcctcccctgcgcaaggcaaccggcaggagagcaccgtgtcattcaatccatatgagcccgaattggccccttgggccgccgataagggtcctcagcgggaggcactgccaatggatacagaggtgtacgagtcaccatacgccgatccagaggaaatcaggcccaaggaggtgtatttagatcgcaagctcctaactttggaagataaagaactaggttctggaaattttggaaccgtgaaaaagggatattaccagatgaaaaaggtggtaaagaccgtggcggtgaagatccttaagaatgaggccaatgacccggccttgaaggatgaactgttggccgaggctaatgtgatgcagcagctggacaacccatatatcgtgagaatgatcgggatctgcgaagctgagtcttggatgttagtcatggagatggcagaattggggccactgaataagtacctgcagcagaataggcatgtcaaggataagaacattattgagctcgtgcatcaggtgagcatgggtatgaagtatttggaggaatcaaactttgtccatcgagatcttgctgccagaaacgtcctgctggttacccagcactacgccaagatctcagacttcggcttgtctaaggctcttagagctgacgaaaactactacaaagcacagacacacggtaaatggcctgtgaagtggtacgcccctgagtgtatcaattattacaagttttcctctaagagtgatgtctggtctttcggcgtccttatgtgggaagcctttagctacggccagaaaccatacaggggaatgaagggcagcgaagtcacagcgatgcttgaaaagggcgagcggatgggatgtcccgccggttgcccacgggagatgtacgatctgatgaacttgtgctggacgtatgacgtggagaacagaccaggctttgccgccgtggagttaagactgcgcaactactactatgatgtagtgaattag

SEQ ID NO: 136116 - DNA, 1839 bp, Artificial Sequence
  Description of Artificial Sequence: Synthetic coding sequence
atggctagttcgggtatggctgacagtgctaaccacctgccttttttctttggcaatatcactcgcgaggaagccgaggattacctggtgcaggggggaatgtctgatggtctgtacctcctccgacagtctagaaattaccttgggggattcgccctcagcgtagctcacggtaggaaggcccaccactacaccatcgaaagagagctaaatggtacctacgccattgctggcggtagaacacacgcgtccccagccgatctgtgccattatcacagtcaggaatctgatggcctggtctgcttgctcaagaaaccatttaatcgcccacagggagtgcagccaaaaacaggaccgttcgaagatttaaaagagaatctgatccgggaatacgttaaacagacatggaacctgcagggccaggccctggaacaggccattatctcccagaagccgcagctggagaagttaatagctacgacagcccatgaaaagatgccctggttccatggaaaaataagcagggaagaatccgagcaaatcgtgcttatcggctcaaaaaccaatggcaagttcctaattagggcaagggacaacaacggcagttatgcactatgtctccttcatgaggggaaggtgctccactatcggattgataaagataaaactggtaaactgtctatccctgagggtaagaaattcgataccctgtggcagcttgtcgagcattacagctataaggccgatgggttgctaagggtgctgaccgtgccctgccagaaaatcggcactcagggcaacgtgaacttcggagggcggccccagctccccggcagtcaccctgcctccagtccagcacagggcaatagacaggaaagtacagtgagttttaatccctatgagcctgaattggctccatgggctgccgataagggccctcagcgagaagcactccccatggataccgaagtttacgagagcccttatgcagatccagaggagattaggcctaaggaggtttacctcgaccggaaacttttaaccctggaggacaaagagctaggcagcggaaactttggaacagtgaaaaaaggctattatcaaatgaaaaaggtggttaagacagtcgctgtcaagattctgaaaaacgaagcaaatgatcccgcactgaaggacgaattgttagccgaggctaacgtgatgcaacagctggacaacccatatatcgtgagaatgatcggtatttgcgaagctgagagttggatgttggtgatggagatggcagagcttggtcccctgaataagtatctccagcagaacagacatgtaaaagacaagaacatcattgagcttgtccatcaagtcagcatgggtatgaaatacctggaggagtccaatttcgtccaccgagatttagctgcgaggaatgtgcttctggtaacacaacattatgcaaaaatatccgactttggtctgagcaaagccttacgcgcagatgagaactactacaaggcccagacccacggcaaatggcccgtaaagtggtacgcccctgagtgtatcaattattacaaattctcatccaagtccgatgtctggagctttggagtgttaatgtgggaagcctttagctatggacagaagccgtatcgtggaatgaaaggttcagaagtaactgctatgcttgagaagggcgaaagaatggggtgccctgccggatgtccgcgagagatgtatgacctaatgaatctgtgctggacatatgatgtggagaacagaccaggcttcgccgccgtcgagctgcgcttgagaaattattactacgatgtggtgaattag

SEQ ID NO: 136117 - DNA, 1908 bp, Artificial Sequence
  Description of Artificial Sequence: Synthetic coding sequence
atggctagctcggggatggccgactcagccaaccacttgcctttcttcttcggaaatatcacacgtgaggaagcggaggattaccttgtgcagggcgggatgtcagacggactttacttgctgagacaatcacggaactacttaggcggcttcgcactctccgtggctcacggaaggaaagcacaccattacactatagagcgggaattgaacggtacatacgcaatcgccggcggcaggactcatgctagcccagctgatctgtgtcattatcatagccaagagtctgatggcctagtgtgcctactcaagaaacccttcaatcgtccacagggagtgcagcctaaaactggcccgtttgaggacctgaaggagaatctgattcgagaatatgttaaacagacatggaatctgcaggggcaggcgcttgagcaggcgatcataagtcagaagccccagctcgagaaactcatagcgaccaccgcgcacgaaaaaatgccctggtttcatggaaaaatcagtagagaggaatctgaacagattgtactgattggcagtaaaacaaacggaaaatttttgatcagagcaagggataataacgggtcctacgccttatgtttgttgcatgagggcaaagtcctgcactatcggatcgacaaagataagactggcaaactcagtatcccagagggtaagaaattcgacaccctgtggcagctagtggagcactattcctacaaggcagacggactactccgtgtcctgaccgtgccatgccagaagataggtacacagggcaacgtcaatttcggcggacgcccacagctacccggctctcacccggccacctggtccgctggaggtatcatctccaggattaagagctactcattccccaaacccggccaccggaagtcaagtcctgcgcagggaaatcgccaagaatccactgtgtcctttaatccttacgaaccagagctggcaccttgggccgcggacaagggacctcaacgtgaggcactgccaatggatacggaagtatacgaatctccctacgcggacccagaagagatccgcccgaaagaagtctacctcgatcgtaagctcctgacactggaagataaagaacttggcagtggaaacttcggcacagtcaaaaaggggtactatcagatgaagaaggtggtgaagactgtggccgtgaaaattctcaagaacgaggcgaatgaccccgccctgaaagatgagctgctggccgaagccaacgtaatgcaacagctggacaacccctatatagtacgcatgatcggaatttgcgaggccgaaagttggatgctcgttatggagatggccgaactggggcctttgaataagtacttgcagcaaaataggcacgtcaaagacaagaatatcattgagcttgttcatcaggtgtcaatgggtatgaaatatttggaagaatctaattttgttcatcgggatctagctgctcgaaatgtacttttagtgactcagcactacgctaagatcagcgattttgggctgagtaaggccctcagggccgacgaaaactattacaaggcgcagacacatggtaagtggcctgtgaagtggtacgcacctgaatgtatcaattattacaaattctcatctaagtcggatgtgtggagcttcggtgtgctgatgtgggaagctttctcgtacggccaaaagccataccgcggaatgaaggggtccgaagtaacggccatgctcgagaaaggagaaaggatgggctgtcctgccggttgccccagggagatgtacgatcttatgaatctatgctggacgtacgacgtggagaatcgccctggcttcgccgccgtcgaattaaggctgaggaactattactacgacgttgtcaattag

SEQ ID NO: 136118 - DNA, 990 bp, Artificial Sequence
  Description of Artificial Sequence: Synthetic coding sequence
atggtgtcaaagtcccgctggaagttgctcgcaatgcttgctctagttctggtggtgatggtgtggtactccattagtcgggaagattccttttactttccaatccctgagaaaaaggaaccctgcttacaaggtgaggccgagtctaaagcctcaaaactcttcggcaactattccagggaccagccaattttcctccggctggaagattacttctgggtcaaaacacccagtgcctatgagctaccctacggtacaaagggtagcgaggacctgctgctgagagtgctcgcaatcaccagttcttcaatccccaaaaacatccagtcactgcggtgtcgtcgctgcgttgtggtggggaacgggcatcggctgcggaattcttccctaggcgacgcaatcaataagtacgatgtcgtcattagactcaataatgcaccagtggctggctatgagggggacgtcggatcaaagacaacaatgaggctgttctacccggaatccgcccatttcgatcctaaggtagagaataaccctgacacactgctcgttttggtggcctttaaggcaatggactttcattggatagagaccatcctttcagataaaaagagggtcaggaagggattttggaagcagccccctctgatttgggacgtgaaccccaaacagattaggatactgaaccctttctttatggagatcgcagccgacaaactcctgtcccttccgatgcagcagccaagaaagataaaacaaaaaccaacaacaggactgctggcaataacattagctttacatctctgtgatctggtccacatcgcggggtttggatacccagatgcctataataagaagcaaaccatacattactacgagcagattactttgaagagcatggctggaagcgggcacaacgtctcccaggaagccttagccatcaaaagaatgttggaaatgggcgcaataaaaaacctcacctcattctag

SEQ ID NO: 136119 - DNA, 1917 bp, Artificial Sequence
  Description of Artificial Sequence: Synthetic coding sequence
atggcaacaggcgccaatgcaacacccctggattttccatcaaaaaagcgcaaaagaagtcggtggaatcaggatacgatggagcagaaaactgtgatccctggaatgccgaccgtcatccctcctggcctgactcgggagcaggaacgcgcctacatagtgcagcttcagattgaggatctcacacgcaaactcaggaccggtgatctgggaattccaccaaaccccgaggacaggtccccgtcccctgagcctatttacaactcagaaggcaaaaggctgaatacaagagagttccgcacccgcaagaaactcgaagaagaacgacataacttgattaccgagatggtggctctgaatccagattttaagccgcctgccgactataagccacccgcaactcgcgtttccgacaaggttatgataccacaggacgagtatcccgagatcaacttcgtggggttactgatcggtccccgcggcaacaccttgaagaatatcgagaaggaatgcaacgcaaagattatgatccgggggaaaggctccgtcaaagagggcaaagtagggagaaaagatgggcagatgcttccgggtgaagacgagcccttacacgctttagtgaccgccaacactatggagaacgtgaagaaagccgtcgagcagattagaaatattctcaaacagggtatcgagactcctgaagaccagaatgacctgcgcaaaatgcagctccgcgagttggcccgcttaaatggaactctgagagaagacgataatcggattctgcgaccatggcagagctccgaaactcgaagcattactaacacaactgtgtgcacaaagtgcggaggcgccggacacatagcatctgattgtaaattccagcgacctggcgatccccaatccgcacaggataaggctagaatggacaaagagtacctgagtttaatggctgagctgggggaggcacccgtgcctgcctctgtcggtagcacctccggccctgctacaacaccactcgctagtgcccctaggccggctgcccccgcgaacaacccaccccccccatcgttgatgtctacaacacagtctcgcccaccatggatgaattcggggccaagtgaatctcgcccgtatcatggcatgcacggcggagggccaggtggtcccggcgggggcccgcatagctttcctcacccattacccagcctgacaggaggccacggaggccaccccatgcagcacaatccaaacggcccaccacccccatggatgcaaccacccccaccacctatgaatcagggtcctcatccaccgggccaccacggcccaccgcccatggatcagtatttggggagtactcccgtcggtagcggcgtatatcgcctccaccagggaaagggcatgatgccccccccaccaatgggcatgatgccaccgccgcctccccctccctcaggacaacccccccctcccccaagtggtccccttccaccttggcagcaacagcagcagcagcctccacccccccctccgcccagcagtagcatggccagcagtacacccttaccatggcaacaaaacacaactacaactacgacatctgctggtaccggctcaatcccaccctggcagcagcaacaggcagcggccgcggctagccctggtgccccccagatgcagggcaatcctaccatggtgcccctgcccccgggcgtccagcccccgctaccaccgggagctccacctcccccaccccccccgccaccagggtccgccgggatgatgatcccaccacgagggggagatggaccctctcacgagtccgaggactttccccgacctctagtcactctgcccggacgccaacctcagcagcgcccttggtggactgggtggttcggtaaggctgcatag

SEQ ID NO: 136120 - DNA, 1920 bp, Artificial Sequence
  Description of Artificial Sequence: Synthetic coding sequence
atggcgacaggtgccaatgccacaccactcgacttcccatctaaaaaaaggaaacggtcccggtggaatcaagatacgatggagcagaaaacagtgatccccggcatgcccactgtgatcccaccaggcctcaccagggaacaggaaagggcctacatcgtccagctgcagatcgaagatctaaccagaaaactcagaacaggcgacctgggcatcccgcccaatccagaggatcgcagcccgagtccagaacctatctataatagcgagggtaaacggcttaacacccgggagttcagaacgaggaagaaattggaggaggaaagacataatttgatcacggaaatggtagcgttgaatcccgacttcaagccacctgctgactataaaccaccagcgaccagggtttcagacaaagtgatgatcccccaggacgaatatcctgaaattaatttcgtgggtctgttaatcggaccacgcggcaataccctgaagaacattgagaaggagtgcaatgccaagattatgattaggggaaagggaagtgtcaaggagggaaaggtgggacggaaagatggacagatgctgcccggcgaagacgagccgttacatgcactggtaaccgccaataccatggagaatgtcaagaaagctgtggaacagatacgcaatatcctgaagcagggaatcgagacccccgaagatcagaacgaccttagaaaaatgcagcttcgagaactggctagactgaacggaacactgagagaggacgataaccgaatcttgagaccatggcagagctccgagacccggtcgatcacaaatacaaccgtatgcacgaagtgtggtggcgccggccacatagcgagtgactgcaaatttcagcgacctggagacccacaaagtgctcaggacaaggcaaggatggacaaagaatacctctctctgatggcagagctcggcgaagcacctgtccccgcgtctgtggggagtacaagtggaccggcaacaacaccccttgcttccgctccccgccccgctgccccagcaaataatcctccgccaccttcactgatgtctacaacgcaatcgcgaccgccctggatgaacagcggacctagcgagagccgaccataccacggaatgcatggcggtggaccaggtggccctggaggggggccacatagctttccccatcctcttccatctcttaccggcggtcacggaggccaccccatgcagcataaccccaacgggccacctccaccttggatgcaaccacccccccccccgatgaaccagggcccccatcccccaggacaccacggacctccacctatggaccagtatcttggcagtacacctgttggttccggtgtttatagattgcatcagggcaaggggatgatgccaccccccccgatgggaatgatgccgccccctcctcctcctccttcaggccagcctccacctcctccaagcggacccctaccaccgtggcagcaacagcagcaacagcccccccccccaccgccaccttcatcctcaatggcctcctcgacaccccttccatggcagcaaaacacaacaacaaccacaacaagcgctggcacaggctctatccccccatggcagcagcaacaggctgctgcagctgcctcccctggcgcaccccagatgcaaggtaatcctaccatggtgccactcccccctggggttcagccacccctgcctccaggtgcgcctccccctcctcccccacctcctcctggctccgcgggaatgatgtatgcacctccccccccgccaccacctccaatggatccctccaactttgtgactatgatgggtatgggcgtagctggaatgccaccctttggaatgccgcctgctcccccccctccaccaccacagaactag

SEQ ID NO: 136121 - DNA, 1716 bp, Artificial Sequence
  Description of Artificial Sequence: Synthetic coding sequence
atggccactggcgcaaatgcaacgccactggattttccttcaaaaaaaaggaaaagatcccggtggaaccaggacacaatggaacagaagaccgtcattccaggaatgccgaccgtcattccgcctggactgactagagaacaagagagggcatatatcgtgcagctgcagatcgaggatctgactcgcaagctcagaaccggagatctgggcattccccctaatcccgaggatcgaagcccaagtcccgagcccatctacaactctgagggcaaacggttgaatacacgcgagtttaggaccaggaagaagctggaggaagaacgccataatctcattactgaaatggtggcactgaatcctgattttaagccaccagccgattataagccaccagcgacccgggtgtctgataaggtgatgatcccccaggatgagtatcccgaaatcaacttcgtcggcctgctgatcggccccaggggaaacaccttgaaaaatatcgaaaaagaatgtaacgccaagattatgatcagggggaaaggatccgttaaggaaggcaaggtgggaagaaaggatggacagatgcttcccggagaggacgagccccttcacgcacttgtgacagccaataccatggagaacgtaaagaaagcagtggaacagattcgcaatatattaaagcaaggaatcgaaaccccagaggaccaaaatgacttacgcaagatgcaactgcgggagctagccaggctcaatggcaccctgcgggaggacgacaacagaatcctgcggccttggcagtcctccgagacaagaagcatcaccaacacaactgtctgtaccaagtgcggcggggccggccacattgcgtcggactgtaagttccagcggccaggggatccccaatccgcccaggataaggccagaatggacaaggaatacttatctctcatggccgagctgggggaggctcctgtgccggcctccgtgggctctacctctgggcccgcaacaacccccctggcttctgcacctcgtccagccgctcctgctaataacccacctcccccctcactcatgtctacaacgcagtcccggcccccttggatgaattccggacccagcgaaagccgcccatatcatgggatgcatggtggcgggcccggcggaccaggaggggggccacatagtttcccccatcccctgccatccttgacgggtgggcatggaggccaccccatgcagcataacccaaatggtcctccacccccctggatgcagccgccacctccccctatgaaccagggtccgcacccccctgggcatcatgggcccccgccaatgggtaagtcagtacctggcaaatacgcctgcggcctgtggggtctctccccggctagcaggaaaaggtatgatgccgctacaacgtatggccacgacgctgccgctgctgcggcctcccagtgggccgccccaactcctagcctttggtcctcttcccccatggccaccaccgctgcggcagcatccgccactccgtctgcgcagcagcaatacgggtttcaatatccactggctatggccgctaagataccccctcgaggaggggatggacccagccacgagagcgaagatttccccagaccactggtgacgctccctggcaggcagcctcagcagcgaccatggtggacgggctggtttggcaaagccgcctag

SEQ ID NO: 136122 - DNA, 1302 bp, Artificial Sequence
  Description of Artificial Sequence: Synthetic coding sequence
atggttgcactcaaccctgacttcaagccacccgccgactataaacctccggcaacacgggtaagcgataaagtgatgatcccacaggacgagtatccggaaatcaactttgtcggcctgctgattggcccacgaggcaacacattgaagaatatcgagaaagaatgtaacgccaagattatgatcagggggaaaggcagcgtgaaggaaggaaaggtcggccgtaaggacggacaaatgttaccaggagaagacgagcccttgcacgctcttgtaaccgccaacacgatggagaacgtaaaaaaggcggtggaacaaataagaaacatcttaaaacaaggtatcgagacacccgaggatcagaatgaccttagaaaaatgcagcttagagagctggcacggctgaatggtactctgcgcgaggatgacaacagaattttaagaccgtggcagagcagcgaaactaggtccatcaccaatactaccgtgtgtacaaagtgcggcggggccgggcatatcgcctcagattgcaagttccagcgacctggcgacccccagtccgcacaggataaagcgaggatggacaaagagtacttaagtctgatggctgagttgggtgaggcaccagtgccagccagcgtcggctccacaagtgggcccgctactacacctttggcgtccgcaccaaggccagcagctcccgcaaacaatcccccacctccttcactgatgtccacaacccagtcacgcccgccttggatgaattctggcccgtcagagagcaggccgtaccacggaatgcatggaggaggtcctggagggccgggcggggggcctcactcttttcctcaccctctgcccagcctgaccggaggacatggaggtcaccccatgcagcataatcctaacggcccaccaccaccatggatgcaaccgccccccccacctatgaatcaagggcctcacccgccaggccaccatggacctccaccaatggaccaatatctggggtccacgcccgtaggtagcggggtgtaccgtctccatcagggaaaggggatgatgcctccgccgccgatgggcatgatgcccccgccaccgccccccccaagtgggcagcccccccctccaccaagcggaccactccctccatggcagcaacaacaacagcagccacctccgcctccccctccatcctctagtatggcttcaagcacccccctaccctggcagcaacgttcactccccgccgccgctatggcccgggccatgcgggttcgcaccttcagggcccactggtag

SEQ ID NO: 136123 - DNA, 2022 bp, Artificial Sequence
  Description of Artificial Sequence: Synthetic coding sequence
atggctaccggcgcgaacgcaacgcctctcggaaaactgggtccacccggacttcctccgctgccaggccccaagggcggctttgagcccggccccccccccgcccctggaccaggtgcaggcctgctggcgcccggccccccacccccaccaccagtcggatctatgggtgcgctgacggccgcgttcccgttcgcagcacttccccctccacccccgcccccgcctccccccccacctcaacaacccccaccaccccccccaccgccctcaccgggggctagctatccaccgccacagcctccccccccccctcctttatatcagagggtgtctcccccccaaccccccccaccccagccgccaaggaaagaccaacagccaggacccgctggcgggggcggagactttccaagcaagaagcgcaaaaggtctcgttggaatcaggataccatggaacagaaaacagtcattcccggaatgcccaccgttattccacccggactgacgagagaacaggagagggcctacatcgttcaactgcagatagaggaccttactagaaagctccgcaccggcgacctgggcatccccccaaaccctgaggatagaagtcctagtcctgagcctatctacaacagcgagggtaaacgcctgaatacgagggagtttagaacacgcaagaagctagaggaagagcggcacaatttaattaccgagatggtggccctgaatccagactttaagccaccagccgattacaaacctccagccacgcgggtatccgataaggtgatgattccacaggacgagtaccccgagattaactttgtaggacttctgatcggcccacggggtaacacgctcaagaacattgaaaaagaatgcaatgcaaagatcatgatccgtgggaagggaagcgtgaaagagggtaaagtaggaaggaaagatggacaaatgctgccaggggaagacgagccactacacgcactcgtgactgccaacaccatggaaaacgtcaaaaaggcagtggagcagatacgcaacattctgaagcaaggaatcgagacacccgaagaccaaaacgacctgcggaaaatgcaactgcgagaactcgctagactgaatggaaccctgcgcgaggatgataaccgtattcttcgcccctggcaatcaagcgagactcgttctatcacaaacacaacagtgtgcactaaatgcggtggtgcaggacatatagctagtgattgtaagtttcagaggcctggggacccgcagagcgcccaggataaggcccgcatggacaaggagtacctgagcttaatggctgaactaggcgaagcacccgtccctgcttcagttggtagcacttccgggccagcaaccacacccctcgcgtcagctcctcggcctgccgcacccgcaaataatcctccccctccttctttgatgtctacaacccagagtagacccccgtggatgaacagcggaccctcagaatccaggccctatcacggcatgcacgggggcggcccaggtgggcccggtggcggccctcacagctttccccatccactccccagccttacaggtggccacgggggccacccgatgcagcacaatccaaacggaccaccacctccctggatgcagcccccacccccccctatgaatcagggacctcaccctccaggacatcacggtccacctcctatggaccagtatctcggcagcactcctgtcggatcgggggtgtaccgtctgcatcagggcaagggaatgatgccccctccgcctatgggcatgatgccacctccaccccccccccctagtggtcagcctcccccccccccatccggcccccttcctccctggcaacaacagcagcagcagccccccccccctcccccaccatcctcctccatggccagtagtacaccattaccttggcagcaaagatcgcttccagccgccgccatggccagggcaatgcgggtccgaaccttcagagcccattggtag

SEQ ID NO: 136124 - DNA, 1842 bp, Artificial Sequence
  Description of Artificial Sequence: Synthetic coding sequence
atggagcagaagaccgttattccaggcatgccaacagtgattccacccggactgacccgggagcaagaacgggcttacatcgtccaattgcagatagaggacctgactcgaaaactccgcaccggagacttgggtatccctccgaaccccgaggatcggagcccctcccccgagcccatatacaattctgagggcaagcgtctgaatacccgggaatttagaaccagaaagaaactcgaagaggaacgccacaatctgatcactgaaatggtggcgctgaatcctgattttaagccacccgccgactataagccccctgccactcgcgtgtccgacaaagtgatgatccctcaggacgaatatcctgaaataaacttcgttgggctgctgatcggcccgcgtgggaacacacttaagaatatagagaaggagtgcaatgctaaaatcatgatccggggaaagggtagcgttaaggaaggaaaggtgggccggaaggacggacagatgctgcccggagaggacgagccacttcacgccctggtgacagctaacacaatggagaacgtcaagaaagctgtggaacagattcggaacatactcaagcagggaatcgaaacacccgaggaccagaacgaccttcgcaagatgcagctccgggagcttgcccgccttaacggcaccttacgggaagacgataatcgaattctgagaccctggcagtcatccgagactcggtcaattacaaacaccactgtctgtacaaagtgtggaggcgccggtcacatcgctagtgactgcaaatttcagaggccaggggacccacaaagtgcccaagacaaggcccgaatggataaagaatacctgtctctgatggcggagctcggcgaggctcccgtccccgcctccgtgggctccacaagtggacccgccacaactcccttagcctctgccccacggcccgccgcacccgccaacaatcctcccccaccaagcctgatgtccacgacccagtcaaggccaccctggatgaactccgggccctcagagagtagaccttaccatgggatgcatgggggcggaccaggaggtcccggaggtggtccccattcatttccccacccactcccttccttgacgggcggccacggggggcatcccatgcaacacaacccgaatggtccgccacctccctggatgcaaccacctccccctcctatgaaccagggcccccatcctcctggccaccatggaccacccccaatggatcagtacctgggctcaacccccgtgggttctggggtttatcggcttcaccagggcaagggtatgatgccgcccccccctatgggcatgatgcccccacctccccctcctccaagcggccagccccctcctcccccctcaggtcctttacctccttggcaacagcagcagcagcagccgccaccacctcctccaccgtcctcgtcaatggcctcttcgaccccattgccatggcagcaaaacaccactacgactacaacgagcgccggtaccggttcaatccccccatggcagcaacagcaggcagcagccgcagcatcccctggcgccccccagatgcagggtaatcccacaatggtgcctcttcccccaggggtccaaccacctttgccaccgggagctcctcctccccctccaccaccgcctcccggtagcgcagggatgatgtatgcccctcccccaccccctccccctcccatggatccctcaaacttcgtcaccatgatggggatgggggtcgccggtatgccacctttcgggatgccccccgcaccgccccctcctccaccccagaactag

SEQ ID NO: 136125 - DNA, 1527 bp, Artificial Sequence
  Description of Artificial Sequence: Synthetic coding sequence
atggccaaatctaatggggagaatggtcccagagctcccgccgccggcgagagcctgagcgggacccgggaatccctggctcagggtcctgatgctgcgactactgatgagttgtcatctctagggtctgactccgaagcaaatggattcgccgaaagacgaatagataaattcggattcattgtgggcagccagggtgctgaaggagcgctcgaagaagtccccctggaggtgctgcgacagcgggaaagcaaatggctcgacatgctgaataattgggataaatggatggcaaagaagcataaaaagatcagattaagatgccagaaggggataccgccctcactgagaggccgggcgtggcagtacctgtccgggggaaaggtaaaactgcagcagaatccaggaaagtttgacgaactcgacatgagcccaggggatcctaaatggctggatgtcatagagcgggacttgcatagacagttcccattccatgagatgtttgtgtcgagggggggtcatggacaacaggaccttttcagggtgttgaaggcctacactctctacagaccagaagagggatactgtcaggctcaggcccctattgccgccgtcctgctgatgcatatgcctgccgaacaggccttttggtgtttggttcagatttgcgagaaatatcttcccggctattactcggagaaactggaagccatacaattagatggggagatactcttcagtctgttgcagaaagtatcacctgtcgcccacaagcacttgagtcgtcagaagatcgacccactgctgtacatgactgagtggtttatgtgcgcttttagccgcactctgccctggtccagtgtcttaagagtttgggacatgttcttctgtgaaggagtcaaaatcatatttagggtgggcctggttctgttgaagcacgccctggggagcccggaaaaggttaaggcctgccagggccagtatgagactatcgaacgccttcgatctctgagcccgaagattatgcaggaagcctttctcgtccaggaagtggtggagctccctgtgacagagagacaaattgaacgagagcatctcattcagctgagacgatggcaggagacgcgtggagagcttcagtgtaggtcccccccgaggctccatggtgccaaggccatcctagatgctgagcccgggcctcgcccagctttgcaacctagtccttctattcggctccccctggacgccccgctccctggcagcaaagctaagcctaagccgcctaaacaggcacagaaggaacagagaaaacagatgaaaggcagaggccaactggagaagcctccggcacctaatcaggccatggttgtcgccgccgctggagacgcctgtcctcctcaacacgtgccgcccaaagactcagctcctaaggatagtgccccccaggacctggcacctcaagtgtctgcccaccacagatcccaggaatctttaacatctcaggaaagcgaagacacctatctgtag

SEQ ID NO: 136126 - DNA, 2187 bp, Artificial Sequence
  Description of Artificial Sequence: Synthetic coding sequence
atgcctgcagggcctgtacaggcagtgccccccccaccccccgtaccgactgaacccaaacagcctacagaagaagaagctagctcgaaggaggactctgccccgagtaagccagtggtcggaatcatatatcctccccccgaagtgcgtaacattgtcgataaaaccgctagcttcgtcgcccgcaatgggcctgagtttgaggcccgcatcagacagaatgagatcaataacccgaaatttaacttcctaaaccctaacgacccataccatgcttactaccgacacaaggtctcagagtttaaggaaggcaaggcgcagtttgtcgcacgcaatggccggcaatttcttactcaactaatgcaaaaagagcagcgaaactaccaattcgacttcctgcgcccccagcacagtctgtttaactactttactaagctggtggagcagtacacaaagatactaataccacccaaggggctgttttccaagttaaagaaggaagccgagaacccacgcgaagtgctggaccaggtgtgttaccgagtggaatgggctaagttccaggaacgggagaggaaaaaggaggaggaagagaaagaaaaggaaagagtggcctacgcccagatcgactggcacgatttcgtggtagttgagaccgttgatttccaaccaaacgagcaggggaatttcccgcctcccaccacgccagaagagctgggagcacgcattctaattcaggagagatacgagaagtttggggagtccgaggaagttgagatggaggtggaaagtgacgaggaagatgataaacaggagaaagccgaagaacctccttcccagctcgatcaagatacgcaagtccaggacatggacgaaggctctgatgacgaagaagagggccagaaagtacctccacccccagaaacaccaatgccgccaccactaccccctacaccagatcaggtaatcgtaagaaaggactacgacccaaaggccagtaaaccactcccacctgcccccgcgcctgatgagtacctcgtcagcccaattaccggcgaaaaaataccagcatcaaaaatgcaagaacatatgcgtataggccttctggacccacgatggctggagcagcgcgacagaagtatcagagagaaacagtccgatgatgaggtctatgctccgggcctggacatcgagtctagtcttaagcagttagcagagaggagaacagacattttcggtgtcgaagagaccgccatcggcaagaagatcggcgaggaggagatccagaaacccgaagagaaagtgacatgggatggtcactccggctccatggcccggactcagcaggcagcacaagcaaatatcactctacaggaacagatagaggccatacacaaggccaaggggttagtacctgaggatgacactaaggagaagatcggtccgtccaaacccaacgagatcccccagcaacctccacctccatcaagcgcgacgaacatcccttcctctgctccacccatcaccagtgtgccacgccctcccaccatgccccctccagtccgcaccacagtggtctctgctgtcccagtgatgcccaggccccccatggccagtgttgtgcgattgccacctgggtctgtgattgctcccatgccaccaatcatccacgcgccgcgaatcaacgtcgttccaatgccccctagcgcacctccaataatggctcctcggcctccacccatgattgtgccaacagcgttcgttccagcacccccagtggccccggtgcccgctccagctcctatgcccccggtgcatcctcccccgcccatggaggatgagcccacctcaaaaaagctcaaaaccgaggactccttgatgccagaggaggagtttctcagacgcaacaagggtcctgtcagcatcaaagtgcaagttcccaacatgcaagacaaaacagaatggaagctgaatggacaggtgttggtgtttaccctccccctcaccgatcaggtgtctgtcatcaaagtaaaaatccacgaggcaacaggcatgcctgccggtaaacagaaattgcagtacgaagggatcttcatcaaagacagcaatagcctggcctattataacatggctaacggagcagtgattcatttagcacttaaggaaagaggtgggcgaaaaaagtag

SEQ ID NO: 136127 - DNA, 2073 bp, Artificial Sequence
  Description of Artificial Sequence: Synthetic coding sequence
atgacactcacgatgccgaccacagcaatccccaaggtcatgcaacagcaacagcagacaacccaacagcagctgccccagaaagtgcaggcacaggtaattcaggagaccatagtgcccaaagaaccacccccggagtttgaattcattgctgaccctccgtccatttccgcattcgaccttgatgtggtaaagctgactgcccagtttgtcgcccgcaatggacggcaattccttacccagctgatgcagaaggagcagcgaaattaccaattcgatttccttaggccccagcacagtctcttcaactactttactaaattagtcgagcaatataccaagatactcattcccccgaaaggactattcagtaaacttaaaaaggaggctgaaaacccacgagaggtcctcgaccaggtctgttacagggtggagtgggcgaagtttcaggagcgggagcgaaaaaaagaggaggaagaaaaggagaaggaacgtgtcgcctatgcacagatcgactggcatgactttgtcgttgtggagacagttgactttcaacctaacgagcaggggaacttcccacctcccactaccccggaggagctgggcgcccgcatactgatacaggagcgctacgagaagttcggagaatccgaagaagtggagatggaggtagaatctgatgaagaggatgataagcaggaaaaggctgaagagccaccatcccagttggatcaggacacccaggtccaggatatggacgaaggtagcgatgacgaggaggaggggcagaaggtgccaccaccacctgagacccctatgccgccccctttgccccccacaccagaccaggtgatcgttagaaaggactatgatcccaaggcctccaaaccactcccccctgcacctgcccccgatgaatatctggtctcgccgataacaggcgaaaagatacccgcgtctaaaatgcaagagcatatgagaatcggcctgctggaccccaggtggctcgaacagcgtgaccggagcatcagggaaaaacagtcggatgatgaagtatacgcgccgggcctcgatatcgagtccagcctgaagcagctcgccgaaagaaggacggatatttttggtgttgaggagacggccattggaaagaaaattggcgaggaggagatccagaaaccagaagagaaggtaacctgggacggccacagcgggtccatggccaggacccaacaggccgctcaagctaacattactttacaagagcaaattgaagccatccacaaggctaaaggcttggtacctgaagacgatacaaaggaaaaaatcggaccctctaagccaaacgagattccacagcagcctcccccgcctagtagcgctactaacattcccagttcagctcctccaatcacaagcgttcctcggccccctacgatgccgcccccagtgcgaaccacagtggtttctgctgtgccggttatgccacgcccgccaatggcctccgtcgttaggctgccccctggttccgtaatagccccaatgccaccgattattcacgcaccgaggatcaatgtggtgcccatgcccccatctgccccaccgattatggcccccaggccccccccgatgatcgtgcccaccgcttttgtgcccgctccgcctgtcgcccctgtgcctgccccggctcccatgcctcccgtacaccctccacccccaatggaggatgaaccaacatctaaaaagctaaaaacagaagatagcctgatgccggaggaggaattcttgagacggaataaagggcctgtttccatcaaagttcaagtgcctaacatgcaagacaagactgaatggaagctgaatggtcaggtcctggtgttcacgcttcctctgactgatcaggtctctgtgattaaggtgaaaatccatgaggccaccggcatgcctgcaggcaagcagaaactgcagtatgagggaatattcattaaggatagtaattcgcttgcttattacaatatggccaatggcgccgttattcacctagcactgaaggaacgcggaggacggaagaagtag

SEQ ID NO: 136128 - DNA, 900 bp, Artificial Sequence
  Description of Artificial Sequence: Synthetic coding sequence
atggacctgtctgagttggagcgggataatacggggcgctgccgactgtcctcacctgtgccggcggtgtgccgcaaagagccctgcgtgttgggtgtcgacgaggctggtcgtggccccgttctcggacctatggtgtatgccatttgttactgccctctacccaggctggcagatttagaggcactgaaagtcgctgatagtaaaacattgctggaaagcgagagagagcggctgttcgctaagatggaagacaccgacttcgtggggtgggccctcgatgtgctttccccaaatctcatcagcacctctatgctgggcagggtgaaatacaatcttaacagcctgagtcacgatactgccaccggtctcatccagtatgcccttgatcagggagtgaatgtaactcaagttttcgtggacacagtgggcatgcccgaaacgtatcaggcccgactgcagcaatcttttcctggcatcgaggtgaccgtgaaggcaaaggcagatgccctgtatcccgtggtaagcgccgcaagtatttgcgccaaggttgcccgggaccaggccgtgaaaaaatggcagttcgtggaaaagctccaggatctcgataccgattatgggtcaggctatccaaacgatccgaaaaccaaagcctggctaaaggagcacgtggagcccgtctttggatttcctcagttcgttcggttctcctggcgaactgctcagactattctcgagaaggaggctgaagatgtgatttgggaagattctgcgtctgagaaccaggaaggactgcggaaaattaccagctacttcctgaatgagggttcacaggctaggccaaggagtagtcacaggtactttctggaacgtggtttggaaagcgcaaccagcctttag

SEQ ID NO: 136129 - DNA, 3915 bp, Artificial Sequence
  Description of Artificial Sequence: Synthetic coding sequence
atggccaagattgcgaagacacacgaagatattgaggctcagattcgggagattcagggaaagaaggccgccctcgacgaggcacagggcgtgggcctggactcaaccgggtattatgaccaggagatctacggcggcagtgactccagatttgccgggtacgtcacctcgatcgctgccacagaactcgaggacgatgacgatgattactcaagctctacatcactgttgggtcagaaaaagcccggctatcacgccccagttgctctgctcaatgacattccccagtctaccgagcaatacgacccattcgccgagcatagacctccgaagattgccgatcgcgaagacgagtataagaagcatcggcggactatgatcatcagccccgagcgactggatccctttgcagacggtggcaagacccccgatcctaaaatgaacgctcggacttatatggacgtaatgcgagaacaacacttaaccaaagaagaacgggaaatcaggcagcagttggccgagaaagccaaagcaggtgagctgaaggtggtcaacggtgccgctgcaagtcagccaccctccaagaggaagagacgatgggatcagaccgccgaccaaacacccggggcaactccaaaaaagttgtcttcatgggaccaagcggaaactcctggacacacaccatcactgcgatgggacgagactcctggcagggccaaagggagtgagacaccaggcgctactccaggatccaaaatctgggaccctaccccctcccatacacctgcgggggctgccacgcctggccgcggggacaccccaggacatgccacacccggccatggtggggcgacctcatctgctagaaagaatcgatgggacgagacgcctaaaacagagcgagacacgccgggacacggtagcggctgggctgagacacccaggacggacaggggaggtgattcgatcggtgaaacccctacacctggtgcatctaaacggaaatctcgttgggatgagacaccagcatcacagatgggggggtctacgccggtcctgacacccgggaagaccccaatcgggacccctgctatgaatatggcaacccctacccccggtcacattatgagcatgactccagaacagttgcaagcatggcgctgggagagagagatagatgaacgcaacaggcccctttccgacgaagagcttgacgctatgtttccagaaggttacaaagtcttacccccacctgctgggtacgtccctattcgcacacctgccagaaagttgacggccacccctacccctctggggggcatgactggattccatatgcaaacagaggaccggaccatgaagtccgtcaatgaccagcccagcggaaatctgccgtttcttaaaccagatgacattcagtacttcgacaaactactcgttgacgtggacgagtctacattgagcccagaagagcagaaagagaggaagatcatgaagttgcttctgaaaatcaaaaatgggacccctcccatgagaaaagccgctctcagacaaatcaccgacaaagccagagagttcggggccgggccgctgttcaaccagattctccctctgctgatgagccctacgttagaagaccaggagcggcatctgttggtgaaagtaatcgaccgaattctgtataaattagacgacctggtgagaccctatgtacacaagatactggtcgtcatcgagcctctcctgattgacgaagattactatgcgagggttgaaggacgggagataatcagcaatctggccaaggctgctggtctagccactatgatatccacaatgcggccagacatcgacaacatggacgagtacgttcgcaacaccaccgcccgagcttttgccgtggtggcaagtgccctgggtatcccctcgcttctgcccttcctcaaggccgtgtgtaaaagcaaaaagagctggcaggctcgacacaccgggattaaaattgtgcagcaaattgccatactgatgggctgcgctatcctcccccatctgaggtcactcgtggagatcatcgagcacggactggtcgacgagcagcagaaggtgcgcacgatctccgccctcgccattgcagcactggccgaggccgccactccatatggtatcgagagttttgacagcgtgctgaaacccctctggaagggcatacggcagcatagaggtaaaggtttagccgcctttctgaaagcaattggctaccttatcccactgatggacgcagagtacgccaactattatacccgggaggtcatgttgatcctaatcagggagttccaaagccctgacgaagagatgaaaaaaatcgtgctcaaggttgttaaacagtgttgcgggaccgacggtgtggaagctaattatataaagaccgaaattctgccgccattctttaagcacttctggcaacatagaatggccctggaccgtagaaactaccggcagctggtcgataccactgtagaacttgctaacaaggtaggcgccgcagagatcatctctcggatcgtggatgacctgaaggacgaggccgaacagtaccgaaaaatggttatggaaacgatagagaaaattatgggcaacctgggagcagccgacattgaccacaagcttgaggaacagctgattgatgggattctctatgctttccaggagcagaccaccgaagacagcgttatgctgaatggattcggaactgtcgtgaatgccctcggcaagagagtcaagccgtaccttccccagatatgcggcactgtgctttggaggttaaataataagagtgcaaaagtcagacagcaggccgcagacctcataagtcggaccgccgttgtgatgaaaacttgtcaagaggaaaagctgatggggcacctcggggtagtattgtacgaatacttgggcgaggagtaccccgaagtcctgggctccattctcggtgcgttgaaggctatcgttaatgtcatcggtatgcacaaaatgactcctccaatcaaggacctcctgcctaggctgacacccatactgaaaaaccggcacgagaaggtgcaggagaactgcattgacctcgtcggaagaatcgccgaccgcggggcagagtatgtaagtgcacgcgagtggatgcgcatctgctttgagctgctggaactgttaaaagctcataaaaaggcgatacggcgcgcaactgtcaatactttcgggtatatagcaaaagccatcggcccccacgatgtgctggcgacactccttaacaacttaaaggtacaggaacgacagaatcgagtctgcaccaccgtagccattgctatcgtggcggaaacttgctcccctttcacagtccttcctgcactcatgaatgaatatcgggtgccggaattgaacgtgcaaaacggggtgctcaaatctttgagttttctgtttgagtacataggagagatggggaaggattatatctatgcagtaacccctctgcttgaggacgccctaatggatcgggatctggttcatagacaaactgcctctgctgtggtgcagcacatgtcgctgggggtctacggtttcggctgtgaggactctctgaaccacctccttaattatgtctggcccaatgtttttgagactagtcctcacgtgatacaggcggttatgggagccctggaaggcctgagggtagccataggaccttgcagaatgctccagtactgtctccagggcctattccacccggcaaggaaggtaagagacgtttattggaagatctataactctatttacatcggctctcaggatgctcttatagctcactacccgcggatatacaacgatgacaaaaacacatatatccggtatgagctcgactacatactgtag

SEQ ID NO: 136130 - DNA, 435 bp, Artificial Sequence
  Description of Artificial Sequence: Synthetic coding sequence
atggctaagatcgcgaagacgcatgaagatatagaagcccaaattcgagaaatccagggtaaaaaagcagcactggatgaagcccagggtgtagggctggactcaaccggttactatgaccaggagatatatgggggaagtgactcgcggtttgccgggtacgtgacgtcgatcgcagccactgagcttgaggacgatgacgatgactattcttcatctacttctctcctggggcagaagaagcccggatatcatgctcccgtagctctactgaatgatattccacagagtactgagcagtacgacccattcgccgaacataggccccctaagatagcagatagagaagatgaatacaaaaaacataggcgcacaatgataatatcaccggagcggcttgatcccttcgctgacggcttttacagcgcagcatag

SEQ ID NO: 136131 - DNA, 435 bp, Artificial Sequence
  Description of Artificial Sequence: Synthetic coding sequence
atggcaaaaatcgccaagactcatgaggacatcgaggctcagattcgagaaattcagggcaagaaagccgccctggatgaggcccaaggtgtcggcctggacagcacaggatactatgaccaggaaatatacggagggtcagattctcgctttgccggttacgtaaccagtatagccgcaacagagctcgaagatgacgatgacgattatagcagttccacatcgctgctggggcaaaaaaagccagggtaccatgcccccgtcgcccttctgaatgatataccacaatctacagagcagtatgatccatttgcagaacatcggccaccaaaaattgcagaccgggaggatgagtataaaaaacacaggcgcactatgatcatttcccccgaaaggctggacccattcgccgatggcttttatagcgctgcctag

SEQ ID NO: 136132 - DNA, 2688 bp, Artificial Sequence
  Description of Artificial Sequence: Synthetic coding sequence
atggctacggaacaccctgagcctcctaaggctgaacttcagctgccacctccacctccccccggtcattacggcgcatgggcagcccaagagctgcaagcaaagcttgcagagatcggggctcctatccaaggcaatagggaggaacttgtggagcggctccaaagttatacccggcagaccggcatcgtgctcaaccggcccgtcctcagaggggaggacggcgacaaagcagcacctcccccgatgagcgcccagctacccggcatcccaatgcctcctcccccgcttgggctgccacccctacagcctccccctcctccacccccaccccctcccgggcttggtcttggatttcctatggctcatcctcccaacctggggcccccaccccctttacgggttggagagcctgtcgcactgtccgaggaagagaggctaaaattggctcagcagcaagccgcgctgctgatgcagcaggaggagcgtgctaaacaacagggcgatcacagtctgaaggaacatgaacttctggaacagcaaaagcgggcagctgtactgctggagcaggagcgacagcaggaaatagccaaaatgggaacccctgtgcctcggcctcctcaagatatgggccagattggggtgcggacacctctcggtcctagggtggccgcacctgtgggtccagttggccctacgccaacggtgctgcctatgggcgcacccgtgcccaggcccagggggcctccccccccccccggggatgaaaatcgcgaaatggacgaccctagtgttgggcctaagattcctcaggctctcgagaagatccttcagctgaaagagtcccggcaggaggagatgaatagtcagcaggaggaggaggaaatggagacagacgcacgctcttccctggggcagagcgcatctgaaacagaggaagacacggtgtcagtgtcaaaaaaggagaagaacaggaagaggcggaacaggaagaaaaaaaagaaaccccagagggtaaggggggtaagcagcgaatcttccggggaccgcgagaaagactccacgcgcagcagaggtagtgactctcccgcggctgacgtcgaaattgagtacgtaacagaagagcccgagatttacgaaccgaatttcatcttcttcaagcgcatcttcgaggcctttaaactgactgatgatgtgaagaaagaaaaggagaaggagccagagaagctggacaaattagagaatagcgcagccccaaaaaagaaaggatttgaggaggaacataaggatagcgacgacgactcctcggacgacgaacaggaaaagaagccggaagcccctaaattgtccaaaaagaagctccgtcgcatgaacaggtttacagtggccgaacttaagcagctggtggctcggcctgatgtcgtggaaatgcacgatgtgacagcacaggatcctaagctactggtgcatctgaaggcaacaaggaatagcgtgcccgtgcccagacactggtgttttaagcggaagtatctgcagggcaaacgggggattgaaaaaccgcccttcgaactgccggattttatcaagcgtacaggaatccaggagatgagggaagcacttcaagaaaaagaggagcagaaaactatgaagtcgaagatgcgcgagaaggtgcggcctaaaatggggaaaatcgacattgattaccaaaaattgcacgatgcgttctttaagtggcaaacgaagcctaagctgacaattcacggcgatctttattatgagggcaaggagttcgaaacccggctcaaggagaaaaaacccggcgacctgagcgatgaattacgtatctcactaggcatgccagtgggccctaatgctcacaaagtacccccaccctggctcatcgcgatgcagcgttacggacctcctcccagctatccaaatctgaaaatacctgggttgaatagccccatcccagagagttgttcctttggatatcatgccggaggctggggcaaacctccagtggatgaaactggaaagcccctgtatggcgacgtgtttggaacaaacgccgcggagttccaaacaaagaccgaggaggaggaaattgatcgcaccccatggggggaattggaaccgagcgatgaagagtctagcgaggaagaggaggaagaagaatccgatgaagacaagcccgatgaaacaggatttatcacaccagcggactctggcctgataacacctggggggtttagctctgtgcccgcaggcatggagacaccagagctcatcgagctccggaaaaagaagattgaggaggccatggacggcagcgagactccccaactgttcaccgttcttccagaaaaacgtacggccacagtggggggtgccatgatgggatcaacacacatctatgatatgagcacagtgatgagccgcaagggccccgcgccagagctccagggagtcgaggtggcactcgctcccgaagagctggagttagacccaatggctatgacccagaagtatgaagagcacgtgagagaacagcaggctcaggtcgaaaaagaagattttagcgatatggtcgctgagcacgcagccaaacagaaacagaaaaagcgtaaagcacagcctcaggactcgcgtggcggcagcaagaagtacaaggagtttaagttttag

SEQ ID NO: 136133 - DNA, 2400 bp, Artificial Sequence
  Description of Artificial Sequence: Synthetic coding sequence
gccaagatggccacagaacaccctgagccacccaaagcagaactccaactccctcccccccctccacccggccactacggcgcatgggccgcacaggagttgcaggccaaactggctgagataggagcccccattcagggcaacagagaggaactcgtggagcgactgcagtcatacacacgtcagaccggcatagttctgaataggcccgtcctaaggggcgaagacggcgacaaggccgccccacctcccatgtccgctcagctgccaggcatccccatgcctccaccccctttgggactgcccccgctgcagcccccaccacccccccctccgccaccgcctggcctagggcttggcttcccaatggcacaccctcccaatctggggcctccgcctccccttcgcgtaggtgaaccagtcgcactttccgaagaggagagactcaagctggcacaacagcaggccgcactcctgatgcaacaggaagagagagcgaagcaaggagatcactccctaaaagagcacgagctacttgaacagcagaagcgggcggccgtgctgcttgagcaggaacggcagcaagaagaagaagagatggagacagatgcacgcagtagcttaggccagagcgcctccgaaaccgaggaggataccgtgagtgtttctaaaaaggagaaaaatcgaaagcgcagaaataggaaaaaaaaaaaaaagcctcagcgcgtcaggggggtctcgagcgagagctccggcgacagggaaaaagactccacgcgcagtcgcggttctgattcccccgctgctgatgtcgagatcgaatacgtcaccgaggagcccgagatctacgaacctaactttatcttcttcaagcgtatttttgaggcctttaagttaaccgatgacgtcaagaaggaaaaggagaaggagccggaaaagttggataagcttgagaattcagccgccccaaagaaaaaagggtttgaggaggaacacaaggacagtgacgacgacagttcagacgatgagcaggaaaagaagcctgaagctcctaaattaagcaagaaaaagctgagaagaatgaataggtttacggtggccgaactgaaacagcttgttgctcgcccagacgtggtcgagatgcacgatgtgacagcccaggatcctaaacttctggtgcacctaaaagctacccggaattcagtcccggtgccgcggcactggtgcttcaaaagaaaataccttcagggcaagcgcggaatcgaaaagcccccgttcgagctccccgactttatcaaaaggacaggtatccaggagatgagggaggcccttcaggaaaaggaggagcagaaaactatgaagagtaaaatgagagagaaggttcgtcccaaaatggggaagatcgatattgactaccagaagcttcatgacgcattcttcaagtggcaaaccaaaccaaagctgaccattcatggggatttgtactacgaggggaaggaatttgagaccaggctcaaggaaaagaagcctggcgatctgtcggatgaactccggatttcactcgggatgccagtagggccaaatgcgcacaaggtgcctccaccctggctgattgcaatgcagcgttacggcccaccaccatcctacccaaacctgaagatacccgggctcaatagtcctatcccagagtcctgctcgtttggataccacgccggtgggtggggcaagcctcccgtggacgagactggaaaacccctctacggcgatgtgtttgggacaaacgcagccgagttccaaaccaaaaccgaggaagaggagattgatcgtactccatggggagagctggaaccatccgacgaggagagtagcgaggaggaagaggaagaggaatctgatgaagataagccggatgaaactggatttattactccagctgattccgggctgattaccccgggggggttttcgagtgtgcccgctggcatggaaacgcccgagctgatagaactgcgtaaaaagaaaatagaggaggcaatggacggtagcgaaacaccccagctgttcactgtgctgcccgagaaacggacagccacagtcgggggagccatgatgggctccacccacatctatgacatgagcactgtgatgagccgcaaaggacctgctcctgaactccagggcgtggaggtagcactcgcccccgaggagctggaactcgaccccatggctatgacccagaagtatgaggagcacgtgcgagagcagcaggcccaagtagaaaaagaagatttctctgatatggtggccgagcacgcggcaaagcaaaagcagaaaaagcgaaaggctcagccccaggactcaagaggtggatccaagaaatataaagagttcaaattctag

SEQ ID NO: 136134 - DNA, 3654 bp, Artificial Sequence
  Description of Artificial Sequence: Synthetic coding sequence
atgtttttgtacaacctcacccttcagcgagctactggaattagcttcgctatccatggaaattttagcggaaccaaacagcaggaaattgttgtttctcggggcaaaattctggagctgctgaggcctgatccaaacacagggaaggtccacacgttactgaccgtagaagtgtttggggtcatccgatcgctgatggcgtttagactgacaggcggcacaaaagactatatcgtcgtgggatccgacagtggacgcatcgtgatactcgaataccagccctcaaaaaatatgtttgagaaaatccatcaagagacttttgggaaatcagggtgcaggagaatagtgcccgggcagtttctagctgtggatcctaaggggcgggcagtgatgatctccgcaatagagaagcagaaactggtgtacattttaaatcgggatgccgccgcacgcttgacaatatcgtcgccattggaggcacataaggccaacacgctggtgtaccacgtcgtcggcgttgatgtaggcttcgagaatcctatgtttgcttgtttagagatggattatgaggaagccgataacgatcccacgggagaggccgccgccaatacacagcaaacgctgactttctacgagctggatctgggactaaatcatgtcgttcgcaagtattcagagcctcttgaggagcacgggaactttttgatcacagttcccggcgggtcagatggtccctcaggtgtcctaatttgttctgaaaattacattacctacaagaatttcggcgatcaaccagatatccgctgtccgattcctcgcagaagaaacgatctggacgatcctgagagggggatgattttcgtctgctccgctacgcataaaacaaagtcaatgttttttttcctggctcaaactgagcagggggacattttcaaaatcacccttgagactgatgaggatatggtgaccgaaatacgcctgaagtactttgataccgttcctgtggcagccgctatgtgcgtcctgaagaccggatttctgttcgttgcctccgagtttggtaatcactatctctatcagatcgcccatctgggtgatgatgacgaagagccagaattctcgtcagcaatgcctctggaggagggagatacctttttttttcagccccggccacttaaaaatctcgtgctggtggatgaactggattcactttcccccattctgttttgccaaatagccgacctggcaaatgaagataccccgcaattatatgtcgcctgtggtcgtggaccccgcagctctctccgagtcctgcgccacggtctggaagttagcgaaatggcagtctctgagctcccaggaaatccgaatgcagtgtggactgtgagacggcacatagaagatgagtttgatgcttacatcatcgtttcctttgtcaatgccactcttgtgctttccattggcgaaactgtagaagaagtcaccgactcaggcttccttggcaccacccctaccctgtcatgcagcctactaggcgatgatgcgctggttcaggtctacccagacggaattcgacacattagagctgacaagcgggtgaatgaatggaaaacacctggtaaaaagacaattgttaaatgcgccgtcaatcagagacaagtggttatcgccctgaccggtggggagctcgtgtacttcgagatggaccctagcggacagttgaatgagtacactgaacgaaaagaaatgagcgccgatgttgtctgtatgtcactggccaatgtgccacctggtgagcagcgtagcagatttttggctgtggggctggtcgacaatactgttcgaatcatttccctggacccttcggattgcctgcaaccactgtctatgcaggccctgccagctcaaccagaaagtctgtgcatcgttgaaatgggaggtaccgaaaagcaggatgaactgggagaacgggggtccatcggatttttgtatttgaatattggattacagaatggggttcttcttagaactgtgctggaccctgtcaccggtgacctgtctgatacgcggactcgttatctgggctcccgcccagtgaagctctttcgggtgagaatgcagggccaagaggccgtgctggcaatgagcagcagatcctggctgagctactcatatcagtcccgtttccatttgacacctttatcttacgaaaccctggagttcgcctctgggttcgcgtctgagcagtgccccgagggaattgtggctatctccactaatacactccgtatcctagccttagagaagctcggcgctgtgtttaaccaggtcgcgtttcctctgcagtacaccccgaggaaattcgttattcaccctgagtcgaacaatctcatcatcatcgagaccgatcataatgcatataccgaggccacaaaagcgcagcgcaagcagcagatggcagaagagatggtagaggctgcaggggaggacgagcgagagctggctgctgaaatggccgcagcttttctgaatgagaacctgcctgaaagcatttttggggctcctaaagcaggcaacggacaatgggcgtctgtaattagggttatgaatccgattcaaggtaacacgctggacctcgtgcagctggaacaaaacgaagccgcgttttccgttgccgtgtgcagattctcaaacacaggcgaggattggtatgtattagtaggtgtggcaaaggatcttatcctcaaccctcgctccgttgcaggcgggtttgtctacacatacaaactggtaaacaatggtgaaaagctggagttccttcataaaacacctgtggaggaagtgcccgcagcaattgctcctttccagggtcgcgtcctgatcggcgtgggaaagctgctccgtgtctacgacttgggcaaaaagaagctgctgcgcaaatgcgagaataaacacatcgcaaattatatctctggcattcagacgatcggacacagagtcattgtgtctgacgttcaggagagtttcatttgggttcgttataaacgaaatgaaaaccaactcattatctttgccgatgatacttacccaaggtgggttactacggcaagtctgctggactatgatactgtcgcaggcgcagataagtttggtaatatctgtgtcgttcgcctgcctcccaacactaatgacgaggtggatgaagacccgactggcaataaggctctgtgggacagaggcctcctcaatggggccagccagaaagcagaagttattatgaactatcatgttggggagactgtactctccttacaaaagacgacccttatcccagggggaagcgagtcattggtgtatacaaccctctctggtggaattggaattctggttcccttcacaagtcatgaagatcacgacttcttccagcatgttgaaatgcatctccgctccgagcatccgccgttgtgcgggagggaccatcttagcttccggtcttattactttcctgttaagaatgtcatcgatggcgacctgtgcgaacagttcaactctatggaaccaaataagcagaagaacgtgtctgaagagcttgacaggacgccaccggaagtgagcaagaagcttgaagatattcgcacccgatacgccttctag

SEQ ID NO: 136135 - DNA, 828 bp, Artificial Sequence
  Description of Artificial Sequence: Synthetic coding sequence
atgttcctttacaatctgacattacagagagcaaccggcatttcatttgctatccacgggaatttctctgggaccaagcaacaggagatcgtagtgtcgcgggggaaaatactcgagcttctgcggccagatcctaacacgggcaaggttcacacactgctcaccgtggaggtttttggggtcatccggtcccttatggcctttaggctgaccggaggtaccaaggactatattgttgtgggtagcgactccggtaggatagtaattctcgaatatcagcctagtaagaatatgtttgaaaagatccaccaggaaacgtttgggaagtcaggctgtcggagaattgttcccggtcagttcctcgcggtggacccgaaaggtcgcgcggtcatgatctctgcgatagaaaaacagaaattggtttatattcttaatagagacgccgcggctagactaacaattagctctcctcttgaggcgcataaagccaacactctcgtgtaccacgtggtaggagtggatgttgggttcgagaatccaatgtttgcatgcctcgaaatggattacgaagaggcagacaacgaccccactggcgaggccgccgcaaatacgcagcagactctcactttttatgaattagacctggggctgaatcacgtggttagaaaatactctgaacctttggaggagcatggaaatttcctaatcaccgtgccagggggttcagacggaccttcaggggtcctgaacctatccccgcccttccccaaagcaataccggcacttatctgcttggacagccctgtgtacttttgtacacatccatag

SEQ ID NO: 136136 - DNA, 1275 bp, Artificial Sequence
  Description of Artificial Sequence: Synthetic coding sequence
atggctgctggacccataagtgaaagaaaccaagacgctaccgtctatgtgggtggccttgacgagaaagtgagtgagccgctactctgggagctgttcctacaagccggtccagtggtcaacacccatatgcccaaagaccgtgtcacaggccagcatcagggatatggttttgtggagtttctgtccgaggaggacgctgattatgcaatcaaaattatgaacatgatcaaattatatggaaagcccatacgcgtgaacaaggcaagcgctcacaacaagaacttagatgtgggcgcaaacatctttattggtaacctggacccagagatagatgagaagctgctttacgataccttctctgccttcggcgtgatactccagacgcccaagataatgagagacccagataccgggaatagtaaaggatatgcattcattaacttcgcatctttcgatgcctcggacgccgcgatagaggctatgaacggacaatatttatgtaaccgtccaattactgtttcttatgcctttaagaaggatagcaagggagagcgtcatggctccgccgcggagcgcctgcttgctgcgcagaaccctctcagtcaggcagataggccccatcagctcttcgccgatgccccacctcctccctctgcaccaaatcctgttgtatcttcattgggctccggtctcccacccccggggatgccacctcccggctcctttccgcccccggtgcctcctcctggggctcttccccccgggatacctcccgccatgcctcccccaccgatgccaccgggggcagccgggcatggcccgccctcagcaggtacccctggcgccgggcacccaggccatggtcatagccatccacaccctttcccaccaggtggcatgccgcatccggggatgtctcagatgcaactcgcacaccacggccctcatggactcggtcaccctcatgccggacctccaggctctggtgggcagccacctccacggcctccacccggcatgcctcaccccggcccaccgccgatggggatgcctccacgggggccacctttcggcagtcctatggggcatccaggaccaatgccaccccacggtatgcggggcccaccacccctcatgcctcctcatggctacacaggcccacccaggccccccccatatggataccagcgaggcccactgcccccgcctagacccactcctcgccccccagtgcctcctcgtgggcccctgaggggccctctcccacagtag

SEQ ID NO: 136137 - DNA, 573 bp, Artificial Sequence
  Description of Artificial Sequence: Synthetic coding sequence
atgcccaaagatagagttaccggtcagcatcaggggtacggttttgttgagtttctgtccgaggaggacgcagattacgccataaagatcatgaatatgatcaaactgtatgggaagccaattagagtcaataaagcgagcgctcacaacaaaaaccttgatgtaggggccaatatattcattggcaatttggatcctgagatcgacgaaaaattattgtatgatactttcagcgcatttggcgtcatcctgcaaactcctaaaatcatgcgggatccggataccggcaactctaaggggtacgctttcattaattttgcctcattcgacgcctccgacgcagcaatagaggctatgaatggccagtacctgtgtaaccgccccataaccgtaagttacgcctttaagaaggactccaagggcgaacggcacgggagtgccgccgagcgacttttggctgctcagaaccccttgtcacaggccgaccggccccatcagttatttgctgatgctcctccaccaccgagcgccccaaaccctgtggtgagttctttgggaagcgggttgccttag

SEQ ID NO: 136138 - DNA, 2124 bp, Artificial Sequence
  Description of Artificial Sequence: Synthetic coding sequence
atgtcacgtgacaggttcaggtcacgcggcgggggtggaggcggcttccaccgaagaggcgggggcggcggaagaggtggacttcatgacttccggtccccgcccccaggcatggggctgaaccaaaaccggggcccgatggggcccggccctggccaatctggacctaagccacccatccccccgcccccccctcatcagcaacaacagcagcctcctccacaacagccaccaccacagcaaccgccaccccatcagcctcccccccatccacaaccgcaccagcaacaacagcctcccccgccaccccaggacagctctaagcccgtggtggcacaggggcccggccccgccccaggagtcggatcagcgcctccagcttcctcttccgctccccccgcaaccccacctacctctggagcacccccaggcagtggaccaggccccacaccaaccccacctcccgccgttacctctgccccacccggggcccccccacctactcccccctccagcggagttccaactacccccccccaggctggtgggccccccccacctcccgccgcagttcctggccccggccccggccctaagcaggggcccgggcctggcggcccaaaagggggtaaaatgccaggaggacccaagcccggaggcgggcctgggctgagcacccctggtgggcacccaaagccgccccaccgaggcggtggcgaacccagggggggacgacagcaccatcccccctatcaccagcagcatcatcagggccctcctcctggaggcccaggaggaagatctgaagaaaagatttccgactccgaaggattcaaagcaaacctcagtctgctgcgacggcccggcgagaagacatatacacagcgttgcagactattcgtcgggaacctgccggcagatatcaccgaggacgagtttaagcggctgttcgccaaatacggagagcccggagaggtcttcatcaataaaggaaagggattcggttttattaagctagagtcgagagctctcgccgagatcgcgaaggccgagctggatgatacacccatgcgcggccgccagttacgagtccgttttgccacgcacgccgctgctttgtccgtcagaaacctgtctccatacgtcagtaacgagcttttggaggaggctttctcccagtttgggcccattgagagagctgtggtgattgtggatgatcggggcagaagtacggggaaaggcatcgtcgaattcgcatccaaaccagccgcacgtaaggcttttgagcgctgctccgaaggagtcttcctgttgacaacaaccccccgccccgtgatcgtagagcccctggagcagctggatgacgaggatggactacctgagaagctcgcgcaaaaaaaccccatgtaccagaaggagcgggaaacaccccctcggttcgcccagcacgggacgtttgaatacgagtatagtcagcgctggaagtcactagatgaaatggaaaagcaacaacgggaacaagttgagaaaaacatgaaggatgccaaggacaagctggaaagtgaaatggaggacgcttatcatgaacaccaagctaacctgctgcggcaggatctcatgaggcggcaggaggagttaaggagaatggaagagttgcacaaccaagagatgcagaagcgcaaagaaatgcagttaagacaggaggaggaacgacgtcgcagagaagaagaaatgatgataagacagagggagatggaggagcaaatgcgtagacaacgtgaggagtcgtactcgcgcatgggttacatggatcccagagagagagacatgcggatggggggagggggcgccatgaatatgggggacccctatgggagcggcggccagaagtttccacccttgggaggcggtggcggcatcggatacgaggctaaccccggagtccctcccgctactatgtccgggtcaatgatggggtcagacatgcgaaccgaacgctttggacagggcggggccggccctgttggtgggcagggcccccgggggatgggccctggcactccagcagggtacggcagagggcgggaagaatatgaggggccgaataaaaaacccaggttttag

SEQ ID NO: 136139 - DNA, 1875 bp, Artificial Sequence
  Description of Artificial Sequence: Synthetic coding sequence
atgaactctgggggggggtttggcctcggtttaggcttcggattgacaccaacttccgtcattcaagttactaacctctctagcgcagtgacatccgagcagatgaggaccctgttctcgtttctgggggagattgaggagttgcgtctgtaccctcccgataatgccccgctggcgttttcaagcaaggtgtgctacgtaaaatttcgagatccctcctccgtgggagtggcacagcacctgactaacactgtgtttatagatcgggccctgatagtcgtgccatgtgccgaaggcaagatcccggaggagagcaaagccctgagtctccttgccccggcccccacgatgacctcgctaatgccaggggccggcctcctgccaattccaacacctaatcccctcaccacactgggcgtgtctcttagtagcctgggggccatccctgcagcggccctggaccctaacattgctactctgggggaaatcccacagccaccactgatggggaacgttgacccttcaaagattgacgagattaggcgcaccgtttatgtgggaaatctgaatagccagaccaccactgccgatcagttgctggaattttttaagcaggtcggagaggtgaagttcgtgcggatggctggagatgaaacacagcctactagattcgccttcgttgaatttgctgatcagaactccgttcctagagccctggcttttaacggagtaatgtttggtgacaggcccctgaagatcaaccactcaaataacgcaatcgtgaagcccccagagatgacccctcaggccgcggctaaggagctcgaggaggtgatgaaacgtgtccgggaggcgcagtccttcatttccgcggcaatcgagcctgaatcagggaaatctaacgagcgcaaaggggggaggagccgatcacatacgcgatccaagagtcgttcttcgtctaaatcacatagtcgccggaagcggtctcagtccaagcaccggtcgagaagccacaacagatctcgaagccggcagaaggacagaagacgctccaagtcaccccacaagaagcgctccaagtctagagagcggagaaaaagcagatctagaagccacagccgcgacaaacgcaaggacacacgcgagaaaatcaaggaaaaagagagagtgaaggaaaaagacagagaaaaagagcgggagcgcgagaaggaaagagaaaaagaaaaggagaggggcaaaaataaggatagggacaaggagcgggagaaggaccgggagaaggacaaggaaaaggatcgcgagcgcgagagagaaaaagaacacgagaaggatcgtgacaaggagaaggaaaaggagcaagacaaggagaaggagcgggaaaaagaccgaagcaaagaaattgatgaaaaacgaaagaaggataagaagtctcggactccacccagatcctacaatgccagccgccggtcacggtcctcaagccgcgagagacgccgaagacgaagcaggagctccagcagaagtccacggacatccaagacaatcaaacgcaagtcttctagatctccgagccctaggtctaggaacaagaaagataaaaaacgcgaaaaggagcgcgatcacatttccgaacgccgagagcgcgaacgaagcactagtatgcggaagtcttcaaatgaccgcgacggtaaagaaaaacttgagaaaaattctaccagtctgaaagaaaaggaacataacaaagaacctgacagtagtgtgtccaaggaggtagacgataaggacgccccccgcactgaggaaaacaaaatacagcacaatggcaattgtcagctgaatgaggagaatctgtctacgaagaccgaagccgtttag

SEQ ID NO: 136140 - DNA, 1527 bp, Artificial Sequence
  Description of Artificial Sequence: Synthetic coding sequence
atgacaagtctaatgcccggcgccggactactgccaattccaaccccaaacccattgaccaccttgggtgtatccttgagcagcttaggtgctatcccagctgcagctcttgatcctaatatcgccacacttggggagatccctcagcctcctctcatgggtaacgtggatccctccaaaatcgacgagattcgcaggactgtctacgttggtaacttgaacagccagaccaccaccgccgatcagcttctcgagttcttcaagcaggtgggagaggtgaagtttgtccggatggctggtgacgagacacagcctacacgttttgcttttgttgaatttgcggatcaaaactcagttcctagagccctggcgtttaacggggtgatgtttggggatcggcccctgaaaataaatcactccaataacgcgattgtcaaaccccccgaaatgactccccaagcagccgcaaaagagttagaagaggttatgaagagagtcagagaggcacagtcctttattagtgctgccatagagccagagtcggggaagtccaatgagcgtaagggagggcgctcacgatcccatacgcgtagcaaatctagatcctcctcaaaatctcactcaagacggaaaaggagccagtctaagcaccgcagtagaagccataaccgcagccgatcaagacagaaagaccgtcgcaggagcaaaagtccccataagaagcgttccaagagtagggagaggcggaagtcgaggagccggtcacatagtcgggacaagcgcaaggatacacgcgagaagattaaagaaaaagagcgcgtgaaagaaaaggatagagagaaggaacgggagagggagaaggagcgagagaaagagaaagagagaggaaaaaacaaagatcgtgacaaggaacgagaaaaggatcgcgaaaaggataaagaaaaagacagagaaagagagcgggaaaaggaacatgaaaaagatagggataaagaaaaggagaaagagcaagacaaggaaaaagagcgggaaaaggacagaagcaaggagattgatgagaaaagaaagaaggacaaaaaatctagaaccccaccacgatcctataacgcatccagacgcagccgctcatcatcccgggaacgaaggcgtaggagatcccggtcctcctctagatctccgaggaccagcaagactattaagcggaaaagctccagatccccttcccccaggagccgcaacaagaaagataaaaaaagagaaaaggaacgtgatcatattagtgagcgacgggagcgagagcgtagcacctctatgcggaaatcctccaatgatagagatgggaaggaaaagctagagaaaaacagtacctcccttaaagagaaggaacataacaaggagcctgatagttccgtcagtaaagaggtcgatgacaaggacgcaccacggacggaggaaaataaaatccagcacaacggtaactgccagttgaatgaagagaacctcagcactaagactgaagcggtgtag

SEQ ID NO: 136141 - DNA, 231 bp, Artificial Sequence
  Description of Artificial Sequence: Synthetic coding sequence
atgacttcactgatgccaggggcaggcctcttgcctatcccaacacctaatccactcacgacgctgggtgtgtccctatcgagtttaggagctatccccgccgcagccctggatcctaacattgccactctgggcgagataccccagcccccacttatggggaacgttgacccctccaagattgatgagattagaagaaccgtgtacgttgggaacttaaactctcagtag

SEQ ID NO: 136142 - DNA, 1545 bp, Artificial Sequence
  Description of Artificial Sequence: Synthetic coding sequence
atgaactctggcggcggcttcgggttaggattgggtttcgggctgacaccgacatctgtgatccaagtgaccaacctgagcagcgccgttacttctgagcagatgaggacactgttctctttcctaggagaaatcgaggagcttcggctgtatccacccgataatgcacctctggctttttctagtaaggtctgttacgtcaaatttagagacccttcctcagttggcgtggcacagcacttgacaaacacggtttttatagaccgtgcactgatcgtggtgccctgcgctgaggggaaaatccccgaggagagcaaggccctgtcattgctggcacccgcaccaacaatgacaagcctcatgcccggagccggtctcctgcctattccaactcccaaccctcttaccaccttgggagtctctctatctagtctgggtgccatccctgctgctgccctcgatcccaatatcgctaccctcggggagataccgcagccccccctcatgggtaacgtggatccctctaagatcgatgagattaggcgcactgtttacgtgggtaacctgaatagtcagacaacgacagcagaccaactgttggagttcttcaagcaagtgggggaggttaaatttgtcagaatggcaggcgacgaaacccagccgacacggttcgcctttgttgaattcgctgaccagaattccgtgccaagggctctcgcattcaacggtgtcatgtttggggatcgtcccctgaagatcaatcactccaacaacgccatcgtgaagccacctgagatgactccccaggcggctgccaaggagctggaagaggtgatgaagagggtcagggaagctcaaagctttataagcgcggctatcgaacccgaaagcgggaaatcaaatgagaggaaaggcgggcggtcccgctcccatacccggagcaaatcaagaagctcctccaagtcacacagtaggcgcaagcgctctcagagcaagcacaggtcgcggtcacacaatcggagtcgttccaggcagaaggatcgcagaaggtctaaatcgccccacaagaagcgctccaaatccagggaacgacggaagtctagatcccgcagccacagtagggataagcgtaaagatacacgggaaaagattaaggagaaagagagggttaaagaaaaggatcgcgaaaaggagagagaacgagagaaggagcgtgaaaaggaaaaggagagaggaaaaaataaggaccgtgataaggagcgggagaaagatcgcgagaaggataaagagaaagatagagaacgagaaagagagaaagaacacgagaaggaccgagacaaggaaaaagagaaagagcaagataaggagaaggagagggagaaagatcgctcaaaagaaattgatgagaagaggaagaaagacaaaaaccctgagcaccaccctggcgtaactatgcacagggaggatttagtggtccctgcgggcaaaggtgtgggtggtggcgccggcgtgctgcccgatcggcaggagcaccaaaagccttag

SEQ ID NO: 136143 - DNA, 213 bp, Artificial Sequence
  Description of Artificial Sequence: Synthetic coding sequence
atgtctgaaaagaaacagcccgtggacctcggtctcctggaggaggatgatgagtttgaggagttccctgcggaggactgggcagggctggacgaggatgaagatgcccatgtgtgggaggataattgggatgacgataatgtggaggatgacttttcaaatcaactcagagcagagctggagaagcatggctacaaaatggaaacctcctag

SEQ ID NO: 136144 - DNA, 1077 bp, Artificial Sequence
  Description of Artificial Sequence: Synthetic coding sequence
atggcgtttgcccctatgggaccggaggctagcttttttgacgtgcttgataggcacagagaatccctccttgcagccctgagacgggggggccgggaaccacccaccggaggatcccggctcgcctcccggttcgaggattccgtgggccttcagatggtgtctcactgtacaacacgcaaaatcaaaagcgacagccccaagagtgcacagaagttcagcttgatccttaagattctgagcatgatctacaagctggttcagtcaaatacgtacgctacaaagcgagacatctactacacagattcccagttgtttggcaatcaaaccgtagtcgacaacatcataaatgatatcagttgtatgctcaaggttagcaggcgctctctgcacatcctaagcacttctaaaggactaattgccggtaacctccgctatatcgaggaggatggaaccaaggtgaactgcacctgcggagccactgctgttgccgtgccctcaaacatccaaggcatccgaaatctggtgactgacgcaaaatttgtgttaatcgtcgagaaagatgcaactttccagcggctccttgatgacaacttttgtaacaaactatccccttgtattatgattacggggaagggagtgccagatctgaatacacgactcctcgtgaagaaactatgggacacatttcatgtgcccgtgtttaccctcgtagacgcagacccacacggaatagaaatcatgtgcatatataaatacgggtccatgtccatgtctttcgaggcacaccatctgaccgtgccagccattcgatggttagggctcctgcccagtgatctaaaacgcctcaatgtgccgaaagattccctgatccccctgaccaagcgtgaccagatgaagctggacagtatccttagacgcccctacgtgacctgtcagcccttctggagaaaggagatggagatcatggccgacagcaaaatgaaggccgagatccaggccttgaccttcctgagtagcgactatttgtcacgggtatacttacctaacaaactcaagttcggtggatggatctag

SEQ ID NO: 136145 - DNA, 1065 bp, Artificial Sequence
  Description of Artificial Sequence: Synthetic coding sequence
atggcctttgccccgatgggcccggaagctagctttttcgacgtcctggatcgccatcgtgaaagcctgttggccgctcttagaaggggaggcagggaacctcctacaggcgggtcacgcctcgccagccgcttcgaggatagcgtgggtctgcaaatggtttcccactgcacaacccgcaagatcaaatcagactccccaaaaagtgcacaaaagttctcgctcatactgaagatcctctcgatgatctataaactggtgcagagcaatacttacgcaacaaagcgcgatatctactacaccgatagccagctattcggcaaccaaacagtcgtcgataacattataaatgatataagttgtatgctcaaggtctcaagacggagcttacacatcttgagtacctccaaggggctcatagccgggaatctcagatacatcgaggaggacggcacaaaagtgaactgcacctgtggcgccaccgccgtcgctgtaccatccaatattcagggtatacgcaatgctaaatttgtgctgatcgtagagaaggacgcaactttccagagacttctcgatgataacttctgcaataaactgtcaccatgcatcatgattactggaaaaggcgtgcctgacctaaacacaaggcttcttgtcaagaagttatgggacacctttcacgtccccgtgttcactttggtggacgccgaccctcatgggattgaaattatgtgcatctacaagtacggatctatgtctatgtccttcgaggcccatcacctgactgtgcctgcaatcagatggcttggccttcttccatcagaccttaagcgactgaatgttccaaaagactccctgatcccactcaccaaacgcgatcagatgaagctggattcgattctccggcgaccctatgtcacatgccaaccgttctggagaaaggaaatggaaatcatggcggacagtaaaatgaaggcggaaatccaagccctgactttcttatcctctgactatctctctagggtttatctgcctaacaagttgaagtttggcgggtggatttag

SEQ ID NO: 136146 - DNA, 1191 bp, Artificial Sequence
  Description of Artificial Sequence: Synthetic coding sequence
atggcctttgcccctatgggacccgaggcgtcattcttcgacgttctcgacagacaccgagagtccctgcttgccgctctaagaagaggcggaagggaacccccaaccgggggctcccgtctggccagcagcagcgaggtacttgctagcattgaaaatatcatccaggatatcatcacttcgctcgccagaaatgaggcccctgcttttaccattgataatcggagcagctgggagaatatcaaattcgaggatagcgtagggcttcagatggtgagtcattgtaccacgcgtaaaatcaaaagcgactcccctaagtcagctcaaaaattttccctaatcctcaaaatcttgagtatgatctacaaactcgttcagtctaatacctacgctacgaagagggatatatattatacagatagccagctctttggcaaccaaactgtggttgacaacatcatcaatgacatctcatgtatgctgaaagtcagcagaagatcgctgcatatcttgtctacgagcaaaggtctcatcgctggaaacctgcggtatattgaggaagacggcactaaggtgaattgtacttgtggagcaacagcggttgccgtgccctctaatatacaaggcatacgcaatctggtaaccgacgccaaatttgttctgatcgtagagaaggacgccacatttcagcgtctgctcgacgataatttttgtaacaaactgagtccctgcatcatgatcaccggcaagggagtacctgatttaaacaccagactgcttgtaaagaaattgtgggacaccttccacgtgcccgtgttcactcttgtggacgccgatccccacggcatcgagatcatgtgcatctataaatatggtagcatgtcaatgtctttcgaggcacatcatctaaccgttcctgccatacgctggctgggtttactaccctccgatctaaagagattgaatgtgcctaaggatagcctcatccccttaaccaaaagagatcagatgaagctggactctatcctaagacgtccctacgtaacatgtcagccattttggagaaaggaaatggagataatggctgacagcaagatgaaggcggaaattcaggccctgacttttctgtcttccgattacctttccagagtctacctgcctaacaagctgaaattcggaggatggatttag

SEQ ID NO: 136147 - DNA, 813 bp, Artificial Sequence
  Description of Artificial Sequence: Synthetic coding sequence
ctgctcgcggccttgagacggggtggaagggagccccccaccggcgggtcgaggctcgccagctcttccgaggtcctggcctcaatcgaaaacattatccaggatattattacttcactagcccgtaatgaggcgcctgcgtttactattgataacagaagtagctgggaaaacattaagttcgaagacagtgtgggcttacagatggtgagccactgtaccactaggaagattaagtccgactcccccaaatcagctcagaaattctctctcattctcaaaatccttagcatgatatacaaacttgtgcaatcaaatacttacgctacgaaacgagacatctattatactgactctcagttgttcggaaaccagacagtggtggataatatcattaatgatatctcatgcatgttgaaagtcagtcggcgctcgctgcacatactctccactagtaagggcctcatcgccggaaatctcaggtatatcgaggaggatggaacaaaagtgaactgtacgtgcggagccacagcagtggctgtgccttctaacattcagggtatcagaattactgacgccaagttcgtgctcatcgtagaaaaagacgctactttccagagactcttggacgataacttttgcaataagctgtccccctgcattatgattacggggaaaggtgttcccgatctgaacacccggctgctggtcaaaaagctttgggacacattccatgtgccagttttcacgctggtggacgcagacccacatgggattgagattatgtgtatttacaaatatggaagtatgtag

SEQ ID NO: 136148 - DNA, 996 bp, Artificial Sequence
  Description of Artificial Sequence: Synthetic coding sequence
atggagaacccgtcgcccgccgctgccctcggtaaggccttatgcgccttactcctggccacccttggcgccgctgggcagcccctgggaggggagagcatctgtagtgctagagctctggcaaagtactctatcaccttcacggggaagtggtcgcaaaccgccttccccaaacagtaccccctcttccggccgcccgcacagtggtcatcgctgctgggtgccgctcacagttctgattattccatgtggcgtaaaaaccagtatgtgagtaatggcttgagagacttcgcagaaaggggagaggcatgggccttgatgaaggaaatcgaggccgcaggggaggctctgcagtctgtgcatgcggtcttttcagcacccgccgtgcccagcgggaccggtcagacatcagccgagttagaggttcagaggcgtcattctcttgtctccttcgtcgtgcggatcgtccctagccccgattggttcgtcggcgtggactcgttggacttgtgtgatggagatagatggcgggagcaagcggcccttgatctgtacccttatgacgctggaactgattccggtttcactttctctagtccaaattttgccactatcccccaggacacggttacagagattacaagctcttctccttcccaccctgcgaacagcttttactatccgcgcctgaaagcgctgccaccaattgctcgtgtgacactggtgcggctccgacagagcccacgggcgttcatccctcccgctccagtgctccctagtcgagacaacgaaattgtcgactcagcaagtgttcccgaaacaccactcgactgcgaggttagcctctggtccagctggggcttatgcggtggacactgtggacgcctcggaactaaaagtcgcactaggtacgtgcgcgtgcagcctgcgaacaatgggagtccatgcccagagttagaggaggaagccgaatgcgtacctgacaactgcgtctag

SEQ ID NO: 136149 - DNA, 996 bp, Artificial Sequence
  Description of Artificial Sequence: Synthetic coding sequence
atggagaacccatccccagcggctgctctaggaaaggccctctgcgccttgcttcttgccactttaggtgctgccggtcaaccccttggaggcgagagtatttgctcagctcgagccttggctaaatattccatcacatttacggggaaatggagccagacggccttcccgaagcagtatcccttgttccgtccccccgcccagtggagcagcctccttggggccgcccatagctcagattatagcatgtggagaaagaatcagtatgtgagcaacgggttgagagacttcgctgagcgaggcgaggcatgggctctgatgaaagagatcgaagccgccggcgaagcacttcagtcggtacacgcggtcttttcagcccctgccgttccttctgggaccggccaaacgagtgccgaactcgaggtgcagaggcgccactctttggtttcgttcgtcgtgcgcatcgtgcccagcccagattggttcgttggggtcgattcgttggacctttgtgatggtgacaggtggagagagcaggcggccctcgacctctacccgtacgacgccgggacagatagtggcttcacattctcttctcctaactttgccaccattccccaagacaccgtaactgagattacctcttctagcccttcacacccagctaatagcttttactatcctagactgaaggctttgcctcctatcgccagggtgacactagtgcgccttcgccagtcaccaagagccttcattcctccggcccccgttctgcctagccgggacaatgagatcgtcgacagtgccagcgttcccgagacgcctcttgactgtgaggtgagcctttggagctcttggggcctgtgtggtggacactgcggtcgcctggggaccaaaagtcgtaccagatatgtgcgggtgcaacccgcaaataacggctcgccttgccctgagctggaggaagaagctgagtgtgtacctgataactgtgtctag

SEQ ID NO: 136150 - DNA, 186 bp, Artificial Sequence
  Description of Artificial Sequence: Synthetic coding sequence
atggaaaaccccagtcccgctgctgctctcggcaaggccctctgcgccctcttgctggctactctgggagctgccggacaaccactgggtggagagagtatctgctccgcccgggcattggccaagtactctatcacctttaccgggaaatggtcacaaacagccttcccaaaacagtatccatag

SEQ ID NO: 136151 - DNA, 327 bp, Artificial Sequence
  Description of Artificial Sequence: Synthetic coding sequence
atggagaacccctccccggctgccgcactggggaaagcgttgtgcgccctcctgctggcaacccttggcgctgcgggccagccccttggtggggagagcatctgctccgcgagggctcttgccaagtatagtattacttttaccggcaaatggtcccagactgccttccctaaacagtatcccctgtttaggccacccgcacagtggagctctctgctcggagcggctcacagttctgactacagcatgtggaggaagaatcaatatgtgagtaatggcttgagggacttcgccgagcggggagaggcatgggcactgatgaagtag

SEQ ID NO: 136152 - DNA, 54 bp, Artificial Sequence
  Description of Artificial Sequence: Synthetic coding sequence
atggagaaccccagtccagccgccgcgctcggaaaagccctgtgtgcattatag

SEQ ID NO: 136153 - DNA, 27 bp, Artificial Sequence
  Description of Artificial Sequence: Synthetic coding sequence
atggagaacccttctcccgctgcatag

SEQ ID NO: 136154 - DNA, 51 bp, Artificial Sequence
  Description of Artificial Sequence: Synthetic coding sequence
atggaaaacccatcacctgctgctgcgctgggaaaggctctctgtgcatag

SEQ ID NO: 136155 - DNA, 75 bp, Artificial Sequence
  Description of Artificial Sequence: Synthetic coding sequence
atggagaacccctctccagcggccgctctgggaaaggccctgtgtgcattactgcttgcaaccctcggtgcctag

SEQ ID NO: 136156 - DNA, 195 bp, Artificial Sequence
  Description of Artificial Sequence: Synthetic coding sequence
atggaaaatccgtcacctgcagccgccctgggaaaagccctctgcgccctgctgctcgcgacacttggagccgccgggcagcccctgggcggggagagtatatgtagtgcaagagctctggccaagtactctataacatttacaggaaaatggtcccagactgcttttcccaagcaatatccgcttttccgctag

SEQ ID NO: 136157 - DNA, 960 bp, Artificial Sequence
  Description of Artificial Sequence: Synthetic coding sequence
atggacccccaaaaccaacatggaagtgggtcatctctcgtagtgatccagcagccctcactggatagccgacagagactggactacgaacgggaaatacaaccgacggctattctgtcactagatcaaattaaggcgattcggggctcaaacgaatacaccgagggcccttctgttgttaagaggccagccccacggaccgctccacgccaagagaagcatgaacggacccacgagatcatacccataaacgtgaataacaattatgagcaccgacacacatctcacctgggccatgccgtgctccctagtaacgctagaggtccaatcctctcccgctccacctccactggaagtgctgcgagttcaggaagcaactctagcgcatcttccgagcagggactgctggggagaagcccccctacacgacccgtgccgggccatcgctctgagcgggctattcgaacacagcctaaacagctgattgtcgatgaccttaagggtagcctgaaagaggacctgactcagcataaatttatctgtgagcagtgtggcaagtgtaagtgcggagagtgcacagccccgcgcacacttcctagctgcctggcatgtaaccgtcagtgtttgtgctccgcggaaagcatggtggagtatggtacatgtatgtgcctcgttaagggaatcttttatcactgcagcaatgacgatgagggagattcctacagtgataatccctgctcctgttctcagtcacactgttgctcccgctatttgtgtatgggcgctatgtccctctttttgccttgtcttttgtgctacccaccagctaaaggctgtctgaaactctgccgacggtgctatgactggattcacagacccggatgcagatgcaaaaatagcaataccgtgtactgtaagctcgagtcttgtccatcacgagggcagggcaagccctcatag

SEQ ID NO: 136158 - DNA, 960 bp, Artificial Sequence
  Description of Artificial Sequence: Synthetic coding sequence
atggacccccagaatcagcacggcagtggttccagcctggtcgtgatccagcagccttcactcgactcacgccaaagactcgactacgagcgggagatccagccaacggctatcctttcactagatcagattaaagctattcgaggtagtaacgagtacactgaaggtccaagcgtggtcaaaagacccgctcctagaacggcccctagacaggaaaagcacgagaggacccacgagataatacctatcaatgtgaacaacaattatgaacatcggcatacctcccacttggggcacgccgttttacctagtaacgccaggggcccaatcctatctcgttccacaagcactggcagcgcggccagtagcggctctaattcttccgcgtcctcagaacaaggactcctcgggcgcagccctcctacgcgtccggtaccaggacatcggagcgaacgcgccataaggacccaaccaaaacagctgatagtggatgacctcaagggaagcctgaaagaagacctgacccagcataaattcatctgcgagcagtgtggaaaatgcaagtgtggagaatgtaccgctcctcgtacactgccttcctgtttagcctgcaaccggcaatgcctgtgtagcgcagagagcatggtggagtatgggacatgcatgtgcttggtgaagggaattttctatcactgcagtaacgacgatgagggtgattcctactccgacaatccctgctcctgtagtcagtcacactgttgttcgaggtacttatgcatgggcgcaatgagtctgttcctgccatgcctgctttgctatccaccagccaagggatgtttaaagctgtgtagacggtgttacgattggatacatagacccggctgtcgctgcaagaatagcaatacagtgtactgcaagcttgagagctgtcccagcagggggcagggcaagccaagttag

SEQ ID NO: 136159 - DNA, 204 bp, Artificial Sequence
  Description of Artificial Sequence: Synthetic coding sequence
atggacccacaaaatcaacatggctccggctctagtttggtcgtgatccagcagccttcccttgacagcagacagcggttggattacgagagagaaattcaacccaccgcaatactcagtctggaccagatcaaggccattcgcggcagcaatgaatatactgagggaccctccgtcgtgaaacgacctgcacctcgcacatag

SEQ ID NO: 136160 - DNA, 630 bp, Artificial Sequence
  Description of Artificial Sequence: Synthetic coding sequence
atggatccacaaaatcagcacggctccggctcttctttggtcgttatccaacagcccagtttggattcaagacagagactggattatgagcgagaaatccagccaaccgcgatcctgtctctcgatcagatcaaggccatccggggcagcaatgagtacacagaaggaccaagcgtcgtgaaaaggcctgctccaagaactgccccacggcaagagaaacacgagagaacccatgaaataatccccattaatgtcaacaataattatgagcaccgccacacctctcacttaggtcatgccgtgctgccgtccaacgcccgagggcctatactgagccgatctacctctacggggtctgccgcctcaagtgggagtaacagctccgcctcgtcggaacaaggtctgctgggcaggagtccacccaccagaccagtgcccggccacaggtctgagcgcgcaatccgtacccagcctaagcagcttatagtagacgacctgaagggaagcttgaaggaggatcttacacagcacaaattcatctgtgagcagtgtggcaagtgtaaatgcggcgagtgtactgcgcctcgcacattacccagttgccttgcttgcaatcgtcagtgcctgtag

SEQ ID NO: 136161 - DNA, 108 bp, Artificial Sequence
  Description of Artificial Sequence: Synthetic coding sequence
atggacccccagaaccagcatggctcaggatcctccttagtggtgatccaacagccttcactggactctcggcagcggctggactacgagagagaaatacagccatag

SEQ ID NO: 136162 - DNA, 948 bp, Artificial Sequence
  Description of Artificial Sequence: Synthetic coding sequence
atggaagcacgcgctcaatctggcaacgggtctcagcctcttctgcagactcccagagacggcggccgtcagaggggagagccggatcctagagatgccctgacccagcaggtgcatgttttatcactggatcagatcagggcgatccgcaacaccaacgagtacaccgaggggccaactgtggtgccacggccgggcctgaaaccagcaccgaggccgagcacccagcacaagcatgagagactgcacggactgccagaacataggcaacctcctagattacaacactcacaagtgcacagttctgcgagggcccctcttagtcgctccatttccaccgtgagctctggctcacggagtagtacccgcacaagcacgtcaagctcgagtagtgagcagagacttctgggctccagctttagctccggacctgtagccgatggcattattcgagtccaaccgaagtccgaattaaaacccggcgaactcaagcctctcagtaaagaggacttagggctgcacgcttaccgatgcgaggattgtgggaagtgcaagtgtaaggaatgtacttatccccgccccctcccatcagattggatttgcgacaaacaatgtttgtgcagtgcgcaaaacgtcatcgactacggcacctgcgtgtgctgcgtgaaggggctgttctaccactgtagtaacgatgacgaggacaactgcgctgacaacccatgctcttgcagtcagagccactgctgcactaggtggagcgcaatgggtgttatgtcactcttcctgccctgcttatggtgctaccttccagcaaagggctgcctgaaactgtgtcaaggctgctacgaccgagtcaacagacccggctgccgctgcaagaattcgaataccgtttgctgcaaggttcctacagtcccgcccaggaacttcgagaagcccacatag

SEQ ID NO: 136163 - DNA, 948 bp, Artificial Sequence
  Description of Artificial Sequence: Synthetic coding sequence
atggaggccagagcccagtcaggaaacggatctcaacctttgttgcagaccccccgagacggcgggcgacagcgaggggaacctgatcccagggacgcacttacccagcaagttcacgtgcttagcctggatcagatcagagccattcgtaatactaacgaatacacagagggaccaacagtcgtccctaggccaggactaaaaccagctcctcgccctagcacacaacacaaacatgaacggctacacggcctgccagaacaccgacagccgccaagactgcagcacagccaggttcacagctctgcccgcgctcctctatctagaagcatttctacggtgtcctccggcagccgatcgtctacgcgaacatcaacaagcagcagtagcagtgaacaacgcctgctgggtagcagtttctcatctggtccagtggcagacggcatcattagggtgcaaccaaaatccgaacttaagcccggggagctaaagcccctgtccaaagaagatctcggcctgcacgcctacagatgcgaggattgtggaaaatgtaaatgtaaggaatgtacatatccaagaccactaccatcggattggatctgcgataaacagtgtctttgctccgctcaaaatgtgatcgattacggcacctgcgtttgttgtgtaaagggcttattctatcattgttcgaacgacgatgaagacaactgtgcggacaacccttgctcgtgtagccaatcacactgctgcactaggtggtcagcaatgggggtgatgtcgctgttcctcccttgtctgtggtgctatcttccagcaaaaggctgtctgaaattgtgccagggctgctatgaccgggtgaacaggccaggttgcaggtgtaaaaactctaacaccgtctgttgcaaggtacccacggtgccaccgaggaacttcgagaaacctacgtag

SEQ ID NO: 136164 - DNA, 948 bp, Artificial Sequence
  Description of Artificial Sequence: Synthetic coding sequence
atggaggcgagggctcaatctggtaacggctcgcagcccctgttgcaaactccgagggatggaggccgtcagagaggcgagcccgacccccgtgatgctttgacacagcaggtgcatgtgctatctctggatcagatacgagctatccggaatacgaatgaatacacagaaggacctaccgtggtcccaagacccggcctaaaacccgcgcctcggccaagtactcaacataagcacgaacgattgcatggattacccgaacaccgtcagcccccaagactccagcactcccaggtgcattccagtgcccgcgctccactgtcacgctcaatcagcacagtctcctccggatcaaggagcagcacccggacctccaccagttctagttctagtgagcagagactgctcggttcaagcttttcctcaggtccggtggcagacggcatcattagagtgcagcccaaatccgagctcaaacccggcgaactcaagcccctctccaaggaggatctgggcctccatgcttaccgatgtgaagactgcgggaagtgcaagtgtaaggagtgcacctacccccgacccctgccctccgattggatttgtgacaagcaatgcctgtgctctgctcaaaatgtgatagactacggtacctgcgtctgctgcgtcaaaggactcttctaccactgttctaacgacgacgaggacaactgcgccgataacccctgtagttgctcgcagagtcactgttgtaccaggtggtccgctatgggcgtaatgagcctgttcctcccttgtctctggtgctaccttcctgcaaagggctgtttgaagctgtgtcagggatgttacgatagagttaacaggccagggtgccgatgtaaaaactctaacacagtctgctgtaaggtccccacagttcctccgaggaatttcgagaagccgacatag

SEQ ID NO: 136165 - DNA, 1062 bp, Artificial Sequence
  Description of Artificial Sequence: Synthetic coding sequence
atggaagccagggctcagtctgggaatgggagccaaccactgttgcagacccctcgtgacggcggaagacagagaggagagcccgatccacgcgatgctttaactcagcaggtccatgtgctgtcgctggaccaaattagagctattcgcaacactaatgaatatacggagggcccaaccgttgtccctcgcccaggcttgaaacccgcaccccgcccatctacccagcataagcacgaacggttgcacggattgcctgagcacaggcagccacctcggcttcagcactctcaggtgcacagtagcgccagggctcccctgagcagatctatcagtacggtatcttccggaagtagatctagtacccggactagcacttcatcgtcctctagcgaacagaggctgctaggctcatccttctctagcggcccagtcgccgacggcataatccgcgtccagcccaaatcggaactcaagcctggcgaactcaagcctctttccaaagaagatttgggcctgcatgcctaccgctgcgaggactgtgggaagtgcaaatgcaaggagtgtacatatccaaggccccttccgagcgattggatctgcgacaaacagtgcctctgttccgctcaaaacgttattgattatggaacttgtgtgtgttgtgtcaagggcctgttttatcattgctcaaatgatgatgaggataattgtgcagacaatccttgcagttgtagccagtcgcattgctgtacccgctggagtgctatgggggtcatgtccttgttcctgccatgcctttggtgttacctgcccgcgaaaggttgcttgaaattgtgccagggatgttatgatagggtgaatcgtcctgggtgccgttgcaagaattcgaacaccgtttgctgcaaggtcccaactgtaccgccgaggaccttaaagaaccagcacagtataatcaaccaggaatactatagcaatgaggactttttcttccttttcctgatccatatttgcaaccagctaaacagctataacctgggaactgttaacagaaaagtggggtag

SEQ ID NO: 136166 - DNA, 867 bp, Artificial Sequence
  Description of Artificial Sequence: Synthetic coding sequence
atggatgctgcagtgaccgacgacttccagcagatcctcccaatcgagcagctgaggtctacccacgccagcaatgattatgtagagaggccgccagcaccgtgtaagcaggccttatcgtcccccagcttgattgtccagacccacaagagcgactggagtctcgctaccatgcctacttccctgccccggagtctgtcgcagtgccaccaactgcaacccctacctcagcatctgtcccagagttctatcgcaagcagcatgtcacacagcaccaccgctagcgaccagagactactcgcttcaatcacccctagtccaagcggtcagtctatcattcgcacccagccaggtgctggagtgcacccaaaagcggatggggcattaaagggagaggccgagcagtctgctggacacccctctgaacacctcttcatttgcgaggagtgcgggcggtgcaagtgcgtgccttgcaccgcggccagacctctgccatcgtgttggctgtgtaatcaaagatgcctgtgtagcgcagagagcctcctggattacggaacctgtttgtgttgcgtgaaggggcttttttaccactgtagcaccgacgacgaggataattgcgcggacgagccgtgttcctgtggcccaagtagctgtttcgtgaggtgggcagccatgtccctaatctccctgtttttaccatgtctgtgctgctacttaccaactagagggtgtctccatttgtgccagcagggttatgattcattgcggagacctggatgtagatgtaaacggcacaccaatacagtgtgcagaaaaatcagctccggctcagctccttttcccaaggcccaggaaaaaagtgtgtag

SEQ ID NO: 136167 - DNA, 378 bp, Artificial Sequence
  Description of Artificial Sequence: Synthetic coding sequence
atggacgccgcagtgacagatgatttccaacagatacttcctattgagcagctgcggagcacccacgcatcgaacgactatgtcgaacgaccacccgccccctgtaagcaggctctgtcttctccatctctgatcgtacagacccataaatctgattggtcactcgcaactatgcccacttcgctgccgaggtccctgagtcagtgtcaccaattgcagcccctaccacagcacctgtcccagtcaagcatcgcctcaagtatgagccattcaactacggcttcttctaccacagcccccctgatgatgaagaccacggtgctgatgtcccccgctctcgtgggattggttttggccctctctgccggacagccctag

SEQ ID NO: 136168 - DNA, 969 bp, Artificial Sequence
  Description of Artificial Sequence: Synthetic coding sequence
atgctcagtcccctgcctaccggcccgctcgaggcgtgtttcagtgtacaatcgcggacatcctctcctatggaacccccaattcctcaatcagctcctctgacaccaaactcagtcatggtgcagccgctcctcgatagcagaatgtcacattctcgtctacagcatccgctaaccattctgcctatcgaccaggtcaaaactagccacgtggagaatgactatatcgacaacccctccctagcgttgaccaccgggcctaagcgaacacggggcggtgcacccgagctggcccccacacccgcaagatgtgatcaagatgttacacatcactggatctccttctctggcaggccatcctctgtgtccagcagttcaagcacatcgtctgaccaaagactgctcgatcatatggccccaccacccgtggctgaccaggcgagtcccagagcggtgcgcatccagccgaaagtcgttcactgccaacctttagaccttaaggggcccgcagtgcctcctgaactagataaacacttcctcttgtgcgaggcctgtggcaagtgcaagtgcaaggaatgtgctagccctagaacgttgccatcttgttgggtctgcaatcaggagtgcctttgttcagcccagaccctggtcaactacgggacctgcatgtgtctggtccaaggaatattctatcactgcaccaatgaggatgacgaaggttcttgtgccgaccatccttgcagctgcagtaggtctaattgctgcgccaggtggagtttcatgggcgctctgtcagtggtgctgccctgtttattatgttacctcccagcaaccgggtgtgtaaagctggcccagcggggttacgataggctgcgaaggccaggatgtagatgcaaacacacaaacagtgtcatctgtaaagcagccagcggggacgcaaaaacgtccagacccgataagccattctag

SEQ ID NO: 136169 - DNA, 321 bp, Artificial Sequence
  Description of Artificial Sequence: Synthetic coding sequence
atggagcccccaattccccagtctgctccactcacccctaacagtgtaatggtccagccgttgttggactcaagaatgtcacattcaagactgcagcatcctctcactatcctccccatagatcaggtcaagactagtcatgtcgagaatgactatattgataatccctccctggcccttacaacagggccaaaaagaacgcgcggcggcgcccctgagttggcccccacaccagctagatgcgaccaggatgtcacccaccactggatctccttcagcggcagaccctgttcagctacatgcctccccccagctgcttag

SEQ ID NO: 136170 - DNA, 900 bp, Artificial Sequence
  Description of Artificial Sequence: Synthetic coding sequence
atggaaccacccatcccgcagtccgctcccttgaccccgaacagtgttatggtccagcccctactggactcacgcatgtctcacagcagactccaacatcctctcaccatattaccaattgatcaggtgaagacatcacacgttgagaatgactacattgacaatccctccctcgccctgacaaccggacctaaaaggacacgaggaggagcacccgaattagccccgactcccgcacgatgtgaccaagacgtcacacatcactggatctcattttcaggccgcccatcgagcgtgagctcatcttcctccacatcctccgaccaacgactgcttgaccatatggcccctccccctgtggccgatcaggcgtcaccgcgggctgtccgaatccaacctaaggtcgtgcactgccagcccttggatctgaaaggccccgcagtcccaccggagctggacaagcacttcctgctttgtgaagcctgcggtaagtgtaaatgcaaagagtgcgcatcccccaggacattaccttcatgctgggtgtgtaatcaggagtgcctctgttccgcacagaccctggttaactatggtacttgcatgtgcttagtgcaaggcattttttaccattgtactaatgaagatgacgaaggcagctgcgccgaccacccatgttcttgtagccggtctaactgctgcgcacgctggagctttatgggagccttgtcagtggtgttgccgtgtctcctgtgctacctgcccgcgacaggttgtgttaaacttgcgcagcgagggtacgatcggctcagaagaccaggctgtcgctgtaagcacaccaatagcgtcatctgcaaagccgcatccggagatgcgaaaacatcacggccagacaagcctttttag

SEQ ID NO: 136171 - DNA, 153 bp, Artificial Sequence
  Description of Artificial Sequence: Synthetic coding sequence
atggaaccccctattcctcagagcgcgcccctgacccccaactcggtcatggtacaaccactgttggattcacggatgagccacagccgcctccagcatccactcactatacttcccatcgaccaggtgaaaaccagccatgtggaaaattag

SEQ ID NO: 136172 - DNA, 1335 bp, Artificial Sequence
  Description of Artificial Sequence: Synthetic coding sequence
atgagcgaggagaccgctaccagcgacaacgataactcgtacgcgcgagtgagagctgtcgtaatgacgagagatgactctagtggcggttggcttcctttgggggggtcgggcttgagcagcgtgaccgttttcaaagtgccccaccaggaagagaatggctgtgccgatttttttattaggggcgaacgtctgcgggacaagatggtggtcctggaatgcatgctgaagaaagatctgatctacaacaaggtaaccccgactttccaccactggaagatcgatgacaagaagtttgggctcaccttccagagccccgcagatgctcgggcctttgacagagggatccgcagagctattgaggacatttctcagggctgtcccgagagtaaaaacgaggcagaaggcgccgacgatcttcaggctaacgaagaagacagcagcagttccctggtaaaggatcatttattccagcaggagacagtcgttacctcagaaccgtaccgaagtagcaacatccggccttccccattcgaggacctaaatgcccgaagagtatacatgcagtcacaagctaaccaaatcacttttggccaacccggtctcgatatccagtcgcgaagtatggagtacgtacaaaggcagatcagcaaggagtgtggttcccttaaatcccagaaccgggtacccctcaaatccattagacacgtttcatttcaggatgaagacgaaatagtaaggattaacccccgggacatactgattcgacgatacgccgactacaggcaccccgatatgtggaaaaatgatcttgagcgagatgacgctgactccagcattcaattctcgaagccagatagtaagaaatcagattatctgtattcttgtggagatgagacaaaactctcttcccctaaggattctgtggtgttcaagacacagccatcctccctgaaaatcaagaaatcaaagagaagaaaggaagatggggaaaggtcaagatgtgtttactgtcaggaaaggttcaaccacgaggaaaacgtgcgtggcaagtgccaggacgcccccgatcccattaagcgatgcatttaccaggtgtcttgtatgctgtgcgccgaatctatgttgtaccattgcatgagtgatagcgaaggggacttttccgacccatgcagttgcgacactagcgacgacaagttctgtcttagatggctcgccttagtcgccctgagttttatagtgccatgtatgtgctgctacgtccccctgcgaatgtgccatagatgcggagaggcttgtgggtgttgtggcggcaagcacaaagctgctggctag

SEQ ID NO: 136173 - DNA, 1257 bp, Artificial Sequence
  Description of Artificial Sequence: Synthetic coding sequence
atgaccgaggagacacacccggacgacgatagctacatcgtgcgcgtgaaggcagtggtgatgacccgggacgacagctcaggaggatggttcccgcaagaagggggaggaatctcccgtgtaggcgtgtgcaaagttatgcaccccgagggcaacggccggtctggatttctaatacacggagagcgacagaaggataagctggtggtgcttgagtgctacgtgcggaaagacctcgtgtatactaaagccaaccctacgtttcaccactggaaggtagacaatcgaaaattcgggctgacctttcagagcccagcagatgctcgcgcgtttgacaggggtgtgcgcaaagccatcgaagatctaatcgaggggtccactacttcgagcagcaccatccataacgaggccgagttaggcgatgatgatgttttcaccacagcaaccgacagttcgagcaatagttcgcaaaaacgtgagcagcctacccgcactatcagctcacctaccagctgcgaacaccggagaatctatacactgggacatctgcacgatagctaccctactgatcattatcacctggaccagcctatgccccgcccatatcgccaggtcagcttccctgatgacgatgaggagatcgttaggataaatccacgcgaaaaaatctggatgaccggctacgaggactacagacacgcccccgtcagagggaaatacccagatccgtcagaagatgccgactccagttacgttagatttgccaagggcgaggtgcccaagcatgattacaactacccctatgtagactcctccgattttggactgggcgaagaccctaagggccgcggtggcagtgtaattaagacacagccctcccgaggtaagagtcgacgccgcaaagaagatggagaacgttcacgttgcgtgtactgccgggacatgttcaatcacgaggaaaatagaagagggcattgccaggatgcccccgactccgtgaggacctgcatacggagggtctcctgcatgtggtgtgccgacagcatgctgtaccactgcatgtccgatcctgagggtgattacaccgacccctgctcctgcgacacgagtgatgagaagttctgcctgcgttggatggccttaatcgccctgtcattcctggccccgtgcatgtgttgctatctgccccttagggcttgctaccattgcggggtgatgtgtaggtgttgtggcggtaaacataaggctgctgcctag

SEQ ID NO: 136174 - DNA, 351 bp, Artificial Sequence
  Description of Artificial Sequence: Synthetic coding sequence
atgactgaggagacccacccagacgatgacagctacattgttcgcgtcaaggcagtcgtgatgacacgcgacgattccagtggaggctggtttcctcaggagggaggcggaatcagccgcgtgggagtgtgcaaggtcatgcaccccgaaggcaatggtagaagcgggtttctcatccatggcgagcggcagaaagacaaactcgttgtgctggaatgctacgttagaaaagacctggtgtatactaaggcaaatcctacattccaccactggaaggtggataataggaagtttggactcacttttcagagccctgcagatgccagggcattcgatcgcggtgtgcgatag

SEQ ID NO: 136175 - DNA, 1248 bp, Artificial Sequence
  Description of Artificial Sequence: Synthetic coding sequence
atggctagccccggatccgattcatatatcgtacgggtaaaagctgttgtcatgacaagagacgacagttcaggtggttggtttccacaggagggcgggggcatatcccgggttggcgtgtgcaaggtgatgcatccggaaggtaacggccgcagcggttttctgattcacggagaaagacagaaggataagctggtggtcctggaatgttacgttagaaaggacctggtgtacacaaaagcgaacccaacatttcaccactggaaagtcgataaccgtaagttcgggctgacattccagagccctgccgacgctcgcgcatttgaccgcggcgtaagaaaggccatcgaggacctgatagaggggagtacaacaagctcatccacgatccacaacgaggcagaattaggagacgacgatgtgttcacgaccgccacagacagtagctcgaactctagccagaaacgtgaacagccaacgaggaccatcagcagccctacttcgtgtgagcacagaaggatttacacactggggcatctacacgattcatatcctaccgaccactaccacctggaccaacccatgccaagaccctaccgccaggtctcattccccgatgatgacgaggaaatcgtgcgaattaatccccgggagaaaatttggatgacaggttatgaagactaccggcacgcccctgtccgcggaaaataccctgacccaagtgaagacgctgactcctcctatgtcagattcgcaaaaggagaagtgccgaagcatgattataattatccatatgtagacagttcggattttggcctcggtgaggaccccaagggaaggggggggtccgtgatcaagactcagccttctaggggcaaaagtagaaggagaaaggaagacggggaacgatctcggtgcgtgtattgccgcgacatgttcaatcatgaagagaatcggcggggccattgtcaggacgctcctgacagtgtgcgtacctgtattcgccgcgtgagttgtatgtggtgtgccgattctatgctctatcattgtatgtcagatccagagggcgattataccgatccctgcagttgcgacacttccgacgaaaagttctgccttagatggatggcactgatagccctgagctttcttgccccgtgtatgtgctgctacttgcctttgagagcctgttatcactgtggagtaatgtgccgttgctgcggcgggaagcataaagccgctgcttag

SEQ ID NO: 136176 - DNA, 1233 bp, Artificial Sequence
  Description of Artificial Sequence: Synthetic coding sequence
atggtccgagtaagggctgttgttatggctcgcgacgatagtagcggtggatggctacctgtcggcggggggggtttatctcaggtgtctgtttgtagagtgcgaggcgccagacccgagggcggggcacgccagggtcattatgtgatccacggtgagaggctgcgagatcaaaaaaccactcttgagtgcacacttaagccaggcctcgtttataacaaagtgaaccccattttccaccactggagtttgggggattgtaagttcggcctgaccttccagtccccagcggaagccgacgaattccaaaagtcacttctggctgctctcgcagctctcgggagagggtcactgaccccctcaagttcctctagttcttcgagtccatcacaagataccgcagagacaccttgccctctcacctcccacgtcgatagtgatagtagctcatcacacagccgccaggaaacacctccaagcgccgccgccgctcccattatcactatggagtccgcatccggcttcgggcccaccacaccccctcagcgtcgccgcagtagtgcccagagttacccccccctgctaccttttaccgggattcctgaaccgtccgaacctttggcgggggccgggggtctgggttggggaggcaggggatatgaagattacaggcgaagtggcccaccagcccctcttgccctgtcaacctgcgtcgtgcgatttgcaaagaccggagcgctgcgtggcgcagctttaggccctccagcggcactgcctgctccacttaccgaggcagccccccccgcccctcccgctagaccgcctcccggtcctggtcctagcagcgcacccgctaaggcaagtcccgaagcagaggaagcagcacgttgtgttcattgtcgagccctgttccgcagacgcgcagacggaaggggggggaggtgcgctgaagcgcccgatcctggccgcttactggtgcgtaggttgtcttgtctctggtgcgctgagagcctcctctatcactgcctgtctgatgccgagggagatttcagcgatccatgcgcgtgcgagccagggcatccccgccctgctgcacgatgggccgcactcgctgccctgagcttagctgttccctgcctgtgctgttatgcccctcttagggcatgtcattgggtggctgcaagatgtggctgcgctggatgcgggggtcggcacgaagaagctgcaagatag

SEQ ID NO: 136177 - DNA, 459 bp, Artificial Sequence
  Description of Artificial Sequence: Synthetic coding sequence
atggttcgggtcagagctgtggtaatggcacgcgacgattctagtggaggatggctgcccgtgggaggcggaggtctgtctcaagtctctgtgtgccgcgtgcggggtgcaaggccagaggggggggctagacagggccattacgttatccatggcgagcgtttacgggatcagaagacaaccttggaatgcacgttgaaacccgggctggtgtacaacaaggtcaacccaatttttcaccactggtccctcggcgactgtaaatttggtctgacgttccagtcccccgccgaggccgacgaattccaaaaatctctgctcgcagccctagctgctctcggccggggaagcctcactccgtccagttcctctagctcttctagcccttcccaggacaccgctgaaaccccttgtccgttaactctatcccaatattttaggcacatgctctgtccgtag

SEQ ID NO: 136178 - DNA, 1725 bp, Artificial Sequence
  Description of Artificial Sequence: Synthetic coding sequence
atgtggacattcctcggtatcgctacgttcacatatttctacaagaagttcggggacttcattaccttagccaaccgagaggtcctgctgtgcgtcctggtattcctttcgctcggcctcgtcttgagctataggtgtcgccacaggaatgggggactgttggggcgccagcagtctggcagtcagttcgccctgttttcggatatactctctggcctgccattcatcggttttttctgggccaagagtccccccgaatccgagaataaagaacagctggaagctaggaggaggaggaaggggactaacatctcggagacatcactgattggtactgctgcctgtacttctaccagcagccagaatgacccagaggtaattatcgtaggtgccggcgtcctgggatccgccctggctgctgtgttatcccgcgatgggagaaaggtgaccgtgattgagcgggacctgaaagagccagaccgcattgtgggggaattcttgcagcccggagggtaccatgttctcaaagatttgggactcggcgatactgtcgagggccttgacgcacaggtcgttaacggctatatgattcacgatcaggaatcaaagagcgaggtgcaaatcccgtacccactctccgagaacaaccaggtgcagtctgggcgggccttccaccacgggcgattcatcatgagcctgcgtaaggccgcaatggcagagcccaatgctaaattcatcgagggcgtggtcctgcagctgttagaggaagacgacgtggtcatgggagttcagtacaaagacaaggaaacaggggacattaaggagctgcacgctccgcttactgtggtggctgacggtctgttttcaaagttcaggaagagtttagtcagcaacaaggtgtcggtttcttctcacttcgtaggtttcctgatgaaaaatgctccacagtttaaggctaaccacgcagagctgatcctggccaacccttctcccgtgttgatctatcaaattagtagttccgagaccagagtcctggtcgacattagaggcgaaatgccacgtaaccttagggagtatatggttgagaagatttatcctcagattcctgatcacctcaaggagccttttctagaagccaccgacaattcacatttacggagcatgccagcctcttttctgccgccctcaagtgtgaaaaaacggggtgtcctgctgctcggcgacgcctataacatgaggcacccattgacagggggagggatgaccgtcgcattcaaggatatcaagctttggcgtaagttactgaaagggatcccagacctctacgatgacgctgcaatctttgaagccaaaaaatccttttattgggctagaaagactagccattccttcgtggtgaacatactggctcaggccctgtacgaactgttctcagctactgatgattcgctccaccaacttcgtaaagcttgttttctttacttcaaactgggaggggagtgcgttgcaggcccagttggtctgctgtctgtgctgtcccctaaccccctggtgctcattggtcactttttcgccgttgctatctacgctgtatatttctgttttaaatccgagccgtggataactaaacctagggccttactttctagcggagcagtgctgtataaggcgtgcagtgtgatctttcctctgatctattcagagatgaaatacatggtgcattag

SEQ ID NO: 136179 - DNA, 1440 bp, Artificial Sequence
  Description of Artificial Sequence: Synthetic coding sequence
atgttaaggcgcaaggggaccaatatctccgagacatcacttatcgggaccgcagcctgcacatctacttcatctcagaacgaccccgaagtaatcatcgtcggagcgggcgttctcggctcagccctggcggccgttctgtccagagacgggcggaaggtgacggtcattgagagagatcttaaagagcctgaccgaattgtgggcgagtttctgcaacccggagggtaccatgtgctaaaggacctcggacttggcgatacagtggagggcctggatgctcaagtggttaacggttatatgattcacgaccaagaaagtaagagcgaagtgcagattccctatcccctgtctgaaaataaccaagtgcaaagtggccgagcttttcatcatggtagattcataatgagtctccggaaggcggcaatggcagaaccaaacgcaaagttcatagagggggtggtactccagctcctcgaggaagacgacgttgtcatgggtgtgcaatacaaagacaaagaaaccggagacataaaggagctgcatgcgccactgacagtggtggctgatggtctattcagcaagttccgtaagtccttagtgtcaaataaagtgagtgtctcctcccactttgtggggttcctgatgaaaaacgccccccagtttaaagccaatcatgcagagcttatcctcgccaacccctcacccgtcctgatatatcagatctcctcgtccgaaacccgggttttggtggatatccggggcgaaatgcctagaaatctcagggaatatatggttgaaaaaatctatcctcagatacctgatcacctgaaggaaccttttctcgaagccactgacaatagccacttacggtctatgcctgcctcctttctgccacccagtagcgtgaaaaagcgaggggtgctgcttctgggtgacgcctacaacatgaggcatcctttgaccggcggtggcatgacagtagccttcaaagacataaagctctggcggaagctgctgaagggtatccccgacttgtatgatgatgccgccatattcgaagctaagaaatcgttctactgggctcgcaaaaccagtcacagctttgtcgtaaacatccttgcccaggccctgtatgagctcttctcagccacagatgactccttgcatcagctgagaaaggcatgtttcttgtacttcaagctgggcggagagtgtgtcgcaggcccggtggggctgctctctgtgctgtccccaaacccgttagtgttaattggccacttcttcgccgtcgcaatctacgcggtatacttctgttttaaaagtgagccctggataactaagccacgagcactgctgtcctctggtgcggtgctgtataaggcttgctctgtgatattcccactgatctatagtgaaatgaagtacatggtgcactag

SEQ ID NO: 136180 - DNA, 1140 bp, Artificial Sequence
  Description of Artificial Sequence: Synthetic coding sequence
atgattcacgatcaggagtcgaaatctgaggttcagatcccttaccctctgtccgaaaataaccaagtccagagcggtagagcgttccaccatggccggttcataatgtcgctgcggaaagccgccatggctgaaccgaatgctaagtttatcgagggagtggttctacagttgttggaggaggatgacgtcgttatgggggttcagtacaaggacaaagaaaccggcgatataaaggagctgcatgcaccgttaaccgtcgtggcggacggcctcttttccaaatttcgcaaatccctggtgtccaataaagtttcggtatcaagtcatttcgtgggatttctgatgaaaaacgctccccagttcaaagctaaccatgctgaactgatcttagcgaatccttctcccgtgttgatttatcagatctcctctagcgaaaccagagtgctggtggatatcagaggcgagatgcctagaaacctccgggaatatatggtagagaagatctatccacaaatccctgaccaccttaaggaaccctttcttgaggcaaccgacaatagtcatcttcgctccatgccagcaagcttcctccccccttcctcagtgaagaaacggggcgtgttacttctgggcgacgcctataacatgaggcaccctctgacagggggcggcatgaccgtggcattcaaggacataaagctgtggagaaagcttctgaaggggatcccagatttatacgatgacgctgccatcttcgaagcgaagaaatctttctactgggcccgcaagacaagtcacagttttgtggtcaatatactggcacaggctctgtacgagctatttagtgccaccgacgattctctgcatcagcttagaaaggcctgttttctgtacttcaaactcggaggggagtgcgtcgctggtcctgttggtctgctttccgtactgagtccgaatccattagtcctgattggccatttctttgcggtcgccatatatgcggtatacttctgcttcaaaagcgaaccctggatcacaaagcccagggccctcttgtcgagtggcgccgtgttatacaaggcctgctccgtcatcttccctctgatttactctgagatgaaatatatggtgcactag

SEQ ID NO: 136181 - DNA, 822 bp, Artificial Sequence
  Description of Artificial Sequence: Synthetic coding sequence
atgaagaagacacagacatggatcctgacctgcatctatctccagctgctcttatttaacccccttgttaaaactgaagggatctgtaggaaccgcgtgacaaataacgtgaaagacgtgacgaagctggttgctaaccttccaaaggattacatgattactttgaaatatgttcccggcatggacgttctaccttctcattgctggatcagcgagatggtggtgcaactctcagacagcctgaccgatctgctggacaagttctctaacatttctgaggggctgtccaactacagtatcatcgacaagctcgtaaacatagtcgatgatctggtagagtgtgtgaaagaaaattcctctaaggaccttaaaaagagctttaagtcaccagaacctcgcttatttactccagaggagttttttagaatattcaatcggagcattgacgccttcaaggatttcgtggtggcatccgagacctcggattgtgtggtctcctctacgctttcaccagagaaggatagccgcgtgtcggttactaaaccattcatgctgccacctgtcgctgctagctcgttgagaaatgacagctcaagcagcaacagaaaagctaagaatccccccggagacagtagccttcactgggcagccatggccctaccggccctgttttctctgatcatcgggttcgcatttggtgccctttactggaagaaacgtcaaccttcattaacccgcgcagtagagaacatccagataaatgaggaagacaatgagatcagcatgttgcaagaaaaagaacgagaatttcaggaggtgtag

SEQ ID NO: 136182 - DNA, 2100 bp, Artificial Sequence
  Description of Artificial Sequence: Synthetic coding sequence
atgaggctgagaaggttgggccagggagggcgatgctatcggggactctggcccctgcggcacacccgtccctggagctcacctggggaatacgaatgggaatacgacgaggaggaggagaaaaatcaattggagatagagaggttggaggaacaactgtccattaacgtgtacgattataattgccacgttgacctcatccggctgctacggctggagggcgagctgaccaaagtgaggatggcccgacagaaaatgtcggagattttccccttaacggaagaattgtggctcgagtggctccacgacgagatttctatggctcaggacggcttagatcgagagcacgtctacgacctgttcgagaaagccgtcaaggactatatatgccctaacatctggttggaatacggtcagtactccgtgggcggcataggacaaaaaggggggctggagaaggtgcgtagcgtgttcgagcgcgccctttcctccgtgggtcttcatatgacaaaaggtttggctctgtgggaggcttatcgggagtttgagtccgctatcgtagaagccgccaggctggaaaaggtccactcgctgttccgccgacaactggccatccctctctatgatatggaagctacatttgctgagtatgaagagtggtcagaggatcccattcccgagtcagttatccagaactataacaaagccctacagcagctggagaaatacaaaccatatgaggaagccctcctccaggccgaggcccccaggctggccgagtaccaggcctatatagacttcgagatgaagatcggggaccctgcaaggatccagttgattttcgagagggcactggttgaaaactgtttggtccccgatctctggatccgatacagccaatatcttgacaggcaattaaaagtgaaagatctggtgttgtccgttcacaacagagctattagaaactgtccgtggactgtcgcactgtggtcccgctacttgttagctatggagcgacacggagttgatcatcaggtgatctctgtgaccttcgaaaaagctcttaatgcaggttttatccaggctaccgattatgtggaaatttggcaggcctacttagactacctaaggaggagggtggattttaagcaagatagcagcaaggaactggaggaattacgggccgcatttacaagggccttggagtacttaaagcaagaagtcgaagagagattcaacgaatcgggcgaccccagctgcgtgatcatgcagaactgggccagaatagaggccagattgtgcaacaatatgcagaaggcccgcgaactgtgggatagtatcatgactcggggcaatgccaagtatgcgaacatgtggttagagtactacaatttagagagagcacacggtgatactcagcactgccgcaaagcactgcacagagccgtgcagtgcacaagcgactaccccgagcacgtctgcgaggttcttcttactatggaacgtacagaggggtcgcttgaagactgggatatagctgtacaaaaaactgagactaggctggccagagttaacgagcagcgcatgaaagctgcggagaaagaggccgccctggtgcaacaggaagaagagaaggctgagcaaagaaagcgcgccagagctgaaaagaaggcccttaaaaaaaaaaaaaaaatcagggggcctgaaaaacggggggcagatgaagacgatgagaaggagtggggagatgatgaggaagcctttcagacccaaaaaggcagagagcagcatccctgctcttggcgcaacacaaagtgtaggagctctagcagagctcggtgggagatgtgttgtcgacgctgtggagctccattcgaggccgagggggaaggtagtttacctgaggaagggcatgcacagggagcagctagacagcagcagggccagcaccataggctatgtcaacaaccagctttacaacacgcaggggctggtcacgaagcccaggccacccttaggggcctctggggcggcggccctgaccctacccaccttcaacagccctggggatttccaagactgctcttacgtggagtctag

SEQ ID NO: 136183 - DNA, 2784 bp, Artificial Sequence
  Description of Artificial Sequence: Synthetic coding sequence
atggccactgcagcggaaacctccgcaagcgagccggaggccgagtctaaggccgggccgaaagcagacggcgaggaagatgaagtcaaagcggcgaggacccggcgcaaagttcttagtcgggccgtcgcagcagccacttataagaccatgggaccagcctgggatcagcaggaggagggcgtcagcgaatctgatggggatgagtacgctatggcatcctctgcagagtcatctcccggagagtatgagtgggagtatgatgaagaggaggaaaaaaatcagctggagattgagcgcctggaggagcagctgtcaataaatgtttatgattacaactgccacgtggacctgatccggttgttaagactggaaggggaactcaccaaggtgagaatggcccggcagaaaatgagcgagatttttcccctgaccgaggagctatggctcgaatggctccacgacgaaatctctatggctcaggacggactggacagggaacacgtttacgatctgttcgagaaagccgtgaaggactacatatgcccaaacatatggttggagtacggccagtactcagtgggtggcatagggcagaaaggaggcctagaaaaggtacggagcgtatttgagcgtgcactgtccagcgtgggattacacatgactaaaggtctggctctctgggaagcctacagggagttcgagtctgcaatcgttgaggccgcacgtctggaaaaggtacattctctgttcagacgtcagctcgccatccctctctacgacatggaagccacattcgcagagtatgaagagtggtctgaggacccaattccagagtctgtgatccagaactacaacaaggcgttgcaacagcttgaaaagtacaagccttacgaagaggctttactccaggcagaggcccccaggctcgccgagtaccaagcatacatcgattttgagatgaagatcggggacccggctcggattcagctgatatttgagcgggcactagtggaaaactgtctggtgcctgacctttggattcgctactcacaatatctggatcgacaactgaaggtaaaggatctggtgttatcagtccataatagagccataagaaactgcccttggaccgttgcactctggtccagatacctgctggccatggagagacatggggtggaccaccaagtgatcagtgattcttctaaggaactggaggaattgcgggcagcatttacaagagcgctggagtatttgaagcaggaagtggaagagcgcttcaatgagagtggggaccccagctgcgtgattatgcaaaactgggctaggattgaagccaggctgtgtaataatatgcagaaggcgcgggagttgtgggacagtattatgactaggggcaatgccaagtatgccaatatgtggctggagtactataatctcgagcgcgcacacggggatacacagcactgtcggaaagctctgcatcgggctgtgcagtgcacatcagactatccagaacacgtctgtgaagtgctgctgaccatggagagaaccgagggatctctggaagactgggatatcgctgtgcagaaaactgagactaggctcgccagagtgaatgaacagcgcatgaaagccgcagagaaggaggcagctctggtgcagcaagaggaggaaaaagctgaacagaggaagcgcgcaagagctgagaaaaaggctctgaagaagaagaagaagattcgtggcccagagaagcgaggagccgacgaggacgacgagaaggagtggggcgacgacgaggaggagcagccttccaaacgtcgtagagtcgaaaacagtattcccgccgcaggcgagacacaaaatgttgaggtcgccgccggaccggcagggaaatgtgccgccgtcgacgtagagccgcccagtaagcagaaggagaaggctgcctccctgaagcgggatatgcccaaggtgctgcatgatagctccaaagattctattactgtgtttgtcagcaatctgccatactccatgcaggagcccgacacaaagctgcggccgctgtttgaggcatgcggcgaggtagtccaaataagacccatttttagcaaccgcggtgattttaggggatactgttacgtggaatttaaggaggagaagtcggccttgcaggcccttgaaatggataggaaaagcgtagagggaagacccatgtttgtcagcccctgtgtagacaagtctaagaatcccgacttcaaagtcttccgctattcgacttcactagaaaaacacaaactctttatttcaggcctgcccttttcctgtacgaaagaggagctggaggagatctgtaaagcacacggcacagtaaaggacctccgcctggttactaacagggctggcaaaccgaagggtttagcttacgtggagtacgagaatgaatcacaggctagccaggctgttatgaagatggacggtatgactatcaaagagaatataattaaagtcgccatttctaaccccccacagcgtaaggtgcctgaaaagcctgagaccagaaaggctccgggcggccccatgttgctcccacagacatatggggccagaggcaagggacgaactcagctgtctctactgcccagagccctgcagcgacccagtgctgctgctcctcaggccgaaaacgggcccgccgcggcacctgcggtggctgcacccgcagccactgaggccccaaagatgtcaaacgccgacttcgcaaagctcttccttagaaagtag

SEQ ID NO: 136184 - DNA, 1587 bp, Artificial Sequence
  Description of Artificial Sequence: Synthetic coding sequence
atggagcggcatggggtagaccatcaggtgatctccgattccagtaaggaactggaagaactgagggcagccttcacccgggccctagaataccttaaacaggaagttgaggaacgattcaacgagagcggtgacccatcctgcgttattatgcagaactgggcccgaattgaagctcgcttgtgtaataacatgcagaaggctcgcgaactgtgggactccattatgacgagaggcaatgccaagtatgccaacatgtggttggagtactacaacctagaacgcgcccatggggacacccaacactgcaggaaagctttacacagagccgtgcaatgcacaagtgattaccccgaacacgtctgcgaggtgctcctcactatggaacggaccgaggggagccttgaggattgggatatagctgttcaaaaaaccgagactagactggcacgcgtcaatgaacagcggatgaaagctgccgagaaggaagcggccctggtccaacaagaagaggagaaagccgaacagcgcaagagagcacgggctgaaaaaaaggccctgaagaagaagaaaaagatccgcggaccggagaagcgtggcgctgacgaagatgatgaaaaagagtggggcgacgatgaagaggagcaaccaagcaagcggcgtcgtgttgagaactctatcccagcagccggggagacacagaatgtggaggtggccgcaggcccagccggcaaatgtgctgccgtggatgtcgagcccccgagcaagcagaaggagaaagcagcatccctaaaacgcgacatgcccaaagtgttgcacgattcaagcaaggactctatgcaggagccagacacaaagctgcgcccactcttcgaggcgtgcggagaagtggtccagatcaggcccatttttagcaataggggagactttcgaggttactgctatgtggaatttaaggaggagaaatctgccctccaagcactcgagatggaccggaagagtgtcgaaggaaggcccatgttcgtgtccccctgtgtcgataagtctaaaaaccccgacttcaaagtatttcggtattcaactagtttggaaaaacacaaactctttatttctggcctgccctttagttgcactaaagaggagttagaagagatctgcaaagcccatggcaccgtcaaagacttacgcctggtgaccaatagagctggaaagccaaagggtcttgcctacgtagagtacgagaacgagtctcaagcatcccaggccgtaatgaagatggatggcatgactataaaggagaacatcattaaggtcgccatcagcaatcccccccagcgtaaggtccccgaaaagccagagacaagaaaggcgcctggaggacctatgctgctgccgcagacatacggcgctagaggcaaaggccgaacccagctctctttgctgccccgcgcgctgcagcggccatcagctgccgccccccaggctgagaatgggccggcagccgcccctgccgtcgctgcccccgctgccaccgaggctcctaaaatgtcaaatgctgatttcgccaaactgttcctgcggaaatag

SEQ ID NO: 136185 - DNA, 390 bp, Artificial Sequence
  Description of Artificial Sequence: Synthetic coding sequence
atggcaactgctgcagaaacatcagccagtgagcctgaggcagaaagcaaggcaggtcctaaagctgatggtgaagaagatgaagttaaggcggcaagaacaagacgcaaggtgctgagccgtgcagtggcggccgcgacctataaaaccatgggccctgcttgggaccagcaagaggaaggagtcagcgagagtgatggggacgagtatgccatggcctcttcagccgaaagctcaccgggagaatacgagtgggagtacgatgaggaggaagagaagaatcaactcgaaatagaaagactcgaggagcaggtgggcccaggcgttggtagcggacatctccccgtgttccaagtgcttggatcgccatgcccggggccacccccatag

SEQ ID NO: 136186 - DNA, 330 bp, Artificial Sequence
  Description of Artificial Sequence: Synthetic coding sequence
atggccgcatccgcggcccgcggagctgctgcactgagacggagtataaatcagccagttgcctttgtgcgccggattccttggactgcggcaagtagccagttgaaagaacacttcgcccagtttgggcatgtgcgccggtgcattctgcccttcgataaagaaaccggattccaccgagggctcggatgggtgcagttcagctcagaggaaggcctgcggaatgcccttcaacaggaaaatcacattatcgatggtgttaaagtgcaggtgcacactaggcgacccaagctgccacagacttccgacgatgaaaaaaaggacttttag

SEQ ID NO: 136187 - DNA, 894 bp, Artificial Sequence
  Description of Artificial Sequence: Synthetic coding sequence
atggctaaatggcttaataagtatttttctctgggaaattctaaaacgaagagccctccccagccacctcgcccagactaccgggaacagagacgcagaggcgagcgcccgtcccagcctccacaggctgttccccaggcctcttctgccgctagcgctagttgtggtcctgcaacagcatcctgtttttccgcttcctctggcagtttgcctgacgatagcggcagtacgtccgatctgattcgtgcataccgggcacaaaaagaacgggacttcgaggacccatacaacggtcccggttctagcctaagaaaactccgcgctatgtgccgtttggattattgcggcgggagcggggagccgggcggcgtgcaaagggctttcagcgcaagctccgcttcgggagccgctggatgctgctgcgccagcagtggagccggagccgccgcatcatcctcctcaagttctggctctccacacctataccgatcatcttccgagcggaggccagccacacctgccgaagtgcgctacatctcacccaagcacaggcttattaaagtagaatcagctgctggcggtggagccggcgatcctctgggcggcgcctgcgccggaggaagaacctggtcaccaacagcttgtggaggaaaaaagctgttgaataagtgtgctgcatcagcggctgaggaatccggtgccggcaagaaagacaaggttaccatagccgatgactattctgacccctttgatgctaaaaatgacctgaaatcaaaagccgggaagggtgagtccgctggctacatggagccatatgaggcccagcggattatgaccggtctccaagaggcatggcgacatagcccaagcgggtgctttcccgtgggtccatag

SEQ ID NO: 136188 - DNA, 1530 bp, Artificial Sequence
  Description of Artificial Sequence: Synthetic coding sequence
atggctaagtggctgaataagtactttagcctgggcaattctaagaccaagtccccccctcagcccccacgccctgactaccgtgagcagagacggcgcggcgaacgcccaagtcagcccccacaagccgtgcctcaggctagcagcgcagctagtgcaagctgtggaccagcaaccgccagctgctttagcgcctccagcggcagtctgccggacgatagcggatctacctccgatttgatccgcgcttacagggctcagaaagaaagagactttgaggatccgtataatgggccagggtctagtttgagaaagctgcgcgccatgtgtcgcttagactattgtggaggaagcggagaacccggaggcgtacaacgcgcattcagtgcctcatccgccagtggcgccgcaggatgctgttgtgcctcgtccggagcaggcgctgcagcctcctcctcttcctcaagcggaagcccgcacttgtataggagctcaagcgagcgacgaccggccacgcccgccgaggttaggtatatttcccccaaacaccgacttatcaaggtggaaagtgctgccggtggtggggccggggatccgctcggcggggcatgcgcagggggcagaacctggtcccctactgcctgtgggggtaagaaactgctgaataagtgcgccgcgagtgctgcagaggagtctggggcaggaaagaaggacaaagtgaccattgccgacgactacagcgatccattcgacgcaaagaacgacctcaaatcgaaggcgggtaagggggagagcgctgggtacatggaaccctatgaggcacagcgcataatgactgagttccagagacaggagtctgttagatctcagcataaaggcattcagctatacgataccccatacgagcctgagggacagagcgtagattccgatagcgaaagcaccgttagcccacgattacgagagagcaagttgccccaggacgacgatagacctgctgatgagtacgatcaaccgtgggagtggaacagagtcactataccagccttggcagcccagttcaacggaaacgagaagcgccagtcttctcctagcccctctagggatagacggcggcaactccgcgccccaggagggggatttaagcctatcaagcacgggtcacccgaattttgtggaatcctcggagaacgcgtggaccctgcagtgccactggagaagcagatctggtaccacggagccattagtcgaggcgatgcagaaaacttgctgagactgtgcaaggaatgctcatatttggtgcgcaattcccaaacatcaaagcacgattactctctctcactccgcagcaatcagggctttatgcatatgaagctcgccaagacgaaggagaaatatgtcttggggcagaattcaccgccattcgactctgtacccgaagtgattcactattacaccaccaggaaactgccaataaaaggtgctgaacacctcagtctgctgtatccagtcgcagtgcgcactctgtag

SEQ ID NO: 136189 - DNA, 1080 bp, Artificial Sequence
  Description of Artificial Sequence: Synthetic coding sequence
atgcaagcggccgccttgccagaggagattagatggctgctggaggacgccgaagagtttctggcggaggggctcagaaatgaaaatcttagcgcagtcgccagagaccatcgagatcatatcctgcgaggatttcaacagataaaggcacggtattattgggactttcagccccagggtggggacatcggccaggactcctcggatgataaccacagtggaaccttggggctgagtctgacgtccgatgcgccgtttctctcggactaccaggatgaagggatggaggatatagttaagggagctcaggagctggataatgttatcaagcaggggtatctcgagaagaaaagcaaagaccatagcttcttcggatccgaatggcagaagaggtggtgcgtggtctcccgcggactgttctattactacgcaaacgagaagtcaaaacagccaaagggtacattcctcattaagggatacggtgtgaggatggccccacacctcagaagggacagcaaaaaggaatcttgctttgaattgacctcccaggataggcgctcctatgagtttacagcgacctcccccgccgaagcacgggactgggtggatcagataagcttcctcctaaaggacctgtcctcgttgaccatcccctacgaggaagacgaggaggaggaggagaaggaggaaacttacgatgacattgatgggttcgatagtccttcctgcggctctcagtgtcggcccaccatcttgccgggttctgtgggtattaaggagcctacagaagagaaggaagaggaagacatttatgaagttctccccgacgaggagcacgatctggaagaagacgagagcggaaccaggcgtaagggggttgactatgcaagctattatcaaggactttgggactgccacggagaccagcccgatgaattatcatttcaaaggggtgaccttatcaggattttgagtaaggagtataacatgtacggttggtgggtgggggaactgaactctctggttgggatcgttcccaaagagtacctgaccacagccttcgaagtcgaggagcgctag

SEQ ID NO: 136190 - DNA, 831 bp, Artificial Sequence
  Description of Artificial Sequence: Synthetic coding sequence
atgggcaactcaatgaaatctactccggctcccgctgagaggccattgccaaatccagagggactagattctgattttctggccgtgctgagcgattaccctagtcccgatatatcccctcccatctttagaaggggggaaaagctgcgcgtgattagtgacgaggggggctggtggaaggcaattagcttgtcgacaggtcgggaatcctatatccccggtatctgtgtggccagggtgtatcacggttggctgttcgagggcctcgggcgggataaggccgaggagctcctccagttgcctgacacgaaggtgggctcgttcatgatacgggaatcagaaactaaaaagggcttttattccttgtcagtccgtcaccggcaggtcaaacactacaggatattcagactgcctaacaactggtactatatctcaccacgcctaacctttcaatgccttgaggacctagtaaaccactacagcgaagtcgccgacgggctttgttgcgttctgaccactccctgccttactcaatctactgctgcacctgccgtcagggcgtcttcaagccccgtgacactacgacaaaaaacggtggactggagaagggtcagtagattgcaggaagaccctgaggggactgagaaccccctgggggtcgacgaaagtctcttttcctacggcctgcgggaatccatcgccagttatctgagcttgacatccgaggacaacactagctttgaccggaagaaaaagtccatctcactcatgtatggaggatcaaaaagaaagagctcttttttcagctctccaccctactttgaagattag

SEQ ID NO: 136191 - DNA, 882 bp, Artificial Sequence
  Description of Artificial Sequence: Synthetic coding sequence
atgctccacagactctgggcctcacccgctgcccctggtaaaaaaaaggagatgggcaactcaatgaagtctacacccgcccccgcggaacgacctctgccaaatccggaaggattggatagtgactttctagccgtcctctccgattatccttctcccgacatcagccctccaatttttcgccgtggagaaaagctgcgcgttatctccgacgagggtgggtggtggaaagctatctctcttagcaccgggagagaaagctacattcccgggatttgcgtggcccgggtttatcacgggtggctcttcgagggacttggaagagacaaggcagaggaactcctgcagctgcctgataccaaggtgggaagctttatgattagagaatctgaaaccaaaaagggcttttacagtttgtccgtacggcacagacaggtgaaacactaccgtatatttcggctgcccaacaattggtattacatctctcccagactaacttttcagtgcttggaggatctggtgaatcactattctgaggttgctgacggcctttgctgcgtgcttacgacaccctgccttacccaatctacagctgcgccggccgtcagggccagctcaagccccgtgaccctccgtcagaagacagtcgactggaggcgcgtgagccgcctgcaggaggaccctgagggtacggaaaaccccctaggcgttgacgagagtctcttcagttacggcttgcgggaaagtattgcttcgtacctgtccctgactagtgaggataatacatcctttgatcggaaaaaaaaaagcatttccctcatgtacggcggaagcaaaagaaagtccagcttttttagctcacccccctatttcgaagactag

SEQ ID NO: 136192 - DNA, 951 bp, Artificial Sequence
  Description of Artificial Sequence: Synthetic coding sequence
atgcttagtaagctgggtcacagccccctcgggggacttcgagcaagactaaccttccccgtctgtttactttatcacaggctgtgggccagcccagctgcccccggcaaaaaaaaagagatgggtaatagtatgaaatcaacacctgcccccgccgaacgcccactaccgaatcctgaggggctggatagtgactttctggcagtgctcagcgactatccctcacccgacatctctcccccgatctttcggaggggcgagaaactcagagtgatttccgatgaggggggatggtggaaagccatctcactgtccaccggcagggaatcttacatccctggtatttgcgtggcaagggtctaccatgggtggttgttcgaaggactggggagggataaagccgaagaattactgcaattgccagatacgaaagtcggtagctttatgattcgtgagagcgagactaagaagggtttctatagtctttctgtccgccaccgccaagtaaagcattaccggatcttcagactgcctaacaactggtactatatcagcccaaggcttacttttcagtgtctcgaagatctggtcaatcactacagcgaggtggccgatggcctttgttgcgtgctgaccacgccctgtctcacacaaagcaccgcagcaccagctgttcgggctagttcttcaccggtcactctcagacagaagaccgtggattggcgacgcgtgtcccggctgcaggaagacccagagggaacagagaatccacttggagtcgacgaatccctcttctcttatggccttagggagtctatagcttcctacttgagtctgacgagcgaagacaacacctcgtttgatcggaagaagaaatctatcagtctcatgtacggaggaagtaagaggaaatctagctttttttcctcaccaccttattttgaggactag

SEQ ID NO: 136193 - DNA, 276 bp, Artificial Sequence
  Description of Artificial Sequence: Synthetic coding sequence
atggggaactcaatgaaatccactccagcccccgcagagcgtcccttgccaaatcctgaggggctggatagtgactttttggccgtgctgagcgattacccctccccggacatcagcccgccaatctttaggagaggcgagaagctacgcgttatatcagacgaaggagggtggtggaaggccataagcctgtcaacgggtcgggaatcttacattccaggtatttgtgttgcccgggtgtaccatgggtggctgttcgaggggctgggtaggtag

SEQ ID NO: 136194 - DNA, 45 bp, Artificial Sequence
  Description of Artificial Sequence: Synthetic coding sequence
atgggcaactctatgaagtccacgcccgcacccgctgaacgttag

SEQ ID NO: 136195 - DNA, 150 bp, Artificial Sequence
  Description of Artificial Sequence: Synthetic coding sequence
atggggaacagtatgaaaagcacgcctgcgccagccgagcgcccgctccctaatcccgagggacttgactcagatttcttagcggtactgtctgactatccatcgccagacatatcgccgccgatatttcgcagaggcgagaagttgtag

SEQ ID NO: 136196 - DNA, 477 bp, Artificial Sequence
  Description of Artificial Sequence: Synthetic coding sequence
atgggcaactctatgaaatccacccccgccccagccgagcgtccactccccaatccagaggggttagacagcgacttcctggctgtcctgtctgattacccttcaccagatatctctcctccgatctttaggcggggtgaaaaattgcgagtcataagtgacgaggggggttggtggaaagctattagcctgtccaccggccgcgaatcttatatccctggcatttgtgtggcccgtgtttatcatgggtggctattcgaaggcctcggacgggacaaggctgaggagctgctccaattaccagataccaaggtgggatctttcatgatcagggagtccgagactaagaagggcttctactccttgagtgtgcggcaccgccaggtcaaacactatcggatcttcaggcttccaaataactggtactatatctctcctaggttaacattccagtgtctagaagacttggtgaactag

SEQ ID NO: 136197 - DNA, 123 bp, Artificial Sequence
  Description of Artificial Sequence: Synthetic coding sequence
atgggtaactccatgaaaagtacccccgcccccgcggagaggccactaccaaaccctgagggcctcgactctgatttcctggccgtactttccgactatccttccccagacatctcaccttag

SEQ ID NO: 136198 - DNA, 786 bp, Artificial Sequence
  Description of Artificial Sequence: Synthetic coding sequence
atgggttcgctgccaagtagaaggaagtcactccccagccccagtctgagcagtagcgttcagggtcaggggcccgtcaccatggaagctgagaggagtaaggccactgcagtggccctgggtagcttcccggccggtggcccagcagaattatccctgcggctgggggagcctctgaccattgtgagtgaagacggcgattggtggaccgttctgtctgaggtgagcgggcgagagtataatattccctcagtacatgtagccaaagtgagccatggttggctgtacgaggggttgtcacgcgagaaagctgaagaacttctgctgttgccgggcaaccccgggggggccttcctcattagagagtctcagaccagacggggctcctatagcctctctgttaggctgtcacgcccagcaagctgggatagaattagacactaccgaattcactgccttgacaacggctggctgtacattagcccacgcctgaccttccccagtctgcaagcgctggttgaccactacagcgagctggccgatgacatttgttgcttgctcaaggagccatgtgtactgcagcgcgccggtcctctgcccggcaaagatattcctctgccagtaaccgtgcaaagaactccacttaactggaaggagctggactcgtcactgttattcagtgaagccgctacgggggaagagagtttgctgagcgagggcctccgtgaaagtctgtctttttacatatccctaaacgacgaggccgtttccctggatgatgcatag

SEQ ID NO: 136199 - DNA, 633 bp, Artificial Sequence
  Description of Artificial Sequence: Synthetic coding sequence
atggggtcgcttccatcaaggcgaaagagcctaccttccccaagcttaagtagtagcgttcaggggcagggtccagtaacaatggaggcggagagaagcaaagcgacggcagttgcactgggttcctttccagctggagggccagctgaactcagccttcgactcggggagccactgactattgtatccgaggacggggattggtggaccgtactgtccgaagttagcggaagggagtacaatattcctagtgtgcacgtcgcgaaggtgtcccatggctggctctatgaaggcttgagccgggagaaggccgaggagttgctgctcctcccaggcaatcctggcggggcttttcttattagggagagccagactcgcagaggttcttactccctaagcgttagactgtctaggcctgcatcctgggatcgcatccgacattaccgaattcactgtttggacaatggatggctctacatcagtccacgactcacttttccgtcactgcaagccctggtggatcactacagtgaagggtggccggcaccctggcaaggatacacccccacatgtgattgcgccgaagacaccacacaactcgagcgtgctgggcagctgccacccgtgttttag

SEQ ID NO: 136200 - DNA, 3840 bp, Artificial Sequence
  Description of Artificial Sequence: Synthetic coding sequence
atgaccctcaccgaacggctgagagaaaagatcagccgcgccttctacaaccacggactgttgtgcgcaagctaccccattcccataatcctgtttacgggtttctgtatcctggcttgctgttatccgttgctcaagctcccactccccgggactgggcctgtggaattcacaacaccggttaaggactacagcccgcctccagtagacagcgaccgcaagcaaggtgaacccacagaacagcctgagtggtacgttggtgccccggtagcatatgtccaacagatattcgtgaaatcttctgtattcccctggcataagaatctactagctgtggacgtcttcaggtctcctttaagcagggctttccaattagtggaggagattcgcaaccacgtgcttcgagattctagtgggattcgttctttagaggagctctgccttcaggtcaccgatttgctgcctggcctacgcaaactcaggaacctgctccccgaacacgggtgcctgcttctctcacctggtaacttttggcaaaatgactgggaacgcttccatgccgaccctgacatcatcggcacgattcatcagcatgaacctaaaaccttacagaccagcgcaacccttaaagacctgttatttggagtcccgggtaaatatagcggggtgtctttgtacacccggaaacggatggttagctacacaatcacattggtttttcagcactatcacgcgaagtttctgggttctctgcgagcccgactgatgctgctgcacccttcccctaattgctctctgcgggctgaatcactggtgcatgtgcacttcaaagaggaaatcggcgtggcagagctaattccacttgtaacaacatacataattcttttcgcatacatttatttctcaactaggaaaattgacatggtgaagagtaagtggggcctggcccttgctgcggtggtaaccgttctgtcctctctgttgatgtctgtgggactttgcacactctttggcctgacccctacactgaatggaggtgagatctttccctatctagtggttgtcatcggactggaaaacgtcctggtgctgactaaaagcgtggtgtccacgcctgtcgaccttgaagtcaagctgcgtatcgcccaggggctcagctctgaatcttggtccatcatgaagaacatggccacggagcttgggatcatcctcatcggatattttaccctggtgccagccatccaggagttttgcctattcgcagtggtggggcttgtttcagacttttttctgcaaatgctgttcttcaccactgtgctctcaatcgacatcaggagaatggaactcgcggacctcaataaacggctgcctcctgaggcctgcctcccgtcagccaaaccagtagggcagcctacccgatacgagcgtcagctggccgtcaggcctagtactcctcacaccatcaccctacagccttccagttttcgcaatttgcgcttacccaaaagattacgtgtggtgtattttctcgctcgaaccaggttggcccagagacttatcatggcagggactgttgtctggatcggcattttagtttatacagacccagccgggttgcgcaattaccttgccgcacaggtgaccgagcagtcacctctgggcgaaggagcgttggcaccaatgccagtgccttcaggaatgctaccaccctcacatccagatcctgccttctccatattcccacccgatgccccaaaactccctgaaaatcagacatctccaggcgagtccccagagcgggggggaccagcagaggttgtacatgacagccccgtgccagaagtgacttggggccccgaggatgaggagctttggcggaagctgagctttcgacactggccaacccttttttcctattacaacatcaccctagctaaacgatacatcagccttctccccgtcatacccgttacgctgagactgaaccccagagaggcgctggagggcagacatcctcaggacgggcgttcggcctggcccccaccaggtcctatcccagccggtcactgggaggccggacccaagggacccggcggcgtgcaggcacatggtgacgttaccttatataaggttgccgcgctcggcctggcgacgggtattgtgcttgtcctgttattgctgtgcctttacagggtattgtgcccgcgtaactacggccagctgggaggcggacccgggagaagaagacgcggggagctgccatgcgatgactacggatatgctccacccgagactgaaattgtacctttggtactgcgggggcacctaatggacatcgaatgcctggcctctgacgggatgctgctcgtttcctgttgtttagccggtcatgtgtgtgtgtgggatgcccagacaggcgattgtttgaccagaattcccagaccaggcaggcagagacgagatagtggagtaggcagtgggctcgaagctcaggagtcgtgggagcgcctctctgatgggggcaaagctggtcccgaggagcccggcgactccccgccgttacggcaccgaccgcgcggtccccctccaccatctctgttcggcgatcaacctgacctgacctgcttaatcgacaccaacttctcagctcagcccagaagcagccagcccacgcagccggagcctcgccaccgcgctgtctgtggtagaagtagggatagcccaggctacgatttctcctgtctggttcaaagagtgtaccaggaagaaggcttggctgcagtgtgcacccccgcccttagacccccatctccaggacccgtgctgagtcaggcgccagaggatgaagggggaagcccggagaaagggtctcccagtctcgcctgggccccatccgccgagggatcgatctggtcccttgaacttcagggtaatcttatagtcgtgggccggtcctccggaagactggaagtctgggatgcgatcgagggagtgctgtgctgcagctctgaagaggtatcttctggcatcaccgctctggtattcctggacaaaaggatcgtggctgcacggctgaacgggtccctggacttcttctctctggaaactcatactgccctctccccactgcagtttaggggaacaccaggaaggggcagctccccggcgagccctgtctattcttcaagcgacacagtcgcttgtcacctgacccacactgtgccttgcgcgcatcagaaacctatcactgcccttaaagcggccgccggacgtcttgttactggcagccaggatcatacactgagagttttcaggttggaggattcttgctgcttgtttaccctgcagggacacagtggggccataactaccgtgtacattgatcagactatggtgctggcctcaggcggccaagatggcgctatttgtctgtgggacgtcttgacagggagccgtgtttcccacgtttttgcccacagaggagacgttacaagcctgacctgtacaacatcttgtgtcatatctagtggcctcgacgacctgatcagtatctgggaccggagcaccgggattaaattttacagcatacagcaagatcttgggtgcggagcctccttgggtgtgatctcagataatctgctggtcacgggcgggcaggggtgcgtatcattctgggacttgaactacggagatctcctgcagaccgtgtatctcgggaagaacagcgaggcccagcctgccagacagatcctggtactggacaatgcggcgattgtctgcaactttggaagtgagctctctctggtgtatgttccatccgtcttagagaaattggactag

SEQ ID NO: 136201 - DNA, 2316 bp, Artificial Sequence
  Description of Artificial Sequence: Synthetic coding sequence
atgaccctgaccgagcgactgagagagaaaattagccgggccttctacaatcacggcctgctctgtgcatcttacccaattcctattatactgttcacagggttctgtatcttggcatgctgttaccctctgctgaaactgcccttgcctgggacagggcccgtcgagttcaccacccctgttaaggactactcgcctcctccagtcgattcagatagaaaacagggggagccaactgagcagcccgagtggtatgttggcgctcccgtggcttatgtgcaacagatcttcgtgaaaagctccgtgtttccttggcacaagaatctcctggccgtggacgtcttccggtcaccacttagccgggcctttcagctagttgaggagatccgcaaccatgtcttgcgagattcatcaggtatccgcagcctggaggaactatgcctgcaggtcacagatctgctccctgggcttcgcaagctccgaaaccttctgcctgaacacgggtgtctgctgctgtctcccggtaatttttggcagaacgactgggaacgtttccacgccgatccagacatcattggaaccattcaccagcacgaacctaaaacgctgcagacctcagctaccctgaaggacctgctgttcggagttcccggaaaatatagtggcgtgagtctgtacacacggaaacgtatggtatcctataccatcaccttagttttccagcactaccacgcaaaattcttgggatccctgcgggcgcggctcatgctgctgcatcctagcccaaactgtagtctacgcgctgagtctctggtgcacgtgcatttcaaagaggagataggggtagcagagctcatacctcttgttacaacttatatcattttgttcgcttacatctacttcagcacaagaaagattgacatggttaagtccaagtggggactggccttggctgctgtggtgaccgtcctttctagtcttctgatgtccgttggtctttgcacattgtttgggctgacacccaccttaaacggcggagaaatttttccgtacctggtcgtggtgataggtctagaaaatgtgttggtgctcactaagtcagtggtctctaccccagtcgatctggaggttaagttgcggattgcacagggcctcagcagcgagtcgtggtccattatgaaaaatatggcaacagagcttggtattatcttgatcggctactttaccctagtcccagccatccaggagttctgtctgttcgcagtggtgggcctggtttcagacttctttctccaaatgctgttttttaccacagtgctctccatcgatataagaagaatggaacttgcagatttgaacaaacgattgcccccagaggcctgtctgccctctgctaagcctgtcggccagcctactcgttatgagcgctcttctggcaggctggaggtttgggatgccatcgaaggagtgttgtgctgctcatctgaggaagtgagttcaggtataactgcactggtgttcctggacaagaggatagttgccgcgcgtttgaacggctctctggacttcttcagtctcgagacacacaccgccctgtcccccttacagttccgcgggactcccggcaggggatcttccccagcttcgccagtgtatagcagctctgacaccgtggcttgccacctgacacacacggttccttgtgcacatcagaagcccataaccgctctgaaagctgccgccggccggctcgtgaccggtagtcaggatcacacattgcgtgtttttagactcgaagattcttgctgccttttcacattgcagggccacagcggtgccattaccaccgtgtatattgaccagactatggttctggctagcggggggcaggacggcgcgatctgtctctgggacgttttgaccgggtctagagtgtctcatgttttcgcgcatcgaggagatgtcacatctctgacttgtactacctcctgcgtgattagttcaggattggacgatctcatttctatttgggatagaagcaccggcattaagttctattctatccagcaggatctgggatgtggagccagcctgggcgtgataagcgataatttactggtcacggggggccaaggctgcgttagtttctgggacctgaattacggagacctcctgcaaaccgtgtacctggggaagaactcagaggcccagccagctaggcaaatcctggtcctggataacgcagcaatcgtctgtaactttggctccgagttaagcttagtatatgtgcccagcgtgctggagaaactggactag

SEQ ID NO: 136202 - DNA, 2718 bp, Artificial Sequence
  Description of Artificial Sequence: Synthetic coding sequence
atgacactcaccgaaaggctgcgggagaaaattagccgtgctttctataaccacgggctcctgtgcgcgtcttacccgataccaattattctaattggatacttcacacttgtcccggcaatacaggaattctgcctgtttgcagtggtgggactggtttcagacttcttccttcagatgctattttttactacggtgctgtccatcgatatacgaagaatggaactcgctgaccttaacaagcggctcccacctgaagcttgcctaccctcagcgaagccagttgggcaacccacacggtacgagcgtcagctggcggtgcgtccgtctacgccacatacaattaccctgcaaccctctagcttccggaacctgagactgcctaaacggctgcgggtggtatacttcctcgcccgaactcgcctggcccagcgactcatcatggctggcacggttgtgtggattggaattctggtgtatacagatccggccgggttaaggaattatctcgcggcacaggtcacggagcagtcccctttgggtgagggcgcccttgcacccatgcccgtgccatccggcatgctgcctccgagccacccagatccggcattttctatttttccgcccgatgcgccaaaacttcccgaaaaccagacttcccccggtgaaagtccggagagaggtgggcctgctgaggtggttcacgacagtcccgtgcccgaagtgacatggggaccggaagatgaagagctttggaggaagctgtcatttaggcattggccaactctgttctcatattataacatcaccctggctaaaagatacattagcctcctgcccgtcattcctgtcaccctacggctcaaccctagagaggctctggagggccgacacccccaggacgggaggtccgcatggcctcctccaggccccatccctgccggccattgggaagctggaccaaaaggcccaggaggggtgcaagcccacggcgacgttactctgtataaggtcgctgcccttggactcgccactgggattgtcctggtcttgcttctcctctgcctgtatcgagtcctctgtcctaggaactacggccagctgggtggggggcccggacgtcgtcgccgtggtgaactgccctgcgacgactatggttatgctccccccgaaacagagatcgtaccactcgtacttcgaggccatctgatggacatagagtgccttgcatcagacggaatgctgctggtgtcttgttgtttggcggggcacgtttgtgtatgggatgcccagacaggcgactgcctgacgagaatcccaagacccgggcagcgcagggacagcggggtcggaagtggactggaagcgcaggagagctgggaacgtctgagtgatggcggtaaagcggggcccgaggagcccggagattccccacctctgcgccaccggccccgcggccctccccctcccagcttgtttggagatcaacccgacttgacttgcctgattgatactaatttttccgcacaaccacgatcttctcaacccacccagcccgagcctcgacaccgcgccgtgtgcggacggtcacgggacagccctgggtacgatttcagctgccttgtacagagagtgtaccaggaagagggcctggcagctgtgtgtaccccagctctccgccccccatctcccggtcccgtgctttcccaagcccctgaggacgaaggcggctcccccgagaaagggtctccttcgttggcgtgggcccccagtgctgaaggatccatttggagcctggaattgcagggtaatttgattgtggtcgggagatcttcgggacgccttgaggtgtgggatgctatcgaaggcgtgctgtgctgcagctccgaggaggtcagttctgggatcacagccctggtgtttctagataagcggatcgtagccgcacggcttaatggtagtctcgacttcttcagcttggaaacacatacggcactatcacccctccagttccgcggaacacctgggcgcggtagtagccccgcttcccctgtgtacagctcctctgacacagttgcctgccacctgacccatacagttccttgcgcacatcagaaaccaatcaccgccctgaaggctgccgcgggcagactcgtgactggctctcaggaccacacgctgcgcgtcttcaggctagaagatagttgctgcctctttacattgcagggtcacagcggggcaatcaccaccgtgtatatcgatcagaccatggtgctagcaagcggcggtcaggatggggccatttgcctgtgggacgtactgaccgggagtagagtgtcacatgtgttcgcccacagaggggatgtcactagcctcacctgcacgacatcgtgcgtgatctcctctggcctggatgaccttatctcgatctgggatcgctccacaggaattaagttttattccatccagcaggatctgggttgtggcgcctctcttggcgtgatctccgacaaccttttggtcaccggcgggcaggggtgtgtatcattttgggacttgaactacggcgacctgctgcaaactgtgtatcttgggaaaaatagcgaagcccagcctgcacggcagatcctcgttctggacaatgctgccatagtgtgcaatttcggatctgagctgtcccttgtctatgttcccagtgtactggagaaattggattag

SEQ ID NO: 136203 - DNA, 1059 bp, Artificial Sequence
  Description of Artificial Sequence: Synthetic coding sequence
atggtgaaatcaaagtggggccttgcgctcgctgcagtcgtgaccgtgctgtcgagtctcctgatgagcgtcgggctctgcaccctcttcggccttacgccgaccttaaatggaggcgagatctttccctacctggtggtagtgattggcctcgaaaacgtcctcgtgcttacgaagagtgtcgtcagcacccccgtggatctcgaggtaaaactgcgaatcgcccagggactcagcagtgagagttggagcatcatgaaaaatatggcaacagagctaggcatcatcctaattggctacttcacactggttccggctattcaggaattttgcctgttcgcagtggtcgggctcgtgagcgattttttcttgcagatgttgttctttactaccgtgctaagcatcgacattagacggatggaactagcagacttgaacaagcggctgccccccgaagcatgtttgccctccgccaagcctgttggacagccgacacgctacgagagacagttggcggttcgtcctagtactccacacactattacattgcaacctagcagctttcgcaatctacggctccctaagaggcttcgagtcgtctattttctagccccaacaggcgcacacacctgttgggctctgggcagcaggacacaaggtccccggtggggagcgggaccttggcgtagacacgcggtgcagggcgggggtgccggccctggccatcgccacagactcggggccgcagcagctctaccactccccagggccatgccggcccagctgagagccgcgggctggtgggccagagcagcagaggcccgtggtgccgccctgcgcaggctacggctctgtgccacccgtgacggggatagggccgcttgtgccgccaggccaccgcatggtcaccgtgtgcctgggcagaggcggcacgccgccggcgagttactgccaggtaggccaaggctcagggtggggagggcagataggggactgccgaacgctcattccgcgcccagacaagctgcacctggacaatggaggggccagcgcgcatag

SEQ ID NO: 136204 - DNA, 411 bp, Artificial Sequence
  Description of Artificial Sequence: Synthetic coding sequence
atgactctgacagaaaggttgcgggagaaaatcagccgcgcattttataaccacggactcttatgtgccagttatcccatccccatcattctcttcacaggtttttgtatcctggcttgttgttaccctcttcttaaactgcccctccctggcacaggaccagttgaattcacaaccccggtgaaagattacagccctccacccgtggatagtgaccgtaagcagggcgagccaaccgagcagccagaatggtatgtgggagcccccgtggcgtacgttcagcaaatcttcgttaaatccagcgttttcccatggcacaaaaatctattggccgtcgacgtatttagatcccccctctccagggctttccagcttgtcgaggagattagaaatcacgtcctgcgcgactag

SEQ ID NO: 136205 - DNA, 3072 bp, Artificial Sequence
  Description of Artificial Sequence: Synthetic coding sequence
atgctgcttcatcccagccccaattgctcccttagggcagagtcgctcgtgcacgtgcattttaaggaagaaataggcgtggccgagcttatacccctggtgacaacctatataattctgtttgcctatatctacttctcaacccgtaagattgacatggtcaaatccaagtggggactggcccttgccgctgtagtaaccgtcctgtcctcccttttgatgagtgtcggcctgtgtacacttttcggactgactccaactttgaacggaggggaaatttttccctacttagtagttgtcatcggattagagaatgtgttggtgcttaccaagtccgtggtaagtaccccggttgatctggaggtgaagttaagaatcgctcaggggctgtcatcagaatcctggagcattatgaagaatatggcaacagaactcggcatcatcctaattggttattttaccctggttccagctatccaggagttttgtctgttcgcagtcgtcggccttgtcagcgactttttcctgcaaatgttgtttttcacaaccgtcctgtctatcgacattcgcaggatggagctggcggacttgaataagcggctgccaccagaagcttgcctgcccagtgccaagccggtgggtcagccaactcggtacgagaggcagctggctgttcgaccttcaacaccccatactattaccttgcagccctcaagtttccgaaatttaaggttgcctaaaaggctcagagtggtgtattttctggcccgaactcgcttggcccagagacttatcatggcagggaccgttgtgtggattggaattttggtctacacggatccagcgggtctccgcaattatctggcagcacaggtaactgaacagtccccacttggtgagggtgctctggcgcccatgcccgtgccatctggaatgctccccccaagccaccctgaccccgcattctcgatctttccgccagatgcacctaagctgccagagaaccaaacttcacctggggagagtcccgagagaggtggacccgcagaagtggttcacgattcccccgtcccagaggtgacatggggacccgaagatgaggaactttggcggaagttgtcttttcggcactggccaaccttgttctcttactacaatataacactggcaaagcgctacatctcactgctgccagtaattccagtcacactacgactcaacccccgtgaggccctggaaggccgacacccccaggatggacggtccgcgtggcccccaccaggtcccatcccagccgggcactgggaggcgggacccaaaggacccggtggggtccaagcgcatggtgacgtcaccctgtacaaagttgccgccctgggactcgccacaggtatcgtgctcgtgctgctgctgctgtgcttatatcgagtgctatgtccacggaactatggtcaactgggaggcgggcccggtcggaggagaagaggggagctgccatgcgatgattacggctacgcacctcctgaaaccgaaatagtgccactggtcctgcgtggccacctgatggacatcgagtgcttggcctcagacgggatgctgctcgtgagttgttgcctcgcgggccacgtgtgcgtttgggatgcacaaactggagattgcctgactaggatccctagaccaggtcaaagaagagattcaggcgttggctctggattagaagcccaggaatcatgggaacggctcagcgacggtgggaaagcaggaccggaggaacctggggacagcccccccttgcggcatcgcccccgcggacccccacctcctagcttgttcggcgatcagcctgacctgacctgcctgatcgacacaaacttttctgcccagcccagaagttcacagccaacccagcctgaaccacggcatcgagcggtgtgtggacgctcaagggactcccctggctacgacttctcatgcttggttcaacgagtctatcaggaggaaggactggctgcagtttgtacaccagcccttcggccaccgtcccctggcccggtgctgtcccaggctcctgaagacgagggcgggtcccccgaaaagggcagtccttccctggcctgggctccttcagctgagggatccatctggagcttagagctccagggaaatctgatcgtcgtcgggcgctcgagcgggagactggaggtgtgggatgccatcgaaggtgtgctgtgctgcagctcggaggaggtcagtagcgggatcaccgctttagtgttccttgacaagaggatcgttgccgccaggctgaacgggtccctggacttttttagccttgagacgcatactgccctgtctcctttgcagttcagggggacaccaggacgtggttcgtcaccagcgtcacctgtgtattcctctagtgacaccgtggcctgccacttgacccacactgtgccatgcgcccaccagaagcccatcaccgcgctcaaggctgccgcgggcaggctggtaacaggctcccaggaccacaccttgcgcgtgtttaggctcgaggatagttgttgtctctttacactacaagggcactccggggccatcacgacagtttacattgatcagacaatggtgctcgcctccggaggacaggatggagccatctgtctgtgggatgtgctaacaggaagtagagtttctcacgtttttgcacaccgcggtgacgtgacaagcctgacttgcacaacctcttgtgtgatttcctctggtctggacgacctaatttcaatctgggacaggagcaccggcataaagttttacagcatccagcaagatctggggtgcggggcaagtctcggggtgatctccgataacctactggtaactggcggtcaggggtgcgtatccttttgggatcttaactatggagatctcctgcagaccgtgtatctgggcaaaaatagcgaggcacagccagcaagacagattctcgtcctggacaacgctgctatcgtgtgtaattttgggtctgagctcagtctggtgtatgtgccctcggtgcttgagaaattggattag

SEQ ID NO: 136206 - DNA, 267 bp, Artificial Sequence
  Description of Artificial Sequence: Synthetic coding sequence
atgacgctcacagagagactgagggagaaaatctcaagggcgttctacaaccacgggctcctgtgtgcaagctaccctatccccatcatactctttacgggtttttgtatcctggcctgttgttatccactgctaaagttgccacttcccggtacaggtcctgtcgagttcacaacccccgtgaaagattattcccctcctcctgttgacagtgatagaaagcaaggagagcccactgagcaaccggagtgggtgggcactcgctag

SEQ ID NO: 136207 - DNA, 399 bp, Artificial Sequence
  Description of Artificial Sequence: Synthetic coding sequence
atgactctcactgagcgcctccgcgaaaaaatttccagagccttttataaccacggtctgctgtgcgcctcttaccccattcccatcatactgtttacaggcttttgtattcttgcctgttgttatcctcttctaaaactgcccctgccagggacaggccctgtggaattcaccaccccggtgaaggattactcccctcccccagtggattctgaccggaaacagggagagcccactgaacaaccagaatggtacgtgggcgccccggttgcctatgtccagcagatcttcgtcaagtcgtccgtgttcccatggcataaaaacttgttggctgtggatgtgttcagatcccctctgtcaagggcgttccagctggtggaggaaatcaggaatcattag

SEQ ID NO: 136208 - DNA, 2661 bp, Artificial Sequence
  Description of Artificial Sequence: Synthetic coding sequence
atgaagaacatggccaccgaactcggaatcatcctgatcggatacttcacccttgtgcctgccatccaagagttctgcctgttcgctgtagttgggcttgtgtctgacttttttctacagatgctgttctttacgactgttctgtccattgatatccgacgcatggagcttgcagatctcaataagagactcccccccgaagcttgcctcccttccgccaagcccgttggacaaccgactcgctacgagcgccagctggccgtgcgtccaagtaccccacacactattacactccagcctagtagttttaggaatctgcgtctccccaagcgcttaagggtggtatacttcctggcccgcacgcggctcgcacagagattgattatggccggtaccgtggtttggatcggaatcttagtgtatacagatcctgccggcttgcgtaactacctcgccgctcaagtaacggagcagagccctttaggagaaggcgcactggctccaatgccagtaccatcaggtatgctgcccccttcacatcccgatcctgcgtttagcattttcccaccagatgcccccaaactacctgagaatcagacgagccctggcgagtcccctgaaaggggcggaccagcggaggtcgttcacgatagtccagtgccggaggtcacatggggccccgaggatgaagagctgtggcggaagctgtctttccgccactggcccactttatttagctactacaacataacactggccaagcgatatatttcgctgcttccagtgatccccgtcacattgcgattgaatcccagagaagccctggagggacgacacccccaggatggcagaagtgcatggccacctcctggcccaattcctgccgggcactgggaggccgggcccaaaggccccggcggagtgcaggcacacggcgacgtcacattatataaggtggctgcacttggcctcgctactggtattgtgctggtgctactgctgctgtgcctgtaccgcgtgctgtgcccacgcaattacggccaactcggggggggccccggccgacggagacggggggagttaccgtgcgacgactatgggtatgccccgcctgaaacagagatagttcctctggtgttgcggggacatctcatggacattgagtgcctggccagtgacggcatgcttctggtgagctgttgcttagcagggcacgtgtgtgtgtgggacgcacagaccggggattgtctgaccaggatcccaagaccggggcagaggcgcgatagcggtgtgggaagcggcttggaagcgcaggaatcttgggaacgactgtctgacgggggcaaagcaggccccgaggaacctggtgattcaccacccctccggcatcgccctagggggccacctccgccttctttatttggagaccagcctgacctcacgtgcctgatagatacaaacttctctgcccagccacggagctctcagcctacccagcccgaacccagacatcgcgcggtatgcgggagaagtagagatagcccgggttacgacttctcttgcttggtgcaaagagtgtaccaggaggagggactcgctgccgtgtgcacccctgctctgagaccaccttcacccgggcccgttctgagtcaggctcctgaggacgagggaggctctccagaaaagggctcacccagcctggcatgggctccatccgcagaaggatcgatttggtctctcgaactccaagggaatctaattgttgtggggagaagctcaggtcgccttgaggtgtgggacgctattgaaggagtcttatgctgttcctcagaggaggtgagctcaggaatcactgccctagtctttctagacaagaggatcgtcgcagctcggttgaacgggtcactcgacttcttctcgcttgagacccacactgcgctgagtcctctacagtttcgggggacgcccgggaggggtagctcacccgccagtccagtctattcctcaagcgacaccgtggcatgtcatctcacccacaccgttccatgtgcccaccagaagcccatcacggcgctgaaggccgccgcaggccggctggtaacaggatcacaggaccataccctgagagtgttccgactggaggatagttgttgtctcttcacactgcagggtcatagtggcgctatcacaactgtttacattgatcaaaccatggtactcgcctctggagggcaggacggcgccatctgtctctgggatgtcctcaccggctctagagtgagccacgtgttcgctcataggggagacgtgacctctctcacgtgcaccaccagctgcgttatttccagcggattggatgacctgatctccatctgggaccgatcaacaggcatcaagttttattctattcagcaagacctgggctgcggcgccagcctgggcgttatttctgacaacttgctggtgaccggcggccaaggatgcgtctcgttttgggatctgaattatggtgacttgttacagacagtgtatctgggcaaaaatagcgaagcccagccagctcggcaaattctggtcctcgataatgccgctatagtctgtaactttggatcggaactgtctctggtgtacgtgccttccgtgctcgaaaagcttgattag

SEQ ID NO: 136209 - DNA, 792 bp, Artificial Sequence
  Description of Artificial Sequence: Synthetic coding sequence
atgctcctcgcttgggtgcaagctttcctagtgtctaatatgcttctcgcggaggcctacggtagcggcggctgtttttgggacaatggacatctctatcgagaggatcagacgagtccagctcccggcttgagatgcttgaattggttggacgcacagtccggcctggcgagtgctcccgtttccggcgcgggaaatcatagttattgtaggaacccggacgaagatcctcgcggaccctggtgttacgtgtccggcgaagccggtgtgcccgagaagaggccttgtgaagatctgcgctgccccgagacaactagccaggcactcccggcctttacgacagaaattcaagaagcctccgagggtcctggggcggacgaagtccaggtgttcgctccagctaacgctctgccagctaggtccgaggccgccgccgtgcagcccgtgatcggcatcagtcagagagtcaggatgaacagcaaggagaaaaaggatcttggaacattagggtacgtactggggatcaccatgatggttatcattattgcgataggcgcaggaattatcctgggttacagctacaagaggggcaaggatctgaaggagcagcacgaccagaaggtctgcgagagagagatgcaacgcatcaccctgcccctgagcgctttcaccaaccccacctgcgagatagtcgatgaaaagaccgtggtggtgcataccagccagacaccagtagatccccaagaggggactacccctctcatgggacaggccggcacccctggggcttag

SEQ ID NO: 136210 - DNA, 1176 bp, Artificial Sequence
  Description of Artificial Sequence: Synthetic coding sequence
atgtacagcatgatgatggaaacggaccttcacagtccaggcggcgcccaggcacctaccaatctcagtggtcctgcaggcgcaggcgggggcggtgggggtggtggggggggcggcggaggcggaggcgcgaaggccaaccaggatcgggtgaagcgaccgatgaacgctttcatggtttggtcacgagggcagcggcgcaagatggcccaagagaaccccaagatgcacaactccgaaatctcaaagcggctcggtgcagaatggaaggtcatgagtgaggctgagaagaggccatttatcgacgaggctaagcgtctccgagctctccatatgaaagagcaccccgactataaataccgaccgagacggaaaactaagacactgctgaagaaagacaagtatagtcttgccggcggccttttagcagcaggagccggcggcggaggtgccgccgtggccatgggggtgggcgtaggtgtgggcgccgcagcagtgggccagaggttagagtcaccaggaggagcagccggtggtggctatgcccatgtgaacggatgggctaacggagcatatcctgggagtgtcgccgccgcggccgccgctgctgctatgatgcaggaagcgcaattggcctacggtcagcaccccggggcaggcggagcccatccccacgctcatcctgcacaccctcatcctcaccacccacatgcccacccacacaatcctcagcctatgcatcgttatgatatgggcgctcttcagtactcgccaattagcaactctcagggctacatgagtgcctcaccaagcgggtatggaggacttccctatggcgctgccgccgcggccgctgccgcagctgggggggcgcatcagaattccgcggtggctgctgcagctgccgccgcagccgcatctagtggagccctaggcgcactcggttcactggtgaagtcagaaccttccggctctcccccagctccagcacactctcgggcaccatgtcctggagatctcagggagatgatatcgatgtacttaccagccggtgaagggggcgaccccgcagccgctgcagctgcggctgctcaaagtcgcctgcattccctacctcagcactaccagggggcaggcgccggcgttaacggcaccgtgcccctgacccacatctag

SEQ ID NO: 136211 - DNA, 1326 bp, Artificial Sequence
  Description of Artificial Sequence: Synthetic coding sequence
atggtccaacaggccgagtccctggaggctgaaagcaatttaccccgggaagccctcgacaccgaagagggagaattcatggcttgcagtccagtagccctggatgaatccgaccctgattggtgcaagaccgcttctggtcatatcaagcgtcccatgaacgccttcatggtatggtccaaaattgaacgtcggaagatcatggaacagagtcctgacatgcacaacgccgaaatttccaagcgattggggaagaggtggaaaatgctgaaggacagcgaaaagatcccttttatcagggaggccgagaggcttcgtttgaaacacatggctgattaccccgactacaaatatcggcctaggaagaagcctaagatggaccctagtgctaagccctccgctagccagtcgccggagaagtcagctgctggtgggggaggaggctccgcaggcggtggagccggcggagctaagacctccaagggaagttcaaaaaaatgtgggaagcttaaagctcctgcggccgctggagccaaagcaggagccgggaaggcagcgcagtctggcgactacgggggtgcaggcgacgactacgtccttggctccttacgggtaagcgggtcgggtggcggcggcgccggtaagacagtgaagtgcgtattccttgacgaggatgatgatgacgacgacgacgacgatgaactccaattacagatcaaacaggaaccagacgaagaggatgaggagcccccacatcagcaactgctgcaaccaccaggtcagcagccatcacagttgcttcggagatacaacgtcgcaaaggtgcccgctagtcctacactgtcaagctcagccgagtctcctgagggggcctcactttatgatgaagtgcgcgccggcgctacctctggcgcaggcgggggctcgcgtctatactactcatttaaaaacataacaaaacagcatccgccaccccttgcccaacctgctctcagccctgcttcttctaggagcgtgagtactagctcctcatcgagttcaggtagttcatctgggagcagcggcgaggatgccgatgatctcatgttcgatctgtctttaaacttctcccagtccgcccactccgcgtccgaacaacaacttggagggggcgctgcagctgggaacctgagcctcagcttagtggacaaggacctggacagtttttctgagggaagccttggctcacactttgagtttcctgactactgtacacctgagttaagcgaaatgattgcaggagactggctcgaggccaatttctccgacctcgtattcacctactag

SEQ ID NO: 136212 - DNA, 948 bp, Artificial Sequence
  Description of Artificial Sequence: Synthetic coding sequence
atggtacaacagcgcggtgcccgcgccaagagggatggcggtccacctccaccagggccagggccagccgaagagggtgctagagaacccggatggtgtaaaactccctccggccatattaaacggccaatgaacgcttttatggtatggtcccagcatgaaagacgaaagattatggatcagtggcccgatatgcacaacgcagaaattagtaagagactaggacgacgttggcagctgctgcaagactcggaaaaaattccattcgtaagagaggctgaaagactgagactgaagcatatggcggattatcccgattataagtaccggccccggaagaaaagtaagggtgcaccagcaaaggcccggcctagaccaccaggaggcagcggcggaggatcccggctcaaacccgggccacagttgcccgggagaggcgggcgccgggctgccgggggacccttaggaggaggagctgcagcgcctgaggatgatgatgaagacgacgatgaggaactgctggaggttcgcttggtagagacaccaggcagggaactctggcgcatggttcccgccggccgagccgcccgcgggcaggcagaacgtgcccagggccctagcggagagggagctgccgctgcagcagcagctagcccgaccccctcagaggacgaggaacctgaagaggaggaggaggaagcagccgctgctgaagagggggaggaggagaccgtcgcttccggagaggagtcattaggcttcctttccaggctccccccggggcctgctggtttagactgctccgctcttgaccgggaccctgacctgcaaccccctagtggaacatctcacttcgagttcccagactattgtacccctgaagtgactgaaatgatcgccggcgactggcggcccagtagtattgcagatcttgtgtttacctactag

SEQ ID NO: 136213 - DNA, 948 bp, Artificial Sequence
  Description of Artificial Sequence: Synthetic coding sequence
atggtgcaacagaggggagcccgtgcaaaaagagatggcgggcccccaccaccaggacctggtcccgcagaggaaggcgcccgggagcctggttggtgcaagactccaagtggtcacatcaagcgcccaatgaatgctttcatggtttggtctcaacatgagagacgcaagatcatggaccagtggcctgacatgcacaacgctgaaatctcgaaacggttaggtcgccggtggcagctgttgcaggattcagagaagatcccattcgttagagaggctgagcgactgcgacttaaacacatggctgattatccagactacaaataccgccctcggaagaaatcaaaaggcgcccccgctaaagcccgaccacgcccccccggaggaagcggcggggggtcacggttgaagccgggaccccaactacctggccgggggggtcggagggccgcaggcgggcccctgggaggaggtgctgctgcgcccgaggatgacgacgaagacgatgacgaagagttactggaagtgcgtcttgtcgagactcctggtagagagctctggcggatggtgcctgctgggcgagcagcgaggggacaggccgaaagggctcagggccccagtggtgaaggtgcagccgcagctgctgccgcgagccccactcctagcgaagatgaggagcccgaagaagaggaggaagaagctgcggctgccgaagagggtgaagaggagacagtggcgagcggagaggagtccctcggttttctgagcagacttccgcccggcccggccggtcttgactgtagcgcgctagaccgcgatcccgacctgcagcctccaagcggcacttcacactttgagtttcccgattattgcaccccagaggtgactgaaatgattgcaggagattggcgaccctcttcaattgcagacttggtgttcacatattag

SEQ ID NO: 136214 - DNA, 1869 bp, Artificial Sequence
  Description of Artificial Sequence: Synthetic coding sequence
atgtctatgcggtcacccattagtgcacaattggcactcgatggcgtggggacgatggtgaactgcacaatcaagtcagaagaaaagaaggagccctgccacgaggccccccagggctctgctacggcagccgagccccagcctggcgatcccgcaagagcaagccaggattcagcagatccacaagcccccgcacaaggtaactttagaggaagctgggactgttcatccccagagggaaacggcagccctgagccaaagcgacctggtgtatcagaggctgcctccggcagtcaagagaaactggacttcaatagaaatctcaaggaggtcgtgcccgctattgagaagcttctaagttctgactggaaggagcgcttcctcggtcggaacagtatggaggcaaaagacgtcaaaggcacgcaagagtccctggccgaaaaagaacttcagctgctggtaatgatccatcagctgagcaccctgagggaccagttgctgacagcccatagtgagcagaaaaatatggctgccatgctatttgaaaagcagcagcagcaaatggaacttgcccgccaacagcaagagcaaatcgcaaagcagcagcagcagttgatccagcagcaacacaagatcaaccttctccagcagcagatccagcaggtcaatatgccctacgtcatgataccagcatttcccccaagtcaccaaccgctgccagtgacacctgactctcagctggcactgcccatacagcccattccatgcaaaccagttgaatatcctctccagctcttgcacagccccccagccccggtggtgaagcgtcccggtgctatggcaactcaccacccgcttcaggagccttctcaacctcttaatctgacagccaagccaaaggcccccgaactgcctaacacctcaagcagccctagtctgaagatgtcgtcctgtgttcctcgtccgcctagtcatgggggacccacaagggacttacagtcctcccccccgtccctgcccttaggatttttaggagagggtgacgctgtgacaaaggctattcaagacgcccggcagctgttgcactcacattctggggccctcgacggcagtcctaatacaccatttcgcaaggatttgatttctctcgattcctcacccgccaaggagaggctggaggatggttgcgtgcacccactcgaggaggcaatgctatcctgcgatatggacgggtcaaggcatttcccagagagccggaattctagccacattaaaagaccaatgaatgcgtttatggtgtgggcaaaagacgagcgccggaagatcctccaggcctttcccgacatgcataattcctctataagtaagattctcggctccaggtggaagtcaatgacaaaccaagagaaacagccgtactatgaagagcaggctcggctgtccaggcagcatctcgagaagtatcctgattacaaatacaaaccccgccccaagcggacatgcatagtggaggggaagcgtctcagggtgggtgagtataaggccctcatgaggactcggaggcaggacgcccggcaatcgtatgtaatacccccacaggcaggacaggtccagatgtctagctcagatgtcttgtatccacgcgccgccggtatgcccttagcacagcccctggtggaacactacgtgccacgatcattggacccgaatatgccagttatcgttaacacctgctcacttcgtgaagagggcgagggaacagatgacagacactccgtggccgacggtgagatgtatcggtactccgaagacgaagacagcgaaggcgaggaaaaaagtgatggcgagcttgttgtcctgacggattag

SEQ ID NO: 136215 - DNA, 174 bp, Artificial Sequence
  Description of Artificial Sequence: Synthetic coding sequence
atgagtatgcggagtcccataagtgcccagctggccttggacggcgtcggaactatggtcaactgtacaatcaaatctgaggagaagaaagaaccatgccacgaggcgccccagggttcagcaacagctgccgagcctcaacccggagatccagcacgtgccagtcaggattag

SEQ ID NO: 136216 - DNA, 543 bp, Artificial Sequence
  Description of Artificial Sequence: Synthetic coding sequence
atgtctatgcggagtccgataagcgcccaactagcgcttgatggcgttggcactatggtcaactgtactatcaaaagtgaggaaaaaaaagagccttgccatgaagcgccccagggatccgccactgccgcagagccccagcctggagaccccgctcgggcctcccaggattcagccgacccacaggccccggcccagggcaattttcggggaagctgggactgttcttctccggagggtaacgggagcccagaaccaaagcgcccaggagtcagtgaggcagccagcggctcgcaagagaaattggactttaatcggaacctgaaagaagtcgtgccagcgatcgagaagctcctgtcctcggattggaaggaacgctttcttggccgcaattccatggaggccaaagacgttaagggtactcaagagagcttagcagaaaaagagctacagctcttagtaatgatacatcaactctccactttacgagaccagctcttgacagcacactctgagcaaaagaatatggcagctatgttgtag

SEQ ID NO: 136217 - DNA, 723 bp, Artificial Sequence
  Description of Artificial Sequence: Synthetic coding sequence
atgtcaaaacctagtgaccacatcaaaaggccaatgaacgcttttatggtatggtccagaggccagaggagaaagatggcccaagaaaaccctaaaatgcacaattcagagatttccaaacgtctgggagcagaatggaaactactgtcagaagctgaaaagagaccatacatcgacgaagcgaagagacttagggcccagcatatgaaagaacatcctgattacaaatatcggccccgtaggaaaccaaagaatctgctgaagaaggacaggtacgtgttccccctgccctacttgggagacacagatccactgaaagcagctgggctgccggttggcgccagcgacggactgttatccgccccggaaaaagcccgcgcgttcctcccccccgcttccgccccgtattctttactcgaccctgctcagttttctagcagcgctatacaaaaaatgggagaggtgcctcacacactagccacaggcgcactgccctatgctagcaccctcgggtatcagaacggtgcttttggttccctttcctgtcctagtcaacacacccacacgcacccatctccaaccaaccctggttacgtggtaccatgtaactgtactgcttggtcagcaagcaccctgcaaccacccgtagcttatatcctgtttcctggcatgactaagacaggcattgacccatacagctctgcacacgccacggcaatgtag

SEQ ID NO: 136218 - DNA, 702 bp, Artificial Sequence
  Description of Artificial Sequence: Synthetic coding sequence
atggcacttccagggtccagccaggaccaagcatggtctctcgaaccgcctgcagccactgccgccgccagttcatcaagcggcccgcaagagcgtgaaggagctggatcccccgccgctcctggcaccttgccgctcgaaaaagtcaagaggccaatgaacgcctttatggtgtggtcttcagcccaaagacggcaaatggcccagcagaatcctaagatgcataactctgagatttccaagaggctgggcgcgcaatggaaactcctagatgaggacgaaaaaagaccgtttgtagaggaagctaaacggctgagagccaggcatctaagggattacccagactataagtaccgccccaggcgcaaggcaaaaagctcaggagccggaccttcccgatgcggccagggcagagggaacctggctagcggcggacctctgtggggcccaggctatgctactacgcagccgagtcgggggttcggataccggcctcccagttattcaactgcgtacttgccggggtcctatggctcaagtcactgtaaactagaagcacctagtccgtgctcgctgcctcagagcgatcccagactgcagggtgaattgctgccaacctatacccattatctcccacctggcagcccaacaccatacaaccctcccctcgccggcgcacctatgcctcttacacacttatag

SEQ ID NO: 136219 - DNA, 702 bp, Artificial Sequence
  Description of Artificial Sequence: Synthetic coding sequence
atggctttaccaggctcctcgcaggaccaggcttggtccctcgaacccccagccgcaacagccgccgcaagcagtagctccggacctcaggagcgagagggcgccggatcacccgctgcaccgggaacattgccactagaaaaggtgaaaaggccaatgaacgcctttatggtctggagttccgctcagcgtaggcaaatggcccagcagaatcctaagatgcacaacagtgagatcagcaaaagattgggcgcacagtggaaattgttggatgaggatgaaaagcggccttttgtggaggaagcgaagcgcctgagggcgaggcatctgagagactatcctgactataagtaccgacctcggcgtaaagccaaatcatccggggccggtcccagtaggtgtgggcagggaaggggtaatctggccagcggcggacccctatgggggccaggatatgcaacaacccagccaagccgcggctttggttaccggcctccatcctatagcacagcatacctaccagggtcttacggcagttcccattgcaaactcgaagctccctctccatgcagcctgcctcaaagcgaccctaggcttcagggggaattgctgccaacatacacccattatctgcctcccggatctcctacgccatacaaccctcctctggcgggcgcccccatgcccctgactcacctctag

SEQ ID NO: 136220 - DNA, 1245 bp, Artificial Sequence
  Description of Artificial Sequence: Synthetic coding sequence
atgagtagcccagacgccggctacgccagcgatgaccagagccaaacacagtctgcactacctgcagtgatggctggactgggcccctgcccttgggccgagtcactctcccctataggtgatatgaaggtaaagggagaggcacccgccaactcgggtgcgccagcaggggccgccggccgagccaagggagagtcaaggattcgccgccccatgaatgctttcatggtgtgggccaaagacgagaggaaacgattggctcaacagaaccccgacctgcacaatgcagagcttagtaagatgttgggaaagagttggaaggctctgaccctggccgagaaaagacctttcgttgaggaagccgaacgccttcgggttcagcatatgcaggatcatccgaactacaaatatcgaccaagaaggagaaaacaagtaaagcgtctgaagagagtcgaaggggggtttttacatgggcttgccgaaccacaggcagcagccctgggacctgaaggcggacgcgttgctatggatgggctgggcctgcagtttccagaacaggggtttcccgccgggccaccgcttctgcctccccacatgggtggacactatcgtgattgccagtcattgggcgcgcctccactcgatggctaccctctcccaacccctgacacatcaccgcttgacggagtggatcccgaccctgcctttttcgccgcacctatgcccggtgattgccccgccgcaggaacgtattcttacgcccaggtctcagattatgctggccctcctgagcctccggccggtcctatgcatcctaggctgggcccagagccagccgggcctagtatcccagggcttctagcacctccttcagcattgcacgtgtactatggtgcaatgggaagcccaggagccggcggcggcagaggtttccagatgcagccacagcaccagcaccaacatcagcatcaacatcacccccccggcccaggccagccttcgcccccccccgaagccttaccatgccgagacgggactgatccatctcagcccgctgagctccttggagaggtggatcgtaccgaattcgagcagtatcttcatttcgtctgcaagcccgagatgggccttccataccaggggcacgactctggggtgaacctcccggatagccacggcgcgatttctagcgtcgtgtccgatgcctcctccgctgtgtactactgtaattatcctgatgtatag

SEQ ID NO: 136221 - DNA, 1155 bp, Artificial Sequence
  Description of Artificial Sequence: Synthetic coding sequence
atgcagagaagcccccccggatacggggcacaggatgacccccccgcccgacgggactgtgcctgggcgccaggtcacggcgctgctgcagatacgcgcgggcttgcagctggtccagccgcgctggccgctcctgcagcgcctgcttctccaccctccccacaacgctccccccccagaagccccgaaccaggcagatacggactctctccagccggcagaggtgagcggcaggccgccgacgaatccaggattaggagacctatgaatgctttcatggtgtgggcaaaggatgagcggaaaaggctcgcacaacagaaccccgatcttcataatgctgttctcagcaagatgctcggaaaagcctggaaggaactgaatgcagccgagaaaaggccctttgtagaagaggccgaacgtctgagagtccagcacttgcgggaccatcccaattataagtatcgaccccgccggaagaagcaagctagaaaggctagacgcctggagccaggcttactacttccaggtctggctcccccacaacctcctcccgaacccttcccagcagctagtggctccgcccgcgcttttagggaactgcccccattgggcgctgagtttgacggcttaggcctgcccaccccagagcgttcccccttggatggtctcgaacctggggaggcagccttcttcccccccccagctgcacccgaagattgcgccctccggccttttcgcgccccctacgcccccaccgagctgagccgggacccggggggttgctacggagcacctttagcagaagcactgcggactgcccctcccgctgcccccctggcagggctctattacggcacactcggcaccccaggcccgtacccaggtcccctttcgccgcccccagaagcacctccccttgaatcggcagaacccctaggacccgccgctgatctgtgggctgacgtcgacttaactgagttcgatcagtatctcaactgttctagaacacggcctgacgcaccaggccttccttaccacgttgctctggcgaagttgggaccgcgcgccatgtcctgtcctgaggagtcctccttgatcagcgccctgtcagatgcctcgagtgctgtgtactacagtgcatgcatatccggatag

SEQ ID NO: 136222 - DNA, 831 bp, Artificial Sequence
  Description of Artificial Sequence: Synthetic coding sequence
atgtctaaacccgtagaccacgtaaaacgcccaatgaatgcatttatggtgtggagcagggcccagcgacgaaaaatggctcaggaaaatcccaagatgcacaattccgagatttcgaaaagactcggcgcagaatggaagttgcttaccgagtcagagaagcggcccttcatcgacgaagcaaaacggctgcgtgctatgcatatgaaggaacatcctgattacaaatatagacccaggaggaagcctaaaacactgttgaagaaggacaaatttgcattccccgtaccgtatgggctcggtggtgtcgcagacgccgagcacccagcgctgaaggcgggagccggtctccacgctggcgctggcgggggattggtccccgagtccctgttggccaatcccgagaaagcagctgccgctgctgctgcagccgccgcaagagtatttttcccccaatcagctgccgccgccgcagctgcagccgcggctgccgccgcaggaagcccttatagcctcttagacttgggttcaaagatggccgagatttcctctagttcctcgggactgccatatgcctcatcactggggtaccctaccgctggtgcgggagcttttcacggtgctgctgctgcagccgctgccgctgcagctgcagcaggcggacatactcattcacacccctcccctggcaatccgggttacatgatcccatgcaactgctctgcctggcccagcccaggactgcaaccacccctggcatatatattgctgccaggcatgggcaaaccacagctggatccataccccgctgcttacgctgctgctctgtag

SEQ ID NO: 136223 - DNA, 1341 bp, Artificial Sequence
  Description of Artificial Sequence: Synthetic coding sequence
atgcgccctgtgagggaaaattcctctggcgcccggtcccctagagtgcctgccgaccttgctcggtcaatcttgatttcattaccattccctccagatagtctcgcacatcgcccaccttctagtgcccctacggagtcacaaggcctgtttaccgtagctgcaccagccccgggagccccctctccacctgcgacactcgcccacctcctgcctgccccagctatgtactcattgctcgaaacagagttgaagaatcctgtgggtacaccaacacaggccgctggaacagggggccctgccgctccagggggcgccggtaagagtagcgctaacgccgcaggaggcgcaaactcaggaggaggcagtagcggcggagcatcgggtggcgggggcggcaccgaccaggacagggtaaagaggcctatgaatgctttcatggtatggagccggggccagcggaggaagatggccttagaaaatcccaaaatgcacaattctgaaatctctaaacggctcggagccgactggaaactgctcaccgatgcggagaagcgccctttcattgacgaggccaaaagattgagagccgtgcatatgaaggagtaccctgattacaagtaccgcccgaggcgcaagaccaagacactgctcaagaaggacaagtactcccttccgagcggcttgcttccacccggcgccgccgcagcggctgctgccgctgccgctgccgcagccgccgcatcctccccagtgggggtgggtcagcgcctagacacctacacacacgtgaacggctgggctaacggcgcctactccctcgtccaagagcaactaggctacgcacagcccccctccatgagctctcctcccccaccaccagccttaccacccatgcatcgatacgacatggccggcttgcagtactctcccatgatgccacccggggcacagagctacatgaacgtagctgctgctgctgcagcagcgagcggatatggcggcatggccccctcagctactgctgcagccgctgctgcttatgggcagcagccagccacagccgctgccgctgcagctgctgcagcagccatgagtctaggtcccatggggtctgtggtgaaaagcgagccttcatcgccacccccagctatcgccagccactcccagagagcgtgcttgggagacctgagagacatgatatctatgtatctaccacctggtggggacgccgccgatgctgcttctccgctgccaggaggtcgacttcatggtgtgcaccagcattaccagggggcgggtactgccgttaacggcaccgtccctttgacacatatttag

SEQ ID NO: 136224 - DNA, 2253 bp, Artificial Sequence
  Description of Artificial Sequence: Synthetic coding sequence
atgagtagcaaaaggcctgcctctccttatggcgaggcagacggggaggtggccatggtgaccagtagacagaaggtggaggaagaagagtccgacgggctcccagcttttcacctccccctgcatgtttcctttcccaacaagccccatagtgaggaattccagccagttagcctgttaacgcaggaaacctgcgggcacaggaccccaaccagccaacacaacacaatggaggtagacggtaacaaggtaatgtcttcatttgcccctcacaactcctccaccagtcctcagaaggcagaggagggcggtaggcaatcgggcgaaagcctttcaagtacagcgctcgggactccggagcgtcgtaaaggcagtctggctgacgtcgtggacacactgaagcagcgcaagatggaggagttaatcaaaaacgaaccagaggagacaccatcgatcgaaaagctcctcagcaaagactggaaggataaactgctggcaatgggatcgggcaacttcggagagataaagggcactccggagtctctcgcagagaaggagcggcagttgatgggtatgatcaaccagctgacaagcctccgagaacagctgctagccgcccatgatgaacagaagaaactggctgcctctcagatcgagaaacagcggcagcagatggagctcgcaaagcaacagcaggagcagattgcgcgacagcagcagcaactattgcagcaacagcacaaaatcaacctgctgcaacagcagatccaagtgcagggtcagttaccaccccttatgatcccggtattccctccagaccagcggacactggccgcagctgcgcaacaaggctttcttctgccaccaggcttttcctataaagccggttgtagcgatccctaccccgttcagctcattccgaccactatggctgctgcggccgcggccacccctggactcggcccgctgcagttgcagcagttgtacgccgcacaactggccgcaatgcaggtctcccctggcggtaagcttcccggcattcctcagggaaatctgggcgccgctgtttccccaaccagcatacatactgataagtccacaaactcaccgccacccaaatctaaagacgaagttgcacagcctctgaatctcagcgcaaaacctaagacaagtgatggcaaaagccccacatcacctaccagtccccatatgcctgccctgcgcatcaatagtggagctggcccactgaaagccagcgtccccgctgccctggctagccccagtgcgcgtgttagcaccatcgggtacctgaacgaccatgacgccgtgaccaaagcaattcaagaggcgcgacaaatgaaggagcaacttcggagggaacagcaggtcctcgatgggaaagttgccgtggtaaactcgctggggttgaacaactgtcgcactgagaaggagaagactacattggagtccctgacccagcaactggcggttaaacaaaatgaggagggaaagtttagtcatgcaatgatggactttaatctgagtggcgattccgatggcagcgccggagtgtcagaatctagaatctatcgagagtccagagggcggggtagcaacgaaccgcatatcaagaggccaatgaacgcctttatggtttgggccaaggacgaacggagaaagatactccaggctttccctgacatgcataattccaatatatcgaagattctggggtcacgctggaaggccatgacgaatttagagaaacagccttactatgaagagcaggccagactgtccaaacagcacttagagaaataccctgattataaatataaaccgcgaccaaagcgcacttgccttgtggacggcaaaaagttgcgcattggagagtataaggctatcatgaggaacaggcggcaggagatgagacaatatttcaatgtgggccagcaggctcagattccaattgccaccgctggcgtggtgtatcccggcgctatagctatggccggcatgccatctccacatcttccctccgagcattcgtcggtatcctcttcccctgaaccaggcatgccagtcattcaatcaacgtacggcgttaagggggaggagccccacatcaaagaggagattcaggctgaagatataaatggcgaaatttacgacgagtatgacgaggaggaagacgatcccgacgtggattatgggtccgattctgagaatcacattgcaggccaggccaattag

SEQ ID NO: 136225 - DNA, 1929 bp, Artificial Sequence
  Description of Artificial Sequence: Synthetic coding sequence
atgtcttctaaacgccctgcctctccctacggcgaagccgacggcgaggtggcgatggtgacgagccggcagaaggttgaagaagaagaatctgacggcctccctgcctttcacttgccgcttcatgtatcgtttcccaacaagcctcactctgaagagttccagccggtgtcactattgactcaggagacctgtggacacaggactccaacctctcagcataacacaatggaggtggacgggaacaaagtaatgagttcattcgctcctcataacagcagtacaagtccgcagaaggccgaagaggggggaaggcagtccggagagtcactgtcttccaccgcattaggcacccccgagcggcgcaaaggttccctcgcagatgtggtggatacccttaagcagagaaagatggaggaactgatcaagaatgagcctgaggagacccccagcattgagaaactgctgtctaaagactggaaggataaattactggccatgggctcgggtaactttggagaaatcaaaggcacccctgaatcactggccgagaaggagcgacagcttatgggcatgatcaaccagttgaccagtttgcgtgagcagctcctggcagctcacgatgaacagaaaaaacttgcagcttctcaaatcgagaaacaacgccaacagatggaactggctaagcagcagcaagagcaaattgctcgacagcagcagcaactcttgcaacaacagcataagatcaacctcctgcaacagcagattcaagttcaaggccaactgcccccattaatgatcccagtgttccctcctgaccaaaggacattagccgcggcggcccagcagggtttcctgctgccacctggttttagttataaagccgggtgtagtgatccgtaccccgtacagcttattccaaccactatggcagctgcagctgctgcgactcccggactgggaccattgcagctgcagcagctgtacgctgcccagttggctgcaatgcaggtttccccgggcggcaagcttccaggtattccccagggaaatctgggtgctgccgttagtccaacctctattcataccgataaatcaactaacagccctccccccaaaagcaaggaaaaaaccaccctggagagcttgacacagcagcttgctgttaaacagaacgaggaaggaaaattctcccacgccatgatggactttaacctctctggagattcagatggatctgcaggagtctccgagtctcggatctaccgggaatccagaggaagaggctcgaatgagcctcacattaagagaccaatgaatgcctttatggtatgggccaaggatgaaagacggaaaatcttgcaggcctttcccgatatgcacaactctaacatctccaaaattctgggctccagatggaaggccatgaccaacctggaaaaacagccatattatgaagagcaagcaagactgagcaaacaacatcttgaaaaatatcccgattataagtacaagccccggccaaagagaacatgtctggtagatggaaagaagcttagaatcggcgagtacaaagccattatgcggaataggcgccaggaaatgcgacaatacttcaatgtgggtcagcaagcccagatccccatagcaacagcgggcgtcgtctacccgggggccatcgcaatggccggaatgcctagccctcacctgccctctgagcactcctccgtctcttccagccccgaaccgggtatgcctgtgattcagagcacttatggagtaaaaggtgaggaacctcatattaaggaagagatccaagccgaggacattaacggcgagatttatgatgagtacgacgaagaagaagatgatcccgacgtggactacgggtcggacagcgaaaatcacatagctggacaggccaactag

SEQ ID NO: 136226 - DNA, 1134 bp, Artificial Sequence
  Description of Artificial Sequence: Synthetic coding sequence
atgcatgacgaagtggctcaacctctaaacctttctgccaagccaaagacatctgatggtaagtccccgacatctcccactagcccacatatgccagccctccgtataaacagcggggcgggccccctcaaagcctccgtgccagcagctctggcatccccatcagctcgcgtgagcaccatcggctacctaaacgatcatgacgcggtgaccaaggccattcaggaagctcggcaaatgaaggagcagctcagacgtgagcaacaggtcctggatgggaaggtggcagttgtgaacagcctcggtctcaataattgtaggactgagaaggaaaaaactactcttgagagtcttactcagcagctggcagtgaagcagaatgaagagggaaagttcagccacgctatgatggattttaacctgtccggcgattctgacggaagcgctggtgtgagcgaatccaggatttatcgtgagtccagagggcggggatcaaatgagccacacattaagcgccccatgaacgcctttatggtgtgggcgaaggacgagcgcaggaaaattctccaggctttccctgatatgcacaactccaacatcagcaaaattctaggctcacgatggaaggctatgacaaacctggagaagcaaccttactacgaagagcaggcacgtctcagtaaacaacaccttgagaagtaccccgactacaaatataaacctagacctaaacggacctgtctggtggacggaaagaagcttcgtattggcgagtacaaggccatcatgcgaaaccggaggcaggagatgagacaatatttcaacgtcggccagcaagctcaaattcccattgcaaccgcaggggtcgtgtatcccggcgccatcgcaatggcagggatgcccagccctcacctgccaagcgagcactcctcggtgtcttcctccccagaaccaggaatgccagtcattcagagcacttacggcgtgaaaggcgaagaacctcacatcaaagaggaaatccaggctgaggatatcaatggggagatctacgacgagtatgacgaggaagaggatgaccctgacgtggactacggttctgactccgaaaaccatattgctggacaagccaactag

SEQ ID NO: 136227 - DNA, 1764 bp, Artificial Sequence
  Description of Artificial Sequence: Synthetic coding sequence
atgagcagcaaacgtcccgcatccccttacggagaggcagacggtgaagttgcaatggtgacaagcagacaaaaagtcgaagaagaggagagcgatggattaccagcgtttcacttgcctttacacgaagtcgatgggaataaggtgatgtcatcattcgcccctcacaatagctccacatcccctcagaaggccgaggaaggtggccggcagtcaggagaaagcctatcctccaccgccctgggaacccctgaacgaagaaagggcagcctggccgacgttgtagacaccctgaagcagcgcaagatggaggaactaattaaaaacgaacctgaagaaacaccgtcgatcgaaaaactgctgtcaaaagattggaaagacaagcttcttgcgatgggaagcgggaacttcggggagatcaaaggaactcctgagtccctggccgagaaggaacggcaactcatgggcatgataaatcaactgacttctctgcgggagcagctgctggcagcccacgatgagcaaaagaaactggctgcaagccagatcgagaaacagcgccagcaaatggagttagctaagcaacagcaggagcagatagctcgccagcagcagcaactccttcagcagcagcacaaaattaacctgctgcagcagcagatccaagtgcagggccagctccccccccttatgatccctgtctttccaccggatcagaggaccctggctgccgcggcacagcagggcttccttctgccacccggcttttcatataaggcaggctgttctgatccataccctgtgcagctgattcctaccacgatggcggctgctgcggcagccacccctggcctcggacccctacagttgcagcagctgtatgcagcgcaactggcagctatgcaagtgtcacccggagggaaacttccaggaatcccccagggcaatctgggcgctgctgtctctccgacctcaattcatactgacaagagcaccaatagcccccctccaaaaagtaaagacgaagttgctcaaccgctcaacttgagcgctaaaccaaaaacatccgacggtaaaagccctactagccctacatctccccacatgcccgctctgaggatcaatagtggggccggaccactgaaagcctcggtgccagccgcattggcctctccttccgccagggtcagcacgattggctatttgaatgaccacgatgcagtgactaaggcaatccaggaggctagacaaatgaaagaacagctcagacgcgaacagcaggtattggatggcaaggtggctgtcgtcaattcactgggcttgaacaattgcaggacggagaaggagaaaacgaccctggagtcactaacacagcagctcgcggtgaaacagaacgaagaaggtaagttcagccacgctatgatggactttaatctgtcaggggatagtgatggttcagccggggtgtcagagagccgcatctatcgcgagtcccgtgggcgcggaagcaacgaaccacatatcaagcgccctatgaacgcatttatggtgtgggcaaaggatgagaggcggaagatcctccaggcgttccccgaccttggcttcctgtgtgtctgcatgtatgttatcatggtgctgatcatcggcattacccttgatcactgtgaactgaacccgcatctgggcatgaagagccatatcttgcccagcgactggagccgcaacaatttggatcttgacttcgctctgcaaatgacgacatag

SEQ ID NO: 136228 - DNA, 2292 bp, Artificial Sequence
  Description of Artificial Sequence: Synthetic coding sequence
atgcttaccgacccagacctcccccaggaatttgaaaggatgtcatcaaagcggccagcctcaccatatggggaagcagacggagaggtagcgatggtcacatctcgacagaaagtggaggaagaggagtcggatggcttgcccgcctttcatctccctctgcatgtgagctttcccaacaagccacacagtgaggaattccagcccgtgtctctgcttactcaggaaacctgcggccacaggacaccaaccagtcagcacaatactatggaagttgacgggaataaggtaatgtcttcattcgccccacataactctagtacttctccacagaaagctgaagaggggggacgccagtcaggcgagtcactttccagtactgcgctcggcacacccgagcggcgcaaaggttccctggctgacgtggtggatacccttaaacagcgaaagatggaggaattgatcaagaatgaaccagaggagaccccaagcatcgagaaacttctctccaaggattggaaagacaaactcttggcgatggggtccgggaatttcggtgagatcaagggaacccccgagtcactcgccgagaaggagcggcagctcatgggaatgatcaaccaattgactagcttgcgggagcagctgctcgcggcacatgacgagcaaaagaaactggccgccagccaaattgagaagcagaggcagcagatggaactggccaagcagcaacaggaacagatcgctagacagcagcagcagctgctgcagcagcagcacaaaatcaaccttctgcagcaacagatccaggtgcagggccagctgccccccctaatgatccccgtgttccctccagaccagcggactctagcagctgcagcacagcaaggattcctgctgccccctgggttttcctacaaggccggatgttccgatccctacccggtccagctgattcctacaacaatggccgccgcagccgccgccacccccgggctcggacctctacagctccaacagctgtacgcagcccagcttgctgcaatgcaagtctctcccggaggcaagctgccgggaatcccccaggggaacctcggggctgctgtgtcccccacctccatccacaccgataagagtacaaacagtccgcctcctaaaagcaaagacgaggtggctcagccccttaatttgtctgctaagccaaagacatcagacggcaagtcccctaccagtccaaccagtccacacatgcctgcactaagaattaactctggggcagggcctcttaaggccagtgtccccgctgctttagcctcacccagtgcacgggtctctactattgggtatcttaatgatcatgacgctgtgacaaaagccattcaagaggcacggcagatgaaggagcagcttaggagggagcaacaggtcctcgacggcaaggtcgccgtcgtcaacagtttgggactcaataattgtagaacagaaaaggagaaaacaaccctcgaaagcctgacacaacagctcgcagtgaagcagaatgaggaggggaaattcagtcatgcgatgatggactttaacctaagtggcgattcggacggctcagccggcgtctctgaaagcaggatctacagagaaagtaggggacgcggctctaacgagccccatatcaagcggccaatgaatgctttcatggtttgggctaaagacgagagaagaaaaatcctccaggccttcccagatatgcataattccaacatcagtaagatcttagggtcaagatggaaagctatgacaaaccttgaaaagcagccctactacgaagagcaggccaggttgtcaaaacagcatcttgagaagtaccctgattacaagtataagccgcggcccaaaagaacatgcctcgtggatggtaagaagctgcggatcggagagtacaaggcaataatgcggaaccgacgccaggagatgcggcaatacttcaatgttggccagcaggcccaaatcccaatcgcgactgccggagtggtgtatcctggcgccatcgccatggccgggatgccatcacctcacctgccttcagaacatagttcagtctcatcttctccggaaccagggatgccagtcattcagtcaacttacggagtcaagggagaggagccccacatcaaagaggaaattcaagcagaggatataaatggggaaatctacgacgagtacgatgaagaagaagatgatcctgacgtagactatggcagcgattcagagaatcacattgctggtcaggcgaattag

SEQ ID NO: 136229 - DNA, 1929 bp, Artificial Sequence
  Description of Artificial Sequence: Synthetic coding sequence
atgtcatccaaaagacccgcttctccatatggcgaggccgacggggaggtcgcgatggtgacttcacgccaaaaggtggaagaggaggaatcagatggactaccagcttttcatcttccactccacgtcagttttcctaacaagccgcacagcgaggaatttcaacccgtgtcattgttaacacaggagacatgcggacatcggacccctacctctcagcacaatacaatggaagtggacgggaacaaggttatgagttcctttgctccacacaatagtagcacctccccccaaaaggcggaagaagggggccggcagtccggagagtcactcagtagcacagcccttgggacgccggagcgtagaaagggtagcctggctgatgtggtggatactctaaagcaacgcaaaatggaggagttaattaaaaacgagccagaagaaacacctagcattgagaagctcctctctaaggactggaaggataagctgctcgcaatgggctcgggtaactttggggaaattaaggggaccccagaatctttggctgagaaggagagacaactgatgggaatgattaatcaattgacatccctgcgggaacagttgttagccgcccacgatgagcagaaaaagttagctgccagccagatcgaaaagcaaagacaacaaatggagctggctaagcagcaacaggagcagatcgccagacaacagcagcagctcttgcaacaacaacacaagatcaaccttctccagcagcaaattcaggtgcaaggccagctgccgcctttgatgattcccgttttccctcctgaccagcgcactctagctgctgccgcacagcagggcttcctcctgccacctggatttagttacaaggcgggatgctcagacccatatcccgtgcagctgatccctactactatggcagctgccgctgcagcaacgccaggcctcggccccttacaactgcagcagctgtatgcagcgcaactggctgcaatgcaagtgtctccggggggcaaactgcccgggatcccacaggggaaccttggtgccgctgtgtccccaacttcgatccacaccgataagtccacaaattcccctccgccgaagagcaaggagaaaaccacattagagtctctgacccagcagcttgccgtgaaacagaacgaggaggggaagttctcccacgccatgatggactttaatttatctggcgactctgacgggtcagcaggggtaagcgagtcaaggatataccgggagagtcggggcaggggttccaacgaaccacacataaaaaggccgatgaacgcctttatggtgtgggccaaagatgagagacgcaagatcctccaggctttccccgacatgcataattcgaatatcagtaagattcttggctcaaggtggaaggctatgacaaatttggaaaaacagccctattatgaagaacaggcccggctgtctaagcaacacttggagaaatacccagattacaaatacaaaccccgacctaagaggacatgtcttgtagacggaaagaagctgcgcattggagagtataaggccataatgaggaaccgccgtcaggaaatgagacagtatttcaatgtgggacagcaggcacagattccgattgcaaccgccggggttgtgtatccaggcgctatcgccatggcgggtatgccttcaccgcatttgccttctgaacatagttccgtgagctcgagccctgagcctggaatgcccgtaatccagtctacttacggagttaaaggtgaagaacctcatattaaagaggagatacaggctgaagatatcaatggtgaaatctacgacgagtacgacgaagaggaggatgatcccgatgtggactatggatccgactccgagaaccacattgccggtcaggctaactag

SEQ ID NO: 136230 - DNA, 2253 bp, Artificial Sequence
  Description of Artificial Sequence: Synthetic coding sequence
atgtcttcaaagagacctgcgagtccatacggagaggctgacggggaagttgcaatggtgacatccaggcagaaggtcgaggaggaagagagcgacgggctgcctgccttccatctgccattgcatgtcagctttcccaacaagccgcattccgaagagttccagccagtctctctgctgacccaggagacctgcggtcacaggacccctacctcgcaacataacacaatggaggtcgatggcaataaagttatgtcatccttcgcaccgcataactcttctacttctcctcaaaaggctgaagaaggtggccggcaatccggtgagtcactatcatccactgcactgggtacaccagaaaggcggaagggcagtctagccgacgtggtcgacaccctgaagcagcgtaaaatggaagagctgattaagaacgaacctgaggagactccttcaatcgagaagctcctaagcaaagactggaaagacaagctcttagcaatgggctcaggaaatttcggcgaaatcaagggtactcctgagagccttgcagagaaggaacggcagctgatggggatgattaaccagctcacgtctcttagagagcagttgctcgcagcgcacgatgagcagaaaaagctcgccgcctctcagatcgaaaagcaacgacaacagatggaactcgctaagcagcagcaggagcagatcgcgagacagcaacagcagctcctgcagcaacagcataaaatcaatctgctgcaacagcagatccaggtgcaaggccagctacctcctctgatgatccctgtttttcccccagaccaaagaactctcgctgcggcagcacagcaaggattcctccttccgccaggcttttcttataaggcagggtgcagtgacccataccctgtgcagcttattccgacaaccatggcagcagccgcagctgccacacccggcctaggtcccctgcagttgcaacagctttacgctgcccagctagctgcaatgcaggtgtcaccaggaggcaagttgcctgggattccacagggaaatctcggcgcagctgtgtcaccgacttcaatacacaccgacaaatctactaattcgccaccccccaagagcaaggatgaggtcgcccaacccctaaacttgagcgccaaacccaaaacatctgacggtaagagtcccacctcaccaacttcaccccacatgcctgccctgcgcattaactctggagccggccctttgaaggcttctgtgcctgccgccttggcttccccttctgcccgggttagcacaatagggtacctgaacgaccatgacgctgtgactaaagccattcaggaggcgagacagatgaaggagcagttgcggcgggagcaacaggtgttagacgggaaagtagcagtggtcaacagcctgggactgaacaattgcaggaccgagaaggagaagacgactctcgaatcgctcactcagcagctggctgtgaagcagaacgaagaaggcaagttttcccatgccatgatggatttcaacctcagcggcgatagcgacggatctgccggggtttctgaaagcaggatctatagagaatcaagaggtcgcgggtcaaacgaacctcacattaagcgcccgatgaatgcgtttatggtatgggcgaaggacgagcgtcgcaagatcttgcaagcgtttcccgacatgcacaattcaaatatttccaagatcctgggcagccgctggaaggctatgacaaatctagagaagcagccctactatgaagaacaagcacgcttatctaagcagcacttagagaagtaccccgattataagtacaagcccaggcctaaacggacatgcctggtagatggtaagaaactccggattggcgagtacaaggctattatgcgcaataggcgccaggaaatgagacaatattttaatgtgggccagcaagctcagattcctatcgccaccgcaggcgtggtgtatcctggcgccatagccatggcgggcatgccaagtcctcatctcccgtcggagcacagctcagtatcctcatcccctgagcccgggatgcccgtgatccagtccacatacggtgttaagggtgaagagccacatataaaggaagagatccaggccgaggacatcaatggcgaaatctacgacgagtatgacgaggaagaggacgaccccgatgtggactatggttcagatagcgaaaatcatatcgctggtcaagccaattag

SEQ ID NO: 136231 - DNA, 2427 bp, Artificial Sequence
  Description of Artificial Sequence: Synthetic coding sequence
atgagttccaaacaagccacctctcctttcgcctgtgccgccgatggggaagacgctatgacacaagatcttacgtctcgcgaaaaagaagagggcagcgatcaacatgtggcaagccatctccctctccaccccatcatgcataataagccgcacagcgaggagctgcccactttggtgtccaccatccagcaggacgccgattgggatagcgttctctcaagtcagcaacggatggagagcgaaaataacaagctttgtagcttgtatagctttcggaatacctcgacatcccctcataagccggatgaggggtcccgggacagggagatcatgacttctgtaaccttcggcaccccggaaagaaggaaaggctcacttgctgacgtggtagatactctgaagcagaagaagcttgaggagatgacaaggaccgaacaggaggattcaagttgcatggaaaaactactttcaaaggactggaaagaaaagatggagcggttgaatacttctgagctactgggcgaaatcaaaggcacccccgagtcgttggctgaaaaagagcggcagctgtccacaatgatcactcagctgatatcgctgcgggagcagctgctcgcagcccacgacgagcagaaaaaactagcagcatcacagatcgagaaacagaggcagcagatggatttagcgaggcagcagcaggagcagattgccagacaacaacaacagttgttgcaacagcagcacaagatcaacttactgcagcagcagattcaggtgcagggccatatgccccctttgatgatccccatctttcctcacgaccaacggacattagcggcagctgctgccgcccagcaggggtttctgttcccacctggcattacatataaaccaggggacaattaccccgtccagttcataccatctacgatggccgccgccgcagcttccggcctatcgcccttacagttacaaaaaggtcacgtgagtcacccacaaatcaaccagcggctaaagggtctctctgatcgctttggacggaatctggatacattcgagcacgggggcgggcattcatacaaccacaaacagatcgaacagctgtatgcagcccagttggcttctatgcaagtttcccctggagccaagatgccttccacaccgcagcctccgaacactgcgggaaccgtcagtccgacaggaatcaaaaacgaaaagcgcggcacaagtcctgtcacccaggtgaaggatgaggcagccgcccagccactcaatctgagctctagaccgaaaactgcggagcccgttaagtctccaactagccccacacagaatctgtttccagcaagcaagactagccctgtaaacctaccaaacaaaagctcgattccttctcctatcggcggcagtctggggaggggatctagcctagacattctgtcctcactcaattctccagctctcttcggtgatcaggatacagtgatgaaggccattcaggaagctcggaagatgagagaacagatccaacgggaacaacagcagcagcaaccgcatggggtcgacggcaagttatcctctatcaacaacatgggtctgaactcttgtcgaaacgagaaggagcgtacaagattcgaaaaccttggaccgcaactgacagggaagagtaatgaggacggaaagctcggccccggagtgattgaccttaccagacccgaggatgccgaaggcggggctacggttgcggaagcccgcgtgtacagagacgcccgaggaagggccagtagcgagccccacatcaagaggccgatgaacgcatttatggtgtgggcgaaagatgagaggaggaagattctgcaagcttttcccgatatgcacaattccaatattagcaagatcctcgggagccgctggaagtccatgtcaaatcaggagaaacagccttactatgaagagcaggcccgattgagcaaaattcatctcgaaaaatatcccaattacaagtacaaaccccgtccaaaaagaacttgcattgttgacggcaagaaactgagaatcggagaatacaagcagctaatgagatctagacgccaggagatgcgccagttctttacagtcggtcaacagcctcaaatcccgatcaccaccggaactggggtcgtctatccaggggctatcacgatggccaccaccactcccagtccacaaatgacgagcgattgctcgagtacttctgcgagtccagagccatctttgccggtaatccagagtacctacggcatgaaaactgacggcgggtcgctggctggcaacgagatgatcaacggggaagacgagatggaaatgtacgatgactacgaagacgacccaaaatctgactacagctccgaaaatgaggctccagaagccgtgtctgctaattag

SEQ ID NO: 136232 - DNA, 2487 bp, Artificial Sequence
  Description of Artificial Sequence: Synthetic coding sequence
atgtctagtaagcaggccaccagtcctttcgcatgcgccgcggacggcgaagatgctatgacccaagacctgacctcccgcgagaaagaagaaggatctgaccagcatgtagcctcccacctgccgctacacccaatcatgcataacaagcctcacagtgaggaattaccgacactggtgtcaaccatccagcaggatgccgactgggacagcgtactaagctctcagcagcggatggaatcagaaaataacaaactctgtagcctgtacagcttcaggaacacctccacctcacctcataagcctgacgaggggtcacgggaccgagagattatgaccagtgtcacctttggcacaccggaacgtagaaaagggtccctggccgacgtggtggatactctgaagcaaaagaaacttgaggaaatgaccagaaccgagcaggaggacagctcctgtatggagaagttgctcagtaaagattggaaagagaagatggagaggcttaatacgagcgagttacttggagagattaaaggcacacctgaatctctcgccgagaaagaacgacagctgagtacaatgataacacaactaatcagtctgcgtgaacagctgctcgctgcccatgatgaacagaagaaacttgccgcgagccagatcgagaagcagaggcagcagatggacctcgctcggcagcagcaggaacagattgccaggcaacagcaacagctattacagcagcaacacaaaatcaacctcctgcagcagcagattcaggttcagggtcacatgccccccctaatgattcccatcttcccacatgaccagaggacactcgccgcggccgccgccgcacagcaggggttccttttcccacctggaattacgtacaaaccaggcgacaactaccccgttcagttcatccctagtacaatggcggcagctgccgcttccgggctatcaccactccagctgcaaaaggggcatgtgagtcaccctcagattaatcaaaggctcaaggggctatctgatcgttttggccggaacctcgatacattcgagcacggggggggacactcctataaccataagcaaattgagcagctttacgcagcgcagctcgcttccatgcaagtgtcccccggagcaaagatgcccagcacccctcaacctcctaataccgcgggtacggtgtctcctacgggtataaaaaatgaaaagcgcgggacaagcccagtgacacaggtcaaagatgaagccgcggcgcagccgctgaacctttccagcagacccaagacagctgagccagtgaagtcacccacgagcccaacacaaaacttgttccccgcatctaagaccagccccgtgaacctccctaacaaaagctcaatcccaagccccatcggtggctccctggggcggggtagttcattagacatcctgtcctcactgaatagcccagcactgttcggggatcaagataccgtgatgaaggcaatccaggaagctagaaaaatgcgtgagcagatccagagagaacagcagcagcagcagcctcacggtgtcgacgggaaactgtccagcattaataatatgggactgaattcctgtcgcaacgaaaaagaacgtacccgtttcgagaacctcgggccgcagcttactggtaagtccaatgaggacggcaaactcggacccggcgtgatcgatcttacccggcccgaagacgctgaagggagcaaggctatgaacggatccgctgccaagctgcagcagtattactgttggcctacaggaggggccacagtggctgaagcgcgggtgtaccgagacgcacgtgggcgcgcctcctccgagccacatattaagaggcctatgaatgcctttatggtgtgggccaaagatgagagacgtaagatcttacaggcattcccagacatgcataattcaaacatctctaagattttaggaagcagatggaaatcgatgagcaaccaggagaaacagccctactacgaggagcaggcgcgcctgtctaaaatccacctggagaaatacccaaactataagtacaagcctagacctaagagaacatgtattgtggacggcaaaaagctccgtattggagagtataaacaactaatgcggtcgaggcggcaggagatgcggcaatttttcaccgtggggcagcagcctcaaatccctattacaaccggtaccggcgtggtttatcccggcgcgatcacaatggcgaccactacaccttctcctcagatgacaagtgattgttcaagcacatccgcatctcctgaaccctcacttccagttatccagtctacatatggtatgaagacagacggcgggagtttggccggtaacgaaatgatcaatggggaggacgagatggaaatgtatgacgactacgaagacgatcccaaatctgactatagtagcgaaaatgaagcaccagaggcggtgtcagccaattag

SEQ ID NO: 136233 - DNA, 2427 bp, Artificial Sequence
  Description of Artificial Sequence: Synthetic coding sequence
atgagcagtaagcaagcaacgtcccccttcgcatgcgccgcagatggggaggatgccatgacacaggatctgaccagtcgcgagaaggaagagggatccgatcagcatgtggctagccacttgcctttacacccaatcatgcataacaagccgcactctgaggagctccctacccttgtctcaactatacaacaggatgctgattgggattctgtgctgtcttcccagcaaagaatggagagtgagaacaacaaattatgctcactctattcattccggaatacttctactagtccgcacaagcctgacgagggcagtcgtgaccgcgaaataatgacaagtgtgaccttcgggacgcccgagcggcgcaaagggtccttagcagacgtagttgatacgcttaaacagaagaagctggaagaaatgacacggaccgagcaagaggacagttcatgtatggaaaagctcctaagcaaggattggaaggaaaagatggagagactgaatacaagcgagctgctgggcgagatcaaaggtactcctgagagtttggccgaaaaagagcgccagcttagcacaatgattacgcagttgatttccctgcgggaacagttgcttgcagcgcatgatgaacagaagaagctagctgcctcccagatcgaaaagcagcggcaacagatggacctcgcgcgacaacaacaggagcagatcgccaggcaacaacagcaactcctgcagcagcagcataaaatcaacctcctgcagcagcagattcaggtgcaggggcacatgccaccactcatgatccccatcttcccccatgatcagcgaacgctggccgccgctgccgctgcacaacaggggttcttatttccacctggaataacctacaagccaggggataattacccagttcaatttatcccatcaaccatggctgcagcagccgccagtggcctgtccccactgcagctgcaaaagggtcatgtgtcgcacccccagatcaaccagcgccttaagggtctgtccgacaggttcgggagaaaccttgatacatttgaacatggcggaggacactcttacaaccacaaacaaatcgagcagctgtatgctgcccagctcgcaagcatgcaggtttctcctggtgcgaagatgccctccaccccacagccgcccaacacggctggaaccgtttctcctacaggcataaaaaacgaaaagaggggcacctctcccgtcacccaggtcaaggacgaggccgccgcacaacccttaaacctctcctccagacccaagaccgccgaacccgtaaaatcaccaacgtctcctactcagaacctgtttccagcttcaaaaacttcaccagtgaatcttccaaataaatcaagcattccgtctcccatcggtggttctctgggcagaggctcctcactcgacatactgtcctcattgaattctcctgccctctttggagatcaggacaccgtgatgaaagccattcaggaagcacggaagatgagagaacagattcagagagagcagcagcagcagcagccacacggtgtagatggcaaactaagctctataaataacatgggcctgaattcatgccgcaacgaaaaggaacggactaggttcgaaaatctgggcccccaactgacagggaaaagcaatgaggatggaaaactggggccaggggtcatcgatctaactagacctgaggacgcagaaggcggggcgactgtggctgaagcccgagtgtaccgagatgcgcgggggagggcctctagtgagccccatattaaaagaccaatgaatgcattcatggtctgggcaaaggatgaacgcaggaaaattttgcaagcattccccgatatgcacaatagcaatattagtaaaatcctcggatctcgatggaagtcaatgagcaatcaggaaaagcaaccttactacgaagagcaggctaggctgtccaaaatccacctcgagaaatatcctaattataagtataaaccacgccccaagagaacttgcattgtcgatggaaagaagctgagaatcggggaatacaagcagctgatgcgaagccggaggcaggagatgcggcaattcttcactgtcggccagcagccacaaattccaattactacaggcaccggagtggtgtatcctggcgcgatcacaatggccaccacgacgccatcacctcagatgacaagcgattgcagtagcacatccgctagcccagagccatccctgcctgttattcaaagcacctacggcatgaagactgacgggggttcgttagcaggaaacgagatgattaacggagaggatgaaatggagatgtacgacgactatgaggatgacccgaagtcagactactcctccgaaaacgaagcccctgaggccgtttccgccaactag

SEQ ID NO: 136234 - DNA, 420 bp, Artificial Sequence
  Description of Artificial Sequence: Synthetic coding sequence
atgtccagcaagcaggctacaagtccattcgcttgcgctgcggacggggaagacgcgatgacccaggacttaacgtctagggaaaaggaggagggaagcgatcagcatgtcgcttcacatcttcctttacacccgataatgcataataagccacattcagaggagcttcccaccctggtcagtacaatacagcaggacgccgactgggactcagtgctttctagtcagcagcgtatggaatccgaaaataacaagttgtgttctctctattcttttcgcaatactagtacctctccacacaagcccgatgagggctcacgcgatcgggaaatcatgaccagcgtcacttttgggactccagaacggagaaaaggctccctggcggacgttgtcgacaccctgaaacaaaaaaagctctag

SEQ ID NO: 136235 - DNA, 2406 bp, Artificial Sequence
  Description of Artificial Sequence: Synthetic coding sequence
atgtccagtaaacaggctacgtcccccttcgcatgtgcagcggacggcgaagatgcaatgacgcaggacctcacatcacgcgagaaggaggaagggtccgatcagcacgtcgccagccatcttccccttcaccccatcatgcacaacaagccacattcagaagagctcccgactctagtgagcactatacagcaggatgctgactgggattccgttctaagttcccagcagagaatggagtcagagaacaacaaactgtgcagcctttactcattcagaaacaccagcacatcacctcacaagccagatgaaggcagccgtgatcgggagattatgacgagcgtgaccttcgggacccctgagcggcgtaaggggtcacttgcagatgtagtggacaccttgaagcagaagaagctcgaggaaatgacccgcaccgagcaagaggacagctcttgtatggagaagctgctgagcaaagactggaaggaaaaaatggagcgcctcaacacctccgagctgttgggcgagatcaaggggacccccgaatccctcgctgaaaaagaaagacaactgagtaccatgataacccagctcatttctttgcgggagcaactgcttgcagctcacgatgagcagaagaaactcgcagcgtcccagattgaaaagcaacgccagcaaatggatctcgcccgacagcagcaggagcaaatagccaggcaacagcagcagctgctccaacagcagcacaaaatcaacctgctccaacagcaaatacaggtgcagggccatatgccccctctcatgatcccaattttcccacatgatcagcggactttggcagccgccgccgcagctcagcagggcttcctgtttcctcccggcattacctataagccaggagacaattacccggtgcagttcataccctccacaatggccgccgcggcagcctcaggcttatcgcccctccaactccagcagctgtacgcagcccagctcgcctcaatgcaggtatcaccaggtgccaagatgccttctaccccccagcctccaaacaccgccgggaccgtatcccctaccggcatcaagaacgaaaaaagaggcacctcccctgtaacccaggtgaaggacgaggctgccgctcagccacttaatctctctagtcgcccaaagacagctgagcccgtcaagagcccgactagccctacccagaatctttttcccgcatcaaagacctctcccgtgaaccttccaaacaagtccagcataccaagccctattggaggatccttagggagagggtcaagcctagggaaatggaaatcgcagcatcaagaagaaacatacgagctcgacatcctgtccagcctaaacagtcccgcactctttggcgatcaggatacggtgatgaaggccatacaagaagcccggaaaatgagggaacagatccaaagggaacagcagcaacagcagcctcatggagtggacgggaagctgtcatcgataaacaacatgggactgaattcctgccggaacgagaaagagaggacaaggttcgaaaatcttggcccgcaactgaccggcaaaagcaatgaagatggtaagttggggcccggcgtgattgatttgacaagaccagaagacgcggagggaagcaaagctatgaatgggagcgccgctaaattgcaacagtactactgttggccgactggcggcgccacagtcgccgaagcccgtgtatacagagacgctcgcgggcgagcatcttctgagccccacatcaagagaccaatgaacgccttcatggtgtgggccaaggatgagcggcggaagatcttacaggccttccccgacatgcataactctaatatatccaaaatcctggggtccaggtggaaatccatgtcaaatcaggagaaacaaccctattatgaagagcaagctcgcctctctaaaatacacctggagaagtacccaaattataagtacaagcctagacctaagcggacatgcattgtggacggaaagaagctcaggatcggggaatacaagcaactcatgcgatcccgaaggcaggaaatgcggcaattcttcaccgttggacaacagccacaaatccctataacaactggtactggggtggtgtaccccggcgccattactatggctaccactactccaagcccgcaaatgacttccgattgttcatctacatctgcaagcccagagccctcattgcccgtgatccagagcacttatgggatgaaaacagacggaggcagcctagcagggaacgagatgatcaatggggaggacgaaatggagatgtacgatgactacgaggacgatcctaagtccgactactcatcagaaaacgaagcccctgaagctgtctcagcaaactag

SEQ ID NO: 136236 - DNA, 2487 bp, Artificial Sequence
  Description of Artificial Sequence: Synthetic coding sequence
atgtcatcaaaacaggccacctcaccctttgcttgtgcagccgacggggaggacgccatgacgcaggacctgacttcaagggagaaggaggaaggatctgaccaacatgtcgcctcacaccttccattgcaccccatcatgcataataagccgcactcagaagaactcccgaccctggtgagcacaatccaacaggacgctgactgggactccgtcctgagctcacagcagcgcatggaaagcgaaaataataagctgtgttccctttatagctttaggaacaccagtacctcccctcataagcctgatgagggcagtcgcgaccgggagataatgactagtgtgacattcggcaccccagagagacggaaagggtccctggcagatgtcgttgacaccctgaagcagaagaagctggaggaaatgacaaggacggaacaggaggattcttcgtgtatggaaaagttgcttagtaaggactggaaggagaaaatggagcggttgaacacctctgaactgcttggagagatcaaaggcacccccgagtctcttgccgaaaaggaaagacagctgagcacaatgataacacaactcatctccctgcgggagcagctcctggctgcccacgatgaacaaaaaaaattggctgcttctcagatagaaaaacaaagacagcagatggacctcgcacgccagcagcaagaacaaatcgcgcgccagcagcaacagctattgcagcagcagcacaaaattaacttgctgcagcagcagattcaggtgcaaggccacatgccccccctgatgattcccatttttccacacgatcaacggactttggctgccgctgcggcggcccagcagggctttctgtttcccccgggcatcacctataaacctggcgataactacccagtgcagttcattccaagcacgatggccgcagcagccgcaagtgggctcagccctctccaactgcaaaaaggacatgtgtcccaccctcaaattaaccaacggctgaaaggcctgtccgatcggtttggtcggaacctagacaccttcgagcacggagggggacattcctataatcataaacagattgagcagctttatgcggcccaactcgccagtatgcaggtgagtcccggtgcaaaaatgccctcaactccccaaccacctaacacggccggtaccgtctctcccacaggtatcaagaacgagaaaagggggaccagtcccgttacacaggtgaaggacgaagccgctgcccagcccctcaatctgagtagcaggccaaaaaccgccgagcccgtcaagtctcctacgtcaccaacacaaaatctgttcccggcatccaaaactagccccgtaaatctgcccaacaagtcctccatccccagtcctatcggcgggtccctgggaaggggatctagtttagatatcctttcatcccttaattcacctgcattgttcggtgaccaagatacagttatgaaagctatccaagaggcgaggaagatgcgggagcagattcaacgggagcagcagcagcagcaacctcatggagtggatggcaaattgagctctatcaataacatgggccttaacagctgtcgaaacgagaaggaacggactagatttgagaatcttggtccacagctcaccgggaagtcaaacgaagatggtaaactggggcccggcgtgatagaccttactcggcctgaggatgcagagggctctaaagccatgaacggatcggccgcaaaactgcagcagtattactgctggccgactggtggcgctactgtggctgaggcccgtgtctatcgcgacgctagggggcgggcatcttctgagcctcatataaagagacctatgaacgcgttcatggtttgggcgaaggacgagcgccgtaagatcctgcaggctttccccgatatgcacaactccaatatcagcaagattcttgggagccgctggaagagcatgagcaatcaggagaagcagccctactacgaagagcaggcccgccttagtaaaatccacctggagaaataccctaactataagtacaaacccaggcctaaacggacatgtatcgtggatggtaagaagctacggatcggcgagtacaagcagctgatgaggtctcgccggcaggagatgagacaatttttcactgtcggacaacagccccagatcccaatcacaactggcaccggggtggtataccccggggccataacaatggctaccacaactccctctccccagatgacttcagactgcagctccacatcggcatccccagagcctagtctcccggtgatccaatccacatatggaatgaaaaccgatggcggaagcctagccggaaacgagatgattaatggtgaagacgagatggaaatgtacgatgactatgaggatgaccctaagagcgactacagcagtgagaatgaggcgcccgaggccgtgagcgccaactag

SEQ ID NO: 136237 - DNA, 240 bp, Artificial Sequence
  Description of Artificial Sequence: Synthetic coding sequence
atgtcctccaagcaggcaacttcccccttcgcgtgcgctgcggacggggaggatgcaatgacccaggatctgacaagtagggagaaggaagagggttcagaccaacacgtggcttcccatctcccattacatcccattatgcacaacaagccacatagtgaggaattgcccacgctggtatccacaatccaacaggacgccgactgggattccgttctgagttcccagcagcggatgtag

SEQ ID NO: 136238 - DNA, 480 bp, Artificial Sequence
  Description of Artificial Sequence: Synthetic coding sequence
atgtcaagcaagcaggccaccagccccttcgcttgcgcagccgacggcgaagacgcaatgacccaggatctcacaagtagggagaaagaggaggggtcggatcagcacgttgcctctcatctcccactgcacccaataatgcacaacaaaccccatagcgaggagctgccgaccctcgttagcaccatccaacaggatgccgattgggattcagtgctgtccagtcagcagcgcatggagtccgagaacaataaattatgttctctctattcttttagaaacacaagtacctccccccacaagccagatgaagggtcacgcgatcgggagataatgacttctgtcacgtttggcactcctgaacgacgaaagggctcactggcggatgtggtcgacacgctgaagcagaagaaattggaagagatgacaagaactgaacaggaagatagctcatgcatggagaagctactctctaaatag

SEQ ID NO: 136239 - DNA, 2415 bp, Artificial Sequence
  Description of Artificial Sequence: Synthetic coding sequence
atgggcaggatgtcctccaagcaggctacctctcccttcgcgtgcgctgccgatggcgaagacgcaatgacgcaggacctcacgtctcgtgaaaaggaagagggtagtgatcagcacgtagccagccacctccctctgcacccaataatgcataacaagccacacagtgaggagcttccaacgctcgtgtctaccattcaacaagacgcagactgggacagcgtgctgtcttctcagcagagaatggaatccgaaaataataagctgtgcagcctgtactcattcaggaacacaagcacaagcccgcacaaacccgatgaagggtccagggatcgcgaaatcatgacgtccgtgacatttggcacacctgaaagacggaagggctcactggcagacgtagttgacaccttaaagcaaaagaaattggaagagatgaccaggacagaacaagaagactcttcatgcatggagaaactgcttagtaaagactggaaggaaaagatggagcgacttaacacctccgaattgctgggtgagatcaagggtacacctgagtctttggcggagaaggagcgtcagctttcgaccatgatcacccagttgatttcattacgcgaacagttactcgcagcccacgatgagcaaaaaaaactggccgctagtcagatcgagaaacaaaggcaacagatggacctggccagacagcagcaagagcagatcgcccggcagcagcagcagctcctgcagcagcagcacaagatcaacctgctgcagcagcagatccaggtccagggtcatatgcctccccttatgatccccattttccctcatgaccaaagaaccctggcagcagcggccgcagctcagcaggggttcctgttccctccaggcattacatacaagcccggcgacaattaccccgtacagtttattccgagtacgatggctgccgcagcagcatcaggtcttagcccactgcagttacagcagctgtacgccgctcaattggcaagcatgcaggtcagccccggcgctaagatgcccagcaccccccagcctccaaataccgcgggcaccgtcagtcctaccggaattaagaacgagaagagagggacttccccagtgactcaggtgaaggatgaagccgcagcacaaccactgaacttgtcgtctcgccctaagaccgccgaaccagtgaaaagccctacctcacctacccagaatcttttccccgccagcaagacttctccagtaaacctaccaaataaaagttccattcccagccccattggcggctccttaggacgaggctcttcactcggcaagtggaagtcacagcaccaggaggagacatatgagttggacattctcagctccctcaacagcccagcactatttggagaccaggacacagttatgaaagctattcaggaggcacgaaagatgagggagcagatccagcgagaacagcagcaacagcagccccacggggtggatggtaagctctccagcatcaataatatgggcttgaattcttgccgaaatgaaaaagagcgtactcgttttgaaaatttgggcccacaactgacaggtaagagcaacgaagatggcaaactcggcccaggggtgatcgacctgacccggccggaagacgccgaagggtccaaggcaatgaacggatcagctgccaaactgcagcaatactattgttggccgacaggaggcgctaccgtggctgaagcacgagtttaccgggatgctcggggcagggctagctcagagccacacattaaacgcccaatgaatgcctttatggtttgggcaaaggatgaacgacgcaagattctgcaggcctttccagacatgcataacagcaatatctctaaaattctggggtcgaggtggaaatccatgtccaaccaggagaaacagccatactatgaggaacaggcccggctttcaaaaattcaccttgagaagtatccaaactataagtacaaaccccgcccaaagaggacgtgcatcgtggacggtaaaaaactgaggattggcgagtacaaacagctgatgcgttcaagacgccaagaaatgaggcagttcttcacggtcggccagcagcctcagatcccaataactacaggaacaggggtggtctaccccggggctatcacgatggccacgactacgccttccccccagatgacctctgattgcagttccacctccgctagccccgaaccctccctgccagttatccagtccacatacggaatgaaaacagacggggggagtctcgccggtaatgaaatgattaatggggaggacgagatggagatgtatgatgattatgaggatgatcctaagtccgactactcctcagagaacgaggccccggaggcagtctcagccaactag

SEQ ID NO: 136240 - DNA, 1167 bp, Artificial Sequence
  Description of Artificial Sequence: Synthetic coding sequence
atggctagtttgttaggtgcttatccatggcccgaaggactggaatgcccagctctggatgcagagttgagcgatgggcaaagcccacctgctgtgccacgacctccaggtgataaaggcagcgaatcacggatacggcggcccatgaatgccttcatggtgtgggccaaagacgagcgtaaacggctggccgtccagaatcccgatttgcacaacgccgagctttcaaagatgcttggtaagagctggaaggcacttactcttagccagaagagaccatacgtggatgaggctgagagactgaggctgcaacacatgcaagactaccctaactataagtacagacctcggcgcaagaagcaggcgaagagactgtgcaagagagtggacccgggattcctattatcaagcctgagcagagatcagaatgcactccccgagaagcgctccggctctcggggtgcattaggcgaaaaagaagaccgcggtgaatatagcccagggaccgctctgccttcactccgtggctgctatcacgaaggaccagcaggaggtgggggcggcgggaccccttcttccgtagacacttatccttacggattaccgacacccccagagatgagccctttggacgtacttgagccggaacagacatttttctcctctccttgccaggaggaacatggccatccacggcggattccacacctcccagggcacccgtactcgccagaatatgcaccctctcccctccattgctcccatcctttgggctctctggctctcggccaatccccaggggtgtccatgatgtctccagtgcctggctgccctccctcccctgcatattactcacctgccacatatcatcccctgcacagcaatctgcaagcccatctggggcagttgagtccgcctcctgaacatcctggatttgatgctctcgatcagctgtctcaggtcgaactgctcggcgatatggatcggaatgaattcgaccagtatctaaatacgcccggtcaccccgattctgctacgggcgcaatggcactttcaggtcatgtacccgtatctcaggtcactccaacggggcccactgaaactagcctgatttccgtgcttgcggacgcgactgccacatactacaactcctactctgtatcctag

SEQ ID NO: 136241 - DNA, 1323 bp, Artificial Sequence
  Description of Artificial Sequence: Synthetic coding sequence
atgagtatgctcgccgagagaaggcgcaagcagaaatgggctgtggatcctcagaatacagcctggagtaacgacgacagcaagttcggacaacggatgctcgagaagatgggatggagcaaaggcaaaggtcttggcgcccaggaacagggcgccaccgaccacatcaaggtccaagtgaagaataaccacctgggcctgggggcaaccataaacaacgaggataattggatcgcccaccaggacgactttaaccagctgctggctgagctgaatacttgtcacgggcaggagaccacagactcatctgacaagaaagaaaaaaagagtttctcgcttgaagaaaagtctaagatttctaagaatagagtccattacatgaaattcaccaaagggaagagctggaaggcgctgacactctcgcaaaagcgcccatatgtagacgaagcggagcggctgagactgcagcacatgcaagattaccctaactataagtaccggccaagacggaagaagcaggcgaagaggctgtgtaagcgcgttgacccgggattccttttgagctctctgtctcgcgaccaaaatgcactccctgaaaagagatcagggtctcggggcgctttgggagaaaaagaggacagaggagagtattcgcctggcaccgcattaccaagcctacggggatgctatcacgaggggcccgccggcggaggagggggggggacacctagctctgtggacacttacccttatggattgccaacacctcccgaaatgtcacccctcgatgtgctggaacccgagcaaaccttttttagtagtccctgccaggaggagcatggacatcctcggcgaataccccaccttcctggtcacccatattcaccagagtatgcccccagtcccctacattgtagtcaccctttgggtagcctggcactagggcagtcccccggggtatcaatgatgagtccggtgccagggtgtcccccctcaccagcctattactcccctgctacatatcaccctctccattcaaacttacaggcccatctggggcagctgagcccacctccggagcaccccggctttgacgccttggatcagttgtcacaggttgagctgcttggagatatggatagaaacgagtttgatcagtatttgaatacacccggtcacccagatagcgccacaggggctatggcgctgagtggccacgtccccgtttcacaggtgactccaactgggcctacagagacctcccttattagtgtcttggcagatgcaacagcaacatactacaatagctattccgtgtcttag

SEQ ID NO: 136242 - DNA, 1341 bp, Artificial Sequence
  Description of Artificial Sequence: Synthetic coding sequence
atgctggacatgtccgaggcccgtagccagcccccctgcagtccttccggtaccgcttccagtatgtcacacgtggaagactcagacagtgacgcccccccatcccctgctggatctgaggggctgggcagagctggtgtcgccgtcggcggcgcgaggggcgacccagctgaagccgctgacgagagattcccggcctgtatccgagatgctgtatcccaggtccttaaaggctatgattggagcctggttcccatgcctgtacgcggcgggggcggcggggcactgaaggccaaaccacacgtcaaacgccccatgaacgctttcatggtatgggctcaggcagcccgaaggaaacttgccgatcaatacccacacttgcacaacgctgagctgagcaagaccttgggtaaactctggaggctcctgagcgagagtgagaagaggcccttcgttgaagaagcggaaagactccgcgtacagcacaaaaaagaccatccagactataagtaccaaccccgccgtcgcaagagcgccaaggctgggcatagcgactccgattctggcgccgaactgggccctcaccccggaggaggggcagtgtacaaagccgaggctggtctaggagacgggcaccaccacggtgaccacaccggtcagacccacggaccacccactccacctacgacgccgaagaccgaacttcagcaggcgggggcaaagcctgagctcaagctagaaggcaggagacctgtcgactctggtaggcagaatattgacttctccaatgtggacatatctgagctgtcctctgaggtgatgggtaccatggacgccttcgacgtacatgagtttgaccagtatcttcccctgggaggtcctgcgcctcctgaaccaggtcaggcgtacggtggcgcatactttcacgccggcgcaagtccagtttgggcccataagagtgccccgtccgccagcgctagccccaccgagaccgggccacctcggccgcacattaagacggagcagccttcacccggacattatggagatcagccacgaggttctcccgattatggaagctgtagcggacagtcaagtgccacacctgcagccccagccgggccatttgcaggatcccaaggagactacggggatctacaggcctcatcctactatggagcctacccggggtacgcacctggactgtatcagtacccttgcttccactccccccgcagaccttacgcaagtcccttgttaaacggcctggcacttccaccagctcactcacccacttcccattgggaccagcctgtgtatactaccttaacccgcccctag

SEQ ID NO: 136243 - DNA, 1530 bp, Artificial Sequence
  Description of Artificial Sequence: Synthetic coding sequence
atgaacttgttggatccttttatgaaaatgacagacgaacaggagaaagggctgtctggggctccgagccctaccatgagcgaggactccgcgggaagcccttgtccatccggatccggctccgacaccgaaaatactagaccacaggagaatacatttcccaagggtgagcctgatcttaaaaaggagtcggaggaagacaagttccccgtctgcatacgggaggccgtctcgcaggtcctaaagggatacgactggactctggtccctatgcccgtcagagtcaatggatcatccaaaaataaacctcatgtaaaacgacctatgaacgccttcatggtgtgggcccaggcagctagacggaaactcgccgatcaatatccacacctccataacgcagaactgagcaagacgctggggaagctttggaggttgctaaatgaaagtgaaaaaagaccatttgtggaagaggctgagaggttacgggtgcagcacaagaaggaccatcctgactataagtatcagcctcggcgacggaaatccgtgaagaatggacaagccgaggctgaagaggcgactgaacaaactcacatttcccctaacgctatcttcaaggctctgcaggcagatagtcctcacagctcttccgggatgtccgaagttcactcccccggcgagcacagcggccagtcccagggccctccaacacctccaacgactcccaagactgatgtgcagccagggaaggccgacctaaagcgcgagggcaggcctctgcctgagggagggagacagccgcccattgattttcgggatgttgatattggagaacttagctccgacgtcatcagcaacattgaaactttcgacgttaacgagttcgatcagtacttgccaccaaacggacaccccggagtccctgctacccatggccaagtgacatacaccggttcatacggtattagctctaccgcagccaccccagccagtgcaggccatgtgtggatgtcaaagcaacaggcgcctccaccaccgccacagcagccaccccaggcgccccctgcaccacaggcccctcctcaaccccaagctgctcctccccagcaacctgcagccccaccgcagcaaccacaagcacataccctgacaacactgtccagcgaaccaggacaatcacagagaacccacatcaagactgaacaactcagcccttcccattacagcgaacagcagcagcacagtccacagcagattgcatactcacccttcaacctaccacattactctccttcctaccccccaatcacaaggtcacagtacgactatactgatcaccaaaacagtagtagctactattctcacgccgctggccaagggactggattatatagcacgttcacctacatgaatccagcccaacggcctatgtacacacccatcgcagacacctcaggggtgcctagcatcccacagacgcacagtcctcaacactgggagcagcccgtatacacccaactgacacgaccttag

SEQ ID NO: 136244 - DNA, 1338 bp, Artificial Sequence
  Description of Artificial Sequence: Synthetic coding sequence
atgaacctcctcgaccctttcatgaagatgaccgatgagcaggaaaaggggctgtccggcgcaccttccccgacaatgagcgaggacagtgcaggcagcccttgtccttctgggtctggctcagatacagagaatactagaccgcaggagaacacattccccaagggcgagccagacctgaagaaggaaagcgaggaggataagttccctgtttgcatacgggaggctgtctcccaggttcttaagggctatgattggactctggtacccatgcctgtgcgggtaaacggttcaagcaagaataagccacatgtgaagaggcccatgaacgcctttatggtgtgggcccaggccgcccgccgcaagctggccgaccaatatccacaccttcacaacgcagagctctcgaagaccctgggaaagttgtggcgactcctcaatgaaagcgagaagcgaccttttgtggaggaggcggaacgcctgcgagtccagcataaaaaggaccacccagactataaataccagcccaggcggcgcaagtccgtcaaaaatgggcaggctgaagctgaagaagctacagaacaaacccacatctcccctaacgcaatcttcaaggctctgcaggctgacagccctcactcctcaagtggtatgtccgaggttcactccccaggtgagcacagtggccaatcacaagggccacctacccctcccactactccaaaaacagacgtgcagcctggcaaggccgatctgaagcgtgaaggcagacctttgcctgagggggggcggcagccgccaatcgacttccgcgacgtcgacattggggaactgagtagcgacgtgatttccaatatcgaaacgttcgacgtgaacgaattcgatcagtacctaccacccaacggacacccaggggtcccagctacgcatggtcaggtgacctataccggctcgtatggcatcagttccacagcagccactccagcctcagctggccatgtgtggatgagcaagcagcaggcaccgccaccaccaccacaacagcactcgccgcaacagatcgcatacagtccgtttaatcttccacattacagcccatcatacccgcccattacacgaagtcaatacgactacacagatcatcagaattctagctcatattactctcatgcggctgggcaggggacagggctgtacagcacgtttacctatatgaaccccgcccagaggcctatgtatactccaatcgccgatactagcggcgttccttctatacctcagactcattcccctcagcactgggaacagccagtttacacgcaactgacccgcccgtag

SEQ ID NO: 136245 - DNA, 273 bp, Artificial Sequence
  Description of Artificial Sequence: Synthetic coding sequence
atgagagggtacctggtggctattttcctgagcgctgtcttcctgtactacgttctgcattgtattctttggggaacaaacgtttactgggtagctccagtggagatgaaacggcgcaacaaaatacagccttgtctgtccaagcctgcctttgcaagtctcctgtctcaatcctctgcatatattctgagaaagggtatagaggaactgaatcaaaccagcattctgttcacacaagtgagcagcgtgagtcctttttctgtgtgcggctag

SEQ ID NO: 136246 - DNA, 273 bp, Artificial Sequence
  Description of Artificial Sequence: Synthetic coding sequence
atgagggggtacttggtcgcaatcttcttgagcgcagtgttcttgtattacgttctccactgcatcctatggggtacgaatgtgtactgggttgcccccgttgagatgaaaaggagaaataaaatacaaccttgtctgtcgaagcctgcattcgcatctctcctgagtcagagctcggcttacatattacggaagggcatcgaggaactgaaccagacttctatcctgttcacccaggtctcctctgtgtccccctttagcgtgtgcggctag

SEQ ID NO: 136247 - DNA, 1335 bp, Artificial Sequence
  Description of Artificial Sequence: Synthetic coding sequence
atgggcctgctcgtttttgtgagaaacctcttgttggcactctgcttatttctggtgctggggtttctgtactacagtgcctggaaacttcacctgttacaatgggaggaggattcttctaagtatagtcactcttcctccccccaggagaaaccggtggctgattccgtggtgctgagtttcgattcagcgggccaaactctggggtctgagtacgatagactggggtttctgctgaatttagacagcaaactgagtcctcgcacactctgcactgtggtgttcggattggactgcattcttgaatccccaggtgagccaaaaaaattactgatgcccgcatctcaccccctagagatcttgaagtccttatctgaagataccgcctttgcactcggcttcctgaaacttccgcggcctgccgagctagctacaaagtacgcgaacttttccgagggagcgtgtaagccaggctatgcgtcggcgctgatgactgccatcttcccccggttctcaaaacctgcccctatgttcctcgatgactcttttaggaagtgggcccgcattcgggaatttgtccctccttttggaattaagggacaagataaccttattaaggcaattctgtccgtgaccaaggagtatcgcttgactccagccttggactcgcttcgctgtcgtcgatgcatcattgtcggaaatggcggggttctcgccaacaagtccttggggtcacgcatcgatgactatgatattgtggtgcggctgaacagcgcaccagtgaaaggtttcgagaaagacgttggatcaaagacaacgctgcggatcacctaccctgaaggagctatgcagaggcctgagcagtacgagcgagactcgcttttcgtactggccggcttcaaatggcaggactttaagtggctgaaatatatcgtgtataaggagagagtgagcgcttccgacggcttctggaaatccgtggccacccgggtcccaaaggagcctcctgaaattcgtattctgaacccctattttattcaggaagccgccttcaccttaattggactgccatttaataatggattgatgggtcgtggaaacattcctacgctggggagcgtagccgtgaccatggctctgcacggctgtgatgaggtcgctgtcgcgggtttcggatacgatatgtccacacctaatgcacccctgcattactatgaaacagtacgtatggcagctataaaggagtcctggacacataatatacagagagagaaggagtttctgcggaagcttgtgaaagctcgcgtgataactgacctgtctagcggcatctag

SEQ ID NO: 136248 - DNA, 468 bp, Artificial Sequence
  Description of Artificial Sequence: Synthetic coding sequence
atggggcttctggtctttgtcagaaatctcctcctagctctgtgtcttttcctggtcttggggttcctctattattccgcgtggaagctccatctcctccagtgggaggaggactctaacagcgtagtcctgagcttcgattcagcaggacaaaccctggggtccgagtatgaccggcttgggttcctgttgaacttggattcaaaactacccgcagagttggcgacaaaatatgcaaacttttcagaaggcgcctgtaaacctggctacgcctccgcgctgatgacagccatcttcccacggttcagtaaaccagcgcccatgtttctcgacgactcttttcgaaaatgggcccgaattagagagttcgtaccaccctttggaattaaaggccaagtgctggatgcacaatatcctgccagggaacgcgtgagcgctgaagctggtgagtcatctcggcatcactag

SEQ ID NO: 136249 - DNA, 1035 bp, Artificial Sequence
  Description of Artificial Sequence: Synthetic coding sequence
atgggcctccttgtgttcgttcgaaacttactgctggcattgtgtctctttctggttctgggctttttgtactatagcgcttggaagctccatctcttgcagtgggaggaggactctaattcagtagtcctaagttttgatagtgcaggccagacactgggcagcgagtacgaccgcctgggcttcctgctcaatctcgactcgaagctgttcagcaagccagcacccatgttcctagacgacagtttcaggaagtgggcgcggatccgagaattcgtgccccccttcggaattaaagggcaggacaacttgatcaaagctatcctctctgtgacaaaggaatatcgacttacacccgctctggattctctgcggtgtcgcagatgtattatcgttggcaacggcggtgtgcttgctaacaaatctcttggttcacggattgacgattacgacatagttgtacggctaaatagtgctcccgttaaaggatttgagaaggacgtgggcagtaagaccacattacggattacttatcctgagggcgccatgcagcgccccgaacagtacgagcgcgatagcttatttgtgctggccggctttaaatggcaggactttaaatggctgaaatacattgtttacaaggagagagtcagcgcatctgatggcttttggaagagcgtcgccacacgtgtcccaaaggagccccccgagatccgcatcttgaacccatatttcatccaggaggcagcatttactttaattggcctgcccttcaacaacggcctcatgggcagagggaacattcccaccttgggtagcgttgctgttacaatggctctccacggctgcgatgaggtggctgtggcaggctttggctatgatatgtctactcccaatgccccacttcattattatgagaccgtgcgcatggcagctatcaaagagtcctggacgcataacatccagcgggagaaggagtttcttaggaagctggtaaaagccagggtgatcaccgacttatcgtccggcatttag

SEQ ID NO: 136250 - DNA, 687 bp, Artificial Sequence
  Description of Artificial Sequence: Synthetic coding sequence
atgggactgctcgtctttgtgagaaatctcctcctcgccctctgtttgttcctcgtactgggttttctgtattacagtgcttggaagctgcaccttctgcagtgggaagaggactccaagtacgatcggctggggtttttactcaacctggatagtaaattgccagcagagctcgcaaccaagtacgccaactttagcgagggtgcctgtaagccaggatacgctagcgctctgatgaccgcgatttttccgaggtttagtaagcccgcccccatgttcttggacgactcctttaggaaatgggctcggatcagagaatttgtgccaccttttggcattaagggacaggacaatctgattaaagcgatcctgagtgtaactaaggagtatcgcctcaccccggcattggatagtctcagatgccgacggtgcatcatcgtgggtaacggaggcgtccttgccaataaaagtctgggctccaggatcgacgattatgacatcgtagtgagggtgcaccggatggccagcggcaacctgtggccactggagtgcccaaggagcccacttcggtttgaaagttccacacatattagctctcgtaggcctcccagtccttccttagcctgtccgtcaacaatggcatcgtgggccggcggaacctcactgccgctcgctgtgtggcagtag

SEQ ID NO: 136251 - DNA, 1173 bp, Artificial Sequence
  Description of Artificial Sequence: Synthetic coding sequence
atgggcctgctagtgtttgtccgcaatctacttctggctctgtgcttgtttctggtgttggggttcctttactatagcgcatggaagctccatctgctgcaatgggaagaggactcttccaagtactctcatagttctagcccacaggagaaacccgttgctgactcagttgtgctctcttttgattccgccggccagactctgggctccgaatacgaccgcctaggcttcctgctgaacctggattccaagctccctgctgaactagctacaaagtatgccaatttctctgaaggcgcatgtaaacccggttacgctagcgctcttatgactgccatatttcctcgcttcagtaagcctgcccccatgtttctcgacgacagctttcgtaagtgggccaggatacgcgagttcgtacccccattcggcatcaaagggcaggacaatctaattaaagcaatactgtcggtgacaaaggagtaccgcctaacaccagcgcttgactcactaagatgtaggagatgtattattgttgggaatggcggcgtactcgcaaacaagtctctgggctcaagaattgacgattatgatatcgttgtgagattgaacagcgcccccgtgaaaggatttgaaaaggatgtgggctctaaaacgacactcagaatcacatatcctgagggggcaatgcagcggcctgagcagtatgaacgtgacagtctgttcgtgctggcaggttttaaatggcaggacttcaagtggctgaaatacattgtgtacaaagaaagggtttcagcatcagacggcttctggaaatcagttgccactcgcgtgccgaaagaaccccccgagataaggattctgaacccatactttattcaggaggccgcttttactctgattggactgccttttaataacggcctgatggggcgcggcaacattcctacgctcggatctgtggctgtaaccatggcccttcatggatgcgacgaggttgccgtggcgggttttggttacgatatgtcaacccccaacgctccactgcactactacgagaccgtccggatggccgctattaaagaaagctggacacacaatattcaaagagaaaaggagtttttgcggaagctcgtgaaagcccgggtgatcaccgacctgagcagcgggatctag

SEQ ID NO: 136252 - DNA, 1242 bp, Artificial Sequence
  Description of Artificial Sequence: Synthetic coding sequence
atgggtctgctggtgttcgtcagaaatcttctgctggccctgtgccttttcctcgtcttagggtttctgtattacagcgcctggaaactgcacttgcttcagtgggaggaggactcgaagtacgacaggttaggtttcttgctgaacctggattctaaactctcgccaaggacactgtgcaccgtagtgttcggcctggactgcattcttgaatctcccggcgagccaaagaaactcctaatgcccgcttctcaccctctggagatcttgaagtcactgtccgaggatacagcctttgccttgggcttcctgaaactgccacggccggctgaacttgctactaagtatgcaaatttttcggagggggcatgtaaacccggatatgcctctgcccttatgacagccatctttccccgattctctaagcctgcccctatgtttctagacgacagcttccggaagtgggcccgtattcgcgaatttgttcctccatttgggattaagggtcaggataacctgatcaaggccattcttagcgtgacaaaggaatatagactgacgcccgcccttgacagccttaggtgtcgtcggtgtattatcgtcgggaatggaggcgtgttggccaataagtctcttgggtcccgaatcgatgattacgatatcgtagtccggttgaactcagcccccgtgaagggctttgagaaggacgtcggcagtaagactacgttaagaatcacgtatcccgagggcgctatgcaacgacccgaacagtatgaaagagactccctcttcgttctggccgggtttaagtggcaggatttcaagtggcttaaatacattgtgtacaaagaaagagtgagcgcgtcggacggtttttggaagtccgtggccaccagagtgcccaaggagcctccagaaatacgaatcctgaacccttattttatacaggaagctgccttcacgctgatcgggttgccattcaacaacgggctgatgggtcgaggaaatattcccacactcgggagcgtggctgtcacaatggcgcttcacggatgcgatgaagtggcggtcgccggcttcgggtacgatatgagtacgcccaacgcacccctgcactactatgaaaccgtgaggatggcggcaatcaaggagtcctggacgcacaatattcaacgagaaaaagaattcttgcggaaactcgtgaaagccagagtcatcacagaccttagcagcgggatttag

SEQ ID NO: 136253 - DNA, 834 bp, Artificial Sequence
  Description of Artificial Sequence: Synthetic coding sequence
atgggcctgttggtgtttgtgcggaatctgctgctggctctttgtctgtttcttgtgctggggttcctgtactactcggcgtggaaacttcacttactgcagtgggaggaagattctaactccgtggtcctgagtttcgattctgctggacagaccctgggatcagaatacgatagactgggcttcctgttaaatcttgatagtaaactgcccgcggagctcgccacaaaatatgccaacttctcagagggcgcctgcaagcccggatacgcctccgccctcatgacggccatcttcccgaggttctcaaagcctgctccgatgttcctcgacgactcatttcgcaagtgggctagaatcagagagttcgtgcccccttttgggatcaagggacaggataacttaattaaggccatcttaagcgtgaccaaagagtaccgattgacgcccgccctggattccctacggtgtcgacgatgtatcatcgtagggaatgggggagtgctggccaacaaaagcctcggctccaggatcgatgactacgacatcgtagtgaggttaaatagtgctcctgtcaaaggtttcgagaaagatgtcggaagcaagaccactctgagaataacttaccccgaaggtgctatgcagcgccccgagcaatatgagagggattctttgtttgtccttgctggcttcaaatggcaggacttcaagtggctgaagtatattgtctacaaagaacgggtgtcctggacccataacatccaacgcgaaaaagagttcctgcggaagctcgtaaaggctcgagtcattacagatctgtccagtggtatctag

SEQ ID NO: 136254 - DNA, 1128 bp, Artificial Sequence
  Description of Artificial Sequence: Synthetic coding sequence
atggggctcctcgtgttcgttcggaaccttctgttggcactgtgcttgtttctagtcttgggattcctgtactactccgcgtggaaactgcacttgctccagtgggaggaagacagcaacagcgttgttctgagtttcgactctgccggccaaaccctcggctcagagtacgatagactgggattccttctgaacctggactcgaagctccctgccgaattagcgacaaaatacgccaactttagtgagggggcctgcaaacccggctacgctagtgcattgatgacagcaatatttcccagattctcgaagccagcacccatgtttctcgatgactcgttccgtaagtgggctagaatcagggagttcgtacccccctttggcatcaaaggccaggataacctgattaaagctatcctcagcgttactaaagaataccgtttaacacctgctttggacagtctgcgttgtcgtcggtgcatcatcgtcgggaacggaggtgttctggcaaacaaaagcctggggtcccgaattgatgattatgatatcgtcgtccggctcaacagcgctcccgtgaaaggctttgagaaggacgttgggtccaagactacacttagaattacctaccctgaaggcgcgatgcagcgcccagagcagtacgagagagactctttattcgtcttggcaggctttaaatggcaggacttcaaatggctgaagtacatagtttataaggaacgggtcagcgcatctgatggattttggaaatctgtggcgactcgagtccccaaagagccacccgaaatccgcatcctcaatccatatttcattcaggaggctgccttcactctcataggtctacctttcaataatggtctcatggggcggggcaatattcccactctcggctcagtcgccgtgacgatggcactccacgggtgcgatgaggttgccgtggctgggttcggatacgatatgagcaccccaaatgcccccctccattactatgaaaccgtgcgcatggccgccatcaaggaatcttggacccacaacatccagcgcgaaaaggaattcttacgaaagctagtgaaagcgcgggttattacagacttgtctagtggaatctag

SEQ ID NO: 136255 - DNA, 1080 bp, Artificial Sequence
  Description of Artificial Sequence: Synthetic coding sequence
atgggactcctggtgtttgttagaaatctgttgctggccctgtgtctttttttagttttgggcttcctgtattactcagcgtggaaactgcacctcttacagtgggaggaggatagcaaatacgatagattaggatttctgctcaacctggacagcaaactgcctgcagaactcgccactaagtatgccaatttttccgaaggagcctgcaaacccgggtacgcttctgctttgatgactgcaatcttccctcgcttctccaagcccgcgcctatgttcctggatgattcttttcgcaaatgggctcggatccgcgagtttgtgccaccattcgggataaagggccaagacaacctgatcaaggccattctctctgtgactaaggagtaccgtttgaccccagctctcgatagtctgcgttgtagaaggtgcatcatagtcggaaacggaggcgttctcgctaataaatctcttggcagccgcatagatgattatgatattgtggtgcgcctgaattccgctccggtcaaagggttcgaaaaggacgtgggatccaagaccacactgagaataacctatcccgaaggcgctatgcaaagacctgagcagtatgagagggactctctttttgtgctggcaggattcaaatggcaagattttaaatggttaaaatacattgtgtacaaggagagagttagtgccagcgacgggttttggaagtctgtcgcaactcgggtaccaaaggaacctcctgagatcaggattctcaacccatacttcatccaggaagccgcctttacactaatcgggttaccatttaacaacgggttgatggggagaggaaacatacctaccttgggaagcgtagctgttacgatggcactgcatggctgcgacgaagtggcagtggcgggatttggctacgacatgagcacccccaacgctcccttgcactactacgagacagtgagaatggcggcaataaaagaaagctggacccataatattcagcgtgaaaaggagttcttgcgaaaactggttaaagctcgggttatcactgatctgtcttccggaatctag

SEQ ID NO: 136256 - DNA, 1335 bp, Artificial Sequence
  Description of Artificial Sequence: Synthetic coding sequence
atgggtttgttggttttcgtccgtaatctgctgttggcactgtgtttatttcttgtgctgggattcctgtattactcagcctggaaactccacctgctacagtgggaggaggactctagtaagtactctcattcaagctcccctcaggaaaaacctgtcgcggactcagtcgtactgtcttttgactccgccggccagacccttgggtctgaatacgaccggctcggttttctactgaatctggacagtaagctgagtccacgaacgctatgtacagtggttttcggcctggactgcatcctggaatcccccggagagcctaaaaaattgttaatgccagcctcccacccccttgagatcctgaaaagtttgtctgaggacacagccttcgcattaggattcctgaagctcccaagaccagcagagctggccaccaaatatgctaatttttccgagggggcatgcaaaccaggatatgcatctgccttgatgaccgctatttttccccgcttcagcaaaccagccccgatgtttctggacgactctttccggaaatgggctcggattagggaatttgtgccaccgtttgggatcaaaggacaagataacttgatcaaggcaatcctctccgtgaccaaggagtaccggctcactccggctctggacagtctgaggtgtcggagatgcattatagtcggaaatggcggcgtcctcgctaataagagcctggggtctaggattgacgattatgacatcgtggttaggttaaacagtgcccctgtgaaaggcttcgaaaaagacgtgggtagcaaaactacgctgcgcatcacctaccctgagggcgccatgcaaagaccggagcaatacgagagggattctttgtttgtgcttgcgggctttaagtggcaagatttcaagtggctgaaatatatagtttacaaagagagagttagtgcatctgacggcttctggaagagcgtagccacccgtgtccctaaagaaccgccggagatccggatcctcaacccatactttatccaggaggctgctttcactttaattggattaccgttcaacaacggtctcatgggccggggaaacattcccactctaggctcggtggcagtgacgatggccttgcacggctgcgatgaggtggccgttgcaggattcggatacgacatgagcaccccaaatgcacccctccactactacgagaccgtgaggatggccgcgatcaaggagtcatggactcacaacatccagagagagaaggaatttctgagaaaattggtgaaagccagggtgatcactgatctttcttctggtatttag

SEQ ID NO: 136257 - DNA, 513 bp, Artificial Sequence
  Description of Artificial Sequence: Synthetic coding sequence
atggggcttttggtgttcgtgcggaatcttctgctcgcgctgtgtctctttcttgtgctaggatttctctattactctgcttggaagctgcacttgttgcaatgggaagaggactcaagcaagtacagccattctagcagtccgcaagaaaaaccagtggccgattccgtggtattgagcttcgattccgctggacagactctggggagtgaatacgaccgattaggttttctgctgaacctggactccaagctccctgccgaattagctactaagtacgcaaattttagcgaaggtgcctgtaaacctggctatgcctcagccctgatgaccgcaattttcccgaggttctccaaacccgcccccatgtttctcgatgattcatttcgcaagtgggcaagaatcagagagttcgtcccgccgtttggaattaagggccaggtcctagacgcgcagtacccagcgcgagagagagtcagtgctgaagccggagagtcatccagacaccactag

SEQ ID NO: 136258 - DNA, 468 bp, Artificial Sequence
  Description of Artificial Sequence: Synthetic coding sequence
atgggcctgctcgtgttcgtgcggaacctcctgctggcgctatgtctctttctcgtcctggggttcctgtattacagtgcatggaagttgcatctgttgcaatgggaagaagattccaattccgtggtgctgtcatttgacagcgccggacaaaccctggggtccgagtacgacagactcggattcctgttgaatttggacagtaagcttccagccgagcttgcgaccaagtacgcgaacttcagcgagggagcctgcaagccagggtacgccagtgccttgatgacggccattttccccagatttagtaaaccagctcccatgttccttgacgacagctttcgtaagtgggctaggatcagagagtttgtgcccccttttggaatcaagggacaagtgttggatgcacagtatcccgctcgcgagcgggtttctgcggaagctggagagtcgagcagacatcattag

SEQ ID NO: 136259 - DNA, 561 bp, Artificial Sequence
  Description of Artificial Sequence: Synthetic coding sequence
atggggctgctggtcttcgttagaaatctgttgttagctctgtgcctgtttttggtgctcggatttctgtattactctgcttggaaactgcatctgttgcaatgggaagaggacagtaattccgttgttctgtcttttgattcagccggccaaaccttgggcagcgagtatgacaggctgggcttcctgctgaacctcgactcaaagctccctgccgaactggctacaaagtacgcaaacttcagcgagggagcatgtaagccggggtacgcttccgccctaatgacggccattttcccaaggttctcaaaacccgcccctatgtttctcgatgatagttttagaaagtgggctcggattcgagagtttgtgccgcccttcgggattaaggggcaagacaacctgattaaagccatactgagtgtaactaaggaatatcggctgactccagcattagactcgctacgctgcaggagatgtatcattgtcgggaacggtggcgtgttggcgaacaaatcgcttgggtcgagaatcgacgattacgacattgtcgtgcgttag

SEQ ID NO: 136260 - DNA, 558 bp, Artificial Sequence
  Description of Artificial Sequence: Synthetic coding sequence
atggggctgctggttttcgtgcgaaatctgcttctggcactgtgtctgttcctcgttctcggattcctgtactattctgcctggaagcttcatttgctgcagtgggaggaggattcttctaagtatagtcatagttctagtccgcaagaaaagccagttgccgaatatgatagactcggcttcttactgaacctcgactccaaactccccgctgaactggccactaagtacgccaattttagtgagggcgcgtgtaaaccggggtacgcttccgccctgatgacagccatcttccctcggttctctaagcccgccccaatgtttctcgacgacagcttccgaaaatgggcaagaattagggaattcgtgccacctttcggaatcaaaggacaggacaatctgatcaaagctattcttagcgtaacaaaagaataccggctcacacccgcactagacagcctaaggtgcaggcgatgcataatcgtgggaaatggcggcgttttagccaacaagagtctaggtagccgaatcgatgactacgatatcgtggttagatag

SEQ ID NO: 136261 - DNA, 606 bp, Artificial Sequence
  Description of Artificial Sequence: Synthetic coding sequence
atgggactgctagttttcgtccgcaacctgttgcttgcattgtgtctcttcctcgtcctgggatttttgtactacagtgcttggaagctgcacctcctgcaatgggaagaagactccagtaagtactctcactcttcatcaccacaggagaaacccgtggccgagtatgatcgactcggcttcttgctgaatctcgactccaaactgcctgccgagttggctaccaagtatgctaacttctcagagggagcttgcaaaccagggtacgcgtctgcactgatgaccgcaattttcccgcgctttagtaagcctgcaccgatgtttctggacgattcctttcgaaaatgggctcgcattcgagagttcgtgccaccgttcggtatcaaggggcaggataatctcataaaggccatactttcagtaacaaaagagtaccgcctgaccccagccctcgactccctgcggtgtcgcaggtgcatcatcgtcggaaacggcggcgtcctggctaataaatctctgggttctagaatcgacgattacgacattgtagtcagccccggccgcaccatcagttctgagaggaagtcattctgtggctcatggtag

SEQ ID NO: 136262 - DNA, 1290 bp, Artificial Sequence
  Description of Artificial Sequence: Synthetic coding sequence
atgggtctgctggtgttcgtcaggaacctcctgctcgcattgtgtctctttctcgtgctcgggttcctgtactattcagcatggaaactccacctgcttcagtgggaggaagatagtaactcagtggtcctgagttttgacagtgcagggcaaacccttgggtcagagtatgacagactgggatttctcctcaacctcgacagcaaactctcaccacgaaccttatgtactgtggtcttcggactcgactgtattctggaaagcccgggcgagccgaagaaactgctgatgcccgcaagtcacccgctggaaatactcaaaagtctctcagaggacacggccttcgccctgggctttctgaaactgccacggcccgcagaactcgctaccaagtatgccaacttcagcgaaggcgcgtgtaaaccagggtacgctagcgcactgatgaccgccatattccctcggttcagcaaacccgccccaatgttcctggacgatagcttcaggaagtgggccagaatcagggagtttgtaccccccttcgggattaagggccaggacaacctgatcaaggccatactgtccgttacaaaagagtatagactaactcctgccctcgactctctgaggtgtcgcagatgcattattgtgggcaacgggggagtcctggctaacaaaagtctgggaagccggattgatgactacgacatcgttgtgcggcttaactctgctcccgtgaaagggtttgagaaagacgtgggatccaagacaacactccgcatcacgtatccagaaggcgccatgcagagacccgaacagtatgagagagactccctgtttgtgctcgcagggttcaagtggcaggactttaagtggctcaaatacattgtgtacaaggagcgtgtctccgcctcagacggcttctggaagtccgtagctaccagagttccgaaagaacctccagagatacggatactgaatccatattttatccaagaagccgcttttaccctgattggcctgccctttaacaacggcctaatggggagaggtaatataccaacactagggtccgtcgccgtgaccatggccctgcatgggtgcgatgaagtggccgtcgcaggcttcggttacgacatgagcactcctaatgcaccattgcactattacgagaccgttaggatggctgccataaaggagtcatggacacataacatccaacgcgagaaggagtttttgagaaaacttgtgaaggctcgggtgataaccgacctcagtagtggcatctag

SEQ ID NO: 136263 - DNA, 1038 bp, Artificial Sequence
  Description of Artificial Sequence: Synthetic coding sequence
atgggcctgctcgtctttgttagaaatctgttgctcgcactatgtctgttcctcgtgttgggctttctttactacagtgcatggaagttacatttactgcagtgggaggaagactcaaactccgtggtgctgagtttcgactccgctgggcaaactctgggaagcgaatacgatcgtctcggattcttactcaacctcgattcaaagcttccagccgagttggcaaccaaatacgccaacttctccgaaggcgcctgtaaacccgggtacgcgtcagcactgatgaccgccattttcccacggttcagcaaaccagcccccatgtttttagatgattcttttaggaagtgggcccgcatccgtgagttcgtgcctccttttggtattaaaggccaggataatctcataaaagctatcttaagcgtgaccaaggagtaccggctgacccccgccctcgatagcctccgatgtcgcaggtgtatcattgtgggaaatggtggggttttggctaacaagtcactcggaagtaggatcgatgactatgatatagtcgttcggctgaactctgcccctgtcaagggatttgagaaagacgtaggcagtaaaacaacgttacgtatcacataccccgaaggcgccatgcagagaccggaacagtacgagagagattcactgttcgtgctggcaggattcaagtggcaggatttcaaatggcttaagtacattgtgtataaggaaagggtggaggcggcgttcacccttatcgggcttccttttaacaacgggctcatggggaggggtaatattcccacattggggtccgtggcagtgaccatggccttgcacggctgtgatgaagtcgcggtggcaggctttggctacgacatgtcaacgcccaacgcacctctacactattatgaaaccgtgagaatggccgccatcaaagaatcatggacacacaacattcaaagagaaaaggagtttttgcgcaagttagtgaaggcaagggtgataaccgatctgtcttcagggatatag

SEQ ID NO: 136264 - DNA, 1242 bp, Artificial Sequence
  Description of Artificial Sequence: Synthetic coding sequence
atgggactgctcgtcttcgtgaggaatctgctcctagctctttgtctattcctggtgcttggattcctgtactattccgcatggaaactgcacctgctgcagtgggaggaagattcaaagtatgaccggctgggcttcctgctgaacctggattccaagcttagtccaaggacattgtgcacagtggtatttgggctggattgtattctggaaagccctggcgaacctaagaaactgctcatgccagcctcgcacccgctggaaatcctgaaatcgctgtcagaagatacagcgttcgcactcggattcctgaagctgccccggccagcagaactcgcaacaaaatacgccaatttctccgaaggggcatgtaaaccgggctatgccagcgcattgatgaccgccatttttcccagattttccaagcccgcccccatgtttcttgatgacagtttcaggaaatgggccagaatacgcgagtttgtaccacctttcggcattaagggacaggacaacctcataaaggccatcctaagcgtcacgaaggagtatcggctgacacctgcattggattcactgagatgtcggcgctgcattatcgtgggaaacggcggggtgctggccaataaatccctgggttcacgtattgatgactacgacattgtggtaaggctaaattcagcaccagttaagggcttcgagaaggacgttggctctaaaaccactcttcgaattacctacccagagggcgccatgcagcgccccgagcagtatgaacgggattccctctttgtgctcgcagggttcaagtggcaggactttaagtggttgaagtatatagtctataaggagagagtgtcagcatctgacgggttttggaagagcgttgctaccagggttccgaaagagccccctgagatccgcatcttgaatccatactttatccaagaggccgctttcacgttgatcggacttccattcaacaatggactgatgggtaggggaaatatccctacgctgggcagcgtagctgttaccatggccctgcacggctgcgatgaagtggccgtggcaggatttggttacgatatgtcaacacctaacgcccccctgcactactatgagactgtgcggatggctgccatcaaggaatcctggactcacaatattcagcgcgagaaagagttcctgcgcaagttagtgaaagctcgtgtgattacagaccttagctcaggcatatag

SEQ ID NO: 136265 - DNA, 1035 bp, Artificial Sequence
  Description of Artificial Sequence: Synthetic coding sequence
atgggtttgttggtctttgtgcgaaacttgctgttggcattatgcctttttttagtactgggattcctgtactactctgcttggaagttacacctcctgcaatgggaggaggacagcaatagtgttgtgctgtcattcgattccgcgggacagacactgggatcggagtatgaccgactgggttttttattgaaccttgactccaagctcttttccaaaccagcccccatgttccttgatgactcctttagaaaatgggcaagaatccgggagtttgtgccaccttttggcattaaaggccaggacaacttgatcaaagcaattttgagtgtaaccaaagaatacaggctaacccctgctctcgacagtctgcgatgccgaagatgcatcatcgtcggaaacggtggggtgctggcaaacaagagtctgggctccaggatcgatgactacgacatcgttgtgcgcttaaatagtgctcctgtcaagggcttcgagaaagacgtgggctcgaagaccacacttcggataacctacccagagggcgcaatgcaacgaccagaacagtatgagagggattctctgttcgtcctagcaggcttcaaatggcaagatttcaagtggctgaagtacatcgtgtataaggagcgagtaagcgcctctgacggtttttggaaatcggttgcgacgagggtgcctaaagagccccccgagatcagaattctgaacccatatttcatacaagaggcagccttcacactgatcggcctgccgtttaataacggacttatgggccgtggaaacattccaacattgggatcagttgctgttacgatggctcttcatggctgtgatgaggtggctgtggccgggtttggatatgatatgtcaactcctaatgccccactgcactactatgagacagttcgcatggctgccatcaaggagtcttggacccacaacatccagcgggaaaaggagtttctgcgcaaacttgtgaaggctagagtaatcaccgatctgagcagcggaatctag

SEQ ID NO: 136266 - DNA, 1290 bp, Artificial Sequence
  Description of Artificial Sequence: Synthetic coding sequence
atgggtttgctggttttcgtccgaaatctgctgctggcattgtgcctgttcctggtgctgggcttcctgtactattctgcctggaaattgcacttactgcagtgggaagaagattctaatagcgtagtcctctcatttgactctgccggacagacgctcgggagcgagtatgaccggctcggttttctgttgaacctggactcgaaactgtctccccgaactctttgcaccgtggtatttggccttgactgcatcctcgagtcacccggtgagccaaagaaacttctgatgcccgccagtcatcccctggagattctcaaaagcctgagcgaagataccgcgttcgcattagggttcttgaaattgccgagacctgcagagcttgcaactaaatatgctaacttctccgaaggggcatgcaagccaggttacgcttctgcccttatgaccgcaatctttcctcggttcagcaagccagcacctatgtttctggacgattccttcagaaaatgggccagaattagggaattcgtgccaccatttggaatcaaagggcaggacaacctcattaaggctattcttagcgttactaaagagtacaggctgacccctgcccttgactcactgcgctgtaggaggtgtatcatcgtcggaaatggcggagtcctggccaacaaatctttgggctcacgaattgatgactacgacatcgtggtaagactcaactcggcccccgtgaagggattcgagaaagacgttggctccaaaaccaccctgcgcattacctaccccgagggtgccatgcaaaggcctgagcagtacgagagggattctctgttcgttctagccggcttcaagtggcaggactttaagtggctgaagtatattgtgtacaaagagcgtgtttccgcctccgatggattctggaaaagtgtggcgacacgggttcctaaagagccaccggagatcaggatcctgaatccttattttattcaggaagctgcgtttaccttgatcggtctgccatttaataatggtctgatgggcagaggaaacatccccaccttggggtccgtggcagtgacaatggcattgcacggctgcgacgaagtggccgttgccgggtttggatacgacatgtccacccccaacgcccctctccattattacgaaactgtgaggatggcagccatcaaggaaagctggactcacaatattcagagggagaaggagtttctccgtaagcttgtgaaggcccgcgtgatcactgatctgtcttctgggatctag

SEQ ID NO: 136267 - DNA, 456 bp, Artificial Sequence
  Description of Artificial Sequence: Synthetic coding sequence
atggggctccttgtttttgtgaggaacctgctgctcgcactctgcctgttcctggtgctgggcttcctctactattccgcttggaaactacaccttttgcagtgggaggaggactccaacagtgtggtcctgtcttttgactcagccggacagaccttaggaagcgaatacgaccggttaggattcctcctcaaccttgactcaaaattgcctgccgaattggcgacaaagtatgcgaatttttcagagggggcttgtaagccaggctacgctagcgctctgatgaccgccatcttccctagatttagcaaacctgctccgatgttcttagacgattctttcagaaagtgggcccgaatcagggagtttgtgcccccgttcggaataaaagggcaggaatgtattggctggttgttagagatatgtggccactcatctgcacagggagccccttag

SEQ ID NO: 136268 - DNA, 561 bp, Artificial Sequence
  Description of Artificial Sequence: Synthetic coding sequence
atgggcctgctggtgttcgtgcggaatttactgttggcgctgtgtctgtttttggtcctcggcttcctgtactactctgcctggaaacttcatctgctccagtgggaggaggattcaaaatacgatagactcgggttcttactgaatctcgattcgaaactgcctgctgagttggccactaaatacgctaatttctctgagggagcttgtaaaccaggctacgccagcgccttgatgaccgctatttttccgcgtttttctaaaccagcacctatgtttctggacgactcttttaggaagtgggcacggatccgagagtttgtgccgcctttcggaatcaagggtcaggacaatctgattaaagcaatcttaagtgtcacaaaagagtaccggctcacccccgcccttgactccctccgctgcaggcgctgtatcatcgtcggtaatggcggcgtcctggccaacaagtctttgggttcccgaatcgacgactacgacattgtggtatcacccggaagaaccatatcctcggagagaaaaagcttttgtgggagctggtag

SEQ ID NO: 136269 - DNA, 420 bp, Artificial Sequence
  Description of Artificial Sequence: Synthetic coding sequence
atgggattgctcgtgttcgtgagaaatcttctgttggccctatgcctgtttttagttcttggcttcctgtactattccgcgtggaagttgcacctgctccaatgggaagaggactcaaaatatgaccgcctggggtttctcctcaacttggactccaaactgccagccgagttggcaacaaagtacgctaatttcagtgagggtgcttgcaagccggggtatgcatccgcactcatgacggccattttccctagattctcaaagccagctcccatgttcctggacgacagtttcagaaagtgggcccggatccgggagtttgttcctccctttggaatcaaaggccaggtgcttgacgcgcagtaccccgccagagagagagtttctgccgaagctggcgagagctccaggcatcactag

SEQ ID NO: 136270 - DNA, 306 bp, Artificial Sequence
  Description of Artificial Sequence: Synthetic coding sequence
atgggtttgttggtgttcgtgcgtaacttgctgcttgccctatgcctattcctagtgttgggcttcctgtattattcagcctggaaactgcaccttctccagtgggaagaagatagcaagtacgaccggctgggattcctgcttaatctcgatagtaagctgccagcggagctcgcaacgaagtacgcaaattttagtgagggagcctgcaaacccggatacgcgagtgcccttatgaccgcaatcttcccgcggccaggaaggaccataagcagcgagaggaaatccttttgtggctcctggtag

SEQ ID NO: 136271 - DNA, 786 bp, Artificial Sequence
  Description of Artificial Sequence: Synthetic coding sequence
atgggattacttgtttttgtccgaaacctgctgctcgccctgtgtctgttccttgtgttgggattcctatattacagtgcttggaaactgcatctgctgcagtgggaggaggacagcaagtatgatagactgggtttcctactgaatctagactcaaagctaccggcggagctcgccaccaagtatgcaaacttctcagagggagcttgtaagcccggatacgcatctgcactgatgacagctatcttccccagattctctaaaccggcccctatgttcttggacgacagcttccgcaagtgggctcggatacgtgagtttgtcccaccatttggaataaaaggacaagataacctgattaaggcaattctaagcgtgacaaaggaataccggctgactccagctcttgattcacttcgctgtaggagatgtattatcgtagggaacggcggtgtgctcgccaacaaaagcctcgggagcaggatcgatgattatgacatagtcgtcaggctgaattccgcgccagtcaagggcttcgaaaaagatgtcgggtctaagactactttgcgcattacgtacccagaaggcgccatgcaacggcccgaacagtacgagcgggactctctttttgtcttggccggcttcaagtggcaggacttcaagtggctgaaatacattgtgtacaaagaacgggtttcctggacacacaacatacagcgggaaaaggagtttctgagaaaattggtaaaggcccgagtcataactgacctcagctcagggatatag

SEQ ID NO: 136272 - DNA, 834 bp, Artificial Sequence
  Description of Artificial Sequence: Synthetic coding sequence
atgggtctgcttgtgtttgtgcggaacctgctgttagccctatgtctctttctggtcctgggttttctgtactatagcgcctggaagctccacctgttgcaatgggaggaagactcaaatagtgtggttctgtcgttcgactctgccggacagacattaggctcggaatatgacagactgggtttcctcctcaatctagattcaaagcttcccgcggagctggctactaagtacgccaattttagtgagggtgcatgcaaaccaggatatgcttctgccctcatgaccgcaatctttcctagattctcaaaaccggctcccatgtttcttgacgattcctttcgcaagtgggcaaggattcgggagttcgtcccgcccttcggcattaaaggacaagataatcttatcaaggcaattcttagtgtcaccaaagagtaccgtctcacaccggcactcgacagcctgcgctgccgacgctgtatcattgtggggaacggtggcgtgctcgcgaacaagagcctgggctctcggatcgacgattacgatatcgttgtgcgccttaatagtgcacctgttaagggctttgaaaaggatgttgggtctaaaaccactctaaggatcacataccctgagggagcaatgcagaggcccgagcagtacgaaagagacagtctattcgttctggcggggttcaagtggcaagacttcaaatggctgaaatacatcgtctacaaagagagggtctcatggacacataatatacagagggagaaggagtttctccggaagctcgtaaaggctagagtaattacggatctaagcagtggcatttag

SEQ ID NO: 136273 - DNA, 513 bp, Artificial Sequence
  Description of Artificial Sequence: Synthetic coding sequence
atgggcttgctggtgtttgtgcgcaatcttctcctcgcgttatgtctgttcctggtgcttggctttctctattatagcgcctggaagctgcacttgttgcagtgggaagaggattcatcaaaatattcccattcaagctccccccaggagaagcctgttgccgactcggtcgtcctctccttcgatagtgctggccagaccctgggcagcgaatatgaccgtctgggattcctcctgaatttggatagtaagctccctgctgaactggctacaaaatacgctaatttcagcgagggagcctgcaagcctggctatgcctctgctctcatgacggcaatttttcccaggttctccaagccagcacccatgtttttagacgattccttccgaaagtgggcccggattcgggaattcgtgcctccctttggcattaaaggccaagtgctggacgcccagtacccagcccgcgaaagggtgtccgcggaggcaggagagtcatcaagacatcactag

SEQ ID NO: 136274 - DNA, 642 bp, Artificial Sequence
  Description of Artificial Sequence: Synthetic coding sequence
atgcgcacttccgccgagtacttccgcctcgctctgagcaagcttcagagctgcgacctattcgacgaatttgataaaatgaacaatggcccagtccttgggcatgaagaagaagtgggaaggcgaacgacattcagactattctatcccgaatcagtcttctcggacccgattcacaacgaccctaatactacggtgatcctcactgcttttaaaccccacgatctccgatggctactggagcttctgatgggtgataagataaataccaatggtttttggaaaaaacctgcgcttaacctcatatataaaccctaccagatacggatactcgatccatttatcatcagaacagcagcttatgagttactgcactttcctaaggtattccccaagaaccaaaagcccaagcatccaaccactgggatcattgccattactttagccttctatatatgccacgaggttcacctggcgggttttaaatacaattttagcgacctgaagagcccgcttcactactacgggaatgccactatgtccctgatgaataaaaacgcttatcacaatgtcactgcagagcagttatttttaaaggatattattgaaaagaatcttgtgatcaatctcacccaggattag

SEQ ID NO: 136275 - DNA, 996 bp, Artificial Sequence
  Description of Artificial Sequence: Synthetic coding sequence
atgaggggttatctggtggccatcttcctttccgcagtgtttctgtattatgtcttgcattgcattttgtgggggaccaatgtctattgggtggcccctgtggaaatgaagcggcgcaacaagattcagccatgcctgagcaaacctgccttcgcctcgctgttgcggtttcaccagttccaccccttcctgtgtgcagccgactttcgcaagattgccagtttgtacggatccgacaagtttgacctgccttatgggatgcgtacctctgccgaatacttcagacttgccctatcaaaacttcaatcatgtgacctcttcgatgagttcgacaacattccttgcaaaaagtgcgtggtcgttggcaacggcggcgtgctaaagaacaaaaccttgggagagaaaatcgactcctacgacgtgattatccggatgaacaacggacctgttttaggccatgaggaggaggtggggagacggacaacatttaggctattttatccggagtctgtcttcagcgatcctatccacaacgatcctaatactaccgtgatcctcactgcctttaagccgcacgatctgcggtggctgctggagctgctcatgggtgacaaaatcaacacaaatggtttctggaaaaagccagcactgaacctgatctacaaaccataccaaattcgaattttggatcctttcattatacgtacagcagcttacgaactcctccacttccccaaggtcttccccaaaaaccagaagcctaagcaccctaccaccggtattatagcaatcaccctggccttctatatatgtcacgaggtccatctcgccggctttaagtataatttttcagatttaaaaagcccactgcattattacggaaacgcaacaatgagtctaatgaacaagaacgcttatcacaacgttacggccgaacaattattcttaaaagacatcatcgaaaagaacttggtgattaacctgactcaggactag

SEQ ID NO: 136276 - DNA, 996 bp, Artificial Sequence
  Description of Artificial Sequence: Synthetic coding sequence
atgagaggatacttggtggctatttttctgtccgcagtcttcctgtactatgttctgcactgtattctgtggggaaccaacgtttattgggtggctccagttgaaatgaaacgccgaaataaaatccagccatgtcttagcaaaccggcctttgcatcactgctccgcttccaccagttccacccttttctgtgtgctgcagatttccgtaagatagcaagtttatacggcagcgataagttcgacctaccctacggcatgagaacgtcagcagaatattttcggctggcgctgagcaagctccaatcctgcgatttgtttgatgagtttgataatatcccttgcaagaaatgcgtggtggtagggaacggtggagttctgaagaacaaaactcttggagagaagatagactcttatgacgtcattatacgcatgaacaacggtcctgttctggggcatgaggaggaggtagggaggcgtaccacgtttaggctgttctatcctgaatccgttttttcagatcccatccataacgaccctaatactacagtgattctgacggctttcaagccccatgatttgaggtggctgcttgagctccttatgggcgacaaaattaatacaaacggattctggaagaagcctgcgctcaacttgatctacaaaccttaccagatccggatcctggatccctttattattaggactgccgcatacgaattgctccatttcccaaaggtgtttccgaaaaatcagaaaccaaaacacccgacaactggcattatcgccatcaccctcgccttttatatctgccatgaggtccatctggctgggttcaagtataacttttcggatctgaagtcgcccctccactactacggtaacgctacaatgagtttaatgaataaaaacgcttaccataacgtgaccgccgagcagctgttcctgaaggatattatcgagaagaatctggtcatcaatctaacacaagactag

SEQ ID NO: 136277 - DNA, 696 bp, Artificial Sequence
  Description of Artificial Sequence: Synthetic coding sequence
atgcgcggatacttagtagccatcttcctgtccgctgtattcctgtactatgtactgcactgcatcctctgggggactaatgtctattgggtggcacccgtagaaatgaagcgccgaaacaaaatccagccctgcctgtctaaacctgcttttgccagcctcttgagattccaccagttccaccctttcctatgtgcagccgactttagaaaaatagcatcgctctacgggtccgataaattcgacctgccttacggcatgcggacttccgcagagtattttcggctggcactgtctaaactgcagtcatgtgatttattcgacgaatttgataacattccttgcaagaaatgtgtggtggtgggaaacggtggcgtgctgaagaataagacactgggcgagaaaattgactcatacgacgtgattatccggatgaacaatggcccggtacttggccacgaagaggaagtgggccgaaggaccacattcagacttttctacccagagtcggtgtttagtgaccctattcataacgaccccaacacaactgtgattctcactgccttcaagccccatgacctaagatggcttctggaattactgatgggggataagatcaacaccaatggcttttggaagaagccggccttgaatctgatttacaagccctaccagatccggattttggacccgtag

SEQ ID NO: 136278 - DNA, 741 bp, Artificial Sequence
  Description of Artificial Sequence: Synthetic coding sequence
atgcactgccgggactgcgcgctggtaacgtctagcgggcatcttttgcatagccgtcaaggcagtcagatcgaccagacggagtgcgtgatccgaatgaacgatgctcccactcggggatatggccgggatgtgggcaaccggacctctctgcgagttattgcccattcgtctattcaacggatactgcggaatcgtcacgacttactgaacgtgtcccagggcacagtatttattttttggggccccagctcttacatgcgccgagacggaaagggacaggtctataataatctgcacctgctgagccaggttttaccaagattaaaagcattcatgataactcgtcataagatgttacagtttgatgagctcttcaagcaagagacgggcaaggatcggaaaatctccaatacgtggctgagtaccgggtggtttaccatgaccatcgcattggagttgtgcgatcgaatcaatgtgtatggtatggtgcctccagacttctgcagagatcctaatcaccccagcgttccctaccattactacgagccgttcggccccgatgaatgtactatgtacctttcacacgagcggggtcgcaagggatcccaccatcgctttatcaccgaaaagagagtgttcaaaaattgggccagaacatttaacattcacttctttcagccagactggaagcctgaatcactcgccatcaaccaccctgaaaataaaccagtgttttag

SEQ ID NO: 136279 - DNA, 1011 bp, Artificial Sequence
  Description of Artificial Sequence: Synthetic coding sequence
atgaaaacactgatgcgccatggcctggccgtgtgcctggctcttaccacaatgtgcacctccctcctgctggtgtactcctctttgggaggccagaaggagcggcctcctcagcagcagcagcaacagcagcagcagcaacaacaggcatctgccaccggaagcagccagcccgccgccgagtcctccacccaacaaagaccaggcgttccagccggtcctcgcccgctggatggttaccttggcgtagcagatcataagccacttaaaatgcactgtcgggactgcgccctcgtaacgtcgtccgggcacttgctgcacagccggcagggcagccagatcgaccagaccgaatgcgtaatcagaatgaacgacgcccccaccaggggatatggccgtgatgttggtaatcgcactagtctaagagtcatcgctcactccagtatccaacggatcctgcgcaaccgacacgatctcctcaatgtgtcacaaggcaccgtgtttatcttctggggcccttccagctatatgcggagggatgggaaaggccaagtatataacaatctccacctcctgagccaggtgttgcccagattaaaggcttttatgatcacaaggcacaaaatgttgcagtttgacgaactatttaagcaggagacagggaaggatagaaaaataagtaacacatggctgagtacaggatggtttacaatgactatagctttggagctgtgcgataggattaatgtttatggcatggtgccaccagacttctgccgagatccaaatcaccccagcgtgccttatcactactatgagccctttggccccgatgagtgcactatgtacctgtcccatgaaaggggaaggaaaggctcacaccaccggtttataacggagaaacgagtgtttaagaattgggctagaacgtttaatattcattttttccaacccgattggaagcccgagtctctggccatcaatcatccagaaaataagcctgttttttag

SEQ ID NO: 136280 - DNA, 1275 bp, Artificial Sequence
  Description of Artificial Sequence: Synthetic coding sequence
atgagcgatcacggggacgtgagcctgccacctgaggaccgcgtgagggcccttagtcagctgggcagtgcagtggaagttaatgaggatatcccaccacgacgatactttcggtctggcgtagagataatccgtatggcaagcatatactcggaggaaggtaacattgaacacgcttttatcctgtataacaaatacattacgctgttcatcgagaagctgcccaagcaccgggactacaagagtgccgtgatccctgaaaagaaggacacagttaagaagctgaaggaaatagcatttcctaaagcagaggagcttaaagcagaactgctcaagcgttacacgaaagagtatactgaatataacgaggaaaagaagaaagaagccgaggagctcgctagaaacatggccatccaacaagaactcgaaaaagaaaagcaaagggtggcacagcagaaacagcagcaactggaacaggaacagtttcacgctttcgaagagatgatccggaatcaagagttggagaaggaaagattgaagatcgtacaggagtttgggaaggtggatcccggcttaggagggcctctcgttcctgatctggaaaaaccgtctctggacgtgttccccactttaaccgtgagcagtattcaaccaagcgactgtcatactacagtacggcccgcaaagcctccggtggtggatagaagtctgaagcccggcgcgctgagcaattcagagtctatcccaaccattgacggccttcgacatgttgtcgtccctggtaggctctgcccccagtttttacaattagcttccgcaaacacagctcggggggtagaaacgtgcgggatcctttgtgggaagctgatgcgcaacgaattcaccattacgcatgttctaattccgaaacagagcgccggcagcgattactgtaatacggaaaacgaggaggagctctttctgatacaggatcagcagggtctgatcacgcttggctggatccacacccaccctactcaaaccgctttcctgtcaagcgttgaccttcacacgcactgtagctaccagatgatgctgcccgaatctgtagccatcgtttgcagcccaaagtttcaggagacaggcttcttcaaactgacagaccacggcctggaggaaattagtagctgccgccagaaggggtttcaccctcacagcaaagaccccccactgttttgctcgtgttcccacgtcactgtggtggaccgggcagttactatcactgacttgaggtag

SEQ ID NO: 136281 - DNA, 1275 bp, Artificial Sequence
  Description of Artificial Sequence: Synthetic coding sequence
atgtccgaccacggggacgttagcctccctccagaggatcgggttcgggccctgtcacagcttggatccgctgttgaagtgaacgaggacattcctccccgccgctacttcaggtctggcgtggaaatcatccgcatggcttccatttattcagaggaggggaatatcgagcacgccttcattctttataataaatatatcacactgttcattgagaagctccctaagcatcgtgactacaaatccgctgtgatccctgagaagaaggacacggtcaagaaactcaaggagatcgccttccctaaggccgaagaactcaaggctgagctgctaaagcgctatactaaagagtacactgagtacaacgaggagaaaaaaaaagaggcggaggagctggcgcgaaacatggcgattcagcaggaattagaaaaggaaaagcaaagagtcgctcagcagaagcaacagcagttagagcaagagcaattccatgcatttgaggagatgattcggaatcaagagctcgaaaaagaaaggttgaaaatcgtccaggaatttggaaaagtcgaccccgggttgggcgggcccctggtacctgatctggagaagcctagcctggatgttttccccactctaactgtcagctctatccagccctccgattgtcataccaccgtgagacccgccaagccccccgtggtggatagatccctgaaacccggcgccctgtccaacagtgagagcattccgaccatcgacgggctgcgtcatgtcgtcgtgcctggtcgcttgtgtccacagttcctccagcttgctagcgcaaataccgcgcgaggtgtcgagacttgcggcattttatgcggaaagcttatgcggaacgagttcaccatcacccacgttctcatccctaaacagtccgccgggtctgactactgcaacactgaaaacgaagaggagctgttcctcattcaggatcaacaaggcctgatcactctggggtggatccacacccatccaacacagaccgccttcttgagtagtgtcgatttgcatacacactgtagttaccagatgatgcttcccgagtcagtggctattgtctgtagtccgaaatttcaagagaccgggttcttcaagcttaccgaccatgggctcgaggagatctcatcctgcagacaaaaagggtttcaccctcacagtaaggatccgcccctcttctgcagctgtagtcatgtcactgtagtggacagagctgttacaattactgacctgcggtag

SEQ ID NO: 136282 - DNA, 1275 bp, Artificial Sequence
  Description of Artificial Sequence: Synthetic coding sequence
atgtcagaccatggagatgtgtctctcccaccggaggatagagtcagggctcttagtcagctaggctctgcggtggaggtaaacgaggacattccacccagacggtactttcggtccggcgtcgagattattcgcatggcatccatttactctgaggaagggaacatcgagcatgctttcatcctgtacaacaagtatatcacactgttcatagaaaagctgccgaagcatagagactacaaatccgcggtgatacccgagaagaaagacacagtgaaaaaactgaaggagatcgcctttcccaaagccgaagaactgaaagcagaactgctcaaaagatatacaaaggaatataccgaatacaacgaagaaaagaaaaaggaagccgaggaactggcccgaaacatggcaatacagcaggagctggagaaggagaagcaaagagtggctcagcaaaagcagcagcagctcgaacaggagcagttccacgctttcgaggagatgatccgaaaccaggaactcgagaaggaacgcttgaaaatcgtgcaagaatttgggaaggttgacccggggctgggagggccccttgtacccgatctggaaaagccatccttagatgtcttccccacgttgaccgtgagcagtattcaaccctccgactgtcacactaccgtgcgtccggccaaaccccccgtggtcgatagaagcctcaaaccaggcgctttgtcgaattccgagtcgatccccacaatcgacggcctgcggcacgttgtggtccccgggaggctttgcccccagtttctacagctagccagtgccaatacagctagaggggtggagacctgcggtatcctctgcggtaagctgatgaggaatgaatttacaataactcacgtgctgatcccgaaacagagcgcaggctccgactactgcaatactgagaatgaggaggaactctttctcattcaggatcagcagggccttatcaccctaggctggattcacacacaccccacacagactgctttcctcagtagcgtagacctgcacacacattgctcctaccagatgatgctgcccgagtcagtcgcaatcgtgtgttcgcctaaatttcaagagaccgggttctttaaactgaccgatcacggcttagaggaaatatcatcttgtaggcaaaagggcttccacccccatagtaaagacccaccactgttctgtagctgctcccacgtcaccgtggttgacagagctgtgacaattacggacctccggtag

SEQ ID NO: 136283 - DNA, 1275 bp, Artificial Sequence
  Description of Artificial Sequence: Synthetic coding sequence
atgtcagaccatggtgacgtttccttgcctccagaggatcgagtgagggctctgagccagctgggatcggcggtcgaggtcaacgaggacatcccacccaggcgctacttccggagtggagttgagattatccgcatggcctccatttatagtgaagagggaaatattgagcacgcatttatcttgtataacaagtacatcactttgttcattgagaagctccccaagcatagagactataaatcggctgtgatccccgagaaaaaggacaccgtgaagaagctgaaagaaatcgctttcccaaaggcagaagaacttaaagccgagctgcttaagcgatacactaaggagtacactgaatataatgaagaaaagaagaaagaagctgaggagctggctcgcaacatggccatccagcaggaactggagaaagaaaaacagcgcgtggcgcaacagaaacagcagcagctggaacaggagcagtttcacgcgtttgaggaaatgatccggaatcaggagttggagaaggagcgactaaagatcgtccaggaattcggtaaggttgatcctgggctgggcggaccgctcgttccagacctggagaagccttcccttgatgtatttccaacgcttactgttagtagcattcagccgtcagattgccacactactgtgcgccccgccaaaccccccgtcgtggacagatcactaaagccaggggccttgtctaacagcgaatctattccaaccattgatggcctcaggcatgtggtagtgcccggcagattgtgtccgcagttcctgcaattggccagcgccaataccgcccgcggcgtggagacgtgtggtatcctgtgtgggaagttaatgaggaacgagtttaccatcactcacgtgctgattccaaagcagagcgccggctccgattactgtaataccgagaacgaggaggagctcttcctgattcaggaccagcagggcctgattaccctaggttggatacatacccatcccacgcagaccgcctttctctcctctgtggatttgcacacccactgcagctatcagatgatgctccccgagtccgttgctatcgtatgctcaccgaaatttcaagaaacaggctttttcaaactgacagatcatgggcttgaagaaataagttcttgccggcagaaaggcttccaccctcactccaaggacccccctttgttctgttcctgctcccacgtgacagtggtggatcgcgcagttaccattactgaccttagatag

SEQ ID NO: 136284 - DNA, 492 bp, Artificial Sequence
  Description of Artificial Sequence: Synthetic coding sequence
atgtccgaccacggggatgtgagcctcccccccgaagatagggtgcgggccctgtctcagctgggttctgccgttgaggtgaatgaagacatccctcctcggaggtatttcagatccggagtggagattatacggatggcctctatatacagtgaggaagggaacatagaacacgcgttcattctctacaataaatatatcacattgtttattgaaaagttacccaagcacagggactataaatccgccgtgatcccggaaaagaaagacaccgtgaagaaactcaaagagattgccttccccaaagccgaggagttaaaagccgagttgttgaaacggtacaccaaggaatacactgagtataatgaagagaaaaagaaggaggcagaagagctagcacggaacatggccattcagcaggagcttgaaaaggaaaagcagcgagtggcacagcaaaaacagcagcagctggaacaggagcaatttcattag

SEQ ID NO: 136285 - DNA, 957 bp, Artificial Sequence
  Description of Artificial Sequence: Synthetic coding sequence
atgagcgaccatggcgatgtaagtctgcctccagaggatcgcgtgagggccctttctcagttgggatcggccgtagaggtgaacgaagacatcccaccgagacgttatttccgatccggggtcgaaattattcgaatggcctcaatatactcagaggaaggcaatattgagcacgcctttatactgtataacaaatacattacactgtttatcgagaagttgccaaaacatagggattataagtcagcagttatacccgaaaaaaaagacacagtgaaaaagttgaaggaaatcgcctttcctaaagccgaagaactgaaggcggaattgctgaagcggtatacaaaggagtacacagaatacaacgaggagaaaaaaaaagaagctgaagaattagctcggaacatggccatccagcaggagctggaaaaagagaaacagagagtggcccagcagaagcagcagcaattggaacaggagcaattccacgcgttcgaagagatgattcgcaaccaggagctagagaaagaaaggctaaagatcgttcaggaattcgggaaggtggacccgggactcgggggtccactggtgcccgatctggaaaaaccttctttggacgtatttcccaccctcacagtctctagcattcagccatccgattgtcatactacagtgcgccctgctaaaccccccgttgtggataggtcactgaaaccaggcgctctcagtaattctgagtccattcctactatcgacggcctgaggcatgtagtcgtccctggcagactgtgcccccagtttttgcagctggcctctgcaaacacggccaggggggtagagacttgtggaatactttgtggaaaattgatgagaaacgaatttacaataacacatgtgttgattcctaagcagtcagcaggaagcgattactgtaacacggaaaatgaagaggagtag

SEQ ID NO: 136286 - DNA, 414 bp, Artificial Sequence
  Description of Artificial Sequence: Synthetic coding sequence
atgagtgatcacggggatgtcagtttaccaccagaggacagggttcgtgccttatcccagctcgggtccgcagtcgaggtgaacgaggacattcccccacgtaggtattttaggagtggcgtcgagataatccgaatggcaagcatttatagcgaggagggcaatattgaacacgctttcatcttgtataataagtacataactttgtttatcgagaagctgcccaaacatagggactataaatccgcggtgatcccagagaagaaagacacagtgaagaagctcaaagagatcgcgttcccgaaagctgaggagcttaaagctgaactgctgaaaaggtacacaaaagaatacaccgaatacaatgaagaaaagaagaaggaggctgaggaactggccagaaacatggcctag

SEQ ID NO: 136287 - DNA, 1047 bp, Artificial Sequence
  Description of Artificial Sequence: Synthetic coding sequence
atgtccgatcacggcgacgtcagtcttccccctgaggatcgcgtgcgcgctctgagccagctggggtctgcagtggaagtcaatgaggacattccacctagaaggtattttaggtcaggagttgagatcattcgcatggcttccatctacagtgaggagggcaatattgagcacgccttcattctttacaataaatacatcactttgtttattgaaaaactgcccaaacacagagactacaaatcggctgtgatccccgagaagaaggatacagtaaaaaagctgaaggaaattgcttttccaaaagctgaagagctcaaggccgagctgctcaagcgctacaccaaagaatatacagagtataatgaggagaagaaaaaagaggccgaggagctcgcccgaaacatggctatccagcaggagttggagaaggaaaaacaaagggtggcacagcagaagcagcagcagctcgaacaagagcaatttcatgcctttgaggagatgatccgtaaccaggaactcgagaaggaaaggcttaagatcgtgcaagaattcgggaaagtggaccccggcctgggtggcccccttgtgcccgaccttgagaagccatcactcgacgtttttccaactttaaccgttagcagcatacaaccctccgattgtcataccaccgtgcgacccgcaaaaccacccgtggtggacaggagcctaaagccaggcgctttgagcaatagtgaaagtattcctacaattgatggtcttaggcatgttgttgtgcctgggcggctctgcccccagtttctccaattggcctcagctaatactgctcggggcgtggaaacctgtggcattctgtgcgggaagctgatgcgcaatgaatttacaataacacacgtgctgattcccaaacagagcgcagggagtgactattgtaacacagagaatgaagaagaactgtttctgatccaagatcagcagggattgataaccctggggtggatccacgtagagactctgtggagtctgaaatcactgcatgccccctag

SEQ ID NO: 136288 - DNA, 813 bp, Artificial Sequence
  Description of Artificial Sequence: Synthetic coding sequence
atgaggcagcaacagctggaatccgaacagtttctgttcttcgaagaccagctgaagaaacaggagttggccaggggccagatgagatcccagcaaaccagcggtctttccgagcagatagacgggtctgctctgtcttgcttttcaacacaccagaacaactcactgctgaatgtgttcgcggatcaacctaacaaaagcgatgctactaactatgcctcccacagcccacccgtgaaccgagcactgacccccgccgctactctaagtgctgttcagaacctcgtggtcgaaggattgcggtgtgtcgtgttacctgaggatttgtgtcataaatttttgcagttggctgagtccaatacggttaggggaatcgaaacctgcgggattctgtgcgggaaactcactcacaatgaattcacgattacccacgtaatcgtccccaagcagtctgcggggcccgattactgtgatatggagaatgtggaagaactgtttaatgttcaagatcagcacgacctacttacactcgggtggattcatacccaccctactcagactgcctttttgtcgtctgtggacctccacactcactgctcataccagctgatgcttccagaagcaattgcgattgtctgctcccctaagcataaagacaccggcatcttcagattgacgaatgctggtatgctggaggtgtcagcatgtaagaagaaaggattccaccctcatacaaaggagcccagactgttctccatatgtaaacacgttcttgtaaaggatatcaagatcatcgtgctggacctgcgatag

SEQ ID NO: 136289 - DNA, 1311 bp, Artificial Sequence
  Description of Artificial Sequence: Synthetic coding sequence
atggaccagcccttcaccgtgaattcactgaagaagctggccgccatgccagaccatacggacgttagcctgagtcctgaggagagagtgcgcgccctctcaaagctgggctgcaatattactattagcgaagacattactcccagacggtatttcaggtccggagttgaaatggagcggatggcctcagtgtatttggaagaaggaaatttggaaaatgcttttgtcctgtataataaattcattaccttattcgtggaaaaactgcccaaccacagagattaccagcagtgtgcagtccctgaaaagcaggatatcatgaaaaagctaaaggaaatcgcctttcccaggactgatgaactgaaaaacgatctgctgaagaagtacaatgtggagtatcaggagtacctgcagtcaaagaataaatacaaggcagaaatcctgaagaagctggagcatcagcggctgattgaagctgagaggaagcgcatcgcccaaatgagacagcagcaactcgaatctgagcaatttctcttctttgaggaccagctgaagaaacaagagttagctcgggggcagatgcggagccagcagacctctggcctgagcgagcagattgacggctccgcactctcctgcttttcaacacatcagaacaattcactgctgaatgtgtttgccgatcagcccaataagagtgacgctacaaattatgcctctcactcccctccggtgaatcgcgcactcacgcccgctgccactctgtcagctgtgcagaacctagtggtggagggtctgaggtgcgtggtactgcccgaggacctgtgtcacaaattcttgcagcttgcggagagcaataccgttcgggggatcgaaacgtgcggcatcctgtgcggaaaactgactcacaacgagttcaccatcacacatgtaattgttcccaaacagtcagccggcccggattattgcgatatggagaatgtggaggagctgtttaatgtccaggatcagcacgacctacttacgttaggatggattcatactcacccaacacagactgcattcctctcctctgtcgatctccacacccactgttcttaccagttgatgctccccgaagccattgcgatcgtatgctcacccaagcacaaggacactggcatttttagattgacgaacgctggtatgttggaggtcagcgcctgcaagaaaaaaggttttcacccacatactaaggaacccagactgttcagcatttgcaagcacgtgctcgtcaaggacatcaagatcatcgtcctcgacttgaggtag

SEQ ID NO: 136290 - DNA, 1311 bp, Artificial Sequence
  Description of Artificial Sequence: Synthetic coding sequence
atggaccagccgttcacggtcaacagcctgaaaaaattagctgcaatgcccgaccacactgacgtaagcttaagccccgaagagagagtccgggctctttctaaattgggttgcaacattactataagcgaagatattacaccgagacgatacttccggtccggtgtggagatggagcggatggcgtccgtgtacctggaagagggaaatctcgaaaacgctttcgtgctgtacaacaagtttatcacactgttcgtggagaagttgccaaaccaccgagactaccagcagtgcgcggtaccggaaaagcaggatattatgaaaaagttgaaagaaatcgccttccctcggacagacgaactaaaaaatgaccttttgaaaaaatacaacgtggagtatcaggagtacctgcagtctaaaaataaatataaggcggagatattgaagaagctggaacatcagcgactgattgaagctgagcgaaagaggatcgcacaaatgaggcagcaacagctggaaagcgagcagttcctgttttttgaagaccagctcaaaaaacaggaactcgcacggggtcaaatgcggtcgcagcagacatccgggctctccgaacagatcgacggatctgcattgtcatgtttttctacccaccagaataactccttactcaatgttttcgccgaccagccaaacaagagcgacgcaacaaattacgcctcccattcgccacccgttaatagagccttgactcccgccgcaaccctctcagctgtccagaatctcgtagtggagggactgcgctgtgtcgttctccccgaagatctttgccataagtttctacagctcgcggagagcaacactgtcagaggcattgagacctgcgggattctttgcggcaaactgacccacaacgaatttactattactcatgtaatagtacccaaacagtccgctggccccgattactgcgacatggagaacgtggaggaactcttcaatgtacaggaccagcatgacttgctaacactgggttggattcatacacacccaacccagacggcattccttagttccgtggatcttcacacccactgctcataccagctcatgctccctgaagcaatcgccatagtctgctctcccaagcataaggacacagggattttccgactcactaatgctggcatgttagaagtctccgcatgtaaaaaaaagggcttccatccacatacaaaagagcccaggctgtttagcatatgtaaacacgtcctggtcaaagacattaagatcatcgtgctcgatctgcgctag

SEQ ID NO: 136291 - DNA, 1386 bp, Artificial Sequence
  Description of Artificial Sequence: Synthetic coding sequence
atggaccagccctttactgtcaacagcctcaagaagctcgctgctatgcctgaccatacagatgtctcactctccccagaagagcgtgtcagagctttgagtaaactaggctgcaatataacgatatctgaggatattaccccaagacgatatttccgttctggggtcgagatggagcgcatggcttctgtttacttagaggaggggaacctggagaatgcgtttgtattatacaacaagtttattacactattcgtcgaaaaattgcccaaccatcgggactatcagcaatgtgccgtgcccgagaaacaggacatcatgaagaagctgaaagagatagcttttcctcggaccgacgagctgaagaatgacctcttaaagaagtataacgttgagtatcaggagtatctccagagcaaaaataaatacaaggcagaaatcctaaaaaagctcgaacaccagcgacttatcgaagcggaacggaagcgaattgcccagatgcgccaacagcagctagaaagcgaacaattccttttttttgaagaccagctcaagaagcaagagctcgcacgaggccagatgcggtctcagcagacaagcggactgtctgagcagattgacgggtcagccctgtcttgtttctctacgcaccagaataactctctcctgaacgtgttcgcagatcagcccaataagtctgacgcaaccaattatgcttcacactccccgcccgtcaatcgcgcattaaccccggccgccactctgtcggccgtgcagaatcttgttgtagaaggcctgaggtgtgtagttctgcccgaggacctgtgccataagtttctgcagctagctgaatctaatacggttcggggcatcgaaacgtgtggcattctgtgcggaaagcttactcacaacgaattcactattacccatgtcatcgtgcccaaacaatccgccggacccgactactgcgatatggaaaacgtcgaagagctgttcaacgtccaggatcaacacgaccttctcaccctgggctggatacatacccaccctacccagacagcctttctgtccagtgtcgatcttcacacccattgttcctaccagctgatgctgcctgaggctatcgcgatagtttgctctccgaaacacaaagacaccggcatcttccggctgacgaacgcggggatgttggaggtgtcagcttgtaagaagaaggggttccacccccatacgaaagagcccaggctgttctccattcagaaatttctgtccggcatcatttcaggcacagctctggaaatggagccactcaaaatcgggtatggaccaaatggattccccttactggggatcagtaggtcttcgtctccatccgaacaactgtag

SEQ ID NO: 136292 - DNA, 267 bp, Artificial Sequence
  Description of Artificial Sequence: Synthetic coding sequence
atgagtattatggaccattcccccactacgggcgtggtgaccgtcatcgtcattttaatagccattgctgctctgggtgcattaatcctgggatgttggtgttacctgcggcttcagagaatatctcagtctgaagacgaggaatcgatagtgggcgatggggagacaaaggagcccttcctgctcgttcagtactcagccaagggcccttgcgtggagcgcaaagctaaactgatgaccccgaacggacccgaggtgcatggctag

SEQ ID NO: 136293 - DNA, 744 bp, Artificial Sequence
  Description of Artificial Sequence: Synthetic coding sequence
atgctacagaacagtgctgttttgctggttctggtcatttccgcctccgccactcacgaagcagagcaaaatgattccgtgtccccgagaaagtccagagtggccgcgcaaaatagtgccgaggtggtgcggtgcctgaactccgctctgcaggtcggctgtggcgcatttgcctgtctggaaaattcaacctgtgacaccgatggaatgtacgatatttgtaaatccttcctatacagtgccgccaaatttgacacccaaggtaaagccttcgtcaaggagagtctcaagtgtatagctaacggagtgacaagcaaggtgttcttggccattcgacgctgctccactttccagaggatgattgcagaagttcaagaggaatgttattccaaactcaacgtgtgcagcatcgctaagagaaatcctgaagctattacagaggtagttcagcttcccaatcacttcagtaatcgctattataatcgccttgttcggagtctgttggaatgtgacgaagacaccgttagcactatccgcgacagccttatggagaaaattggaccaaatatggcaagcctcttccatatcctccagactgatcattgcgctcaaacccacccacgggctgacttcaacagacgcagaaccaacgaacctcaaaagctgaaggtcctgctgagaaatttgagaggtgaagaagactctccctcccatattaaaagaacgtcccacgaatcagcgtag

SEQ ID NO: 136294 - DNA, 537 bp, Artificial Sequence
  Description of Artificial Sequence: Synthetic coding sequence
atgtacgacatttgtaaatcctttctctactccgctgccaagtttgatacccagggaaaggctttcgttaaggagagcctgaagtgtatcgcaaacggcgtaacgagcaaagtcttcttggccataaggagatgctctaccttccaaagaatgatcgctgaggtgcaggaggaatgttactctaagttgaatgtctgctccatcgcaaaaagaaatccagaagctatcacagaagtggttcagcttcctaaccatttctccaaccggtattacaataggttggtgagaagcctgcttgagtgtgatgaggacacagtgtccaccatacgtgattctctcatggaaaagattgggcccaacatggcctctctcttccatatccttcaaactgaccattgcgcccagacacatccccgagcagacttcaataggagacgaaccaacgagccgcagaagctgaaagttctgctcaggaacctacgcggcgaggaggactcaccaagtcacattaagaggacatctcacgagagtgcttag

SEQ ID NO: 136295 - DNA, 537 bp, Artificial Sequence
  Description of Artificial Sequence: Synthetic coding sequence
atgtatgatatctgtaaatccttcctgtatagcgcggctaagttcgacacccaggggaaagcttttgtgaaagaaagcctgaaatgtatcgccaatggggtgactagtaaggtcttccttgctatacgtcgctgttctacattccagaggatgatcgcggaggtgcaggaggaatgctattcgaaactcaacgtgtgcagcatcgcaaagagaaaccctgaggccattacagaggtggttcagctccctaaccatttctccaaccgttattacaaccggctggtgagaagcctcctcgagtgcgacgaggataccgtgagcacaattcgggattccttgatggagaagatcggccctaatatggcttcactatttcacatcctccagacggatcattgtgcccaaactcatccccgggccgattttaacaggcggagaacgaacgagccccagaagttaaaggtactcctgagaaacctccgcggagaggaagattctccatcccacattaagaggacctctcatgaatctgcctag

SEQ ID NO: 136296 - DNA, 2733 bp, Artificial Sequence
  Description of Artificial Sequence: Synthetic coding sequence
atggcttcctcagctcaatccggcggtagttcagggggacccgccgtgcccacggtccaacggggcattatcaagatggttctgagcggctgtgcaattatcgttcgaggccagccacgcggcggaccccctccagaaaggcaaatcaatctgtccaacatccgggcgggaaatctggctcggagggcagccgcaacccagccagacgctaaggatacccctgatgaaccatgggccttcccagccagggaattcctgcgtaagaagttaatcgggaaggaagtgtgctttacgattgaaaataagaccccccaaggaagagaatacggcatgatctatctgggcaaggatactaacggtgaaaacattgctgaaagtctagttgctgaaggcttggccaccaggcgagagggcatgagagctaataatccagagcagaaccgtctatctgagtgcgaggaacaggcaaaagccgctaaaaaggggatgtggtctgaagggaatgggtcccataccatacgtgatttgaaatataccatagaaaacccccgacacttcgtcgacagtcatcatcagaaacccgtgaacgctataatcgaacatgtacgggacggcagtgtggttagagccttactcctgcccgattactacttagtaactgtgatgttgtctggcatcaaatgtcctacattcagacgagaagctgatggctccgagacgcccgagccttttgccgccgaggccaagttcttcaccgagtcgagattattgcaacgtgatgtacagattattctggaatcatgccataaccagaacatccttggtacaatcctgcatccaaatgggaatattactgaactactgctgaaggaggggtttgccaggtgcgtggattggtcgatagcagtgtatactcgtggtgctgaaaagctccgcgcagccgaacggtttgccaaagagaggaggttgcggatatggagagactatgtggcacccacagcaaatctggatcaaaaagacaaacaatttgttgccaaggtcatgcaggttctgaatgcggatgcaattgtggtaaaactgaattctggcgactataagacaattcacctttcttcaattagacctccacgattggaaggcgagaatactcaggacaaaaataagaaactaagaccgctctacgacatcccctacatgttcgaggctagagagttccttcggaaaaagctgataggcaaaaaggtgaatgtcaccgtggattacatcaggccggcctctcccgccacagagactgtgccagctttctctgaacggacctgcgctaccgttactatcggcggaattaacattgctgaagccttggtctctaagggcctcgccaccgttatccgatataggcaggatgatgaccagcgatcatctcattacgatgagctgctggctgccgaagcaagagcgatcaaaaacgggaaggggttgcactccaaaaaagaagtccccatccaccgggttgcggacatctccggcgacacccaaaaagccaagcagtttttacctttcctgcaacgtgcgggtaggtcggaggcagtggtcgagtacgtgttttctggctctaggctaaaattgtacctgcccaaagagacgtgtcttataacattcctgcttgctgggatcgagtgccctcgcggcgcgagaaatctgcctgggctcgttcaggagggagaaccttttagtgaggaggctacactgtttaccaaggaacttgtgctgcagcgggaggtagaagtggaggtggaaagcatggataaagctggcaatttcatcggttggctgcacattgacggcgctaacctgagcgtgctgctggtggaacatgctctgagtaaagtgcactttactgccgaacggtcctcctactataagtcccttctcagtgcggaggaggccgctaagcagaaaaaggaaaaggtttgggcgcattatgaagaacagcccgtggaagaagtgatgccagtgttagaggaaaaggagcggtcagcctcatacaagccagtatttgtgaccgaaatcaccgacgacttgcacttttacgtccaggatgttgaaaccggcacacaactggaaaaactgatggagaacatgcgtaatgatatcgcatctcacccacctgttgagggatcctatgctccccgtcggggcgaattctgcatcgcaaaatttgtggacggggagtggtaccgcgctagagtggagaaggtggagtcccccgccaaaatccatgtgttctacatcgactatgggaacagagaggttttgccttctacaaggctgggaaccctgtcaccagctttctcaacacgcgtgctgcccgcacaggcaaccgaatacgcctttgcattcatccaggtccctcaagacgatgatgctcggactgacgcagttgacagtgtggtgagagatattcagaatacccagtgcctattgaatgtagaacacttaagcgcagggtgcccccatgtaaccctgcaatttgccgatagcaagggcgatgtaggcctgggtcttgtaaaggaagggttggtaatggttgaggtccgaaaagagaagcaattccagaaggtaatcaccgagtacctgaatgcccaggagtccgcgaaatcagcccggttgaatctgtggagatacggcgattttagagctgacgacgcagatgaattcggctattctcgatag

SEQ ID NO: 136297 - DNA, 2703 bp, Artificial Sequence
  Description of Artificial Sequence: Synthetic coding sequence
atggccagcagtgccgttcctactgtgcaacgggggattattaagatggtgctgagtgggtgtgccataatcgtgagagggcaacccagagggggaccgcccccagagcgccagattaatctgagcaatataagagcaggcaatctggcccgccgcgcagccgccacacagccggacgcaaaagatacacccgatgaaccatgggcatttcccgcccgtgagtttttgagaaaaaaattaattggcaaggaggtgtgtttcactatcgagaataagacacctcagggaagagaatatggaatgatctatctcgggaaagatacaaatggagagaatatagctgagtcacttgtggctgagggcctagctactagaagggaaggcatgcgagccaacaaccccgaacagaacaggttgtcagaatgtgaagaacaggctaaagcagccaagaaggggatgtggagcgaagggaatgggtcccacacgattcgggacctcaagtatactattgaaaaccctcggcactttgttgactcacatcatcagaaaccagtgaacgcaattatcgagcatgtgcgggatggcagtgtcgtgcgcgcgctcttgctgccggactattacctagtaacagttatgctgagcgggatcaagtgccccacttttcgccgcgaggccgacggtagtgagaccccggaacctttcgctgccgaggctaaattcttcaccgaaagtaggctcctccagcgcgacgttcagattatcttggagtcttgtcataatcagaacatcttaggaactattctgcaccccaatgggaacataacagaactgttgctgaaggagggatttgccaggtgtgttgattggtcgatcgccgtttacacccgcggggccgagaagctgagagcagccgagcggtttgccaaagaacgtagactccgcatttggagagattacgtcgcccctaccgctaatctcgatcaaaaagacaagcagttcgtggctaaagtgatgcaggtgctgaatgcagacgctatcgttgttaaactcaacagtggggactacaagacaattcatctcagctctattcggccaccccgtctggagggcgaaaacacacaggataagaataagaagctgcgccccctttacgatattccttatatgttcgaagcgagggaattcctgcgaaaaaagcttattggcaagaaggtgaacgtaaccgtcgactacatccgaccggcctcacccgcaactgaaactgttccagctttctctgagaggacatgcgccactgtgaccataggaggaataaacattgccgaagctctcgtctccaaaggtctagcaaccgtgattagatataggcaggatgatgaccagagatcatcccattatgacgagctgctggccgccgaggctcgggcaataaagaacggtaaaggcctgcactcaaagaaggaggtccctattcatagagtggctgacatcagcggcgacacacagaaggccaaacagttccttccgttcctgcagagagcaggcagaagcgaagccgttgtggagtacgtgttttctggatccaggttgaagctgtatttgcccaaagaaacttgtctgattacctttttgctggccggtattgagtgtcccaggggggctagaaacctccctggcctggtgcaggaaggtgagcccttttcagaggaggcaaccctctttacaaaggagcttgtacttcaacgggaggtggaagtcgaagtggagagcatggacaaagccggcaacttcatcgggtggctccatatcgacggtgcaaatctgtcggtgttattggtagagcatgcactcagcaaggtacattttaccgcggaaagatctagctactataagagcctgttgtctgccgaggaagcagcaaagcagaaaaaagaaaaagtttgggctcattatgaggagcagccagtcgaggaagtcatgccagtcctagaggagaaggaacggtcggcatcgtacaagccagtgttcgtgacggagatcaccgatgatctgcatttctatgtgcaagatgtcgaaacaggaactcagttggagaaacttatggaaaatatgcggaacgatatcgcctcacatcctcctgtggaggggagctacgcaccacggcggggggagttctgcatcgcaaaatttgttgacggggaatggtatcgggccagagttgaaaaagtcgagtcccctgcaaagattcatgtgttctatatagattacggaaaccgggaagtgctgcctagcactcgtctaggaacgctgtctcccgccttttccactcgcgttctgcctgcgcaggccacggaatatgcttttgcatttattcaggtgccgcaagacgatgatgcccgaacggatgccgtggatagcgtggtgcgggatatccagaacacccagtgcctcctgaacgtcgagcaccttagcgccggttgtccgcacgtgactctgcagttcgctgattcaaaaggagacgtcggactgggcctcgtcaaagaaggcttagtgatggtggaggttaggaaagagaagcagtttcagaaagttatcacagagtacctgaatgcccaggaatccgctaagagcgctcgcctcaatctttggcgatacggagattttcgggccgatgacgccgacgagttcggttactctcgatag

SEQ ID NO: 136298 - DNA, 705 bp, Artificial Sequence
  Description of Artificial Sequence: Synthetic coding sequence
atgaaccacctgcccgaggatatggagaatgctttgaccggctcccagagctcacacgcatccctccgcaacatccattcaatcaaccccactcagctgatggcgagaatcgaaagttatgaaggccgggaaaaaaaaggaatcagtgacgtgaggcggacattctgcctgtttgtcactttcgatcttctgtttgtgacactcctctggattattgaattgaacgtgaacggggggatcgaaaatactttagagaaggaggtgatgcaatatgattattattctagctatttcgatatctttttactggccgttttcaggtttaaagttctgattctcgcttacgccgtgtgcagattgaggcactggtgggcaatcgcccttaccacagctgtgacaagtgctttcttgctagcaaaggtgattctcagtaagctgttttcccagggagcctttggatacgtactccctatcatcagctttatcctcgcctggatcgaaacatggttcctggacttcaaggtactgcctcaggaagcagaggaagaaaataggctccttatcgtgcaggacgcttctgagcgggcagccctgattcctggaggactgagcgacggtcaattttactccccacccgagtcagaggctggatcggaagaagcggaggagaaacaggattccgagaagcccttgttagagctgtag

SEQ ID NO: 136299 - DNA, 705 bp, Artificial Sequence
  Description of Artificial Sequence: Synthetic coding sequence
atgaatcacttgcctgaggacatggaaaatgctttaactggttcccaatccagtcacgcgagcctgcgtaatatacacagcataaacccgactcagctgatggcacggatcgaaagttacgaaggccgagaaaaaaaaggtatctccgatgtgaggcggactttctgtctctttgtcacttttgatctgctatttgtgacactgctctggataatcgaattgaatgttaatgggggtattgaaaacactctggagaaggaggtgatgcaatatgactattatagctcgtactttgatatattcctgcttgcagtctttcgtttcaaggtgcttattctggcctatgcagtgtgtcgcttacggcattggtgggccatagctctgactacagctgtaacctcagctttcttactggcaaaggtgatcctgagcaagctatttagccagggagcgtttgggtacgttctcccaataatcagctttatcctagcatggatcgagacttggtttttagatttcaaagtccttccccaagaagcagaagaggaaaacaggctgctgatcgtgcaggacgccagcgaacgagccgccctgatcccaggcgggctatctgatgggcagttttacagtccccccgagagcgaggcaggatctgaggaggctgaggagaagcaggattcggagaagccgctgttggaactgtag

SEQ ID NO: 136300 - DNA, 621 bp, Artificial Sequence
  Description of Artificial Sequence: Synthetic coding sequence
atgaatcaccttcccgaggacatggaaaacgccctcacaggtagccagtcctcccatgccagcctgcgcaatattcacagtatcaaccccacccagctgatggcacgaatcgagagttatgaggggcgcgagaagaaaggaatcagcgacgttcgacgcaccttctgtctgttcgttacattcgaccttctgtttgtcacgcttctctggatcatcgagctcaacgtgaatggcggtatcgagaacaccctcgagaaagaagtgatgcagtacgactactactcctcctattttgacatctttctgctggctgtctttagatttaaagtgctgatcctggcgtacgccgtctgcagattgcgacactggtgggccatcgcgctgacaaccgccgtcacctccgccttcctgctagcgaaagtgattctgagcaagctgttttcgcaaggggcctttgggtatgttctgcccattatttctttcatccttgcctggatcgagacatggttccttgattttaaagtgctgccgcaagaggccgaggaagaaaaccgtttactgattgtacaagatgcatcagagagagcggccctgattcctggggggttgtcggatggatag

SEQ ID NO: 136301 - DNA, 555 bp, Artificial Sequence
  Description of Artificial Sequence: Synthetic coding sequence
atgaaccacctccccgaggacatggaaaacgccctgacagggagccagtcatctcacgcatctctgcgaaatatccattcaatcaacccaacccagctcatggccaggattgagtcatacgaaggccgagagaagaaaggaatatctgacgttcgtagaacattttgcctgtttgtcaccttcgacctcctctttgtaactcttttgtggattatcgaacttaacgtgaacggcggcatcgagaacacactggagaaagaggtgatgcagtacgattactattcatcttacttcgacatattcctcctcgctgtcttcaggttcaaagtgcttattttagcctatgctgtctgtaggctgcgccactggtgggcaattgcccttactacggctgtcacttctgcatttctcctggccaaggtgattctgagcaaactgttcagccaaggcgccttcggctacgtactgccaatcatctcatttattctggcatggatcgagacttggtttctggatttcaaggtgttgccacaggaagccgaggaagagaactag

SEQ ID NO: 136302 - DNA, 519 bp, Artificial Sequence
  Description of Artificial Sequence: Synthetic coding sequence
atgaatcatctgcccgaggacatggagaatgcgctgacgggctctcagagcagccacgcttcactgcggaatatacacagcatcaatccaacccaactcatggcaagaatcgaatcttacgaaggtagggagaagaaggggatctccgacgtgcgacggaccttctgccttttcgtcaccttcgatctcttgtttgtgactcttctgtggatcattgaactgaatgtgaacggaggcatagaaaatacgctagaaaaggaagtgatgcagtatgactactactcgagttattttgatattttcctgttagccgtgttccgctttaaagtgctgatcttggcatacgctgtttgtcgcttacgccattggtgggcaatagcgctgactaccgcagttacctcagctttcttgctggctaaagtaatactgagtaaattattttcccagggcgcctttggatatgtgcttcctatcattagtttcatcttggcatggattgagacatggttcctggattag

SEQ ID NO: 136303 - DNA, 684 bp, Artificial Sequence
  Description of Artificial Sequence: Synthetic coding sequence
atggagaacgccttaacagggagtcagtcctctcatgcctccctgaggaatattcatagtatcaaccctactcagcttatggcaaggatcgagtcctatgaggggagagagaagaaaggcataagcgatgttaggagaacattctgcctgttcgtcacgttcgatctccttttcgtgaccctgctgtggataattgaactgaacgttaacggcggaattgagaataccttggagaaggaggtcatgcagtacgactactactcgagctacttcgatatcttcctgctcgctgtgtttcgctttaaggtgctcatcctcgcatacgcagtatgccggcttagacattggtgggctatcgcacttaccaccgccgtgacatctgcattcctgttggctaaagtgatacttagcaagctgttttcccagggggcctttggctacgtcctccctatcatcagttttattctggcgtggattgaaacctggtttctcgactttaaggtcttgcctcaggaagccgaggaagagaacaggttattaatcgtgcaggacgctagcgaacgggctgcgcttattccaggtggcctaagcgatggccaattctattccccaccagagtctgaggctggctccgaggaggcagaggagaagcaggactcagaaaagcctctgctggagctctag

SEQ ID NO: 136304 - DNA, 1338 bp, Artificial Sequence
  Description of Artificial Sequence: Synthetic coding sequence
atgtctaagttgccacgggaactgaccagagatctggagcgttcactgcccgccgtcgcaagcctgggctccagcctgtcccatagccagagtctgtcctcacatctgctgccaccacctgagaaacggcgtgcgatctcggatgttaggcggacgttctgcctgtttgttacctttgacctgctcttcataagtttactgtggatcatcgagctcaatactaacaccggtatcagaaaaaatcttgaacaggagataatccagtacaacttcaaaactagcttttttgatatcttcgttcttgcttttttcagattttcaggactattgctgggctatgccgtgctaagactgcgccattggtgggtcatagcagttacaaccttggtgagctctgctttccttattgtgaaggtcatcttgtcggagctactctccaagggcgcatttgggtatctgcttcctatcgtgtctttcgtacttgcttggctggagacctggtttttggactttaaggtgttacctcaggaagcagaggaagagaggtggtatctggccgcgcaggtcgcagttgcccgaggaccacttctgttctccggagccctctccgaaggacaattctactctccaccggagtcattcgctggcagcgataacgaaagcgatgaggaggtggctggaaagaagagctttagtgctcaagagcgcgagtacattaggcagggcaaggaagctaccgccgtggtggaccagatactggcccaggaggaaaactggaaatttgagaagaataacgaatacggtgacactgtgtacacaatcgaagttcccttccatgggaagacttttattctgaaaacttttctgccttgtccggcagaactggtgtatcaggaggtcattcttcagccggaaagaatggtgctttggaacaagactgtgaccgcctgtcaaatcctccagcgggttgaagacaatacactgatctcctatgatgtgagtgccggcgcggccggcggtgtcgtcagtcctagggactttgtgaacgttcgtaggatcgaacgcaggagagaccgctacctgtcaagcgggattgcgacaagtcactctgcaaaacccccaacccacaaatacgtacgaggcgagaatggcccagggggcttcatcgtgctcaagtccgcttctaatccacgagtatgcaccttcgtctggattctcaacaccgacctaaaagggcgcctgccgaggtacctcattcaccagtctctcgctgccacgatgttcgagttcgcttttcatcttcgccagcgaatctccgagctgggcgcaagggcatag

SEQ ID NO: 136305 - DNA, 1284 bp, Artificial Sequence
  Description of Artificial Sequence: Synthetic coding sequence
atgagcaaattgcctcgggagctgactcgtgaccttgaacgctcactgccagccgtggcctctttggggtcctcgctgagccactcgcagtctctaagcagtcacctgctgccccctccggaaaagcgcagagccatttccgacgttagaagaacattctgtctgtttgtgacttttgatctcctctttatcagtctgctgtggatcatcgaattaaatacaaataccggtatccggaaaaatctcgagcaagagattatacaatataactttaaaaccagtttttttgatatctttgttctcgcctttttccggttctcaggcctgcttctgggatacgctgtgctgcggcttaggcactggtgggtcatagctctgctctctaaaggggcctttggataccttttgccaatcgtgagcttcgttctggcctggcttgaaacctggttcctggactttaaggtgcttccccaggaagcggaagaggagagatggtaccttgcggcccaggttgctgtcgctagggggccccttctgttttctggggctttgagtgaagggcaattctattcaccaccagaatcatttgccggttcagataatgaatcggatgaggaagtcgcaggtaaaaaaagtttctccgcccaggaacgagaatacattaggcagggaaaggaagccaccgctgtggttgatcaaatcctggcccaagaggaaaactggaagttcgagaaaaataacgagtacggagacactgtctacacgatcgaggtgccctttcacggtaagacgtttatcctgaagactttcctgccttgcccagctgagctggtgtaccaggaagtcattctccagccagagagaatggtgttgtggaataaaaccgtaacggcgtgccaaatcctgcagcgggtggaggacaacactcttatctcctacgacgtgtcagctggtgcagccggcggcgtggtctctcccagggacttcgtgaatgtccggcgtattgagcggagacgcgaccggtacctgtcatccggaatcgccacttcccactccgcaaagccacccacacataagtatgttagaggcgaaaatggcccgggtggattcatcgtgttgaagtccgcctctaatcctcgcgtttgcactttcgtgtggatcctcaacactgacctaaagggccgcctgccccggtatttgattcaccaatccctggcagcaaccatgtttgagtttgcgttccacttgaggcagcgcattagcgagctgggggccagggcatag

SEQ ID NO: 136306 - DNA, 591 bp, Artificial Sequence
  Description of Artificial Sequence: Synthetic coding sequence
atgagcaaacttccccgggaactaactcgcgatcttgagcggtcgctgcctgccgtggccagcctgggtagttcactgtcccattcccagtccctgtcctcccatctcttaccaccgcccgaaaagcggcgagcgatcagcgatgtccgaaggacattctgtctgttcgtgactttcgacctactcttcatctccctcctctggattattgaactaaacaccaatacaggaattaggaaaaatttggaacaagagataatccagtataacttcaagacatccttcttcgacatattcgtcctggctttctttcggttttccggcctgcttctgggttatgccgtgttgaggctgcgccactggtgggtaattgccgtgacaacactggtttcctctgcattcttgattgttaaagtcatcttgtcagaactattaagcaagggggcttttggctatctactgccgattgtcagctttgtcctagcatggttagaaacttggttcctcgactttaaagtcctgccacaggaggccgaggaagagcgttggtacctcgctgcccaggtagctgtcgctagagggccactgtag

SEQ ID NO: 136307 - DNA, 1338 bp, Artificial Sequence
  Description of Artificial Sequence: Synthetic coding sequence
atgagtaagctacctcgtgagctcactcgggacctggagcggagcctgccagctgtggcaagcctgggttcttcgctttcacactcccagtccctgtcctcacatctgctgccgccacccgaaaagcggcgtgcaatttctgatgttcggcggactttttgcttgttcgtcaccttcgacttgttgttcattagccttctgtggatcatcgagttaaatactaatacaggaatcaggaagaatcttgaacaggagattattcagtataactttaagacatccttttttgatatttttgttctggctttcttccggttcagcgggctcttattaggttatgcagtactccggctgcgccattggtcacggagatggtgtcccgtgcactcttctctatctcgatcgagcagtcttagttgctccgctaaagggcatctggccacttgctcaccttcttcactgctttcatctcctggttggaggccaggctccctgactagcaaatcttaccctcgaaagctaaagcgtagcgacagcgctccccctgggtatcttgcagcgcaggtggcagtagcccgcggccccttgctgttttcaggggctctgtcagagggacaattctacagccctccagagtctttcgcgggttccgataacgaatctgatgaggaagttgccggcaaaaagagtttttctgctcaggaaagggaatacatcaggcaggggaaagaagccactgccgttgtcgatcagattctcgcccaggaggaaaactggaagtttgagaaaaacaatgagtatggtgatacagtgtacaccattgaagtgccttttcatggcaaaaccttcattttgaaaacatttcttccctgcccagcggagttggtgtatcaggaggtcatactccagccggagcgtatggtgctgtggaacaaaaccgtcacagcttgccaaatcctacaacgagtcgaagacaatacacttatttcctatgacgtgtctgctggggccgcgggtggcgttgttagccccagggactttgtcaacgtacgcagaattgaaaggcgacgcgaccgctatctgtccagcggcatagccaccagtcattcagctaaacctccaactcataaatatgtaagaggagaaaacggacctggaggttttattgttctgaaatcagctagcaacccgagagtctgcacctttgtgtggattttgaacactgatcttaaaggtcgactgcctaggtatctcatccatcagtcgttggccgctacaatgtttgaatttgcctttcacctaagacaacggatttccgagctcggagcgcgcgcttag

SEQ ID NO: 136308 - DNA, 618 bp, Artificial Sequence
  Description of Artificial Sequence: Synthetic coding sequence
atggaaggcttgagtgacgtggcaagcttcgctactaagttgaagaacactcttatccagtatcatagtattgaagaagacaaatggagggtggcgaaaaagaccaaggacgtgacagtctggcggaaaccctccgaagaattcaacggctacctgtacaaggctcagggtgtgatagatgatctggtgtacagtataattgaccacatcagacctggaccctgccggctcgactgggattccctcatgacttcactggacattctagaaaacttcgaggaaaactgctgcgtgatgaggtacaccaccgctggacagctatggaatatcatttcccctagagagttcgtggacttctcctataccgttggctacaaagagggactgctgagttgtggtatatccctggactgggatgagaagcgccctgaattcgttcggggttataatcatccgtgcggctggttctgtgtgcctttgaaagataatccgaaccagagcctgctgacaggatatatccagaccgatcttcgggggatgatccctcagtcggcagtagatacagccatggcctctacgttgacaaacttttacggggatctaaggaaagcactgtag

SEQ ID NO: 136309 - DNA, 576 bp, Artificial Sequence
  Description of Artificial Sequence: Synthetic coding sequence
atggaggggctgtcagatgtcgcgagctttgcaactaaactgaaaaatacactcatccagtaccacagcattgaggaggacaagtggagagttgccaaaaagacaaaggacgttaccgtctggcggaaaccttctgaggaatttaacggctatttgtacaaggctcagggcgttattgacgacctcgtgtactcaataatagaccacatcagacctgggccttgccggctggattgggattcgcttatgaccagtctggatattctagagaatttcgaggaaaactgttgtgtcatgaggtataccaccgctgggcagctttggaatataattagtcctcgcgagttcgtggatttcagctacaccgttggctacaaagaggggctcctcagctgtggaatttccctcgattgggacgagaaaagacctgagtttgtgcgggggtataaccacccttgcgggtggttctgtgtgcctcttaaagataacccaaatcagtcactgctgaccggctatatccagacggatctgagaggaatgattccccagtccgctgtggataccgctatggcttag

SEQ ID NO: 136310 - DNA, 642 bp, Artificial Sequence
  Description of Artificial Sequence: Synthetic coding sequence
atggatccagctctggccgcccagatgtctgaggccgtcgcggaaaaaatgcttcagtataggcgcgataccgccggatggaagatctgtcgcgagggtaacggcgtgtccgtttcttggcgaccgtctgtcgagttccctggtaacctgtatcggggtgaaggtatcgtctacgggacactggaggaggtgtgggactgcgtcaaacctgccgtaggagggctccgggtcaagtgggacgagaacgtgaccgggttcgagattattcagagtatcaccgacaccctatgtgtgtcccggaccagtaccccatctgccgctatgaagctgatatcgcctcgagattttgtagatctggtcctcgtaaaaaggtatgaagatgggaccatatcctcgaatgcgacacatgtggagcaccctctttgcccccctaaacctggctttgtgagaggcttcaatcatccctgtggatgtttctgtgaacctctcccaggtgagccaacaaagacaaatctcgtcaccttcttccacaccgatctgtcaggttacttgcctcagaacgtggtggacagcttcttccctcgttcgatgacccgcttttacgctaatttacagaaagctgtgaagcaattccacgagtag

SEQ ID NO: 136311 - DNA, 663 bp, Artificial Sequence
  Description of Artificial Sequence: Synthetic coding sequence
atggatttcaaagcaatagcccaacagacagcacaggaagttctcgggtataatagggatacttccgggtggaaagtggtcaagacctctaaaaagatcacggtgtcaagcaaggcaagccgtaagttccacggcaacttgtatagggttgagggtattatccccgagagccccgcaaaattgtcagacttcttatatcaaaccggcgataggattacctgggataagagcctccaggtgtacaatatggttcaccgcatcgattctgacacctttatctgtcacacaatcacgcaatccttcgccgtcggcagtatctcacctcgggacttcatagacctggtctatattaagcgttacgaagggaacatgaacatcattagctccaagtccgttgattttcctgaatacccaccctcttccaattacatacgcggttataaccatccatgtggcttcgtttgttctccgatggaggaaaaccccgcatactcaaagctagtgatgttcgtccaaacagagatgcgcggaaaattatctccctctatcatcgagaaaaccatgccaagcaacctggttaacttcatcctgaatgccaaggacggaatcaaggcccaccggacaccatcccggagaggcttccatcataattcccactcctag

SEQ ID NO: 136312 - DNA, 3072 bp, Artificial Sequence
  Description of Artificial Sequence: Synthetic coding sequence
atgaccctgaacaattgtgcctccatgaaactagaggttcattttcagtctaaacaaaacgaggactctgaggaagaggaacaatgtaccataagttcccactgggccttccagcaggaatccaaatgctggagcccaatgggaagcagcgatctgctggcacctccatctcctgggctccctgccacctctagctgtgaatcagtccttaccgagctgagcgccacatcactgcccgtcataaccgtcagcttgcccccagaacccgccgatctgcctctcccgggacgggctccgtccagttctgatcgtccactgcttagcccaactcaaggccaagagggaccgcaggacaaggccaagaaacgccacagaaaccggtcgttcttgaagcacctggaatcgctacgaaggaaggaaaaatccggttcccagcaggccgagcctaagcattctccagccacatcggaaaaggtgtccaaagcctccagctttaggtcttgtcggggttttttgtccgcagggttctaccgggcgaagaactgggccgctacatccgccggagggagcggggcgaacaccaggaaggcatgggaggcatggcccgtcgcttcatttcgccacccacaatggacccaccgtggcgactgcctggtgcacgttccaggcgatcataagcctggtaccttcccccgctctctgagcatcgagtccctttgtcccgaggacggacacaggctcgctgattggcagcccggcaggcggtggggttgtgagggccggaggggctcgtgcggcagcaccggaagccatgccagcacttacgataacttaccagagctgtatcctgccgagccggtgatggtgggagctgaggcagaagacgaagacgacgaagaatcaggcggctcctacgcccatctggatgatatcctccaacacgtgtggggtttacagcagcgggtcgagctttggtctcgtgccatgtaccctgatctgggccctggagatgaagaagaagaagaagccaccagctctgtagagattgctacagtggaggtgaagtgccaggctgaggcactctcacagatggaagtgccagcccacggcgaaagccccgcttgggcgcaggcagaagtacagccagctgtgcttgctccagctcaagcccccgcggaagccgaaccagtcgcacaggaggaggcagaagcccccgctcccgctcccgcccctgccccagctcaagactcagagcaggaagctcactcaggtggtgagcccaccttcgcatcgagcctgagcgtggaagaggggcatagtatctccgataccgtcgcctcttccagcgagcttgatagttccgggaacagcatgaacgaggcagaagccgctggacctctggccggtctccaagcctcaatgccccgggagagacgggactcaggcgtcggagcttccttgacacgcccatgtaggaagctcagatggcattcctttcagaattctcatcgtcccagcctgaactctgagtcgttagagataaataggcagttcgccggtcagatcaacctactgcacaaggggtcacttctcaggctcaccgccttcatggagaaatacacagtgccccataagcagggatgggtgtggagcatgccaaagtttatgaggagaaacaagacaccagattaccgcgggcagcacgtgtttggcgtacccccgttgattcatgtgcagagaactggtcagcccctgccacagtcaatccaacaggctatgcgctacctacggagccagtgcctcgatcaggtgggaattttccgaaagagtggagtcaaatccagaatccaaaacctcagacagatgaatgagaccagtcccgacaatgtgtgctatgagggacaatctgcttacgacgtggcagatctgttgaagcaatatttcagggacctccccgagcccattttcacctccaagctgacaactacatttttacagatataccagctactgcccaaggatcaatggctggcagctgcccaggcagccacgcttctgttgccggacgagaatcgagaagtgctgcagacactgctgtacttccttagcgatattgcctctgccgaggaaaatcagatgactgccgggaatctggctgtgtgtctggctccctccatttttcatctaaatgtcagtaagaaggacagtccaagtccccgtattaagtccaagcgctctctcattggccggcctggcccgagagatctaagcgacaatatggccgccacgcaaggtttgtcgcatatgatttctgattgcaaaaaattattccaggtgcctcaggatatggtgcttcagctttgctctagctacagcgccgccgaactgagcccccccggaccagctttagcagaactgagacaggctcaggccgctggcgtgtcgctctctctgtatatggaagagaacatccaggacctgcttagagatgcagcagagaggttcaaaggatggatgagtgttcctggaccccagcataccgagctggcctgccgtaaggccccggacggccatccattgcgattgtggaaagcgagtactgaggtcgccgctccacctgccgttgttcttcaccgcgttttaagggagcgggctctttgggacgaagatctgctgcgtgcgcaggtgttagaagcactgatgcccggggtcgaattatatcactatgtaactgatagcatggccccgcacccctgcagagattttgtggtgctgcggatgtggaggtcggacctgccccggggaggctgcctgttagtgagccaaagcctggatcccgagcaaccagtgccggaatctggggtgcgagccttgatgctgaccagccaatacctcatggagccatgcggtttggggagatcacgcctgacacatatatgcagagctgacctccgcggtcgatcccccgattggtataacaaggtgttcggacacctttgtgcaatggaggtggccaagatccgggactcattccctacacttcaggcggcaggacctgaaactaaattgtag

SEQ ID NO: 136313 - DNA, 3072 bp, Artificial Sequence
  Description of Artificial Sequence: Synthetic coding sequence
atgactctgaataactgtgcctctatgaagctggaagtccacttccagtccaagcagaacgaagatagtgaggaagaagagcagtgcacgatcagctcccactgggcatttcagcaagaaagcaaatgctggagcccaatgggtagttctgatctcttggcgcccccatcacctggcctgcctgcaacttccagctgcgagtccgttctgaccgaactgtccgcgaccagcctgcccgtgatcacagtgagcctgccacccgaacctgctgatctccccctgccaggaagagctccgtcttccagtgaccgacctttactcagccccactcagggccaggagggtccgcaggacaaagctaagaagagacacagaaataggtccttcctgaagcacctggaaagtttgaggcgaaaggagaagtctggcagtcagcaggcagaacccaagcactctcctgcgactagtgagaaggtctctaaggctagctcctttcggagctgccgggggtttttatcagccggattttaccgcgccaagaattgggccgcaacctcagcaggtgggtccggcgccaatacaagaaaagcttgggaagcgtggccggtcgccagcttcagacacccacagtggacgcacagaggcgattgcttggtccacgttcctggagaccacaagcccgggactttccctaggtcactgagcatcgaaagcctgtgcccagaggatggccaccgactggccgactggcagccaggaaggaggtggggatgcgagggaaggagagggagctgcggctccaccggtagtcatgcttccacctatgacaacctgcctgaactgtaccctgccgagcccgtgatggtaggggccgaggcagaggatgaggatgacgaggagtccggtgggtcatatgcccacctggacgatattttgcagcacgtctggggtctgcagcagcgcgtggaactttggtcccgcgcaatgtaccctgatctgggacccggggatgaagaggaagaggaagcaacctcgagcgtcgaaatcgctacagtagaggtcaagtgtcaggccgaggccctaagccaaatggaagtacctgctcacggcgagtcacctgcatgggctcaggccgaggtccaacctgcagtgctggctccagcacaagcccccgcagaggcggaaccggttgcccaagaggaggcggaagcccccgcgcctgcgcctgcgccagcaccagctcaggactccgagcaggaggcccactcgggcggagagcccacgttcgcctccagcttgtctgttgaggagggtcattcgatctctgatacggtcgcatcgagctccgaactggactcctctggaaattcgatgaatgaggccgaagccgcaggacccctggctggcctccaggcatccatgcctagagaacgaagagattcaggagtgggcgcctccttgaccagaccttgccgcaagctccggtggcattccttccagaattctcatagaccgagcttgaactccgagtctctggagattaataggcagtttgctggccagatcaatcttcttcataaggggtcattactgcgcctaactgcctttatggagaagtatactgtgccgcacaagcaggggtgggtctggtcaatgcccaaattcatgcggaggaacaagacaccagactaccggggacagcacgtgtttggggtgccaccactgatacatgtgcagcgtaccggacagcctcttcctcagtcaatccagcaggctatgagatatttacgtagccagtgcttggatcaggtcgggatcttcaggaagtctggagtgaagagtcgcatccagaatcttaggcagatgaacgagacttctcccgacaatgtctgctatgagggtcagtcagcctatgatgtcgcagatctgctcaaacagtacttccgggacctgccagaaccaatattcactagcaaactgactactaccttcctgcagatataccagctgctccccaaagaccagtggctggcagccgcccaagctgcaaccctattgctgcctgatgaaaaccgtgaagtgttacagactctgctgtactttctgtccgatatcgcaagtgccgaggaaaaccagatgactgccggaaaccttgccgtttgccttgcgccttcaattttccatctaaacgtctccaaaaaagactccccctctccgcgcattaagagtaagcgatcgctgattggtagacccggtccacgggacctgtcggataatatggcagctacccagggtctttctcacatgatatccgattgtaagaagttgttccaggtgccacaggacatggtgctgcagttgtgctcctcctatagtgccgccgagctgagcccccccggccccgcattggctgagctacgccaggcccaggctgcaggcgtctccctttccctttacatggaggagaacatccaggacctgcttagggatgccgctgaaaggtttaaaggatggatgtccgtccccggacctcaacataccgagctggcctgccgaaaggccccagatggccacccattacggctttggaaggcctccactgaagtagctgctcctcctgcagtagtgcttcacagagtgctgcgagagcgagctctgtgggacgaagatctcttgagggcgcaagtattggaagcattaatgcctggagtcgagctataccactacgtgacagacagtatggctccccacccctgtcgggacttcgtagtgctgcgcatgtggcgatccgatctgcctcgcgggggctgcctactggtcagccagtccctggacccagaacagcccgtgcctgaatcaggggtgagagccttaatgctgacgtcccagtacttaatggaaccatgcggcctcggtcgctctcgactgacccacatctgcagagccgacctgcgcggccgctcacctgactggtataacaaagtgttcgggcatctctgcgcgatggaagtcgccaagatcagagacagcttccccacgttgcaggctgctgggcctgagacaaagctgtag

SEQ ID NO: 136314 - DNA, 3312 bp, Artificial Sequence
  Description of Artificial Sequence: Synthetic coding sequence
atgcccctgctcgacgtgttttggagttgcttcaggaaggtgaagtgtttccctcttctgcaggtgaagaaaaacgccgaggcagaggcaaagcgcgcctgtgagtggctacaggctaccggcttcccacagtatgtgcagctgtttgaggagggttcctttccccttgacatcggcagcgtgaaaaagaatcacgggttcctagatgaggactctctgggtgcactttgtaggcgactgatgacactgaacaactgtgcgagcatgaagttagaggttcattttcagtctaagcagaacgaggatagtgaagaggaggaacaatgcaccatttcatcccactgggccttccaacaagaatcaaagtgctggtcccccatggggtccagtgacctcttagcccccccttccccaggacttccagccacctcaagttgcgagagcgttctaactgagctcagcgccacaagcctacccgttatcactgtctccctgcctccggagcctgcggacctgccactgccagggcgggcgccatcgagtagcgatcggcccctcctgtcgcctacccaaggacaggagggaccccaggataaagcaaaaaagaggcatagaaataggtcatttcttaaacacctggagtctctaagacggaaagagaaaagtgggagccagcaagccgaaccgaagcactccccagcaactagtgagaaagtttcaaaggcctcatccttcagatcttgccggggcttcctttctgcgggcttttatcgggcaaagaattgggccgcaactagcgctggaggcagcggcgctaatacaagaaaagcgtgggaagcctggcctgtggcttcttttaggcatcctcagtggacccatcgcggcgactgtctcgtgcacgttccgggcgaccataagcccggaacatttccgaggtcgttgtccatcgagtccctctgtcctgaagacggacatcggctggctgactggcaacccggtaggcggtggggctgcgaagggaggagaggctcctgcggatccacaggcagtcacgcaagcacttatgataatctcccagagctttaccctgcggaacctgtcatggttggagctgaggccgaagacgaagatgatgaagaaagcggagggagctacgctcatctggatgatatactgcagcacgtgtggggactgcagcagcgggttgagttgtggagccgtgccatgtaccctgacctgggtccaggagacgaggaagaggaagaggccacctcctccgtggagatcgcaactgtagaagtgaaatgtcaggccgaggccctctcacaaatggaagtgccagctcatggggagtccccggcctgggctcaggccgaagtccagcctgcagtcctggctcctgcgcaggccccggccgaggctgagccagtggcacaggaagaggccgaagcccccgcacccgcccctgcaccagcccctgcccaggattctgaacaggaggcacactccggcggcgaacccacgtttgcgtccagtctgagcgtcgaggaggggcacagtatatctgacacagttgccagctcttctgaacttgatagttctggcaatagcatgaacgaggctgaggccgcaggccctctagccggactgcaggcctcaatgccacgggagaggagggattccggagtcggcgcttcacttactagaccatgtaggaaattgaggtggcactcctttcagaatagtcaccgcccctcccttaacagtgaaagccttgagatcaatcgtcagtttgcgggccaaattaacttgctccacaagggtagtttgctgcgcctgaccgccttcatggaaaagtatactgtgccacacaagcagggctgggtttggtccatgccaaagtttatgagacgcaacaaaacgccagattatcgcggacaacatgtgtttggtgtgccacccttgatccatgtgcaaaggacaggtcagcctcttcctcagtcaatacaacaggcaatgcgatatctgcgttcccagtgcttggatcaggttggcatcttcaggaaatcaggcgtgaagtctaggatacagaatttgcggcagatgaacgagaccagcccagataacgtctgctatgagggccagagcgcatatgatgtcgccgacctgctcaaacagtactttagggatctacccgagcccatctttacctccaagctgactaccacttttttgcaaatttatcagctgctccccaaggaccagtggttggctgccgcacaggccgccacactcctccttcctgacgaaaatagagaggtgctccagacactcctttatttcctgtcagacatagcttccgccgaagaaaatcaaatgaccgccgggaacctggcagtatgtctggctccctccatctttcatctcaatgtgtcgaagaaggactccccctcccctagaatcaagagcaaaagatcactgatcggacgacccggacctagagacctgtctgacaacatggcagccacccagggactcagtcacatgatctccgattgcaaaaaactattccaagtcccacaggacatggtcctgcagctgtgttcatcctattcagccgccgaactttccccacctggacccgctctcgccgagctccggcaagctcaggccgcaggggtttccttgagcctgtacatggaagaaaacattcaggatctcctacgagatgcggctgaaagattcaaagggtggatgagtgttccgggcccccaacatacagaactggcctgtagaaaggcgccagatggccatcctttgcgactctggaaggcctccactgaggttgctgcacctcccgcagtggttctgcacagagtgctcagggaaagagcgctctgggacgaggatttattgagggctcaggtgctggaagctcttatgccaggagtcgagttgtaccattatgtgaccgactctatggcgcctcatccttgtagggactttgtggtgctccggatgtggagatcagatctacccaggggcgggtgccttttagtttcccagtcactggatcctgagcagccagttcctgagtcaggtgtacgggcccttatgttaactagtcaatatttgatggaaccctgcggattaggaaggagtcgattgacacatatctgcagagctgacctgcgcggcagatctcctgattggtataacaaggtatttgggcatctatgcgccatggaagttgctaaaatccgagactccttccctacgttgcaagcagcgggccccgagaccaagctctag

SEQ ID NO: 136315 - DNA, 159 bp, Artificial Sequence
  Description of Artificial Sequence: Synthetic coding sequence
atgccattacttgacgtattctggtcctgcttccgcaaagtcaagtgctttcccctcttgcaggtgaagaagaacgccgaggctgaagctaaaagagcctgcgagtggcttcaggcaacaggcttccctcagtacgtccaattattcgaaggggggtag

SEQ ID NO: 136316 - DNA, 189 bp, Artificial Sequence
  Description of Artificial Sequence: Synthetic coding sequence
atgaaattcctagtgttcgcattcatcctcgccctgatggttagcatgataggagcagacagcagtgaagaaaaattcctccggaggatcggtaggtttggctatggttatggaccttaccagcctgtccccgagcagccattgtaccctcagccctatcagccccagtatcaacagtatacattctag

SEQ ID NO: 136317 - DNA, 159 bp, Artificial Sequence
  Description of Artificial Sequence: Synthetic coding sequence
atgaagtttctggtgttcgcgtttatcttagcgttgatggttagtatgattggggcagacagctccgaagaatacgggtatgggccttaccagccagtgccagaacagccactgtacccacaaccgtatcaaccccaatatcaacagtatacattctag

SEQ ID NO: 136318 - DNA, 843 bp, Artificial Sequence
  Description of Artificial Sequence: Synthetic coding sequence
atgagatggttcctgccctggacactggctgctgtaacagcagcagccgccagtaccgtgttggcaacagcgttatcccctgctccaacgacaatggacttcactccagccccccttgaggacacatccagccgtccacagttttgtaaatggccatgtgagtgccctccatctccccctcgttgtcctctgggagtttctctgattactgacgggtgcgagtgctgtaaaatgtgcgcccagcaacttggcgataattgtactgaagccgcaatctgcgatcctcatcgggggttgtattgcgactactccggagacaggccgcgatacgccattggggtgtgtgcccatgcggtcggtgaggtagaagcttggcatcggaactgtatagcatacacctcgccttggtccccttgtagtacatcttgtggattaggcgtctccactcgcatatcgaacgtcaacgcccaatgctggcctgaacaggaaagcaggctgtgcaacttgcggccttgtgatgtggacattcacacactcattaaagccggcaagaagtgtttagctgtatatcagcctgaggcctcgatgaacttcactcttgcagggtgcatttcgacacggtcataccagcccaagtattgcggggtgtgcatggacaaccggtgttgtatcccttataaaagcaaaacaattgatgtgtcttttcagtgtcccgatggcctgggttttagtaggcaggtcttatggattaacgcctgcttctgtaacctgtcttgccgtaaccccaatgatattttcgcagacttagagtcctaccctgacttctcagagatcgccaattag

SEQ ID NO: 136319 - DNA, 507 bp, Artificial Sequence
  Description of Artificial Sequence: Synthetic coding sequence
atggccaaaacagccatggcgtacaaagaaaagatgaaagaactctccatgttgtcccttatctgctcttgcttttaccccgagcctagaaacatcaatatctacacatatgacgatatggaggtgaagcaaataaataaacgggcatccggccaagctttcgagctcatcctgaagccaccttctcccaaaaaaaaagatttatcgctggaagaaatccaaaagaagctggaagctgcagaggaaaggagaaagagtcaagaggcccaagtcctgaagcagctagctgagaaaagggagcatgagagggaggtgctgcaaaaggccttggaggagaataacaacttctcaaagatggctgaagaaaaactgattctcaaaatggagcagatcaaagaaaatagagaggctaaccttgcagcaataatagagaggctgcaggaaaaagagaggcacgctgccgaggttcggagaaacaaggagctgcaagtcgaattgtcaggctag

SEQ ID NO: 136320 - DNA, 564 bp, Artificial Sequence
  Description of Artificial Sequence: Synthetic coding sequence
atggccaaaaccgccatggcctacaaggaaaaaatgaaagagctgagcatgctatccctgatttgtagctgtttctatccggaaccccgaaatataaatatttacacttacgatgatatggaggtcaagcaaatcaataagcgggcgagcggtcaagcttttgaactcatcctgaagccgccatccccaatatccgaggccccaaggactcttgcgagtcccaagaagaaggacttgagtcttgaagagatccagaagaagctcgaggccgctgaagagcggagaaagtctcaggaggcccaggtcctgaaacagctggccgaaaaaagggaacatgagcgagaggttctccagaaagcactggaggaaaacaacaatttttcaaagatggccgaagaaaagcttatcctaaagatggaacaaatcaaagagaaccgagaggctaatttagccgcaatcattgaacgcttacaggagaagctggtcaagtttatctctagtgagctgaaggagagtattgagtcgcagttcctcgaactccagagggagggggagaaacagtag

SEQ ID NO: 136321 - DNA, 543 bp, Artificial Sequence
  Description of Artificial Sequence: Synthetic coding sequence
atggcatctaccatatcggcctataaggaaaagatgaaggagctgtcagtcctgtccctgatctgttcttgcttctacacccaacctcatccaaacaccgtgtaccaatacggagatatggaggtgaagcagctcgataagcgcgctagtggccagtccttcgaagtgattctgaagtccccatctgacttgtctcccgagtcacctatgctgtctagccctcctaagaaaaaggacaccagcttagaggagttgcagaagagactagaggcagccgaggagcggaggaagactcaggaggcccaggtgctcaaacagctcgctgaacggcgcgagcatgaaagagaggtgctccacaaagctctagaagaaaataataatttctcaaggcaggcagaggagaaacttaactataaaatggaattgtcaaaagaaataagagaggctcacttggccgccctgcgcgagaggttacgagaaaaagagctccacgcagccgaggtacggaggaacaaggagcaaagagaggagatgtcaggctag

SEQ ID NO: 136322 - DNA, 510 bp, Artificial Sequence
  Description of Artificial Sequence: Synthetic coding sequence
atgaaagagctgagcgttctgtcccttatctgcagctgtttttacactcagccacatccgaatacagtttaccaatatggtgacatggaagtcaagcagcttgacaagagagctagcggccagtccttcgaggtcattctgaagagtcccagcgatctctcacccgagtctcctatgctatcatctcctcccaaaaagaaagatacttcgctggaagagcttcagaagcggttggaggccgcagaagagaggcggaaaacacaggaggcacaggttttgaagcagctggccgagagacgcgagcacgagcgagaggtgctgcataaggctctcgaggagaataacaatttctctcgccaggcggaagagaaattaaattacaaaatggaattgagtaaggaaatccgtgaggcccacctggccgcgctccgcgagcgtctgagagagaaagaactgcacgcagccgaagtgcgtaggaataaggagcaacgggaagaaatgtctggttag

SEQ ID NO: 136323 - DNA, 1422 bp, Artificial Sequence
  Description of Artificial Sequence: Synthetic coding sequence
atgttcagtgtccaattgtctcttggcgaacagacatgggaaagcgaggggtcatcaatcaagaaggcccaacaggcagtcgcgaataaagctcttacagagtcaactctcccaaaacccgtgcagaaaccaccgaaatcaaatgtcaacaataatcccggctcaatcacacccacagtggagctgaacgggctcgctatgaagcgtggtgaacctgccatttatcggcctcttgatcctaagccattccccaactatagggcaaattacaatttcagagggatgtacaaccagcgctaccattgtcccgtccccaaaatcttctacgtgcagctgacagttggcaacaatgaattttttggcgagggaaaaaccaggcaagccgccagacacaatgctgctatgaaggccttgcaggcactgcagaatgaaccaatcccagaaaggagcccgcaaaacggcgagtctggtaaggatgtggatgacgacaaggacgctaacaaatcagagatctccctggtgtttgaaattgccctgaaaaggaatatgccggtgagttttgaagtcatcaaggaatccggccccccccatatgaagagctttgtcacacgcgtcagcgttggtgagtttagtgccgagggggaaggaaacagcaaaaaactctcaaaaaaacgagcagcaactaccgtcctacaggaattgaaaaagctgccccctctgcccgttgtcgaaaaacccaaactttttttcaaaaaaaggcccaaaacaatcgttaaggctgggcctgaatacggccaggggatgaaccctatttcacggttggcccagattcagcaggctaaaaaggaaaaggagcccgactatgtactgctgtcagagcgcggaatgcctcgtcggagggagtttgtcatgcaagttaaggtcgggaatgaagtcgctaccggtaccggaccaaacaaaaagatcgccaaaaagaacgccgccgaggccatgctgctgcagcttgggtataaagcctctacgaacctgcaggatcagcttgagaagactggcgagaataagggatggtcagggcctaaacccggcttccccgagccaacaaacaacacacccaagggaatcctacacttgagccccgatgtatatcaagaaatggaagcgtctagacataaagtgattagcggcacaacactcgggtacttgtctcccaaggacatgaatcagccttccagttcctttttctctattagtcccacttctaattcctccgccaccattgctcgtgagctcttaatgaatggcaccagctcaacggcggaagccatcggccttaaagggagcagcccgactcccccttgctcacccgtccagcctagcaaacaactcgaatatcttgctcgcattcagggctttcaggtttag

SEQ ID NO: 136324 - DNA, 1515 bp, Artificial Sequence
  Description of Artificial Sequence: Synthetic coding sequence
atgaaacggggtgagcctgccatttaccgccctctggacccaaagccattcccaaactatagagcaaactacaacttccgcggaatgtataaccaaaggtatcactgccccgtacccaaaatattctacgtgcagctgacagtgggaaacaacgaattcttcggggagggcaagaccaggcaggcggcgagacataacgctgccatgaaggctcttcaagcgctgcagaatgagccaatccctgagcgaagcccacagaacggcgaatccggtaaggatgtcgatgatgataaagatgctaataagagcgagatctcactcgtattcgaaattgctctcaagagaaatatgcctgtgtcctttgaggtgataaaggaatccggccccccccacatgaagtccttcgtgaccagagtctcagtcggggaattctctgccgagggagaaggcaactctaaaaagctctccaagaagagggctgccaccactgtgctgcaggagctcaagaaactgccccccctcccggtggtagaaaaacccaagctatttttcaagaaacggcctaagactatagtgaaagccggcccggaatacggccaagggatgaatcctatttcaagactggcgcaaattcagcaggccaagaaagagaaggaaccagactatgtcctcctctctgagcgtggcatgcctcgccgcagagaattcgtcatgcaagtcaaggttggtaacgaggtcgcaacagggacaggtcctaataaaaagattgcaaaaaagaatgccgctgaggcaatgctactgcagctcggatataaggcctccacaaaccttcaggaccaattggaaaaaacaggggaaaataagggttggtctggtccaaaacctgggtttcctgaaccgaccaacaatacaccaaaaggcatattgcaccttagtccagatgtgtaccaggagatggaagcaagccgccacaaggtgatttctgggactaccctggggtatttgtctccgaaggacatgaaccagccctcgtcatcatttttctccatcagcccaacatccaactcttcagctactattgcccgggagttactgatgaatgggacatcttcaacggccgaggccattggccttaagggctctagccctactccaccatgctcccctgtgcagccatcaaagcagctcgagtacctcgccagaattcaggggttccaggttcattattgtgatagacagtccggcaaggagtgcgtcacttgtctaacgttggcccccgtgcagatgacattccacgccattggctccagcatcgaggctagccatgaccaggcagcactgtcagcccttaaacagttcagcgaacaggggctggaccccatcgatggcgccatgaatatcgagaagggtagccttgaaaagcaggcgaagcacttgcgggagaaggctgacaataaccaggccccacctggcagtatagctcaagattgcaaaaaaagtaactctgccgtctag

SEQ ID NO: 136325 - DNA, 1197 bp, Artificial Sequence
  Description of Artificial Sequence: Synthetic coding sequence
atgaaggccctgcaggctctgcagaacgaacctattcccgaaaggtcaccccagaatggcgaaagtggaaaggatgtggatgacgataaggatgcaaacaaatcagagatatcgctggtgttcgaaattgccttgaaacggaacatgcctgtgagcttcgaggtcatcaaagagtctggacctccacatatgaagagctttgttacacgggtaagcgttggggaattcagtgccgagggagaagggaacagcaagaaattaagcaaaaagcgcgcggcaaccactgttctccaggagctgaagaagcttcccccattgcctgtggttgagaagcccaaactctttttcaagaaaaggcccaagacaatagtaaaagccgggccagaatatgggcaagggatgaatcctatctctcggctggctcaaattcagcaagccaagaaggagaaggaacccgactacgtgctcctgtctgaaagagggatgcctcggagacgggaattcgtgatgcaggttaaggtgggcaacgaggttgctactggcactggcccgaataagaagatcgcaaagaagaatgctgctgaggcaatgctgctccaactgggctacaaggccagcactaatctacaggaccagctggaaaagaccggagagaacaagggatggtccgggcccaagccaggcttccctgagccaaccaataacacgccaaaaggcatactgcacctgagtccggacgtctatcaggagatggaggcaagtcggcataaagtcattagtggcaccacactggggtacctgtcccccaaagacatgaatcagccctcatcttccttcttctcaattagcccaactagtaattcaagtgccaccatcgctagagaattgttaatgaatgggacaagttcaacagccgaggctatagggttgaagggaagcagcccaactcctccctgctccccagttcagccctcaaaacaattagaatacttggctaggattcagggctttcaggctgctctctccgctctgaaacaattctcggaacagggacttgatccgattgacggggcaatgaacatcgagaagggatcccttgagaaacaggccaagcatctgagggaaaaggccgacaacaaccaggccccccccgggtctatcgctcaggattgcaagaagtctaatagtgctgtatag

SEQ ID NO: 136326 - DNA, 1440 bp, Artificial Sequence
  Description of Artificial Sequence: Synthetic coding sequence
atgttacagataaaccagatgttctccgtccagttatcactcggagagcaaacttgggagtccgaggggtcatcaattaagaaggcccagcaagctgtcgcaaacaaggcgctgaccgagagcactctcccaaaacctgtgcagaagccacctaaatcaaacgtgaacaataatcccggcagcatcactcccacggtcgagcttaacgggctcgctatgaagagaggagagcctgctatctatcgccccctagacccaaaacctttccctaattatcgcgccaattacaactttcgaggcatgtataaccagaggtaccattgcccagtcccaaagatcttttatgttcaactgacagtcggtaataatgaattcttcggcgagggcaagacaaggcaggccgcgagacacaacgccgccatgaaagccctgcaagccctgcagaatgagcctatccccgaacggagccctcagaatggggagagtgggaaggatgtggatgatgacaaggacgccaataaatctgagatttcattagtcttcgagatcgccctgaaacggaatatgccagtgagcttcgaagttatcaaggagtccggccccccgcacatgaagtccttcgtcactagagttagtgtcggggaattctcagctgaaggcgagggtaacagtaagaagctttctaagaaaagagctgctaccacagttctacaggaactgaagaagttaccccctctccccgtggttgaaaagccaaagctgttttttaaaaaacgccccaaaactattgtgaaagccggccccgagtacgggcaaggcatgaaccctattagcagactcgcccagattcagcaggctaagaaggagaaggagccggactatgtcctactgtctgagagaggaatgcctcgacgaagggaattcgtgatgcaagtgaaagttgggaatgaggtagcaactggtacggggcccaacaaaaaaatagctaaaaagaacgctgctgaagcgatgctcttacagttagggtacaaggcatccaccaatctccaggatcagcttgagaagaccggtgagaataaaggatggtccgggcctaaacctggatttccggaacccactaataatactcccaagggtatccttcacctctcacccgatgtgtaccaggagatggaagccagtcgtcacaaggttatatccggcactacacttggctacctgagcccaaaagatatgaaccagccttcttcttcctttttttcaatatcgcctacatccaactccagcgcgacaatagctcgcgagctcttgatgaacggcactagctctacagctgaagcaataggactgaagggaagcagtccaactcccccttgcagtcccgtccagccatctaagcagttggagtacctggcccgtattcagggctttcaagtgtag

SEQ ID NO: 136327 - DNA, 615 bp, Artificial Sequence
  Description of Artificial Sequence: Synthetic coding sequence
atgctgcaaattaatcagatgttcagtgtccagcttagcttaggggagcagacctgggagtcggagggaagcagcattaaaaaggcacagcaggctgtggccaataaggctttaaccgagtctaccctacccaagcctgtgcagaaaccccctaagtcaaatgtaaacaataatccaggtagcatcactccaactgtagaactgaatggactagccatgaagaggggagagccggccatttataggcccttggaccctaagccattcccgaactatagagccaactataatttccgcgggatgtacaaccagcgataccactgccccgtgcccaagatattctacgtccagctgaccgtggggaacaacgaattttttggagaaggtaaaacccggcaagccgcacggcataatgcggccatgaaggccctccaagcacttcaaaatgagcctatccccgaaaggagtccccaaaatggcgaatccggtaaggatgtagatgacgacaaggatgcaaacaagtctgagatcagcttggtttttgagattgctttaaagaggaatatgccggtgtcctttgaagtcattaaagagtcaggtcctccacatatgtag

SEQ ID NO: 136328 - DNA, 195 bp, Artificial Sequence
  Description of Artificial Sequence: Synthetic coding sequence
atgttgcagataaaccaaatgttcagcgtgcagctaagccttggtgagcagacatgggaatccgaaggctcttctatcaaaaaggcgcaacaggcggtggctaataaggctcttacagagagtacgcttccaaagccagtgcagaagcctcctaaaagcaacgtgaacaataaccccggatcaattaccccctag

SEQ ID NO: 136329 - DNA, 1440 bp, Artificial Sequence
  Description of Artificial Sequence: Synthetic coding sequence
atgctacagatcaatcagatgttctctgtgcaactctccctgggtgagcagacctgggagtctgaggggtctagcatcaaaaaggcccaacaagcagttgccaataaggccctcaccgaaagcaccttgccaaagccagtccaaaagccacccaaaagtaatgtcaataataacccggggagtatcacacctaccgtcgagctcaatggcctagccatgaagcgaggtgagcccgccatctaccgaccattagaccccaagccattcccaaattacagagctaactacaatttcagaggcatgtacaatcagagataccattgtccagtccctaaaatcttctacgtccagctcaccgtcggcaataacgaattcttcggcgagggaaaaactcgccaagctgccagacataatgcggctatgaaggcgctacaggccctccaaaatgagcctattccagagcggagcccccaaaatggtgaatcaggtaaagatgtggatgatgacaaagacgctaacaaatccgagatcagtctggtattcgaaatcgctttgaagaggaatatgcctgtgagctttgaagtaatcaaggaatccgggcctcctcacatgaaaagtttcgtgactagagtgtccgtcggcgagtttagcgccgagggagaggggaattcgaaaaagttgtccaagaaaagagccgcgaccacagtcctgcaggaactcaaaaagctcccaccactacctgtcgtggagaagccgaagctatttttcaagaaacgaccaaaaactattgtcaaagcagggcctgagtatggccagggcatgaacccgatctcccgcctagcacagattcagcaagccaagaaggagaaggaaccagattatgtgctgctgagcgagcgggggatgccgagacgccgagagttcgttatgcaggttaaagtgggcaatgaagtggccactggcacggggccaaataaaaaaatcgcaaaaaaaaatgccgctgaggctatgttgctgcagctggggtataaagcatccaccaatctccaggaccagctggaaaagactggagagaataagggatggtctggtccgaaacctgggttcccggagcctacaaataatacacccaaagggattctgcacctttctcctgacgtttaccaagaaatggaggcctcacgccacaaagtaattagcggaacgactctgggatatcttagccctaaagacatgaaccaaccctcgagttctttctttagcataagccccacttctaattcttccgcaacaattgcccgggagctgctgatgaatggtacatcatccaccgccgaggcaattgggcttaagggctcctcccccaccccgccttgctcaccagtacagccatccaagcagctagaataccttgcccgcatccagggattccaggtgtag

SEQ ID NO: 136330 - DNA, 1617 bp, Artificial Sequence
  Description of Artificial Sequence: Synthetic coding sequence
atgttgcagattaaccagatgtttagcgtgcagttaagcttaggcgaacagacctgggagtcggaaggatcctcgattaaaaaggcccaacaggccgtggcgaacaaggcactgacagagtccacccttccaaaaccagtccagaagccccccaagagcaacgttaacaataaccccggatcaatcacaccaactgtggagttgaatggcctggctatgaagcgtggggagcccgcgatctatcggccattggaccctaagcctttcccgaattaccgagctaattataatttcaggggaatgtataatcagcggtatcattgccccgttcctaaaattttctatgtgcagcttacagtaggcaataatgagttctttggcgagggaaagacacgccaggctgcacggcacaatgccgcaatgaaagccctgcaagcactgcagaatgagccaatacccgagagaagcccccagaatggtgagagcggcaaggacgtggatgatgacaaggacgccaacaaatccgaaatcagcctagtgtttgaaatcgccctgaagcggaacatgcctgtgtccttcgaggtaattaaggaaagtggtcctccccatatgaagtcctttgtgacacgagtgtctgtgggagagttcagtgccgagggcgagggaaattcgaaaaaactctccaaaaaaagagctgccaccactgtcttgcaagaattgaagaaactgcctccgctgccggtcgtagagaaacctaagctgttttttaagaaacgtcctaagacaatcgtaaaagcagggccagagtacggacagggtatgaatccaatttcaaggctcgctcagatacagcaggccaagaaagaaaaggagcccgactatgtactgctgagcgaacggggtatgcctcgacgcagggagttcgtaatgcaagtgaaagtcggaaacgaggtagcaacaggcactggccctaataagaagatcgccaagaagaatgcagccgaagccatgctgctgcaattaggctataaagcttccacgaacctccaggatcagctcgaaaagacaggcgaaaacaaggggtggtccggcccaaaacctggcttcccagaacccactaataacacacccaagggaatcctgcacctctctccagatgtctaccaagaaatggaggcctcaaggcataaggtcatttctggcacgacgctgggctacctgagtcccaaggacatgaaccagcctagttcgagttttttttccatctcaccaacctcgaactcaagtgccactatcgctagagagctgctaatgaacggaacgtcgagcactgccgaagccatcgggttgaagggatccagccccacccccccatgttccccggtgcagccatccaaacagttagaatacttagctcgcatacagggctttcaggctgcactatcagctctgaagcagtttagcgaacagggactggaccctattgacggagcgatgaatatagagaaaggcagtctggagaaacaggctaagcacctgagggaaaaggccgataacaatcaggcgcccccaggctctattgcccaggactgcaagaagtcgaactccgctgtatag

SEQ ID NO: 136331 - DNA, 318 bp, Artificial Sequence
  Description of Artificial Sequence: Synthetic coding sequence
atgctccagattaaccagatgttctccgtccagctgagtcttggggaacagacttgggagtccgaggggagctcgattaaaaaagctcagcaggccgtggctaacaaagcgttaacagagtctactcttcccaaacccgtgcagaagccaccaaagtccaatgtgaataataaccccggtagcattacgccgactgttgaactgaatggactggccatgaaacgcggtgagcccgcaatatatagacctctggatcccaaaccttttcccaattatagggctaactacaacttcaggggcatgtataatcaaagatag

SEQ ID NO: 136332 - DNA, 1713 bp, Artificial Sequence
  Description of Artificial Sequence: Synthetic coding sequence
atggccaacccgaaggagaagacggctatgtgtctagttaacgaacttgctagattcaatcgagttcagccacaatacaaactcttgaatgaacgcggccccgctcatagtaaaatgttctccgttcagctctcgctcggcgaacaaacatgggaatctgagggctccagcatcaaaaaagcccagcaggcagtggcaaacaaggccctcacagagagtactctacctaagcccgtgcagaaaccaccaaaatcaaacgtgaataacaaccccgggagcatcactccgaccgtagagctcaatggcctggctatgaagcggggcgaaccggctatctacaggccactggaccctaagccatttcctaactaccgtgcgaattacaacttcaggggaatgtacaatcaacgctaccattgccctgttcctaaaatcttctatgtgcaactgactgtgggaaacaatgaattttttggagaaggaaaaacccggcaggcagctaggcacaatgcggccatgaaggcattgcaggctctgcagaatgagcccatccccgaaaggtccccgcagaatggagagtctggaaaggatgtcgacgatgataaggatgcaaacaagagcgagatcagcctcgttttcgaaattgcactcaagagaaacatgccagtcagcttcgaagtcatcaaggagagcgggcctcctcatatgaagagctttgtgacccgcgtttcagtgggcgaattctccgccgagggagaggggaactccaaaaaactttccaaaaaaagggcggctactactgttttgcaggagctaaaaaagttacccccacttcccgttgtggaaaaaccgaaattattcttcaagaagaggccgaaaacgattgtgaaggctgggccagagtacggacagggcatgaatcccatcagtcgactcgcccagatccagcaggccaagaaggagaaggagcccgattatgtcctcctctccgagaggggcatgcctcgaagacgagaatttgtgatgcaggtcaaagttgggaatgaagtggcgaccgggactggtccaaataaaaagattgctaaaaaaaacgccgccgaagcgatgctactgcagctaggttataaggcaagcacgaatctgcaagaccagctcgagaaaactggagagaataagggttggtctggtcctaagccgggtttccccgaacctaccaacaacacccccaaaggcatcttacacctctcacctgacgtatatcaggaaatggaggcgtctaggcataaggtcatctcagggaccacactcggctatctgagcccaaaagatatgaaccaaccctcgagttccttcttctcaattagtcccactagcaatagcagcgcgaccattgctcgagagttgcttatgaatggcacctcttctactgccgaggcaattggactaaagggcagttctcctacgccaccctgctctcctgttcagcccagcaagcagctcgagtatttggctaggattcaaggctttcaggctgccctttctgccctgaaacagttctcagagcagggcctggatccaatagatggtgccatgaacatagagaaagggagcctggagaagcaagcaaagcacctaagggagaaagcagacaacaatcaggcccctcctggatccatcgcccaggactgcaagaagtccaactcagctgtgtag

SEQ ID NO: 136333 - DNA, 1044 bp, Artificial Sequence
  Description of Artificial Sequence: Synthetic coding sequence
tcactgctcaccaatgacgcatctagtgaaagtatagcttcgtttagcaagcaagaagtgatgtctagcttcctgcccgagggcggatgttacgagctgctgactgtgatcggaaagggattcgaagaccttatgaccgtgaatctcgcgagatacaagccaactggcgaatatgtgaccgtaagacgtattaacttagaagcctgcagcaatgagatggtgaccttcctgcagggagagctgcacgtttccaaactgtttaaccaccccaacattgtgccctacagggctacctttatcgcagataacgagctctgggtcgtgacgtccttcatggcttatgggtcagcaaaggacctgatttgcacacacttcatggacggtatgaatgaactggcaatcgcctacatactgcagggagttcttaaagcacttgattatatacaccatatgggatatgtccacaggtctgtgaaggcctctcacatccttatcagcgtcgacggcaaagtgtacctcagcggcttaaggtccaatctctcaatgatttcccacggccaacgacaacgcgttgtccacgatttcccgaagtactctgtgaaggtactgccttggctgtcccctgaggtgctgcagcaaaatctgcagggttacgatgccaaaagcgatatctattctgttggcatcacagcgtgcgaactggccaacggccacgtgcccttcaaagacatgcctgccactcagatgttgcttgagaagttgaacgggaccgttccttgcttactcgacacctccactattccggccgaggaattgaccatgagccccagccggtcagttgctaacagtggattgtccgattcactgaccacatctacccccagaccctccaatggtgactcaccgtcccacccttaccatcgcaccttcagtccacactttcaccatttcgtcgagcagtgtctccagaggaacccggacgcgcgatatccctgctggcccggcccaggactccgggaaagccgcggatgctctgggggatag

SEQ ID NO: 136334 - DNA, 1296 bp, Artificial Sequence
  Description of Artificial Sequence: Synthetic coding sequence
atgtcttttttggtaagtaagcctgaacggattaggcgctgggtgagtgaaaagtttatcgttgagggactgagggatctcgagcttttcggcgagcagccacctggggacactcgcagaaaaacgaatgatgcatcatcagagtctattgcatcattcagtaagcaagaggtgatgagctctttcctgcccgaaggcgggtgctacgagctcctcaccgtgattggcaaaggatttgaggatcttatgactgtcaacttagctaggtacaaacccaccggggaatacgttacagtgagaaggataaatctggaagcctgcagtaatgaaatggtcaccttcctgcagggcgagctgcacgtctctaaactttttaaccatcctaatatcgtgccttatagagccacctttatcgcggacaatgagctgtgggtggtgacaagcttcatggcctacggcagcgcgaaggacctgatatgtacacatttcatggatgggatgaatgagcttgccattgcttacattctgcaaggggtgttaaaagcacttgattacatccaccacatggggtatgtccacaggagcgtcaaggccagtcacatattgatctctgtggatggtaaggtatacttaagcggtctgcgaagtaacctatcaatgattagccacggacaaaggcagcgggtggttcatgatttcccaaagtacagcgtcaaggtgctgccctggctgagtcccgaagtgttacagcaaaatctccagggatacgatgctaagagcgatatttattcagtaggaataaccgcatgtgaactggccaacggtcacgtccccttcaaggatatgcccgccactcagatgctgttggagaagctgaacggaacagtgccctgtttactcgacacgtccacaattccagcggaggagctgaccatgagcccaagccgctccgtggcaaattccggtctgtccgacagtctgacaactagtaccccacggccaagtaacggggattcccccagtcacccctatcataggacattctcgcctcatttccaccattttgttgagcaatgtctgcagcggaatcctgacgcccgcccctccgcctctactctcctgaaccatagcttcttcaaacagattaagagaagggcctccgaagccctgcccgagctgcttagacctgtgacccctattacaaactttgagggatctcagagccaggaccacagtggaatattcggtctcgtgactaatctggaagagctggaggtggatgattgggaattttag

SEQ ID NO: 136335 - DNA, 1122 bp, Artificial Sequence
  Description of Artificial Sequence: Synthetic coding sequence
atgagcagcttcctaccagaaggcggttgttatgaactcttaaccgtgattggcaagggctttgaggacctgatgaccgtgaatctcgccagatataaaccaaccggcgagtatgtcactgtccgcaggattaacctcgaggcatgttctaatgagatggtgacattcctgcaaggcgagcttcatgtctctaagctcttcaatcaccccaatatcgttccataccgtgcaaccttcatagctgataatgaactgtgggtggtaacctccttcatggcctacggaagtgcgaaggatctaatctgtactcactttatggatggtatgaacgaactagcaattgcgtacattcttcagggtgtcctgaaggcactggattacatacaccacatgggatatgtgcaccgtagcgttaaagcctcccacattctgatctccgtcgacggcaaggtctacctctccggcctgagaagcaacttaagtatgatttctcacgggcagagacagagagttgtgcatgacttccctaagtatagtgtgaaagtactgccttggctttcccctgaagtcctccagcagaacctccagggttacgacgccaaatctgatatctatagtgtgggtatcacagcctgcgagcttgccaatggccacgtcccttttaaggacatgcccgctacacaaatgctcctggaaaaactaaacggaacagtgccttgcctattggacacgtctaccataccagccgaggaactgacgatgtctccgagcaggagtgtggccaactccggcttgtccgacagcctgaccacttctacgccccgaccaagtaacggagactcgccctcccacccatatcatagaacattcagtccccattttcaccactttgtcgagcaatgtttacaaaggaacccagacgcccggccttccgccagcacgttgctgaaccatagcttttttaaacagattaagaggcgagcctctgaagctttgccagagctcctgaggcctgtcactcctattaccaactttgaggggtctcagtcacaagaccattcaggaatcttcggtctggtgactaacctcgaagaactggaggtcgacgactgggagttttag

SEQ ID NO: 136336 - DNA, 1047 bp, Artificial Sequence
  Description of Artificial Sequence: Synthetic coding sequence
atgtccttcctcactaatgacgcaagtagtgaatctattgcctcatttagtaagcaagaagtgatgtcctcctttctcccagagggaggttgttacgaactgcttactgtcatcggaaaagggtttgaagacctgatgacagtcaatctagcaagatacaagccaacgggagagtacgtaactgtacgccgtattaatctcgaggcatgctctaatgaaatggttacattcttgcaaggagagctgcatgtgagcaagctgttcaatcacccaaatatcgtgccttaccgagcgacgttcatagccgacaacgaactttgggtggtgacaagctttatggcctacggtagcgccaaggacctgatttgtacccattttatggatggcatgaacgaactggccatcgcgtacattctgcaaggagtgctgaaagcccttgactacatccaccacatgggctatgtgcatagaagcgtgaaagcatcccatatcctgatcagcgtggacgggaaagtatatctctcggggctgcggtctaacctcagcatgataagtcacggccaacgccagagggtggtgcatgatttccctaagtattccgtgaaggtgctcccatggctgagcccggaagtgctgcagcagaatctgcaggggtacgatgctaaatctgacatctacagtgtcgggatcacggcttgcgagcttgcaaacggtcatgtcccatttaaagacatgcccgccacccagatgcttctcgaaaagcttaatggaacagtgccatgtttgcttgacaccagtacaattccagctgaagaattgaccatgtccccgagcaggtccgtggccaatagcggactgtctgattccctcacaacctctactccccgccccagtaatggggactccccgtcccacccctaccacagaactttcagcccgcatttccaccatttcgtcgagcagtgccttcaacggaatccagacgctcgctacccttgttggccggggcctggcctacgagaaagccgggggtgtagtgggggatag

SEQ ID NO: 136337 - DNA, 900 bp, Artificial Sequence
  Description of Artificial Sequence: Synthetic coding sequence
atgagcttcctagtctccaaacccgagaggatccggcggtgggtgtccgaaaagttcatcgttgaaggcctgagggacctggagctatttgggggcaagggatttgaggacttgatgaccgtcaaccttgcgagatataagcctaccggcgagtatgttaccgtcaggcgtataaacctggaggcctgtagcaacgagatggtgacattcctgcagggcgaactgcacgtcagcaaactctttaaccaccccaacatcgtaccctacagggccacctttattgccgataacgagttgtgggtagtgacctcgtttatggcttacgggtcagccaaggacctgatttgcacacactttatggacggcatgaatgaattggccattgcatacatcttacagggggtgctgaaagctttggattatattcaccacatggggtatgtgcacaggagcgtcaaagcctcccacattctcatatcagtggacggtaaggtgtatctatctggactccgctccaatctttcaatgatttcccacgggcagaggcagcgcgtcgtacacgactttccaaagtattccgtcaaagtcctgccatggctctcaccagaggtccttcagcagaacctgcagggctatgacgctaagtccgacatttactccgtgggcatcactgcatgtgagttagcaaacgggcacgttcccttcaaagacatgcctgctactcagatgctactcgaaaaattaaacggcacggtgccttgcctgctagacacctccactatccctgcggaagagcttacgatgtcaccttcccgctctgtcgctaatagcgggttgtccgactctttaactacatctaccccacgcccctctaacggacccgtgcccgctccatcgtag

SEQ ID NO: 136338 - DNA, 1257 bp, Artificial Sequence
  Description of Artificial Sequence: Synthetic coding sequence
atgagccttttagactgcttttgtacttcccgcacgcaggtagagtcactgagaccagagaagcagtccgaaacgtcgatccatcagtacctggtagacgaaccgacgctgtcctggtctcgcccatctactagagcctcggaggttttgtgctccaccaatgtgagtcactatgagctgcaggtcgaaattgggcgaggttttgacaatctgacctctgtgcacttggcaaggcacacaccaaccggaactcttgtcactatcaagataaccaatctggaaaattgcaacgaggagcgcctcaaggcgctgcagaaagccgtcattctatcacacttttttaggcaccctaatattaccacttattggacagtgttcaccgtgggatcctggctttgggtcatatccccttttatggcctatgggtccgctagtcaactgctgcgtacatacttccccgaaggaatgagcgaaactttgataagaaatatactgtttggtgccgtgagaggcctgaactacctgcaccagaatgggtgtatccatcgaagtataaaagcaagccatattctcatatcaggagacgggctggtgaccttgagcggcctgtctcatctgcactcgttggttaagcatgggcagaggcacagggctgtgtatgactttccgcagttctccacatcagttcaaccgtggctatctcctgaacttctccgccaggatctccatggatataatgtcaagtccgacatatatagtgtgggcatcacagcctgcgagctggcgtctgggcaggtgccctttcaggatatgcaccggacacaaatgctcctgcagaagctgaaaggcccaccttacagtcctctggatatctcaatcttcccccagtctgaatcaagaatgaagaacagtcagtcgggtgtggactctggcattggagagagtgtgcttgtgtcctcaggcactcacacggttaactcagataggttgcataccccgtccagcaagactttttcccctgccttcttctcactcgtgcaactgtgcttgcagcaggatcctgagaaaagaccatccgcctccagtctgttgtctcacgttttcttcaaacagatgaaggaggagagtcaggacagtatcctgagcctactcccacctgcttataataagcccagtatatccctgccacctgttttgccatggactgaacccgagtgtgactttcctgacgaaaaggattcatactgggagttttag

SEQ ID NO: 136339 - DNA, 1134 bp, Artificial Sequence
  Description of Artificial Sequence: Synthetic coding sequence
atgtctctgcttgactgcttttgtaccagccgcacgcaggtcgagtccctgagacccgagaagcagagtgagacgtccatccatcaatatttggtggatgagcccacactgtcttggagcaggccatctacacgggcatcagaagtgctctgctcaaccaatgtgagccactacgaactgcaggtggagatcgggagaggctttgacaatctaacatccgttcacctggctcgccacacccccacaggtactctggtcaccatcaagataactaacctggagaattgcaatgaggaacgactcaaggctctccagaaagctgttatcttatctcacttttttcggcaccctaatatcaccacctactggaccgtattcactgtgggttcttggttgtgggtaatttctcccttcatggcatacgggagcgctagccagctcttacgcacgtacttccccgagggtatgagtgagaccctcattcgtaacatcctgttcggtgccgtcaggggactcaattatctccatcaaaatgggtgtatccacagaagtattaaagcatcccatatccttattagtggcgacggactcgttaccttgtccggattgtctcacttgcacagcttggtgaaacacggccagcggcacagagccgtgtatgatttcccccagtttagcacctccgtgcaaccttggctaagccccgagctacttagacaggatctgcacgggtacaatgtgaaatccgacatatatagtgtcggaataacagcatgcgaattagccagtggccaggtgcctttccaagatatgcacagaacacaaatgctcctgcagaagctcaagggtcccccatacagccctctggacatatccatttttccacagagtgagtcccggatgaaaaactcccagtcaggcgtggattcagggattggcgagtctgtgctcgtatccagtgggacccatacagttaatagcgaccgtctccacacaccaagcagcaaaaccttttctcccgcattcttttcactggttcagctatgcctgcagcaggatccagaaaagaggccctccgcctcctccctgctcagccatgtcttctttaaacagccttactttgagtttctttag

SEQ ID NO: 136340 - DNA, 843 bp, Artificial Sequence
  Description of Artificial Sequence: Synthetic coding sequence
ctcggctactgcagcgcatcacaattgctccgcacttactttcctgaaggtatgagtgaaacgctcatcaggaatatccttttcggagctgttagaggactgaattacctgcatcagaacggatgtattcaccggtccatcaaggcttctcacatcctcatttctggcgacgggcttgtcaccctgagcggtttgagccatctgcacagtttggtgaaacacggccagaggcacagagctgtgtacgatttcccccagttttccacatcagtgcaaccatggctaagtcctgagctgctccgccaggatctgcacggctacaatgtgaagtcagacatttactcagtgggtattaccgcctgtgagctggcttctgggcaggtgcccttccaggatatgcatagaactcaaatgttgctccagaagttaaagggacctccttattctccactagatataagtatcttcccacagagcgaaagcaggatgaaaaattcccagagtggagtcgacagtgggattggcgagagcgtgcttgtgtcaagcgggacccacactgttaattccgacaggctgcacacaccctccagtaaaacattcagcccagcattcttcagcctggtccagttatgcttacagcaggaccccgaaaaacgaccatctgcatcctcattgctgtcccatgtattttttaaacagatgaaagaggaatctcaggattccatactgagccttttaccacctgcctataataaacccagtattagtcttccccctgtccttccatggactgaaccggagtgtgattttcctgacgagaaggacagttactgggagttctag

SEQ ID NO: 136341 - DNA, 1257 bp, Artificial Sequence
  Description of Artificial Sequence: Synthetic coding sequence
atgagtctgctcgactgcttttgcaccagccgaactcaagtggagtccctcagacctgagaaacagtccgaaacctctatccatcagtacctggtggatgagcctaccctatcctggtcccgcccctccacccgcgcttcagaggtgctgtgctctacaaatgtaagccactacgaactgcaagtggaaattggtcgtgggttcgataatcttacttcagtgcacttggctcgccatacacccactggaacccttgtcactattaaaattacgaatcttgagaactgtaatgaagagaggctcaaggccctgcagaaagcagtgattctgagtcactttttccggcaccccaatattaccacttattggaccgtttttacagtaggctcttggctctgggtgatctctccattcatggcctacgggagtgcctctcagctcttgaggacatacttccctgagggcatgtctgaaacccttatccgaaatatcctttttggcgctgttcgtggacttaactatctgcaccagaatggatgtatacacagatctatcaaagctagccacatcttgatctctggcgacggtctggtcacactgagcgggctttcgcatctgcactctcttgttaagcacggccagcggcatagggctgtgtacgactttcctcagttttctacaagtgtgcaaccgtggctcagccctgagctgctgcgtcaagacctccatggttacaacgtaaagtctgacatttactctgtggggatcaccgcttgcgaactggccagcgggcaggtgccctttcaggatatgcatagaacccagatgctcttgcaaaaactcaaaggacctccatattccccgctggatatatcgattttcccacagagcgaaagtcggatgaaaaactcgcagagtggcgtcgattcaggcattggggagtccgtgctggtttccagtggaacgcataccgtgaacagcgaccgactccacactccctctagtaagacattctcaccagcattttttagccttgtccagctctgtcttcaacaagaccccgagaagagacctagtgcctcaagtttgctgtctcacgtcttctttaaacaaatgaaggaagagagccaagattctatacttagcttattgcctccggcctacaacaagccgagtatctcactgccgcccgttctaccctggaccgaacccgagtgcgacttcccagacgaaaaggattcatactgggagttctag

SEQ ID NO: 136342 - DNA, 1260 bp, Artificial Sequence
  Description of Artificial Sequence: Synthetic coding sequence
atggagagcatctcaatgatgggaagccccaagagtctgtccgaaacatttctccctaacggtatcaatgggattaaggatgcccggaaagttaccgtaggtgtgatcgggtccggcgattttgcaaagtcattaactattcggctgattaggtgtggataccacgtggtgatcggcagccggaaccctaagttcgcgtccgaattctttccacacgtggttgatgtgacccaccacgaagatgccctgacaaagactaacatcatctttgtggcaatacacagggaacattacaccagcttgtgggacctcagacatctgctcgttgggaaaatcctgatagacgtgtcaaataacatgagaataaatcagtatccagaaagtaacgccgaatacctggcctcactatttcccgattctttaatagtcaagggcttcaatgtagtaagcgcgtgggcactgcagctgggccctaaggacgcgtccaggcaggtttacatttgctctaacaatatacaggcacgacagcaggtgatcgagttggcacggcagttgaattttatacctatagacctcggcagtctgagctccgcaagagaaatcgaaaatctgcctctcaggttgtttacgttgtggcgcggccccgtggtggtcgccatttccttggcaaccttcttttttctgtactctttcgttcgggatgtgattcatccatatgcccgtaatcagcagagcgatttttataagatccctattgaaattgtaaataaaacacttcctatcgtggctatcaccttgctgtccctcgtctacctggccgggctgctagcagcagcataccagctctactacgggaccaagtatagacgttttcccccctggctggaaacatggttacagtgcagaaagcagctagggttgctctctttcttttttgccatggttcatgtggcttactccttatgtctcccaatgcggcggtctgaaaggtatctgtttctcaacatggcttaccaacaggtacacgctaatatcgaaaatagttggaatgaagaggaagtgtggagaatcgagatgtacatctcttttggaataatgtcactgggactccttagtctgctggctgtgaccagcattccgtccgtctccaatgcattgaattggagagaattcagtttcattcagatcttctgttcattcgccgatactcagacagagttagaactggaatttgtgttcctgctgacactcctgctgtag

SEQ ID NO: 136343 - DNA, 1473 bp, Artificial Sequence
  Description of Artificial Sequence: Synthetic coding sequence
atggagtcaatcagtatgatgggatctcctaagagcctgtctgagacttttctgcccaatggcatcaacggcataaaagatgccagaaaggtcaccgtaggcgtcattggatctggggattttgccaagagtctcaccataagactgattcgctgcgggtaccacgtagttattggctcccggaacccaaagttcgcaagcgaattttttcctcatgtagtggacgtgacgcatcacgaggacgccctgacaaagacgaatatcatctttgtcgctatccaccgggagcactacacctccctctgggatctcaggcacctgttagtagggaagatcctgatcgacgtgtcgaacaatatgcggattaaccagtaccctgagagtaatgccgaatacctagccagtctgttcccggattcccttattgtaaaaggcttcaacgttgttagcgcctgggcactgcaactgggcccgaaggatgcatcacgacaagtttacatttgctccaataatatccaggctcgacaacaggtgatcgagcttgctcgacagctgaatttcatccccatagacctgggctctttgagctcagccagagagatcgaaaacttgcctctgaggctattcaccctgtggcgagggcccgtcgtcgttgcaataagcttggcgacctttttcttcctgtattccttcgtgagagatgtcatccacccctacgccaggaaccaacagagtgatttttataagatcccgatcgagattgtaaacaagacccttcccatcgtggctatcactttgcttagtcttgtctatcttgcaggactcttggccgcggcataccagttgtattacggcaccaagtatagacggttcccaccctggctggagacctggttacagtgccgaaaacaactgggcctgctcagcttcttctttgccatggttcacgtggcttacagcctatgtctccctatgcgacggagtgagcgctacctgtttttgaacatggcatatcagcaagtgcacgctaatatcgagaactcctggaatgaagaggaggtgtggaggatcgagatgtacatttcctttggcattatgtctctcggtctcctttcgttgctcgccgtaacatccatcccttctgtgtccaacgccttaaactggagggaattcagctttatccaatcgacactgggctacgtggctttattaatttcgacttttcacgtccttatttacggctggaaacgtgctttcgaggaggagtactaccgcttctacactccccctaatttcgttctggctctggtgctgccctctattgtgattctgggcaagataatcctgttcttgccctgtatatccagaaaattaaaacggataaagaagggctgggaaaagtcccagttcctggaagaaggcatggggggcaccatcccacacgtatctccagagagggtaacggtgatgtag

SEQ ID NO: 136344 - DNA, 1473 bp, Artificial Sequence
  Description of Artificial Sequence: Synthetic coding sequence
atggaaagcatttctatgatgggtagccctaaatcactgagcgagaccttcttaccaaacggaatcaacgggattaaggatgctcgcaaggttacagtgggggtgattggctctggcgatttcgctaaatccctgacgattaggctgattagatgcggataccacgttgtcatcggcagcagaaaccccaagttcgcatcagagttcttcccccacgttgtggatgtgactcaccacgaggatgcgcttaccaaaactaacatcattttcgttgccatccaccgggaacactacacgtccctctgggacttacggcatttgttggtaggaaaaatcctgatagacgtgtccaataacatgcgcattaatcaatacccagaatcaaacgccgaatacctggccagtctgttcccagattctctcatcgtcaaagggttcaacgttgtctccgcctgggccctgcagcttgggcctaaggatgctagcaggcaggtgtacatctgctcgaacaacattcaggctcgccagcaggtcattgagctggctcgccagctgaacttcatacccatcgaccttggatctctttcctccgctcgggagatcgagaacctccctctgcgtctcttcacgctgtggcgtggacctgtagtggtcgcaattagcctagccaccttcttttttttgtacagcttcgttagagacgtaatccacccgtatgcccggaaccaacagtctgacttctataagattcccattgagattgttaacaagacattaccaattgttgcaataaccctcctgtccttggtctatcttgcagggctcctggctgctgcctatcagctttactacggaaccaagtatcggcgatttccaccatggctggaaacatggcttcagtgtagaaaacagcttggcctcctctccttcttcttcgccatggtgcacgtggcttactctctttgcctaccgatgcgccgttctgaaaggtacttattcttgaacatggcctaccaacaggtgcacgcaaacatagagaatagctggaacgaagaggaggtatggagaattgaaatgtacatttcattcggaataatgtccctggggctactgagccttctggcagttaccagtatccccagcgtgtcaaacgccctaaactggagagagttctctttcatccagagcacgttaggctacgtggccctccttatctccacctttcacgtgttaatctatggctggaaacgtgcattcgaagaggaatactaccggttctatacacctcctaatttcgttctggctcttgtactaccctccattgttatccttgggaaaatcatcctattcctcccatgtatctcaaggaaactcaagagaattaaaaagggctgggaaaagtctcagttcctggaagagggcatgggcggcaccatccctcacgtgagtcctgagagggtcactgtgatgtag

SEQ ID NO: 136345 - DNA, 1473 bp, Artificial Sequence
  Description of Artificial Sequence: Synthetic coding sequence
atggaaagcataagcatgatgggtagtcccaaatccctctctgagaccttcctcccaaacgggatcaatggaattaaagacgctcgtaaggttacagttggagtgattgggtccggcgacttcgcgaagtccctgaccatccgcttaattcgctgcgggtatcatgtggtaatagggagcaggaaccccaaattcgcaagtgagttcttcccccacgtcgtagatgtcactcaccatgaggatgctctgacaaaaactaatatcatctttgtcgctatccatcgcgagcactacaccagtctctgggacctccggcatctcctggttggaaaaattctgattgatgtctctaacaacatgcgcatcaaccaataccctgagtcaaatgctgagtacctcgcatcgcttttccctgattccctcatagtgaaagggttcaatgtggtgtcagcctgggcacttcaactaggaccaaaagacgcttctaggcaagtgtacatctgttccaacaacatccaagctcgacagcaggtgattgaactggctcgtcaactaaactttatcccgatcgacctgggctcactgagcagcgcacgcgaaatagagaatctgccattacgcttatttacgctgtggcgcggccccgtggttgtggcgattagcttggccactttcttctttttatactctttcgtcagagacgtcatccacccctacgcaagaaaccagcaatctgacttttataaaatcccaatcgaaattgtgaacaagaccttgccaattgtagcaatcaccctactgtcgttagtgtacctggcaggtcttttggcggcggcgtatcagctttactacggcaccaagtaccgccgctttccaccatggctcgaaacatggctccagtgtcggaagcagctaggtctgcttagcttctttttcgcaatggtgcacgtcgcctatagtctatgccttcctatgaggagaagcgagcgctacttattcctgaacatggcatatcagcaggtccacgccaatatcgagaacagttggaacgaagaagaggtctggcggatagagatgtacatatcatttggaataatgtcccttggactgctctccctgttagccgtgaccagcatcccctcagtttcaaatgccctgaactggcgagaattttccttcatccagtccactctggggtatgtggccctgctgatctctacctttcacgtgctcatctacggttggaaacgcgccttcgaggaggaatactacagattttatactcctccaaacttcgtgctggcgctggttctgccctctatagtgattctggggaaaattattctctttctgccttgtatctcacgtaaactaaaacgaattaagaagggctgggagaagtcccagttcttggaggaggggatggggggtactatcccacatgtgtccccagaaagggtgaccgtgatgtag

SEQ ID NO: 136346 - DNA, 1365 bp, Artificial Sequence
  Description of Artificial Sequence: Synthetic coding sequence
atggaatcaatatccatgatgggtagtccaaagtctctgtccgagactttcctcccaaatgggatcaacgggataaaagatgctaggaaagtgaccgtgggcgtcatcggctcaggggatttcgccaagagcttgactatccgattaatccgctgtgggtatcacgttgtaatcggatcgagaaaccccaagtttgcttcagagttctttccacatgtggtcgatgttacgcaccacgaggatgcactgactaaaacgaacattatctttgtggccatccatcgggaacactacacctccctgtgggatcttcgccatttactggttgggaagattctgatcgacgtctctaataatatgcggattaaccaatatccagaaagtaacgccgaatacctcgcgagtctgtttcctgacagtctcatagtgaaagggttcaacgtcgtgtccgcctgggcccttcagctcggccctaaggacgctagtaggcaagtgtacatctgcagtaacaacatccaggctcgacagcaggtgattgaattggcacgacagttgaattttatacccattgaccttggaagtctatccagtgcccgggagatcgagaatttaccattacgactcttcactttatggaggggacccgtggtcgttgccatttcccttgccacatttttcttcttgtacagctttgttagggacgttatccatccatacgcccgtaatcagcagtccgatttttacaaaattcccatcgagattgtcaataaaacactgcccatcgttgcaatcacattgctttcattggtatatttggcaggtctccttgcggctgcataccaactctactatggcacaaagtaccgccgattcccaccttggctggaaacctggcttcaatgtagaaaacagcttgggctcttgtccttcttcttcgcaatggtgcacgtggcctactccctatgcctcccaatgaggcgcagcgaaagatacctatttttaaacatggcataccaacaggtgcacgccaacatcgagaatagctggaacgaagaagaagtgtggcgcatcgagatgtacattagttttggcataatgtcgttgggactcctctccctgctggcagttaccagcataccatctgtgtctaacgcgttgaactggagagaatttagctttatccaatccaccctgggctatgttgctctactgatatccacctttcacgtgttaatatacggctggaagcgcgcctttgaggaggaatactatcgattctatacccccccaaattttgtcctggcactggtgctgccttctatcgtgatactggatctacttcagttgtgtagataccccgactag

SEQ ID NO: 136347 - DNA, 1365 bp, Artificial Sequence
  Description of Artificial Sequence: Synthetic coding sequence
atggagtccattagcatgatgggctcaccaaaatccctcagtgagaccttcttgcctaatgggatcaacgggatcaaggatgctagaaaggtgactgtaggcgtgatcggctccggcgatttcgccaagtctctgacgatcaggcttattcgttgcggataccatgttgtgataggtagccggaaccctaagtttgcatccgagttttttccccacgtcgtagatgtgacccatcatgaggatgctctaaccaaaacaaacatcatttttgtggccatccatcgagaacactatacatccctgtgggatctccggcacttgctcgtaggcaagatcctgattgatgtttcaaacaatatgcgcattaaccaataccctgagagcaacgcagagtatctggcatccctatttccagactccctgattgtcaagggtttcaacgtggtgtccgcctgggccctgcagttggggcccaaggacgcttcgagacaggtgtatatctgcagcaacaacattcaggcacgtcagcaggtaatcgagctggcccggcaactgaacttcatcccgattgatttgggcagtctgagtagcgcgcgagagatagagaatctgccactgaggttatttactctttggcgggggcctgtcgtggtcgctatcagcttggccacatttttctttttgtattcatttgtgagagatgttatccatccctacgctaggaatcaacagtcagacttctataaaataccaattgagatagttaataagacattacctatcgtggctattacgctgctgagtttggtgtacctggcaggcctgctggccgctgcttaccagttatactacgggacaaagtaccggcgctttcctccttggctggaaacttggctgcagtgtcgcaagcagcttggactgcttagctttttctttgcaatggtgcacgttgcatacagcttgtgcttgcccatgcgtcgatcagaaaggtacctgtttctgaatatggcctaccagcaggtgcacgcgaacattgaaaattcgtggaacgaagaagaggtttggcggatagaaatgtacatttccttcggtatcatgtcactcggtctgttatctttgctggcggtcacgagtatcccttccgtttcaaacgccctgaattggagggagtttagcttcatacagagtaccctcgggtacgtggccctgctgattagcactttccacgtgttgatttatgggtggaagcgcgctttcgaagaggagtactacagattttacactcctccaaattttgtgttagctttagtgttgccctcaatcgttattttagaccttttacaactgtgtcgctatcctgactag

SEQ ID NO: 136348 - DNA, 1365 bp, Artificial Sequence
  Description of Artificial Sequence: Synthetic coding sequence
atggaatcgattagtatgatgggttccccgaagtctctgagcgaaacattcctccccaacggcatcaatggcattaaagacgctcgcaaagtgaccgtaggcgtgatcgggtcaggagatttcgcaaagtcactgactatccgtctcatcagatgcgggtaccacgtggtgattggcagccgaaaccccaaatttgcctctgaatttttccctcatgtggtagatgtgactcaccacgaagacgctctcactaaaaccaatataatttttgttgccatccatagggaacattatacttccctatgggacctgcgccatcttctcgtcggcaagatcctcatcgacgtgagcaataatatgagaattaatcagtaccctgagtccaatgccgagtatctggctagcctcttccccgattctcttattgtgaagggattcaatgttgtctccgcctgggcactacaattggggcctaaggacgctagtaggcaggtgtacatatgttccaacaacatccaggcccgacaacaggtgatcgagctggctcgccagcttaatttcattcctatcgacctcggcagtctgtcaagcgcgcgagagatcgaaaacctgcccctgcggctgttcactctgtggagaggccccgtggtggttgcaatcagtctggccaccttctttttcctttactccttcgtgcgggatgtgattcacccctacgctagaaatcaacaaagcgatttttacaaaattccgatagaaatcgtgaacaagacgttaccgatagttgctatcacactcctttcactggtctaccttgccggcctactggccgccgcctatcagctgtattacggcacaaaataccgcaggtttcctccctggctagagacctggttgcagtgtcggaagcagttaggcctgttgagcttttttttcgcgatggtccacgttgcttattcattgtgcctgccgatgcgtaggagtgaacgctacctgtttttgaacatggcataccagcaggtccatgccaatatcgagaattcttggaatgaggaagaagtatggcggattgaaatgtacataagctttggtatcatgtccctcggcctgctaagcctgttggccgttacttccatcccttccgtaagtaatgcactgaactggagagagttcagctttattcaatccactcttgggtacgtggctctgctgatctcaacttttcacgtcctcatttatggatggaaaagagcatttgaggaggagtattatagattttacacgcccccaaattttgttttggctctggtcctgccttcaattgtgatcttggacttgctgcaactatgtaggtaccccgattag

SEQ ID NO: 136349 - DNA, 267 bp, Artificial Sequence
  Description of Artificial Sequence: Synthetic coding sequence
atggagtccatttcaatgatggggtctcccaagtccctctccgagaccttcttgcccaacggcatcaacggcatcaaggacgcacgcaaagtgactgtcggtgtgataggaagtggggactttgcgaagtccctgacaatcaggttgatccgttgcggctatcacgttgtgatagggagtaggaatccaaagttcgcaagcgaattttttccacatgtcgtggatgtgactcatcacgaagacgccctcacaaaaaccaatatatag

SEQ ID NO: 136350 - DNA, 549 bp, Artificial Sequence
  Description of Artificial Sequence: Synthetic coding sequence
atggagtcgatctctatgatggggagcccgaaatccctctctgagactttcctccccaacgggatcaatggcatcaaagatgcccgtaaagtgaccgtgggtgtcatcgggtccggtgattttgctaaatccctgacaatcaggcttatacgatgcggttatcatgtggtaattgggagcagaaacccaaagtttgcttctgagttttttccccacgtcgtggatgtcacacatcacgaagacgccctgactaaaactaatatcatatttgtagccattcatagagagcactacactagcctttgggatctgcgtcacctcttggtgggcaagattctgattgacgtatccaataacatgcggattaatcagtaccctgagtccaacgccgaatacttggctagccttttccctgatagcctaatcgtgaagggatttaatgttgtctcagcgtgggctctacagctggggcctaaggatgcctctcggcaggtgtatatctgttctaataatatacaggcgcgccaacaggttatcgagctggcctag

SEQ ID NO: 136351 - DNA, 1467 bp, Artificial Sequence
  Description of Artificial Sequence: Synthetic coding sequence
atgcccgaggagatggataagccccttatttccctgcacctggtggatagcgattccagcctggctaaagtgcctgatgaggctcccaaggtggggattttgggctccggcgatttcgcgcggtcgctggcaaccaggctggtcgggtctggcttcaaggtggtcgtgggctctcgcaatcctaagcgaacggccaggcttttcccatccgccgcccaagttaccttccaggaggaagcggtgtcttcacctgaagtcatattcgtcgcagtctttcgagagcattacagtagtctgtgttccctctccgaccagctcgctgggaagatactcgtcgacgtatctaaccctaccgagcaggaacacctgcagcaccgtgaaagcaatgcagagtacctcgcctctttgttccctacgtgcaccgtggttaaggcattcaatgtaatctctgcatggactctgcaggctggtcctcgcgacggaaaccggcaggtgccaatctgcggggatcaacctgaggccaagagagcagtgtcagagatggctctggccatgggcttcatgcccgtcgatatgggttccctcgctagtgcttgggaagttgaagccatgccgctgaggcttttacccgcttggaaggtgcctaccctcctagccctgggcctgtttgtttgtttctacgcttacaacttcgtcagggatgtgctacagccatacgtccaggaatcccagaataagtttttcaaactgcctgtgagcgtcgtgaataccaccttgccgtgcgttgcttacgtgctgttgtccctggtgtacctgccaggggtactcgccgccgccctccaactccggcggggtactaaatatcaacggtttcccgactggcttgatcattggctgcagcataggaagcagatcgggctcctcagttttttttgcgcagcactgcatgccttgtatagcttttgtcttcccttgcgtcgcgctcacaggtacgacctcgtaaatctggctgtgaagcaagtcctggccaataaatcacatctgtgggttgaggaagaggtgtggagaatggaaatctatctgtccctgggagtcctggccttaggaacactttctttgcttgctgtcacatcactgcctagcatcgccaattccctcaactggcgagaattttcttttgtccagagcagtctagggtttgtagcccttgtgctgtctacattacataccctgacctatggctggacccgggcctttgaagaaagtcggtacaagttttatctgccacctaccttcactctaactcttcttgtgccgtgcgtggtgatcttagcaaaagccctgttcctcctcccctgcatttcccgtaggctggcaagaatccggcgcggatgggaaagggaaagcacaattaagtttacgctgcccaccgatcacgcgctggcagaaaagacatcccacgtttag

SEQ ID NO: 136352 - DNA, 1467 bp, Artificial Sequence
  Description of Artificial Sequence: Synthetic coding sequence
atgcccgaggaaatggataagccgcttatttcccttcacctggtagacagcgattccagtctggccaaagtgccagatgaggcccctaaagttggcattctcgggagtggcgactttgcacgaagcctggcaactcggttggtcggatccgggttcaaagtagttgtcggctcccgtaaccctaagaggaccgcacgccttttccctagcgcagctcaggttacatttcaggaggaggctgtgagttctcctgaggtcatttttgtggcggtgttcagggagcactacagctccctctgttctctctctgaccagctggctgggaaaatactagtggacgtttcaaaccctactgaacaggagcacctgcagcacagagaaagtaatgcggagtacctggccagcttgttccctacctgcaccgtcgtgaaggcttttaacgtcatctccgcatggaccctccaggccggcccaagggatgggaatcggcaagtcccaatttgcggggatcaacctgaggcaaaaagggccgtgtccgaaatggccctggcaatggggtttatgccagtggatatgggctctctcgcctccgcttgggaggttgaggctatgcctctccgtcttcttcctgcttggaaggtcccgacattactggctctgggactgttcgtttgcttctacgcttataactttgtgcgggatgtattacagccctacgtgcaggagtctcaaaataaatttttcaagcttcctgtgagtgtcgtaaatacaacactgccctgtgtggcatacgtgctgctctcacttgtctacctgcccggagtccttgctgcggctcttcaattaaggagagggactaagtatcagaggtttcctgattggttggaccactggctccaacaccgaaagcagattggactgctgagtttcttctgcgcagccttgcatgctttgtattctttttgcttgcccctacgccgagctcacaggtatgacctcgtcaatcttgctgtgaaacaggtgcttgcaaacaaatcacatctctgggttgaggaagaggtctggcggatggagatctacctgagtttaggggtgctcgctctggggaccctgtctcttttagctgtgacatcgctcccctccatcgctaactccctcaattggcgcgagttctcattcgttcaatcctcactggggttcgtcgcattggtactttcaacactccacactttgacttatgggtggactagggcattcgaggaatcaagatacaaattttatttgcctcctaccttcaccctgacccttttggtcccatgcgttgttatcctggcaaaggctttattcttgcttccatgtatatcaaggcggctagcgcgcatacggagagggtgggaacgcgagtctacaattaaatttacactacctacagatcatgcactggcggaaaagacctcccacgtgtag

SEQ ID NO: 136353 - DNA, 1467 bp, Artificial Sequence
  Description of Artificial Sequence: Synthetic coding sequence
atgcctgaggaaatggataaaccattgatcagccttcacctcgttgactccgattcatccctggctaaggtgccagatgaagccccgaaagtaggaatcttgggatctggagactttgcccggagccttgccacacggctcgtgggttcgggattcaaagtcgtagtgggttctcgtaaccccaagcgtactgcaaggctgtttccgtcggctgctcaagtcacctttcaagaggaggctgtttcttcccctgaagtgatcttcgtcgccgtttttagggagcactacagtagcctgtgctctctgtctgaccagcttgcaggcaagatactagttgatgttagcaacccaactgagcaggaacacctacagcaccgggagtcaaatgccgaatatcttgcctccctgtttcccacttgcactgtggtcaaagctttcaatgtcatcagcgcctggacgttgcaggctgggcctcgagacgggaacaggcaagttcctatctgcggtgatcaacccgaggccaaaagagccgtttccgaaatggctctggccatgggttttatgcccgttgatatggggagcttggcctcggcttgggaggtggaggcaatgcctttgagattgctcccagcgtggaaggtgccgactctcctggctttgggcctgttcgtgtgcttctatgcatacaactttgtgagggacgtactgcagccttatgtgcaggaaagccagaataagtttttcaaattgccggtgagcgtggtgaatactacccttccttgcgtcgcatacgtgctactgagtctggtctatcttcccggcgttttggcagcagcgttacagctccgaagaggaacaaagtatcaaaggtttcctgattggctcgaccactggttacaacataggaagcagattggtctcctttcctttttctgtgctgctttacatgccctgtatagcttctgcttgccactgagacgtgcacaccgttacgacttagtgaatttagccgttaagcaggtacttgcgaataagagccatctgtgggtggaggaggaggtgtggcggatggagatatatctctctctgggcgttctggccctaggaaccctgtcccttctggcagtgacctccctgccatctattgcaaattctctgaattggagggaattctctttcgtacagagctcacttggcttcgtggcgcttgtcctctctacactgcacacattgacctacggctggaccagagcctttgaggagagccgatataagttttacctgccacccacatttacgctgacactgctggtgccatgcgtcgtgatcctggccaaagctttatttctgctgccgtgcatcagtcgccgcctcgcccggattaggaggggctgggaaagggaaagcacaatcaaattcaccctgcccaccgatcacgcacttgcggaaaaaaccagccacgtgtag

SEQ ID NO: 136354 - DNA, 1467 bp, Artificial Sequence
  Description of Artificial Sequence: Synthetic coding sequence
atgcctgaggagatggacaagcccctgatatccctccatctggtggacagcgattcaagcttggcaaaggtccctgacgaagcccctaaagttgggatcttaggatctggagactttgcccgcagcctggccacccggctggtgggtagcgggtttaaagtggtggtcggctcacgcaatccaaaaaggaccgcccgcctcttcccgtccgccgcccaggtcacattccaggaggaggcagtgtctagcccagaagtcatctttgtagctgtgtttagggaacactactcgagtttgtgttccctgtccgatcaattagctggcaagatcctggtagacgtgtccaaccccaccgaacaggaacacctccagcaccgcgagagtaacgctgaatacctggcatctctgttccccacatgcactgttgtcaaggcgttcaacgtcatatctgcctggaccctgcaagcaggaccaagggacggaaaccgacaagtcccaatatgtggggaccaacccgaggctaaacgcgctgttagcgaaatggccttggccatgggatttatgcctgtcgacatgggtagtctggctagtgcctgggaggtggaagcaatgcccttaagattacttccagcctggaaggtcccgacactgctggcgctgggactcttcgtgtgcttctacgcctacaactttgtgagggatgtgctccaaccctacgtgcaagaaagtcagaataaattttttaagctgcccgttagtgttgtgaacactaccttgccctgtgttgcgtatgtgcttctgtctctggtgtacctgcctggggtacttgcagcggctctccaacttcgacgaggaaccaaataccagcgttttccagactggctggatcactggctccagcacaggaagcaaatcggactgctttctttcttctgtgccgccctgcacgctctttattccttctgcctgccactgcggcgcgcccaccggtacgatctggtgaacttggctgtgaagcaggtcttggccaacaaaagccacttgtgggtggaagaagaagtttggcgcatggagatctaccttagcttaggcgtcctggctctgggcactctgtcgttgctggccgtcacgagccttcccagtatcgccaatagtctcaactggagggagttctctttcgttcagtccagcctggggtttgtggctctggtgctgagcaccctgcataccctcacttatggatggactagggcatttgaggagagccgctacaagttctacttgccccctacttttactctgactctgctcgtcccttgtgtggttattctcgctaaggctctgtttctgctgccatgcatttcccgcagactcgcccgaattagacgaggatgggagcgtgagagtaccattaagttcaccctcccaacagatcacgcactagccgagaagacaagccacgtgtag

SEQ ID NO: 136355 - DNA, 1497 bp, Artificial Sequence
  Description of Artificial Sequence: Synthetic coding sequence
atgagccatcaaccggcagtagcaaccaaaatgccagaggagatggataagcctctcatcagtttgcatcttgttgatagcgacagcagtctggctaaagtccctgatgaggcccctaaggtgggtattctgggaagcggggactttgcccggagcctggcgactagattagtgggcagtgggtttaaggttgtggtcggcagtcgtaaccccaagaggactgcacgtttatttccctctgccgcgcaggtgacctttcaggaagaagctgtgtcctctcccgaggtgatatttgtcgctgtgttccgtgagcattattcttcgctttgctccctcagtgaccagctagctggaaagattctcgtggacgtgtccaacccaaccgaacaagaacacctgcagcatcgtgaaagtaatgcggagtatttggcttctctttttcccacctgtaccgttgtgaaagccttcaatgtcattagcgcctggactcttcaggccgggccacgcgatggcaacagacaggttccgatatgcggtgaccagcctgaagctaaacgtgcggtgtcagagatggccctggcgatgggttttatgcccgtagacatggggagccttgccagcgcctgggaagtggaggcaatgcctctgcggctgctccccgcctggaaagtgcccacccttttggcactcggtctcttcgtgtgcttttacgcctacaactttgtgagggatgtcctccaaccttacgtgcaagagagccagaataaattcttcaaactgcctgtgtctgtggtcaatactacattgccttgcgtggcatacgtgttactgagcctggtttacctcccaggcgtgctcgccgccgccctgcagctgcggagaggcacaaaatatcagcggttcccagactggctcgaccactggctgcagcatcgcaaacagataggtctgttgtcctttttttgcgctgcactgcatgcgctttactcattttgcctgcctcttaggcgtgcccaccggtatgaccttgtgaacctggccgtcaaacaggtgctcgccaataaatcccatctctgggtcgaggaagaggtctggagaatggaaatatacctatccctgggagtcttggcgctgggaactctgtctcttctcgcggtgactagccttccatcaatcgccaatagcctgaattggcgagaattctccttcgtccagtctagtcttggcttcgtagcgctcgtccttagtaccttgcatacgctcacctacgggtggacgcgcgcctttgaagaatctaggtacaaattctacttacctcccaccttcacgctaacactgctggtgccctgcgtcgttatactggctaaggctctatttctcctcccttgcattagcagaaggctggcacgtatacgcagaggctgggaacgcgaatcgaccatcaagtttactctgccaacggatcatgccttggccgagaaaacgagtcacgtgtag

SEQ ID NO: 136356 - DNA, 1374 bp, Artificial Sequence
  Description of Artificial Sequence: Synthetic coding sequence
atgcccgaggaaatggacaagccactgatttcgctgcacctggtggactctgactctagcttggccaaggtgccagatgaagcacccaaggtcgggatcctagggagcggtgactttgcccgaagcctggctacccggctcgtgggttcaggcttcaaggtggtggtcggctctcgcaatccgaaacggacagctagactcttcccatctgccgcacaggtgacttttcaagaggaggcagtgtccagtcccgaagttatctttgtggctgtctttcgggagcactactctagcctctgcagtttaagtgatcagcttgccggcaagattctggtggatgtctccaaccctacggagcaggaacatctccagcatcgagagagcaacgccgaataccttgcatcacttttccccacctgtaccgtggtgaaggcctttaacgtgatcagtgcttggactctacaggccgggcctcgtgatgggaatagacaggtaccaatctgcggggatcagcccgaggcgaaacgggctgtcagcgagatggcactggccatggggtttatgccggtcgacatgggcagcctcgcaagcgcatgggaggtggaggccatgcctcttcggttgctgccagcttggaaggttccgaccctgctggccctgggcctgttcgtctgcttttacgcttacaactttgttagggacgtcctccagccctatgtgcaagaatctcagaataaattttttaaactgcccgtctccgtggtgaacacaaccttaccatgtgtcgcttacgtgctgctttccctggtgtatcttccaggtgtgctggccgcagctctgcagctgagacggggaaccaaataccagcggttccctgactggctcgaccattggcttcagcacaggaagcaaataggcctgctctcctttttctgcgcggcccttcatgcactttacagtttttgcttgcctctccggagagcgcacagatacgacttagttaatctggctgtgaagcaggtactggctaacaaatcacatctctgggtggaggaagaagtgtggcgaatggaaatctatcttagcctcggggttctggcactggggaccctgagcctgctcgctgtcacatccctgcccagtattgctaacagcctgaactggcgcgagttctccttcgttcagtgtgtagccacctcctccgcaggcaatactggttctggcacccgcaggccggagtcacaatctcaggatccccacttgcccgcgccccaccatcagacctcgttcctgggaccacgcagcttctgctgctctctggtcccggtcagcaccccctacgggcaccaggaagacctgagttggaccagatag

SEQ ID NO: 136357 - DNA, 1467 bp, Artificial Sequence
  Description of Artificial Sequence: Synthetic coding sequence
atgccggaagagatggataaacctctgatcagcctccatttggtggattcagacagctcgctggcaaaggtgcccgatgaagcgccgaaggtgggaatcctggggtctggagattttgcacggtcactcgccacccggttggtgggctccggttttaaggtagtcgtcggctcacgcaatccgaagaggaccgctcggttatttccttctgccgcccaagttacattccaggaagaggctgtttcgtcacctgaggttattttcgttgccgtgtttagagaacattactcctcattatgttctttgtcggaccagctggcagggaagattcttgtggatgtctcaaaccctacggagcaagagcatctccaacaccgtgagtcaaatgcagagtatctcgcctccctgtttcccacttgcaccgtagtcaaggccttcaacgtgattagtgcctggacattacaggctggcccccgagacgggaatagacaggtgcctatctgtggggaccagcctgaggcaaaaagagccgtgtccgagatggccctggcgatgggcttcatgcccgtggacatggggtctctggcctccgcttgggaggtcgaagccatgcccctgcgtctattgcctgcgtggaaggtaccaactctgttagccctcggtctattcgtttgcttttatgcttacaacttcgttcgggacgttcttcaaccatacgtccaggagtctcagaacaaattctttaaacttcccgtgtctgtcgtcaacactactctgccctgcgttgcgtatgtgctgctcagcctggtctatcttccgggggtgttggctgccgcccttcaactgcggagaggcaccaagtaccaacggttccccgactggttggaccattggctccagcaccggaagcagattggtctcctttccttcttctgcgcggcgcttcatgctctttacagtttttgtttgcccttgcggcgggctcacagatacgacctcgttaatcttgctgtgaaacaggtccttgcaaacaagtcacacctatgggtggaagaagaggtatggagaatggaaatctacttgtcactaggagttcttgccctgggcactctcagcctgctggccgtgaccagcctgccatctatcgctaacagccttaactggcgcgagttcagtttcgtgcagtcaagcctcggcttcgtcgcactggtcctgtccactctacacactttgacctatgggtggactcgcgcgtttgaggaatctaggtacaaattctatttacctcctacattcacactgactttgctcgtgccttgcgttgtaattttggctaaagccctgtttctactcccatgtatcagcaggaggcttgcacgaattcgcagaggatgggagcgggagtctactattaaatttacactacctaccgatcacgctttggcagaaaagaccagccacgtatag

SEQ ID NO: 136358 - DNA, 1374 bp, Artificial Sequence
  Description of Artificial Sequence: Synthetic coding sequence
atgccagaggagatggataaacctctcatttctctccatcttgtcgactctgattcctccctggctaaggttccagacgaggctcccaaagttggcattctaggctcaggcgacttcgccagatcactcgctacacgtctcgttgggtcagggtttaaggtcgtggtgggaagtcggaatccaaagagaaccgcgcgattattcccatccgctgctcaggttactttccaggaggaggctgtcagtagccccgaggttattttcgtcgccgtcttccgagaacattactcctctctgtgctccctgtcggatcagttggcaggcaagattctggtggatgtgtctaacccaactgagcaggaacatctgcagcatcgagaaagcaacgccgagtacctggctagcctcttccctacttgcacggttgttaaagcgtttaatgtgattagcgcctggaccctacaagcagggccccgggatggcaacaggcaggtcccaatttgtggtgaccagcctgaggcaaagagagcggtctccgagatggccttggccatgggattcatgcctgttgacatgggctccctggcatcagcgtgggaggtggaagccatgcccctccggctgctccccgcgtggaaggttcccacccttctggcactcggactatttgtctgtttttacgcttacaactttgtgcgggacgtgctgcagccgtacgtgcaggagagccagaacaagttcttcaaactgcccgtgagtgtcgtgaatacgaccctgccctgcgtggcctatgtcctgctgtcccttgtatacctcccaggcgttctggctgccgccctccagctgagacgagggactaaatatcagagatttcctgattggcttgatcactggctccagcacagaaaacagatcgggttgctgagttttttttgcgcagctctacatgcgctgtatagtttttgcctacctttacggcgggctcatcgatatgacctggtaaacctagccgtgaagcaagtcctggccaataaaagccacctgtgggtggaggaagaggtgtggaggatggagatctatctgagtctgggagtcctggcattaggaactttgtccctgctcgctgtgacttccctgccctccatagctaacagcttaaactggcgggagtttagtttcgtacagtgcgtggctacaagttctgcgggcaataccggttccggaacccggagacccgaatcacagagccaggacccccacctgcccgccccgcatcaccagacctctttcctcgggcctcgttctttctgctgcagcctagtgcctgtgtcaactccatacggtcaccaagaggatctgtcatggacaagatag

SEQ ID NO: 136359 - DNA, 432 bp, Artificial Sequence
  Description of Artificial Sequence: Synthetic coding sequence
atggaaatttatctgagtctcggggtgttggctctggggacattgagcctgctggcagtaacttccttgccaagcattgcgaacagtctgaactggagagagttctcttttgtgcaatcaagtctcggcttcgtggcactagtgctgagcacacttcacaccctcacctacggctggacaagagccttcgaggagtccaggtacaaattctatctcccccccacatttaccctcacactgctagtgccctgcgtggtgattctggcaaaggccctttttctcctcccctgtatttcaagacgcttggctcggatacgtaggggatgggagcgggagagcaccataaagttcaccttacctacagaccatgccctgagtccgcttgggttcctgttcctggtagtccagagcggaattactgtctgtaagtag

SEQ ID NO: 136360 - DNA, 852 bp, Artificial Sequence
  Description of Artificial Sequence: Synthetic coding sequence
atggagaagacatgcattgatgccctgcccctgacaatgaattcttccgagaaacaggaaaccgtgtgcatctttggcaccggcgatttcggtaggagcctgggccttaagatgcttcaatgcggctactcagtcgtgttcggatctcggaacccacagaagaccacgttgcttcccagtggagccgaagtgttgtcatacagtgaggccgcgaagaagtcaggaatcatcatcattgctatccaccgtgagcattacgactttctgactgaactgaccgaggtcctgaacggaaaaatcctcgtggacatatccaataatctgaagataaaccagtaccccgagtcaaatgcagaatatttggcccatttggtcccaggagcacatgttgtgaaggcttttaacaccatctccgcctgggctcttcaaagtggtgccctggatgcctctcgccaagcaatcctgaagaaagaaaacccattctctacatcttcagcttggctcagtgactcttacgttgccttagggattctaggtttctttctctttgtcctgttggggataacatcacttccaagcgtctctaatgccgtgaattggcgggaattccgttttgtacagtctaaattgggctatctcacgctcattctttgcacagcccataccctggtgtacgggggcaaaaggttcctgagcccgtctaacctgaggtggtacctccccgcagcttacgtgctgggcttgattatcccttgtactgtgctggtcattaagtttgttctcataatgccctgtgtggataacactctgaccagaattaggcagggttgggaacgcaattccaagcactag

SEQ ID NO: 136361 - DNA, 1380 bp, Artificial Sequence
  Description of Artificial Sequence: Synthetic coding sequence
atggagaaaacctgtattgacgctctacccctgaccatgaactcgtctgagaaacaggaaacagtgtgcatcttcggcactggtgactttgggagatcactgggcctgaagatgctccagtgtgggtacagtgtcgttttcggatcacgaaatccacagaaaacaactctgctgcctagcggggctgaggtactgagctattctgaggccgcaaagaagagcggcattatcatcatcgccattcaccgcgagcattacgatttcctcactgagctgacagaagtattgaacggcaagatcctggtggatatctcaaacaacttgaaaattaatcagtatccagaaagcaacgctgaatacctggcccacttagttcctggagcacatgtggtgaaggccttcaatacaatcagcgcttgggcccttcaatctggtgctctggatgcatcaaggcaagtctttgtatgtggaaacgactctaaggccaaacaaagggttatggatattgtacgcaacctgggcttgaccccaatggaccaaggtagcctgatggccgcgaaagaaatcgaaaagtaccccctgcagctttttcccatgtggcggttccctttctacctcagcgcagtactatgcgtgtttctgtttttttactgcgtgatcagggacgtgatttatccttacgtctacgaaaaaaaagataatacgttcagaatggctatttcaatcccaaacaggattttccctatcactgccctgacactcctggctctagtatacctcccaggggtgattgcagctatactccaactgtacagaggaacgaagtaccgccgcttccctgattggctggaccactggatgctctgcagaaaacaactggggctggtcgcattggggttcgcgttcttacacgtactctataccttagtgattccaatcaggtactacgtccgctggcggttgggtaatcttactgtgacacaggcaattttgaaaaaagagaatccctttagcacttcctccgcctggctcagtgacagctacgtcgccttgggaattttaggcttctttctgtttgttctgctgggaattacatcgcttcccagtgtttcaaacgctgtcaattggcgcgagtttagatttgttcagtccaaactgggctacttaacactaatcctttgcacagcgcacactctggtgtatggaggaaagagattcttatcaccaagtaatctacgatggtatctgcccgccgcatatgttcttgggctcatcataccatgcaccgtgctcgttatcaaatttgttctgataatgccctgtgtcgataataccctaacgaggatccgccagggatgggaacgcaatagcaagcactag

SEQ ID NO: 136362 - DNA, 1080 bp, Artificial Sequence
  Description of Artificial Sequence: Synthetic coding sequence
atgcctgctcacctcctccaagacgacattagttcttcctacactaccacaaccactattacagccccaccttctcgggtgctgcagaacgggggcgataaacttgagactatgcctctctatttggaagacgacattaggccggatatcaaagacgatatttacgatccaacgtacaaagataaggaggggcctagtccaaaggtcgagtatgtgtggcgcaacataatactaatgtctctcttgcaccttggtgccctctacgggattactctgattcctacctgcaagttctatacctggttgtggggagtgttttattacttcgtgtccgcgctcggcattaccgccggagcacaccggctttggtctcaccgctcatacaaagccagactgccattgcggctgtttctgattatcgctaataccatggccttccaaaacgatgtgtacgagtgggccagagaccatagagcccatcataagttctctgaaacccacgcggacccacataacagcaggcgagggttctttttttcgcacgttggctggctcttggtcagaaagcaccccgcagtcaaagaaaaaggttccacgctcgacctgtcggatctggaggctgaaaagctggtgatgtttcaacggagatactataagccaggcttacttatgatgtgcttcatcctgcccacactggtcccttggtacttctggggggaaacatttcagaatagtgttttcgtggccacctttcttcggtatgcagtggtgcttaatgccacttggctggtgaattccgccgctcacctgttcggatacaggccatacgacaaaaatatctcacctagggagaatatcctcgtgtcactaggcgccgtcggagagggtttccacaattatcaccattctttcccatatgactactctgcctccgagtaccgatggcacattaatttcacaactttttttatagactgtatggcggcactcggcctggcttacgatagaaagaaggtatctaaggcagctatacttgcaaggattaagcggactggagacgggaattacaagagcggttag

SEQ ID NO: 136363 - DNA, 729 bp, Artificial Sequence
  Description of Artificial Sequence: Synthetic coding sequence
atgccagcccatttgctgcaggacgatatctcttcctcctatacaactacaactacaataacagctcccccgagcagggttctgcagaacggtggagataaattagagacaatgcctctctaccttgaggatgatattcgaccagacattaaagatgacatctatgatcctacctataaagataaggaagggcccagtcctaaggttgagtatgtttggcggaacatcatcctgatgtccctcctccatctcggggccctgtacgggattacacttattcccacgtgtaaattctacacctggctttggggagttttctattacttcgtctctgccctcggcatcacagccggagctcaccgtctctggtcccaccggtcctataaggctagactgcccctccgcttattccttattatcgccaataccatggccttccagaatgatgtgtatgaatgggccagagaccatcgggctcaccacaaattctctgaaacgcacgctgaccctcataactcaaggagaggcttcttcttttcccatgtgggttggctcctcgtacgcaaacaccccgccgtgaaagagaaagggtccacactggacctatctgatttagaggcagaaaaactggtgatgttccagcgtcggtactataagcctggactactcatgatgtgctttatcctcccgacactggtgccgtggtatttctggggggaaaccttttag

SEQ ID NO: 136364 - DNA, 813 bp, Artificial Sequence
  Description of Artificial Sequence: Synthetic coding sequence
atggcctgccggccccgttcaccaccccgccaccagtcccggtgcgatggcgatgcctctcccccatcacccgcacggtggagtctaggccgcaaacgcagagctgatggccggcggtggcgtccggaggatgcggaggaggcagagcatagaggggccgagcggaggccagagtcatttactactcccgagggccccaagcctcgttcacgttgctctgactgggctagcgccgtggaggaggacgaaatgcgtacccgcgtcaataaagaaatggccagatacaaacgcaagctgctcataaacgatttcggaagagaacggaaatctagttctgggagcagtgacagtaaggaaagtatgtcgaccgtgcctgcagatttcgaaactgacgaaagtgtcctgatgcgcaggcaaaagcagattaactatggaaagaacactatcgcctatgatagatacattaaggaggtcccacgccatctcaggcagcccggcatccatcccaagactcccaacaagttcaaaaagtacagccgtcggtcctgggatcagcagattaagctctggaaagttgccctccatttttgggaccccccagccgaggagggctgtgatctccaggaaatccaccccgtcgatttagagtccgccgagtcctcttcagaaccacagactagctcacaggatgacttcgatgtgtacagtgggaccccaaccaaggtgcggcatatggatagtcaggtagaggatgagtttgacctggaggcctgcttgactgagccacttcgagacttcagtgctatgtcctag

SEQ ID NO: 136365 - DNA, 5328 bp, Artificial Sequence
  Description of Artificial Sequence: Synthetic coding sequence
atggcactcagtctgtggcctctcttacttttgctgctgttgcttcttctcctgagcttcgccgtcaccctggcacctaccggacctcattctctcgatcccggcctcagctttcttaaatccctgctctctacgctggatcaggcgccccagggatctctaagcagaagtcgttttttcacttttctagcaaatatttcctcctctttcgagccgggtaggatgggtgagggtccagtgggtgaaccccctccactgcaaccccctgccctccgcctgcatgatttcctggtcactctgagggggtcccccgattgggagccaatgctggggctcttgggagatatgctcgcactgctgggtcaggagcagacaccaagagattttctggtgcatcaagccggagtcttgggcggactagttgaagtgttgcttggtgctctcgttcccggcggaccgcccacccccaccagaccaccctgcacacgggacggcccaagtgactgcgtgctcgccgccgattggctgccaagcctactgttgcttttggaaggcacaagatggcaggctttagtacaagtgcagccaagcgtggatccgaccaatgcgaccggactggatggccgcgaagcggcaccccattttttgcaaggactgctgggtctgctgacacccaccggcgagctcggctctaaagaggccctttggggagggctgcttcggactgtgggagcaccgctctatgctgctttccaggagggtctgcttagagtcacccactctctgcaggacgaggtgttctctatactgggccagcctgaaccagatactaatggacagtgtcaggggggtaacttgcagcagttgctgctctggggggttagacacaacctgagctgggacgtacaagctttgggattcctgtccggttcacctccccctcctcccgctctcctccactgtttatccaccggcgtgccgcttcctagggccagtcagccatccgcacacatttcaccaaggcaaagacgggccatcacggtggaagccctgtgcgaaaaccatctcggtcccgcacctccgtatagtatctccaatttttccatacatctgctctgccagcacactaaacctgctaccccacagccgcatccttcaactaccgctatttgtcagacagctgtttggtacgcagtgagctgggccccaggtgcgcagggttggctccaggcctgtcatgatcagtttccagacgagttcctggatgctatctgctctaatctctcgttcagcgccctctctggatctaacagacggcttgtgaaacgcctgtgcgccggacttttgccgccccccacctcatgccccgaggggctccccccagtccccctgactccagatattttctgggggtgtttcttggagaatgaaaccctgtgggctgagcgtctgtgcggcgaagcttccctgcaggccgtcccccctagcaaccaggcttgggtgcagcacgtgtgtcagggccccactcctgacgtaactgcctctcctccatgtcatatcggaccgtgcggcgaacgctgcccagacggagggagttttctggtcatggtttgcgcaaatgacactatgtatgaggtgctcgtcccgttctggccctggctggccggacagtgtcgcatcagcagggggggcaacgatacatgctttctcgaaggcctgctgggtcccttgctgccgtcgttgcctcccctcggaccctcccccctctgccttacaccaggcccctttttattaggaatgctctcccaactgcctaggtgccagagcagtgtgcccgctctcgcgcaccctacccggctccactacctgctccggctattgactttcctcctcggcccaggggctggaggcgctgaagctcagggcatgctgggacgggcactcctgctctctagtctgcctgacaattgttccttttgggatgcctttcggcctgaggggcggcggtctgtgctgagaactattggtgagtacctggagcaggatgaggagcagccgaccccctctggctttgagccgaccgtaaacccaagttcggggatctcaaaaatggaacttttggcctgcttctcacccgtcctatgggatctcttacagcgtgagaaatctgtgtgggcgctgcagatactcgttcaggcctatctgcatatgcccccggagaacctccagcagctggtgctgtctgctgaacgtgaggctgctcaaggtttcctaactctgatgctccaaggaaagctgcaggggaagttgcaagtgcccccaagtgaggaacaggccttaggcaggctgaccgcccttctgttgcagagatacccacgcttgacgagtcagttgttcattgatttatctccactcattccatttctggcagtatcggatttgatgaggtttccaccttccctcctggcaaatgatagtgtgctagcagccatcagggactactccccagggatgcggcccgagcagaaggaagccctcgcaaagaggctgttagcgcctgaattgtttggtgaagtgcccgcatggccgcaagaactgctctgggcggttctgccactcctcccccacctgccgctggagaacttcctccagctcagcccacaccagattcaggccctggaggacagttggcctgccgcgggcctcggccctggacatgcccgtcatgttttgcgaagcctcgttaatcagagcgtgcaggatggggaagagcaggtgaggcgcctgggtccgctggcctgttttttatcacccgaggaacttcagagcctggtcccgcttagcgaccccaccggacccgtggagcggggtttgctggaatgcgctgctaacggaactctgtcacccgaaggcagagttgcatacgagcttcttggggtccttcgcagcagtggaggagctgtgttatcacctcgggaacttcgagtgtgggctcccctcttcagtcagctgggattaaggttcctccaggagcttagcgaaccccagctgagagctatgctccctgtgctgcaaggcacaagcgtgacacccgctcaagctgttctactgctcggccgtctgctgccccgacatgacctatccctcgaggagctgtgttccctgcacctcttacttcctggattgagcccccaaacattgcaggcaatcccccgccgggtcctggtcggtgcttgctcatgtttagcccctgagctctctagactctctgcctgccagacagctgctctgctgcagacctttagggtgaaagatggggtgaaaaatatgggcaccaccggggccgggcctgccgtgtgtatcccagggcagcccatccctacgacctggcctgattgcctcttaccccttctgccattgaaattgctccagttggacagcctggctctcttggcaaataggagacgctactgggaactcccatggtctgagcagcaggcccagtttctgtggaaaaaaatgcaagttcctaccaatctgaccctacgaaatctccaggcgctaggcacattagccggtggaatgagctgcgagttcctgcaacagattaacagtatggttgatttcttagaagtcgttcatatgatctatcaattacccacacgagtgcgcggttcccttagagcctgcatctgggcagaattacagaggcggatggccatgcccgagccagaatggaccacagtcggccctgaactaaacggcctggactccaaactgctgctggacctgccaattcagctgatggacaggctcagtaatgagtccatcatgctcgtagttgaactggtccagcgggctcccgagcagctccttgccctcacaccccttcaccaggcagctcttgcagaaagggctctccagaatctcgcccccaaggaaacacccgtgtctggagaagtgcttgaaactctgggccctctagtcggcttcctcggcaccgagagcacgcggcagatcccactacagattctcctttcacacctgtcgcagcttcagggattctgtctgggtgaaacgtttgccacggagctcgggtggctcctgttgcaagaatccgtattggggaaacccgagttgtggtctcaagacgaggtggagcaggcggggcggctagttttcaccctctccacagaagctatctctttgataccacgggaggcactaggcccagaaacattggagaggttgctcgagaaacaacaatcctgggagcaatctcgtgtgggtcagctctgtcgtgagccgcaactcgcggccaagaaagcagccctcgtcgccggagtggtcaggccggcggccgaggacctccctgagcctgtgccaaattgcgccgatgtgcgaggaacctttccagcggcctggtctgctacccaaatagcagagatggagttgagcgattttgaagattgtttgactcttttcgccggtgatcccggactgggccctgaggagttaagggccgccatgggaaaggccaagcagctctggggcccaccccggggatttaggcccgagcagattttgcagttagggagactcctgatcggcctgggagatcgcgagctccaagagttgatcctagtggattggggagtgctgagcacccttgggcaaattgacggctggtcaaccacacaactccgcattgtagtaagtagttttttaagacagagcggtaggcacgtgagccatcttgacttcgtccatctgacagcgttaggatatactctgtgcggcctgagaccggaagaactccaacacatttcaagttgggagttcagccaggccgctttgtttctcgggaccctccacctccagtgtagcgaagagcagttggaggtgctggcccatctgctggttctgcctggcggatttggacccatctccaactggggccccgagatctttaccgagatcggcacaatagcagccggcatacccgatctggctctgtccgccctgctgaggggccagatacagggtgtcacaccgctcgcgatttccgtgatccctccaccgaagttcgcagttgtgtttagcccaattcagctctcttccctgacctcagcacaagccgtggccgtgactcccgagcagatggcttttctgtcacctgaacaacgcagagccgttgcttgggcccagcacgagggcaaagagtcacctgaacaacagggccggagcacagcatgggggcttcaggattggtctagaccgagttggtcgctagttcttacaatttcattccttggacacttactgtag

SEQ ID NO: 136366 - DNA, 1056 bp, Artificial Sequence
  Description of Artificial Sequence: Synthetic coding sequence
atggccctgtcactctggccgctgcttcttttactcctgttactgttacttctcagttttgcagtgacactcgctcctacaggtccgcacagcttggatcccgggctgagtttccttaagtctttgctcagcacactcgaccaggccccacaaggatcgctttcacgctctagattctttactttcctggctaacatctcaagctccttcgaaccaggccgcatgggggagggtccggtaggtgaaccccccccccttcagcctcctgcacttcgactccatgactttcttgtgactctaagagggtctcccgattgggagcctatgctggggcttctcggggacatgctggccctgctcgggcaggagcaaactccaagggactttctcgtccatcaggccggcgttctgggagggctggttgaagtgctccttggggccctcgtgcccgggggacctcctaccccgacacagccaccatgcactcgagacggcccttccgactgtgtgctggccgcggattggttgccctcactgttactgttgctggagggtacaagatggcaagccctggtgcaggtgcaaccctccgtggatccgactaacgcaaccgggttggatgggcgtgaggcggcaccacattttctgcagggtctgcttggtttgcttactcctacaggcgagttgggcagcaaagaagctctttggggcgggctcctgcgtaccgttggggcccccctctatgccgccttccaagaaggtttactacgagtgactcacagcctacaggacgaagtattttcaattttgggtcagccggaacctgatacaaacggtcagtgtcaaggcggaaacctgcagcagttgcttctttggggggttagacacaacctctcttgggacgttcaggcactgggctttttgagcggtagtccacctcccccacccgccctgctgcattgtctgtctacaggcgtgcctctgccccgagcatctcagccgagtgcccatatctccccaagacaacgccgcgccataactgtagaggctttgtag

SEQ ID NO: 136367 - DNA, 5328 bp, Artificial Sequence
  Description of Artificial Sequence: Synthetic coding sequence
atggccctatctctttggccactgctgctgcttctgttgctcctgctcttgctgtcattcgccgtgaccctggctcctacaggtccccactctctggatcctggcctgagtttcctgaagtccttgctgagcacgctggaccaggctccacagggatctctgtcccggtctagattctttacttttctcgccaacatttcttcctcattcgaaccaggacgcatgggcgagggccccgttggtgagccacccccattacagccgccagccctgcgactccacgatttcctcgtgaccctaagaggttcccctgattgggagcccatgcttgggctcctgggcgacatgctggctctcctgggccaggagcaaaccccacgcgactttctggtgcaccaggcgggagtcctgggaggactagtagaggtattgctgggggcactggtccctggcggcccacccacacctaccagaccaccctgcacccgggatggcccttccgattgtgtgctagccgcagattggctaccaagcttactgcttctgctcgaagggacccgatggcaggcccttgtccaggtacagccctcggttgacccgaccaatgccaccggcctggacgggcgagaagccgctcctcactttttgcaagggttgctcgggttgctgacacctaccggggagctgggttcaaaggaagccctctggggtggactgcttagaaccgttggcgccccactgtacgcggcgttccaagagggtctgcttcgcgtgactcactctctgcaggatgaagtgtttagcattctgggtcagccagaacctgacacgaatggccagtgtcagggagggaacttacaacagctgcttctgtggggtgtccgtcacaatctttcatgggatgtgcaggcacttgggtttttatcaggatctccccccccaccccctgccctgctgcattgtcttagtaccggagttccactaccccgggccagtcagccttccgcccatataagccccaggcagaggcgagccataaccgttgaggcgctctgtgaaaatcatctcgggcctgctccaccctacagtattagtaacttttctatccacttgctttgtcagcataccaagcccgcaaccccacagccccaccccagtacaaccgccatatgtcagaccgcagtctggtacgcagtgtcctgggccccaggcgcgcaaggttggctccaggcctgccacgaccagtttcctgatgaatttctggatgcaatctgttcaaatctgagtttctccgctctgtctggctcaaatcgcagactcgtgaagcgcctgtgcgctggactgctgcccccaccaactagctgtccagaaggcttgccgccagtgcccctgacccccgacatcttctggggctgctttcttgagaacgaaactctatgggcagaacgactgtgtggcgaagcaagtctccaggccgtgccacctagcaaccaggcctgggtgcaacatgtctgccaggggccgaccccagacgtgaccgcatcccccccttgccacatcggcccctgtggggagaggtgtcctgatggggggagcttcctcgttatggtgtgtgccaacgatactatgtacgaggtgttagtccccttctggccatggctggccggacaatgtcgtatttcgagaggggggaatgacacctgtttcctggagggcctgctgggccccctgctgccaagtctgccacccctgggccccagtccactatgtttgacccccggaccatttctcctgggaatgctctcacagctcccacgctgccagtcttccgtgcctgctcttgcccatcctactcgtctgcattacctactgagattgctgacctttctcctcggccccggtgccggcggtgcagaggcgcagggcatgttgggacgtgccctgttgctgtccagtctgcctgataattgttcattttgggacgcatttaggccagaagggcggcggagcgtacttcgaactatcggggaatatctcgaacaggatgaggagcaacccactccgtctggattcgagccaactgtgaacccctcaagcggaatttccaaaatggagctcctggcctgtttttcccccgtgctttgggatcttttacagcgggagaagtctgtgtgggcactgcagattctagttcaagcctacctgcacatgcctccggaaaatttgcaacagttggtgctctccgctgagcgtgaagctgcacagggtttcctgacactgatgcttcagggaaagttgcagggcaagctgcaggtgcctccttccgaggagcaagcacttgggcggctcactgcccttctccttcagcgatatcctagactaacatcccaattgtttatcgatctgtcccctcttatcccattcctcgcagtgtcagatctcatgcgtttccctccctccctacttgcgaatgatagcgttctggcagccatccgagactacagccccggcatgcgccccgaacagaaagaagcacttgccaaacgcctgttggctccagaactattcggggaggttcctgcctggccccaagagctgctctgggccgtcttaccactgctccctcacctgcccctggagaactttttgcagctaagtccacaccaaatccaggcacttgaggacagctggccggcagccggactgggccccggacacgcccgccacgtattacggtcactcgtaaaccagtcagtgcaggatggcgaggagcaggtgcggcgcctgggtcccctggcatgtttcctgtcccccgaagaactgcaatctctggtccccctgtcagacccaacaggccccgtggagaggggactcctcgaatgtgccgcgaacggcactctctcacctgaggggagagtggcctatgagctcctgggagtccttcggtcttctggcggcgccgtgctatctccacgagaactcagagtctgggcaccactgttctcccaactggggcttcgatttctgcaagaactgagtgagcctcaactgcgggcaatgctgcccgtactacagggcacctcagtgactccagcccaggccgtgcttctcctgggaagactgctcccccgtcacgacctgtcactcgaggagctgtgctcattacacctgctgctccccggattatcaccgcagacactgcaggctatccctcgtagggtcctagtcggtgcttgctcctgtctggctcctgagctgagcagactcagtgcctgccaaactgccgccctgctccagaccttcagagtaaaagatggcgtgaaaaatatggggacaaccggggccggccccgctgtatgtatccccgggcagccaattcccaccacctggccagattgcctgctgcccttactgccactgaagctcttgcaactggattctctggccctcctggccaacaggaggagatactgggagttgccctggtcagagcagcaggcccagttcctctggaaaaagatgcaggtcccaacaaacctgacccttcgcaatttgcaggcactaggcaccctggccggtggtatgagctgcgagtttctccaacagataaactccatggtagacttcttggaagtggtccacatgatttaccaactgcctactcgcgtccgcggatctctcagggcctgtatttgggcagaactccagcggcgtatggccatgcccgaacccgagtggaccacagtggggccagaactaaacgggctcgattccaaactgctgttggatctcccaatacagctcatggacaggctgagcaacgaaagtatcatgctcgtggtggagctggttcagcgagctcccgagcagctgctcgctctgacaccccttcaccaggccgctctggccgaacgcgcgttgcagaacctggcacccaaggaaaccccggtgtccggggaagtgctggaaacactcggtcctctggtgggtttcttgggtacggaatccacaaggcaaatcccactgcagatcctcctgtctcacttgagccagctgcagggcttttgtctgggcgagacattcgctaccgagttaggctggctacttctgcaggaaagcgtgctgggcaaaccggaactgtggtcgcaggacgaggttgaacaggccggcagactcgtgttcaccttgtctacagaggccatttccctcatcccccgtgaggccttggggcccgagacactcgagcggctgctagagaaacagcaaagctgggaacagtccagagtcggccagctctgccgcgaacctcaattagctgctaagaaagctgccctcgtcgcaggagttgtgcgtccagcagcagaggacctgccggagccggtccccaattgcgctgacgtgaggggtacgtttcccgcggcttggtcagcaactcaaattgccgagatggagttgtctgactttgaggattgcctcacattgttcgcaggcgatccaggattgggaccagaggaactccgcgcagccatgggaaaagctaagcaactgtggggtccacccaggggcttccgacctgagcagatcttgcaactgggacgcctcctgatcggtcttggcgatagggaattgcaggagttaattctcgtagattggggcgtcctgtccaccctgggacagatcgacgggtggtccactacgcagctgcggatcgtcgtctccagtttcctcagacagagtgggagacacgtgtctcatctcgatttcgtgcatctgacagctctcgggtatacactgtgtggactcagacctgaagaacttcagcacatttcttcttgggaattctcacaagccgctctcttcctgggaacactgcatttgcagtgcagcgaggagcagttggaggtgttagcccatctgttggtgctgcctggaggcttcggaccgattagtaactggggccccgagatattcaccgagattggtaccattgctgctggtatcccagacctcgcacttagcgccttactgagaggtcagatacaaggtgtaactcctctcgccatttccgtaattccccccccgaaattcgctgtcgtctttagtcccatccagctgtctagccttacatccgctcaggccgttgcagttacccctgaacagatggcttttcttagccccgaacagcgaagagccgtggcctgggctcagcacgagggcaaggagagccccgagcagcagggcaggagcacggcgtggggtcttcaggactggtctagaccttcttggagcctcgtattgactattagtttcttaggacacctcttgtag

SEQ ID NO: 136368 - DNA, 1056 bp, Artificial Sequence
  Description of Artificial Sequence: Synthetic coding sequence
atggccctgtccctctggcccctgctgctgctgctgctgttgctgcttctccttagctttgctgtgaccctggcccccacaggcccccattctctggatcctgggctcagtttcttgaaatctctgctgtctactttggaccaagctccacagggctccttgagcaggtcaaggtttttcacatttttggctaacatatccagtagtttcgagcccggccgcatgggcgagggccctgtgggggaaccccctcccctgcagccccccgcactgcggctgcacgactttctcgtcaccttgcggggctctcctgactgggaaccaatgctcggcctgcttggagatatgttggccttgttgggacaggagcaaacccccagagattttctcgtacatcaggctggtgttctaggcggcctcgtcgaggttctacttggggctcttgtgccaggaggcccccctacccctacgaggccaccgtgtacacgagatggtccctctgattgtgtcctagcagccgactggctgccctctctgttactacttctggaggggacaagatggcaggccctggtccaggtgcagccaagcgtggaccccaccaacgcgactggcctggatgggcgagaggctgccccacatttcttacaaggactgctcggcttgcttacacccacgggtgaactggggagcaaagaagcactctggggcggcctcctgagaaccgtgggcgcccccctttatgccgccttccaggagggactgttgcgcgtcacccactctctacaagatgaggtgttcagtattcttggccaaccagagcccgacaccaatggtcaatgccaggggggcaatctgcaacagctgctgctttggggggtgcgccacaatttaagttgggacgtgcaggctctcggatttctgagcggcagccccccaccgccaccggccctgctgcactgcctgtccactggggtgccattacctagggcctctcaacccagcgcacacattagcccaagacagaggagggctatcacagtggaggctctgtag

SEQ ID NO: 136369 - DNA, 2100 bp, Artificial Sequence
  Description of Artificial Sequence: Synthetic coding sequence
atggcattgtccctgtggcctttgctccttttgcttcttcttttactcttgctgagttttgcggtcacactggccccaacaggaccccacagcttggatccagggttgagtttcctgaagtctctgttaagcacactcgatcaggccccacagggcagcctgagcagaagccggttcttcacatttcttgccaacatctcctcatcctttgagcccgggcgcatgggcgagggcccagtgggcgagccccctcctctccaacctcccgctcttcggctgcacgattttctcgtgactttacgcggaagtcccgattgggagcccatgttgggcctgctgggcgacatgctcgccctgttggggcaggagcaaaccccaagggactttctggttcaccaggcgggagtgctgggcgggctggtcgaggtgttactcggggcattagtgcccggcggccctcccacccccacgcagccgccgtgtacacgggatggaccttcagactgcgtcttggccgcggactggctgcctagcttacttttgctgctggagggtacaagatggcaagccctggtacaggtgcagccatctgttgaccctacaaatgcaaccggactggacggccgggaggcagccccccactttttacaagggcttctcggattgttgactccgaccggcgagctcgggtccaaggaggccctgtgggggggcctgctcagaactgtgggcgctccactctatgctgccttccaggaagggctattacgggtgacacactccctccaggatgaggttttctccattttgggccaacccgaaccagataccaatggacagtgtcagggcgggaacctccaacagctgcttctgtggggagtgcggcacaatcttagctgggatgtgcaggctttaggttttctaagcggaagccctcctcccccaccagcgctgctccactgcctgagcactggcgtgccattacccagagcctcccaacccagcgctcacatctcccctcgccagagacgggctataaccgtggaagctttgtgtgagaaccacctgggcccggccccgccatactcaatttctaacttctcaatccatctcttgtgtcagcacaccaaaccagccactccgcagccccatccaagcactacagccatttgccagactgccgtgtggtacgccgtatcttgggcaccaggtgcacagggatggctccaggcctgccatgaccaattccccgatgagttcctcgacgccatttgcagcaacctgagcttttctgctttgagtggatcaaataggcgcctcgtcaagcgcctctgcgcaggcttgctcccaccacctacaagttgcccagagggacttccaccagtcccactaactccagacatcttctggggatgcttcttggaaaatgagactttatgggcagagcggctctgtggtgaagcttccctgcaagccgtccccccgagtaaccaggcctgggttcagcacgtgtgccagggccccaccccagatgtcaccgccagtcctccatgccatattggcccttgtggggagcgttgtcctgatggtgggtcgttcctcgtgatggtgtgcgcaaacgataccatgtacgaagtgcttgtacccttctggccttggcttgcaggacagtgcagaatcagccgtgggggaaatgacacatgctttctggagggattgctgggccctctcctcccctctctgccccctctgggccccagcccattgtgtctgaccccaggaccatttctgctcggaatgctgagccaattaccccggtgccagtcctcagtccctgcccttgcccatcccacacgacttcattatttgctacgactgctaacattcttgctgggtcccggagcaggtggtgccgaggcccagggcatgctcggtcgggccctgctcctgtccagtctccccgacaactgttcattttgggacgctttcagacccgagggaagacgctccgtgctccgcacaattggcgaatataacaaaatgaggagctcacagccgcaccaggctctgaatccactgtctaccccggccctggtgtag

SEQ ID NO: 136370 - DNA, 3009 bp, Artificial Sequence
  Description of Artificial Sequence: Synthetic coding sequence
atggagctgcttgcttgtttttcccccgtgctgtgggatctgctgcagagagagaagagcgtgtgggctctccagatcctggttcaagcctatctgcatatgcctcccgaaaacttgcagcaactggtactctctgccgagagggaagccgcccagggcttcctgacattaatgctgcaggggaagttgcaggggaaactgcaagtgccaccctccgaggagcaggctcttggtcgtttaactgccctgctgcttcagaggtacccccggctcacgagccagcttttcatcgatctttctcccctcattcctttcctggctgtgagtgacctcatgcggtttcctccatctctgctggccaacgattctgtccagcagggataccgaggctctgaggagaacagccttgaggaagacaaggggttgcgaccaatgactcctaggtccctggcagcaatccgcgactacagccccggtatgagaccggaacagaaagaggccctcgcaaaaaggctgctggcccccgagctctttggcgaggtacctgcatggcctcaagagctgctctgggccgtgctgcccctgctcccccacctccctctggagaactttctgcagctctctccccatcaaatccaagcactggaagatagctggccagcggcgggacttggtcccggccacgccagacatgtcctgagatctctagtgaatcagtcggttcaggatggagaagaacaggtacggcgactgggcccactggcatgttttctgtcgcccgaggagttgcagtccttagtcccactgagtgatcctacagggccagttgagaggggtcttcttgaatgcgctgctaacggcactctatcccccgagggaagggtggcatacgaattgcttggagtattgcgctctagcggtggcgctgtactgtctccgcgggaacttcgcgtgtgggccccccttttctcgcagttgggactgaggttcctccaggaactgtcagagccccagctcagggccatgctgccagtgctccagggaacgagcgtgacaccggcccaagccgtgctgctgctcggacgtctgctgccccggcatgacctcctccagctggactctcttgcgttgctggccaaccggagaaggtattgggagctgccttggagtgagcaacaggcacaatttttgtggaagaagatgcaggtgccaaccaatctcaccctccgaaatctgcaagcactgggaactctggccggaggcatgagctgtgaattcctgcagcagattaatagtatggtcgattttctcgaggtggtgcatatgatataccagctgccaactcgcgttagggggagccttcgcgcctgcatatgggccgagttgcagaggcggatggccatgccagagcccgagtggaccactgtcggacctgagttgaatggcctggattcgaagctgctccttgatcttcccatccagctaatggatcggctgtctaacgagtctatcatgctggtagtggaactcgtacagagggcacccgaacagttgcttgccctgactcctcttcaccaggctgcactggctgagagggccttgcagaatctcgcaccgaaggagaccccagtcagtggtgaggtccttgagactttggggcctttagtgggtttcctgggtacagaatccacacgccaaatccctctgcagatcttgctttctcacctttcccaactgcagggcttttgtttaggagagacatttgctacagaactcgggtggctgctgctgcaggagtctgtcctgggtaaaccggagctgtggtcccaggacgaagtggagcaggccggacgcttggtgtttacgctgtcaacggaggcgatctcgcttatccccagagaagcactaggtccagaaaccttagagcgcctgctggagaaacagcagtcctgggaacaaagtcgtgtcgggcagctctgtagagaaccgcagctggccgccaagaaggctgcgttggtagctggcgtggtccgtcccgcggcagaagacttaccggaaccggtccctaattgcgcagatgtaagaggtacattcccagcggcctggagtgcaacccagattgctgagatggaactcagcgacttcgaggattgtctcaccctatttgccggtgacccggggctgggcccagaggaactgagagcagccatgggaaaagctaaacagctttgggggccacccagggggtttcgacctgagcagatccttcaattgggccggctgctcattggtctcggggaccgcgagctgcaggaactgatactggtggactggggggttctcagtactttagggcaaatcgatgggtggtctaccacacagttacgaattgttgtgagcagctttcttaggcagtcagggcgccacgttagtcacctggattttgtgcatctgaccgcgctgggttatactctgtgcggcctaagaccggaagaactgcagcacatcagtagctgggagttttcccaggccgctctcttcttaggcacattgcatctgcagtgctcggaagagcaacttgaggttttggctcatctacttgtgttaccagggggattcggccccatatccaactgggggcccgaaattttcacagaaatcgggactattgcggcaggcattcctgatttagcactttccgctttattgcgagggcaaatacagggagttacaccgctggctatctctgtgatacctcctcctaagtttgccgtggtgttttctcccatacagctgtcaagtcttacatccgcacaggcagtggctgtcactcccgaacagatggcttttctgtccccagaacagagacgtgcagtggcctgggcccagcatgaaggcaaggagtctccagagcagcaaggccgctccactgcctggggcctgcaggactggtctcgaccctcatggtctctggttctgaccatttcttttctcggccatctactgtag

SEQ ID NO: 136371 - DNA, 1890 bp, Artificial Sequence
  Description of Artificial Sequence: Synthetic coding sequence
atgttcagagatcaagtcggcgtgttggcagggtggtttaaggggtggaacgagtgtgagcagactgtcgcgctcctttcactcttgaagcgcgtgagccagacccaggctcgctttcttcagctctgcctggaacattccttagcagattgtgctgagctccacgtgctggaacgcgaggctaattccccaggtataatcaaccagtggcaacaggagtcaaaggataaggtcatctcactgttgctgacacacttgcctttgctgaagcctggaaacctggatgcaaaggtcgaatatatgaaattgttgccaaagatattggctcacagtatcgagcataaccaacacatagaagagtctaggcaactcctttcttacgcgctgatccatccagccacctctttagaggacagatctgctctggctatgtggttaaatcatttagaggatcgaacgtcaactagttttggagggcagaaccgcggacggtccgacagcgtggattatggccagacacattattatcatcagcgacaaaactccgatgacaaattgaacggctggcagaatagccgagattctgggatttgcatcaacgcctcaaattggcaagacaaaagcatgggatgtgaaaatgggcatgtgccgctgtacagcagctcgtcggtccccacaactattaataccatagggacttctacttctacgaacgtgcccgcatggcttaagtcactccgcctccataagtatgccgcccttttctcacagatgacctatgaggagatgatggccttaacagaatgtcaattggaagctcagaacgtgactaaaggggctcgccacaagattgtgattagtatccaaaaactcaaagaaaggcaaaatttgcttaagagcctggagagggacatcatcgagggtggcagcctaagaattcccctgcaggaattgcaccagatgatcctgaccccgattaaagcatactcatctccgtctactacccctgaagctcggaggagggaacctcaagctccacgacagccttcccttatgggacctgaaagccaaagcccagattgtaaagatggggccgccgccaccggagctaccgccacacccagcgcaggggccagtgggggcttgcagccgcaccaactgtcatcctgcgatggcgaattagctgtggcgcccctgcccgagggggacctgcctggacaatttacccgcgtgatgggcaaggtgtgtacccaactactggtttccagaccagatgaagaaaacatcagctcgtacctgcagctcatagacaaatgcttgatccacgaagctttcaccgaaacccagaagaagcggctcctgagctggaagcagcaagttcaaaagctgtttcggagtttcccccgcaagacactgttggacattagcggatacagacagcaaaggaatcggggctttggccaaagtaattccctccctactgccgggagtgtgggcggaggaatgggcaggagaaacccaagacagtaccagataccctctaggaatgttccatcagccaggctgggactgctcggcacctccggtttcgtctcatccaaccaaaggaatacaacggccactccaaccatcatgaaacagggccggcagaacctgtggttcgccaatcccggaggtagcaactccatgcctagcaggactcattcctctgtgcagaggacccggagcctccctgtccacactagcccccaaaatatgctgatgtttcagcaacccgaatttcagctgcccgttaccgagccagacatcaataatcgattggagtcactgtgtctctcaatgactgaacacgccttgggtgacggcgtggatcgcaccagcaccatttag

SEQ ID NO: 136372 - DNA, 1893 bp, Artificial Sequence
  Description of Artificial Sequence: Synthetic coding sequence
atgatgtttcgggaccaggttggggttcttgcggggtggtttaagggatggaacgagtgtgagcagacagttgcactgctctcactacttaagagagttagccagacccaggcccggtttctccagctttgtttagaacactccttagcagactgtgcagagctgcacgtgctcgaaagagaagcaaattctccaggcattatcaatcaatggcaacaggaatccaaagacaaggtgatttcactccttctcactcatttgcctctacttaaacccggcaacctcgatgccaaagtggagtacatgaaattactgccaaagatcttagcccattccattgagcacaaccagcacatagaggagtccagacagctactgtcttacgccctgatccaccccgcaacgtcacttgaggatcggagtgcattggccatgtggctgaatcatctcgaagacaggacctctacttcgttcggtggacagaatcgggggcgctcagactcagtggattacggccagactcattactaccatcagcgtcagaattcagacgataaactcaatggctggcagaactccagagattcagggatttgcatcaatgcctccaattggcaagacaaaagtatggggtgtgaaaatggccatgtgcctttatatagttcatcttcggtgccaaccactattaatacaattgggacctcaacctccacaaacgtgccagcctggctcaagagcttaagacttcacaaatatgccgccctcttttctcagatgacgtatgaggaaatgatggccctcaccgaatgtcaactggaggcacagaatgtaactaagggagccagacataagatagtgatctccattcagaagctcaaggaaaggcagaatctcttgaaaagtctagagcgtgatataatcgaaggggggagcctgcgcatccccttgcaggagctgcatcaaatgattctgactccgattaaagcctattctagcccgagtaccactccagaggcccggcgccgcgagccgcaggcccccagacaacctagccttatggggccagagagccagtctcccgactgcaaagatggtgcagctgccactggtgctactgccaccccatccgctggggcatcaggagggctgcaaccccatcagctgagtagttgcgacggggagctcgcggtggcaccgttaccggaaggggacttgcccgggcagtttactagggtcatgggtaaggtctgcactcagctcctggtgtcccgacctgacgaagagaacattagttcatatctccaactgattgacaagtgtctcatacacgaggcgtttaccgaaacccagaagaaaagactcttgtcctggaaacagcaggtgcagaaactgtttcgctccttcccccgtaaaactctgctggacatctcaggatatcgacagcagaggaaccgcggtttcggacagtctaacagtcttcccaccgccggttcggtaggaggcggtatgggcagacggaaccctcgacagtatcagatcccatctaggaacgtgccttccgccagactgggcttgctggggacttcaggcttcgtgtccagtaatcagcggaatactacagcaacaccaactataatgaaacaaggtcgccagaacctctggtttgctaacccaggaggcagtaatagcatgccctcccgcacacacagtagtgtgcagcggacaaggtctctacctgtacacacctcccctcagaatatgcttatgtttcagcagccggagttccagctccccgtgacagagccagacatcaataatcgactggagtctctctgcctgtctatgactgagcatgctctcggcgacggtgtagaccgcacctctactatctag

SEQ ID NO: 136373 - DNA, 2154 bp, Artificial Sequence
  Description of Artificial Sequence: Synthetic coding sequence
atgtttcgcgaccaagttggcgtgcttgcaggttggttcaagggttggaacgagtgcgagcagacagttgccctcctgagtctgctcaagcgcgtttcccagacacaggcccggtttctccaactctgccttgaacactccctcgccgattgcgccgagctccacgtgttggagagggaagcaaatagccctggcatcattaatcagtggcagcaggagtcaaaagataaggtgatctcactactgctcactcacctgccattactgaaacccggcaacctagacgctaaggtggaatacatgaagctgctgccgaaaattctggcgcactccattgaacacaatcagcacattgaagaaagtcgacagttactgtcatacgctctgattcaccctgccacgagcttggaagatcggtctgccctcgccatgtggctgaaccatctcgaggacaggacctccacaagcttcgggggtcagaaccgaggccgttcagacagcgtggattacggccagacccactactaccaccaacgccagaatagcgatgacaagttaaatggctggcagaactcgagagattccggcatttgtataaacgcaagcaactggcaggacaagagtatgggatgcgagaatggccatgtgccattatactcttcctcttccgtgcccacaaccatcaatactatcggaacttctacatctacaatcctgtctggccaagcgcaccactcccctttgaaaaggtccgtctcactgacgccccccatgaatgttcctaatcagcccttaggtcacggatggatgagccacgaagatctcagagcacggggccctcagtgcctcccatccgatcatgctcccttgagcccacagtccagcgtggcaagctccggaagcggcgggtccgagcacttggaagatcagaccacggccagaaacacattccaagaggaaggcagcggaatgaaagacgtgcccgcctggttgaaatcactccgtctacacaagtacgctgcactgttttcccaaatgacttacgaggagatgatggcactaacagagtgccagctggaagcccaaaacgttactaagggcgccagacataagatcgtgatcagcatccagaagcttaaggaacggcaaaacttgctcaagtcccttgagcgcgacattatagaaggaggaagtctgaggattccgctccaagagcttcatcagatgattctgacacccatcaaagcctactcttctccaagtaccacacccgaggcccgtcgacgcgagccacaagctcccaggcagccaagccttatgggccctgagtcacagagtcctgattgcaaagacggagcggctgcaaccggcgctactgccacgccctccgccggtgctagcggggggctgcaaccacaccagttgagcagctgcgatggcgaactggccgtggctcccctgccggagggcgatctgcctggccagtttactcgggtcatggggaaggtgtgtacacagctgctggtgtcgcggccagatgaggaaaatatctccagctatcttcagctgattgacaaatgcctgattcacgaggcgtttaccgaaacacagaagaagagattgctatcatggaaacaacaggttcagaagctcttccgctcttttccgcggaagacccttctcgacatcagcggctatcgccaacagcgtaaccgcgggtttggccagtccaactcccttccgactgctggaagcgtggggggaggtatggggagaaggaacccacgacagtaccagataccatccaggaatgtaccgagtgctagattgggtctcctcggaacgtcggggttcgtgtcatcgaatcaaaggaataccacagcaactccaactataatgaagcagggcaggcagaatttgtggtttgcaaatcccggagggtccaactccatgcccagtaggacccattcatccgtccagcgaacaaggtcattaccagtgcacaccagccctcaaaatatgcttatgtttcaacagcccgaattccagctgcctgtcacggagccagacatcaataaccgtctggaatctctgtgtctgtccatgaccgaacacgctctcggcgacggagtggatcgcacctccactatatag

SEQ ID NO: 136374 - DNA, 2157 bp, Artificial Sequence
  Description of Artificial Sequence: Synthetic coding sequence
atgatgtttagagatcaggtgggagtgttggcagggtggtttaaagggtggaatgagtgcgagcagactgttgcgctgctatccttgctgaaacgggtttctcaaactcaggccaggtttctgcagctttgcctggagcattcactggctgactgcgctgagctccacgtgttggagagggaggcgaacagcccgggtataattaaccagtggcagcaagagtcaaaggacaaggtgatttccctgttgcttacccatctccccctccttaaacccggcaatctcgatgctaaggtggaatacatgaagttactgcctaagatcctcgctcatagtatcgaacacaatcagcatatcgaagaatctcgccagctcctgtcgtatgcactcatccatcccgcgactagtctggaggatcgctcggcactcgcgatgtggctaaaccatttggaggatcgcacttccacatcttttggcgggcagaatagggggcggtccgactctgtggactatggccagacccactattaccaccaaagacagaattcggacgataaattgaacggatggcagaatagcagggattctgggatctgtataaacgcctctaactggcaagacaaaagcatgggatgcgaaaatggccacgtgcctttgtattcaagctcctccgtgcccacgactataaacaccattggcacttcaacctccaccatcctgtcggggcaagctcatcactcacccctgaaacgctctgtgagcctgacccctcctatgaatgtgcctaatcagccgctggggcatggctggatgagccacgaagatctgcgcgcccgtgggcctcagtgcctgccctcagatcacgcgccactcagccctcagagttccgtggccagctctggatccggaggctctgagcacttagaggatcagacaacagcacgcaatacattccaggaagagggatccggcatgaaagacgtgcctgcttggctgaagagcctgcgcctgcataagtatgcggcactctttagtcagatgacttatgaagagatgatggccctgactgaatgtcagctcgaagctcagaatgtgactaagggggcacggcacaagattgtgatttcaattcagaaacttaaagagaggcagaatctcctcaaatccctggagcgtgacattatcgaaggggggtcactgaggatcccattgcaggagctgcaccagatgattttaaccccaataaaagcttatagttccccctctacgacccctgaagcgagaagacgagagccccaggcgcctcgacagccctccctgatgggacccgaatcacagtcccccgactgcaaggatggggcggcagctacgggggccactgcaacaccctctgcgggcgcctcaggcggtctgcagccccaccagctgagttcgtgtgatggtgaactagccgtggctccactccctgaaggagacctgccgggtcagtttacccgcgtgatgggcaaagtttgcactcagctcctggtgtccagacctgacgaggagaacatatcctcttacctgcaacttatagataagtgtctaattcacgaagcgttcactgagacacagaagaaacggctgcttagttggaagcagcaagtacaaaaactattcaggtctttcccaagaaaaaccctgttggacatatccggttacaggcaacagcgaaatagaggcttcggtcagtccaattctttgccgacggctgggtccgtcgggggaggcatgggccgtagaaaccctagacaataccagatcccatcaaggaatgtgccctccgcacgactgggattgttagggacaagtgggtttgtatcgtccaaccaacggaataccaccgccacacccacgattatgaagcaaggacgccagaatttgtggtttgctaaccctggaggaagtaattctatgccatcccggacacacagttccgtccagagaacccgcagtctgcctgtgcatacttcaccccagaatatgctcatgtttcagcaaccggaatttcagctgccagtgacagagccggatatcaacaacaggcttgagagtctctgcctgtccatgaccgagcacgctctgggcgatggcgtggatcgcacatctaccatttag

SEQ ID NO: 136375 - DNA, 2157 bp, Artificial Sequence
  Description of Artificial Sequence: Synthetic coding sequence
atgatgtttagagatcaagtgggagtgctggccggctggttcaagggttggaatgagtgcgagcagactgtggcactgctgtccctcttgaagagggtctcccaaacacaagctagattcctacagttgtgtctggaacactccttggcagattgcgccgagctccacgttctggagagagaagccaattctcccggtatcatcaaccagtggcagcaggaatccaaggacaaggtgatctccctgctgctcacgcacctaccactgctgaagccaggaaatttggatgctaaagtggaatatatgaagctccttcccaaaattctggcccattctatagagcacaatcagcacattgaggaatcccgccagctattgtcctatgcactcatccatcccgctaccagtctggaggacagaagtgctctcgctatgtggctgaatcatctcgaagaccgaacgagcacgagctttgggggccagaaccgaggcagaagtgactccgtggattacggacagacccactactaccaccagcggcagaacagcgacgacaagctgaatgggtggcagaactcccgcgactctgggatctgtatcaatgcctctaactggcaggacaaatccatggggtgcgagaatggtcatgtgcccctgtacagtagctctagtgtgcctacaaccataaacactataggtacaagtacgtccacaatcctctcagggcaggcccaccattccccattaaagagatccgtatctctcaccccaccgatgaacgtccctaaccaacctcttggacatggctggatgtctcatgaggatttgcgagcgcgaggtccccagtgcttgccttcggaccacgctcctctgagcccacaatcaagcgttgcatcttccgggagcggaggatcagagcatctcgaagaccagaccaccgctcgaaacacattccaggaggaaggatccgggatgaaagatgttcccgcgtggctgaagagcctcagactgcacaagtacgcagctctgttctcccagatgacgtacgaggaaatgatggcacttacagagtgccagctcgaggcccagaatgtgaccaagggggctagacataagatcgttatcagcattcaaaagctgaaagagagacagaatctgcttaagtccctggagcgggacatcatcgaaggaggcagcctgcgcatcccactgcaggaactgcaccagatgatattgacgccaatcaaggcttactccagcccatcaactacaccagaggccaggagacgtgagcctcaggcaccaaggcagccctccctcatgggtccagagtcccaaagccctgattgtaaagacggggcagctgccaccggggcgacggcaactccctctgcaggtgcttcaggaggcctgcagcctcatcagctgtcatcctgtgacggcgaactcgctgtagcccccttaccagagggggacctccctgggcagtttacaagggtaatgggtaaagtgtgtacacaactcctggtctcacgaccagacgaagagaacattagtagctaccttcaactgatagacaagtgcctgatacatgaggccttcaccgagactcagaagaaacgcttgttgtcttggaaacagcaggttcagaagctcttcagaagcttcccgagaaaaaccctgctggatatatctgggtatcgccagcagaggaaccggggcttcggccaaagcaatagcctgccgaccgctggcagtgtaggcggtggcatgggcaggagaaacccccgacagtatcagattccaagtagaaacgtgccttcagcacgcctcggactactgggcacttccgggttcgtctcttcaaatcagcgtaacacaactgccacaccgacgattatgaagcagggacgccaaaacctttggttcgccaacccgggaggcagtaatagcatgccttcccgcactcattcttctgtccagagaactcgctcgttgccagtccatactagcccacagaatatgttaatgttccagcaacccgaatttcagctacccgtaacagagccagatatcaataaccggctggaatctctgtgtttgtccatgactgaacacgccttaggagacggagtggaccgcacctccactatctag

SEQ ID NO: 136376 - DNA, 1038 bp, Artificial Sequence
  Description of Artificial Sequence: Synthetic coding sequence
atgattctgacccctattaaagcctattcatctcctagtaccactccggaggcccgccggcgtgagcctcaagcacctcgccagccctctctgatgggccctgagagtcagagccccgactgcaaagatggagctgcggctaccggcgctacagcgactccgagtgctggagcttccggaggtctgcagccacatcaactctcctcttgtgacggggagctcgccgtagcacctcttcctgaaggcgatctgcccggacagttcactagagtgatggggaaagtctgtactcagctgctcgtatcccggccagatgaagagaatatctccagctatctgcaactgattgataaatgcctgatacatgaggccttcactgaaacacagaaaaagcgccttctgtcatggaagcagcaggtacagaaattgttccgatcttttccaagaaaaactctcttagatattagcggatacaggcagcagcgtaacagaggattcggacagtctaactcgctgccgacagcaggatctgtgggggggggcatgggccggcgcaatcctaggcagtaccagattccatcccggaacgtcccctctgctcgactggggctgcttgggacatctggctttgttagttccaaccagcggaatacaacggccactccgactatcatgaagcagggtcggcagaatctctggtttgcgaatcctggggggagcaatagtatgccgagccgaacccactcctcagtgcagaggactcgctcactaccagttcacacatccccacagaatatgctcatgttccagcagccaggcagccaggtgcactcaggtctgtgtcttacggatttaagggggtggctttcattgagcggagctccatctatgcccgctctaactgtccccaaatcgtctcagggcgaattccaactgcctgtaactgaacctgatatcaacaatagactggagtcgctgtgtctgtctatgaccgaacacgccttgggcgacggggtggatcgcacctcgaccatttag

SEQ ID NO: 136377 - DNA, 981 bp, Artificial Sequence
  Description of Artificial Sequence: Synthetic coding sequence
atggccggacccaaccagctttgcatcaggcgctggacaactaaacatgttgctgtttggctcaaagacgagggattcttcgagtacgtagatattctctgtaacaagcaccgtttagatggcatcacactgttgaccctcacagaatacgaccttcggagtcccccactggaaatcaaggtcttgggagacatcaaacgcctcatgttaagcgttcggaagttacaaaaaatccacatcgacgtgttagaggagatgggatacaatagcgactctcctatgggttctatgacgccgtttatcagtgctctccagtccaccgactggctgtgtaatggggagctttcccacgattgcgacggccctattacagatctgaactctgatcagtatcagtacatgaacggcaagaataagcattcagtgcggcgcctagacccggaatactggaaaacgattctgtcatgcatctacgtgttcattgtttttgggtttacatctttcattatggtgatcgtgcatgagagagtacccgacatgcagacttacccccccctacccgacatcttccttgatagcgtacccaggatcccttgggcttttgctatgactgaagtatgcgggatgatcctgtgctacatttggctgctcgtgcttctgctccataaacacagaagcatcttactgaggcggctctgctcccttatggggacagtgtttctactcaggtgctttaccatgttcgttaccagcttgagcgtaccaggccaacatctgcaatgtaccggtaagatttacggaagcgtctgggaaaaactgcaccgcgcctttgccatttggtccgggttcgggatgaccctaactggagtacacacttgtggagactacatgttttcaggccatacggtcgtgctcacaatgctcaacttctttgtgaccgaatgcaagtacttgttctcagcctcgatgaggattcgttag

SEQ ID NO: 136378 - DNA, 1437 bp, Artificial Sequence
  Description of Artificial Sequence: Synthetic coding sequence
atgcctgcgagatctcgccaccggccacgtctccacagcggaagtcccccccgcgcgcccccccccccccttgaagcacttcatagtggcgaggcaggcagagctccagatagcgacggcgggtctgatgcagactcagaagtgggacctggctctcctacccgtaccgctgaggctgcagaggaagagatggccggccccaaccagctctgtatccggagatggacaactaaacatgtggctgtgtggctcaaagatgaggggtttttcgagtacgtggacatcctctgcaacaaacaccggctcgacgggataactctgttaacattaacggaatacgaccttaggtcaccgccactcgagatcaaggttctgggagatattaaacgacttatgctcagcgtgagaaagttgcagaagatccacatcgatgtcttagaggagatgggctacaattcggacagtccaatggggtctatgaccccgttcattagcgccttgcagagcacagattggctatgcaatggtgaactgagccatgattgcgatgggcccatcacagatctgaattctgaccagtaccaatatatgaacggaaaaaataaacattctgtgcggcggctagatcccgagtactggaagaccattcttagctgtatctatgttttcatcgtgttcggattcacaagctttataatggttattgtccacgagcgcgtccccgacatgcaaacataccccccacttcccgatatttttctcgattctgtgccccggatcccctgggcctttgctatgactgaggtgtgcggaatgatcctgtgctacatttggctactcgtcttgttgctccacaagcaccgcagcattctcctgagacggctctgcagtctgatgggcaccgtgtttcttctccggtgctttacaatgtttgtgactagtctctcagttcctggacagcacctccagtgcaccgggaaaatctacggaagtgtttgggaaaagctgcacagagcttttgccatatggtccggctttggcatgaccctgactggggtacacacatgcggcgattacatgttcagcggccataccgtcgttctcacgatgttaaatttttttgtgacggaatatactcccaggtcatggaattttctccatactttgagctgggtgctgaatttatttggcatcttctttatcttggccgctcacgagcattactccatcgacgtgttcatcgcattttatatcacaacacggctcttcctctattatcacactctcgccaacacacgcgcatatcaacagtctcggcgggcacgaatctggttccccatgttctccttttttgagtgcaatgtcaatggtactgtgccgaacgaatactgctggccttttagcaaaccagccataatgaagagactcattggctag

SEQ ID NO: 136379 - DNA, 765 bp, Artificial Sequence
  Description of Artificial Sequence: Synthetic coding sequence
atggccggcccgaaccagctgtgcattaggagatggacgaccaagcacgtagccgtgtggctcaaggacgaggggttttttgagtacgtcgatatcctgtgtaacaaacacagactggacggcatcacactcttgacgttaactgaatatgatctgagaagccctcctctggaaatcaaagtcctgggggacattaaaaggctgatgttatctgtgagaaagctccagaagatccatatcgatgtcctcgaagaaatgggctataactctgacagcccgatgggttcaatgactccattcatcagcgcactgcaaagtactgactggctctgtaacggcgaactgtcacatgattgcgatggacccatcaccgacctgaacagcgaccagtaccaatacatgaatggcaagaataagcacagcgttagacgcctggacccggaatactggaagacaatcttgagttgcatatatgttttcatagtttttgggttcacctcattcattatggtgatcgtccacgagagggtgcccgatatgcagacttacccccctctgcctgatatctttttggattctgtgccgagaatcccctgggctttcgctatgaccgaagtatgtgggatgatcctgtgttatatctggctgcttgtgttgctgctccacaaacataggtcaatcctattgagacggttgtgttcactgatggggactgtgttcctgcttcggtgcttcacaatgttcgtcacttctctgtccgtgtag

SEQ ID NO: 136380 - DNA, 1248 bp, Artificial Sequence
  Description of Artificial Sequence: Synthetic coding sequence
atggctggaccgaaccagttgtgtatccggcgatggacaaccaagcatgtcgctgtgtggttgaaggatgaaggctttttcgaatatgtcgacattctttgtaacaagcatcgattggatggaatcactctactaacacttaccgaatacgacctcagatcgcccccattggagatcaaagtcctcggggatatcaagagactcatgctatcagtccggaaattgcagaagatccatatagacgtgctggaagagatgggttacaactccgactcccccatgggctctatgacccctttcattagtgcgctgcaatccactgactggttatgcaatggagagctctctcatgactgcgatggtcctatcactgatctaaattccgaccagtaccaatatatgaacggtaagaacaagcacagcgttagaaggcttgacccggagtattggaaaacgattttgtcttgcatatacgtgtttatcgtgttcggctttacttccttcattatggtgattgttcacgagagagtgccggatatgcagacctatccacctttgcctgacattttcctggactccgtcccccggatcccttgggcttttgctatgacggaagtctgcggaatgatcttgtgctacatttggctgctggtcctcctgcttcacaagcatagaagtattctgctgcgtaggttgtgctccctcatgggcaccgtcttcctacttaggtgcttcacaatgtttgtcaccagccttagcgtgcccggccagcacctccagtgcaccggtaaaatttatggttccgtttgggaaaagctgcatagagcctttgctatatggtctggctttggaatgaccctgaccggcgtgcacacctgtggcgattacatgttctctggccataccgtagtgttaactatgcttaatttcttcgtgactgagtacacgccacggagctggaattttctccatacactgagctgggttctcaacctcttcggcatcttttttatactggctgcacacgagcactattccattgacgtgttcatagcattctatatcactactcgcctgtttctctactaccatactttagccaatacaagagcgtaccagcagagtcggcgagcccgcatatggttcccaatgttctccttcttcgagtgcaacgtcaacgggacagtcccaaatgaatactgctggccattctctaagccagcaattatgaaaaggcttatcgggtag

SEQ ID NO: 136381 - DNA, 4770 bp, Artificial Sequence
  Description of Artificial Sequence: Synthetic coding sequence
atggccaaacagctcaatcttcccgaaaacactgacgactggacgaaagaggatgtgaatcaatggctcgaaagtcacaagatcgaccaaaaacaccgcgagatcctgacggaacaggatgttaatggagccgtcctgaagtggttaaagaaagagcatcttgtcgacatgggcatcactcacgggccagctattcagatagaagaactattcaaggaactgaggaaaacagccatagaagactctattcagacaagcaagatgggcaagcctagcaagaacgcaccaaaagatcagactgtatcacagaaggagcgcagagaaacctcgaaacagaagcagaaggggaaagagaacccggatatggcaaaccctagcgccatgtcaacgactgcaaaggggtctaagtctctgaaagtagagctgattgaggacaagattgactacacgaaagagcgccaaccctctatcgatctcacttgtgtatcttaccctttcgacgaattctccaatccctacagatataaacttgacttttcgttacagcccgagacaggcccggggaacctgatcgatcctatccatgagtttaaagctttcacaaacactgctactgccaccgaggaagacgtcaagatgaagttctctaatgaagtctttcgtttcgcctctgcctgcatgaactcgagaaccaacggtacaatccacttcggtgtcaaggacaaacctcatgggaaaatagtgggtatcaaggtcacaaatgacacaaaggaggctctgatcaaccattttaacttgatgatcaataagtatttcgaggaccatcaggttcagcaagccaaaaagtgtattagggagccccggtttgtggaggtcctgctgccgaactcaaccttatctgacaggtttgtgattgaagtcgatataatccctcagttttccgaatgtcagtacgactatttccagatcaagatgcagaattacaacaataagatttgggaacagtctaaaaagttttccctctttgttcgggacgggacatcctccaaggatattacaaagaataaggtagattttagagctttcaaagcagatttcaaaacattggccgagtcccgaaaggccgccgaagaaaaattccgggccaaaaccaataaaaaagaaagggagggccctaaattagtaaagctgctaacaggcaatcaagacctactggacaacagctattatgaacagtacattttggtaacgaacaagtgccatccggaccagacgaaacacctggattttctgaaggaaattaagtggttcgctgtcttagagttcgaccctgagagcaatattaacggcgtggtgaaggcctacaaggagtcccgggtagcaaatctgcattttccaagcgtgtacgtggaacaaaaaacaacccccaacgaaacaatctcaacactcaatttataccatcagccaagctggatattctgtaatggtcggttggacctggattccgaaaagtacaaacctttcgatccctcttcgtggcaaagggaaagagcaagtgatgtgaggaagctaataagtttcctgacgcacgaggacatcatgcccaggggaaaatttctggtagtttttttgctgctgtcgtccgtggatgacccaagggatccccttatcgagacattctgcgcgttttaccaagacttaaaggggatggagaatatcctgtgtatctgtgttcatccacacatttttcagggatggaaagatctcctcgaagcccggttgataaaacaccaggatgagatttccagtcagtgcatcagcgcattatcgctggaagaaattaacgggacaattctcaagctcaagagtgtgacccagagtagcaagaggctgctgcccagcatagggctgtccaccgtgttgttgaagaaggaagaagacatcatgacagcactcgaaattatttgcgagaacgagtgcgaagggactctcttggaaaaggataaaaacaaattcctcgagtttaaggctagtaaagaagaagatttctatcgtggaggaaaagtatcttggtggaacttttatttctcttcagagtcctattcttccccttttgtgaagagagacaaatatgagaggttggaagctatgatccagaattgtgccgattctagcaaacctacctcaaccaagataatccacctgtatcatcatccaggatgtgggggaactactctggctatgcacatcctgtgggagctgcggaagaagttccgctgcgcggttttgaagaacaaaaccgtcgatttctcagagatcggcgagcaagttacttccctgattacatacggcgctatgaacagacaggagtatgtccccgtacttctgctggtggacgattttgaggaacaggacaacgtgtacctgttgcagtattccattcagacagccatcgccaagaagtacattcgatacgagaagccacttgtgattatactgaattgtatgcggtcacagaatccagagaagagcgcacgcatccctgacagtattgctgtaattcagcaactttcaccgaaagaacagagggccttcgagctgaagttgaaggagatcaaggaacagcataaaaacttcgaggacttctatagttttatgatcatgaaaactaacttcaataaagaatatattgagaatgtggtgcgcaatattctgaaagggcagaatattttcacaaaagaggcaaaactgttcagctttctcgctctcctgaattcttatgttcctgatactacaatctctctctctcagtgtgaaaagtttttggggattggaaataaaaaagcattttggggaaccgagaagttcgaagacaagatgggaacgtattcaacgatcctgattaagacagaagtaattgaatgtgggaactactgtggcgtccggatcatacattcactgattgccgagttttccctagaggaattgaagaaatcgtatcatttgaataagtcacagatcatgctggatatgttaactgagaacttgttcttcgacactggaatgggtaaatccaaatttctgcaggatatgcataccttgcttctgaccagacatcgagacgaacatgagggtgagacagggaactggttcagcccatttattgaggctctgcacaaagacgagggcaacgaagcagtcgaagctgtgttattggagtccatccataggtttaatcccaatgccttcatctgccaggctctcgcacgacatttctacattaaaaaaaaagatttcggtaacgcgttaaactgggcaaagcaggctaaaattatcgagcctgacaacagttatatatcagacaccctcgggcaggtgtacaagagtaaaatacggtggtggattgaggagaacggaggaaatggaaacatctccgtggatgatctaatagcgttacttgatttggctgagcatgcctcatcagccttcaaggaaagccagcagcaatccgaggaccgagagtatgaggtgaaggagaggctctatcccaagagcaagaggaggtatgatacttataatatcgcggggtaccagggcgaaattgaggtcggcctctacaccatccaaatacttcagctaatccccttctttgacaacaaaaatgaactatctaagcgctacatggttaatttcgtgtctggctcttccgacataccaggcgaccctaacaatgaatacaaactggccctcaagaactatatcccgtacttgacgaaattaaaattttcactgaaaaagtccttcgacttcttcgacgaatatttcgtgttactcaagcctcgcaacaacatcaaacagaatgaagaggcaaaaacgcgtcgcaaggttgccggatactttaagaagtacgtcgatatcttctgcctcctcgaagagagccagaataacacagggctgggcagtaagttttcagagccccttcaggtcgaaaggtgtcgacggaacttggtggcccttaaagcagacaagttcagtgggttacttgagtacctgatcaaatcccaggaggatgcaatatctactatgaaatgcatcgtgaacgagtacaccttcctattagaacagtgtaccgtgaagatacaaagcaaggagaaactgaactttattctggctaacattatcttgtcatgtattcagccgacatcccggctcgtgaaacccgtagaaaaactcaaagaccagcttagggaagtgttacagccgattggccttacctatcagttctctgagccttactttctcgcttcgctccttttctggcctgagaatcagcagttggatcaacattcagagcagatgaaggagtacgctcaggccctgaagaattcttttaaaggccagtataaacacatgcacagaaccaagcaaccaattgcttattttttcctcggcaaaggcaagcgacttgaacgcctggtacacaaggggaagatcgaccagtgttttaaaaagaccccagatattaacagcctttggcagtcgggcgacgtttggaaagaggaaaaggtccaggaactgctgctcagactccagggcagagctgaaaacaactgtctgtacattgagtatgggatcaacgaaaaaatcaccatcccaataactccggcctttctgggccagctccggtcggggcggagcattgaaaaggtctctttctatctgggcttctcaatcggcggcccactagcttacgatattgagattgtctag

SEQ ID NO: 136382 - DNA, 3852 bp, Artificial Sequence
  Description of Artificial Sequence: Synthetic coding sequence
atggccaaacaattgaatcttcctgaaaacactgacgattggacaaaggaagacgtgaaccagtggctagaatcccataaaatagaccagaagcacagagagattcttacagagcaggacgtgaatggagccgtgttaaagtggttgaaaaaggagcaccttgtagacatgggtattacacacggacccgctatccagatcgaggagctgttcaaagagctgagaaagacagccatcgaggactctattcagaccagcaagatgggcaagccctcaaagaacgccccaaaagaccagactgtcagccagaaggagcgcagagagacctcaaagcaaaagcaaaaaggaaaggaaaaccccgacatggcgaacccgtctgccatgtccaccaccgcaaaagggagcaagtcgcttaaggtcgagttaatcgaggataaaatagactacaccaaggagcgccagccatccatcgacctgacttgtgtctcatacccttttgacgagttttctaacccatacaggtataaattggacttctccctccaaccagaaaccggccctggcaatttgatcgaccccattcacgaatttaaagctttcactaacacggccacagccactgaagaggatgtgaaaatgaaatttagtaatgaagtattcagattcgctagtgcctgcatgaactccagaaccaatggtactattcatttcggagtcaaggataagccccatggaaagatcgtgggcattaaggttaccaacgatacaaaggaagccctaatcaaccattttaatctcatgatcaataaatacttcgaggaccaccaggtgcagcaggcaaagaagtgcatcagggagccaaggttcgtggaggtcttactccccaattctacgctcagcgatcgttttgttattgaggttgatattatcccccagttttcagaatgtcaatatgactactttcagattaagatgcagaactataacaacaaaatttgggaacagagcaaaaagttttccctgttcgtgcgagacggcacaagcagcaaagacatcaccaaaaataaggtagacttcagagcctttaaagccgatttcaaaacccttgccgagtctaggaaggccgctgaggagaagttcagggccaagaccaataaaaaggaacgagagggccccaaattagttaaattgcttaccggtaatcaggatctgttggacaatagttattacgagcagtatatcctggttacaaataagtgccaccctgaccaaaccaaacatcttgacttcctgaaggagatcaagtggtttgccgtcctggaattcgaccccgagtctaatatcaatggtgtggtgaaggcttacaaggagagcagggtggctaatttgcatttcccatctgtgtatgttgaacagaaaacaacccccaatgagacaatatctaccctcaatctgtaccatcagcctagttggattttctgcaatgggaggctggatctcgattccgaaaagtacaaaccgtttgacccgtcgtcgtggcagagagagcgggcctccgacgtccgcaaactgatcagcttcctaacacacgaggatattatgccccgcgggaagttcctggtggtttttctcctcctgtccagcgttgatgacccgcgggatccgctgatagaaactttctgcgccttctatcaagatctgaagggaatggaaaatatcctgtgtatctgcgtacaccctcatattttccagggttggaaagatctactggaggcacgattgatcaagcaccaggatgaaatcagctcacaatgcatctcagctctatcacttgaggagattaacggcactattctcaaattaaagtctgtgacacaatcctctaagaggctgctgccgtctatcggtctatcgacagtgctgttgaagaaggaagaggacattatgacagctcttgagatcatatgcgagaacgagtgcgaaggaactctgttggaaaaagacaagaacaagttcttggaatttaaggcctccaaagaggaagatttttaccgaggcggaaaggtgtcatggtggaatttttacttttccagcgaatcatattcaagtcctttcgtgaaacgagacaagtacgagcgactggaggccatgattcagaactgtgcagatagcagcaaaccaacgtctacaaagatcatccacctctaccaccaccccggatgtggtgggacaaccctggcaatgcacatactctgggagcttagaaaaaaatttcgctgtgccgttctgaagaataagactgtcgacttttccgagataggcgaacaggttacaagtcttattacctatggtgcaatgaaccgccaggaatacgttccagtgctcttgctcgtggacgattttgaggagcaggataatgtttacctgctgcagtatagtatacagacagcgatcgctaaaaagtatattagatatgagaagcccttggtgattatcttgaactgtatgagatctcaaaaccccgagaaatctgcaaggattcccgactccatcgcggtaatccagcagttgtcacctaaagagcagagggcctttgagctgaaacttaaggaaatcaaggagcagcataagaacttcgaggacttctatagtttcatgattatgaagaccaacttcaacaaggagtatattgagaatgtggttcggaacattcttaaggggcagaacatctttaccaaagaggcaaaactcttcagttttctggccttactgaattcatacgtgccagacacgacaatttctctttcacagtgcgagaagtttctgggtatcggcaacaaaaaagccttttggggcactgaaaagtttgaggacaaaatggggacatactctactatcctaatcaagacagaggtcatcgaatgtggaaattactgtggcgtacgcatcattcactctcttatcgccgagttctctctggaggagttgaagaaatcataccatctcaataagtcgcagattatgctggatatgcttactgaaaatctcttttttgacactggcatgggcaagtccaagtttttacaggatatgcacaccctactactgacacgacaccgggacgagcacgaaggcgagacaggcaattggttctctccattcattgaggctctccataaggacgagggcaatgaggcagtcgaagcagtgcttctggagtccatccaccgcttcaacccgaacgcattcatttgtcaggccctggcgcgacacttctatataaaaaaaaaggactttggcaatgctttgaattgggccaaacaagccaagatcatcgaacctgataatagttatattagcgatactctgggccaggtatataagtctaaaatcagatggtggatcgaggaaaatggcggcaatggaaacatcagtgtggatgacttgatcgccttgctggatctcgcagaacatgctagctctgcctttaaggagagccagcagcaatccgaggacagggaatacgaagtgaaggagagactttaccctaaatccaaacgaaggtacgatacctataatatcgctgggtaccaaggagaaattgaagttggcctttatactatccagattctccagttgatcccattctttgataataaaaacgaactgagtaagagatatatggtcaatttcgtgtctggcagctcagacatccctggtgaccctaacaacgagtacaaactagctctgaagaactatattccatacctgactaaattaaagttttcgttgaaaaaatcatttgactttttcgatgaatactttgtgttgcttaaacctaggaacaactag

SEQ ID NO: 136383 - DNA, 4755 bp, Artificial Sequence
  Description of Artificial Sequence: Synthetic coding sequence
atgtctaagcaagtgtctctgccagagatgatcaaggactggacaaaggagcatgttaagaaatgggtgaacgaggatcttaagatcaacgagcagtatggacagattctcttgtcggaggaagtcactggcctggtgcttcaggagctgaccgagaaggaccttgttgagatgggtcttccttgggggcccgcgttgctgatcaagcgctcatataacaaattgaattccaaaagccctgagtccgacaaccacgaccctgggcagttggataattctaagccgtctaagacggagcatcagaagaatcccaagcacactaagaaggaggaggagaatagcatgagtagcaacatcgactacgaccctcgcgaaatccgcgacattaagcaggaagaaagtattctgatgaaggaaaatgtgcttgatgaggtggctaatgccaaacataagaagaagggcaaattaaagcctgaacagctaacctgtatgccctaccctttcgaccagttccacgactctcatcgatacatcgagcactatacactgcaacctgagactggcgcacttaacttaattgatcccattcacgagttcaaggcactcactaatactgaaactgcaaccgaagtggatattaaaatgaaattctccaacgaagtgtttcgcttcgcctcagcttgtatgaatagccgcactaatggtacgatccacttcggtgttaaggataaacctcacggggagatagtgggggtcaagatcacgtcaaaggcggcctttatcgaccattttaacgtgatgatcaaaaagtatttcgaagagagtgagattaacgaggccaaaaaatgtattagggaaccccggttcgttgaagtgctgctccagaacaatactcctagtgatcgatttgtgatcgaagtcgatactatcccaaagcacagtatttgtaacgacaagtatttctatattcagatgcagatttgtaaagataaaatatggaaacaaaaccagaatttgagcctcttcgtcagggagggagcttccagcagggacatactagcgaatagcaaacaaagagacgtggactttaaggcctttctccagaatcttaagagcctcgtggcaagccgcaaggaagcggaggaagaatatggaatgaaagcaatgaaaaaagagtctgagggcctcaagcttgttaagctcctcattggaaatagagattcgctggacaatagctattacgactggtatatcctcgttacaaacaagtgccacccaaaccaaatcaaacacctcgatttcctaaaggaaattaagtggtttgccgtcttggagttcgatcctgaaagtatgatcaatggcgtcgtgaaggcctataaggagagcagggtggccaatctgcactttcccaatcaatacgaagacaaaactaccaacatgtgggagaagatctccactctcaatttgtaccagcagcccagctggatcttctgcaatggtcgcagcgacctgaagtcggaaacttacaaacctctggaacctcatctgtggcaacgggaaagggcgagcgaagttcggaagctgatcctgttcttgaccgatgaaaatattatgacaagaggcaagtttttagtcgttttcctgctccttagttccgtggagtctccaggggaccctctgattgagactttctgggccttttaccaggcgttaaagggaatggagaacatgctttgcatttcagttaattctcacatttaccagcggtggaaagatctgctgcagacccgcatgaagatggaggatgagctcactaaccactccatttctacactgaacatcgagttggttaactccacaattctgaagctaaaaagcgtaaccaggagttcgcgccgatttctgcccgctcgcggcagctcaagtgtgattctcgaaaaaaagaaagaggacgtgttgaccgccctggagatcctctgcgagaacgagtgcactgagactgacattgagaaagataaaagcaaatttctcgaatttaaaaagagtaaggaggagcacttttaccgaggtggcaaggtgagctggtggaacttttacttctcaagtgaaaactactccagcgactttgtcaaacgagattcatacgaaaagctgaaagatttaattcactgttgggcagagagcccaaaacccatattcgcgaagataataaatctgtaccaccatccaggttgcggagggactaccctcgccatgcacgtgctttgggacttgaagaagaactttcgctgcgccgtgctgaagaacaaaaccacagatttcgcagagatcgcagagcaggtgatcaatctggtcacctaccgcgctaaaagccaccaggattatatcccagtcctgctgctggttgacgatttcgaggagcaggaaaacgtgtactttctgcagaatgccattcatagcgtgttggccgaaaaagaccttaggtatgagaagaccttagttatcatcctgaattgtatgaggtcgaggaatcctgacgaatctgccaaactggccgactcaatcgcgttgaactatcagctgagctccaaggaacaacgtgcctttggtgccaagcttaaggagatcgagaaacagcacaagaattgcgagaatttctacagcttcatgattatgaagtccaacttcgatgagacctacatcgagaacgttgtccgcaatatcctcaagggccaggatgtcgactctaaagaagcacagctcatctcctttctggcactgctctcaagctacgtaacagattccacgattagtgtgagtcagtgtgagatctttctgggaattatttacaccagtacaccatgggagccggagtcactggaagacaagatgggaacgtacagtaccttacttattaaaacagaggtcgcagagtacggccgttacacgggagttcgaataattcaccctcttatcgctctgtattgcctgaaagagcttgaaaggtcatatcaccttgataaatgtcagatagcgctgaatatcctcgaggaaaatctgttctacgactccggcatcggccgtgacaagttccagcacgatgtgcaaaccttgctgctcacacgccaacggaaggtttatggcgatgagactgacaccctttttagccctctgatggaggcgctgcagaacaaggacattgaaaaggtcctatctgcgggatccaggcggttcccgcagaatgcattcatctgtcaagccttagctcggcacttctatattaaggagaaagactttaacacagctctggactgggcccgacaggccaagatgaaggccccaaaaaatagctacattagcgatacattgggccaggtatacaagtcagagattaaatggtggctggatggaaacaagaattgtcgtagcatcaccgtgaacgatctgacccacttgctcgaggccgctgagaaggcatccagagcttttaaggagtcccaaaggcagacagatagcaagaactatgaaaccgaaaactggtccccccagaagtcacagagaaggtacgacatgtataacacagcctgtttcttaggagagatcgaagtgggtttgtacacaatccagattctgcagcttacacccttttttcacaaggaaaatgagctttcaaaaaagcatatggtgcagtttctatcaggcaagtggacgattccgcctgatccacgcaacgagtgttatctcgccctcagcaaattcacctcccacctgaagaatctgcagagcgatctgaagagatgttttgactttttcatagattacatggtccttcttaaaatgcgttatacccagaaggagattgcagagattatgctctccaaaaaggtctcacggtgtttcaggaaatacaccgaacttttttgccatctggacccctgtctgctacagagcaaagagtcacagctacttcaggaggagaactgtcgaaagaagctagaagccctgagggccgatcgcttcgctggactgctcgaatacctgaacccaaactacaaggacgccacaacgatggagtctatcgttaacgagtatgccttcctgctgcagcaaaactcaaagaagcctatgacgaacgagaagcaaaatagcattcttgcaaacattatcctcagctgcctgaagccaaattccaaactaattcagcctctgacaactctaaagaagcaactccgagaggtgttacaattcgtggggctttctcaccagtatcccggtccctatttcctggcttgcctcctcttttggccagagaatcaggagctggaccaggatagcaagttaattgagaagtatgttagttctctcaataggagctttagaggccaatacaagagaatgtgcaggagcaagcaagccagcactctgttttaccttggcaaacggaaaggcttgaacagtattgtgcataaggctaagatagagcaatacttcgacaaagcccaaaacaccaactcactctggcattccggggacgtctggaagaagaatgaagtgaaagatctactgaggaggctgacgggacaggcagaaggaaagcttattagcgtcgagtatgggaccgaggaaaagatcaaaatcccagttatcagtgtatatagcggacctctgcggagcggtcgtaacatcgagcgtgtcagcttttacttggggttctctatagaaggaccgcttgcttacgacattgaagttatttag

SEQ ID NO: 136384 - DNA, 1221 bp, Artificial Sequence
  Description of Artificial Sequence: Synthetic coding sequence
atgtcaaagcaggtgtcgcttcctgaaatgatcaaggactggacaaaggaacacgtgaagaagtgggttaatgaggatcttaagattaacgagcagtacggccagattctactgtccgaagaagttaccggtctcgtgcttcaggagctaactgagaaagacctggttgaaatgggcttgccgtggggcccagctctgctcatcaagagatcgtacaacaagctgaactcgaagtcgccagaatcagataatcacgaccctggtcagcttgacaactcgaagccctcaaaaacagagcatcagaagaacccaaaacataccaagaaagaggaggagaatagtatgtcatccaatatcgattatgatcctagagagattagagacattaagcaggaagagtctatcctgatgaaggagaacgtgttagatgaggtcgcaaacgcgaagcacaaaaagaaactggaggccctgcgcgcagatcgtttcgctggattgcttgagtatctaaaccctaactataaggacgccacgacaatggaaagcattgtgaatgaatacgcattccttctacagcaaaacagcaagaaacctatgacaaacgaaaaacaaaattccatcctggcaaacataattctgtcctgcctcaagcccaactcgaagctaattcagcccctgacaacacttaaaaaacaattgcgggaggtgcttcagttcgtaggcttgagtcaccagtaccccggtccatattttcttgcatgcttgctgttctggccggagaaccaggaactagatcaggacagcaaactcattgagaaatatgttagtagtctgaatcgctccttccggggccagtacaaaaggatgtgccgctccaaacaggcctctactctgttttacttgggaaaacggaagggtctgaactctatcgtgcataaggcaaaaattgaacagtactttgacaaagctcagaacactaatagcctgtggcacagtggagacgtgtggaagaagaatgaggtgaaagatcttcttagacggctcacaggccaggccgaaggtaagctgatatctgtggaatatggaacagaagaaaagatcaaaattcccgtgatctccgtgtactccggccctctgcgtagcggccgcaacattgaacgggtctccttctatctgggattctccatagaagggccgttagcatacgacattgaggtcatctag

SEQ ID NO: 136385 - DNA, 4755 bp, Artificial Sequence
  Description of Artificial Sequence: Synthetic coding sequence
atgtccaagcaggtgtccctccctgagatgattaaggactggactaaagagcatgttaaaaagtgggttaacgaagatttgaaaattaatgaacagtacgggcagatcctgctttccgaagaggtcaccggtcttgttctgcaggaacttaccgagaaggacctggtggagatgggtttgccatggggtcccgctctgctaatcaagcgctcttacaacaaattaaactccaagtctcctgagagcgataatcacgaccctgggcaactggacaactccaagccctccaaaacagagcatcagaagaatcctaagcacacgaagaaagaggaagaaaactccatgtcaagcaatatcgattatgacccccgggaaattcgtgacatcaaacaggaagaaagcatcctgatgaaggagaacgttcttgacgaggtcgccaacgccaagcacaagaaaaagggcaagttaaagccagagcagctaacttgcatgccctacccttttgaccagttccatgacagccacagatacattgagcactatacgctgcaacccgagacaggcgccctgaacctcatcgatccaatacacgagtttaaggccctgaccaacacggagactgctactgaggttgatattaagatgaaattcagtaacgaagtctttcggttcgcatctgcatgcatgaactcaaggaccaacgggaccattcactttggggttaaggacaaacctcacggtgagattgtcggggtgaaaattactagtaaagctgcgttcatcgaccactttaatgtcatgattaaaaagtactttgaagaatcggaaattaacgaagctaagaagtgcattcgagagcctcgattcgtagaggtgctcttgcagaacaacactccatcagacaggttcgtgatcgaggtggacactattcctaagcattctatatgcaatgacaaatacttttatattcagatgcagatctgtaaggataaaatctggaagcagaatcaaaatttgtcattgttcgtccgtgaaggcgcatcgtcccgcgatatcctggcgaactcgaagcagcgcgacgttgattttaaggcctttctgcagaacctcaaaagtctcgtagcaagtaggaaggaggccgaggaagagtacggcatgaaggcaatgaagaaagagtcagagggactgaaactggtcaagctgctcatcggcaatagggacagtttggataactcttactacgattggtacatccttgtcacaaacaaatgccacccaaaccagattaaacacctcgacttcttaaaggaaataaaatggtttgcagtgctagagttcgaccctgagagcatgatcaatggagtagtcaaagcatacaaggagagcagggtagctaatcttcacttcccaaatcaatatgaagataagacaaccaacatgtgggaaaagatctccaccctgaacctttaccagcaaccctcatggatcttctgtaatgggcggtccgatctgaagtcagagacatacaaacccctggagccccacttgtggcagcgagaaagggcaagtgaggtacgaaaattaatcctgttcctgaccgacgaaaatattatgacacggggtaagtttcttgtagtgtttctcctgctgagctccgtcgaatccccaggggaccctttaatcgagaccttctgggccttctaccaggcactaaaaggcatggaaaatatgctctgcatttctgttaatagccatatttaccagagatggaaggacctgctacaaacaaggatgaaaatggaggacgagctgaccaaccactctatcagcacactgaatattgaattggttaatagtaccattttgaaactgaaaagcgtcaccaggtccagcagacggttcctgccagcccggggtagctcctccgtcatacttgagaaaaaaaaagaggatgttcttactgccttagagattctctgtgagaatgaatgtacggagacagatatcgaaaaggacaaaagcaaattcctggagttcaagaagtcaaaggaggaacacttctatagaggtggcaaagtgagctggtggaatttttatttcagtagtgagaactattctagcgacttcgtgaaaagggacagttatgaaaaactgaaagacctaatccattgttgggcagagtcgccaaagccaatctttgccaaaattatcaatctgtaccatcaccccggttgtggaggcacgacgctggctatgcatgtattgtgggatctgaaaaaaaactttcggtgtgctgttctgaaaaacaagaccacggactttgctgaaatcgcagaacaggttattaatttagtaacttatcgtgccaaaagtcaccaagactacatccccgtcctgctgctggtagacgactttgaagagcaggagaacgtatacttcctccagaatgccatacactccgtgctggcggagaaggacctgcggtatgaaaaaacactggtgatcatactgaattgcatgcgttcccggaaccccgatgagagtgcaaaacttgcagacagcatcgcactcaattaccaactgtcgtcgaaagaacagcgtgccttcggcgccaagttgaaagagatcgagaagcagcacaaaaattgcgagaacttctatagtttcatgatcatgaagagtaacttcgacgaaacttatatagaaaacgtcgtccgcaacatactgaaggggcaagacgtggatagcaaggaggcacagcttattagcttcctagctctgctgtcttcctacgtcaccgactccacgattagcgtgtcccagtgtgagatttttctcggtatcatctacactagcacaccatgggagccggagtccctggaggacaagatgggaacttattcgacactgctgatcaagaccgaggtagcagagtacgggaggtatactggggtgcggataattcatcctttaatagccctgtactgcctaaaggagctggaacgcagctaccaccttgataaatgtcagatcgccttgaatatcctagaggagaacttattttacgactcgggaataggccgggataagttccagcacgatgtacagactttacttcttaccaggcaaagaaaagtgtacggagatgagacagacactctgttctctccacttatggaggcattacagaataaagacatagagaaagtgctaagcgctggttcccggagatttccccagaatgccttcatttgccaagctctggccagacacttctacatcaaggagaaggattttaataccgcactcgactgggctagacaggctaagatgaaagcaccgaaaaacagctacatttcagatacccttggacaagtgtataaatccgagatcaaatggtggctcgacggcaacaaaaactgcaggtcaattactgtcaatgatctgactcaccttttggaagccgccgagaaggccagtagagcttttaaagaatcccagcgtcagaccgattccaagaattacgaaaccgagaactggtccccgcagaagtcccagcgaagatacgacatgtacaatacagcgtgttttctaggagaaatcgaggtgggactttatactatccagatcctgcagcttactcctttctttcacaaggagaatgagctgagcaaaaagcacatggtgcaatttctgtctgggaagtggactatcccaccagaccctcgtaacgaatgctaccttgccctgagcaaatttacttcacatcttaagaatctccagagtgatttgaagaggtgtttcgacttcttcatcgactatatggtgttgctgaagatgcgctatactcagaaggaaatcgccgagatcatgcttagcaagaaagttagcaggtgttttcgcaagtatacagaacttttctgccacctggacccttgcttactgcagtcaaaggagtctcagttactgcaagaagaaaactgtagaaagaagcttgaggcacttagagccgacaggttcgccggcttgctggaatatttaaacccaaactataaagatgccaccaccatggagtccattgtcaacgaatatgcttttcttctccaacagaacagcaagaagccaatgactaatgagaagcagaacagtattcttgccaatatcatcctgtcttgcctcaagcctaacagcaagcttatccagcccctgaccactctgaagaaacaactccgtgaggtgttgcagtttgtgggcctgagccaccagtacccagggccatactttctggcctgtctgctcttttggcccgaaaaccaggagctcgatcaagacagcaagttgatagaaaaatatgtatcatcactgaaccgctcctttaggggccagtacaagcgtatgtgtaggtcaaagcaggcctccacacttttttatttgggaaagagaaaggggctgaatagcatagttcataaagctaagattgagcagtatttcgacaaggcacagaatactaatagcctctggcattccggtgatgtatggaaaaagaacgaagtgaaagatcttctgcgtcgcctgacgggccaggcggagggcaagcttatctccgttgagtacggcactgaggaaaagatcaagattccggtcatttctgtgtatagcggcccattgaggagcggccgaaacatcgagcgcgtgtcattctatttgggcttctctatcgagggaccactggcatacgacatcgaggttatctag

SEQ ID NO: 136386 - DNA, 213 bp, Artificial Sequence
  Description of Artificial Sequence: Synthetic coding sequence
atgtcgaagcaggtgtctttgcctgaaatgattaaagactggaccaaggaacacgtaaagaaatgggttaacgaagacttgaagattaatgaacagtatggccagattctgctgagcgaggaagttaccggactggttctgcaggaacttacggaaaaggaccttgtggaaatgggactgccttgggggcccgcattactgatcaagcgctag

SEQ ID NO: 136387 - DNA, 4755 bp, Artificial Sequence
  Description of Artificial Sequence: Synthetic coding sequence
atgtccaagcaggtgagcctgccagaaatgattaaggattggaccaaagagcacgtgaagaaatgggttaacgaagacttaaaaataaacgagcagtacggccagattttgctctcggaagaagtaactggtctggtgctgcaggaactaactgagaaggatctggtcgagatgggcctaccctggggtcccgctcttctgattaagaggtcttacaataagttaaactccaaatcccccgaatccgataatcacgatcctggccaattggacaattccaagccgtctaagacggagcaccagaaaaaccccaagcacactaaaaaagaagaggagaatagcatgtcaagcaacatcgactatgatcctagggaaatccgcgacataaaacaagaagaatccatcctcatgaaagaaaacgtgttagatgaggtggccaacgccaagcacaagaagaagggtaagctgaagccagaacagctcacatgcatgccttatcccttcgaccagtttcatgacagccatagatatatcgaacactacacactccagccggagaccggcgcactgaatctgattgacccaattcacgaatttaaggctctgacaaacacagagacagccacggaagtggatatcaaaatgaagttctcaaatgaggtcttccgctttgccagtgcctgcatgaatagccgcacaaatgggaccatccattttggcgtcaaggataagccccacggagaaatcgttggagtcaagatcacctccaaagcggctttcattgatcactttaacgtcatgatcaaaaagtattttgaggaaagcgagatcaacgaagctaaaaagtgtatcagggaaccaagatttgtggaggtcctacttcaaaacaatacgccatccgatcgatttgttattgaggtggataccattcccaaacattccatttgcaatgataagtatttctatatccagatgcagatctgtaaagacaagatatggaaacagaaccaaaacttatctctttttgtgagagagggcgcctcgtcccgagacatccttgccaattcgaagcagcgggacgttgatttcaaagctttcctgcaaaacttaaagtccttggtggccagcagaaaggaagccgaagaggagtatggaatgaaagccatgaagaaagagtccgagggccttaagttggtgaagctcctgattggtaacagggattccctcgacaattcatactatgattggtacatactagtgactaataaatgccatcctaaccaaattaagcacttggatttcctaaaggaaatcaaatggttcgccgtgttggaatttgaccccgaatcaatgatcaatggtgtggtaaaagcttacaaggagagccgagtagcgaacctacacttcccgaaccaatacgaggacaaaaccactaacatgtgggaaaagatttccacgttgaatctgtatcagcagccctcttggattttttgcaacggccgctctgacttgaagtctgaaacctacaaacccctcgaaccacacctatggcagagggaaagagctagcgaggttaggaaattgatcctttttttgactgatgagaacataatgacccgcggcaaattccttgttgtttttctgctgttatcttctgttgaatcacctggagacccactgattgagactttctgggccttctaccaggccctgaagggaatggagaacatgttatgcatatccgtgaattctcatatttaccagcgatggaaagatctcctgcaaacccgcatgaagatggaggatgagttaaccaatcactccatcagcacactgaatatagagctggtgaactccaccatcctgaagcttaaatctgtgacccgctctagccgcagattcttgcctgcccgcggcagttcttccgttatactggaaaagaaaaaggaagacgtcctgaccgcactggagatcctgtgcgagaacgagtgcacggaaaccgacattgaaaaagataagagcaagttcttagagtttaagaaaagcaaggaggaacatttctaccgcggaggaaaggtgagctggtggaatttttacttctctagtgaaaactactcctcagatttcgtaaagcgcgactcttatgaaaagcttaaagatctgatccactgttgggcagagtccccgaaacctatcttcgccaagattatcaacctataccaccatcccggctgtggaggaacaactcttgcgatgcatgtgctctgggatctcaaaaagaatttcagatgcgctgtgctaaagaataaaacgaccgactttgcggaaatcgccgagcaggtcattaacctcgtgacctaccgagccaaatcccaccaggattatatccccgtgctgctgctggtcgatgattttgaagaacaagaaaacgtctacttcctacagaatgctatccattctgtcctggctgaaaaggacctgcgttatgagaagacactggtgatcatcctcaactgcatgcgcagtagaaaccccgacgagtccgcaaagctggcagacagtatcgcactgaattaccagctttcatccaaagaacagcgtgcattcggcgctaaactgaaagaaattgagaaacagcacaagaactgtgagaacttctactcgttcatgatcatgaaatccaactttgacgagacatatatcgagaacgttgttcgcaacattctcaaggggcaggacgtggattctaaagaggcgcaactcatctcctttctggccctcctgtcgtcttacgtgacagacagcacaattagtgtatcgcagtgcgaaatatttctgggcatcatctatacgagtacaccttgggagcccgaaagtcttgaggataagatggggacgtactcaactctcctaattaagacagaagtagcagagtatggccgctacactggggtgaggatcatacatccccttatcgctctatattgtctgaaagaactggagcgaagctaccatctggataagtgtcagatcgccctcaatatccttgaggaaaatttattctacgattccgggatcggcagggataagtttcagcatgacgtgcagacactactgctgaccagacaaagaaaggtgtatggagacgagaccgacactttgttttccccccttatggaagcccttcagaacaaagacatagagaaagtattgtcggcaggaagtagacggtttccacaaaatgcattcatctgccaggctcttgctaggcacttctatattaaggagaaagatttcaacaccgcgcttgattgggctcgccaggcaaagatgaaggctcccaagaactcttatattagcgataccctcggccaggtctacaaaagcgagattaagtggtggcttgatggtaataaaaattgccgatccatcaccgtcaacgacttgactcacctcttggaggcagcagagaaggctagcagagctttcaaggaatctcagcgacagaccgacagtaagaactacgagaccgagaactggtcaccccagaaatcccagcgtagatatgacatgtataacacggcctgcttcctaggagagatcgaagttgggctgtatactattcagatcctgcagctgacaccattttttcacaaggagaatgagctttctaagaagcacatggtgcaattcctcagcggaaagtggaccattccgcctgacccaaggaacgaatgctacctcgcactaagcaaatttacatctcacttaaaaaatctccaatctgacctaaaacggtgtttcgatttcttcatcgactacatggtattactgaagatgcgatatactcagaaagagattgcagaaattatgctttctaagaaagtcagccgctgcttcaggaaatataccgagctcttttgccacttggacccctgcctgctgcagagcaaggagagccaactgctgcaggaagagaattgccgcaaaaagcttgaggccctgagggctgaccgcttcgcgggcctgctcgagtacctgaaccctaactataaggacgctacaacgatggagtccattgtgaacgagtacgccttcctgcttcaacaaaactccaagaagccaatgaccaacgaaaaacagaattctatcctcgccaacattatcctatcctgcctaaagcctaactccaagctgatccagcccctgactacactgaaaaaacaactcagagaggtcctgcagtttgtcggactgtctcatcagtatcctggaccatactttctggcctgcctgctgttttggccagagaatcaggaactcgatcaggatagcaaactgattgagaagtacgtctcttcccttaataggagctttaggggccagtataagagaatgtgccgaagtaagcaggcctccactcttttctaccttggcaaaaggaaaggactaaactctatcgttcacaaagccaaaattgagcaatatttcgacaaggctcagaacactaactcactgtggcacagcggagacgtgtggaaaaagaacgaagttaaggacctgctgcgtaggctgaccgggcaggccgagggcaagctcatttctgtagagtacggaactgaggagaagataaagatccccgtgatttcagtttactccggaccgctcaggagcgggagaaacatagaacgtgtatctttctatctcggattttcaattgaggggcccctggcctatgatatcgaagtaatttag

SEQ ID NO: 136388 - DNA, 213 bp, Artificial Sequence
  Description of Artificial Sequence: Synthetic coding sequence
atgagtaaacaggtgagcttgccagagatgatcaaagattggacgaaggaacatgttaaaaaatgggtgaacgaagacctgaagatcaacgagcaatacggtcaaattctgctgtcagaagaagtgactggactggtattgcaagaactcaccgagaaagacctggtcgaaatgggcctgccctggggtcccgccttacttatcaagaggtag

SEQ ID NO: 136389 - DNA, 213 bp, Artificial Sequence
  Description of Artificial Sequence: Synthetic coding sequence
atgagcaaacaggtctcgctgcctgaaatgatcaaagactggacgaaggaacacgtgaaaaagtgggtgaatgaggacttgaaaattaacgaacagtatgggcagattctcctgtctgaggaggttactggactggttctacaggagttaaccgagaaagatcttgtagagatgggactgccgtggggacctgccctccttattaagcgatag

SEQ ID NO: 136390 - DNA, 213 bp, Artificial Sequence
  Description of Artificial Sequence: Synthetic coding sequence
atgagcaagcaggttagtctgcccgaaatgatcaaggactggaccaaggaacatgtcaaaaaatgggttaacgaagatctgaaaataaatgagcagtatggacaaattctcctgtcagaggaagtcactggactggtgttgcaggagctcaccgaaaaagatctcgtggagatgggcctgccttggggcccagcgctgcttatcaaacgctag

SEQ ID NO: 136391 - DNA, 957 bp, Artificial Sequence
  Description of Artificial Sequence: Synthetic coding sequence
atggcgccatgggccgaagcggagcacagtgctctgaatccactgcgcgccgtgtggctgaccctgacggcggcattcctgctaacactgctgcttcaacttttgccacccggtctgctgccggggtgtgccatcttccaggacctgattaggtacggaaaaacaaaatgcggagaaccaagcaggcctgctgcttgcagggccttcgatgtgccaaagcggtacttcagccatttttacattatcagcgtgctttggaacgggttccttctctggtgtctaacacaaagtttgtttctgggcgccccattccccagctggctgcatgggttgctgcgtatcctgggtgccgcccagtttcaggggggcgagctggctttgtcagcattcctggtcttagtgttcctctggctgcactccctccggaggctttttgaatgtttatacgtctccgtgttctccaatgtgatgattcacgtggtgcagtactgctttggcttagtctactatgttcttgttggactgaccgtcctctctcaagtacccatggatggccgtaatgcatacattaccggaaagaatctcctcatgcaggcgcgttggtttcacatccttggtatgatgatgttcatatggtcgtccgctcaccagtacaaatgccacgtcatcctgggcaatctgcgcaagaacaaggccggcgtggtgattcactgcaaccacaggatcccttttggcgattggtttgagtacgtctcttctcccaactacctggccgagctgatgatctatgtgagtatggccgttacattcggatttcacaacttaacctggtggcttgtggtgacaaacgtcttttttaaccaagccctcagtgctttcctgtcgcaccaattctataagagcaagtttgtctcttatcccaagcatagaaaggcattcttaccgtttctcttctag

SEQ ID NO: 136392 - DNA, 711 bp, Artificial Sequence
  Description of Artificial Sequence: Synthetic coding sequence
atgacacgctgccccgccggacaggcagaagtcgagatggcagagctgtacgtaaaaccaggaaataaagaacggggctggaatgacccgcctcagttttcgtacggactccagacacaggcgggcggaccccgtcggtcacttctcacaaagagggtcgccgcaccgcaggatggctccccccgtgtacccgcctccgagaccagccctggacccccccccatgggcccaccacctccgagcagtaaggccccccgatccccacccgtgggatcaggcccagctagcggcgtcgaaccaacatcattcccagtggaaagcgaggctgtgatggaggatgtgctccgcccacttgagcaggcgctggaagactgcagagggcacacaaggaagcaagtgtgtgacgacatctccaggagattggcactgctgcaggaacaatgggccggaggtaaacttagtataccagtcaagaaaagaatggcgctgttggtccaggaattgtcctcacatcgctgggatgccgccgacgatattcacaggtctctgatggtagaccacgtcactgaagtttctcagtggatggtaggtgtaaaaaggctgattgccgaaaaaaggagcctatttagcgaggaggctgccaatgaagagaaatctgccgctaccgcggaaaaaaatcacaccatcccaggatttcaacaagcttcctag

SEQ ID NO: 136393 - DNA, 681 bp, Artificial Sequence
  Description of Artificial Sequence: Synthetic coding sequence
atggaaggttgcgtctcgaacttgatggtctgtaaccttgcatactctggtaagctggaggaactaaaagaaagtatcctggctgacaaatccctagccacacgcacagaccaggattctcggactgcactgcactgggcttgttccgctggacataccgagatcgtggagttccttttgcagttgggtgtcccagtgaacgacaaagatgacgcaggatggtccccactgcatatagcagctagtgccggtagagacgagatcgtcaaagcccttctgggcaaaggtgcacaggtaaacgcagtgaatcagaacggctgcaccccattgcactatgcggcctcaaagaacaggcacgagattgctgtgatgttgttggaaggaggagctaaccccgacgccaaagatcactacgaagcaacagctatgcatcgggcagccgcaaaggggaatttgaagatgatccatattctcctttactacaaagcatcaacaaatattcaggataccgaggggaacactcctctgcatcttgcctgtgacgaggaacgggtcgaggaagccaagctgttagtgtcccagggggcctctatctatatcgaaaacaaggaggagaagactccactccaagtcgcgaagggaggacttggcttgatcctgaagaggatggtggagggatag

SEQ ID NO: 136394 - DNA, 780 bp, Artificial Sequence
  Description of Artificial Sequence: Synthetic coding sequence
atggcgactgcaacaggcgtggcggaagaaagacttctcgctgctctagcttacctacagtgtgccgtgggttgtgctgtgtttgctagaaaccgccagactaattccgtttacggccgccatgctctgccgagtcaccgcctaagggtgcccgccagagctgcttgggtagtccaagagttgccgagcttggcgctacccctgtaccagtacgcgagcgagagtgcgccaagactccggtcagctccaaactgtattttgcttgccatgtttctcgtccattatgggcatcgctgtctgatttatccatttctcatgaggggcggcaagcctatgccgctcttggcttgcaccatggcaatcatgttctgtacctgcaacgggtacttacaaagccggtacctctcacactgcgccgtgtacgctgacgactgggtgaccgacccccgttttctgataggttttggcctgtggttgaccgggatgctgatcaacattcactcagaccacattctcagaaacctgcggaagcccggcgacaccggctataaaattcctagggggggactatttgagtatgttacagcggccaactattttggcgaaattatggagtggtgcggctacgccctcgcctcttggagcgttcagggcgcggcttttgctttcttcaccttctgcttcctcagcggccgtgcaaaggaacatcatgagtggtatcttagaaagtttgaggaatatcccaagtttcgtaaaattatcattccttttctgttctag

SEQ ID NO: 136395 - DNA, 585 bp, Artificial Sequence
  Description of Artificial Sequence: Synthetic coding sequence
atggaacacgctgcccagccctggagatggcaacggagaagagggtggcgacgctccgcgtgctggcctagaagtcccacttgctcagctccctgggccgcacgctcttcccgcgccatcgttagaagaactcaatgcacagccgctacacggtgtcccgccacgggttctgaatgtagacgggggccaccaggctggtgtcggagttgccctcggtggccatgccgcagtacttccacaccagcttccccccctagagtgagcgccgctaggccaacagctagtagctggccttgctccagtagcactaccggaatcggaaacgtgggcatgcaagcccttgccgtgtgtctacatcctaagtgtcagcccatggtcccaattgtctgcccagacctgaatcacgacagcaaaactcaacgagaaatagctggcattcgctgctcatattcactgctggggaacactgccgccagccgaaggataccaacttccttgatgactcaacatctgaacgcacacctgctggccaatacctgttttgcagtaaatcagtacgaggtatttttgggagtccttgcctag

SEQ ID NO: 136396 - DNA, 639 bp, Artificial Sequence
  Description of Artificial Sequence: Synthetic coding sequence
atggaacacgctgcacagccttggcgctggcagcgcagacgagggtggcgccggtctgcctgctggccaaggtccccaacctgttctgccccttgggctgcgcgctcttctagagccattgtccgtagaacgcagtgtaccgccgcaaccagatgccccgccaccggctctgagtgtcggagaggccccccggggtggtgtagaagctgtccacgctggccctgtaggtcgactagtacccccgcatccccccctagagtcagcgctgccagacctacagcttcatcatggccgtgctccagctctacaacagggatcgggttcggcttgtggcttaccggcatgttgatcaacattcacagcgaccatattcttcgtaatctgcgcaaacctggggacaccggttacaaaattcctagagggggcctcttcgaatatgtcacagctgctaattacttcggggagatcatggagtggtgtggttatgctcttgccagctggtccgtgcagggcgcagctttcgcctttttcacattttgcttcctttccgggagagccaaagagcaccacgagtggtatctaaggaagtttgaggaataccccaaattcagaaaaatcattatcccctttcttttttag

SEQ ID NO: 136397 - DNA, 858 bp, Artificial Sequence
  Description of Artificial Sequence: Synthetic coding sequence
atgctgctggcaacctttaaactctgcgcagggtctagctacagacatatgaggaatatgaaggggttgcggcagcaggctgtgatggcgatttcccaggaattaaacaggcgcgctttaggcggaccaaccccatccacttggattaaccaggtccgacgcagaagcagtctgttgggctcccgtctcgaggagaccctttattccgaccaggaattggcctatctgcaacagggcgaagaggcaatgcagaaagctctgggcattctcagcaaccaggaaggctggaagaaagagtcccaacaggataacggggacaaggttatgagcaaggtggtgccagacgtgggcaaggtgtttcgactggaggtggtagtcgatcagcccatggagcggctctacgaggagctggtggagcggatggaggctatgggtgagtggaacccgaacgtgaaagaaatcaaggtgttacaaaaaatcggcaaggacaccttcattactcatgagctggccgccgaggctgctggcaatctggtggggcctagagattttgtgtctgtccgttgtgccaagagacgaggctccacgtgtgtcctagccggcatggccacagacttcggcaatatgcccgagcagaaaggagtcattagagccgagcatggtcccacatgtatggtgctgcatcccttggccggctcaccgtcaaagactaagctaacctggttgctgtccattgacctcaagggctggctacctaagtctatcataaatcaggtcttatcccaaacacaggtagactttgccaaccacctccggaaacggttggagtcccaccctgccagcgaggctcgatgttag

SEQ ID NO: 136398 - DNA, 744 bp, Artificial Sequence
  Description of Artificial Sequence: Synthetic coding sequence
atgctactggccacatttaagctgtgcgctgggtcttcctatcggcacatgcgaaacatgaagggaagcagacttgaagaaacgttatattctgaccaggaattggcctacctccagcagggtgaggaggccatgcagaaagccttagggatcttatctaatcaggagggttggaagaaagaatcgcagcaggataatggcgataaggttatgtcgaaggtggtgcctgatgtcggaaaagtttttaggctggaggtggtcgttgatcaacctatggaacgtctgtatgaagagctggtcgagcggatggaggctatgggagagtggaatcccaacgttaaagagatcaaggttctccagaaaatcggcaaggatactttcatcactcacgagctggccgctgaagcagcaggaaatctggtcggccctcgtgactttgtgtctgttcgatgcgcaaagcggcggggaagcacttgtgtcctcgcagggatggctactgattttgggaacatgcctgaacagaagggcgtcattagggctgaacacggccccacctgtatggtgctacatcctctggcggggtccccttctaaaacaaagctcacatggttgctgtctatcgacctcaaaggctggctccccaagtctataattaatcaggtgttgagtcagacccaagtggatttcgctaatcacctgaggaagagattggaatctcatccggcatcggaagctcgctgctag

SEQ ID NO: 136399 - DNA, 969 bp, Artificial Sequence
  Description of Artificial Sequence: Synthetic coding sequence
atgtcgtccagcccatgggagcccgccacgctgcgaagagtctttgtcgtgggagtcggtatgaccaagtttgtgaagcccggtgctgagaactcccgtgattaccctgacttagccgaagaagccggcaagaaagccctggctgatgcacagataccttattctgcagtagatcaagcttgcgtcggctacgtgttcggggtggctgaatgcgtgttagctctcggctttgaaaagatgtcaaaggggagtcttggcatcaagtttagcgatcggacaatcccaaccgataaacatgtagatctcttaatcaataagtacgggttaagcgcccatcctgttgcaccacagatgttcggatacgctggtaaagaacacatggagaagtacggcaccaagattgagcattttgcgaagattggatggaaaaatcataaacactccgtgaacaatccatacagccaattccaggatgaatacagcctggacgaggtgatggcaagcaaggaagtgttcgatttcctgaccattttgcagtgctgtcctactagcgatggtgccgctgccgcaatcctggcaagcgaggcatttgtgcagaaatatgggctgcaatcaaaggccgtggagatcctggcccaggaaatgatgactgacctccctagcagctttgaggagaaatctatcataaaaatggtagggttcgatatgtcaaaggaggcagctcggaagtgctacgagaagtctggacttactcccaatgacatagatgtaattgagctgcatgactgtttctcgaccaacgagctcctgacctatgaggcccttggactctgcccggaaggtcaaggtgcaacacttgtggatagaggcgacaatacatatggggggaagtgggttattaacccctcggggggcctgatctctaaggggcacccattgggtgcaacaggtggccattcttgcagctag

SEQ ID NO: 136400 - DNA, 1644 bp, Artificial Sequence
  Description of Artificial Sequence: Synthetic coding sequence
atgagcagctccccctgggagccagcaacactgcggcgagtgttcgtcgttggagtggggatgaccaaatttgtcaagcctggtgcagagaacagtcgagactacccagacctggccgaggaagctggtaagaaagctttagcagatgctcaaatcccctactccgcggtagatcaggcctgcgtcgggtacgtctttggagacagtacgtgtgggcagcgcgccatctatcattctctgggcatgaccggtatacctattatcaatgtgaacaacaactgtgccactggatctacagccctgtttatggccaggcagctgatccaagggggtgtagctgaatgcgtactggccttgggcttcgaaaagatgagcaaaggaagtctgggtatcaagttcagtgatagaacgatccccactgataaacacgtggatctgctgatcaataaatatgggttgagtgcccatccagtagccccccaaatgttcgggtacgccggcaaggagcacatggaaaagtacggaacaaaaattgagcactttgctaagatcggatggaagaaccacaaacattccgtgaacaacccttactctcagttccaagacgaatattcactagatgaagtgatggcctcaaaagaggtttttgattttcttacgattctgcagtgctgccctacctcggacggagccgcagccgccatcctcgccagcgaggccttcgtgcagaaatacgggcttcagtccaaggctgtggaaatactcgcacaggaaatgatgactgatcttccttcttcgttcgaggagaagtcaataattaaaatggtggggttcgacatgagtaaagaggccgcccgcaaatgctacgaaaagagcggactaacaccaaatgacatagacgtcatcgaacttcacgattgcttcagcacgaacgagttgttgacgtacgaggctctgggattgtgtcccgagggtcagggagccacccttgttgaccgcggggacaacacctacggtggtaaatgggttataaacccttccggaggactcatatccaaaggccatcccctgggagcgaccggactagctcagtgtgcagagctttgctggcagctgaggggggaggccggcaaaagacaggtccctggcgccaaagtggccctgcagcataatctaggcataggcggagccgtggtggttaccctgtataagatgggttttcctgaggccgcttcgtcctttcgcacacaccagatcgaggcagtgcctacatcatctgcatcagatggtttcaaggccaaccttgtgtttaaggaaatcgaaaagaaactggaggaggagggcgaacagttcgttaagaagattggtgggatcttcgcctttaaggtgaaggatggaccaggtggcaaggaggccacctgggtggtggacgtcaaaaacggcaaagggtccgtcctgcccaacagcgataaaaaggctgattgcacaatcactatggccgacagcgactttctcgccctaatgaccggcaagatgaacccacagtcagcgttctttcagggtaaactgaagatcacaggaaacatggggttggccatgaagctgcagaatctacagctccagcctggcaacgccaagctgtag

SEQ ID NO: 136401 - DNA, 1572 bp, Artificial Sequence
  Description of Artificial Sequence: Synthetic coding sequence
atgtccagcagtccttgggagccagcgaccctgaggagagtcttcgtggtgggggtgggtatgactaagtttgtgaagcccggggccgaaaactcacgggactatccagatctagcagaagaagctggcgactccacctgtggccagagagccatataccactcactggggatgaccggtataccgattatcaacgtgaacaacaactgcgccaccggctcaacagctttgttcatggcaagacaattgatacaaggtggcgtcgccgagtgtgtactggccttgggtttcgagaaaatgagtaagggcagccttggcatcaagttcagcgatcgaacaattccaacagacaagcacgtggatttgctaatcaacaagtatggcttatcagctcatccagtggctcctcagatgttcggttatgctggaaaagaacatatggagaaatacgggacaaagatcgagcacttcgcaaagatcggctggaaaaaccataagcattccgtcaacaatccttatagtcagtttcaggacgaatattccttagatgaagtgatggcctccaaagaggtttttgatttcctgactatcctgcagtgctgtccgacatccgacggggctgcagccgctattctggcgagtgaagcctttgtgcagaagtacgggctccagtccaaagcggtggagattctcgcccaggagatgatgacagacctcccgtctagcttcgaggagaaaagcattattaaaatggtaggattcgatatgtccaaggaagccgcaaggaagtgctacgaaaagtctggtctcacacccaatgatatcgatgtgatcgaactccatgactgtttctccacaaacgagttgctgacgtatgaagccctagggctctgtccagagggccagggtgccacccttgttgaccggggagataatacctatggcggaaagtgggttattaacccatccggaggtctgatcagcaaaggtcatcctctcggggctacgggcctcgcccaatgcgccgaactctgttggcagttgcggggcgaggctggcaagaggcaggtcccgggcgccaaggtggcattgcaacataatcttggcatcggtggggccgttgtggtcaccctgtacaagatggggtttcccgaggcagcaagtagttttagaacccaccagatagaggccgtgcctactagcagtgccagtgacggctttaaggctaacctggtgtttaaggaaatcgagaagaagctggaggaggagggcgagcagttcgtcaaaaaaattggcggcatctttgctttcaaagttaaagacggccctgggggcaaagaagccacatgggtggtcgacgtgaagaacggcaagggatccgtattacccaatagcgataagaaggctgattgtacaattaccatggccgactccgatttcctggctctgatgacaggcaagatgaatccccaaagtgccttttttcaagggaagctgaaaataactggaaatatggggcttgccatgaagttacagaatctgcagctccagccgggcaatgccaaattgtag

SEQ ID NO: 136402 - DNA, 180 bp, Artificial Sequence
  Description of Artificial Sequence: Synthetic coding sequence
atgggatttccagaagccgcgtcttcatttcgcactcaccagatcgaagccgtgcctacctctagcgcatcagatggctttaaggccaatctagtctttaaagaaatcgagaagaagctggaagagattaggcgtttaacagctcaatctcaatggctgacacagacttcatggctgtag

SEQ ID NO: 136403 - DNA, 423 bp, Artificial Sequence
  Description of Artificial Sequence: Synthetic coding sequence
atggggttccccgaagccgcacggacccaccagatcgaagctgtacctacaagctctgcttctgatgggtttaaagccaatctcgtgtttaaggagattgagaagaagctcgaagaagagggcgagcagtttgtcaagaagatcggcgggatttttgccttcaaggttaaagacggcccaggcggaaaagaagctacttgggtagttgatgtcaaaaatggaaagggctctgtgctccccaattcagataagaaagcggattgcaccatcacaatggccgacagcgatttcctggccctcatgaccggtaaaatgaatccccagtccgccttttttcagggcaagctgaagatcacgggcaatatgggcctggccatgaaactccagaatctgcagttacaaccagggaatgcgaagttgtag

SEQ ID NO: 136404 - DNA, 432 bp, Artificial Sequence
  Description of Artificial Sequence: Synthetic coding sequence
atgggtttccctgaggccgcgtccagcttccggacacaccaaattgaagcagttccgacctcttcagcgtcagacgggtttaaggcgaacttggtctttaaagagattgaaaaaaaactagaagaagaaggagagcagtttgttaaaaagattggcggaatcttcgcattcaaggtaaaagatggaccaggcggaaaggaagcaacttgggtcgtggatgtgaaaaacggaaaagggtctgtgctaccaaattccgacaagaaggctgactgcacgattaccatggctgactctgatttcttagctctgatgaccggcaagatgaaccctcagtcagcatttttccaggggaagctcaagatcaccggcaacatgggtttggccatgaaactccagaacctccaacttcaacctggaaatgccaaactgtag

SEQ ID NO: 136405 - DNA, 180 bp, Artificial Sequence
  Description of Artificial Sequence: Synthetic coding sequence
atgggtttccccgaggctgccagcagctttagaacccaccagatcgaggcggtgcccacctctagcgccagtgatggcttcaaggctaacctagttttcaaagagattgaaaagaagcttgaagagatacggcgactgaccgctcaaagtcaatggttgacccaaacgtcatggttgtag

SEQ ID NO: 136406 - DNA, 1401 bp, Artificial Sequence
  Description of Artificial Sequence: Synthetic coding sequence
atgacaggtatacccataataaacgtgaataacaactgtgcaaccgggtctactgcccttttcatggcccgccagcttattcagggtggagtggccgagtgcgtgcttgcactcggcttcgagaagatgagcaagggctccctcggcattaaattctctgaccgcacgattcccactgacaagcatgtggatctacttatcaacaaatacgggctgtccgcgcacccggtcgcacctcaaatgttcggatatgctggcaaagaacatatggagaaatatggaacaaagatcgaacatttcgctaaaattggatggaagaaccacaagcattccgttaacaacccctattctcaatttcaggatgagtattccctggacgaggttatggcaagcaaagaagttttcgattttctcacaatcttgcagtgctgtcccactagtgacggcgcggccgcggcaatactcgcatcagaggcctttgtgcagaaatatggattgcaatcaaaggcggttgaaattctggcgcaggaaatgatgaccgacctgccctctagttttgaggagaagtctattataaagatggtggggtttgatatgagtaaggaggcagctcggaaatgctatgaaaagagcggactgacccccaatgatatcgacgtgatcgaactgcatgactgtttttcaacgaacgagctgctcacttacgaagccctcggactttgtcctgagggccagggggctaccctcgtagaccgcggtgataatacttatggggggaaatgggtcatcaatccgtccgggggtttgattagcaaagggcaccccctgggcgccacagggttagctcagtgcgccgaactctgttggcagttgcggggggaagcgggcaagcggcaagtgcctggagccaaggtcgcactccaacacaacttagggataggtggcgctgtagtggtaacattgtataaaatgggttttcctgaggctgcttcttcgtttagaactcaccagatcgaagcggttcctacatcatccgcttctgatggcttcaaagccaacctggtctttaaagagatcgagaagaagctggaagaggagggagaacaattcgtgaaaaaaattggtggcatctttgcctttaaggtgaaagacggccctggtgggaaggaggctacatgggtcgtagatgtcaagaacggtaagggcagcgtactgcccaacagtgataaaaaagcggattgtacaatcactatggctgattccgacttccttgctttaatgaccggcaagatgaacccacaatcggcctttttccagggaaaactgaaaatcacgggtaatatgggactcgcaatgaaactgcagaaccttcaactgcagcctggtaacgcaaaactgtag

SEQ ID NO: 136407 - DNA, 1512 bp, Artificial Sequence
  Description of Artificial Sequence: Synthetic coding sequence
atgtccagctcaccttgggagcctgctaccctgcgcagagtttttgtggtgggcgtgggcatgacaaaatttgtcaagcctggtgccgaaaactctcgcgattaccctgatctggctgaggaggctgggaagaaggccttagctgacgctcagatcccatatagcgccgtggatcaggcctgcgtgggctacgtgttcggtgtggctgagtgtgtcctggctctgggtttcgagaaaatgagcaaggggagcttgggaatcaagtttagtgataggaccattcccaccgacaaacacgtggatctcctgatcaacaaatatggcctctctgctcatcctgtcgctccacaaatgtttggatacgctgggaaggaacacatggaaaaatatggtacaaaaatcgaacattttgccaagattggatggaaaaaccacaagcactccgtcaataatccctatagccagtttcaggacgaatattcgctcgacgaggtcatggcgtccaaggaagtatttgactttttgacaatcctccagtgttgtcctacttccgatggagctgccgctgccatcctggctagcgaggcattcgtgcaaaaatacgggctgcaaagtaaggccgttgagatactagcccaggagatgatgaccgatctcccctccagctttgaagagaagtccattatcaagatggtgggtttcgatatgtccaaggaagcagccagaaagtgctatgaaaaatctggcctcactcccaatgacattgatgtcatagagcttcacgattgctttagtactaatgagctcttaacgtacgaagccctggggctctgtcctgaagggcagggtgccaccttagtggaccgtggagataatacttacgggggcaagtgggtaatcaacccgagcggggggcttatatccaaaggacaccccctgggcgcaaccggtttagcccagtgtgctgaattgtgctggcagctgcgcggcgaagcaggtaagcgccaggtgcctggggctaaggtggccctgcagcacaatctcggaattggaggagccgtcgtagtgacattgtacaaaatgggatttcccgaagccgcctcctcctttcgtacgcaccagattgaggctgtgcccacgagcagcgcctctgatgggttcaaggccaacctcgtgttcaaagaaatcgagaaaaagctagaagaggagggcgagcagtttgttaagaaaatcgggggcatttttgctttcaaggtcaaggatggcccaggaggcaaagaggcgacctgggtagtcgacgtgaaaaacggcaagggttctgtgctgccaaacagcgataagaaagctgactgcacaattaccatggccgacagtgatttcctggccctgatgactggaaagatgaatcctcaaagtgcgttcttccaaggtaaactcaagatcacagggaacatgggcctggcaatgaagcttcagaatctgcaattgcagccaggcaacgctaagctgtag

SEQ ID NO: 136408 - DNA, 1653 bp, Artificial Sequence
  Description of Artificial Sequence: Synthetic coding sequence
atggtgggcgaggaaaaaatgagcctcagaaacagactgagcaaatctcgagagaacccagaagaagacgaagaccaacggaaccccgccaaagaatccctcgaaaccccttctaacgggaggatagacataaagcaattgatcgcgaaaaagatcaaactcaccgctgaagcagaggagctaaagccatttttcatgaaagaagtgggatcacactttgacgatttcgtgaccaatctgattgaaaaaagcgcttctttagacaatggcggctgtgcactcactacattctctgtactcgaaggggagaaaaataaccatcgcgcgaaggatctaagggcccctcccgagcagggcaagatcttcatcgcccgaaggtctctgctggacgagctcctggaagtcgaccatattcgcactatttaccacatgtttattgcgctactcatacttttcatcttatccaccctcgtcgtggattacatcgatgaggggaggctggtgctggaatttagccttctgagctacgcgtttggcaaatttcctaccgtcgtgtggacttggtggatcatgttcttaagcacatttagtgtcccgtatttcctcttccagcattgggccaccggatactcaaagagctctcatcctctcatccgcagtctgtttcacggttttctgttcatgatctttcagataggggttctcggatttggccccacatatgttgtgctagcctatacactaccaccggcttcccggtttattataatctttgagcagatcagatttgtgatgaaggcacatagtttcgtccgcgagaacgtgcccagagtgctgaatagtgccaaggagaagtcctctacagtgcctattccaaccgtcaaccagtacttatacttcctctttgcacctaccctgatatatagagactcgtacccacggaaccctactgtgcggtggggctatgtagcaatgaaattcgcacaagtgtttggatgttttttctatgtatactatatcttcgagagattgtgtgcccccctcttccggaacataaagcaggagccctttagcgccagagtgctggtcttgtgcgtatttaactccatactgccaggcgtccttatcctgttcctcactttctttgcctttttgcattgttggctcaacgctttcgctgaaatgctgcgattcggggaccgaatgttctataaagattggtggaattccacgtcgtattccaactactataggacctggaatgtcgtggtgcacgattggctgtattactatgcttacaaggatttcttgtggttcttctccaaaaggttcaagagcgcagccatgctggccgtgtttgccgtcagtgctgtcgttcatgaatacgcgttagctgtttgtcttagctttttctatcccgtcttgttcgtcctgtttatgttcttcggcatggctttcaacttcatagtgaacgatagcaggaagaagccaatttggaacgtcctaatgtggacgagcctgttcctgggaaacggggtgctactgtgtttctactctcaggaatggtacgcaagacaacactgcccccttaaaaatcccacttttctggactacgtgaggcctaggtcatggacctgtagatacgtgttctag

SEQ ID NO: 136409 - DNA, 783 bp, Artificial Sequence
  Description of Artificial Sequence: Synthetic coding sequence
atggttggagaagaaaaaatgtccctgaggaaccgactctctaaatcccgagaaaacccagaggaagacgaggatcagaggaaccccgcaaaagagagcctggagacccctagtaatggacgaatagacatcaagcagctcatcgctaagaagattaagctgaccgccgaagcagaagagttaaaacccttttttatgaaggaggtggggagccacttcgacgatttcgttactaacctaattgagaagagtgccagtctggataatggggggtgtgcattgacaacgttttccgtgctggaaggcgagaagaacaaccacagagcgaaagacttgcgggctcctcccgagcagggcaagattttcattgctagacggtccctcctcgatgagctgctggaggttgatcatattaggactatttatcatatgttcattgcccttctgatcctcttcatcctgtcaaccctggtggtggattacatcgacgaaggtcgattggtcctggagttctcccttctttcttatgccttcggaaaattccccactgtggtgtggacctggtggatcatgttcctgagcacattcagtgtgccctattttctgtttcagcactgggccactggttatagtaagagcagccatccactgatccggtccctgttccacggctttctgtttatgattttccagatcggagtgctcggctttggccccacatacgtggtccttgcttataccctgcccccagcctctaggttcattataatctttgagcaatag

SEQ ID NO: 136410 - DNA, 861 bp, Artificial Sequence
  Description of Artificial Sequence: Synthetic coding sequence
atgaaggcccatagttttgtgcgcgagaatgtgcctcgcgtgcttaactctgcaaaagaaaaaagctcaaccgtccccatcccaaccgtaaaccaatacctctactttctgttcgcacctactctgatatatcgggattcttacccaagaaaccccacagtacggtgggggtacgtcgctatgaagtttgcccaggtgtttggctgctttttttacgtctactacatcttcgagcgtctctgtgcccccctgttccgaaatatcaagcaggaaccttttagcgctcgtgtcttggtcctatgtgtgttcaatagtatcttgcccggcgtgctcattctgtttctcacttttttcgccttcttgcattgttggctgaacgcatttgccgagatgttgagatttggtgaccgcatgttttacaaggactggtggaattctactagctacagtaactactatcgcacttggaacgtggttgtccatgattggctgtattattatgcctataaggattttctttggttttttagtaagcgttttaagtccgccgccatgttagccgtgtttgcagtctctgccgtcgtgcatgagtatgctctggcagtgtgtctctccttcttctaccccgtgctgtttgttctcttcatgtttttcggaatggcttttaactttatagtgaatgattcgcgtaagaaaccgatttggaacgttttgatgtggacgtccctgtttctgggcaacggcgtgctcctctgtttctactctcaggagtggtacgctcgccagcactgccctctgaaaaatcccacatttctggattacgtcaggcctcggtcctggacctgtaggtatgtgttttag

SEQ ID NO: 136411 - DNA, 1458 bp, Artificial Sequence
  Description of Artificial Sequence: Synthetic coding sequence
atgaaagaagtgggctcccatttcgatgacttcgtgaccaatctcatcgagaaaagcgcgtcactggacaacgggggctgcgcactgacaaccttctctgtcctcgaaggtgagaaaaacaaccatagggcaaaagacctgcgagccccacccgagcaggggaaaattttcatagccaggagaagtctgctggatgagttgctagaagtggaccacattcggacaatctatcatatgttcatcgctcttctgatcttgtttattctctcaactttggtcgtggattacattgacgagggcagactggtgttggagttttcactgctgtcttacgctttcggcaagtttcctaccgtggtttggacttggtggataatgtttctgtccacctttagtgtgccctattttttattccaacactgggcaacgggctattcgaagagcagccacccattaatccgaagcctctttcacggttttttattcatgatctttcagattggagtgctcggctttggcccgacatatgtggtcctggcttataccctgccacccgcaagtcggtttataattatatttgaacagattcgctttgtgatgaaggctcattctttcgtcagggagaacgttcctagagtccttaactctgccaaggagaaatcatctactgtccctatccccaccgtgaaccagtatctgtattttctatttgctcctacactcatttatagagacagctatccccggaatcctactgtacgctggggatacgttgcaatgaagtttgcacaagtgttcgggtgttttttttacgtgtattatatttttgaacggttgtgtgcccccttattccgaaatataaaacaggagcccttcagtgccagggttcttgttctttgcgtctttaacagtatacttcccggagtccttatactgtttcttacctttttcgcctttctacactgctggcttaacgccttcgctgagatgctccgcttcggagaccgcatgttctacaaggactggtggaactctacgagctatagcaactactacagaacctggaacgtagtcgtgcacgactggttgtattactacgcatataaggatttcctgtggtttttttccaaacggtttaagagtgccgcgatgctggccgtgtttgcagtgtcggccgtggtgcacgagtatgcgctggcagtctgcctgtccttcttttatccagtgctctttgttctgtttatgttcttcgggatggcgttcaattttatcgtgaacgacagcaggaaaaaaccaatttggaacgtactgatgtggacatccctgttcttgggcaatggggtgctgctgtgtttctacagccaagaatggtacgcccggcagcattgccccctgaagaatccaacttttttggactacgtgcgcccgcgaagctggacctgtcgctacgtgttttag

SEQ ID NO: 136412 - DNA, 1479 bp, Artificial Sequence
  Description of Artificial Sequence: Synthetic coding sequence
atggaactgaagccatttttcatgaaggaggtgggttcacatttcgacgacttcgtcacaaatctgatcgaaaagtctgcatcacttgacaacggtggctgcgcgttaactacattctcagtccttgagggagagaagaataatcacagagcgaaagatttacgagcgcccccagagcaaggtaagatattcatcgctcggcgaagcctcctggacgaactgttagaagtggaccatattaggactatttatcatatgttcatcgccctcctcatcctctttattctatccacgctcgtagtcgactacatcgatgagggcagactggttctggaattcagcttgctgagctatgctttcgggaagttcccaaccgttgtttggacctggtggattatgtttctgagcacattttcagtgccctactttctgttccagcattgggccactggttattctaaatctagccacccactgatcagaagtctgtttcacggtttcttgtttatgatttttcagatcggggtcctgggctttggacccacttacgttgtccttgcttatacactgcccccagcctccaggttcattatcatattcgaacaaatccggttcgtgatgaaagcccacagcttcgtccgggaaaacgttcctcgagtcttaaattccgctaaagaaaaatcctctactgtgcctattcctaccgtcaaccagtacctgtacttcctcttcgcgccaactctcatttacagggacagctacccaaggaaccccactgttcgatgggggtacgtggcgatgaagtttgcccaggtgtttggctgtttcttttacgtctactacatttttgaaaggttgtgtgctccgctattcagaaatattaagcaggagcctttctcagcccgcgtgttggtgctgtgcgtcttcaactcgatcctgcccggcgtgttaatcctgttcctgacttttttcgccttcttacactgttggctgaatgccttcgctgagatgttgaggtttggtgaccggatgttttataaagattggtggaacagtacatcctactcaaattattacagaacctggaatgtggtggtccacgactggttatactattacgcctacaaagattttttgtggttcttcagcaagcgcttcaagtcggcagcaatgctggcagtttttgccgtaagcgcagtcgtccacgaatacgccctggctgtatgcctcagcttcttctatccggtcctgttcgtgctctttatgttctttggcatggcattcaattttattgtgaatgacagtcggaagaagcctatttggaatgttttgatgtggacgagcctgttcctaggcaatggtgtcctgctttgcttttactcccaggagtggtatgcccgtcagcattgtcctctcaagaatccgacttttcttgactacgtgagaccccgtagttggacttgtaggtatgttttctag

SEQ ID NO: 136413 - DNA, 1569 bp, Artificial Sequence
  Description of Artificial Sequence: Synthetic coding sequence
atggaaccaggaggggctagactccgattacagcgtaccgagggcctaggaggggaacgagaaagacagccctgcggggatggcaatacagagacgcaccgcgcacctgatctcgtccagtggacaagacatatggaggcagtcaaggcacagctcctcgagcaggcgcaagggcagttgcgcgaactcctcgatcgcgctatgagggaggctatccagtcttatccatctcaggacaaaccactgccccccccgccccccgggagtttgtcacgaacccaagagccatctcttggcaagcagaaggtgttcataattaggaagagcctactggacgaactcatggaagtccagcatttccggacaatttaccacatgtttattgccgggctttgtgtgttcattatcagtactttggctatcgatttcattgacgaaggcaggctgctcttggaattcgatctcctcatcttttcatttggccagttaccactggccctggtgacatgggtgccaatgttcctttccacactgctggctccctatcaagctttacgactctgggcgagagggacatggactcaggccactggcctgggttgtgccctgttagccgcacatgcagttgtgctttgcgcattgcctgtacacgtcgccgtagaacaccagctgcccccggcttcccgttgtgtcctggtctttgagcaggtcagatttctgatgaaatcatactccttcttgcgggaagccgtcccaggtacgctgcgggcaagaaggggagagggaattcaagcccccagcttctcctcttatttatactttctattttgccccacactaatttatcgagaaacctatcctagaacgccttacgtccgttggaattatgtggccaagaactttgcacaggctttaggttgtgtgttgtacgcgtgcttcatcctgggacggctgtgcgtccccgttttcgcaaacatgtctcgggaaccctttagtacccgggctctcgtgttaagcatcttgcatgcaacgctgcctggtattttcatgctcttgctcatttttttcgcctttctgcattgttggctgaacgcttttgctgagatgcttcggttcggggatcgcatgttttaccgtgactggtggaattccacttcgttcagcaattactacagaacttggaacgtggtggtccatgactggctctattcgtatgtgtatcaggacggcctgcgcctcctgggcgctagagccagaggagtcgctatgctaggagttttcttggtgagcgccgtagctcatgagtacatattttgtttcgtgctgggatttttctaccctgtaatgctcattctcttcctggtcattggtggcatgctgaatttcatgatgcatgatcagcgaaccggcccagcttggaatgtgctgatgtggacgatgctgtttttggggcagggaattcaggtcagtttatactgccaggagtggtatgcacgacgccactgccctctgccccaagcaactttttggggcttagtaacacctcgttcatggagttgccatacgtag

SEQ ID NO: 136414 - DNA, 3426 bp, Artificial Sequence
  Description of Artificial Sequence: Synthetic coding sequence
atggatgacagcggagaactgggcggactggaaacaatggaaacactcaccgagctgggtgacgagttgactctaggcgatattgacgagatgctccagttcgtctctaatcaggtgggtgaattccctgatcttttctccgagcaattgtgcagcagctttccaggaagcggcggtagcggcagttccagcggcagctctggatcatcaagctcctcttccaacggtagaggttctagcagtggggctgtagacccctcggtgcagcgttccttcacacaggttaccttgccttcctttagcccatcggcagccagtcctcaggcacctaccctacaggtcaaagtgtcccctacttctgtgccgaccaccccccgagccacacccatccttcagcctcgtcctcaaccacagccccagccacaaactcagctccagcaacagaccgtcatgatcactccgacatttagcacgaccccacaaacaagaatcatacaacagcccctcatttaccagaatgccgctacgtcgttccaggtgttgcagccccaggtgcagagcttagttacctcgtcgcaggtgcagcccgtgaccattcaacagcaggtccagaccgtccaggcacagagagttctgactcaaacagctaacggtactctccagacactcgcacctgcaactgtacagacagtggctgcacctcaggtgcagcaggtacctgtgctcgtgcaaccccagatcatcaagaccgactccctggtgttgaccacactcaagacagatggctctcctgtaatggccgcagtgcaaaatccagccctgaccgcacttaccacccccattcaaactgcagccctacaggtgcctacacttgtggggtcatcgggcacaatcctgacaaccatgcccgtgatgatgggccaggagaaggtgcccatcaaacaagttcccggaggggtgaagcagctagagccgcctaaggagggcgagcgccgcacgacacacaatataatcgaaaaacggtaccggtcctccattaatgataaaattattgagctgaaagaccttgtgatgggtacagacgctaagatgcacaaatccggggtgctgcgaaaggcgatcgattacatcaagtacctccagcaggtgaaccacaagctgcgacaagagaacatggtactgaaacttgcaaatcagaagaataagctactgaagggcatcgacctgggatcattggtggataacgaggtagatctcaaaattgaggattttaatcagaacgttctgttaatgtcgcctcctgctagtgatagtggctcgcaggccgggttttcaccgtacagtattgacagcgagcctggctcgcccctgctggacgacgccaaggtgaaggacgaacccgatagcccccctgtcgcactgggcatggtcgacaggagccggatcctgctttgtgtgctgacgtttttgtgcctgtccttcaatccgcttacctcgctcctacaatggggtggtgctcacgacagtgatcagcacccccatagcggctcaggaaggtccgtcctgtccttcgaatccggttccggaggttggttcgactggatgatgccaaccctcttgctgtggctggtcaatggagtgatcgttttgtctgtattcgttaagctcctggtgcatggagagcctgttattcgcccccacagcaggagcagcgtgaccttttggagacaccgtaaacaagccgacctggacctagctcgaggagactttgccgctgccgctggaaacctccaaacctgcttagccgtactcggacgtgctttacctacgtccaggttagacttggcttgcagtctctcttggaacgtgatcaggtacagtcttcaaaagctgcggctagtccggtggctcttgaagaaggtcttccagtgccgtcgtgccaccccagccacagaggctggattcgaagatgaggcgaagacgagtgccagggacgctgccctggcttatcatagactgcaccagctacacatcacaggtaaactgccagccgggtctgcctgtagcgacgttcacatggctctgtgcgccgttaacctggccgagtgtgcagaggagaagatcccaccatccaccctcgtcgaaattcatctgacagcagcgatggggctaaaaacacgatgcgggggaaaactcgggttcctggcctcctacttcctgtcgcgagcccaatcactttgtggcccagagcacagcgctgtgcccgactccctccgctggttgtgtcatccacttggccaaaaattcttcatggagaggtcttggtccgtgaagtcggcggcaaaagagagcctgtattgtgcccagcgtaatcccgcggaccctatcgctcaggtccaccaggccttctgtaaaaatttgcttgagcgagcgatcgagtctctcgttaaaccacaggccaaaaagaaagcgggggatcaagaagaggagtcttgtgaattttccagcgctctggaatacctgaagctgcttcacagcttcgtcgatagcgtgggcgtcatgtcgcccccactgtcacgtagtagcgtcctaaagagtgctctggggcctgatatcatctgcagatggtggacaagtgctattactgtggccatttcttggttgcagggggacgatgctgccgtgagatctcactttaccaaggtcgaacggataccaaaagccctggaagtcactgaaagccccctcgtgaaggccatcttccatgcttgccgggctatgcacgcctccctcccagggaaagcggacggacagcaatccagcttttgtcactgcgaacgcgcatcaggtcacctctggtcctcactcaacgtgtcaggggccacgagtgacccagccctcaaccatgtggtgcaactgctgacttgcgacctgctgctgagtctgaggaccgcactatggcagaagcaagcatccgcgagccaggccgttggcgagacgtaccacgcaagcggagctgagttggccggatttcagcgggatctgggttcactgaggcgactggcacactcattcaggcctgcttaccgtaaagtgtttttgcacgaggctacggttagacttatggccggtgcatccccgacgagaacacaccagttgttagagcatagtctccgcagaagaacaacccagtccactaagcatggggaggttgacgcctggcctggccagcgggagcgcgcgacagccattctgttggcctgcaggcacctgcccttgtcattcctttcctcgcctggccaaagggccgtcttgctggctgaggctgccagaactctggaaaaggtgggcgatagacgcagctgtaacgactgccagcaaatgattgttaagttgggcggcggcactgcaattgccgcttcgtag

SEQ ID NO: 136415 - DNA, 2055 bp, Artificial Sequence
  Description of Artificial Sequence: Synthetic coding sequence
atggacgacagcggagaactgggcggcttggagaccatggaaactctgactgagctcggggatgagctaacactaggtgacatcgacgagatgctgcagtttgtttccaatcaggtgggcgagtttccagacctgttcagtgagcagctgtgctcatctttcccgggttctgggggtagcggatctagcagcgggagttccggcagttcttcctccagtagcaatggccgcggttcctctagtggtgcagtggaccctagcgttcaacgaagtttcacacaggtgaccttaccctccttctcacccagtgccgcctccccgcaagctcctacacttcaggtgaaggtttctcccacgagcgtgccaactacccctcgcgcaacgccgattctccaaccccggcctcaacctcagcctcagcctcagacacagttgcaacaacaaacagtaatgatcaccccgaccttctctaccactccgcagaccaggataatccaacaaccccttatctaccaaaatgctgccaccagtttccaggtgttacagcctcaggtgcagtcattagtgacctcatcacaagttcaacccgtaaccattcagcagcaagttcagactgtccaggcccagcgagttctgacccaaactgctaacggcaccctccagacactggctcctgctacagtgcagacagtcgctgcacctcaagttcaacaggtgcccgtgttagtgcagccacaaatcattaaaacagattcacttgtacttactacgctgaaaaccgatgggtctcctgtgatggctgccgtgcagaatccggccctgaccgcactgactaccccaatccagaccgcagctcttcaggtgccgacccttgtagggtcttctggtaccatcttaaccactatgcctgttatgatgggtcaagagaaggtgccaattaaacaggtacctggtggagtcaaacagctggaaccccccaaggagggggagaggcgcacaacccataatattatcgagaaaaggtatcggagcagcattaacgataaaatcatagagctgaaagatttagtcatgggcaccgatgcgaagatgcataagagcggcgtgctccggaaagcgatcgattacatcaagtatctgcagcaggtcaatcataaacttcggcaagaaaacatggtgctgaagttagccaatcaaaaaaacaaactactcaaagggatcgatctgggatcgctggtcgacaacgaggtcgacttgaagattgaggatttcaaccagaatgtgctgttgatgagcccccccgcttcagacagtggatctcaagctgggtttagtccttactctattgattctgagcccggatcaccattgctcgatgacgctaaggtgaaggatgagccagactcaccgcctgtggcccttggtatggtcgaccggtccaggatcctgctgtgtgtgttaaccttcctgtgcctgagttttaaccccttgaccagcctgctccaatgggggggcgcccacgactccgatcagcatccccactccggtagcggacgctccgtgctatccttcgaaagtggctcaggcggctggttcgattggatgatgcccactctgctgctgtggttggtcaatggtgtgattgtactatctgtgtttgtcaaactgttagtccacggggaacccgtgataaggcctcactcacgcagcagtgtgactttctggcgtcaccggaagcaggccgacctggacctggcaagaggcgtctatgggaagaagtccggggcaacccatagtatagaggaggaactcaacatccacatctcgagaggaactcggacccgaaccctccttagctctagaaggttttgctcttgctgtagacaacctaccaacctgcccgggagtttcggccctggaacagctcacctgccgcccgggcccggtctacaacccctgctggagagggacccactgcagcctgctgaggcgacccccggcgccctagcggcgcaagagtcactgccggtccccgctggacatgcatcgcactag

SEQ ID NO: 136416 - DNA, 3309 bp, Artificial Sequence
  Description of Artificial Sequence: Synthetic coding sequence
atggacgatagcggagagctcggggggttggagacaatggaaactttgacagaactgggagacgagctgactctgggggatattgacgagatgctgcagttcgtgagcaatcaggtcggagagtttcctgaccttttttccgagcaattgtgttctagctttcccgggagcggcggaagtggatcgagctccggctccagtggaagcagttcgagctcaagcaacggtcgaggctcttcgagcggcgccgtcgacccatccgtacagcgaagtttcacacaagtaacactgccttctttctctcccagcgctgcgtccccccaggcccccacactgcaggtcaaagtgtcgccaactagtgtgccaaccacgcctagagcaacaccaatcctccagccaagaccacagcctcagccgcaacctcaaacccaactgcagcagcaaacggtcatgatcacacccacttttagcaccacaccccaaactagaatcattcagcagcctcttatttatcaaaacgcagccacctcgtttcaagtgctgcagccacaggttcagtcgttggtgacatcaagtcaagtgcagccggtcacaatccaacaacaagtccagactgtccaggcacaaagggttctcactcagaccgcaaatggcacgctgcaaaccctagccccagctactgtgcagaccgttgcagctccgcaagtgcagcaagtgcctgtgctggtccagccccaaattataaagacagactctttggtccttacgaccctaaagacagacgggtcaccagtgatggccgcagtccaaaaccctgcactgacagcacttaccacccccattcagacagccgctttgcaggtgcctacgctggttggctcctctggaacaatcttgacgaccatgcccgtgatgatggggcaagagaaggtgcccattaagcaggttcccggtggcgtgaaacaactggaacctcctaaagagggggaacgcaggactactcacaacattattgaaaaacgttatagatcaagtataaatgacaagatcattgaactcaaggacctagttatggggactgacgcgaagatgcacaaatccggggtgctgaggaaggcaattgactacatcaagtacctgcagcaagtcaaccacaaattgcggcaggaaaacatggtgctgaagctggccaaccagaaaaacaaactacttaagggcattgatctcggaagccttgtggataatgaagtcgacctcaagatagaagactttaaccaaaacgttcttttaatgtccccccctgcaagcgactcgggatcccaggccgggttctctccatactccatagattccgagcctggttcccctctgctggacgacgccaaagttaaagatgagcccgatagtcctcccgtcgctttgggcatggtggaccggtctaggattcttctgtgtgtcttaacattcctgtgtctctcctttaatcctctcacatcgctcctgcagtgggggggagcacatgacagcgaccaacaccctcactctgggtctggccgaagtgtgctctccttcgagtctggatccggaggctggttcgattggatgatgcccacactcctgctatggcttgttaacggcgtgatcgtcctgagtgtatttgtgaagctgctcgttcatggtgaaccagttatccggccgcattctagatcatcagttactttttggcgccatagaaagcaagccgatcttgacctggcaaggggcgacttcgccgccgctgcgggtaatttacagacatgtctggcagtgttaggacgggctctgccgacaagtcggttggatttagcttgttcgctgtcctggaatgttattagatattctcttcagaagcttcgcctcgtacgatggctcttgaagaaggtgtttcagtgccgccgagcaactccagctactgaggccggctttgaagacgaggccaagacaagtgcccgggacgccgctctggcataccacagactacaccagctgcacattaccggtaaactgcctgcaggttccgcatgctccgatgtccacatggccctgtgcgcagtgaacctcgccgaatgcgccgaggaaaaaatcccaccttcaaccctcgttgagatccacctaaccgccgctatggggctcaaaaccagatgtggggggaagttaggtttcctcgccagctattttctcagtcgtgctcaaagtctctgcggacctgagcattccgctgtgcccgacagcctccgatggttgtgtcacccactgggccaaaaatttttcatggagcgatcgtggtcagtcaagtcagcagcaaaggaatcactatattgtgcgcagcgtaatcctgctgatcccatcgcacaggttcatcaagcgttttgcaagaatctactggagcgagccatagaaagtttagtgaagcctcaggccaagaagaaggctggagatcaggaagaagagtcctgcgagttttcttctgccctagagtatctgaagctgctgcactcctttgtcgattctgtgggcgtcatgtctccccccctgtcacgaagctccgtgctcaagagtgcattagggccagacatcatatgtagatggtggacatctgccatcaccgtggcaataagttggctgcaaggcgatgatgccgcggtccgaagtcacttcaccaaagtcgagagaatcccgaaagccttagaagtcacagaaagtcccttagtgaaggccattttccacgcttgtagggccatgcacgccagtcttccaggcaaagcagatggacagcagagctcattctgtcactgtgagagagccagtggacacctttggtcctccttaaatgttagcggtgccacaagcgaccccgcgctgaatcatgtggtgcagctccttacctgtgatctgctgctgtccctccggacagcgttgtggcagaagcaagcaagtgcctctcaggccgtgggagaaacatatcacgccagcggagcagagctcgccggatttcaacgtgacctgggctctcttaggaggctggctcacagcttcaggcctgcttatcgtaaagtattcctacatgaagctacagtgagactgatggccggggcttctcccacccgaacgcaccaactgctggagcacagcctgcgccggagaacaacacagtcaacaaaacatggagaggttgatgcttggcccgggcaacgggaacgcgccaccgccattctgcttgcgtgccgacacctgcctctgtccttcctcccatgcctccagccctcctag

SEQ ID NO: 136417 - DNA, 648 bp, Artificial Sequence
  Description of Artificial Sequence: Synthetic coding sequence
atgcacgccagtctgcccggaaaggccgacggccagcaatcctccttctgtcactgtgagagagcttcgggtcacttatggtcatctctaaacgtgagcggagccacaagtgaccccgcccttaaccatgtagttcagctcctgacatgtgatctgctattgtcattacgtaccgccctctggcagaaacaggcaagcgctagccaggccgtgggggaaacctatcatgccagcggagctgaactcgccggcttccagcgcgacctcggtagcttgagacgactggcccattcctttcgcccagcatacaggaaagtgtttctgcacgaagccactgttcgtcttatggccggtgcaagtcccacacggactcaccagttactggaacacagcttgcgccgacgaacaacacagagtacgaagcacggggaggttgacgcctggccgggtcagagggagcgcgcaactgctattttgcttgcctgtaggcacctcccattaagctttctttcaagcccaggtcaaagggccgtgctgctagctgaggccgcgcgcacactcgagaaagtaggggacagacgctcatgtaatgattgccagcagatgattgtgaaactgggcggcgggacggccattgccgcctcctag

SEQ ID NO: 136418 - DNA, 900 bp, Artificial Sequence
  Description of Artificial Sequence: Synthetic coding sequence
atggatcttgtgctaagggtggctgattattactttttcactccttacgtgtatccagctacgtggccagaagacgatatattccggcaagctatctctctgctgatcgtaaccaacgtgggcgcctacatcctttacttcttctgtgcaacactgtcatactacttcgtgtttgaccatgccctgatgaagcacccgcaattcctaaagaaccaagtacgacgggagataaagttcacagtgcaagccctgccatggatctccatcttgacagtagccttgtttttgctggagattcgcggatactcgaaactccacgatgaccttggcgaattcccatatggcctctttgagttggtggtttcaattattagctttctgttcttcacggatatgttcatctactggatccatcgcggtttacaccaccggctcgtctacaaaaggttgcacaaacctcaccacatctggaagataccaacccccttcgcctcacacgctttccatcccatagacggctttcttcaaagcctaccttaccatatttacccatttatctttcccctgcacaaggtggtgtaccttagcctttacatcttggtgaatatctggaccatcagtatccacgacggcgacttcagggtgcctcagatcctgcagccatttatcaatggttcggctcaccacactgaccaccacatgttcttcgactacaactatgggcagtatttcacactttgggatcgaatcggcggatcatttaagaacccaagctcctttgagggtaagggacctcttagttacgttaaagaaatgaccgaagggaaaaggagttctcactcaggcaatggttgcaagaacgagaaactttttaacggcgaatttacaaagaccgagtag

SEQ ID NO: 136419 - DNA, 900 bp, Artificial Sequence
  Description of Artificial Sequence: Synthetic coding sequence
atggacctggtcctgcgagtggccgactactattttttcacaccatatgtgtaccccgctacgtggccagaagacgacatttttcgtcaggccatttctctgctaatagtgacaaacgtcggcgcatatatcctgtacttcttctgcgccacgttaagttactacttcgtgtttgaccacgcactgatgaagcatcctcagtttctgaagaaccaggttcgccgggaaatcaagtttactgtccaagccctgccatggatctccattttgacggtagccttattcctattggaaattcgaggctacagcaagctgcacgacgacctcggcgagttcccttacggcctgttcgaactggtggtcagcattattagtttcctatttttcaccgacatgttcatttactggatccacagaggactgcatcatagactggtgtataagagactgcacaagccacatcacatctggaagatcccaaccccctttgcaagccatgcattccaccctattgacggattcctgcagagcttaccctaccacatatacccttttatatttcctctgcacaaagtggtgtacctgtccctgtatatacttgtgaacatctggactatatcaattcacgatggggatttcagagtgccacaaattctgcagccgtttatcaacggaagcgcacaccacacagatcaccacatgttcttcgattacaattacggccagtacttcactctctgggacaggatcggtggctcctttaagaaccctagctcgttcgagggtaaggggccacttagctacgttaaggaaatgacagaggggaagcggagctctcattccggaaacggttgcaagaatgaaaaactctttaatggggaatttaccaaaacagagtag

SEQ ID NO: 136420 - DNA, 192 bp, Artificial Sequence
  Description of Artificial Sequence: Synthetic coding sequence
atggagggggccggcgctggctcagggtttcgtaaggagctagtgagcaggcttctgcatctgcactttaaagatgataagacaaaggaggcagccgtgcggggggtgagacaggctcaagccgaagatgccctcagggttgacgtggatcaattggaaaaagtattaccacagttgctgctcgacttctag

SEQ ID NO: 136421 - DNA, 246 bp, Artificial Sequence
  Description of Artificial Sequence: Synthetic coding sequence
atggagggcgcgggagcgggatctggattccgcaaggagctggtttcccgtctgttacacctgcattttaaagatgataaaactaaggtctcgggggacgccctgcagctcatggttgagctgctgaaagtcttcgttgtggaagcagccgttcgaggggtgcgccaggcacaggccgaggacgccctccgggttgacgttgaccagctcgaaaaagtcctcccccagctcttactagacttctag

SEQ ID NO: 136422 - DNA, 2121 bp, Artificial Sequence
  Description of Artificial Sequence: Synthetic coding sequence
atgggcggcaagggagggggggatacccggggtcccgtcctttttccctgtcagctggcacaggctctcagtccccgcagagcctttccccgcgagctcaaagagaaaggacagagaatgagtagccaacccgctggtaatcaaacttctcctggggccaccgaagactactcttatggttcgtggtatatcgatgagcctcaaggaggcgaggagctgcagcccgagggggaagtgccaagctgtcacaccagcattccgccagggctgtatcacgcctgcttagccagtttatcaatcctggtgttgctgctactggccatgctagttaggcgtagacagttgtggccggattgtgtccgaggtagacctggcttgccctctcctgtggatttcctcgctggagataggcctcgggctgtgcccgctgcagtcttcatggttctgcttagctctctctgtctgttgctacccgacgaggacgctctgcccttcctgactcttgctagcgcaccatcccaggatggaaagaccgaggccccgaggggcgcatggaagatcctggggttattttattacgcagccctctattacccgctggctgcttgcgccaccgcgggtcatacagccgcacaccttctcggatccactcttagttgggcacacctgggggtgcaggtttggcagagggccgagtgcccacaggttccaaaaatatataagtactactcccttctggcttcccttcctcttttactcggcttaggcttcctctctttatggtatcccgtccagctggtcaggtctttcagtaggcgcactggcgcaggatcaaaaggactgcagtcctcatatagtgaggagtatctacgcaatctgttatgccgcaaaaagctcgggagtagttaccacacctcaaagcacgggtttctctcctgggcacgggtctgcctgcgccattgtatctacaccccccagcctgggtttcatctgcccctgaaactcgtccttagcgcgacactgacaggaaccgccatttaccaggtcgccctgctgctgctggtcggagttgtccccacaatccagaaagtacgcgctggtgttactaccgatgtctcttatctgctagccggatttggcatcgtcttaagtgaagacaaacaggaggttgttgagttggtaaaacaccacttatgggcgctcgaggtgtgctatatatctgccctggtcctctcatgtctgctgacctttctcgtgctgatgcgcagcttagtgacgcataggaccaatttgagggctctccacagaggagctgcgctggatttgtcgcctttacaccgatccccccatccctcacgacaggcaatcttttgttggatgagcttctccgcatatcaaactgccttcatttgcttgggactcttggtccagcagattatcttttttctcggaaccaccgctctggctttcctggttctcatgcccgtgctgcatgggaggaatctactgctgttcaggtctctcgaatcgagctggccattttggttgaccctggccctggccgtgatcctccagaatatggcggcccactgggtatttctcgagacccacgacggacatccccagctgacaaaccggcgggttctatatgccgccacattcctcctgtttcccctgaatgtgcttgttggagccatggtcgccacatggagagtgctgctttctgccctctacaacgcgattcacttgggacagatggatctaagcttgctccccccacgggcagccactcttgaccctgggtactatacctatcgtaactttttgaagatcgaggtgtcgcagagccaccctgcaatgaccgctttctgcagtctgctcctgcaggcccagtctttactcccgaggaccatggccgcacctcaggacagcctgagacctggcgaggaggacgagggtatgcagctactccagacgaaagactcaatggccaagggagctaggcctggggccagccgcggacgggcgcgttggggactcgcgtacacgctacttcacaatccaaccctgcaggtgttccgcaaaacagctttacttggcgcaaacggtgctcaaccatag

SEQ ID NO: 136423 - DNA, 2004 bp, Artificial Sequence
  Description of Artificial Sequence: Synthetic coding sequence
atgtcctcccagccggccggcaatcagacctcacccggggctacggaggattattcctacggctcctggtatatagacgagcctcagggaggggaagaactgcagcctgaaggagaggtgccgtcatgtcacacatccatccctcctggcctgtaccacgcttgtttagcttcattgtctattcttgtgcttctacttctagccatgctcgttcggcgacgccaactctggccagactgtgtgcgcggcaggcctggcctgccatcccctgtggacttcttggcgggggaccggcccagggccgtcccagccgcagtgttcatggtgctgctcagttcactttgtctgcttctccctgacgaagatgccctgccttttcttacactggcctctgccccttctcaggatggcaaaacagaggcacctcggggcgcctggaagatcctgggcctgttctattatgcagccctgtattatccactggcagcctgtgcgactgcggggcacaccgccgcccatctcctgggttccactttgtcctgggcccacctgggcgttcaggtctggcagagagccgaatgcccccaggtgcccaagatatacaagtactactcactgctcgccagcctgcctttgctactcggcttaggatttttgtccctgtggtatcctgtgcagcttgtcaggagcttctccaggaggacgggggcaggctcaaagggcctgcaatcgtcttacagcgaggaatacttgagaaatctattatgccgcaagaagctggggagtagctaccatacatctaaacatggattcttaagttgggcacgcgtgtgtctgcgccattgtatttacacaccgcaacccgggtttcatcttccactgaaactggtgctttcagctactctcactggaaccgccatctaccaagtcgcactgctacttctggtgggcgtcgtgcccactatccagaaggtaagggcaggagtgactacagatgtctcctacctcctggcaggtttcggcattgtgctcagcgaggacaaacaggaggttgtggaactcgtgaaacatcacctgtgggcattagaggtgtgctacatctctgcgctagtgctgagctgcctcctcacctttcttgtgcttatgaggtcccttgtgacgcacaggaccaacttaagagcgctccacaggggggcagcattggatctcagtccccttcatcgaagtccacatccctctaggcaagccattttttgctggatgagttttagcgcgtaccaaaccgcctttatttgccttggactgctcgttcagcagatcatcttctttcttggcactaccgcccttgcgttcttggtcttgatgccggtactgcacgggagaaatctgctcctatttcggagtctggaatcctcatggccgttctggctgacattagccctagcagtcattctgcaaaatatggccgcccattgggtgtttctcgagacccatgatggacacccacagctcactaacagacgggtgctctatgctgcaacctttctgctgttccctttgaatgtgctcgtgggagccatggtggctacctggcgggtcctgctgagcgccctgtacaacgccatacaccttggccaaatggatctttctctgcttccacccagagccgccactctcgacccaggttactacacctaccgtaattttctgaagattgaagtttcacagtcccatcctgctatgaccgctttttgcagtctcttgcttcaggcccagagtctcctgccacgcacaatggccgccccacaagacagtctcagacccggcgaagaggacgaaggaatgcagctgttgcaaacaaaggacagcatggcaaaaggggcccggcccggcgcctctagaggcagagcgcgctggggattagcttacacactgttacacaacccgactctccaggtgtttcgcaagaccgccctgctcggtgcgaacggggcgcagccatag

SEQ ID NO: 136424 - DNA, 2004 bp, Artificial Sequence
  Description of Artificial Sequence: Synthetic coding sequence
atgagtagccagccggcggggaatcagacctctcccggggcgactgaggactattcctatggttcatggtacattgatgaaccccaggggggcgaagagctccagcccgaaggggaagtgccaagctgtcacacaagcatcccccccggactgtaccacgcctgtttagcctctttatctatcctggtcctgcttctgttggccatgttagtgagacgtaggcagctgtggccagattgcgtgcgtggaaggcccgggctcccttctccggtggatttcctggcaggagacagacctcgagcggtgccggccgctgttttcatggtgttgctcagcagtctgtgtttactcttaccagatgaggacgccttacctttccttaccctggcgagcgccccatcccaggacggcaagacagaggctccgcgaggggcttggaaaatcctcggactgttctattacgctgccctgtattatcctctggccgcttgtgcaactgccggacacaccgcagcccaccttctgggctctacactgagctgggcccatctcggtgtgcaggtgtggcaaagggccgagtgcccacaggtgcccaagatttacaagtactattctctgttggcgtccctcccattactgctcggcttggggttcctgtcactatggtacccagtccaactggtccgttccttctcccgccgaacaggggctgggagcaaaggactgcagtcatcctattctgaggaatacctgagaaacctgctatgtaggaaaaaactgggtagcagctaccacacttccaagcacggttttttgtcctgggccagggtgtgtctgagacattgcatttacactccccagccgggttttcaccttccgctaaaactggtactgtctgccactttgactgggactgctatctaccaagttgccttactccttctagtgggagtggtgccaactatccagaaggttcgggccggggtcaccaccgatgtgtcctatcttctggccggcttcggtatagtgctgagcgaggataaacaggaagtggtcgaacttgtgaaacatcacttatgggctttggaagtctgctacatctctgcacttgtgttatcctgtcttctgacattcctagtgctgatgcgctcactagtaacccatagaacgaacttaagggccctgcaccgaggtgctgcactcgacctctcccccctccatagatccccacatccttccaggcaggcaattttctgttggatgtcatttagcgcataccagaccgccttcatttgccttggcctcctcgtccagcaaatcattttctttcttgggaccacagctctcgctttcctcgtcctgatgccagtgctacatggccggaacctattactcttccgcagcctggagtccagttggcctttttggcttacgttggctctcgctgtgatcctccagaacatggccgctcattgggtgtttctcgagactcacgacgggcatcctcagttaacaaacaggcgggtgttgtacgcagctaccttcctactattccctcttaatgtactggttggtgctatggttgccacttggagagttctcctttctgccctttacaacgccatacacttggggcaaatggacttgtctttgctgccccctagggctgctactttggacccaggatactacacctaccgaaactttttaaagattgaggtgagccagtcacatcccgccatgacagctttctgctctcttctgttgcaagcacagtccctgctgccgcgtacaatggcagccccccaggattctctgcggccaggggaggaggacgagggaatgcagctgcttcagaccaaagattctatggcgaagggtgctagacccggtgcatctcgcggcagagcaagatggggactcgcctataccctgcttcataaccccactctccaggtgttccgcaagacagcccttttaggggccaatggagcccagccctag

SEQ ID NO: 136425 - DNA, 1800 bp, Artificial Sequence
  Description of Artificial Sequence: Synthetic coding sequence
atgctggttcgaaggagacagctatggccagactgtgtgaggggtcggccaggcctgcccagcccggtagatttcttggccggagacagaccccgggcagtccccgcagctgttttcatggttctcctctcgtccctgtgtctgctcctgccagacgaagatgcactgccattcctcaccctcgcatccgccccatcacaagatggtaagactgaagcgccacgcggcgcttggaaaatcctgggcttattttattacgcagctctgtactatccactagctgcctgtgctactgcaggccatactgctgcccatctgttaggctctacactgagctgggctcacctcggcgtccaggtttggcagcgggcagaatgcccccaggtccctaaaatctataagtactattctttactggccagccttcccttattgctggggttgggcttcctgtccctgtggtatccagtgcagcttgtgcggtccttctcacggagaactggcgcaggaagcaagggactgcagtcaagctacagcgaagagtacttgcgaaatctcttgtgcagaaagaaactgggcagcagctaccacaccagcaagcacggttttctctcgtgggctcgagtctgcctcagacattgtatctatacaccacagcccgggttccacctcccactgaaattggtgctctcagcgacccttaccgggaccgccatctaccaggtagcacttctgctgcttgtcggcgtagttcccaccatccaaaaagtgagggccggtgttactacggatgtatcttatctgttggccggatttggtatagtgctcagcgaggataagcaggaagtcgtcgagcttgttaagcaccacttatgggcgctggaagtctgctacattagcgctctggtgcttagttgtctcctgaccttcctggttctgatgcggtctcttgtcacacacaggactaatttacgtgcgctccaccgaggagccgctctggatcttagccctcttcaccgctccccacacccgtccaggcaggctattttctgttggatgagttttagcgcgtatcagactgccttcatctgcctggggctgctcgtgcaacaaatcatcttttttctggggaccaccgctttggcctttttagtgttgatgcccgtactgcatggtaggaacttactgctgttccggtccctggagtcctcttggcctttctggctgaccctagccctggcagtcatcttacaaaatatggcggctcattgggttttcctggaaactcacgacggccaccctcagcttactaaccgccgcgtgctgtacgccgcaaccttcctcttgttccctctaaatgttcttgttggggccatggtggccacctggcgtgtgctgctgtccgcactttacaatgccatccacttgggccagatggatctcagcctgctcccaccgcgcgcagctactttggaccctggatattacacttacaggaatttcctgaaaattgaagtgagtcagagtcacccagcaatgaccgccttctgctctcttctgctgcaggcccaaagcctacttccgcggaccatggctgcaccacaagatagtttacgtccaggggaagaagacgaaggcatgcagctcctgcaaacgaaggactcaatggcaaaaggcgcacgccccggcgcgagtcgaggacgtgcacgttggggtcttgcttacacactgctgcacaaccccaccctgcaagtgtttcgcaaaacggctcttttgggggcaaacggcgcgcagccctag

SEQ ID NO: 136426 - DNA, 1977 bp, Artificial Sequence
  Description of Artificial Sequence: Synthetic coding sequence
atgtcgtctcagcctgccggaaatcagacaagtcctggcgctacagaggattatagctatgggtcatggtatattgatgagccccagggcggtgaggagctgcagccagagggggaggtaccgtcttgccacacatccatcccccccggcctgtaccacgcctgtctggcaagcctctctatcctggtcctgctgcttttggcgatgctggtccgacgcaggcagttgtggcctgactgtgtgagaggccggcccgggctgccccggcctcgagccgtacctgccgctgtgtttatggtactcttaagctccctgtgcctgcttctcccagacgaggatgcccttccttttctgactcttgcttccgcgccgagccaggacggaaagaccgaggcccccaggggcgcctggaagatcctgggcctcttctattacgccgctttgtactaccccttggccgcttgtgctaccgctggccatactgccgcccatctgcttggctcaaccctgagttgggcgcatctgggggtccaggtctggcaacgggccgagtgcccccaagtacccaagatttacaagtattattccctgctggcgtctttgcctctgctcctgggacttgggtttctgtctctgtggtaccccgtccagctcgtgcgttcattctctcgcagaactggtgcgggttctaaaggactccagagctcttattcagaggagtacctaaggaatctgttatgccggaaaaagctgggcagctcctaccatacctctaagcacgggttcctcagttgggcgcgggtatgcttaagacactgcatctatactccgcagccaggatttcatttaccattgaaactggtgttatcagctacactcaccggtacggcaatctaccaggtcgccctccttcttttggtcggtgtggtgcccacaatccaaaaggtccgcgcgggagtgacaactgacgttagctacctcctggcaggctttggaatagttctgagcgaggacaagcaggaagtcgtcgagctggtgaaacaccacctctgggctttagaagtttgctatatttctgctctggtgctctcttgtctcctgacttttttggttcttatgcggagcctcgtgactcaccgaactaatttgcgtgctttgcatcgcggagccgcgctcgatctgtccccactacatcgatcccctcatccatccagacaggcgatcttttgctggatgtctttctctgcttatcagaccgcttttatctgcctgggactgctggtgcagcagattattttctttctgggaacaactgcactcgcatttctcgtgctaatgcccgttctccatgggagaaatctgcttttgttcagaagtctggaaagctcttggccattctggctgaccttagcactcgccgttatactgcagaacatggcagcacattgggttttccttgagacccacgacggacacccccagctgacaaaccggagagtcttgtacgcagctacattccttctgttcccattaaatgtgttggtcggcgcgatggtcgccacctggcgcgtgttactgtcagctttgtacaacgcaattcacttaggacagatggatttgtccctcctgccccctcgcgccgccactcttgacccaggatattacacttaccgcaacttcctgaaaattgaggtgtcacagtctcatcccgctatgaccgctttctgttccctgcttctgcaggcccaatctctgctgcctaggacaatggctgctccccaggactccctaagacccggagaagaggatgaaggaatgcaactgctgcagacaaaagattccatggcaaagggcgcgaggccaggtgcgagccgtgggcgcgctcgttggggcctggcatacacattattgcataatcctacattacaggttttccgaaagacggccctgctgggggccaatggcgctcagccctag

SEQ ID NO: 136427 - DNA, 480 bp, Artificial Sequence
  Description of Artificial Sequence: Synthetic coding sequence
atgtcctcacagcctgccggtaatcaaacctctccaggagctaccgaagactattcctatggaagctggtacatcgatgaaccccagggaggggaggaactgcagccggagggggaggtgccctcatgccacacatcaattcctcctggtctctatcatgcctgcttggcatccttaagtatcttggttctgctgcttctcgcaatgctggtaaggcgcaggcaactatggcccgactgcgtcaggggtagacctggcctgccatctcctgtagatttcctcgcaggagatcggccccgggctgttcctgccgccgtgttcatggtgcttctctcttctctctgtctgctacttccagacgaggatgcgctgccattccttacgcttgcttccgcacctagccaggatggaaagactgaggccccccgagggaacctgcccaagataaccgagttgcggctggttagagcctggatctag

SEQ ID NO: 136428 - DNA, 2121 bp, Artificial Sequence
  Description of Artificial Sequence: Synthetic coding sequence
atgggggggaaggggggtggggacacgcggggcccagttctcttcccttgccagctggcccaggccctcagcccaagaagggcgtttccccgcgagctgaaagaaaaaggccagagaatgtcttcccagcccgcaggaaatcagaccagcccaggggccacagaggactactcctatggcagttggtacatcgatgagccacagggtggcgaggagctgcagcccgaaggtgaagtgcccagttgtcacacgagcattccccccgggctgtaccacgcgtgtctcgcaagcttgtcaatcctggtgctgttactgctcgcaatgctggtgaggcgcaggcagttgtggcccgattgtgtacgtgggaggcccggtttgccttctcctgtggacttcctggcaggggatcggccccgagccgttcctgcagccgtctttatggtgctgctgtcctctttgtgccttctattgcctgacgaggacgctctcccgtttttgaccctggcctcagccccatctcaggacggaaaaacagaggccccaagaggcgcctggaagatattggggcttttttactacgctgccctttactatccactggcagcctgtgctaccgctggtcatacggcagcacatctgcttgggtcaacactgagctgggcccacctaggagtccaggtttggcagcgcgccgaatgtccgcaggtacccaagatttataaatattactctttgctggccagtctcccgctgcttcttggactggggtttctttccttgtggtatccagtccagctggttcgctcctttagcaggaggaccggggcaggttctaaagggctgcagagttcttatagtgaagagtacctgcggaatcttctctgtcgcaagaagcttggttcttcttatcacacgtccaaacatgggtttctgtcctgggcgagggtttgcttgaggcattgcatctatactccgcagccgggatttcacttgcctttgaagttagtcctgtcagccaccttgacaggaaccgcaatctatcaagtggccctgcttctgctggtgggagtagtcccaacaatacagaaggtcagagctggtgtgacgaccgacgtgagctacctcctcgctggcttcgggatcgtcctctcagaagacaaacaggaagttgttgaactggtgaaacaccatctatgggctctggaggtgtgctacattagtgccctcgtcctctcatgtttgctgacattcctggtgctgatgcgcagccttgtgacccatagaactaatttgagggcattgcaccgcggcgcagcactggatctgagtcctcttcacaggtcacctcaccccagtaggcaagccattttctgctggatgtcattttctgcctatcagactgctttcatctgcctgggtctgctggtccagcagattatattctttctgggtactaccgctctcgcctttctcgtacttatgcctgtgcttcatgggcgaaatctcctgctctttcggtcgctcgagtcaagctggcccttctggctgaccttagccctggcagttatcctacagaatatggctgctcactgggttttcctggagacccacgatgggcaccctcagttaacgaatagacgggtgctctacgcagccacgtttctcctgtttccactgaatgtgcttgtgggtgcaatggtagccacttggcgggttctcttatccgccctgtacaatgcgatccacctgggacagatggacctgagcctgctcccgccgagggcagccacgttagatccggggtactatacctacaggaatttcttaaagatcgaggtgtcacagtcccacccagcaatgaccgcattttgctcgcttttactgcaggcccagtctctgttgccaagaaccatggccgccccgcaagactcactgagaccaggagaggaggatgaaggaatgcagctcctccaaaccaaggattccatggccaaaggggcacggccaggggccagcagggggcgggctcggtggggtctggcctatacgctgctccacaaccccactcttcaagtatttcggaaaacggccttattgggggcgaatggagctcaaccctag

SEQ ID NO: 136429 - DNA, 2115 bp, Artificial Sequence
  Description of Artificial Sequence: Synthetic coding sequence
atgcagatccggctcctgagagcagagctggttgtaccactgtggcagttcattaggcagtggccaccagggtcagatggctgggggcaaatggaggagaagggacagaggatgtcatcacagccggccggaaaccagacaagtcctggagcaactgaggattacagctatggctcgtggtacatcgatgagcctcagggtggtgaagaactgcagcctgaaggagaggtcccttcctgccacacgagtatcccacctgggttgtaccatgcttgtttggctagcctttccatcctggttctgctacttctggcaatgctagtgcgccgccggcaactgtggcccgactgcgtcagaggcaggcccggactgccttcacccgtggatttcctggctggagatcgcccaagagccgtgcccgcggccgtgttcatggtgctgctgtccagtctgtgtctgctgctcccggacgaggacgccctgccattcctgaccctggcctccgccccaagtcaggatggcaagaccgaagctcccaggggagcttggaaaatcctcggacttttctactatgccgctctgtactacccgctggcggcctgcgccaccgcaggacacacagcagcgcatctcctaggctccacattgagctgggcacatctcggagtacaagtctggcagagggccgagtgtccacaggtgcctaagatttacaagtattatagcctcctggccagcctgcctctgctattaggcctagggtttctcagcctgtggtatcccgtccagctagttcgcagcttctccagaaggaccggcgcaggaagcaagggactccagtcatcttacagcgaagaatatcttagaaatctgctgtgtcgtaagaagcttggcagcagctaccacacctccaagcatgggttcttatcttgggcacgggtgtgccttaggcactgcatctacactcctcagccaggtttccatcttccactgaagttggtactgtcggccacgttgaccggaacagctatctaccaagtggccctccttcttcttgtgggtgtcgtacccacaatccagaaggtaagagccggcgtgacgactgacgtatcatatctgcttgccggcttcgggattgtcttaagcgaggacaagcaggaggtagttgagttagtgaagcaccatctttgggcgcttgaggtgtgttacatttcagccctggtgctcagctgtctactgacattccttgtcttaatgcgctcgctggtgacacatcggacgaatctcagggccttgcacagaggcgcagctctggacctctctccattacacagatctccccacccatcacgccaagcaatcttctgttggatgtccttctccgcatatcagacggctttcatttgcctcggcctcctggtgcagcagataattttttttctcgggaccacagccctcgctttccttgtactgatgcccgtcctgcacggacgaaacttgctgctgttccgctcactggagtcctcatggcctttctggctcacactcgcacttgccgttattctacagaatatggccgcgcactgggtttttcttgagacgcacgacgggcacccccaacttaccaacaggagagtgctgtacgccgccactttccttttattcccgctgaatgtattggttggggctatggtggccacctggcgggtgctgctgtccgccctgtacaacgccattcacctggggcagatggaccttagcttgctgccgcctagggcagcgacactggatccaggttactatacctacaggaatttcctgaagatcgaagtcagccaatcacaccccgccatgaccgccttctgttctttgctcctgcaggctcaatcattgctccccaggacaatggccgcacctcaagattcactcagacctggggaggaagatgagggaatgcagctgcttcaaactaaagactctatggccaaaggggctcgtccaggcgctagcagggggcgcgctaggtggggcctggcctatactctcctgcataatcctacactgcaagtattcagaaaaactgccctcctcggagcaaatggcgcccagccgtag

SEQ ID NO: 136430 - DNA, 1674 bp, Artificial Sequence
  Description of Artificial Sequence: Synthetic coding sequence
atggccgcaggaaccagcatgtcacccgatgaggacgcgctgccctttctgaccctggcatctgcccctagtcaggacggtaagacagaggctcctaggggcgcttggaaaatattgggcctcttctattatgcagccctgtattaccctctcgcagcctgtgctaccgcaggccatacggctgctcacctgttggggtcaaccctgtcttgggcacacctaggggtccaggtttggcagcgagctgagtgtccccaagtgcctaaaatttataagtactatagcctgttggctagccttcccctcctgctgggcctgggcttcctgtctttgtggtacccagtccagctcgttaggtccttttcacgtcgcacgggtgcgggaagtaaaggcctgcagtcctcctactctgaagagtatcttagaaacttgctgtgcagaaaaaaactaggatctagttatcatacttccaagcacgggttcttgtcctgggccagagtgtgcctccggcattgcatctacactccacaacccggcttccatctgccacttaaactggtgctctcagcaactcttaccggaactgcaatctatcaggtcgccctgctcctcctggtgggggtggtccccactatccagaaggtgcgcgcaggcgtgacgactgacgtgagctatcttctcgcagggtttgggattgtgcttagtgaggacaagcaggaagtagtcgagctggtgaagcaccatctgtgggccttggaggtttgttacatttctgccctagttctgtcgtgcctgctgacctttctcgtgctcatgagatcacttgtgacccataggactaacttgcgtgccctccaccgcggggcagccctcgatctctccccacttcacaggtcgccacatccgagccgacaggccattttctgctggatgtcattctcagcttaccaaactgccttcatctgcttgggccttctggtgcaacaaattatcttctttcttggtactaccgcactagcctttttggtgcttatgccagtccttcacggaagaaacctgctattatttagatccctggagtcctcttggcccttttggttgacactggcccttgccgttattctgcaaaacatggcagcccattgggttttcctggagacacacgatggacaccctcaactcaccaaccgtcgcgtgctgtatgcggcaacttttctgcttttcccgctgaatgtgctggttggcgcgatggtggcgacatggcgcgtgctgctttcagctttgtacaacgctattcatctcggccagatggacttgagcctcctgcccccgagagccgctactctcgacccaggctattacacgtaccggaacttcctaaagatcgaggtctcccagtcccaccccgcaatgactgccttctgtagtctactcctgcaggcacaatccctattgccgcgtacaatggccgcgccgcaggactctctaagacccggggaggaggatgaggggatgcagttacttcaaaccaaggatagtatggctaagggagcgcgcccaggggccagcagaggacgcgctcgttgggggttggcgtatacactgttgcacaacccaacgctccaggtatttcgcaaaactgctttactgggtgcgaacggcgcgcagccctag

SEQ ID NO: 136431 - DNA, 1431 bp, Artificial Sequence
  Description of Artificial Sequence: Synthetic coding sequence
atggggaagttgagactgcaggaaatttataaatattacagcctactagcgtccctccctctgctcctggggctcggtttcttgagcctgtggtatcctgtgcagctggtgcgctcctttagccggagaaccggggctggatccaagggactgcagagcagctactccgaagaataccttcggaatttgctgtgccgtaaaaagcttggatcctcttaccacacatcaaaacacgggttcttatcatgggcacgcgtgtgtctgagacactgcatctacactccacagcctggctttcacttaccgttaaagcttgtcctatccgccaccctcactggcacagcaatctaccaggtagccctattgcttttggtcggagtggtgccgacaatccagaaggtaagagctggtgtgactacggatgtgtcctacctgctagccggattcggaatcgttctctcagaagataagcaagaggtagtcgagttggtcaagcatcatttgtgggccctggaggtctgttacatcagtgcattggtgctgtcatgcttgctgacgtttctggtgcttatgcggtcactggttacccacaggaccaacctgcgcgccttacacagaggggccgctcttgaccttagcccgctccaccgctcgccacacccaagccgccaggctatcttttgctggatgtctttttccgcctaccaaaccgcatttatctgtctggggctgctggtccagcagataatcttcttcctgggtacaactgcactggccttcctggtccttatgcccgtcctgcacggccgaaatttgctgctgttccggtctctggaatcctcctggcccttctggctgacactcgccttagctgttattctgcaaaacatggccgcccattgggtgttcctcgaaacgcatgacgggcacccccagttgacgaatcgacgcgtcctatatgctgcaacctttttgctgttccctttgaatgtgctagtcggggctatggtagctacttggcgggtgttgctgagcgcactatataatgccatccacctcggacagatggacctaagcttacttccaccccgagcagccaccttagatccaggctactatacctataggaattttctgaaaattgaagtatcacagagccaccccgctatgacggctttctgttcacttttgctgcaggcgcagtccctgctgccgcggactatggctgccccacaggactcgctgcggccaggcgaggaagatgaggggatgcagctgctccagaccaaggattcaatggctaagggagccagacctggtgcctcccggggcagagcccgctggggcctggcctacacccttctccataatcccacgctgcaggtgtttagaaagactgccttgttgggagcgaacggcgcccagccctag

SEQ ID NO: 136432 - DNA, 993 bp, Artificial Sequence
  Description of Artificial Sequence: Synthetic coding sequence
atgggcaaaatcgacgtggacaagatcttgttcttcaaccaagagatccgcctctggcagctgataatggcaacacctgaagagaacagtaatcctcatgaccgggcaacaccccagctccctgctcagttgcaagaactggagcacagagtagcccgaagacgcctcagtcaggctagacatagagctacactcgccgccctctttaataatctgcggaagactgtttattctcagtcagatcttattgcaagtaagtggcaggtgctgaataaggccaaatctcacatacccgagctcgagcagaccctggacaacctgcttaaactcaaagccagtttcaacctcgaggatgggcatgcttcctccctggaggaagtgaaaaaagaatacgccagcatgtactcaggcaacgattcgttcccacaaaatggaagctctccgtggtacctaaacttttataaacagactatggacctgttgactgggagtgggatcattaccccgcaggaagcggcactaccaatcgtgagtgcagcgattagccacctctggcagaacctgtcagaggaacgaaaggcatcgctgagacaagcttgggcccagaagcaccggggacccgcaacactggctgaggcttgtcgggagcctgcttgcgccgaagggagcgtcaaggattccggagtggacagtcagggtgcttcatgttccttggtgtccaccccagaggaaatccttttcgaagacgcctttgatgttgcaagcttcctggataagtcggaggtaccttccacctcgagtagcagctctgtgctggctagctgtaatcctgaaaatccagaggaaaagtttcaactgtatatgcagattataaatttttttaaggggttaagttgcgcaaatacgcaggtgaaacaagaggctagctttcctgttgacgaagagatgatcatgctgcagtgtactgagacattcgacgatgaggacttgtag

SEQ ID NO: 136433 - DNA, 882 bp, Artificial Sequence
  Description of Artificial Sequence: Synthetic coding sequence
atgggctttcctgctgcagctcttctgtgtgcactgtgttgtggcctgctcgcacccgccgcacgggctgggtacagcgaggagcgttgcagctggagagggagcgggttaacacaagagcctggatctgtgggccagctggcactggcctgcgccgaaggagccgtggagtggctctatcctgccggggcactccgcctgaccctgggcggcccagaccctcgagcgagacctggcatcgcgtgtctgaggcctgtgagaccattcgcaggcgcccaggtgttcgctgagcgcgcgggaggggctcttgaactcctcctcgctgaaggacccggtcctgcagggggcagatgcgtacgctggggccctagagaacgccgggccctgttcctgcaggccacacctcaccaggatatatcacgacgggtcgccgccttccggttcgagctgcgagaggacgggcgacccgagttaccaccccaggcgcacgggttgggcgtagacggggcatgtaggccctgctcagacgcagagctgcttctcgcagcctgtacttcggattttgtgatacacggcatcatccacggagtgacacacgacgtggagttgcaagagtcggtcatcaccgtcgtggcagctcgggtattacgccagaccccacctctgtttcaggccggaaggtctggggatcagggtcttactagtatccggacccccctccgctgcggagtccatcccggccccggcaccttcctgttcatgggatggagtcggttcggcgaggcccgcctgggttgtgccccaagattccaagagttccgacgcgcgtatgaggccgcgcgcgctgcccacctgcacccatgcgaggtggctctgcactag

SEQ ID NO: 136434 - DNA, 1197 bp, Artificial Sequence
  Description of Artificial Sequence: Synthetic coding sequence
atgctcgggcgctctggttaccgtgccctgcccctgggggattttgatcgatttcagcagtcgtcctttggtttcctgggatcgcagaaaggctgtctgagtcctgagcgcggcggcgttggtaccggtgcagatgtgcctcagtcttggcctagttgtttgtgtcatggattgatatctttcctgggatttctgcttctgttagtgaccttccctatctccggctggtttgcattgaagatagtgccaacatacgaaaggatgatcgtttttaggttgggtaggataagaaccccgcaggggcccgggatggtgctgctcttgccattcattgatagctttcagcgcgtcgacctgagaacacgggctttcaatgtgcccccatgtaaactggcctctaaggacggagcagtgctgtccgtgggcgctgacgttcaatttagaatatgggaccccgtcctgagcgtcatgacagtgaaggatctgaacacggccacaaggatgaccgcccagaatgctatgaccaaagctttactcaagcgccctttgcgtgagatccagatggaaaagctgaaaatctcagaccaacttctcctggaaatcaatgatgtcacgagagcttggggccttgaagtggacagagttgagctcgccgtcgaggccgtgctacagcctccacaggattcaccagccgggcccaatcttgattctaccttacagcagctagccctccacttcctcggggggagtatgaacagcatggctggcggcgctccaagtcccggaccagccgatacagttgagatggtgtctgaagtcgagccccctgcgcctcaagttggggcccgcagctcccctaagcaaccactggcagaaggtctgttgactgccttgcagccctttctgtcagaagccctcgtgtcacaagtaggagcttgctatcaatttaatgtcgttctcccatccgggactcagtctgcttattttttggacctcacaaccgggcgggggcgggtgggccacggagtcccagatggaattcccgacgttgtggtcgaaatggcagaggcagacctgcgggccttgctttgccgcgagttaagacctctcggggcctacatgagtggcaggctgaaggtgaagggagacttggctatggcaatgaaactggaagcagttctgcgggccctcaagtag

SEQ ID NO: 136435 - DNA, 1047 bp, Artificial Sequence
  Description of Artificial Sequence: Synthetic coding sequence
atgcttggcagaagcggttatcgggcactccccctcggcgattttgacagatttcagcagtcctcctttggcttcctaggttcacagaaaggctgtctcagtccggaaaggggcggggtggggactggggccgatgtgcctcaatcgtggccctcttgcttatgccacgggttgatctcctttctgggcttcctgttgctgctcgtgacctttcccatctctggttggtttgccctgaagctggcttctaaagatggcgcggtgctgtcggtcggagccgacgttcagtttaggatctgggacccggttctgagcgtgatgaccgtcaaggatttaaatacagcaactcggatgacggcgcagaacgccatgacgaaagctttgttgaaacgtccacttcgcgagatccagatggagaagctgaaaatttctgatcagctgctactcgaaatcaacgacgtgacaagagcatggggtctggaggttgatcgagtagagctggctgtagaagccgtgttgcagccgccacaagactctcctgcaggaccgaaccttgattcaaccctccaacaattagccctacacttcctaggaggatcgatgaattccatggccggaggcgcgccctctcctgggcctgcagatactgtggagatggtgagcgaagtcgagccgcctgcaccacaagtcggcgccagaagctccccaaagcagcctctggctgagggcctcttgacagccctgcagccattcctgtctgaggcactggtctcccaagtcggcgcatgctaccagtttaacgtggtacttcccagcgggacccaaagcgcctactttctcgatctcacaaccggcagaggacgggtagggcatggagtcccagatggtatcccggacgtcgtggtggagatggccgaagccgatctcagggcccttttatgccgggaattgaggccccttggtgcctacatgagcggtcgcttgaaagtgaagggagatcttgccatggcgatgaagttggaagccgttctccgtgctctaaagtag

SEQ ID NO: 136436 - DNA, 984 bp, Artificial Sequence
  Description of Artificial Sequence: Synthetic coding sequence
atgctggggagatctggctatcgagctctgccccttggagacttcgaccgattccagcaaagttcctttgggtttctaggcagccagaaagggtgcctgtcaccagagagagggggagtgggcaccggggccgatgtcccacaatcctggcctagttgcctttgtcatggcctgatttctttcttgggctttcttctgttgctggtgacttttcctatctcagggtggttcgccttgaagatcgttcccacgtacgaacggatgattgtgttccggctcggccggatcagaacccctcaggggccgggaatggttttactcctgccatttattgattccttccagcgcgtggacttgagaactagagcctttaacgtgcccccctgtaagctggcatcgaaggatggggccgttctttctgtgggggcggacgttcagttcaggatttgggaccctgtgttatccgtgatgactgtgaaagacctaaatactgctacgagaatgactgcacagaatgctatgacaaaggcactgctcaaaagaccacttcgcgaaatacagatggagaaactgaagatctccgatcagcttctcctcgagatcaatgatgtcactagggcatggggactcgaggtggatcgcgtggagctcgctgttgaggctgtcctgcagccaccccaggattcgcccgcggggccaaacctcgactctacactgcagcaactggcactgcactttctgggcgggtctatgaattctatggctgggggcgccccttctccgggaccaggccgcggccgtgtcggacatggagttccagacggaattcccgacgttgtggtagaaatggcagaagccgacctcagagcccttctgtgccgcgagctgagacctcttggcgcttacatgtcaggccgactcaaagtgaaaggtgaccttgcaatggccatgaaacttgaggcagtcctgcgggccttaaaatag

SEQ ID NO: 136437 - DNA, 1068 bp, Artificial Sequence
  Description of Artificial Sequence: Synthetic coding sequence
atgccagacgttccacagtcctggccatcctgcctctgccacggactcatttcattcctgggttttctcctgctcttggtcacgttccctatcagcggctggtttgctttgaagatcgtccccacttacgaaagaatgatagtatttcgccttggcagaatccgaactccccaaggacccggtatggtgctcttactccctttcattgactcatttcagagagtggacctccgcacccgagccttcaacgtacctccatgcaagctagcaagtaaagatggagcagtactgtctgtgggcgccgacgtccagttcagaatctgggatcctgtcctttccgtaatgaccgtaaaggacttgaacacagccactagaatgacggcccagaatgccatgacaaaagccctgctcaagcgccctctaagggaaatccaaatggagaagcttaagataagcgaccagctgttactggaaatcaatgacgtgacaagggcatggggattagaggtcgaccgggtcgaattggccgtcgaggcggtcctccaacctcctcaggattcccccgccggacctaacctagattctaccctgcagcaactcgccctccatttcttaggcggctcgatgaacagcatggctggcggcgctccttcgcctggccctgacaccgtggagatggtcagcgaggtcgaaccacccgctccacaggtaggggcccggtcttccccaaagcagcccctcgcagagggtttactgacagccctgcaaccattcctgtcagaggcattggtgagtcaggttggcgcctgttaccagttcaatgtggtactgccctctggcacccaatccgcttactttctggacctgacaacaggtaggggacgcgttggccacggcgtcccagacggaattccagatgtggtggtggaaatggccgaagcagatttacgagcactgctatgcagggagctccgccctctgggagcctacatgtccgggaggctcaaagtgaagggagatctggctatggcaatgaaattggaagcagtgcttcgggccctcaagtag

SEQ ID NO: 136438 - DNA, 933 bp, Artificial Sequence
  Description of Artificial Sequence: Synthetic coding sequence
atgatagtgtttcgtctgggtagaattcgcacacctcagggcccaggaatggttcttctgcttccattcattgactccttccaacgcgtggacctcagaacgcgagctttcaatgtgccaccttgtaaattggcctcaaaggacggcgccgtgttaagcgtgggcgcggacgtgcaatttagaatctgggaccccgtgctgtcggtaatgactgttaaggatttgaacacagctacaaggatgaccgcccagaacgctatgacaaaggccctgttgaaacgcccccttcgggagatacagatggaaaagctcaaaatttcagatcagttactgctggaaatcaatgacgtgaccagggcctgggggctggaggttgacagggtggagctggctgtggaagccgtgttacagccacctcaggactcccctgcagggccgaacttggactctactctgcaacagttagccctccatttcctgggtgggtctatgaactcgatggcagggggcgctccttctccaggaccagacactgtggagatggtctccgaggtggaaccgcctgctccacaggtaggagcacgatctagcccaaagcagccgctcgccgaaggactattaactgctctgcagccttttctgtccgaggctctggttagtcaggtaggcgcttgctatcagttcaacgtggtactgccatcagggacccagtccgcatattttctggacttgacaaccggcagaggacgtgtggggcatggtgtccccgatggtatccccgacgttgtggtggagatggccgaggccgatctcagagccctgctgtgcagagagttaaggcccctgggcgcttacatgtcaggaagattgaaagtcaaaggcgatctggcgatggccatgaagttggaggcagttctcagggcgctcaaatag

SEQ ID NO: 136439 - DNA, 1044 bp, Artificial Sequence
  Description of Artificial Sequence: Synthetic coding sequence
atgctaggcaggagcggctaccgggctctcccactgggcgacttcgacaggtttcagcaatccagcttcggattcctgggatcccagaagggctgcctctcaccagaacgagggggtgtgggcaccggcgccgacgtgcctcagtcctggcctagttgcctgtgccatggactgataagtttcctgggctttctgctgcttctggtgactttccccattagcggatggttcgcccttaaactcgcatcaaaggatggcgcagtgctgtccgttggagccgatgtgcaatttaggatatgggatcctgttttgtccgtgatgacagttaaggaccttaacaccgctacaagaatgaccgcacagaacgccatgactaaggcactcttgaagcgtccactgcgcgagatccagatggagaaacttaagatttctgatcagctgctgctggaaataaatgacgtcacgagggcttgggggctggaggtggaccgcgtggagctcgccgtggaagccgtgctccaaccgcctcaggattccccagccggaccaaatttggattccaccctgcagcagctcgcgctgcattttctgggagggtccatgaactccatggccggtggggctcctagccctggaccagacactgtcgagatggtcagcgaggtggaacctcctgcccctcaggtgggagctcggtcaagtcccaagcagccattggctgaaggccttctcaccgcattgcagcccttcctatccgaagcacttgtgtcccaggtcggggcgtgctaccaatttaatgtggtcctgccatcggggacacagtcagcttacttcctcgaccttacgacagggagaggccgcgtggggcacggcgttccggatgggattcccgatgtcgtcgtggagatggccgaagcggacctgagagctctcttgtgtagggaattgcgacctctcggggcctatatgtctggcaggttgaaagttaaaggggacctggcaatggccatgaaattggaggccgttctgagagcactcaaatag

SEQ ID NO: 136440 - DNA, 1071 bp, Artificial Sequence
  Description of Artificial Sequence: Synthetic coding sequence
atgctcgcaagagccgctcggggaaccggtgcgctccttcttcgtgggagtctcctcgcatccggacgcgctccccgccgtgcatcatctggcctgcctaggaatacggtggtgctgtttgttccacagcaggaggcatgggtcgtcgagagaatgggccgcttccacaggattctcgagcctggcttgaatatattgattccagtattggacaggatccgttatgtgcagtccttgaaagaaatcgtgatcaatgtcccagagcagtccgccgtgacattggacaatgtgacgctgcagatcgatggcgtgctgtacctgcgcatcatggatccttacaaggcctcttatggtgtggaagacccagagtacgcagtaactcaactggctcagaccaccatgcggagcgaactgggaaaactctcacttgacaaagtgtttcgcgaacgagagtctctcaatgccagcatcgttgacgctattaaccaggccgctgattgctgggggatccgctgtcttaggtacgagatcaaagatatccatgtaccacctagggtgaaggaaagcatgcagatgcaggtggaagcagaacgtcggaaacgcgccactgttctggaatcagagggtacccgggagagcgcaattaacgtggcagagggtaaaaagcaggcccaaatcttagcgtccgaggccgagaaggctgaacagataaaccaggccgcgggggaagcttctgctgtcctggcgaaagcaaaggccaaggcagaggcgatacgtatcctcgcagcggccctcacccagcataacggcgacgctgctgccagcttgacggtggcagagcaatacgtgagtgcattttctaaacttgccaaagactcaaacactattctgctcccctctaacccgggcgacgtaacctctatggtggcacaggccatgggtgtatacggtgcgctgactaaggctcctgtacccgggacacctgattcgctgtcttccgggtcgtctagggacgttcagggcacagacgcgagcttggatgaagaactggacagagtaaagatgtcatag

SEQ ID NO: 136441 - DNA, 936 bp, Artificial Sequence
  Description of Artificial Sequence: Synthetic coding sequence
atgttggctagagccgctcggggtaccggtgccttgttgttgcgcggaagtctgctggcatctggtagggcccccaggcgggcctcatcagggctgcctagaaacactgttgtcctgtttgttccacagcaggaagcttgggtcgtcgaaaggatgggtcggtttcatcggatactggagcccggactgaatattctcatccccgtcctggaccgaataagatacgtgcagtctttaaaagaaattgtgattaacgttcccgaacagtccgcagtcacgctcgacaacgtaaccctccagattgatggggttctgtacctgaggataatggacccgtacaaagcttcttatggagtagaagacccagaatacgctgtgacccaattagcccaaacgacaatgcgatcagagctgggtaagctcagcctggataaggtgtttagagtggaggctgaacgcagaaagagggcaacagtactggaaagcgaaggaaccagggaaagtgcaattaacgtggcagagggtaaaaagcaggcccagatactggcgtcggaggccgaaaaggccgaacagatcaaccaggcggccggggaggcttcggcagtgcttgcaaaagctaaagccaaggcggaagcaatcaggattctagctgcagcgttgacccagcataacggcgacgctgcggcgtcattgaccgttgccgagcagtatgtctcagctttcagcaaactggctaaggacagtaatacgatcctgctcccgtcaaaccccggtgatgtgacttccatggtcgcccaggcgatgggggtttacggcgcattaaccaaagccccagtacccggaactccagactccctgtccagtggatcatccagagatgtccagggaactgacgcctcactcgacgaggaattggaccgggttaagatgtcatag

SEQ ID NO: 136442 - DNA, 876 bp, Artificial Sequence
  Description of Artificial Sequence: Synthetic coding sequence
atggactcacgtgtgagtagccccgagaagcaggacaaagagaatttcgtgggcgtcaacaataagaggctgggagtgtgcggctggattttattctccctctccttcctcctggtgatcattacctttccaatttctatctggatgtgcctaaaaatcatcaaagagtatgaacgagccgtagtgttccgcttgggtcgtattcaagcagacaaggccaagggcccaggactaatcttggtcctgccttgcatcgatgtgttcgtgaaagttgatcttcggacagttacgtgcaatattcccccccaagagatattgaccagggactcagtgactactcaggtggatggtgtcgtctattataggatctatagtgcagtttctgcagtggcgaacgtcaacgatgtgcaccaggccacattcctgcttgctcagactacattaagaaacgtcctagggactcaaacattgtcacaaatactggctgggcgtgaagaaattgcacacagcattcagaccttacttgatgacgcaacagaactctgggggattagagtggctagggtggaaataaaggacgtgagaatacctgtgcaactgcaaaggagcatggcggcggaagcagaagcgactcgcgaggccagagcaaaagtgctagccgcagaaggtgaaatgaatgcttccaagtccctgaaatcggcctccatggtgcttgcagaatcaccaatcgccttacagctccggtacctgcaaacactttctacagtcgcaacagagaaaaacagcaccatcgttttcccactgccaatgaatattcttgagggaattgggggcgtaagttacgacaaccataagaagctgccaaacaaagcctag

SEQ ID NO: 136443 - DNA, 849 bp, Artificial Sequence
  Description of Artificial Sequence: Synthetic coding sequence
atgaactcccgaggtgagttggtgggagtgaacaataaacggctcggagtgtgtggatggatcctgttctcgttgtctttcctgctggtaattataacctttcctattagtatttggatgtgtctgaaaatcatcaaggaatacgagagagccgtagtgttcagactgggccgcattcaagccgataaagctaagggacctggtctgatccttgtccttccatgtatcgatgtctttgtaaaagtagacctgcgcaccgtaacttgtaacatcccgcctcaggaaatcctcaccagggattccgtgaccacccaggtcgacggggtggtttattatcggatttactccgccgtttccgctgtggcaaatgttaatgacgtccaccaggctacattcctcctggcccagacgacgcttcggaacgtcttgggaacacagacactctcccagatcctggcaggtcgagaggagatcgcacactcgattcagacccttctggatgacgccactgagctctggggcatccgagtggcgagagtggagatcaaagacgttagaatcccggtacagcttcagcgatcaatggccgcagaggccgaagcgacaagggaggcacgagcgaaggtcctggcggccgaaggcgagatgaatgctagcaagtctctgaagtcagccagtatggtgctggcagaatcgccaatcgcacttcagctgcggtacctgcagactctgtctacagtcgccaccgaaaagaatagcacaatcgtgtttccgcttcccatgaatattctcgaggggattggcggagtttcctacgataaccacaagaaactgcctaacaaggcctag

SEQ ID NO: 136444 - DNA, 2970 bp, Artificial Sequence
  Description of Artificial Sequence: Synthetic coding sequence
atggcacgccctgtgcagctagcccccggctctctggccttggtgttgtgccggctggaagcacaaaaggcagctggagcagctgaggaacctgggggtagagccgtttttcgtgcttttcgaagggctaacgcaagatgcttctggaatgcacgactggcacgggccgccagccggctggcgtttcagggctggctccggcggggcgtacttctcgtaagagcgccccccgcttgcctgcaggtactccgcgatgcctggcgcagacgagcactgcgtccgccccgcggctttcggattcgtgcagtcggggatgtgtttccagttcagatgaatcccattacgcaaagccagtttgtgccactaggtgaagtgctgtgttgcgctatctccgatatgaacacagcccagattgtggtcactcaggagagcctgctggaacgcttgatgaagcactatcctggaatagccatccccagcgaagacatactctatactacgcttggaacactgataaaggagaggaagatctatcacaccggggagggatattttatcgttacccctcagacatacttcatcacgaacacgaccacgcaggagaacaaacgtatgctgccatctgacgaatcccgactcatgcccgcatctatgacatacctagtatccatggagtcatgtgccgaaagcgcacaggaaaacgcagcaccgatcagccattgccagtcctgtcagtgctttcgcgacatgcatacccaagacgtgcaagaggcccccgtcgccgccgaggttacccgtaaatcccacagaggtctcggtgagagcgtgtcgtgggtccaaaatggtgctgtgtctgtctctgctgaacaccacatctgtgagtctacgaagcctctcccttatacaagggataaagaaaagggcaagaagttcggattctccctgctctggaggtccctttcccgaaaagagaagccaaaaaccgagcactcctccttctcggcccagtttccccccgaagagtggcccgtacgcgatgaggatgatcttgataatatcccaagggacgttgagcacgagatcataaagcgtattaatccaatacttaccgtggataacttgatcaagcatacggtgttgatgcaaaaatatgaagaacaaaagaaatataatagccagggaactagtaccgatatgctgaccataggtcataaatatccatccaaggaaggcgtaaagaagagacagggcctcagtgctaaaccccagggtcagggacacagccgaagggataggcataaggctagaaaccagggttcagaattccagcctggctcaattcgactggaaaagcatcccaaattgcccgctacacaacccatccccaggataaaatcaccaaatgaaatggtcgggcagaaacctctaggcgagataacaaccgtgctgggctcacacctcatttataagaagcgcatctccaaccccttccagggcctctcacaccggggtagtaccatttccaagggacacaagatccagaagacaagtgatttgaaaccatcacagacgggaccgaaagaaaagccctttcagaagcccaggagcttggacagttccaggatttttgacggcaaagccaaggaaccttatgctgaacagcccaacgacaaaatggaggccgagtcaatctacattaacgatcctacagtgaagcctattaatgatgactttcgtggccacctattctctcatccacagcagtctatgctgcagaacgacggaaagtgctgcccctttatggagagcatgttgaggtatgaggtctacgggggcgaaaatgaggtcatccctgaagtgctgcgtaagtctcattcccatttcgacaaactcggcgaaaccaaacagacaccccactccctgccatccaggggagcctcctttagcgacagaaccccatccgcctgtagactggtggacaacactatccaccagttccaaaacctggggttacttgactacccagtgggggtgaacccattgcggcaggcagcacgccaggataaagactccgaagaactactgcggaagggattcgtccaggatgcagaaacgacatccctggagaacgagcagctgtcaaacgacgatcaggctttgtaccagaacgaagtggaggatgatgatggagcatgttcgagcctgtatctggaggaagatgatatttcagagaacgatgatctgcgtcaaatgctccctggccatagccaatattctttcacaggcggatcacaggggaaccacctcggcaagcagaaagtgatcgaaagaagtcttaccgagtataatagtaccatggaaagagtcgagtcccaggtgttgaagaggaacgagtgctataagcccacgggcctgcatgcaacccccggggagtcacaggagcccaacctatcagccgaaagctgcggattgaactccggagctcagtttggattcaattacgaggaggaaccaagcgtggctaaatgcgtgcaggctagtgcccctgccgatgagagaatctttgattactactctgcccggaaggcctcattcgaagctgaagttatccaggataccatcggcgacaccggaaaaaagcccgctagttggtcccagtcccctcagaatcaggagatgcggaagcacttcccacagaaatttcaactcttcaatacctctcacatgcccgttctggcacaggacgtgcagtacgagcacagccaccttgagggcactgaaaaccatagcatggcaggagactctggcattgattcacctcggacacagtctctgggcagcaataattccgtcatcctggatggcctcaaaagacgacagaacttcctccaaaatgtggagggaactaagagctcgcagcctctcacttctaattccctcttgcccctgacccccgtcattaacgtgtag

SEQ ID NO: 136445 - DNA, 510 bp, Artificial Sequence
  Description of Artificial Sequence: Synthetic coding sequence
atggccaggcccgtccagctggcacccggtagcctggctctcgtattgtgtcggttggaagcacagaaggcagccggcgctgctgaagagcctgggggaagggcagtgttccgggcttttcggcgcgcaaacgcccgatgtttctggaacgcgcgtctcgcaagagcggcaagccggctggccttccaaggatggctgcgacggggcgtgttactcgtcagagctccccctgcttgtcttcaggtcctccgtgatgcttggcgtcgaagggcccttcgcccaccccggggttttagaattcgtgccgtcggagacgtattcccagtacagatgaatccaatcacacagtcacagtttgtgccactgggcgaagttctgtgctgcgctatctccgatatgaataccgcacaaattgtcgtcacacaagagagcctcttagaaaggctgatgaaacattaccccggacaccgggtttgggatctgattatacagtcgttctggatggactag

SEQ ID NO: 136446 - DNA, 684 bp, Artificial Sequence
  Description of Artificial Sequence: Synthetic coding sequence
atggccaggcccgttcagctggctcctggatctctggccctggttttatgtcgactagaggcgcagaaagcggcgggggccgcagaggaacctggcgggagggccgtgttcagagccttcagacgggccaatgccagatgcttttggaacgctcgcctggctcgtgccgcttctcgcctggcctttcagggctggctcaggagaggcgtactgctagtgcgcgcaccccccgcgtgtcttcaggtgctgcgagacgcttggcggagacgtgccttacggccaccaagaggctttcggatccgtgctgtaggtgatgtcttcccagtgcagatgaaccccataacccagagccaattcgtgcccctcggcgaggtgctctgttgcgctattagcgacatgaacaccgcacagatcgtggttacccaggagtcgctactcgaacgactgatgaagcattatcccgggattgcaattccatccgaggacattctgtacacaacacttggaactctaatcaaagagagaaagatttaccacaccggggagggctatttcattgttacaccacagacctactttatcacaaacactaccactcaagagaataagaggatgttgcccagcgatgagtcaaggttgatgccagcttcaatgacctacttggatactgagtctggcatttag

SEQ ID NO: 136447 - DNA, 2970 bp, Artificial Sequence
  Description of Artificial Sequence: Synthetic coding sequence
atggctaggccagtccagcttgccccaggtagtctggcattggtgctttgcagactggaggcccagaaggctgcaggcgccgccgaggaacccggtgggagggctgttttccgagcctttagaagggcaaatgcaaggtgtttctggaatgcccgcctggctcgggccgcttcaaggctggcattccagggttggttacgccgaggcgtgcttctggttagggctccacctgcctgcctacaggtgctgcgcgacgcttggcgtaggcgtgccctgcgcccaccccgcggcttccggatacgggccgtcggcgacgtgtttccggtgcagatgaatccgatcactcaaagtcaatttgtgcccctgggagaggtgctctgctgtgctattagcgacatgaatacagcccagatagtggtgacacaggagtctttgctagaaaggctgatgaagcactaccctggtattgctattccttctgaagatatcttgtatacaaccctcggcactctgattaaggagcgtaagatctatcacaccggcgagggatactttatcgtcacgccacagacctatttcatcactaatacaacaacccaggaaaataagaggatgttgccaagtgatgaatctaggcttatgccagcctccatgacatacctcgtgagcatggagtcctgcgccgagtccgcccaggagaacgctgcacctatctctcattgccagtcatgccagtgttttcgtgacatgcatacacaggacgtgcaggaagccccagtcgctgcagaagtcacacgcaagagtcatcgcggcctgggggaatccgtgtcctgggtgcagaacggagctgtaagcgtgtccgctgaacaccacatctgtgagtccaccaagccgctgccgtatacaagggacaaggagaagggcaagaagttcggcttctcactgttgtggcgctcattatcccgcaaagagaagcccaagaccgagcactcttccttcagtgctcaattcccccctgaggaatggccagtgcgggacgaagatgatctggataatattccgcgagatgttgaacacgaaattattaagcgcattaatcctattctcactgtagacaacctaattaagcacacagtgctgatgcaaaaatacgaagaacaaaagaagtacaacagccaggggaccagcactgatatgctcacgatcgggcataagtaccctagcaaggagggtgtcaagaaaagacagggactctccgcaaaaccccagggccagggccactcccgcagggaccgccacaaagcacgcaaccagggcagcgagttccagcccggaagtattagattggagaaacaccctaaattgccagcaactcagccaatccctaggattaagtctcccaatgagatggtcggtcagaaaccactgggggagatcaccacagtcctcggctcgcacctcatttacaagaaacgcatttcaaatcctttccagggcctgtcccacagaggcagtacaatcagcaaagggcataagatccagaaaacaagtgatctcaaaccttcacagacaggtcccaaggaaaagcctttccagaaaccccgctctctggactccagtagaatctttgatggcaaggccaaggaaccctacgccgaacaacccaatgacaaaatggaggcggagagcatttatatcaacgacccgacagtgaaacctatcaacgatgactttcgaggccacctgttctcccacccccaacaaagcatgctgcaaaatgacggtaagtgctgcccatttatggaaagtatgcttagatacgaagtctacgggggtgaaaacgaggttatacctgaagtgcttaggaagtcacacagccatttcgacaagctgggagaaaccaagcagaccccccactccttacctagccgtggcgcatcctttagcgatcgcacacccagtgcatgccggctggtggacaacaccatccaccagtttcagaacctggggctcctggattaccccgttggggtgaacccactgagacaggccgcaagacaggataaggattctgaggaactgctaaggaagggtttcgtacaggatgccgagaccacctcactggagaacgaacagctgtctaacgacgaccaggcactttaccagaatgaagtggaagacgatgatggtgcttgctcgagcttgtacttagaggaggacgacatatcggaaaatgatgacttgcgacagatgctccctggacacagtcaatattcgtttacaggggggagtcagggtaaccacttgggtaaacaaaaagtgatcgagcgctccctaactgaatacaacagcacaatggaaagggtcgagagccaggtcctcaagcgaaatgaatgttataagccaactggcctgcacgcaacgcccggagagagccaggagcccaatctgagcgccgaaagctgcggattaaattctggcgcccagttcggctttaattacgaagaggaaccctcagttgcaaagtgtgtccaggcctcagccccagctgatgagcggatctttgattactatagcgcccgcaaagctagctttgaggccgaagtgatccaggacacgatcggcgacactggaaagaaaccagcctcctggagtcagtctccccagaatcaagaaatgcggaagcatttcccacagaaatttcagctgtttaacacttcacacatgcctgttctcgcacaggatgtgcagtacgagcactcccacctagagggaaccgagaatcatagtatggccggtgatagcgggatcgacagccctcgtacacagtctttaggatccaacaactcggtgattcttgatgggctcaaaagaaggcagaactttctccagaatgtcgaaggaacaaagagctcacagcctctcacctcaaatagcctgctccctttgaccccagtaattaatgtgtag

SEQ ID NO: 136448 - DNA, 2640 bp, Artificial Sequence
  Description of Artificial Sequence: Synthetic coding sequence
atgaacccaattacacagtcccagtttgtgccccttggagaagtcctgtgctgcgccatcagtgatatgaacacagctcagatcgtggtcacccaggaatccctgctggagcggctcatgaaacattatccagggatcgccatcccctctgaggatatcctctacactaccctgggaacactgataaaggagcggaaaatctaccataccggagaaggctatttcatcgttacaccccagacctatttcattactaatacgactacacaagagaacaagagaatgttaccttccgacgaatcccgtctgatgcctgcatcaatgacatatttggtttccatggagtcttgtgccgaaagtgcccaggaaaatgcagctcccattagccattgccagtcctgtcaatgttttcgggacatgcacactcaggacgtccaagaagcccccgtggctgcagaagtcaccaggaaatcgcaccgcggcttaggagaaagtgttagctgggtccagaatggcgccgttagcgtgtccgcagaacaccatatctgcgaaagtacgaagccattgccgtatacacgggataaagagaaggggaagaagttcggattctccctcttgtggaggagtttgagccgcaaagaaaagcctaagaccgaacactcgtcattttccgctcagttccccccagaggagtggccagtccgggacgaggacgatctcgacaatattccacgggacgttgagcatgaaattataaagcggatcaacccgatcctgactgtagacaacctcatcaagcacactgtgctgatgcagaaatacgaagaacaaaaaaaatacaactctcagggaacctctaccgatatgttgaccattgggcataagtatccatccaaggaaggcgtgaagaagaggcagggcctgagtgctaagccccagggacagggccattcacgccgcgataggcacaaggcgaggaaccagggctccgaatttcagcctggtagtattcgcctggaaaagcatcccaaactgcccgctacccagcctataccaagaatcaagtcgccaaacgagatggtgggccaaaagcccctaggggagatcaccacagtactgggcagtcatctgatttataagaagcgaataagtaatccctttcagggtctgtcacatcgcgggagtaccatttcaaaggggcacaagatccagaaaaccagtgatctgaaaccgagccaaacaggcccaaaggagaaacccttccagaaacctaggtcactggacagctcccggatttttgacggcaaggccaaggaaccatacgcagaacagcctaacgacaagatggaggctgagtcaatttacattaatgacccgaccgtgaagccgatcaacgatgacttccggggacacctgttttcccacccccagcagtcaatgctgcagaacgacggcaaatgttgcccgtttatggaaagtatgctcagatatgaagtgtacgggggggaaaacgaggtcatccctgaggtccttcgcaaatcccattctcattttgacaagttgggagaaacaaaacagactcctcactctttgccatctcgcggtgcctccttttcagatagaacacccagcgcatgtaggctggtagacaacacaattcaccaatttcaaaacctgggtcttcttgactatcccgtcggggtcaaccccctgagacaagccgccagacaggataaggacagtgaggaactgctgaggaaaggctttgtgcaagacgccgagacgacatccttggagaacgagcaattgtctaatgacgaccaagcgctgtatcagaacgaggtggaggatgacgatggggcttgttcaagcctgtacctggaagaggacgatatctccgagaacgacgatctgcgccaaatgctacccggacactcccagtattctttcactgggggaagccaaggaaatcatttaggtaaacagaaggttatagagcgatccctcactgagtacaactccactatggaaagagtcgagtcccaggtgctgaagaggaatgaatgctataaacctaccggcttacacgccacacccggggagagccaggagccaaatctctcagctgaatcatgtggactgaactctggcgcacaatttgggtttaactatgaagaggagccctccgtggccaaatgcgtgcaggccagtgcacccgcggatgaacggatcttcgattattactcagccagaaaagcttccttcgaagcagaggtaattcaggacaccatcggcgacactggaaagaaaccggcctcctggagccagagcccccagaaccaggaaatgcgtaagcatttccctcagaagttccaattgtttaatacctcccatatgccagttttagcccaagacgttcaatatgagcactcccacctggaaggaacggaaaatcactccatggccggagacagtgggatagattccccccgtacccaaagtctcggctcaaacaacagtgtgatattagacgggcttaaacggcgccagaactttctccaaaatgtcgagggcactaaatctagccagcccttgacttcgaattccctgttgcctctgacaccagtcataaatgtatag

SEQ ID NO: 136449 - DNA, 4179 bp, Artificial Sequence
  Description of Artificial Sequence: Synthetic coding sequence
atggttgaacctggccaggatcttctgctcgctgccctgagtgagagtggcatcagcccaaacgacctgtttgatatcgatggcggggacgccggcctggcaaccccaatgcctacaccctccgtgcagcagtcagtgcccctatctgcccttgaattgggactggaaaccgaagcagctgtgcctgtgaaacaagagcccgaaaccgtaccgacacctgccctccttaacgtgcgtcagcccccctcaacgacgacctttgtcctgaatcagatcaaccacctacctcctttgggcagcaccatcgtcatgacaaaaacccccccggtgacaaccaatagacagacaattaccctgactaagttcattcaaacaacagcctccacccggccaagtgtaagcgctcccactgttaggaatgcaatgacctccgcgccttcaaaagaccaggtacagctgaaggacttgctcaaaaacaattctctcaacgaacttatgaagcttaaaccaccggccaatatcgcacagcccgtggccactgccgccaccgatgtgtctaacgggaccgtgaagaaggagtccagcaataaggagggcgctcgcatgtggatcaacgacatgaagatgagaagtttctctcccacaatgaaagtgccagtggtaaaggaggacgatgagcctgaggaagaggatgaagaggaaatgggacacgctgagacgtacgccgagtacatgcccatcaagcttaagataggactccgacatcccgatgccgttgtagagacaagcagtctttcgtcagtgaccccgccggacgtctggtacaagacaagtattagcgaagagacaatagacaacggttggctatccgctctccagctagaggcaattacttatgcggctcagcagcacgagaccttcttacctaacggcgaccgcgctggcttcctcattggggatggcgctggcgtggggaaaggacggaccattgctggcataatttatgagaattatctgcttagccgcaagagggcactttggttctccgttagcaacgacctcaaatacgatgccgaacgcgacctgagggacattggggcgaagaatatccttgtgcattctctgaacaagtttaaatacggaaagattagtagtaaacataatggttcggtcaaaaaaggcgtcatctttgcaacctactcttccctgattggcgagagccagtctggtgggaaatacaagacccggttgaaacagctgttacactggtgcggcgatgatttcgacggggtgatcgtgttcgacgaatgccataaagccaagaacctctgtccagtcggcagctcgaagccaaccaagaccggactggctgtgctcgagctacagaacaagttgcccaaggctcgggtcgtgtatgctagtgccaccggcgcatccgagccaaggaatatggcctacatgaaccgcttgggcatttggggggagggaacaccgtttcgggaattctcagatttcatccaggctgtcgaaaggagaggcgtgggggctatggaaattgtggctatggacatgaagttacgtggaatgtacattgctagacaactgtcctttactggtgtaacctttaaaattgaggaagtgctgctgtcccagtcctatgtgaagatgtataacaaagccgtgaaactctgggtcattgccagagagcggtttcagcaggctgctgatctgattgatgctgagcagcgtatgaaaaagagtatgtggggtcagttctggtctgctcaccagcgcttctttaaatatctttgtatcgcatccaaggtgaagagggtagtccagttggctcgggaagagataaaaaatggcaaatgcgtggttattggattgcagagtaccggagaagcccggactctcgaggctctagaagaaggaggcggtgagcttaatgattttgtgtcaactgctaaaggtgtactgcagtctctgatcgagaaacattttcctgcccccgatcggaaaaagctctattccctactcgggattgacttgactgctcccagcaataattcaagcccaagggacagtccatgcaaggagaacaaaataaagaaaagaaaaggagaggagataacacgggaagctaagaaagcgcgcaaggtcggcggtttgacaggctcctcaagcgacgattcaggaagcgagagtgacgccagcgacaacgaggaatctgactatgaatcttcgaagaatatgtcatccggggatgatgacgactttaaccccttcctagacgagagcaatgaggacgatgaaaatgacccttggctgatacgcaaagatcacaagaaaaacaaagagaagaagaaaaaaaagtctattgatccagattccattcaatccgccctgctggcgtcagggttgggtagcaaacgaccctccttcagctccactccggttatctcgccagctcccaattccacaccagccaactcgaatactaattcaaatagtagcttgatcacaagccaggatgccgttgagcgagcgcagcagatgaagaaagatcttctcgacaagctggaaaagctggcagaggatttaccccccaataccctagatgagctgattgatgagctgggcggccccgaaaatgtcgccgaaatgaccggaagaaaaggaagagtggtgtccaatgacgatggcagtataagctatgaatccaggtctgaactggacgtccccgtggaaatcctgaatataactgaaaagcagagatttatggacggtgacaaaaatatagctattatctccgaagctgcaagtagcggaatttctttacaggccgacagaagggcgaaaaaccagaggcgccgcgttcatatgacactagaactgccttggagtgccgatcgggcaattcagcagttcgggaggacccaccgaagtaatcaggtcacagcccccgagtatgtgttcctgattagtgagcttgccggtgagcagcgctttgccagtatcgtggctaagcgcctggaaagtctgggggccttgacccacggggaccgtagagcgactgagtctagagatctctcgcggttcaatttcgacaacaagtatggtaggaatgccctcgagatcgtaatgaaatctattgttaatctggattccccgatggtcagccccccccccgactacccaggggagttctttaaggatgtccggcagggtctgatcggtgtgggtttgattaatgtggaagatagatcagggattctcaccttggacaaagactataataacatcggtaaatttttaaatcggatccttggcatggaggtccaccagcagaacgcactttttcagtactttgcggacacactaactgcagttgtgcaaaacgccaagaagaatggccgctacgatatggggatcctagacctggggagcggagatgaaaaagtgagaaagagcgacgtgaagaagtttctgacacctggctattctacttcagggcatgtggaactttacaccatcagtgtagaacgaggaatgtcctgggaggaggctacaaaaatctgggcagagttaaccggcccagacgacggcttttatctgagtctccagatacggaataataagaagacagccatcctagtcaaagaagttaacccaaagaagaaactgtttcttgtgtacaggcccaatactgggaagcagcttaagttggagatctatgcagatcttaaaaaaaagtataagaaggtagtttccgacgatgccctcatgcattggctggatcaatataactcaagtgctgacacttgcacccacgcttactggaggggcaactgtaagaaggcatccttgggcctggtatgcgagatcggcctgcgctgccgcacctactacgtgttgtgtggttcagttctgagtgtgtggacgaaggtggaaggggtactcgcttctgtctcaggtactaatgtgaaaatgcagatcgtcagactcaggaccgaggatgggcaaaggatcgtgggtttgatcattcccgccaactgcgttagtcctctggtaaatctgctgtccaccagtgatcagtctcagcaacttgcagttcaacagaagcaattgtggcagcagcaccatccacagagcatcacaaacctgtccaatgcctag

SEQ ID NO: 136450 - DNA, 4182 bp, Artificial Sequence
  Description of Artificial Sequence: Synthetic coding sequence
atggtcgagcccgggcaggacctgctgttggctgccctgtctgagtctggaataagccccaatgacctgttcgatatcgacggaggagatgccggattggccacgcccatgccaacaccctcagtccagcagagcgtcccattatcagccctggagttgggcttagaaaccgaagcagcagttcctgtgaaacaggagccggagactgtgccgactcctgccttgctcaacgtccggcagcagcccccctctacaacgacgttcgtacttaaccagatcaaccacctgcctccacttggctcgaccatcgttatgacaaagactccaccagtgactactaatcgccaaactataaccttgaccaaattcattcagaccacagcttctactcgcccaagcgttagcgcacctactgtcagaaacgccatgacttccgccccctctaaggatcaggttcagctgaaagatcttttaaagaataacagtttgaatgagctgatgaaactcaaaccaccagctaatatagcccaacctgtggctacagctgctacagatgtcagcaacgggactgtgaaaaaagaatccagcaacaaagagggagccaggatgtggatcaatgacatgaagatgcgatcattcagccctaccatgaaagtgcctgtggtgaaagaagacgatgaacctgaggaggaggacgaagaagagatgggccatgcagagacatatgccgaatatatgcctattaagttgaagataggccttagacacccggatgccgttgtcgagacctccagcttaagttccgtgacaccaccagatgtctggtataagacttcgattagcgaggaaaccatcgataacggctggctctcggctctgcagctcgaagcaattacctacgctgcccagcagcacgagacgtttctgccaaacggcgaccgagcaggcttcctcatcggggacggagccggcgtgggcaagggtagaaccatcgcaggtattatctatgagaattacttactgagtcgaaagcgcgctctctggttcagcgtatctaacgatctgaaatatgatgcagagagggacctccgggacattggagcaaagaacattctggttcactcactgaataaatttaaatacggtaagatctcaagcaaacataacgggtcagtgaagaagggcgtgatctttgcaacttacagctctctgattggcgagtcccagtcgggcgggaagtacaaaaccagactaaaacagctgctgcattggtgcggagatgacttcgatggggtgattgtgtttgatgagtgtcacaaggcaaagaacctttgtcccgtgggcagttccaagcctaccaagaccggtctcgccgtcctggagttgcagaataagctgcccaaggcccgcgtagtgtacgcatcagccactggagcatccgaacctcgaaatatggcttacatgaacaggcttggaatatggggagaggggaccccattccgagaattttctgactttatccaggcagtggagcgcaggggagttggggccatggaaatcgtggcaatggatatgaagctgcggggcatgtacatcgcacgacagttgtcttttacaggggtcaccttcaagatcgaagaggttttactgtcgcaaagctatgtcaagatgtataacaaggcagtcaagctatgggtgatcgcccgtgagaggtttcagcaggctgccgatctgattgacgctgagcaacggatgaaaaagagcatgtgggggcagttttggtccgctcatcagcgctttttcaagtatctatgcatagccagtaaggtgaaacgggtggtgcagttggcaagggaagagattaaaaacgggaaatgtgtggttataggcctgcagtccactggagaagcgcgtaccttggaagctctcgaagaggggggtggggaactcaatgattttgtgagcacagcaaaaggtgtcctacagtctctgatcgagaagcattttcccgcaccggaccgcaaaaagctgtattctttgctcggcattgacctaacagcccccagcaataactcaagcccacgagattccccatgtaaggagaacaagatcaaaaagagaaaaggtgaagaaatcaccagggaagccaagaaggcccggaaagttggagggctgaccggctcgtccagcgacgacagcggcagtgagtcagacgccagcgataacgaggagtccgactacgaaagcagcaaaaacatgtccagtggcgatgacgacgatttcaacccgttcttggacgagagtaacgaagacgacgagaatgatccctggctcattagaaaggatcacaagaaaaacaaggagaagaaaaagaagaagtcaatcgacccagattccatccagtcagccctattggctagcggcctggggagcaagagaccctcttttagcagcactccagtgatctccccagcaccgaatagcacaccggctaatagtaatacgaatagcaattctagccttattacatctcaggacgcagttgaaagagcccaacaaatgaagaaggacctgctcgacaagttggagaaactggcagaggatctcccacctaacaccctcgatgaactgatagatgagctcggggggcccgagaatgtcgcagagatgacggggagaaagggaagagttgtcagcaatgatgacggctcgataagctatgagtcccggtccgaactcgacgtgcctgttgaaatactcaacatcacagagaagcagagattcatggacggcgataagaatattgcaatcatctccgaagcagcttcatcaggcatctcattgcaggccgataggagggccaaaaaccagcgacgccgagtccacatgacactggagctgccttggtccgccgatcgggccattcagcagtttggcaggacacatcgatcaaatcaggttacagcccccgaatacgtgttcctgataagtgaacttgcaggggagcaaagatttgcatctatcgtggccaagcgacttgagtcactcggagctctgactcacggcgatcggagagcaacggaaagtcgtgatctgtctcgttttaactttgataacaaatatggaaggaacgctcttgagatcgtgatgaagagtatcgtgaacctcgactcacccatggtgtcacctccgcctgactatcccggcgaattctttaaggacgtgcgacagggccttatcggggtgggacttattaacgtggaggacagatcaggtattcttacattggacaaggattacaacaacatcggaaagttcctcaaccggatcctcggtatggaggttcaccagcagaatgctctgttccaatacttcgctgatactttaacagccgtagtgcaaaacgcaaaaaagaacggacggtacgatatgggaatcttagatctgggctctggtgacgagaaggtgcggaaatctgatgtcaagaagttccttacacccggttactctacatcaggccacgtggagctttatacaattagtgtggagagaggaatgtcctgggaagaggcaactaaaatttgggctgagttaactgggccagacgacgggttctatcttagcctgcagatcaggaataacaaaaaaaccgctatactggttaaggaggttaatcctaagaaaaaactgttcttggtgtatcgcccaaatacgggaaagcaattgaagctcgagatctacgccgacctgaaaaaaaagtacaagaaggtcgtgtcggatgacgcgctgatgcactggctggaccagtacaattcttcagccgatacctgcacgcacgcttattggagagggaattgtaaaaaggcatcccttgggctggtgtgtgagatcggcctccgttgcagaacctattacgtgctgtgcggctccgtgctgagcgtgtggaccaaggtggagggcgtactagcatcggtcagcggtactaatgttaagatgcaaatcgtgcgcctacgcactgaggatgggcaaagaattgtgggcctgattatccctgccaattgtgtaagtcctcttgtgaatttgctgagtaccagcgaccagtcccagcaacttgccgtccagcagaaacagttatggcagcaacaccatccgcagagtatcacaaacttatctaacgcttag

SEQ ID NO: 136451 - DNA, 2199 bp, Artificial Sequence
  Description of Artificial Sequence: Synthetic coding sequence
atggtagagcctgggcaagacttgctgttggcagccctgagtgaatctgggattagtccaaatgacctcttcgacatcgacggtggcgacgcaggactggccacgcctatgccaacgccttccgtgcagcagagcgttccactgtcagccctggagctggggttggaaaccgaggccgccgtgccagtgaaacaagaacccgaaactgtacccacacctgcgctgctcaatgtgaggcagcctccgtctacaaccacctttgtgttgaatcagataaaccatctgccccccttaggcagcacaatcgttatgacaaaaacaccaccagtcaccaccaaccgccagaccattaccctgaccaaatttatccagactacagctagtacacgccctagtgtttcggctcctacagtgaggaacgccatgacgtccgctccctcaaaagaccaggtgcaactgaaagacctgctgaagaacaacagccttaatgaactgatgaagctgaagccgcccgctaacattgcacagcctgtggccacagcagccactgacgtctcaaacggaaccgtaaaaaaggagagttctaacaaagaaggcgcacgaatgtggatcaacgatatgaagatgcggagttttagtcccaccatgaaagtgcccgttgtaaaagaggacgacgaacccgaggaagaagacgaggaggaaatgggccacgcggagacgtacgcagaatatatgcccattaagcttaagatcggtctccgccatcccgatgctgtcgttgagacttcctccctctcttcagtgactccgcctgatgtgtggtacaagacttctatctcagaagaaacgattgataacggctggctgtctgctttacagctggaggccattacctacgccgctcagcagcacgaaacctttctgcccaatggcgatcgggccgggtttctgatcggagacggggcaggagtagggaaaggcaggacgattgccggcatcatttacgaaaactacctgttgagccggaagagggctctctggttttctgttagtaacgatttgaaatacgatgcagagcgcgacctgcgggacataggtgccaagaacattctggtccactcattgaataaattcaagtatggaaaaatctcctctaaacacaacggttccgtaaagaagggtgtgatattcgctacttattcttctctgatcggcgagtcacaatcaggtgggaagtataaaaccagattgaaacagctgttgcactggtgcggtgacgactttgatggcgtgatcgtcttcgacgaatgtcataaggccaaaaacctatgcccggttggcagttccaagcccaccaagaccgggttggcggtccttgagctgcaaaataagctgccaaaagcacgggtggtttacgcctctgcaacaggggcttccgagcctcgaaacatggcctatatgaaccggttggggatttggggggaaggcacacctttccgcgaattctcagatttcattcaggcagtggaaaggcggggcgtcggggccatggagatcgtggcgatggatatgaaactgcgggggatgtatattgcccgacagctgtccttcactggggtgacatttaagattgaggaagtgctcttgagccagtcgtacgttaagatgtacaataaggcagtaaagctttgggtaatcgcccgagaacgatttcagcaagctgcagatctgatagatgcagaacaacggatgaaaaagtcaatgtggggacaattttggagcgcccaccagcggttcttcaagtacttatgcatcgcttcgaaggttaagagggtggtccaactggcaagggaagagatcaagaatggaaaatgcgtggtgattggactgcaatctacgggcgaggctcgcacattggaggctctggaggagggcggtggtgaactgaacgacttcgtgtctaccgctaaaggagtgttgcaatctcttattgagaaacactttcccgcccccgacagaaagaaactgtattccctgctcggcattgatctgactgccccgagtaacaactcctcgcctcgagatagcccctgtaaggagaataaaatcaaaaagcgtaagggagaggaaattacaagagaagcaaagaaggctaggaagatgtctttgatgcgtatgatgaagatggtctctagctag

SEQ ID NO: 136452 - DNA, 1632 bp, Artificial Sequence
  Description of Artificial Sequence: Synthetic coding sequence
atggagcaggtcaacgaactcaaagaaaagggtaacaaggctttgtcggtggggaatattgacgacgcactgcagtgctatagcgaggccatcaagctggaccctcacaatcacgttctctactccaaccggagcgctgcctatgccaaaaaaggggactaccagaaggcctatgaggatgggtgtaagaccgtggacctgaaaccagactggggaaaggggtacagccgtaaggcggccgcgctggaatttctgaatcggtttgaggaggccaagaggacgtatgaggagggattgaagcacgaagctaacaacccacagctgaaggaaggtctccagaacatggaggctcgattggcagaacggaagttcatgaacccgttcaatatgcctaacctgtatcagaagttagaatcagacccgagaacaagaacgctcctgagcgaccctacatatcgtgaactaattgagcaactccgtaataagccctctgatctgggaacgaagctgcaggatccgaggattatgaccaccttgtccgtcctcttaggcgtggacctgggcagtatggatgaggaggaagaaatagccacacctcccccccctccaccacctaaaaaggagaccaaacctgagccaatggaggaggatttgccagagaataaaaaacaggcccttaaggaaaaagaattgggtaacgatgcctataaaaagaaggattttgacactgcgctgaagcattacgacaaagccaaagagcttgaccccactaatatgacatacattaccaaccaagcagctgtgtatttcgagaagggggactacaataaatgccgggagctgtgtgagaaggccatcgaggtgggcagggaaaacagagaagattacaggcagattgctaaagcatatgcacgtattgggaacagctactttaaagaggagaaatacaaggacgccatccacttctacaacaagtctctagctgaacataggactcccgacgttctgaagaagtgccagcaagccgaaaagattctgaaggaacaggagcgcctagcttatatcaatccggacctagcattggaagaaaagaataaaggaaatgagtgtttccaaaaaggggattaccctcaggcaatgaaacattatacagaagctattaaaagaaaccccaaagacgccaagttgtattccaaccgggcagcttgttacactaaactgttggagtttcagctggcccttaaggactgcgaagagtgtatccagctggagcctacattcataaaaggttatactcgcaaagcagccgcactggaggctatgaaggattacactaaagcaatggatgtatatcagaaggccctcgatcttgactcaagctgcaaggaagctgcagatggatatcagcgctgcatgatggctcagtacaacagacacgactcgcccgaggatgtaaagagaagagccatggccgaccccgaagtgcagcagatcatgagtgatcctgccatgcggctgatccttgaacaaatgcaaaaggaccctcaggccctctctgagcacctgaagaacccggtcattgctcagaagatacagaagcttatggacgtgggattgatcgccattcgatag

SEQ ID NO: 136453 - DNA, 1359 bp, Artificial Sequence
  Description of Artificial Sequence: Synthetic coding sequence
atgaacagacagctggtgaacattctgaccgctttgtttgctttcttcctcgaaactaatcattttcgtaccgcgttttgtaaagatcatgatagcagatcgggcaaacagcccagccagaccctgagcccatccgactttttagacaaactgatgggaaggaccagtggttacgacgccaggatacgtccaaatttcaaaggcccgccagtgaatgtgacgtgtaacatattcatcaacagctttgggagtgtaacagaaaccactatggactaccgcgttaatattttcctgcgtcaacagtggaacgatagtcggcttgcctattccgagtacccagacgacagcctggacctggacccgagtatgctcgatagcatctggaagcctgacctgtttttcgcgaacgaaaaaggcgccaattttcacgatgtcactaccgataacaagctactgcgcatctcaaaaaacggtaaggtgttatactccataagactgacccttaccttatcttgcccaatggacctgaagaacttccctatggacgtccagacctgtacgatgcagttggaatccttcggctataccatgaatgacttaatatttgaatggttaagcgatggccctgtccaggtggccgaaggtctgacgctgcctcaatttatcttgaaggaggagaaagagctgggctattgcacaaaacactacaataccggaaagttcacatgtattgaagtcaagtttcacttggagcgccagatgggctactacttaattcagatgtatattccttcgctccttattgttatactgtcctgggtttccttctggataaacatggatgctgctcctgcaagagtggctttgggtataacaacagtgctaaccatgacaacccagtcatcagggtctcgggcgtctttgccaaaagtctcctacgttaaagcaatagacatttggatggcggtatgcctgttatttgtcttcgctgccctcctggaatacgccgctgttaacttcgtttcaagacagcataaagagttccttaggctgagaaggcggcaaaaacgacagaacaaggaagaagatgtcacccgcgagtctagatttaacttctccgggtacggcatgggccactgcttgcaggtgaaggatggtaccgctgtgaaggccaccccagcaaatcccctcccacaaccgcccaaggacggagatgcgatcaaaaagaagttcgttgatagggctaagaggatcgatacgatatctagggctgcgttccctttggctttcttaatctttaatatcttttactggataacctataaaattatccgccacgaagatgtgcacaaaaagtag

SEQ ID NO: 136454 - DNA, 3489 bp, Artificial Sequence
  Description of Artificial Sequence: Synthetic coding sequence
atgaatgggcatcatcagcaaaatggtgttgaaaatatgatgctcttcgaagtggtgaagatgggaaagtctgctatgcagtctgttgtggatgattggattgagtcatataaacacgacagggatatcgcgctcctggaccttataaatttttttatccagtgtagcggatgtaaaggcgtcgtgaccgctgaaatgttcagacacatgcaaaatagcgaaatcattagaaagatgactgaagagtttgatgaggattcgggggattaccctttgaccatggccggccctcaatggaagaaatttaaatccagcttctgcgagtttattggcgtgctggtgagacaatgccagtatagcattatatacgacgagtatatgatggatacggtgatctccctcttaacaggactttccgatagccaggtgagagctttccgacataccagcacgctcgctgccatgaagctgatgaccgcccttgtaaacgtggcgctgaacctgagtattaatatggataatacccaacggcagtacgaggccgaacgaaacaagatgattggaaagagagctaacgaacgcctcgagctgctcctgcagaagaggaaggaactccaggagaaccaggatgaaattgagaacatgatgaacgcgatctttaaaggcgtttttgttcaccggtacagagacgctatcgcggaaatcagagctatctgtattgaggagataggaatctggatgaaaatgtactctgacgctttcttgaatgattcgtacctgaaatatgtgggatggactatgcatgataagcaaggcgaggtgaggctgaagtgtttgacagcccttcaggggctgtactataacaaggagcttaattcgaaattggaactcttcacctctcgctttaaggatcgcatcgtctccatgactctggacaaggagtacgatgttgccgttcaggctatcaagctcctgacgcttgtgctccagtcttcagaggaagttctcactgctgaggattgcgaaaacgtctaccatttggtctattctgcgcacaggcctgtcgccgtcgcagcaggagagtttctgtacaaaaagctcttttctagacgcgatcctgaggaagatggaatgatgaaacgtcgaggacgccaaggtcctaatgccaatctggttaagactctagtgttcttttttctggaaagcgaactgcacgagcatgccgcctacttagttgactccatgtgggattgtgcgacagaacttctgaaagactgggaatgcatgaactcgttgctgctggaggagcctctctcaggagaagaggcattgaccgatcgccaagagtcagctctaattgagattatgttatgtaccatcaggcaggcagccgagtgccacccaccggttggcagaggcactgggaaacgcgttctcaccgccaaagagaagaagacccagcttgacgacagaaccaaaattacggagctttttgccgtcgccttgccacagctattggccaaatactctgtggacgccgagaaagtcaccaatttgctgcagttaccgcagtactttgacctggagatctacacgacaggacgactagagaaacatctggacgccttgcttcgccagatccggaatatcgttgaaaaacacaccgatacggacgttctggaggcctgctcaaaaacctatcacgcactgtgtaatgaggagttcacaatatttaatagagtcgacatcagtcggtcgcagcttatcgacgagctcgcagataaattcaaccgcttgctggaggattttctgcaggagggcgaggaacccgacgaagacgatgcctaccaagtgctttctactctcaagcggattactgcctttcacaatgcacatgacctgtcgaagtgggatttattcgcttgtaactacaagctccttaagactggaattgaaaacggcgatatgcccgagcagatcgtgatccacgccctgcagtgtacacattacgtcatcctctggcagctcgctaaaatcaccgaatcttccagcacaaaagaagacctgctgcgcctgaagaaacagatgcgagtgttttgccagatctgtcagcattacttaaccaatgtgaacaccactgtgaaggagcaggcatttaccattctttgtgatattctcatgattttcagtcatcagatcatgagtggtggaagagatatgcttgaacctttggtgtacactccagactccagcttacagtccgagctgctctcgtttattttggatcatgtgtttatcgaacaggacgatgacaataatagcgcggacggccagcaggaggacgaagcttctaagatagaggccctgcataagcgacgtaatctcctagcagctttttgcaagctgatcgtgtatacagtggtggaaatgaatacggctgccgacatctttaaacaatacatgaaatactataatgattatggggatatcattaaggagacgatgtcaaagactcgccagattgacaagatacagtgcgccaagactttgattttgagtctccagcagctgttcaacgaaatgatccaggaaaacggctacaacttcgaccgcagtagttctacctttagtggcatcaaggaactggccaggagattcgctctaacgtttggactggatcagctgaaaacccgtgaagcaatcgcaatgctacataaggacggaatagaattcgccttcaaggaaccgaacccccagggggagtcccatcccccattgaacctcgctttcctggatattctcagtgagttcagcagcaaattactccgccaggataagcgcacagtgtatgtttacctggaaaagtttatgactttccagatgagtcttcgccgggaggacgtgtggctgccgctgatgagttaccgcaattcccttcttgcagggggcgatgatgataccatgtctgtgatttcaggtatatctagtcgcggcagcactgtgcgttccaaaaagagtaaacctagtacaggtaaacgcaaggtggtggaagggatgcagttgagtctgactgaagagagctcatcttccgatagcatgtggctcagtcgcgagcagacactccacacccctgttatgatgcagacgccgcaactgacatctacaatcatgcgagaacccaagcggctaaggcccgaagactcctttatgtcagtttatcctatgcagactgaacatcaccagaccccattggattataaccggcggggtaccagcctgatggaagacgatgaggagcctatcgtcgaggacgtcatgatgagctctgaggggcgcattgaagacttaaacgaggggatggattttgatacaatggatattgatctccctccttctaaaaaccggagagaacgaacggagctgaagccagactttttcgatcctgcctcaatcatggacgaaagtgttctcggcgtctccatgttttag

SEQ ID NO: 136455 - DNA, 3696 bp, Artificial Sequence
  Description of Artificial Sequence: Synthetic coding sequence
atgattgctgctccagaaatcccgacagacttcaaccttctgcaggagtcagagacccactttagctccgatacagattttgaggatatcgaaggtaagaaccagaagcagggcaaaggaaagacctgcaaaaaggggaaaaaaggccccgccgagaagggaaagggaggaaatggcggagggaaacctccctctggcccaaatcggatgaatggacaccatcagcagaacggggtggaaaacatgatgcttttcgaggtcgttaagatggggaaatccgcgatgcagtccgtcgttgatgactggatagagtcatacaagcatgacagagacattgctcttctggatctgatcaatttctttatccagtgctctgggtgcaagggcgtggtcacagcagagatgttccgccacatgcagaatagtgaaatcattagaaagatgacagaggagtttgacgaagatagcggtgactatccactgaccatggcgggtcctcagtggaagaaatttaaatcttcattttgtgaatttatcggggtgttggtcagacaatgtcaatattcaattatttatgacgagtacatgatggataccgtcatctcactactgacaggcttatctgactctcaggtgcgcgccttccgtcatacttccacactggccgcaatgaagctcatgactgccctcgtgaatgtggccctgaacctctccattaatatggacaatacacagaggcagtacgaggcggagcggaataagatgattggaaaacgcgcaaatgagcgccttgagctgctcctacagaagcgcaaggagctgcaggaaaatcaggacgaaattgaaaatatgatgaatgcaatattcaaaggagtgttcgtccatcgctacagggacgctattgccgaaattcgcgccatatgtattgaggagatcggcatttggatgaagatgtacagcgacgcgtttctcaacgacagttatcttaagtacgtcggttggacaatgcacgacaaacagggcgaggtgcgccttaagtgtctgaccgccctgcagggactgtattataataaggagctgaacagtaagctcgaactgttcacaagcaggttcaaagaccgaatagtcagcatgacactggataaggagtacgacgtcgccgtccaggctatcaagctgctgactctagtgttgcaaagtagcgaggaggtacttacggccgaggactgcgaaaacgtgtatcatttggtgtatagtgcccataggcctgtcgccgtcgctgccggcgagttcctgtacaagaaactcttctctaggagggacccagaagaagatggcatgatgaaacgaagaggccgtcaaggtccaaatgctaatttggttaagacattggtgtttttctttctggaatctgaactccatgaacatgctgcttatttggtggattcaatgtgggactgtgccaccgagttactgaaagactgggaatgcatgaactcacttctgctggaggagccactaagcggcgaggaagccctgacagatcgtcaagagtccgcactaatcgaaataatgttgtgcaccatccggcaggccgccgagtgtcatccgcccgtagggcgcggaaccggcaaaagggtgcttaccgctaaggagaaaaagactcagttggacgatcgaacaaagattacagaactttttgccgtggcactgccacagcttctcgctaaatatagcgtggatgcagagaaagtgacaaatcttctgcagctccctcagtattttgaccttgagatttatactaccgggcggctggaaaagcacctggatgccttactccgacagattcgaaatatcgtagagaaacacactgatacagacgtgctagaggcatgttctaagacctaccacgccctctgtaacgaagaatttactatttttaatcgagtggatatctccagaagccagctgattgatgagcttgccgacaaattcaatcgcctgctcgaggatttcttgcaggaaggcgaagaaccggacgaggacgacgcttatcaggtgctctctacgctcaaaaggattacagcgttccacaacgctcacgatttatccaaatgggacctattcgcctgtaattacaaacttctgaagactggtatagagaatggagacatgcccgagcagatcgttatacacgccctccaatgcacccattacgtaatcctgtggcagctggctaagatcactgagtcttcgagcactaaggaagatttattacgtcttaaaaaacaaatgcgtgttttttgtcaaatatgtcagcactatcttacgaatgttaatacaacggtgaaggaacaggcctttacgatactttgtgacatcttaatgatcttctctcaccagatcatgagtggagggcgcgacatgctcgaacccttagtgtatacccctgatagctccttgcaatccgaattgctcagctttattctggaccacgtctttattgagcaggatgatgacaataattcagcagatggtcaacaagaagacgaggcgtccaagatcgaggcactgcacaaaagacgaaatttgcttgcagccttctgtaaactcatagtgtataccgtcgtagaaatgaacactgccgccgatattttcaagcaatacatgaagtattacaatgactatggggacattatcaaggagacaatgtcaaagactcggcagatcgacaagatccaatgcgctaaaactttgatcctttccctgcagcagttattcaacgagatgattcaggagaatggctacaatttcgatcgatcttccagcacatttagtggtataaaggagcttgcacggcgtttcgccttaacttttggactggaccaactgaaaacccgagaggctatcgctatgctgcacaaggatgggatcgaatttgctttcaaagaacctaacccgcaaggcgagtcacaccctcccctgaacttggcattcttggacattcttagtgagttctcttccaaactgctccggcaggacaagcgcacagtatacgtttatctggaaaaattcatgactttccagatgtcactgcggcgggaggatgtctggttgccattgatgtcttaccggaactccctgctagccggcggggatgacgacacaatgagcgtcatatcgggcattagtagtagggggtcaaccgtgcgttccaagaagtctaagccgtcaacaggaaaaagaaaggtggtggagggaatgcagttgtcattaaccgaggagagctcatcttctgatagcatgtggctgagcagagaacagactctgcataccccggtaatgatgcagactccccagttgaccagtactattatgagggagccaaaacgattgcgacccgaagattcattcatgtccgtctacccaatgcagaccgagcaccatcagacccccctcgattacaacagacgaggcactagcttaatggaagacgacgaagaacctatcgtggaggacgtgatgatgtccagtgagggccgtatcgaggacctgaacgaaggcatggacttcgatacaatggatatagatcttcccccgagcaagaaccggagagagagaacggagctcaaaccagactttttcgaccccgcttccatcatggacgagagcgttctgggggtctccatgttttag

SEQ ID NO: 136456 - DNA, 3807 bp, Artificial Sequence
  Description of Artificial Sequence: Synthetic coding sequence
atgatcgctgcccctgagattccaaccgactttaacctgttgcaggagtctgagacccatttttcttcggatacggattttgaggacattgaagggaaaaaccagaagcagggcaaaggaaagacctgtaagaaaggaaaaaaaggacctgcagagaaaggaaaaggagggaacgggggtggaaaacctccctcgggcccgaatagaatgaacggacatcaccagcaaaacggggtggagaatatgatgctatttgaagtggttaagatgggcaaatcagctatgcagtccgttgtggacgattggattgagtcttacaagcatgatcgagatattgcactgctggatctcatcaatttcttcattcagtgtagtgggtgtaagggagtcgtgactgccgagatgttccggcacatgcagaattccgaaattattcgcaaaatgaccgaggaatttgacgaagacagtggagattacccacttaccatggccggcccccagtggaagaagttcaaaagttctttctgtgagttcatcggtgtgttagtccgccagtgccagtattctatcatctatgatgaatatatgatggataccgtgatttccttacttacgggtctgtcagactcacaggtgagagctttccgacacaccagcacattggccgccatgaagctaatgactgcgttagtgaatgtggcactgaacctctccattaatatggataatacacaaagacagtatgaagccgagcgaaataagatgatcgggaaaagagcgaatgagcggttggagttgctcttgcagaaaagaaaagaattacaggagaatcaggatgaaatcgagaacatgatgaatgcaatatttaagggagtttttgtgcatcggtaccgggacgcaatagctgaaattcgggccatctgcatcgaagagattggcatatggatgaagatgtactcggatgccttccttaacgactcctatctcaaatatgttggttggaccatgcacgataagcagggagaggttcggctgaagtgcctgactgcgctgcagggactgtattataacaaggagctcaactctaaattggaactgtttacttctaggtttaaagaccgcatcgtgtccatgaccttggataaagaatatgatgtggcagttcaggccattaaacttctgacactcgtactacagtcttctgaggaggtactaacagcagaagactgcgagaatgtctatcacctggtttactcagcacaccgccccgtcgccgtagcagcaggagaattcttgtacaagaaattattcagtcggagagatcctgaggaggatgggatgatgaagcgaagaggccggcaagggccaaatgctaacctggtgaaaacactcgtttttttctttctggaatccgaactgcatgagcacgcggcttacctggtcgactccatgtgggactgcgctaccgaactgttaaaagattgggagtgtatgaatagtctgctcctggaggagcccctgagtggagaagaagccctgactgataggcaagagtcagccctcattgagatcatgttgtgcaccattcgccaggccgcggagtgtcaccctcctgtaggaagaggcaccggtaagcgagtgctgaccgctaaggaaaagaaaacgcagctggatgacagaactaaaatcaccgagctgtttgccgttgctttaccacagcttttagcaaagtattctgttgatgccgaaaaggtgactaacctgctgcagctgccacagtatttcgatctggagatttatacgactggacgcctggagaagcatctagacgccctgctgcgccagattcgcaacattgtcgagaagcataccgacacagatgtactggaggcctgttcgaagacatatcacgccctgtgcaacgaggagttcaccatctttaatcgagtggacatcagccgctctcagttgattgacgaattggccgacaaatttaataggctcttggaggatttcctgcaggaaggggaggagccagacgaggatgacgcctaccaggtgctgtctaccctgaaacggattaccgcattccacaacgcccacgatctgtccaagtgggatctttttgcctgtaattacaagctactcaagactggcattgaaaacggagatatgcctgagcagatcgtgatccacgctttgcaatgcactcactacgtgatcctttggcaactggcgaagatcacagagtctagctccacaaaggaagatcttctgcggctcaaaaaacagatgagagttttttgtcagatatgccaacactatctgaccaacgtgaacaccactgtgaaggaacaagctttcacgatcctctgtgacatcctgatgatcttttcacatcagatcatgtcaggcggacgggatatgctggagcccctggtgtatacaccagactcaagtctacagtctgagcttctctcttttatcctggaccacgtctttattgaacaggatgatgacaacaatagcgccgatggccagcaggaagacgaggcctccaagatcgaagcgctgcacaaaaggcggaacctcctggcagctttctgcaagctcatcgtgtacacagtagtggaaatgaacactgcagcagatatttttaagcagtacatgaagtactacaacgattatggcgacatcatcaaggaaacaatgagcaaaacccggcagatcgacaagatacagtgcgccaaaacactgatcctttctctccagcagctatttaatgagatgatccaagagaacggatataattttgatcgctctagcagcaccttcagcggaatcaaggaactcgcacgcagattcgccctgactttcgggctggatcagctcaaaacacgagaagccattgccatgttgcataaagacggaattgaatttgcgttcaaggagcctaatccccaaggcgagagccatccccctttgaacttagcgttcctggacatactcagcgaatttagctcaaaattgctgcgtcaggataaacgaacagtgtatgtctacctggaaaaattcatgacctttcagatgtcgctgagacgcgaagatgtgtggctgccgctgatgtcatataggaattctctcctcgccggaggggatgacgacaccatgtcagtcatctcaggaatcagctcccgcggctcgacagtcagatctaagaagagcaagccttctacaggcaagcggaaggtggttgagggaatgcagctgtccttgacagaagaatccagcagtagtgactcaatgtggctctcccgggaacagacactacacactccagtcatgatgcaaacccctcagttaacatctaccatcatgagagaacccaagagactgagaccggaggactcctttatgagcgtgtatcccatgcagaccgagcatcatcagactcctctggactacaatacgcaggttacctggatgctcgcccagaggcaacaggaagaggctcgccagcaacaggagagggccgccatgagttacgtgaagctcaggaccaacctccagcatgcaattcgcaggggcactagtttaatggaggacgacgaagagcctattgtggaagatgtaatgatgagttccgagggacgcatcgaggatcttaacgagggtatggacttcgatacaatggatatcgacctgccaccaagtaagaataggcgggagcggacagaacttaagcccgactttttcgaccccgcttccattatggatgagtcagtcttaggtgtctccatgttctag

SEQ ID NO: 136457 - DNA, 3696 bp, Artificial Sequence
  Description of Artificial Sequence: Synthetic coding sequence
atgatcgccgcgcccgagattccaactgactttaacctgcttcaggaaagcgagacccacttcagctctgacacggactttgaagacatcgagggaaaaaaccaaaaacaaggtaagggaaaaacatgtaagaagggcaagaaaggaccagcagagaaaggcaaaggaggtaatggggggggcaaaccaccctctggacctaacagaatgaacggacaccatcagcagaatggggtggaaaatatgatgttgtttgaagttgtgaaaatgggaaagtccgcgatgcaatccgtcgtggacgactggatagaatcgtataaacatgatcgggacatcgccctgctagacctgataaacttcttcatccagtgcagcgggtgtaagggggttgtgaccgctgaaatgtttagacacatgcagaattctgaaatcattcggaaaatgacggaagaatttgatgaagactcaggcgactatccactcactatggcaggtccacagtggaagaaatttaagtcttccttctgcgaatttattggtgttctcgtgagacagtgtcagtactccattatctacgacgagtatatgatggacaccgtcatttcattactcaccggtctcagtgactcccaggtacgggcctttagacatacatctaccctggctgccatgaaactgatgaccgcactggttaacgtggcacttaatctgtccatcaatatggacaacacccaacgccagtatgaagccgaacgtaataaaatgatcgggaagcgcgcgaatgagcggcttgagctgctcctccagaaacgcaaagagctccaggagaaccaggacgaaattgagaatatgatgaatgctatttttaaaggtgtgtttgtccaccgttacagagacgctatcgctgagatccgtgccatatgtatcgaggagataggaatctggatgaagatgtattccgatgcctttctgaatgattcgtacctaaagtatgtggggtggactatgcacgataaacagggcgaggtacgtctgaagtgcctgacagctctccagggcctgtactacaacaaagaactgaactcaaagttagaactgttcacttcaagattcaaagatcgtatagtgtccatgacgcttgacaaggaatacgacgtggccgttcaggcgatcaaactgctgactttggtgctccagtcttcagaggaggtcctaactgcagaggactgcgagaacgtgtaccacttagtttatagcgcccatagaccagtggccgtggccgctggagagtttctgtataagaagctcttcagcaggcgggacccagaagaagatggtatgatgaaaaggagagggagacagggtcccaatgcaaaccttgtgaagaccttagtatttttttttttggaaagcgaattacatgagcacgcggcatatcttgtagacagtatgtgggactgtgctaccgaattgctgaaagactgggagtgcatgaactctctgctgctcgaagagcctctcagcggagaggaagcacttactgaccgccaagagagcgctctaattgagatcatgttgtgtaccatccgacaagccgcagaatgtcaccctccagttggccgggggaccggcaagcgcgttctgacggccaaggagaaaaagacacagctggacgacaggactaaaattaccgagctcttcgcagtggctctccctcaattgctcgccaagtacagcgtggatgcagagaaagtcacaaatctcctccaactccctcagtacttcgacctggagatctacaccaccggccggcttgagaagcacctggatgcactgctgcgccagatcagaaatattgtagagaaacataccgacactgatgttctcgaagcctgttctaaaacgtatcacgcattgtgcaatgaggagtttacgatcttcaatagggtggatatctcccgaagccaacttatagatgaactggctgataagtttaatcgtctgctggaggactttctgcaggagggggaagagccagatgaggacgatgcgtaccaggtcctgtcgacccttaagcgaattaccgctttccataacgcccatgacctgtcaaaatgggatctattcgcctgtaattacaaactgctgaagaccggcatcgagaacggcgatatgcccgagcagatcgtcattcacgctctgcaatgtacccattatgtcattctgtggcagcttgccaagattaccgagagcagtagcactaaagaggacctgttacggctaaagaagcaaatgcgcgtgttttgtcagatttgccagcattacctgactaacgtgaacaccacagtgaaagagcaagcattcactatcctttgcgatatcttgatgatcttttcacatcagattatgtcaggcggccgcgatatgttagaaccgctcgtctataccccggatagttccctccagagcgaacttctctcttttatattggatcatgtgttcatcgagcaggacgatgacaacaactctgcggacgggcaacaggaagatgaggcgagtaagattgaagccttacacaagcgcagaaatctgctggccgcattctgtaaactcattgtgtacactgtagtggagatgaacacggccgcagatatctttaaacagtacatgaaatattacaacgattacggagacattattaaagagaccatgagtaagacacgacagatcgacaagatccagtgtgctaagaccctaattctcagtttgcagcagctcttcaacgaaatgatccaggagaacggttacaattttgataggagctccagcaccttcagtggcattaaagaactggcacgtagattcgcactcacctttggactggaccaactcaaaacaagggaggccattgccatgctgcacaaggacggcatcgaatttgcgttcaaggaacctaaccctcagggggagagccaccctccactcaacctggccttcctggacattctttctgagttttcatcgaagttattgcgtcaggacaagaggaccgtgtatgtataccttgagaagttcatgacattccaaatgagtcttagacgggaagacgtatggctgcccttgatgtcctaccggaattctttgctggccggtggagacgacgataccatgagtgttatctctggcatcagttcaagaggaagtactgtcagatccaaaaagtctaaaccgagtacagggaagcgaaaagtggtggaaggtatgcagctatctctgaccgaagagtctagctcgagtgactcaatgtggctgagccgtgagcagacactacacacacctgtgatgatgcaaacaccccagctgacctcaacaattatgcgagagcctaagcgactgcggcccgaggactcgttcatgtccgtttaccccatgcagacagaacatcatcagactccattagattacaacaggcgaggtacatcactgatggaagatgatgaggagccaattgtagaggatgttatgatgagcagcgagggcagaattgaggacctgaatgaggggatggactttgacacaatggatattgatctgccgccctccaaaaatcgccgagaacggactgagctgaagcccgatttctttgacccggccagcatcatggatgagtctgtattaggagtgagcatgttctag

SEQ ID NO: 136458 - DNA, 3696 bp, Artificial Sequence
  Description of Artificial Sequence: Synthetic coding sequence
atgatagcagccccagaaatccctacggactttaatcttctgcaggagtctgaaactcactttagctctgataccgacttcgaggacattgagggtaaaaaccagaagcagggtaaggggaaaacttgtaagaagggcaaaaagggtcccgccgagaagggtaagggaggaaacggaggaggcaaacccccaagtggccccaaccgcatgaatggccatcatcaacagaatggagttgagaatatgatgctctttgaagtcgttaagatgggtaaatccgccatgcagtccgtggtggacgattggatagaatcttataagcacgatcgagatatcgcactgcttgatttaattaacttttttatacagtgctctggatgcaagggtgtcgtgacagcagaaatgtttcgacatatgcagaactcagaaatcatccggaaaatgaccgaagagtttgatgaggatagcggggactaccccctgacaatggccggaccccaatggaagaagtttaagagctccttctgtgagtttattggagtcctcgtaagacagtgtcagtacagcattatctatgacgaatacatgatggacacagtaattagcttgctgaccggtctgtctgattcccaggtgcgcgcctttcggcatacctcaacattggccgctatgaaactcatgactgcactggtcaatgttgcactgaacttaagtatcaatatggacaacacacagcgccagtacgaggctgagagaaataagatgatcggtaaacgcgcaaatgagaggctcgagctgttgctgcaaaagaggaaggagttgcaggagaatcaagatgaaattgagaacatgatgaatgccatattcaagggcgtgtttgtgcatcgttacagggacgcaattgccgagatccgcgccatttgcatcgaagagatcggaatctggatgaaaatgtattccgatgcattcctgaatgacagctatcttaaatacgtcgggtggacgatgcatgacaaacagggtgaggtgcgactgaaatgtctcaccgccttgcagggcttatattataacaaagaattgaattcgaagcttgagctcttcaccagccggttcaaggaccgaattgtgagcatgacattagacaaagaatatgacgtcgccgtccaggctataaagttgctcacacttgtgctgcaatcatcagaggaagtgctaactgccgaggattgcgagaatgtctatcacctcgtgtactccgcgcatcgaccagtggctgtcgccgctggggaatttctgtacaagaagctgttctcgcgcagggatccggaagaggacggcatgatgaaacgacgtggccggcagggacctaacgccaacctcgtgaagacactcgttttctttttcctggagagtgaactacacgagcatgctgcctatctggtggactcaatgtgggactgcgcgacggagctgttaaaagactgggaatgcatgaacagcctactattggaggagcctctctctggcgaggaggctctaacagatcgccaagagagtgcactcattgagatcatgctatgcaccatcaggcaagccgcagagtgccacccccctgttggcagggggacaggcaagcgcgtcctgaccgctaaggaaaagaagacccagctggatgatagaactaagataaccgagttgttcgctgtggcgttgccccaactgttggccaaatactcagtggacgctgagaaagtaacaaacttgctgcagcttcctcaatattttgacctggagatttatacaacaggccgtctcgagaagcacctcgatgccctgctccgtcagattcgaaatattgtagagaagcacactgacacggatgtgctggaagcctgttcaaagacttaccatgctctttgtaacgaggaattcacaatcttcaacagagtggacatatcccggtcacaactgattgacgagttggccgataagttcaacagattgctagaagattttctccaggagggtgaggaacccgatgaggacgacgcttaccaggtgttaagcacgcttaagcggattacagccttccataatgctcatgatctgtccaagtgggatctgttcgcgtgtaactataaacttttgaagacgggtattgagaatggcgatatgccagagcagattgtcattcacgctctacagtgtactcactatgtcatcctgtggcagttggcaaaaatcacggagtcctcttccacaaaagaagacctactgagactgaaaaaacagatgcgggtcttctgccagatctgtcagcattacctgaccaatgtcaatacaactgtgaaagagcaggctttcactatactctgcgacatcctaatgatcttcagccatcagatcatgagcggagggagagacatgcttgagcccctggtgtacacacccgactcaagcctgcagagcgagctcttgagcttcatactggaccacgtctttatagaacaggacgatgataacaatagtgcggacggtcaacaggaggacgaagcgtccaagatcgaggcactgcacaaaagacgtaatctcctggcagccttttgcaagctcatcgtatacaccgtggtggaaatgaatacggcggcagacatcttcaagcaatatatgaaatactataatgattacggcgacatcatcaaagaaaccatgagcaagacgagacagattgacaagatacaatgcgcaaaaaccctcattctctccttgcagcagctgtttaatgagatgatccaggaaaacggctacaattttgacaggtctagcagcactttcagtgggatcaaggagctcgctaggcgttttgccctgacctttgggctggaccagttaaagacaagagaagctatagccatgctccataaggatggcatcgagtttgctttcaaagaaccaaacccccaaggcgagtctcatcccccattgaatctagcctttctggatattcttagcgagttctccagcaaattgttgagacaggataagcggaccgtctacgtttaccttgaaaagtttatgactttccagatgtcattgaggcgggaagatgtgtggttaccactgatgtcgtaccgaaacagccttctggccggaggcgatgacgacactatgtccgtgattagcggaatctcctctcggggaagcaccgtccggtcgaaaaagagcaagccttcaactgggaagaggaaggtcgttgagggaatgcagctcagccttaccgaagagtcaagctctagcgacagcatgtggctgtcacgcgagcagaccctgcatacaccagtgatgatgcagacccctcagctgacctccaccattatgcgggagccaaaaagactaagacccgaagatagctttatgtccgtgtatccgatgcagaccgaacaccaccagaccccacttgactacaaccgtcgaggcacctccctcatggaagatgatgaagaacctattgtcgaagatgtcatgatgtcttcagaggggcgaatagaggatctgaacgaaggcatggatttcgacactatggatatcgatttgccccccagtaaaaaccgccgggaaaggactgaactcaaaccggatttctttgatcctgccagtatcatggacgagagcgtgctcggcgtgtctatgttctag

SEQ ID NO: 136459 - DNA, 213 bp, Artificial Sequence
  Description of Artificial Sequence: Synthetic coding sequence
atgatcgcggccccggagattcccacagattttaacttgctccaggaaagcgaaacccacttctcaagcgatacggacttcgaggatatagaagggaaaaaccagaagcagggcaaaggaaaaacttgtaagaagggaaagaagggccccgccgaaaaaggcaaaggggggaacggcggagggaagcccccctcaggcccaaatcggatgtag

SEQ ID NO: 136460 - DNA, 348 bp, Artificial Sequence
  Description of Artificial Sequence: Synthetic coding sequence
atgattgctgccccagagatcccaactgactttaatctgttgcaggagtccgagactcacttctcgtctgatacagacttcgaggacattgagggtaagaatcaaaagcagggaaagggaaagacatgcaaaaaagggaaaaaggggcctgcggaaaaaggtaagggaggtaacggtggcggcaagccaccgagcggacctaatagaatgaacggccaccatcaacaaaatggagtggaaaatatgatgctgtttgaggttgtgaagatgggaaagtcggccatgcaatcagtcgtggacgactggatcgaatcgtacaagcacgacagggatattgctctgctgtag

SEQ ID NO: 136461 - DNA, 510 bp, Artificial Sequence
  Description of Artificial Sequence: Synthetic coding sequence
atgattgctgcccccgaaatcccaaccgatttcaacttattgcaggagtccgaaacacattttagtagcgatactgattttgaggatatcgagggcaagaaccagaaacaggggaaagggaagacttgcaaaaagggcaagaagggtcccgccgaaaaggggaaaggggggaatggaggcggaaaaccaccttccggaccaaacagaatgaacggccatcaccagcagaatggcgtggaaaatatgatgctttttgaggtcgtcaagatggggaaaagcgctatgcagagtgtggtcgatgactggattgaatcgtacaagcatgaccgcgacatagcccttctggacctaattaacttttttatccagtgctccgggtgcaagggcgtcgtcaccgcagagatgttccggcacatgcaaaacagcgaaatcattcggaagatgacagaggaatttgacgaggattctggcgattacccattaacaatggcaggaccccagtggaaatag

SEQ ID NO: 136462 - DNA, 465 bp, Artificial Sequence
  Description of Artificial Sequence: Synthetic coding sequence
atgatcgcagcccccgagatacccaccgacttcaatctgctccaggagagtgagacccactttagtagtgatacagactttgaggacatcgagggtaaaaaccaaaagcagggaaaaggcaaaacctgcaagaaaggtaagaaagggcccgccgaaaagggcaaaggaggtaacgggggtggcaaacccccctcaggtcccaacagaatgaacggccaccaccaacaaaacggcgtggagaacatgatgctgtttgaggtggtcaaaatgggcaagtccgccatgcagtcggtggttgacgactggatcgagtcttacaagcatgaccgagatatcgcactcctggatctcatcaactttttcatccaatgcagcgggtgcaaaggagttgttactgctgagatgtttcgccatatgcagaatagcgagatcatcagaaaaatgactgaggagtttgatgagtag

SEQ ID NO: 136463 - DNA, 627 bp, Artificial Sequence
  Description of Artificial Sequence: Synthetic coding sequence
atgattgcagcccccgaaatcccaaccgactttaacctcctccaagagtcagagacacactttagctctgacactgatttcgaagacatagagggtaagaatcagaaacagggcaaaggaaagacatgtaagaaggggaaaaaaggccctgcagagaagggcaagggaggcaacggaggtggcaaaccgccatccggtccgaacagaatgaacggacatcaccaacagaatggagttgagaatatgatgttatttgaggtggttaagatgggcaaatccgccatgcagagcgtggttgatgactggatcgagtcttataagcatgatagggatatcgccttactggatctgattaatttcttcatccagtgttcaggctgcaagggcgtcgttacagccgaaatgtttcgtcacatgcagaattcagagataattaggaaaatgacagaggagttcgacgaagactcgggagattaccctcttaccatggccggaccccagtggaaaaagttcaagtcctccttttgtgaattcatcggcgtgcttgttaggcagtgtcagtacagtatcatctacgatgaatatatgatggataccgtgatctcacttcttacaggcttgtcttag

SEQ ID NO: 136464 - DNA, 1647 bp, Artificial Sequence
  Description of Artificial Sequence: Synthetic coding sequence
atgattgcagcccccgagattccaacagactttaatctgctccaggagagtgagacccatttctcatcagataccgacttcgaggatattgagggaaagaatcaaaagcaggggaaagggaaaacatgtaaaaagggtaaaaaaggaccagccgaaaaaggaaaaggaggcaatggtggaggcaaacctcccagtggcccaaatcgcatgaatggacatcaccagcaaaacggagtggagaacatgatgcttttcgaggtcgtaaaaatgggtaagtctgccatgcagtcggtggtcgatgattggatagagtcatacaagcacgatcgcgatatcgccttgctcgacctgatcaacttctttatccagtgctctggatgcaagggtgttgtgacagcggaaatgtttcggcacatgcagaacagtgaaattattagaaaaatgactgaggaattcgacgaggattcgggggattaccctctgacgatggccgggccacaatggaaaaagttcaagtcgtccttctgtgagtttatcggggttctcgtgcggcagtgccagtacagtatcatttacgatgagtatatgatggataccgtgatctcgctcctaaccgggctctcagatagtcaggtccgagcctttcgtcatacatctacgctggctgccatgaaattgatgacagctctggtgaatgtcgcactaaacctcagtattaacatggacaacactcagaggcaatatgaagcagagcgaaataagatgattggtaaaagagccaacgagaggttggagctgctcctgcagaaacggaaagaactacaggaaaaccaggatgagatcgagaacatgatgaacgcaattttcaagggtgtgtttgtgcaccggtatcgggacgcaattgctgagatccgcgcaatctgtatcgaggaaataggcatttggatgaagatgtacagcgacgcattccttaacgattcatatctgaagtacgtcggatggacaatgcatgacaaacagggggaagtgagattgaagtgccttacagccttacaaggactctactacaacaaggagctgaacagcaaactagaacttttcaccagccggtttaaggacagaatcgtgtctatgacacttgacaaggaatatgacgtcgccgtccaggccattaagctcctgaccctcgtgctgcagtcctccgaagaagtgctcacagcagaggactgcgaaaacgtgtatcatttggtatactccgcacacaggcccgtggctgttgctgccggagagtttctctataaaaagctattctcccgccgcgatcccgaggaagacggaatgatgaaaagacggggcaggcagggtccaaacgcaaatctggtgaagacactggtgttcttcttcttggagtctgagctgcacgagcatgccgcatatctggttgatagcatgtgggattgcgccacagagctactgaaggactgggagtgcatgaattctctcttgctggaggaaccactctccggggaagaggcactgacggatcggcaggaatctgccctcattgagatcatgctgtgcaccatacgacaggccgccgaatgtcatccccccgtgggccgtggaaccggtaagagggttctctag

SEQ ID NO: 136465 - DNA, 123 bp, Artificial Sequence
  Description of Artificial Sequence: Synthetic coding sequence
atgatagcggcccctgagatcccgacagactttaatctgctacaggaatccgagactcacttctcttcggacactgacttcgaagacattgaggggaagaatcagaaacagggtaaggggtag

SEQ ID NO: 136466 - DNA, 3678 bp, Artificial Sequence
  Description of Artificial Sequence: Synthetic coding sequence
atgtcttctccgcttcaaagggcggttggcgacactaagagagccctgtctgcttcatcgagcagtagcgcaagtctgccttttgatgaccgcgactccaatcacactagtgaaggaaatggcgattccttgctggctgacgaggacacagatttcgaagattctcttaaccgcaacgtgaagaagcgcgccgccaaacggcccccgaagacgacaccagtagctaagcatcccaagaagggctccagagtggtacacaggcattcaagaaagcaatccgagcctcctgccaatgacctgtttaatgccgttaaggccgcaaagtccgatatgcaatccctcgtggacgagtggctggattcctataagcaggatcaggatgctgggttcttggagctggtcaattttttcatccagagctgcgggtgtaagggcatcgtgacgcccgagatgtttaaaaagatgagcaatagtgagattatccagcacctgaccgaacagtttaatgaagattctggggattatcctctcattgctcctggcccatcttggaagaaatttcagggttccttttgtgaatttgtaagaactctggtgtgccagtgccagtactctctgctgtacgatggatttccaatggacgacctgatttctttgttgacaggcctcagtgactcacaggttagagctttcagacatacttctaccctcgccgcaatgaagttgatgacctctctggtgaaggtagccctccagctgtctgtgcaccaagataataaccagcggcagtatgaggcagaaaggaataaagggcccggacagcgagcccccgaacgtctggagtctctcctggagaaacggaaggagttacaagaacatcaggaggaaattgaaggcatgatgaatgcattattcagaggtgtcttcgtccatcgctaccgggatgtactgccagagattagagccatctgtattgaagagattggttgctggatgcagagctactctacctctttcctgactgactcgtacctgaaatatatcggatggaccctacatgacaagcaccgcgaggtgaggctgaaatgcgtgaaggccctcaaggggttgtatggcaaccgcgacctgactacccggctagaactcttcacgtcaaggttcaaggacagaatggtgagcatggtgatggatcgtgagtacgatgtcgcagtcgaggcagtgcgtctcctgatcttgatcttaaagaatatggagggcgtgctcacagatgctgattgtgaatcagtttaccctgtcgtctatgcctcccaccgggggctggcctctgcagccggagaattcttgtactggaagctgttttacccagaatgtgaaatccgcatgatgggaggccgggaacagcgtcagagccccggtgcacagagaacctttttccagctgttgttatccttcttcgtggaaagcgagttacatgaccatgccgcatacctggtggattcattgtgggattgcgcaggagccagattgaaagactgggaaggtttgacatccctgctgctggagaaagaccaaaacctcggcgacgttcaagaaagcactcttattgagattttagtaagttccgctcgacaggcatccgaaggccaccctccggtggggcgcgtcacagggagaaaagggctcacatctaaagagagaaaaacacaggccgatgacagagtgaaattgacagaacaccttatccctctgctgcctcagctcctagccaagttttctgcagatgctgaaaaagttacccccctcctgcaactgctctcgtgtttcgatctgcatatttattgtactggccggctggagaaacatctcgagctgtttctgcagcagctgcaggaagtggttgttaaacatgcagagcccgccgtgctcgaggcaggagcccacgctttgtatctcctgtgcaacccggagttcacgtttttcagcagggccgacttcgcccgatcgcagctggtggatctactaactgatcggttccagcaagaattagaagaacttctccagagctcttttctggatgaagacgaggtgtataacctggctgccactttaaagcgcctctcagctttctacaacacgcacgatttgactcgatgggaactttacgagccttgctgccagctccttcagaaggctgttgatacaggcgaagtgcctcaccaggtcatcctgcccgccctgacactggtatacttctcaatcctttggactttgactcacatcagcaagagcgatgcctcgcagaaacagttgagctccctgcgagatcgaatggtggcattttgcgagctgtgtcagagttgcttgagcgacgtggatactgagatccaggagcaagcttttgtgctgttaagcgatctcctgcttatcttttcgccacagatgatagtcggtggccgcgattttctgcgccctctggtgtttttccccgaagctaccttgcagtccgagttagcttcctttttaatggatcacgtgttcatccagccaggcgacctgggttccggggactcacaggaagatcacctgcagattgaacggctgcatcagcgacggcgcctcctagctgggttttgcaagctgctgctatatggagttctggagatggatgctgcctccgacgtcttcaaacattataacaaattttataatgactacggggatattattaaggaaactctgactagagctaggcaaatcgataggtctcactgcagtcggattctcctgttatccttgaaacagctctacactgaacttctccaggagcacggcccccaggggctaaatgagctccctgcgtttatcgagatgagggaccttgctcggaggtttgccctgagcttcggtccacagcagctgcagaacagagatctggttgtaatgcttcacaaagagggcattcagttctctcttagcgagctgcctccagctgggagctcaaaccaaccccccaatctagcctttctggaactgctgagtgagttttcaccgaggctgttccaccaggacaaacagctcctcctgtcgtatctcgagaagtgcctacagcatgttagccaggcccccgggcacccctggggccccgtgaccacgtattgtcacagtctttccccggtggaaaacactgcagagaccagccctcaagtcctgccgtctagcaagagaaggagagtcgagggacccgcaaaaccgaatcgggaggatgtgagctctagccaggaagaatcccttcagcttaattccatcccccccacccctactctgacttccacagctgtgaagagccgacagccactttggggccttaaagagatggaggaagaggatggaagtgagctggatttcgcacaggggcaaccagttgccggtactgaacgaagccggtttctgggcccgcaatactttcagactcctcataacccttccgggccgggactcgggaatcaattaatgcgattgagtctgatggaagaagacgaggaggaggagctcgagatccaggacgagagcaatgaggaacgccaggataccgacatgcaggcaagctcctactccagtacaagtgagcgtggactcgaccttctcgattccactgagttggatattgaggacttttag

SEQ ID NO: 136467 - DNA, 2667 bp, Artificial Sequence
  Description of Artificial Sequence: Synthetic coding sequence
atgtccagccccctgcagcgtgccgtgggagatacaaagcgggcactgtctgccagtagcagctcgtctgcttctctgcctttcgatgaccgagactctaatcataccagcgagggcaacggagacagtctgttggcagatgaagataccgacttcgaggatagtctcaaccgcaatgtcaaaaagagggccgccaaacgccctccaaaaacaaccccagtggccaagcaccctaagaagggttcaagagtggttcatcgccacagcagaaagcagagcgaacccccagctaacgacttgtttaatgcagttaaggcagccaagtccgatatgcaaagcttggttgacgagtggttggattcctataagcaggatcaggatgcaggttttctggaactcgttaacttctttattcagtcatgtggatgtaaggggattgttactcctgagatgttcaaaaagatgtctaactcagaaatcatccaacatctgactgaacagttcaacgagatggatgacctgattagtcttctaaccggcctgtctgactcgcaggtacgggcattccgccacacctcaacgctcgcagccatgaagcttatgaccagtctggtcaaggttgccctgcagctgagcgtccatcaggataacaaccagcggcagtatgaggccgagcgcaataagggacctgggcagagggcaccagaacgcctcgaatccctactggaaaagcgaaaagaacttcaggagcatcaggaggagatcgagggcatgatgaacgcattatttcgcggagtgttcgttcaccggtatagggatgtattgcctgaaatcagggcaatttgcatagaagagattgggtgttggatgcagagctattcaacctcctttctgacagattcctatctaaagtatattggctggaccctgcacgataagcatcgagaagtacggctgaagtgcgtgaaagccttgaagggcctgtatggcaaccgcgacctgacaacgagactagagctcttcacaagcaggtttaaagaccgcatggtgagcatggtcatggatagagaatacgatgtggcagtggaagctgtgcgcctcttaattctgatcctcaagaacatggagggagttctaaccgatgcagattgcgagagtgtctaccctgtcgtctatgcaagccatcggggactggcctctgcggccggtgaatttctatattggaaactgttttaccctgaatgcgagatacgtatgatgggcggcagggaacagagacagtccccaggagcccagcggactttctttcaacttctgctgagtttcttcgtcgagagcgagctgcatgaccacgccgcctacctcgttgactcactatgggactgcgctggcgccagacttaaagactgggagggcctgacctcactcttactcgaaaaagaccagaacctgggcgatgtacaggagagtacattgatcgagatcctggtgtcctccgcccgacaggcctctgaaggccaccctccggtcggacgggtgacggggaggaaggggctcacgagtaaggagagaaagactcaagccgatgatagagtgaagctgactgaacatttgataccactgctgccccagcttctcgcgaagttcagcgctgacgcagagaaggtgacaccactcctgcagttgttgtcatgtttcgatttgcacatttactgcactggacgccttgaaaaacatctggagctgtttctgcagcaattgcaggaagtcgtcgtaaagcacgccgaaccggctgttcttgaggccggcgcacacgccctgtacctgctgtgtaatcctgagttcacattcttctcgagggcagactttgctagatctcagcttgtggacttattaactgatcgcttccagcaagagctggaagagctgctccagtcttcctttctggatgaggatgaggtctacaacttggctgcaaccctcaagaggctcagtgctttctacaatacacacgacctcacccgctgggagctctatgaaccctgttgtcagctgttgcagaaggccgtggatactggcgaggtcccccatcaggttatccttcccgccctgactctggtgtattttagcattctctggactctcacgcattcccttagcccagtagagaacactgccgaaacttctccacaggttctgccatcaagtaagcgacggagagtggagggcccggcaaagccgaatcgagaggacgtgagctcctcccaggaagaatccctgcagctgaactctatccctccgacgcctacgcttacatctaccgctgtgaaaagtaggcagcccctgtggggcctgaaagaaatggaggaagaggacggttccgagctggattttgcccaaggacaaccagtggcaggaacagaacgttccaggtttttggggcctcaatatttccagactccacacaacccttcaggacctggcctgggaaaccagcttatgcggctatcactgatggaggaagacgaggaagaggagctggaaatccaggacgagtctaacgaggagagacaggatactgacatgcaggccagttcttactccagcacttccgaacgcggccttgacctgctagacagtaccgaactcgacatcgaggacttttag

SEQ ID NO: 136468 - DNA, 789 bp, Artificial Sequence
  Description of Artificial Sequence: Synthetic coding sequence
atgttgcacaaagagggaattcagttcagtctgtcggagctgccccctgccggaagcagcaatcagcctcccaacttggctttcctcgagctcctctccgaattctccccgaggctgttccaccaggataaacaattactcctgtcctatctggagaagtgtcttcaacatgtttctcaggcaccaggtcacccctggggtcccgtgacaacctactgtcactctctctcaccagtcgaaaacaccgcagaaacttccccccaggtcctacctagctcaaagcgtagacgtgttgagggacctgctaagcccaacagggaggatgtgagtagctcacaggaagagtcgctgcagttaaactccattcctcctactcctacgctgactagtacggccgttaagtctcggcagccgctatggggcctgaaggagatggaggaagaggatggtagtgagctggatttcgcgcagggatcccaacctgtcgctgggaccgagaggtccagatttttgggtcctcagtatttccagacaccacataacccaagcggtcccggtctggggaaccagctgatgagactgagtttaatggaggaagatgaggaagaagaacttgagattcaggacgaatcgaatgaggaacgccaggataccgatatgcaagcttctagttactcgagtacttcagagagaggcctcgacctgcttgattctactgagcttgacatagaaatcaccgagagtctgccactgctagggaagtcaccccacccttacaattcccggtag

SEQ ID NO: 136469 - DNA, 438 bp, Artificial Sequence
  Description of Artificial Sequence: Synthetic coding sequence
atgtcatctcccctgcagagggcagtaggagacaccaaacgcgccctgagcgcctcaagcagctcttctgctagcctcccttttgatgaccgcgacagcaatcatacttccgagggaaacggagacagcttgctagccgacgaagatactgatttcgaggatagtctaaacagaaatgtcaagaaacgtgccgctaagcgcccacctaaaaccactcccgttgcaaaacatccaaaaaaaggaagccgggtcgtccacagacacagccgcaagcagagtgagcctcctgctaatgatctcttcaatgccgttaaggctgcaaagtccgacatgcaaagccttgtggatgagtggctcgactcctataaacaggaccaggacgccggcttcctcgaattggtgaacttttttatacaatcttgtgggtgcaagggctag

SEQ ID NO: 136470 - DNA, 339 bp, Artificial Sequence
  Description of Artificial Sequence: Synthetic coding sequence
atgtccagcccattacagagggcagtgggggacacaaagcgagctttaagcgcttctagtagttcctctgcaagcctgccgttcgatgacagggatagtaaccatacctctgaaggtaacggggacagccttttagccgatgaggatactgatttcgaggactcattgaataggaacgttaaaaaacgcgccgctaaaagaccgcctaaaactacccccgtagcaaaacatccgaaaaaaggttctcgcgttgtgcatcgccacagccggaagcaatctgagccgcctgcaaatgacctgtttaatgctgtgaaggcagctaaatcagacatgcagtag

SEQ ID NO: 136471 - DNA, 3678 bp, Artificial Sequence
  Description of Artificial Sequence: Synthetic coding sequence
atgtcctctcccctccaaagagccgtgggggacactaagagagccctgtccgcctcatcctcttccagcgcaagtcttcccttcgacgatcgggacagcaaccataccagtgaggggaacggtgattccctcctagcagacgaagataccgattttgaggactcactgaacagaaatgtgaagaagagagctgccaagcgccctcccaagaccacccctgtggccaagcacccaaaaaaaggaagcagagtggttcatcgtcatagcaggaagcagagcgaaccaccagccaacgatctgttcaacgctgtcaaggcagccaaaagtgatatgcagtccctggtcgacgaatggttggactcttacaagcaggaccaggacgcaggcttcttagaattggtgaacttttttatccagtcctgcgggtgtaaaggaatcgttacccctgaaatgtttaaaaagatgtccaactccgagattatccagcaccttacagaacagttcaacgaggacagtggggactatccactgatcgctccaggaccctcttggaaaaaatttcagggaagcttctgtgagttcgtgcgcacactcgtctgccagtgccaatattcattgctgtacgatgggttcccgatggacgacctgatcagcctgctgacgggattaagcgactcccaggtgcgcgcctttcggcacactagtactctggcagccatgaagctgatgacctctttggtgaaagtcgctctgcagctgtcggttcaccaagataacaatcaacgccagtatgaagcagaacgcaataaaggccccggacagcgggctccggagagacttgaaagcttactggagaaaaggaaggagctccaggaacaccaggaagaaatcgagggtatgatgaatgctcttttccgcggggtgttcgtgcaccggtacagggatgtcttgcctgaaatcagggctatatgcattgaggaaattggatgctggatgcagagttacagcaccagttttttgacagactcatatctcaagtacattggatggacgctgcacgacaagcaccgcgaagtgcgcttgaaatgtgtgaaagcactgaaaggcctctatggcaacagggacctgacaacaagactggaattgtttacgagccgtttcaaggaccggatggtgtccatggtaatggatcgtgagtacgacgtagccgttgaggcggtccgtctgctgattctgatcctgaagaatatggagggtgttcttacggacgctgattgcgagagcgtctatcctgtcgtctatgcatcccatagagggttggcgtccgcagctggtgaatttctttattggaaactattttacccagagtgcgagattagaatgatgggggggcgcgaacagagacagtctcctggagcgcaaaggacattttttcagctcctcctgtcgtttttcgtggaatctgaactgcatgaccatgccgcctacctggtggacagcctttgggactgcgcaggggcgcggctgaaagactgggaggggctgacctccctgctgctggagaaggaccagaatctaggggatgttcaagaatccactttgatcgaaatactggtgtcatccgcccggcaagcttctgaaggacatccccctgtcggcagggtgactggtagaaagggactcacttccaaagaacgcaaaacccaggcggacgacagagtcaaactaaccgagcacctgattcccctcctaccccaactgctggccaaattcagtgcagatgctgagaaggtgaccccactgcttcagctcttatcctgctttgacctgcacatatactgtactgggcggttagaaaaacatcttgagctcttcctgcagcaattacaggaagttgtagttaaacatgctgagcctgcagttctggaggcaggggcacatgccctgtaccttctttgcaatccagaattcacatttttctcccgcgcagatttcgcgcgcagccagctggtagatttgttaaccgatagattccagcaggagcttgaagagctgctgcaatcctcttttcttgacgaggatgaggtgtacaacctcgccgccacactaaagaggctctccgccttctacaacacacacgacttgactaggtgggagctttatgaaccttgctgccagttgctgcaaaaggctgtggacaccggtgaagttccccaccaggtgattcttccagcattgactcttgtatatttttcgattctgtggactctgacacatatctctaagtcagacgcatctcagaagcaactctccagcctgagggacaggatggttgccttctgcgagctctgtcagtcctgtctcagtgatgtggacacagaaatccaggagcaagcattcgtacttttgagcgatctcctcctcatcttttcccctcagatgattgtgggaggccgcgactttctgcgccccctggtgttcttcccggaggccaccctccaatctgagctggcctcattcttaatggaccatgtgttcattcagccgggcgacttgggatcgggggatagtcaggaggatcacctccagattgagcggctgcatcaaaggaggagacttctagctggcttctgcaagctgctgttatacggcgtcctagaaatggacgcggcttccgatgtgttcaagcattataacaaattttataatgactatggtgacatcataaaggagacgctcaccagagcccggcagatcgaccggagtcactgttcccgcatcttgcttctttccctgaaacagttgtacaccgagcttctgcaggagcatggtccccaaggcttgaatgaacttcctgccttcatcgagatgcgggacttggctcggcgcttcgcattgagcttcgggccccagcagctgcagaacagggacctcgtggtcatgctgcataaagaggggattcagttcagtctgagcgaactcccgcccgccgggtcctccaaccagcctcccaacctagccttcctggagctcctgtccgagttttctccccgtctgtttcatcaggataaacaactcctgttgagctatctggagaagtgcctacagcacgtcagccaggcacctggacacccttggggaccggtcacgacttattgtcactccctgtcaccagtcgaaaacacagccgagacgagtccgcaggtgctcccgagttctaagcgaaggcgtgtagagggacctgccaagcccaatcgcgaagacgtgtcttcgtcccaggaggagtctctacagcttaatagcatccctcccaccccgaccctgaccagtaccgccgtcaagtcacgacaacctctctggggcctcaaggagatggaggaagaggatggctctgagctggattttgctcagggtcagcccgtggcgggaaccgaacggtccaggtttctgggacctcaatacttccagaccccacataatccctccggcccagggcttggcaatcagctgatgaggctcagcttgatggaggaggatgaagaggaagagctagagatccaggacgagtctaatgaagagcggcaagataccgacatgcaggcctcctcctattcaagtactagtgagcgaggcctggacctcctcgacagcacagagctagacattgaggatttctag

SEQ ID NO: 136472 - DNA, 567 bp, Artificial Sequence
  Description of Artificial Sequence: Synthetic coding sequence
atgagtagccccttgcagagggctgtaggggatacgaaacgcgccctgtcggccagctcttctagctctgcatccctgccttttgacgacagggatagcaaccatacgagtgaaggcaatggtgatagcctccttgcagacgaggataccgactttgaggacagccttaatagaaacgtgaaaaagcgcgcagccaaacgaccgcccaagaccacgcctgtggcgaaacatcctaaaaaggggtctagggtagtacacaggcactcacgcaaacaatccgagccgccagccaacgacctctttaatgccgtcaaagcagcaaaaagcgacatgcaagacagtggcgactaccccctgattgcacctgggccatcctggaaaaagttccagggctcattttgcgagtttgttcgtaccctcgtctgccagtgccagtatagcttactgtacgacggtttccctatggatgacctgatcagcctcctgaccggcttatctgattcccaagttagggcattccggcacacaagtaccctggcagccatgaagctgatgacatccctgtag

SEQ ID NO: 136473 - DNA, 1047 bp, Artificial Sequence
  Description of Artificial Sequence: Synthetic coding sequence
atggtgtggccatgggtcgcaatggccagccggtgggggccgctgatcggactggccccctgttgcctctggctgctgggagcagtgcttttgatggacgcgtcagcgcggccagccaatcactctagcacacgggaacgtgtggctaatagagaggagaatgagattctgcccccagatcacctgaacggggtgaagctagagatggacgggcacctgaataggggttttcaccaagaagtatttctcggcaaggacctgggcgggttcgatgaagacgcagaaccccgccgcagccggaggaagctcatggttatattcagcaaagtagacgtgaatactgatcgaaaaatttcggcgaaagaaatgcagaggtggatcatggaaaaaaccgccgagcattttcaggaggcaatggaagagtccaaaacccacttccgggccgtggaccctgatggtgatgggcatgtgagctgggacgaatacaaagtcaagtttctggcttcaaagggtcattctgagaaggaggtcgccgacgccatccgacttaatgaagaattaaaggtggacgaggaaacacaggaggtgcttgaaaatctcaaggaccggtggtaccaggctgattctccacctgccgacctgctgttaaccgaagaagagtttctgtcattcctgcacccagaacactcccgaggaatgctgcgctttatggtgaaagagatagtacgggacctggaccaagatggtgataagcaactcagcgtgcccgaattcatatcactgcccgtcgggactgtagagaaccaacaggggcaggatattgacgacaattgggtcaaagatcggaagaaggaatttgaggagctaattgattccaatcacgacggaattgtgactgcagaggagctggagaacgtccccacacttccgttacagcctattggaacgctcaattctcactttgtgcgactggcagcagagttgggtggggggaaggcgacactgacatgcgcccctcttgccaggcgggcaacatggacaccttag

SEQ ID NO: 136474 - DNA, 1089 bp, Artificial Sequence
  Description of Artificial Sequence: Synthetic coding sequence
atggtctggccttgggtggccatggcgagccgctggggcccactgatcggactggccccgtgctgcctgtggctgttaggggcagtcctcttgatggatgcaagcgctaggcccgctaaccattcctcaactagggagcgagtagctaaccgcgaggagaatgaaatcctaccccccgaccacctgaacggggttaagttggaaatggacgggcacctcaatagaggattccaccaggaagtgttcctcggcaaggacctgggagggttcgacgaggatgcagaacccaggcggagcagaagaaagctcatggtgatcttttctaaagtggacgttaacaccgaccggaagatatcagcgaaagaaatgcaaagatggattatggagaagaccgccgagcattttcaggaggccatggaggagtccaagacgcacttccgagcggtagacccagatggtgacggccacgtctcctgggatgagtataaagttaagtttctcgcctccaagggacatagtgaaaaggaggttgctgacgcaatcagactgaacgaggagctgaaagtcgatgaagagactcaggaagttctagagaacctaaaagatagatggtaccaggcagattcaccgcccgcagatcttttgctgaccgaagaagaattcttatcttttctgcaccctgagcactcacgcggcatgctccgctttatggtgaaggagatcgtgcgagatctggaccaggacggggacaagcaacttagcgtgcctgaattcatttctctcccagtgggcacagtagaaaaccagcagggacaggacattgatgataactgggtgaaggaccggaagaaagaattcgaagaattaattgactcaaaccacgacggaatcgtcaccgctgaggaattagagtcatatatggacccaatgaacgaatataatgccttgaacgaagccaaacaaatgatagccgtggcagacgagaatcagaaccaccacctggaaccagaagaggtgctgaagtactcggagttcttcacaggctcaaagctggtggattatgcccggagtgtgcacgaagagttctag

SEQ ID NO: 136475 - DNA, 732 bp, Artificial Sequence
  Description of Artificial Sequence: Synthetic coding sequence
taactagagatggatgggcacctgaacaggggtttccatcaggaggtgtttctcgggaaggatttaggcgggtttgacgaagacgccgaaccacgacggtctagaagaaagctgatggtgatttttagcaaggtcgacgtgaataccgaccgtaaaatttccgcaaaagaaatgcagcggtggatcatggagaaaactgccgaacacttccaggaagcgatggaagagagtaaaacccactttcgcgctgttgaccctgacggtgacggacacgtgtcctgggatgaatacaaagtgaagtttctggccagcaaaggacactctgagaaggaggtagcagatgccatcaggttgaacgaagaacttaaagtcgatgaggagtcgtctacttcaaggaacttccttgatctgagagccggggtttgtaggcctaggtacccccaagctgcgcccctctcggctcaagaggtgctcgagaatttgaaggaccgatggtatcaagccgattccccacctgcagatcttctactcaccgaagaggaattcctaagcttcctccatcctgagcactcgcggggaatgttgagattcatggtgaaagagatcgtcagagatcttgaccaggatggtgacaagcagctctcagtgcctgagtttatctctctcccggtcggaaccgtggagaatcagcagggccaggacatcgatgacaattgggtcaaggaccgctag

SEQ ID NO: 136476 - DNA, 609 bp, Artificial Sequence
  Description of Artificial Sequence: Synthetic coding sequence
atggtatggccctgggtcgcgatggcgagccgctgggggcccctcattggtttagccccctgctgcctgtggttgctaggcgccgttctcctgatggacgcctccgctagacccgccaatcactcctctacacgagaacgtgtagcaaaccgagaagaaaatgagatactccccccagaccacttgaacggagtgaagctcgaaatggatggccacctcaacagagggtttcaccaggaggtgttcctgggaaaagatcttggcgggttcgacgaagacgccgagccacggcgatccagacgaaaactcatggtgattttcagtaaggtggatgtgaatacagaccggaagatcagtgcaaaggagatgcaaagatggattatggaaaagacagcggagcactttcaagaggccatggaggagagcaagactcacttccgcgccgtcgacccagacggcgacgggcatgtcagctgggatgagtacaaggtgaagtttttggccagcaaggggcatagcgagaaagaagtggccgatgcaatccgattgaatgaggaactgaaggttgacgaagagagacatgggccgcctgggccacgggccttatag

SEQ ID NO: 136477 - DNA, 636 bp, Artificial Sequence
  Description of Artificial Sequence: Synthetic coding sequence
atggctgtggtcccccttttgctgctgggcggcctctggagcgccgtgggcgcgtcttccctgggagtagtcacctgtggaagtgtggtcaagttgcttaatacccggcataatgttcggcttcacagccatgatgtgcgctacggtagtggctccggacagcagtctgtaaccggtgtaacgagcgtggacgacagcaactcatactggcgaatcagaggtaaatcagccacagtgtgcgaaaggggaacacctatcaagtgcggccagcctatccggttaacccacgttaataccggcagaaatttgcattcccaccacttcacatcacccctcagcggtaaccaggaagtgagcgctttcggggaggagggcgagggcgactatctggacgattggaccgttctgtgtaatggtccttattgggtgcgagatggcgaagtgcgcttcaaacactcgtcaaccgaggtgcttctgtccgtgactggggagcagtacggtaggcccatctccggacagaaagaggttcacggtatggctcaaccatctcagaataattactggaaggcaatggaggggatcttcatgaagccttcagaactcctaaaagcagaggcgcatcatgcagagctttag

SEQ ID NO: 136478 - DNA, 666 bp, Artificial Sequence
  Description of Artificial Sequence: Synthetic coding sequence
atgtggagcgccggtaggggaggcgccgcatggccagttcttttaggcctcctcctggctttattagtgcctggtggcggtgccgccaaaactggtgccgaactcgttacttgcgggagcgtgctcaagctgctgaatacgcatcatcgggtgaggttacattcacacgacataaagtacggatccggctcagggcagcagtctgtgactggggttgaggcgagcgacgacgctaacagctattggcgtatccgaggcggaagcgagggcggctgtcctcgaggtagccccgttcggtgcgggcaagctgtgcggctcactcacgtacttaccggcaaaaatcttcatacccatcattttccatcgcctcttagcaacaatcaggaggtgtccgctttcggggaggacggggaaggggatgacctcgacctctggacggtccggtgcagcggccagcattgggaacgggaagctgccgtgcgttttcagcacgtggggacttcagtttttcttagtgtcaccggcgagcagtacggaagccccattaggggccaacatgaagtgcacggcatgccatctgccaatacgcacaacacatggaaggccatggagggaatctttatcaaacctagcgtcgagcccagtgcagggcacgacgaactgtag

SEQ ID NO: 136479 - DNA, 2058 bp, Artificial Sequence
  Description of Artificial Sequence: Synthetic coding sequence
atggacgtctgtgtgagactggctctgtggctgctgtggggactgctcctgcatcagggtcagtcactatctcactcacattctgaaaaagcaactggcaccagcagcggggccaatagcgaggagtctactgcggcggaattttgtaggatcgacaaacctttatgtcatagtgaggatgagaaactctctttcgaggctgtacggaatattcataaattgatggacgatgacgcaaatggagatgtagacgtggaagagtccgatgaatttctcagagaagaccttaattatcacgatcctactgtcaagcacagtacctttcacggcgaggacaaactcatctccgttgaagacctatggaaggcctggaaaagcagcgaggtgtataattggacagtggatgaagtggtgcagtggctcatcacttacgttgagcttcctcagtatgaggaaacattcaggaagctgcagctatcaggccatgccatgcctcgtctcgcagtcaccaacacaactatgaccggaaccgtgctgaaaatgaccgatcggagtcaccgccaaaagctgcagttgaaagccctggatactgtcttgtttggtcctccactgctcacccggcataaccatctgaaggactttatgcttgtcgtgtccatcgtgattggtgtgggcgggtgttggttcgcctacatccaaaacaggtattccaaagaacacatgaagaagatgatgaaggaccttgaaggcctacatcgagccgagcagagtctgcatgatctgcaggaacgactgcataaagcccaggaagagcaccggacggtagaagtcgagaaggttcaccttgaaaagaagttaagagacgagatcaacctggccaagcaggaggcccagagactaaaagagctgcgtgaaggcaccgaaaatgaacgtagtagacagaagtacgcggaagaggagctagagcaggtgagagaggctctgaggaaggcggagaaggagctcgaatctcatagcagctggtatgctcctgaggctctccagaagtggctccagctcactcatgaagtggaggttcagtattataatattaagaagcagaacgctgagaagcaactgttggtggctaaagagggagctgaaaaaattaagaaaaagcgcaacacactattcggaactttccacgtcgctcattcctcatctttagatgatgttgatcacaagatcctgaccgccaagcaggcactctcagaggtgaccgctgcccttcgcgagcgcctccatcgatggcaacagattgagattctgtgtggatttcagatcgtcaataatccggggattcactccctggttgctgccctgaacatcgacccttcatggatgggctcaacacgtcctaacccagcccactttatcatgactgatgatgtggacgatatggatgaggaaatcgtctcacctctttccatgcaatctccatcactgcagtcctccgtgcgacaacgattaacggagcctcagcacgggcttggcagccagagggacctaacccattcagacagcgaatctagccttcacatgagtgatagacaaagagtggcccccaagcctccccagatgagcagggcagcagacgaggcccttaacgctatgacaagcaacgggagccataggctgatagagggcgtgcaccccggtagcctcgttgaaaaactgccggatagccctgccttggcgaagaaggctctacttgcgctaaatcacggcctggataaggctcatagtctgatggaactaagcccctccgcgccgccaggaggatccccgcatctggacagttctaggtctcactcaccctcctctccagatcccgataccccatctcccgtcggagattcccgcgctttgcaggcaagccgcaacacaaggattccccacctggctggcaaaaaggctgtcgccgaagaagacaacggaagtattggagaagagaccgactcttcaccgggccggaagaagttccctcttaagatttttaaaaaacccctgaaaaagtag

SEQ ID NO: 136480 - DNA, 2502 bp, Artificial Sequence
  Description of Artificial Sequence: Synthetic coding sequence
atgaatgccgccggaattagagcccctgaggcggctggcgcggatggcactcgactggctccaggagggtctccatgtctgcgccggcgcggccgccctgaggagagtcctgcagcggttgtcgctcctaggggcgccggtgaactgcaggctgcgggcgcaccactcaggttccaccccgcatcaccacgcaggctccacccagcctccacccctgggccagcctggggttggctgctccgacgcaggcggtgggcagcacttctggtgctgggcctcctcgtggccggagccgctgatggatgtgagctagtgccacgacatctcagaggtagaagagcgacagggtccgctgccaccgccgcctcctcacctgcagcagcagccggcgacagcccagcgctcatgactgacccctgtatgtctctaagccctccgtgttttacagaggaggatagattcagccttgaagccctgcaaactatacacaagcagatggatgatgataaagacggtggtatagaagtggaggagtcagatgagtttattagggaagacatgaaatataaggacgctacgaacaaacacagtcatctgcatcgtgaagacaagcacatcacgatcgaggatttatggaagcggtggaagacaagcgaagttcacaactggaccctagaagacacacttcaatggctgattgaattcgtcgagttgccacagtacgaaaaaaacttccgcgataacaacgtgaaaggtaccacccttccaagaattgctgtgcacgaaccctcctttatgatctcccagttaaaaatctcagaccgctctcatcgccagaaactccaactgaaggctttggatgtcgtgctatttggccctctgacaaggccaccccacaactggatgaaagacttcatactcacagtgagcatcgttatcggagtcggcggctgttggttcgcctatacccagaacaagacatctaaggagcacgtggctaaaatgatgaaagacctcgaaagcctccagacagctgagcagtctctgatggacctgcaggagcgattggaaaaagcgcaggaggagaatcgaaacgtcgcggtcgaaaagcagaatctggagagaaaaatgatggatgaaattaactacgctaaggaggaagcctgcaggctcagagaactgcgagagggagccgagtgcgaactctccaggcggcagtacgccgaacaggagctggagcaggtgagaatggcacttaaaaaggcagagaaagaattcgaactgagaagcagctggtcggtgcccgatgcactccagaagtggctccagctgacccatgaggtcgaagtgcagtactacaacatcaaacgtcagaacgcagagatgcagctggctattgcgaaagacgaggcagagaagatcaagaagaaaaggagcaccgtctttggtacactccatgtggctcactccagctccctcgatgaagtggatcacaagatccttgaagccaagaaggccttatcggagttaaccacatgcctcagggagaggctgtttagatggcaacagatcgagaagatttgcggcttccagattgcccataattcaggcctcccttcccttacatcctctttgtacagcgaccattcttgggtggtgatgcccagagtcagcattcctccctaccctatcgctggaggtgtcgacgacctggacgaggacacccctcccatcgtgtcacagtttcctggtaccatggctaaaccccccggttctctggctagaagctcatccttgtgccgaagccgtagatccattgtaccctcatccccacagccgcaaagggctcagctcgcgcctcatgcaccccacccgtcacatccccgccatcctcaccatccgcagcataccccacattctctgccctccccagacccagatatcctgagcgtttcctcctgtcctgcactgtatagaaacgaggaggaggaggaggccatatacttcagtgccgagaaacaatgggaagttccggatactgcaagcgagtgcgacagtctgaattcatctattggacgcaagcaatcccccccattaagcttagaaatttaccaaacactctcgcctcgaaagatctcaagggatgaagttagccttgaggattcgagccgcggcgatagcccagtgacagtggacgtgagttgggggtcaccagattgcgtgggattaacagagactaaatcaatgatctttagccccgccagcaaagtatacaacggcatcctcgagaagtcttgttccatgaaccagctgtcctcgggtattccagtgcccaagcctcgccatacttcatgtagcagcgctggcaacgattcaaaacccgttcaggaagcaccctcagttgcccggatatctagcatcccacatgacttgtgccacaatggggagaaaagcaaaaaaccctctaagattaagagccttttcaaaaagaagtcaaaatag

SEQ ID NO: 136481 - DNA, 2526 bp, Artificial Sequence
  Description of Artificial Sequence: Synthetic coding sequence
atgaacgccgctggtattcgtgcgcccgaagccgccggagccgacggaacccgcttggctccaggtggatcgccttgtctgagaaggcgcgggcggccggaggaatctcccgcagctgtggtggcccctcggggcgcgggagaactgcaggccgcgggcgcaccacttcggttccatcccgctagcccacggaggctccaccctgcttcaactccgggcccagcatggggttggctgctccgaagacgaagatgggcggccttgttagtgctcggactgcttgtggccggcgctgccgacggatgtgagttagtgccaaggcatctgaggggacggcgagccacagggtcagcagccacagccgctagcagccctgccgcggccgctggagattctcccgccctcatgacggacccctgcatgagcttaagccccccttgttttacagaggaagaccgttttagtctggaagcacttcagacaattcataaacagatggacgatgacaaagatggggggatcgaggtcgaagagtctgacgagtttattcgtgaagatatgaaatacaaggatgctaccaacaagcacagccatttgcacagggaggataaacatatcactatcgaagacttgtggaagagatggaaaacatcggaagtgcataattggacacttgaagatactctgcagtggcttattgagttcgtggaactgccccagtacgagaagaactttagagacaataatgtgaagggaactaccttgccccggattgcggtccacgagcctagctttatgatttcacagctgaaaatatccgacagaagccatcggcagaaactccagttgaaagctctagatgtggtgctcttcggacctctgactagaccgcctcacaactggatgaaggacttcattcttaccgtctcaatcgttatcggtgtgggagggtgttggttcgcttatacgcagaacaaaacgagcaaagaacacgtcgctaaaatgatgaaggatttggagtcactgcagaccgccgagcagagtctaatggacctccaggagcgcctggagaaagctcaggaggagaaccgtaacgtggccgtcgagaaacaaaatcttgagaggaagatgatggatgagataaactacgctaaagaggaggcgtgccgcctgcgggagcttagggagggcgcggagtgcgagctcagtagacgacaatacgctgagcaggaactggagcaggttcgcatggctttgaaaaaagctgaaaaagagttcgagctgcgctctagttggtctgtgccagatgctctccagaaatggttgcagctcacacacgaagtagaagttcagtactataacatcaaacgtcagaacgctgagatgcagctcgcaatcgccaaggacgaagtggctgcctcctatctgatacaggccgaaaagatcaaaaagaaaagaagtaccgttttcggcactctgcatgtggcccactcttcctcactcgatgaggtggaccacaagatcttggaggctaaaaaagccctcagtgaactaacgacttgcttgcgcgagaggctcttcagatggcagcagattgagaaaatctgcgggttccagatcgcacacaactctggacttccgagtctgacttcctccctctacagcgatcactcttgggtggtcatgccacgcgtgtcaataccaccttatcctatcgctgggggggtagacgatctggacgaggacacccccccaattgtttcgcagttcccaggaaccatggccaaacctcctggttccctcgcaagatcctcttccctttgcaggagcagacgaagtatcgtgccttccagccctcagccgcagagggcccagctggccccccatgccccacacccatcacaccctagacaccctcaccacccccagcacacgccccattcattaccttcgcctgatccggacattctgagcgtctccagctgccccgccctgtatcgaaatgaagaagaggaagaggcaatttacttttccgcggagaaacagtgggaggtgcccgataccgcctctgagtgtgacagcctaaattcttcaattggccggaagcagagcccccccttgtctctggaaatctaccagaccctgtcccccagaaaaatctcccgggatgaggtgagtcttgaggactcctcccgcggcgattctcccgtgactgttgacgtcagctggggctccccagactgtgtcggactcactgagaccaagagtatgatctttagccctgctagcaaagtttataacggaattctagagaagtcctgctcgatgaatcagctgtccagcggcatcccagttcctaagccccgacatacttcctgctcttccgctgggaacgactctaagcccgtccaggaggccccatctgtggccagaatcagtagtatcccgcacgatctgtgtcataatggcgaaaaaagcaagaaacccagtaaaatcaaaagcctgtttaagaaaaagtctaagtag

SEQ ID NO: 136482 - DNA, 2061 bp, Artificial Sequence
  Description of Artificial Sequence: Synthetic coding sequence
atgaatgccgccggaatcagagccccagaggccgccggagccgacggcacaaggttggctcccggggggtccccctgcctccgtaggagggggaggcctgaagagtccccggccgcagtcgtggcacctagaggagcaggagaactgcaggcagccggtgctcccctgcgcttccatcctgcctcacccaggaggctgcatccagcaagcactcctggtcctgcctggggttggctcctgcgccgacgtcggtgggccgctcttctcgttcttggactgctcgtggcaggggccgccgacggctgcgagctagtgcctcgccatctaagagggcggagggccactggtagcgctgcgactgccgcttcctccccagccgctgcggctggcgactcccccgccctgatgacagacccctgtatgagcctgagccctccatgttttaccgaagaggatcgcttttcacttgaggcgttgcagacaattcacaaacagatggatgatgacaaggatggaggaatcgaggtggaagagtccgatgagtttattagggaagatatgaagtacaaggacgctacaaacaagcactctcacctccatagggaggataagcatatcaccattgaagacttatggaagaggtggaagaccagtgaggtccataactggactcttgaagacacactccagtggctgatagaatttgtggagcttccacagtacgagaaaaactttcgggacaataacgtgaaaggcaccactctgcccaggattgctgtccacgagccatctttcatgatcagccagttaaagatctcagatcggtctcacagacagaaactccagttgaaagctctggatgtcgtcttatttgggcccctcacacgacccccacacaattggatgaaagacttcatcttgaccgtgtctatagtaattggcgttggcggctgctggttcgcttatacccagaataaaacctcaaaggaacacgtggccaaaatgatgaaagatttggagagcctgcagaccgcagaacaatcattgatggatcttcaggagcgcctggagaaggctcaggaagagaaccggaacgtggccgtagaaaagcagaatctggaaaggaaaatgatggacgagatcaattatgccaaagaagaggcctgtcgtctcagagaactgagagagggcgctgagtgcgagctgagtaggcggcaatatgccgagcaagagctggaacaagttcgcatggccctcaagaaggctgaaaaggagtttgagctgcgctcctcatggtccgtaccagacgcactccaaaaatggttgcaactaacacacgaggtagaggtgcagtactacaacattaaacgacaaaacgccgaaatgcagctagcgatcgccaaagacgaagcggaaaaaataaagaagaaaagaagtaccgttttcggcacactacatgttgctcactctagctcactcgacgaagtggaccacaagatcctcgaggctaagaaggcactgtctgaactgaccacctgcttacgtgaacgcctgtttagatggcagcagatcgaaaaaatatgcggctttcagattgctcacaacagtggtctcccttccctgacatcctccctgtattctgaccatagctgggttgtgatgccaagagtgagtattccgccctatccaatcgccgggggagtggacgacctggatgaagacactcctcccatcgtgtctcagtttcctgggaccatggcaaagccaccaggctccttagcgagatcttcgtctctctgccgaagtagaagatccatcgtaccatcatccccgcagccgcagcgagcccagctggctccccacgcgccccacccatctcatcctaggcaccctcaccatcctcaacatactccacactccctccccagccctgacccggatatcctctccgtcagcagctgccctgctttgtaccgcaatgaagaggaggaagaagctatctacttcagcgccgagaagcagtgtattcacttaggactgggagcttgcaaatcagagtag

SEQ ID NO: 136483 - DNA, 2241 bp, Artificial Sequence
  Description of Artificial Sequence: Synthetic coding sequence
cttctggtcttaggactgctggtggccggggcagcggatggctgcgaactcgttccccggcatttaagggggcggagagccactgggagcgccgctaccgcagccagctcacccgcagcagccgccggagatagccctgccctgatgacagatccatgcatgtctctgtctcctccatgttttaccgaggaggatagatttagcctagaggcactgcagacaatccacaagcagatggacgatgataaggacggtggcatagaggttgaggaatccgatgagtttatccgtgaagacatgaagtacaaagatgccaccaacaagcatagccacttacaccgtgaggataagcacattaccattgaagacctgtggaagcggtggaaaacatctgaggtacacaattggacccttgaggacaccctccagtggttgatagagttcgtcgaactgcctcaatacgaaaaaaattttagggacaacaatgtcaagggaaccacccttcccagaattgcggtgcacgagccttcatttatgatttcccagttaaagatttcggacaggtctcatagacaaaaactgcaactgaaagcgctggatgtagtgctctttggacccttgactagaccaccacataactggatgaaagatttcatcctgacggtgagtattgtgattggtgtcggggggtgttggtttgcatatacgcagaataagacttccaaagaacacgtcgctaaaatgatgaaggatcttgagtctctacagaccgcggagcaatccctcatggacttgcaggaaagactggagaaagcacaggaggaaaacaggaatgtagcagtggaaaaacagaatttggaaaggaaaatgatggacgagatcaattatgccaaggaggaagcatgcagattaagagaacttagagaaggagctgagtgcgagctgagtagaagacaatatgccgagcaggagctggagcaggttaggatggcactgaagaaggcagaaaaagagtttgaactcagatcttcttggtccgttcccgatgcactgcagaaatggctccagttgactcacgaggtggaggtacagtattacaatatcaagcgccaaaatgcagaaatgcagctcgccattgcgaaggacgaagccgagaaaatcaaaaaaaaacgaagcacagtgttcgggacgttgcacgttgcccactcctcctctctggacgaagtggaccataagatcctggaggctaagaaggctctcagtgaactgacaacgtgcttgcgggaacgcctcttcaggtggcagcagatcgagaagatctgcggatttcagattgcccacaactccgggcttcctagtctgacctcatccctgtatagtgatcatagctgggtcgtaatgccaagagtgagcatcccaccctatccgatcgccgggggagtagatgacttagatgaggatactccccctattgtatcgcagttcccagggaccatggccaagcctcccgggtctctcgcgcgttctagttccctgtgccgcagtcggagatctatcgtgccttcttccccacagccgcagagagcacagttagcacctcatgcaccgcacccatcccatcctcgccatccccaccaccctcagcataccccacattccctacctagtcctgatcctgatatcctctccgtgtcatcatgtccagcactgtaccgcaacgaggaggaggaagaagccatctatttctctgctgagaaacagtgggaggttcccgacactgccagcgaatgtgactcactcaattccagcatcggcagaaagcagtcgccccctctgagtctagagatataccagaccttaagccctcgaaaaataagcagggacgaagtgtcactggaggattcttctaggggggattctcccgttaccgttgacgtctcctggggtagtccagattgtgtcgggctgacggagactaagagcatgatcttcagccctgcctctaaggtttacaatgggatcttggaaaaaagctgcagtatgaaccaactgtcctcaggcatccccgtccccaaacctaggcatacgagttgtagctccgccggcaatgacagcaagcccgtgcaggaagccccatcagtggctagaatttcctctattcctcatgatctctgccacaatggcgaaaagtcgaaaaagccctctaaaattaagagcctcttcaagaagaagtccaaatag

SEQ ID NO: 136484 - DNA, 2265 bp, Artificial Sequence
  Description of Artificial Sequence: Synthetic coding sequence
ttgctcgtcttaggactgctggtagctggagccgctgacggctgcgaactggttccccgacacctcagaggaaggagggccaccggctccgctgccaccgccgcttcgtcacccgccgccgcagcgggagactcaccagcactgatgacagatccctgcatgtccctgtcacctccatgcttcacagaagaggacaggttttccctcgaggctctgcagaccatccacaaacaaatggacgatgataaagacggcggaattgaggtggaagaatctgatgagtttattcgagaagacatgaaatataaagacgctacaaacaaacatagtcacttgcaccgtgaagacaaacacattacaatcgaagatttgtggaaacggtggaaaacatcagaggtccataactggactctggaggatactttacagtggctcatcgaattcgtggaactgccccagtatgagaagaactttcgcgacaacaacgtcaaaggaaccacactcccacgcattgcagtccatgaacccagtttcatgatctctcagctaaaaatcagcgatagatcacaccggcagaaattacagcttaaggctttggatgtggtccttttcggccccctcacccgacctccccataactggatgaaggatttcattctgactgtgtccattgtgataggagtggggggatgctggttcgcctatacccagaacaaaaccagtaaggagcacgtggccaagatgatgaaggatttagaatctttgcagactgctgagcagtcccttatggacctccaagaacgactggaaaaagcacaggaggagaaccgtaacgtagcggtagagaagcagaatttagaaaggaagatgatggatgagatcaactacgcaaaggaagaggcatgtaggctaagagagttgagagagggtgctgaatgcgagctttctcgccgtcagtacgcagaacaggaactggaacaggtccgtatggctctgaagaaagccgagaaagagtttgagctccgatcctcttggagtgttcctgatgctctgcagaagtggctacaactgactcacgaggtagaggttcaatattacaatattaaaaggcagaatgctgaaatgcaactggctatcgcgaaggacgaggtggcagcatcttatcttatccaggctgagaagataaaaaaaaaaagatctaccgtcttcggaacattgcacgtagctcactcatcctccctcgacgaagtggatcacaaaatactggaggcaaagaaggcactgtccgagctcaccacctgcctgagggagcggctcttccgctggcagcagatcgagaaaatctgtggttttcagatcgcgcataattccggtttacctagtctgaccagttccctgtatagcgaccactcttgggtcgtgatgccacgagtcagtatccccccttatccgatagcagggggtgtggacgacctggacgaggacactccacccatcgtgtctcagtttcctggtaccatggccaagccacccggaagcctagctagatctagtagtttgtgcaggtcacgccgctctatcgtcccttcatcgccgcaaccacaacgagctcagttggcaccccacgccccccatcccagtcatcccaggcacccgcaccacccacagcatactcctcactctctgccgagtcccgaccctgatatcctgagcgtgagcagttgtcccgctttgtatagaaatgaagaagaagaggaagctatctacttttccgctgaaaaacagtgggaagttccggacacagcttctgagtgcgactccctcaattccagcatcggtcgcaagcagtctccccctctgtccctagagatttatcagacactgtctccccgaaaaatatcccgggatgaggtctccctggaagactcatctcgtggggactcacccgtgacagttgacgtgagctgggggagcccggattgcgtgggcttgacagaaaccaaatctatgatattctcccccgcctctaaggtgtacaacgggattttagagaaatcgtgcagtatgaatcagctctcctccggcattcccgttcctaaaccaaggcacacatcatgcagcagtgcaggcaacgattcaaagccggtgcaggaggcaccaagcgtggctcgcatttcatccatcccacatgacctctgccacaatggagagaagagtaagaagccttctaagatcaagtctttgttcaagaagaaatccaagtag

SEQ ID NO: 136485 - DNA, 1800 bp, Artificial Sequence
  Description of Artificial Sequence: Synthetic coding sequence
cttctggtactggggctgttggtggcaggggccgccgacggttgcgagctagtgccccggcacctacgcggtcgacgtgccaccggctcagccgctaccgccgcatcttcacctgcagcagcggcgggtgactcgccagcccttatgacagacccgtgtatgtctctttcccccccgtgcttcactgaggaggatcgattttccctggaagctctccaaaccatacacaagcagatggacgatgataaagacggaggaattgaggtcgaggagtccgatgagtttatccgagaggacatgaagtacaaagatgctaccaacaagcatagtcacctgcaccgcgaggacaagcacataaccatcgaggacctatggaagaggtggaagacatctgaagttcacaattggacactggaagacacactgcagtggctgatcgaattcgttgaattgccccagtacgagaaaaactttcgggataacaacgtgaaaggaacaacacttcctagaatcgctgttcacgagccttctttcatgatcagtcaattgaagatctctgaccgttcccatcgccagaaactgcaattgaaagccttggatgtagtgctgttcggtcctcttactagaccgccacataactggatgaaggacttcatcctgactgtgtccatagtgatcggggtcggcggttgttggtttgcctatacacagaacaagacctccaaagaacatgtcgcaaagatgatgaaggacctagagagtctgcaaactgcggagcaaagtctcatggacctgcaggaaagactagagaaagcccaggaagagaaccggaacgtggccgtcgagaagcagaatctggagagaaaaatgatggatgagattaattacgcaaaggaggaggcctgtcgcctgcgcgagctacgggaaggggccgagtgcgagctttccaggcggcagtacgcggagcaggagttggaacaggtaaggatggccctgaaaaaggccgaaaaggagttcgagttaagatcttcttggtccgtgcctgacgccctccagaagtggctccaactgacacatgaggtcgaagtgcagtactataatatcaaacgacagaatgctgaaatgcaactggccatcgcaaaggacgaagcagagaaaattaaaaagaaaaggagcacggtgtttggtactctgcacgtagcccactcctcctccctagacgaagtcgatcacaagatcctggaggctaagaaagccctttccgagctgacaacatgtctgcgagagagacttttccgctggcaacagatagagaaaatctgtggatttcagattgcccacaacagcggcctccccagcctcacatcatccttgtacagcgatcatagctgggtggtgatgcctagggtgtctattcccccttaccccatcgccggtggggtggacgatttggacgaagatacccctccaatcgtaagccagttccctgggacgatggcaaagccacccggctccctggcgcggagttcatccctctgtaggtcaagaagaagcatagtaccatcctccccccaacctcagagggcccaactagccccacatgccccgcacccctctcatccacgacacccccatcatccccagcatacacctcactccctaccctcacccgatccagatatcctgtctgtaagctcttgtccagcactgtatagaaatgaggaagaggaagaggccatctatttctcagctgagaagcagtgtattcacttgggtctcggcgcttgtaaatcagagtag

SEQ ID NO: 136486 - DNA, 3654 bp, Artificial Sequence
  Description of Artificial Sequence: Synthetic coding sequence
atgtatatcaagcaagtgatcattcagggcttccgcagctaccgcgaccagacaattgtggaccccttcagcagcaagcacaacgtgatcgtgggaaggaatgggagcggcaaatctaacttcttctacgcaatccagtttgtactcagcgatgaatttagccaccttcggccggaacagagactggccttgttgcatgaagggactggcccacgtgttatttcagctttcgtggagatcatctttgataattctgataatcgtctgcccatagacaaagaggaggtcagtctgcggagagttatcggtgccaagaaagatcagtatttcctggataaaaaaatggtgacaaagaacgacgttatgaatcttctggaaagtgccggtttttcccgcagtaatccttactatatcgtgaaacaaggcaagattaatcaaatggcgaccgctccggattcccagagactcaaactgctgagagaagtggcaggcactcgcgtatacgacgagcgcaaggaggaatctatatcacttatgaaagaaaccgaagggaagagggagaaaattaacgaattattaaagtatatagaggagcgactccacacactcgaggaagagaaagaagagttggcacagtaccaaaagtgggacaaaatgcgtcgcgccttggaatatactatctataatcaggaactcaacgagacccgcgccaagctcgacgagctgtcagcaaaacgtgagacatccggagaaaagtcccgtcaactgcgcgatgcgcagcaggatgctcgcgataagatggaggatattgagcgacaggtgagggaattgaagaccaagatctccgccatgaaagaagaaaaggaacagctgagtgcagagcggcaagagcagatcaaacagcgtactaaactggagctgaaagccaaggacctgcaagatgagctggctggcaattcagagcagcgtaagcgcctgctgaaagagcgccagaagcttctggagaaaatcgaggagaagcagaaggaactcgccgaaacagaacctaagtttaacagcgttaaagaaaaagaagagcgcggaatcgctcggctggctcaggcaacgcaagagcgcactgatctttatgctaaacaaggtagaggctctcaattcacatctaaggaagagagagataagtggattaaaaaagaattgaagtctttggatcaagccatcaacgacaaaaagagacagatcgcggcgattcataaggacctggaagatacagaggcgaacaaggagaaaaatctggagcagtataataagttagatcaggaccttaacgaagtgaaggcacgcgtcgaagaactggaccgcaagtactacgaagttaaaaataaaaaagatgaacttcagtccgagaggaattacctttggcgagaggaaaatgctgaacaacaggcattggcagcaaagagggaggatctggagaaaaaacagcagttgcttcgggccgcaactggcaaggccatcctgaacgggattgacagcatcaacaaggtgcttgatcacttccggaggaagggcatcaatcagcacgtccagaacggatatcacggaatcgtgatgaacaacttcgagtgcgaacccgccttctacacgtgcgttgaggtgactgctggtaaccggcttttctatcacattgttgattccgacgaggtcagcaccaagatactaatggagttcaacaagatgaacctcccaggcgaggtcacattcttacctctgaacaaactagacgttcgcgataccgcttatcccgaaacaaacgacgcaatcccgatgatcagcaaattaagatataatccgaggtttgataaggcattcaagcacgtttttggtaaaaccttgatctgccggagcatggaggtcagcacccagctggcaagagccttcactatggattgtattactctcgagggggatcaagtatcccacaggggcgcacttaccggcggctattatgacacaaggaagtccagacttgagcttcaaaaagacgtgagaaaggcagaggaggagctgggggagctggaagcgaaacttaatgaaaacttgaggcgcaatatcgagaggattaataacgagattgaccagctgatgaatcagatgcaacagatcgaaacccagcaacgcaagtttaaagcttcaagggacagcatcctcagcgaaatgaaaatgctgaaggagaagcggcaacagtcagagaagacattcatgccgaagcagcgatcactccagagtctggaagcatctttgcacgctatggaatccacacgggaatcactcaaggccgagctcggaacagatctgttatcccagttatccctggaggatcagaagagagtcgacgctctaaacgacgagatcagacagctgcagcaggaaaatcggcaactattgaacgaacgcattaagctggaaggtattatcacaagggtagagacttacctgaatgaaaatctgagaaaacgccttgatcaagtggaacaggagctgaacgagctgcgcgaaaccgaaggaggcactgtactgacggccacaacttccgaactggaggcgattaacaaacgggtaaaagacactatggctaggtcagaggacttagataacagcattgacaagaccgaagccggaattaaggaacttcagaagtccatggagaggtggaaaaatatggagaaagagcacatggacgctattaaccatgataccaaggagctggagaagatgacaaatcggcaaggtatgctcctgaaaaagaaggaggaatgcatgaaaaaaatcagggaactggggtccctgccccaggaggcttttgagaagtatcaaaccctgagcttgaagcaactgttccgcaaactcgaacagtgtaataccgagctcaaaaaatactctcatgtcaacaagaaagctctcgaccagttcgtgaactttagcgaacagaaggaaaagttaattaaaagacaggaagagctcgacagagggtataagtcaatcatggagttgatgaatgtgcttgagctcagaaagtatgaggctatacaactaacatttaagcaggtgtctaaaaatttttccgaggtgtttcaaaagctcgtgcccggagggaaagcgacactggtgatgaaaaagggcgatgtggaaggatcacaaagccaggatgagggcgaggggtctggggagagcgaacgcggctcgggcagtcagagttcggtgccttccgttgatcagtttaccggggtaggcatcagggtgtcctttacggggaaacagggtgaaatgcgcgagatgcagcaactgagcggcggccagaagtcactggtggctctcgctctgatctttgctatccagaaatgcgaccctgctccattctacctgtttgatgagattgatcaggccttggatgctcagcatcggaaagctgtgtccgacatgatcatggaactggccgtccacgcccagttcatcaccacaacgttccggcccgagctgctggagtcagctgacaagttctatggagtgaagttcagaaataaggtgagccacatcgatgtgattaccgccgaaatggcaaaagacttcgtagaggatgacaccactcacggttag

SEQ ID NO: 136487 - DNA, 3306 bp, Artificial Sequence
  Description of Artificial Sequence: Synthetic coding sequence
atggcaacaccatcaaagaaaacaagtactccttccccacaaccaagtaaacgcgccctgcctcgggacccgagttctgaggtccccagcaagcgcaaaaattcagcccctcaacttccactgctgcagtcctcagggcctttcgttgaaggatctatcgttagaatttctatggagaacttcctgacatacgatatctgtgaagtgagccctggtccgcacttaaatatgattgtgggagcgaacggaacaggaaaatcatccatcgtatgcgcaatttgtctcggcctcgcaggcaaaccagccttcatgggaagggctgataaggtgggctttttcgttaagcgcggctgctctaggggaatggtggagatcgagcttttcagagccagcggaaatctagttatcacacgcgagatagatgtagcaaaaaatcaatccttttggttcatcaacaaaaaatccacgacacagaagatcgttgaagagaaagtggcagcgttgaacattcaggtgggcaacctgtgtcagtttctgcctcaggacaaagttggtgaatttgccaagctttctaaaatcgagctgttggaggctaccgagaaatctatcgggccccctgaaatgcataagtaccactgtgagctgaagaatctcagagagaaagaaaagcagctcgagacttcttgtaaagaaaagacagaatacttacaaaaaatggtgcagcggaacgagaggtacaagcaagacgtggagagattctacgagagaaagcgccatctggatctcatcgaaatgctggaagccaagcggccctgggtagaatatgagaatgtgcgtcaagaatatgaggaagtgaaactggtgagagaccgtgtcaaagaggaagtacgcaagttaaaggaggggcagattccagtcacttgtagaattgaagaaatggagaatgaacgccataatttggaagctaggatcaaggaaaaggcaaccgacatcaaggaagcgtcccaaaaatgcaaacaaaagcaggacgtcattgagaggaaggacaaacatatagaggagctgcagcaggctcttatagtgaagcagaatgaagaactggacagacagcgtagaattggcaatacccgcaagatgatcgaggacctgcagaacgagctgaagacaacggaaaactgcgagaacctccagccacaaattgatgccataacaaacgatcttcggaggatccaggatgaaaaggctttatgtgagggggaaattattgacaaacggagagagagagagacacttgagaaggaaaaaaagagcgttgatgaccacatcgtccggttcgacaacctgatgaaccaaaaggaagataaactgagacaaaggtttagggatacatacgatgcagtgctttggctgcgcaacaatcgggacaagtttaaacaacgggtgtgtgagcctattatgctaacaatcaatatgaaggacaataaaaacgcaaagtacattgagaatcacattccttccaatgacttgcgcgccttcgtgttcgagagtcaggaggatatggaagtgttcttgaaagaagtgcgggacaacaaaaaactgcgggtaaacgcagtgatcgccccaaagtcctcttacgcggacaaggcgccctcccggtcacttaatgaactgaagcagtacgggtttttcagttatcttcgtgagctcttcgatgctccggaccccgtcatgagctacctctgctgtcaataccacatacacgaagtgcccgtgggaacggagaagactcgggaaagaattgagcgtgtgattcaagaaacacgcttaaaacaaatatataccgcagaggagaaatatgtcgtgaagacttccttctatagcaacaaggtgatctctagtaacaccagccttaaggttgctcagttcctgactgtgactgttgatctcgaacagcggcgacacctggaggagcagctgaaggagattcataggaagctccaggcagttgacagtggacttattgccctacgcgaaacctcgaagcacctggaacacaaagacaacgagttacggcagaagaaaaaggaactcctggaacgtaagaccaagaaacgccaactggaacagaaaatctcttcaaagctgggaagcctcaagctaatggagcaggatacctgtaatctcgaggaggaggagaggaaagcttctactaagatcaaagagattaacgtccagaaggccaagcttgtaacagagctcacgaacctcatcaaaatctgtacgagtctgcacatccagaaagtggatttaatcctccagaacactacagtaattagcgaaaagaataagctggaaagtgattacatggccgcttcctctcagctgcggctgactgaacagcatttcatcgagctggatgaaaaccgccaacggctcttgcagaagtgtaaggagttgatgaagcgggcaagacaagtgtgtaatcttggagctgagcagaccctgcctcaggaataccagacccaagttccaacgatccccaatggacacaatagctctctgccaatggtatttcaggatttgcctaacaccctcgatgaaatcgacgctctattgactgaggagcggagtagggcaagttgctttaccggtctgaatcccaccatcgtgcaggagtacacaaaacgggaagaagaaattgagcaactgaccgaggaactcaaggggaaaaaggtggaactcgaccagtaccgagagaatattagtcaggtgaaggagcgatggctgaatccgttaaaagaacttgtcgagaaaatcaatgaaaagttttctaactttttctcatccatgcagtgtgccggcgaggtcgacttgcacaccgaaaacgaggaggattatgacaagtatggaatacgaataagggtgaaatttcgatcatctacacaactccacgaacttacccctcatcaccaatccggaggagaaaggagcgtgagcactatgctctatctcatggcacttcaggagctaaatcggtgccctttcagagtcgtggatgagatcaaccagggaatggatcccatcaacgaacgtagagtcttcgagatggtcgtgaatactgcttgcaaggagaatacttcccaatacttcttcattacacccaagctcctccaaaacttaccttactccgagaagatgaccgttctgtttgtgtataatggccctcacatgctggaacctaatacctggaatctgaaggcattccagaggagaaggaggagaattacttttacacaaccctcatag

SEQ ID NO: 136488 - DNA, 3276 bp, Artificial Sequence
  Description of Artificial Sequence: Synthetic coding sequence
atggcaaaacggaaggaagagaattttagttctcctaagaacgctaagcggcctcggcaggaagagttggaagacttcgacaaggatggggatgaagacgaatgcaagggcactactctgacagctgcagaggtaggcatcatagagtccatacatttgaaaaactttatgtgtcacagcatgttgggccccttcaagtttggctctaatgtgaacttcgttgtggggaacaacgggtctggaaagagtgcggtactgacggcactgatagttgggctgggcggtcgggcagtggccactaacaggggtagttcacttaagggattcgtcaaagacggacaaaactctgctgacatttcaattaccctccgtaatagaggcgacgacgcttttaaggcatctgtttatgggaatagtatcctgatccaacagcatatcagcatcgacgggtcccgatcttacaagctcaagagcgccaccggaagcgttgtgagcactcgaaaagaagagctgattgccatcctggaccactttaacatccaggtggataacccggtctcggtcttgacacaggaaatgtcaaagcagttcctgcagtcgaagaatgaaggagacaaatacaagttctttatgaaggcaactcaattggagcaaatgaaagaggattacagctatataatggagactaaggaacgaacaaaggaacagattcaccagggcgaggaacgtctaacagagttaaaacggcagtgcgtggaaaaagaagaaagattccaatccatcgcaggcctgagtacaatgaaaactaacctggaaagtctgaagcacgagatggcctgggccgtcgtgaacgagatcgagaagcagctcaatgctatcagggacaatattaagataggcgaagatcgggcagcccgcctggatcggaagatggaggaacagcaggtgcgactgaacgaggccgaacagaaatacaaggacatacaggacaagctcgagaagatcagtgaggagacaaacgcacgggcccctgagtgtatggcgcttaaggctgacgtagttgcaaagaaaagagcctataacgaagcagaggtcttatacaatcgttcactgaacgaatacaaagcgttgaaaaaagatgacgaacagctttgtaaaagaattgaggaactgaaaaaatctacagatcagtctctggagcctgaaaggctggaacgtcagaaaaaaatcagttggttaaaggagcgcgtcaaggcgtttcagaaccaggagaattccgtcaaccaagagatagagcagtttcagcaggccatcgagaaagacaaggaggagcacggcaaaattaagcgcgaggagctggacgtgaaacacgctttaagctacaaccaacgtcagctgaaggagctgaaggactctaagacagacaggttgaagaggttcgggcccaacgtacccgccctgttggaagctatcgacgatgcctaccggcagggacacttcacgtacaagccagtgggtcctctgggtgcatgtatccacctgcgggatccagaactcgcgctggctatcgagagttgcctgaaaggcctgttgcaggcctattgttgtcacaatcacgctgatgaaagagtcttgcaagcgttaatgaaacggttctatctcccaggtaccagtcgcccccccatcattgtctctgaattcaggaatgagatatatgacgtaagacatcgggctgcctatcaccctgacttccccacggtcctgaccgcactggagatagacaatgcagtggttgccaatagccttattgatatgagagggattgaaacagtactgttaattaagaataactcagtggctcgggcggtcatgcagtcccaaaagcctcctaagaattgccgcgaagcctttaccgctgacggagatcaagtctttgcaggtaggtattattcttctgaaaacacgagacccaagttcctgtctcgtgacgtggactccgaaatctcagatcttgagaacgaggtggagaacaagacggcacagatcttaaatctccagcagcacctgtcagccttggagaaggatattaaacacaacgaggagcttctcaagagatgccaactacactacaaggagctaaagatgaagattcgcaagaatatttctgagatcagggaactggagaatattgaagagcaccaaagtgtggatattgctacgctggaggacgaggcccaggagaacaaaagcaaaatgaaaatggtagaagagcacatggagcagcagaaggagaacatggaacatctgaagagtttgaaaatcgaagccgaaaataaatatgacgcaattaagtttaaaatcaaccaactcagcgaactggcagatccgctcaaagatgagctcaacctcgcagatagcgaggtcgacaaccagaagcgcggcaagcggcactatgaggagaagcaaaaggagcacctggacacactgaacaagaaaaagcgggagctcgacatgaaagagaaggaattagaagaaaaaatgtcccaggcccgtcagatatgtcctgaacggattgaagtggaaaagagcgcttcgatcctggataaagagatcaaccggctgcgtcagaaaattcaggctgagcacgctagtcatggggaccgagaggagattatgagacaatatcaggaagctcgtgagacttacctcgatctcgatagtaaggtacgcactctaaagaagttcatcaaactgctgggggaaattatggaacaccgcttcaaaacttaccagcagtttcgcaggtgccttaccctgcgttgcaagctttatttcgacaatttactgtcccagcgagcctactgcggaaagatgaactttgatcacaaaaacgaaacacttagcatatctgtccagcctggtgaagggaataaggcagccttcaatgacatgcgcgcactttctggaggcgaacgcagctttagtactgtgtgcttcatcctctcattgtggagtattgctgaatcaccctttagatgtttagatgagttcgatgtatacatggacatggtgaatcgtaggatagctatggacctcattctgaaaatggccgacagtcagagattcaggcaatttatattgctgacccctcaaagcatgtcatctctcccttcttctaaactgatccggattcttaggatgagcgaccccgagcgaggacagacgacattgccttttcgacctgtcacgcaggaggaggatgacgatcagcggtag

SEQ ID NO: 136489 - DNA, 3354 bp, Artificial Sequence
  Description of Artificial Sequence: Synthetic coding sequence
atggcgaaacgcaaagaggagaatttttcgtcaccaaagaatgcgaagcggccacgccaggaggagctggaggattttgataaagacggcgacgaggatgagtgcaagggcaccactctgaccgcagctgaggtggggatcattgaaagcattcatcttaaaaactttatgtgtcactctatgttgggcccttttaaattcgggtccaatgtcaatttcgtcgtggggaacaatggctcctggagcgctgtggtgcgctcaaggctcaacgccacatcagcttcccaggtgcaagctatcctgctgtttcagccatgcggtaaaagcgctgttttgacggcactgatcgttggtctgggcggccgagctgtggcaaccaaccgtggctctagtctgaagggcttcgtgaaggatggtcagaatagtgcagatatttcgataacgctgagaaacagaggagatgatgcctttaaagcttcagtgtatggaaactcaatcctcatccagcagcacatctccatcgacgggtctcggtcttataagctcaaaagcgctacaggaagtgtggtctctacccgaaaggaagagcttattgcaatcttggatcacttcaacatccaggtagataaccccgtctccgttctgacacaagagatgtcaaagcagtttctccagtccaaaaacgagggagacaaatacaagttcttcatgaaagcgacccaactggaacagatgaaagaggattattcctacataatggagacgaaagaaaggaccaaagaacagatccaccaaggagaggagagactaacagagctcaaacggcagtgcgtggagaaggaagaaagatttcaatccatcgccggcctgtctacaatgaagacaaaccttgagtccctcaagcacgaaatggcttgggccgtggtgaacgaaattgagaagcaacttaacgcaatccgtgataacattaagatcggcgaggaccgcgccgccagattggaccgtaaaatggaggaacagcaggtgaggctgaacgaagccgagcagaagtataaggatatccaagacaaattggagaagatttctgaagagacaaacgcccgggcacccgaatgcatggctttgaaggccgatgtggtcgcaaagaagcgtgcatacaatgaagctgaggtgctctacaataggtccctcaacgaatacaaggccctgaagaaggatgacgaacagctgtgcaagaggattgaagaactcaagaaatctacagaccagagtttggagcccgagagactggaaaggcaaaagaagattagttggctgaaggagcgcgttaaggctttccagaaccaggagaatagcgtgaatcaagagatcgaacaatttcagcaagctattgaaaaggacaaagaggagcacggcaagattaagcgcgaagagttagacgtcaagcatgcactgtcttacaatcagcgacagctgaaggagctcaaggacagtaaaacagatcgactgaaaagattcgggcctaacgtccctgccctgctcgaggccatagatgacgcctaccggcagggccatttcacatataagccagtgggaccactcggtgcgtgcattcacctgcgagatccagaactggctctggccatcgaaagttgtctcaagggtctgctgcaagcctactgttgccataaccacgctgatgaacgagtgttgcaggcgctgatgaaacgattttatcttcccggcacgtcaagacctccaattatcgtctccgaattccgcaatgaaatttatgacgtgagacaccgagccgcctatcaccctgatttcccgactgtgctgaccgccctggagatcgacaatgccgtggtagcgaactcattaatcgatatgcgcggtattgaaaccgtgttgttgattaaaaacaactctgttgccagggccgtaatgcagagccaaaagcctccgaagaactgcagggaggcctttaccgcggatggtgaccaggtcttcgcaggacgctactatagttcagagaatactcgaccgaagttcctcagtagagacgttgattctgagatctctgatctggagaacgaagtggagaacaaaacagcacagatcttaaacctgcagcagcacttgagtgccctggagaaggatattaagcataacgaggaattgctgaagaggtgccaattacattacaaagaactcaaaatgaaaattcgtaagaacatctcagagatcagggagctggaaaacattgaagagcaccagagcgtagacatcgctaccctggaagatgaggcgcaagagaataagtcgaagatgaagatggtcgaagaacatatggaacaacagaaggaaaatatggaacacctcaagtcactcaaaatcgaagcagagaataagtatgacgccataaaattcaagatcaaccagttaagcgagctcgctgaccccctcaaggacgagttgaatcttgccgattctgaagtcgacaaccagaagagaggcaaacggcactatgaggaaaaacagaaagaacatttagacacgcttaacaagaagaagagagagctagacatgaaggaaaaagagctggaggagaaaatgagtcaggcaagacagatctgcccagaacggattgaggtcgaaaagtccgcatccattctggacaaggagattaaccgcttgagacaaaagattcaggccgagcacgcttcccatggcgaccgagaagaaatcatgcggcaatatcaggaagcccgagaaacctatctggatcttgattcaaaagtacgcacactcaaaaaatttatcaaattactcggggagataatggagcatagatttaaaacataccagcagttcagaagatgcctgacccttcgatgtaaattgtactttgataacctcctctcccagagagcctactgtggcaagatgaattttgaccacaaaaatgagactcttagtatcagcgtccagccgggggaaggtaataaagccgcatttaatgacatgagggcattgagcggcggggagcggtccttcagtaccgtgtgctttattctatccctttggtccatcgcagagtcccctttcaggtgcctcgacgaatttgacgtgtacatggatatggtgaaccgaagaatagcgatggatctgatcctgaagatggctgacagccaacgtttccgacagttcatcttactgacacctcagtccatgtcctctcttccctcatcgaaactgatccgaatcttgcgcatgagtgatccggaacggggccaaacaacactgcctttccggccagtcacgcaggaggaagatgatgaccaacgctag

SEQ ID NO: 136490 - DNA, 3276 bp, Artificial Sequence
  Description of Artificial Sequence: Synthetic coding sequence
atggctaagaggaaggaggagaatttctcctctccaaagaacgcaaaaagaccgcgccaggaagagttggaagacttcgataaagacggggacgaggatgagtgcaagggaacaaccttaacagcggcggaagtggggataattgagagcatccacctcaagaattttatgtgtcattcgatgctgggaccttttaagtttgggagcaacgtgaactttgtggtggggaataacgggtccggaaagagcgccgttctcacagctcttatcgtgggactcggtggccgggctgtagcaactaatcggggatcttcactgaaaggcttcgttaaggacggacagaacagtgctgacatctccatcaccttgcggaacagaggtgacgacgcctttaaagcttccgtgtatggaaacagcatcctcattcagcagcatatttccattgacggcagccgatcctataagctcaagtcagcaacgggtagcgtcgtgtctaccaggaaagaagaactgattgccatactggatcactttaacatccaggtggacaaccccgtttccgtattgactcaggagatgagcaaacagttcttacagtccaagaacgaaggggataagtataagttttttatgaaggccacacagctagagcagatgaaagaggactacagttatataatggagaccaaagagcgcaccaaggagcagatacatcaaggcgaagagagactcaccgaactcaaaaggcagtgtgtggaaaaggaagaaaggttccagagtatagctggattgagcaccatgaaaacaaacttggagtcactgaagcatgaaatggcctgggctgtggtgaatgagattgagaagcagctcaacgcgattcgggataacatcaaaattggagaggaccgcgcagcaagactggaccgtaagatggaagagcaacaggttcgcttaaacgaggcagaacagaagtacaaggatatccaggataagctcgagaagatctcagaggagacaaatgcccgggcaccagagtgcatggccctaaaggctgacgtggtggctaagaagagggcctacaatgaagctgaggtgctgtacaaccggagcctgaacgagtacaaagccctgaaaaaagacgacgagcagctgtgcaagagaatcgaggagctgaagaaaagcactgaccagtccctcgagcctgagaggctggagagacaaaagaagataagctggttgaaggagcgggtcaaagccttccaaaatcaggaaaactctgtgaatcaagaaatagaacagttccaacaggctatcgaaaaggacaaggaggagcacggcaagataaaaagggaggaactggatgttaaacacgccctctcatataaccagaggcagcttaaagagttgaaagattctaaaactgatagactgaagcgatttgggccaaatgtcccggccctgctggaggccattgatgacgcctaccgccagggccactttacatataaaccagtgggccctctgggagcctgcatccatctaagagacccagaactggcactcgccattgaatcatgtcttaagggactgctccaggcatattgttgccataaccatgctgacgaaagagtgctgcaggctctgatgaaacgattttacctcccaggtacatctaggcccccaatcatcgtctctgagtttaggaatgagatctacgacgtgcgtcacagagcagcataccatcctgatttccctacagtgctgacagctctggagattgacaacgccgttgtcgccaattccctcattgatatgcgtggcattgagacagttctgttgataaaaaataattctgttgcacgggctgttatgcagtctcagaagcctccaaagaattgccgtgaggcctttactgccgatggagaccaggtattcgcaggaagatattacagttcagagaataccaggcctaaatttctgtccagggacgtggactcagagatctctgatctggagaatgaagtggaaaacaagacggcacaaatactgaacctgcaacagcatctgagcgccctggaaaaggatattaagcacaacgaagaactcttgaaacggtgtcagctgcactacaaagagcttaaaatgaagattaggaaaaacatttccgagattagagaattagagaatatagaggaacatcaaagcgtggatatagcgaccctcgaggacgaagcacaggagaataaatccaaaatgaagatggtcgaggaacacatggaacagcagaaagaaaatatggagcatttaaagtcattaaagatcgaagccgaaaacaaatacgatgctattaagtttaagattaaccagctgtcagagcttgcagacccactcaaggacgaacttaatcttgcggacagcgaagtcgacaaccagaagagagggaagagacactatgaggaaaagcagaaagaacatctggataccttaaacaagaaaaagcgggagctggacatgaaggagaaggagctcgaagaaaagatgagccaggcacgtcaaatatgcccagagaggatcgaggtcgagaagtccgccagcatcctggataaggaaatcaacagattgcgccagaagatccaggctgagcatgcctcgcacggggatcgggaagaaatcatgagacagtaccaggaggctcgggagacatacctggacttggatagcaaggtcagaacacttaaaaagttcattaagctcctgggtgagataatggagcacagattcaaaacctaccagcagttccgccgttgcttgaccctgagatgtaaactgtattttgataacctgctgtcccagcgggcatattgtggcaagatgaactttgatcacaagaatgagacactcagcatcagtgtgcagccaggagaagggaacaaggcagcattcaatgacatgagagccctgagcgggggggaaagatcattctccactgtctgctttattttatccctctggagcattgctgagagtccctttaggtgcttggacgagtttgatgtatatatggacatggttaacaggaggatcgccatggatctgatcctgaagatggctgactcgcagaggttcagacagttcattctgctgactccgcaatcaatgtccagcttgccatcgtctaagctcatccgtatcctccggatgtctgatcccgagagggggcagactacccttcctttccggcctgtgacacaagaggaggacgatgatcaacgttag

SEQ ID NO: 136491 - DNA, 174 bp, Artificial Sequence
  Description of Artificial Sequence: Synthetic coding sequence
atggctaaacgtaaggaggagaatttctcttcccctaaaaacgccaaacgtcctcggcaggaagagctggaagattttgataaggacggcgatgaagacgagtgcaagggtaccactctgacggctgcagaggttggtataattgaaagcatccatttgaaaaattttatgtag

SEQ ID NO: 136492 - DNA, 3276 bp, Artificial Sequence
  Description of Artificial Sequence: Synthetic coding sequence
atggccaagcgcaaggaagagaatttcagcagtcctaagaacgccaagaggccacgacaagaggaactagaagatttcgataaggatggggacgaggacgagtgcaaaggcaccactctgaccgccgctgaagtgggaattatcgagagtatccacttgaagaatttcatgtgtcacagcatgctcggcccttttaagtttggctccaacgtgaacttcgtggtgggaaacaatggctccggcaagtccgccgtgctgacagcactgatcgttggactcggaggccgggcggtagctacaaaccgcggatcatcccttaaaggctttgttaaagacgggcaaaacagcgccgacatttctatcactcttcgtaacagaggggatgatgcattcaaggctagcgtgtacggcaacagtatcttgatacagcaacacatctcaatcgacgggtctagatcgtataagctcaagtcggccaccgggagcgttgtcagcacgcggaaagaggagctgatcgcaatccttgaccattttaatatacaggtcgataacccagtgtcagtgctgactcaggaaatgagtaaacagtttcttcagtccaaaaacgagggggacaaatacaagttttttatgaaggccacacagctggagcagatgaaggaggactatagctatattatggagacaaaagagaggacgaaggaacaaatccatcagggcgaggaacggctgacggaattgaaaaggcagtgcgtggagaaggaagaaagatttcagagcatcgccggcctcagtactatgaagaccaacttagagtccttgaagcacgagatggcatgggcagtggtgaacgagatagaaaagcagttaaacgccatccgtgacaatatcaaaatcggcgaggatcgcgccgcccgccttgatcgcaagatggaggagcagcaggtcaggcttaacgaagccgaacagaagtacaaggacatccaggataaactggaaaagatctcggaagagacaaacgctagggcacccgagtgtatggcactgaaagctgatgttgtcgctaagaaacgggcctacaatgaagctgaggtcctttataaccgctctctgaacgagtataaagccctaaaaaaggacgatgaacagttgtgtaagcggattgaagaactaaaaaaatcgacagaccaaagtctggagcctgagcgtctcgagcggcagaagaaaatctcatggctaaaggagcgagtgaaagctttccagaaccaggaaaacagcgttaatcaggaaattgaacagttccaacaagccatagaaaaggataaggaggagcacggcaagatcaagagagaggaacttgacgtgaaacatgccttatcatacaatcagcgccagctcaaggagcttaaggactcaaagactgatcggctcaagaggttcggtccaaacgtccccgctctccttgaggctattgatgatgcctatagacaaggccattttacctacaaaccggtcggaccactgggtgcatgcattcatctgcgcgacccggaattggcactggctattgagagctgtctcaagggactcctccaagcttattgttgtcataaccacgccgatgagagagtgctgcaggcactgatgaagcgcttctatctgcctggcaccagtaggccgcctattatagtttcggagtttaggaatgaaatctacgatgtgcggcaccgcgccgcgtaccacccagattttccaaccgtgctgacagccttagagattgataatgccgtggtcgccaacagcctgatcgatatgcgggggatcgagaccgtactgctgatcaaaaataactcagtggctcgcgcagtaatgcagagccagaagcctccaaagaattgtcgggaggcctttaccgccgatggcgatcaggtttttgcaggccggtattactcttctgagaacactaggccgaaattcctatccagagacgtggattcagagatctctgacctcgagaacgaagtggagaataagaccgctcagatccttaatctccagcagcacctttccgctctagaaaaggatattaagcacaatgaggagctgttaaaaaggtgccagctacactacaaagagttaaaaatgaagattcgcaaaaacattagcgaaattcgggagctggagaatatcgaagaacaccagtcggtagacatagcaaccctggaagatgaggcgcaggagaataagagcaaaatgaagatggtagaggaacacatggaacaacaaaaagaaaacatggaacaccttaaatccctgaaaatagaagctgaaaacaaatatgatgcaattaaattcaagatcaatcagttgagcgagttggccgatccactcaaggacgagctgaatcttgccgacagcgaagtcgataaccagaagcgagggaagaggcactatgaggaaaagcagaaggaacacttggatacgctcaataagaagaagagagagctcgacatgaaagaaaaggagctggaagaaaagatgtctcaggcaagacagatttgccctgaaaggattgaggtcgaaaagtccgcgtccatcctggacaaggagattaatcgcctgcggcagaagatccaggccgagcacgcctcccacggagatagagaagagataatgagacagtaccaggaagcccgggaaacttacctggatctggatagtaaagtgaggaccctgaaaaaattcatcaagttacttggggaaattatggaacacaggtttaagacataccaacagttcagaaggtgtctcaccctgcgatgtaagttatacttcgacaatcttctcagtcagcgcgcctattgtgggaagatgaacttcgatcacaagaacgaaaccctctccatttctgttcagcccggagagggcaataaggctgccttcaatgacatgagggctttgagtgggggggagcgcagtttttccacagtgtgctttatcctcagtctgtggtcgatcgcggaatcaccttttcgttgtctggatgagtttgatgtgtacatggatatggttaaccgtcggattgccatggacctgatccttaagatggctgactcacagcggttcaggcaatttatcctgctaacacctcaatccatgtccagcttgccatcttccaaattgatccggatcctgaggatgagcgatccggagcgtggccagaccactcttccatttagaccagtgacccaagaagaggatgacgaccagcgatag

SEQ ID NO: 136493 - DNA, 2130 bp, Artificial Sequence
  Description of Artificial Sequence: Synthetic coding sequence
atggctgaaaccctcgaattcaacgacgtatatcaggaagtcaaggggtccatgaatgacggcagattacgcctatcacgccaaggaataatattcaagaattcaaagactggaaaagtcgacaatatccaggcgggagagctaacagagggcatttggcgccgtgtggccctcggacacggcctgaagcttctgacaaagaacggacacgtctacaagtacgacgggtttagggagagtgagtttgagaagttgagcgacttttttaagactcattatcggttggaattgatggagaaagatctttgcgtaaagggctggaattggggcactgtgaaattcgggggccaactgctgagcttcgatattggggaccagcctgtatttgaaatccctcttagtaacgttagtcagtgcaccaccggcaaaaatgaagtcaccttggagttccatcagaacgacgatgcggaagtctccctgatggaggtgcgcttttacgttccacccacacaagaggacggcgtggaccctgtggaggcatttgctcaaaacgtcctatccaaagcagatgtcattcaggcgacaggcgacgccatttgcatctttcgtgagctgcagtgtctgacgccaaggggccgttatgatatcaggatctacccaacatttctgcatttgcatggcaagacctttgattataaaatcccttataccaccgtcctgcgtctttttttactcccccataaggatcaacgacaaatgtttttcgtaatatcgctggacccgcccattaaacaggggcaaactaggtaccacttcctgattcttctgttcagtaaggacgaggatatcagcctgacactgaacatgaacgaagaggaggtcgagaaacggtttgagggtaggcttacgaaaaacatgtcaggttccctctacgagatggtctcccgagttatgaaagctttagttaaccggaagatcactgtacccgggaattttcagggacattccggtgctcagtgcataacatgctcttataaggcctcttctggactattgtaccccttggaaaggggatttatctatgtgcataagccccccgtccacatccggttcgacgaaatctccttcgtcaactttgcaaggggaaccaccaccaccagatctttcgacttcgaaatagaaactaagcaaggcacccagtatactttcagcagcattgagcgggaggaatatggcaagctgttcgattttgtgaacgccaaaaagctcaatatcaagaaccgggggctcaaggagggtatgaatccctcatacgatgagtatgccgactccgatgaagatcagcacgacgcctatctcgaacgaatgaaggaggaaggtaagatccgggaagaaaatgccaacgatagctctgatgactctggtgaagaaactgacgaaagctttaacccaggcgaggaagaggaagatgtcgccgaagagtttgactctaatgcctcagcctcctcctcttctaacgagggcgatagcgacagagacgaaaagaaaaggaaacagttgaaaaaagcgaaaatggccaaggatagaaaatcaaggaagaagcctgtggaagttaagaaagggaaggaccccaatgcccccaagcgtcctatgtcagcttatatgctgtggttgaacgccagcagagagaagataaagagtgatcacccggggatcagcatcacagatcttagtaagaaagccggagagatttggaaaggtatgtccaaagaaaagaaggaagagtgggaccgtaaggcagaggacgcgcgtcgggactacgaaaaagctatgaaagaatatgaaggtggcaggggcgaaagtagcaagcgagataaaagtaaaaaaaagaagaaagtcaaagtcaagatggaaaagaagtcaacgccctcgcggggaagcagttcaaagagctcaagccgtcagctctccgaatcgtttaaaagtaaagagtttgtttcatcggatgagagctcgagcggcgagaacaaatccaagaagaaaaggcggcgctctgaagacagtgaggaagaagagctcgcaagcacgcctcctagcagtgaagacagtgcctccggctccgatgagtag

SEQ ID NO: 136494 - DNA, 240 bp, Artificial Sequence
  Description of Artificial Sequence: Synthetic coding sequence
atgaagagcctgacttggattctcggactatgggcgctggccgcttgctttacgccaggtgagtcacagcggggtcctcgcggaccttaccccccaggcccactggctccccctcagcccttcggtcctggatttgtgcctcctcccccaccccctccatacgggccaggacgtatccctccacccccccctgctccatacggacccgggatttttcctcctccaccaccacagccctag

SEQ ID NO: 136495 - DNA, 324 bp, Artificial Sequence
  Description of Artificial Sequence: Synthetic coding sequence
atgaaatctctcacttggattctgggattgtgggctctggccgcatgctttacccctggagagtctcaacgtgggccccgtggtccttaccctccaggccctttagcgccaccgcagcctttcgggcccggtttcgttcctccacccccaccaccaccatacggacccggaaggattccaccgccgccgtattcatgtactccgaacatgaacaactgcagccggtgccaccaccatcacaaacggcatcactatccctgcaactattgcttctattatccgaagtatgaattccagcattgtttccaagaaaccttcacctag

SEQ ID NO: 136496 - DNA, 240 bp, Artificial Sequence
  Description of Artificial Sequence: Synthetic coding sequence
atgaaatcccttacttggatcctggggctctgggctcttgccgcgtgcttcactcccggggaaagccagcgtggccccagagggccttaccctccaggaccccttgcccctcctcagccctttggaccgggtttcgtaccaccccctcccccccccccttatggccccggtaggatacctcccccacctcccgccccatacggtcctggcatcttcccccctcctcctccacaaccctag

SEQ ID NO: 136497 - DNA, 348 bp, Artificial Sequence
  Description of Artificial Sequence: Synthetic coding sequence
atgtcccggcactcaaggctgcaaaggcaggttctgtccttgtatcgcgatctcctgagggcaggccggggcaaacccggggctgaggcaagagttagagcggagttcaggcagcacgccggattgccccgcagcgatgtgttgagaatcgagtacctgtaccggagaggaagacgtcaacttcagttgctcaggagtggccacgccacggccatgggagcatttgtccgaccgagagcgccgaccggcgagccaggtggcgtgggctgccagcccgacgatggcgactctccccgaaatccacatgattctaccggggcacccgagacgcggccggatggaaggtag

SEQ ID NO: 136498 - DNA, 501 bp, Artificial Sequence
  Description of Artificial Sequence: Synthetic coding sequence
atggccgtgtctactgtgttctccacctcttcactgatgctggcccttagccgacactctttgttgagcccactcctcagtgtcacttcgtttcggcgattttacaggggtgattctcctaccgactcacagaaggatatgattgaaatacctctgcccccctggcaggagaggacagatgagagtattgagacaaagcgagccaggctcttgtacgagagccgcaaaagaggaatgcttgaaaattgtatcctattgagcctgtttgcaaaagagcatctccagcacatgactgaaaagcaacttaatctgtacgatcggttaatcaatgaacccagcaacgattgggacatttactattgggccaccgaggccaaaccagcgcctgaaatcttcgaaaatgaggtgatggcccttctgagggacttcgcaaaaaacaagaataaagagcagaggcttcgtgctcctgacctcgagtatctctttgaaaagccacgatag

SEQ ID NO: 136499 - DNA, 843 bp, Artificial Sequence
  Description of Artificial Sequence: Synthetic coding sequence
atggcagctgtggtcgctctttcactgagacggcgtttgcccgccacaacgctgggcggagcctgtcttcaagcatcacgcggcgctcagacggctgccgctaccgctccccgcatcaaaaagttcgctatctatagatgggacccagataaagcgggagacaaaccacatatgcagacctacgaggtggacctgaataaatgcggcccgatggttctcgatgccctcatcaagattaaaaacgaagttgactcaacgttaacgtttaggcggagctgccgagagggaatttgtggaagctgtgcaatgaatatcaatggagggaatactttagcctgcacgcgccggatcgataccaacctcaataaagtgtcaaagatctacccccttcctcacatgtacgtgattaaggatcttgtgcctgatctgtccaacttctatgcacagtacaaaagcatagagccatacctcaagaagaaagatgagtctcaggagggtaaacaacaatacttacaaagcatcgaggagcgggaaaagctcgacgggctttatgagtgcatcctttgtgcctgttgttcaacaagctgccctagctattggtggaacggtgataaatacttgggcccggctgtactcatgcaggcctacaggtggatgatcgacagtcgcgatgattttaccgaagagaggctcgccaagctccaggatcccttctcgctttaccgctgccatactataatgaactgtactagaacttgtccgaaaggtctgaatcctggaaaggctatagctgagatcaaaaaaatgatggccacttataaagagaagaaggcttcagtctag

SEQ ID NO: 136500 - DNA, 453 bp, Artificial Sequence
  Description of Artificial Sequence: Synthetic coding sequence
atggccgctctgctgctacgacacgtgggtcgacactgtcttcgtgcccacttctccccgcagttatgtattcgaaacgctgtgccattgggcactaccgctaaagaggagatggaacggttttggaataagaacatcgggagtaacaggcccttgagtccccacattacaatctactcgtggtctttgccgatggccatgtccatctgccacagaggaacagggatcgctctctccgccgacgtgggccccagaaaacgccccgaggactctccagccatcccagtctggtccgggtgcccgggatcttattgtgtggtcctgtatggagccggctcccacgtcaagaagggcggctcccagcaccacctcccgacccactactatatccaccctagcttttgcctcagttttctaagcccagcgtgggagaagttctccctgtttgtgtag

SEQ ID NO: 136501 - DNA, 510 bp, Artificial Sequence
  Description of Artificial Sequence: Synthetic coding sequence
atggctgctcttctgctcagacacgtggggagacactgcctgagagcacacttttctccacaactctgcatccgcaacgcagttcctctcgggaccacggccaaggaggagatggaaaggttctggaataaaaacattggatccaatagaccattgtcacctcatatcaccatttactcttggtcactgccaatggctatgtcaatctgccacaggggcacgggaattgccctttccgccggggtgtctttgttcggcatgtcagcactgttgctccccggaaactttgaaagctacctggagctggtcaaatcactgtgcttgggtccagccctgatccacacggcaaagtttgccttggtctttcctctcatgtatcatacatggaacgggatccgtcacctgatgtgggacttaggcaagggattaaagattccccaactgtaccaatccggagtagtggtgttagtgttgactgtcctctcctccatgggcctggcagcgatgtag

SEQ ID NO: 136502 - DNA, 351 bp, Artificial Sequence
  Description of Artificial Sequence: Synthetic coding sequence
atggcagctttattgctgtcatggtccctgccaatggccatgtccatctgtcaccgggggaccgggatagctctgagtgccggcgtcagtctctttggtatgagcgccctgctgttgccaggaaacttcgagagctatctggagctagtcaagtctctgtgcttaggacctgccctgattcacactgctaagttcgccctggtgtttccgctgatgtaccacacgtggaacggcattcgccacctaatgtgggacttggggaaaggtttgaagatcccccaactgtatcagtctggggtagtcgtactggtcctcaccgtgttgtcctctatgggcttagcagccatgtag

SEQ ID NO: 136503 - DNA, 408 bp, Artificial Sequence
  Description of Artificial Sequence: Synthetic coding sequence
atggctgcccttctgctgcggcacgtgggccgtcattgtcttagggctcatttctctccacagttgtgtattcggaactggtcacttccaatggctatgtctatttgtcacaggggtaccgggattgccctgagtgctggtgtctctttgtttggaatgagcgctctgctcctgcccgggaatttcgagtcttatcttgagttggtcaaaagcctgtgcctgggcccagcgctgattcacacagccaaatttgccctcgtctttccattaatgtatcacacttggaacggaataaggcacttaatgtgggatctgggcaaaggactcaaaatcccacagttgtatcaatctggagtggttgtgctggtgctgactgtactctcttctatgggtcttgctgctatgtag

SEQ ID NO: 136504 - DNA, 480 bp, Artificial Sequence
  Description of Artificial Sequence: Synthetic coding sequence
atggccgtgttatggcggttgtctgctgtctgcggtgccctcggggggcgggccctgcttctgcgcaccccagtggttcgtccagcccacatctccgcctttcttcaggacaggcctattccagaatggtgcggggtgcaacacattcatttaagccctagccaccactctggcagcaaagccgcttccctccactggacatcggagcgggtagtttccgtccttttgctgggcttgctccctgctgcataccttaatccttgtagcgcaatggattatagcttggctgccgccctgacattgcacggtcactggggattagggcaggttgtaaccgactacgttcatggggacgctctccagaaagcagctaaggctggactgctggcgctaagtgcattaacgtttgcgggcctatgttattttaattaccatgacgttggcatctgcaaggcagtcgcgatgctgtggaaactgtag

SEQ ID NO: 136505 - DNA, 465 bp, Artificial Sequence
  Description of Artificial Sequence: Synthetic coding sequence
atggcggctagtatgttttacgggcgacttgtggccgtagccactttgcgaaaccatcggccgcggactgcgcaacgagccgccgcacaggggccggtcttgatcggcagcagtcacggcggtgtgaacatcgaggatgttgctgcggagtcccctgaggctataatcaaggagcccatcgatattgaggaagggattaaaaaagaacaggcattgcagctcgcccaaaagatgggcttcccaccaaacattgtcgagtccgcggcagagaacatggtgaagctgtatagcttatttctgaagtacgatgctactatgatcgagattaacccaatggtggaagatagcgacggagcagttctgtgcatggatgcaaagataaacttcgactccaactctgcctataggcagaagaagatcttcgatctgcaggactggacacaggaggatgagcgggataagtag

SEQ ID NO: 136506 - DNA, 897 bp, Artificial Sequence
  Description of Artificial Sequence: Synthetic coding sequence
agcggccgaggacaccctagcgaaccgcctgcaagcgatggcccagcgggctgttgtagcggttcaaaagatgtggtgataaaggctcaagtcctcgctgggggacggggcaagggtacattcgaaagtggacttaagggcggtgtaaaaattgttttctcgcccgaagaggcaaaagccgtgagctcacagatgatcggaaagaagttattcaccaagcagacaggggagaagggccggatctgtaaccaggttctggtctgcgagcggaagtaccctagaagagagtactactttgccattaccatggaacggagcttccaagggcccgtcctgattggaagttctcacggcggcgtgaatatcgaggacgtagctgcggagtcaccagaggcgataatcaaggaaccaattgacatcgaggagggaattaagaaagagcaggctctccagctcgcacagaaaatgggctttccccccaatatagtggagtcagcggctgaaaacatggttaaattgtactctctgtttctgaagtatgacgccaccatgatcgagattaatccaatggttgaagattcagacggcgccgtgctttgtatggatgcgaaaatcaatttcgactccaactccgcttaccggcagaagaaaatatttgacttgcaggattggacccaggaggatgagcgagacaaggatgcagcgaaggccaatctgaactacataggcttggacggcaacattggatgtctggtcaatggtgctggacttgctatggccactatggatatcatcaagctacacgggggcactccagctaattttctggatgtgggagggggggcaacagtgcatcaggttaccgaggcttttaagctgattacgtctgacaaatag

SEQ ID NO: 136507 - DNA, 1326 bp, Artificial Sequence
  Description of Artificial Sequence: Synthetic coding sequence
atggcggcctctatgttttacggtcggctggtggcagtagcgaccctgcgaaatcatcgccctagaacagctcagcagcaacaacggaacctgagtctacacgagtacatgtccatggaactcctgcaggaagcaggggtctcggtaccgaagggatacgtggccaagtctcctgacgaggcctatgcaatcgccaagaagttgggatctaaggatgtggtgattaaggctcaagtgctagccgggggtcgggggaagggtacgttcgagtctgggcttaaggggggggtaaaaatagttttttctcctgaggaagccaaggctgttagcagtcaaatgataggtaagaagctgttcacaaagcagaccggcgagaagggtagaatttgcaaccaggtgctcgtctgcgagcggaaatatcctaggagagaatactacttcgccatcacaatggagagatctttccagggtcccgtgttaatcggaagctcgcacggtggcgttaacatcgaggatgtcgctgccgaaagtcctgaagccattatcaaagagcctattgatatagaggagggaataaagaaagagcaagcattgcagttggctcaaaagatgggatttccccctaatatcgttgagagcgctgctgagaatatggttaaactctattcccttttcctaaagtatgatgcaacaatgatcgaaattaatcctatggtggaagactctgatggagcagtgttgtgcatggatgctaagatcaatttcgactccaatagcgcctaccgacagaaaaaaatttttgatcttcaggactggacccaggaagacgagagagataaggatgccgctaaggccaatctcaactacattggacttgatggcaatattgggtgccttgtgaatggggcggggttggccatggctaccatggacatcattaagctgcatgggggcacccccgctaactttttggatgtgggaggcggggccacagtgcaccaggtgaccgaggccttcaagctgattaccagtgataaaaaggtgcttgccattctcgtcaacatctttggcggcataatgcgctgcgacgtcatagcacaggggatcgtgatggccgtgaaggacttagagatcaagatcccagtggtggttaggctgcagggaacccgggtggacgacgccaaagccctgattgctgattctggccttaagatactggcctgcgatgacctggacgaggcagcccggatggttgttaagctgagcgagattgtgacattggcaaagcaggctcacgtcgacgttaagtttcagctgccaatctag

SEQ ID NO: 136508 - DNA, 1392 bp, Artificial Sequence
  Description of Artificial Sequence: Synthetic coding sequence
atggcggcaagtatgttctatgggaggctcgttgccgtggctaccctccgcaaccataggccaaggacagcacagcgagccgcagcgcaggtgctgggaagctctgggctcttcaataaccatggattacaggtgcagcagcaacagcagaggaatctgagtctacacgaatacatgtccatggagttattgcaggaagcaggcgtgagtgtgcctaagggatacgtggctaagtcccctgacgaagcctacgccatcgcaaaaaaactgggtagtaaggacgtcgtcataaaagcacaggtccttgcgggtggtagaggtaaaggcacattcgagagcggtcttaaaggcggagtcaaaatcgtgttttcccccgaggaggctaaggcagtgtcctcccaaatgattggcaagaagctgttcacaaagcagacaggagagaaaggtaggatttgtaaccaagtgttggtgtgtgagcggaagtatccccgacgcgagtattacttcgccatcacaatggagcggtctttccagggccccgtgctcatcggcagctcacacggtggagtcaatatagaggacgtagctgcggagtcacccgaggccatcatcaaggaacccatcgacatagaagaggggatcaaaaaggaacaggctctgcagctggcacaaaagatggggttcccgccaaacattgtagagtctgcagcagaaaatatggtgaaactgtacagtcttttcttgaagtatgacgccaccatgatcgaaatcaaccccatggtcgaagactccgacggtgctgtcctgtgtatggacgcaaagatcaattttgacagcaactcggcctatcgacagaaaaaaatctttgatctgcaggattggacccaggaggatgagagggacaaggatgcggccaaggcaaatctaaattacattgggttagatggaaacatcggctgcctggtcaatggcgccggccttgccatggcgaccatggatataattaaacttcacggcggcacccccgccaattttctggacgtcggaggtggggccacagtccaccaagtaaccgaggccttcaaattgatcacctccgacaaaaaagtcctggctatcctggtgaatatcttcggcgggatcatgcgatgcgatgttattgcccagggaattgtgatggctgtgaaggacctggagataaaaatcccggtcgtggtccgtctccagggaacacgggttgacgacgcgaaagcgctcatagccgattctggcttaaagatcttggcttgcgatgatctggacgaggccgcacgcatggttgtcaagttgtcagaaatcgtgaccctcgcaaagcaggcccacgtggatgtgaagtttcagttacctatttag

SEQ ID NO: 136509 - DNA, 1218 bp, Artificial Sequence
  Description of Artificial Sequence: Synthetic coding sequence
atgtcaatggaacttttacaggaggctggcgtgtcggtacccaagggatacgttgcaaagtctcccgacgaggcatacgctatcgctaagaagctggggtctaaggatgtggtaatcaaagctcaagtgctggccggtggtcgcgggaagggtaccttcgagtctggcctgaaggggggcgtgaaaatcgttttcagtcctgaagaggcaaaggctgtgagctctcagatgatcggtaaaaagctctttactaaacagacaggtgaaaagggtagaatctgcaatcaggtgctggtgtgcgagcgcaagtatcctaggagggaatactattttgcaataaccatggagcgaagcttccaaggtcccgtgctcatcggctcttctcatggcggcgtcaacattgaggatgtggcggccgagagtcccgaggcgatcataaaggaacctatagatattgaggaaggaataaagaaagagcaggcccttcagctggcccagaaaatgggcttccctcctaacattgtggaaagtgccgccgaaaatatggtgaagctgtattcactctttttgaaatatgatgctactatgattgaaatcaaccctatggtcgaagacagcgatggtgctgtcctttgtatggatgcaaagatcaacttcgattcgaactctgcttacagacagaaaaaaatcttcgatctgcaggactggacgcaagaagatgagcgggacaaagacgccgcgaaggcaaatctgaattatattggactggatgggaacatagggtgtctggtcaatggggccgggctagcgatggcgacaatggatattattaagctgcacggggggacacctgcaaattttcttgatgtgggaggcggagctaccgtccaccaagtgaccgaggctttcaaattgatcacgtccgacaagaaagtgttggcaatcctggtgaatatctttgggggcatcatgcggtgtgacgtaatcgcccaaggcatagttatggccgtcaaggacctggaaataaagattccagttgtcgtccgcttacaggggacgcgcgtagatgatgctaaagcccttattgctgacagcggcctgaagatattggcttgcgacgacctggacgaggcagctcgaatggtggtgaagctgtcagagatcgtcacattagctaaacaggcccacgtcgacgttaagttccagctccctatctag

SEQ ID NO: 136510 - DNA, 876 bp, Artificial Sequence
  Description of Artificial Sequence: Synthetic coding sequence
atggaacgctcattccagggtccggttcttatcggctcctcccacggtggagtgaacatcgaagatgtggcagctgaatctccggaggcaatcattaaagaacccatcgacatagaggaaggtatcaagaaggaacaagctctccaactggcccagaaaatgggctttcctcccaatattgtggagagcgctgcggagaatatggttaagctgtactcccttttccttaagtatgatgcgacaatgattgagattaatccgatggtcgaggactcagacggggcggtcttatgcatggatgcaaaaatcaattttgactccaacagcgcatataggcagaagaagattttcgacttgcaggactggacccaggaggacgagcgcgataaagatgctgcaaaagcaaacctgaactacataggactggacggcaatattggctgcctcgtaaacggagcaggccttgccatggctaccatggatatcatcaaacttcacggcgggactccagccaattttctcgacgtcggaggtggagcaacagtacaccaggttaccgaggcgtttaagctcatcacgagcgataaaaaagttctcgccatactggtgaacatcttcggtggcattatgagatgcgacgtcatcgctcagggcatagtgatggctgtcaaggatctcgaaattaagatccctgttgtggtaaggctccagggcacaagagtggatgacgccaaggccttgatcgcagactcgggccttaagattcttgcctgcgacgacctggacgaagcagcccggatggtggtcaagctgagtgagatcgtgaccctggcaaagcaggcccacgtggatgttaagttccagctgcccatctag

SEQ ID NO: 136511 - DNA, 1218 bp, Artificial Sequence
  Description of Artificial Sequence: Synthetic coding sequence
atgagcatggagctgctgcaagaggccggcgtgagcgtgcctaaaggatatgtggccaagagtccagacgaagcctacgctatcgctaagaagttgggcagcaaagatgtggttatcaaggcccaggtgttagctggagggagagggaagggaactttcgagtcaggccttaagggaggagtcaaaattgtcttctctccagaggaggcaaaggctgtatcctcccagatgatcgggaaaaaattattcaccaagcagacaggcgagaagggcaggatttgcaatcaggtgctggtctgcgagcgaaagtacccaagacgggaatactatttcgcaattactatggagcgcagctttcagggacccgtactgatcggaagctctcatggaggcgttaacattgaggatgttgccgctgagtctcccgaagcaattatcaaggaaccaatcgatatcgaggaaggcatcaagaaagagcaggcactccagctggctcaaaagatggggttcccacccaacattgtggagtctgcagcggaaaatatggttaagctgtattctctgttcttaaagtacgacgcgaccatgatagaaatcaatccaatggtggaagatagcgatggagccgtcttatgtatggatgccaaaattaactttgattccaactccgcgtaccggcagaagaaaatttttgacctccaggactggactcaggaagatgaacgcgacaaagatgctgccaaggcaaacctgaattacatcggccttgacggcaacattggatgccttgtgaacggcgcagggctggctatggccaccatggatatcataaagctgcatggtggaaccccagctaactttttggatgttggagggggagccacagtgcaccaggtcaccgaggcttttaagctcataacctctgataagaaggtgctcgctatcctggtgaatatttttggagggatcatgagatgcgatgtgattgcgcaaggcatcgtcatggctgtaaaggacctggaaatcaaaatccccgtcgtggtgcggctgcaaggtactcgagtagacgacgctaaagcgctcattgccgacagtggtctgaagattctggcctgcgacgatctcgatgaggctgccagaatggtggtcaagttaagcgagattgtaactttagctaaacaggcccacgtggacgttaagttccagctccctatttag

SEQ ID NO: 136512 - DNA, 990 bp, Artificial Sequence
  Description of Artificial Sequence: Synthetic coding sequence
atgatcggcaagaagcttttcacaaagcagaccggtgagaagggtagaatctgcaatcaggttctggtatgcgagcggaaatacccgcggcgcgaatattacttcgcaataaccatggagcggtcatttcaagggcccgttctaatcgggtcaagccatggtggcgttaatattgaggatgtagccgctgaatcccccgaggccatcattaaggagcccattgatatcgaagaaggcatcaaaaaggaacaggcgctgcaactggcccaaaaaatgggcttccccccaaatatcgtcgaaagtgccgccgagaatatggtgaagctctattccctctttctcaaatacgacgccacaatgattgagattaatcctatggtcgaggacagcgacggtgccgtgctgtgcatggacgctaaaatcaacttcgacagcaactccgcctatcgacaaaagaagatcttcgacctgcaagattggactcaggaagatgagagagacaaggatgctgccaaagctaatctgaattacattggcctggacggtaacattggctgtctcgtcaacggtgccggattggcgatggccacgatggatatcataaagctgcacgggggcaccccagcgaactttttggatgtgggcggaggcgctacagtgcatcaagtgaccgaagctttcaagttgatcacaagtgataagaaagtgttagctattctcgtgaatatatttggtgggataatgaggtgcgacgtgatcgcccagggcatcgtgatggccgttaaggacttagaaatcaagatcccagtggtggtgcgtctgcagggaacacgggtcgatgacgctaaggccctgatcgccgattcaggactgaagattctggcatgtgatgatctggatgaagccgccagaatggtggtgaaactatccgaaatagtgacattggccaaacaggctcacgtcgatgttaagttccagctacctatttag

SEQ ID NO: 136513 - DNA, 1041 bp, Artificial Sequence
  Description of Artificial Sequence: Synthetic coding sequence
atgaccgctacgctcgccgcggcagcagacatcgccaccatggtctccggctcatctgggctcgccgcagctaggctgttaagtcgcagcttcctcctccctcaaaacggaatcaggcattgttcatacaccgcctcccggcaacatctttatgtggataagaataccaagatcatctgccagggcttcacgggcaagcagggcacatttcattctcagcaagcactggaatacgggacaaaacttgtgggaggcacaactcctgggaaggggggacagacccatctggggctgccagtgttcaacacagtaaaggaggccaaggagcagaccggtgccactgccagtgtcatttacgtgcccccaccctttgcagccgccgccattaacgaggccatagaggccgaaatccctctggtggtttgcatcacggaagggattccccagcaagatatggtgagggttaaacacaagctgctccggcaggaaaagactagacttatcggaccaaactgtccaggggtgattaatcctggagagtgtaagattgggattatgcctggccacatccataagaagggtaggatcggcattgtttcccgcagtggaactctgacctacgaggccgtacaccagaccacacaagttggcttggggcaaagcttgtgcgtaggcattgggggcgaccctttcaacggaaccgacttcattgattgcctggagatcttccttaatgacagcgccaccgaaggaattattctgattggggagatcggggggaatgctgaggagaatgccgccgagtttttgaaacagcataacagtggacctaattccaagcccgtggtttccttcatcgcaggcctgacagcacctcccgggcgacgcatgggacacgctggggctattatagccgggggcaaggggggtgcaaaagagaagattagcgcattgcagtcagccggagtggtggtttcaatgtctcctgcacaacttggcacaacgatctataaagaatttgagaagcggaaaatgctttag

SEQ ID NO: 136514 - DNA, 5484 bp, Artificial Sequence
  Description of Artificial Sequence: Synthetic coding sequence
atggcccggaagaagttctccggcctcgaaatttcgctgattgttctgttcgttatcgttaccatcattgccattgctctgatagtggtactcgcaacaaagacccctgcagtcgatgagatcagcgactctaccagtacccccgccacaactcgcgtgaccaccaatccctccgacagtggtaaatgcccaaatgtcctgaatgatccagtgaatgttcgcattaactgtatcccggagcagttcccaactgagggaatttgtgcacagcgtggctgttgttggagaccatggaacgacagtctaataccatggtgtttcttcgtcgacaaccacgggtataacgtgcaggacatgacaaccaccagtataggggtagaggccaagctgaatcggatcccaagccctaccctctttgggaacgatattaattcagttctgtttaccactcaaaaccagactcccaatcgttttcgattcaaaatcaccgaccccaacaataggcgatatgaagtgccgcaccagtacgttaaagagtttactggtcctactgtgtccgatacactttacgacgtgaaggtggcgcaaaacccttttagcatacaagtgatacgaaaatcaaacggcaagactctgttcgacactagcatcggccccctggtatattctgatcaatatctgcagatctctaccagactgcctagtgactacatctatggaatcggggagcaggtgcacaaaaggttcagacacgatttgtcctggaaaacatggcctatcttcaccagagaccagctcccaggggacaataataacaatctgtacggccaccaaacctttttcatgtgcatcgaagacacctccggtaagagcttcggggtctttctgatgaacagcaacgctatggagatttttatccagccaactcccatagttacttatagggtgaccgggggaattttagatttttatatactgttaggtgatacacctgagcaagttgttcagcagtaccaacagttggtagggttgcctgcaatgcctgcctactggaacctcgggtttcagctgtccagatggaattacaaatccttggacgttgtcaaagaagtagtacgccgcaacagggaagcgggtatcccattcgatacccaagtcacagatatcgactatatggaagataaaaaagactttacctatgatcaggtagcttttaacggactgccccagttcgtgcaggacctgcacgaccacggccagaaatacgtaatcatattggatccggctatcagcattggccggcgagccaacggaactacctacgcaacctacgaacggggaaacactcagcatgtatggataaacgaatctgatggatccactcccatcattggcgaggtgtggcccggcctcaccgtatatccagacttcactaatccaaactgcatcgactggtgggcaaacgagtgctccatttttcatcaggaggtccaatatgatggattatggatagacatgaacgaagtgtccagcttcatccaaggctcaaccaaaggatgcaacgtaaacaagctcaactatcctccgttcactcccgacatactagacaaattgatgtacagtaagactatatgcatggacgcagttcagaattggggcaagcagtatgatgtgcacagcctgtatggatacagcatggccatcgccaccgagcaggccgtgcaaaaggtgttccccaataaacgaagttttattctgacacgatcaaccttcgcagggtcagggcgacatgccgctcactggttaggggataatactgcatcatgggagcagatggagtggagtatcactgggatgttggaattttccctgttcggcatccccttggtcggtgctgacatatgcggctttgtcgccgaaaccaccgaggaactatgccggcggtggatgcagttgggagccttctaccctttctctagaaaccataattccgacggatatgagcatcaagatccagcttttttcggccagaactcccttctcgtgaagtccagcagacagtatctcacaattcggtacacactactgccatttctctacacactgttctataaggcacacgtgttcggcgagacagtggcacgccccgtgctgcacgaattctatgaggacaccaactcttggatcgaggacactgaatttctttggggtcccgccctgctcattacccccgttctgaaacagggcgccgacacagtgagcgcatatataccagatgctatatggtacgactacgagagtggcgcgaaaagaccgtggagaaagcagagagtggacatgtatctcccagccgacaaaatcggtttgcacttacgaggcggttacatcatccctattcaggagcccgacgttactaccactgcaagtaggaagaatccactcggcttgatagtggcacttggtgagaataataccgccaaaggggacttcttctgggatgacggggaaactaaggacaccatccagaacggcaattacattctttatacgttctcagtttctaataatacgctggacattgtctgcactcactcttcctaccaagaaggaaccactctggcattccaaaccgtgaagatcctcggtctaacagattcagtgactgaggttagggtcgctgagaacaaccagccaatgaatgcacacagcaacttcacatatgacgccagcaatcaggtgctcctaattgcagatcttaagttaaacctcgggcgcaatttttcagtccagtggaatcagattttttccgaaaacgagcggttcaattgctatcccgacgccgaccttgccaccgaacagaaatgtacccagcgcggctgtgtctggcgcacaggatccagtctgtctaaagcccccgaatgctactttcccagacaggacaacagttattcggtcaactccgcaagatattcttcaatggggattacagccgacctccagctaaacacagccaatgcgcgcattaaactaccgtcagaccctatatccactctgcgagtcgaagtcaagtaccataagaatgacatgctccaatttaaaatctatgaccctcagaaaaagcggtacgaggtgcctgttccattgaatattccaaccacccctataagcacctacgaggacaggctctacgacgtggagatcaaggaaaaccccttcgggattcagatcaggaggcggagctccggccgcgtgatctgggactcctggcttccggggtttgcgttcaacgaccagtttattcaaatctccactcggctcccgagtgagtatatctacggattcggggaggtagagcatactgcatttaaaagggatctgaattggaacacatggggcatgttcacacgtgaccaacctcctggttataagttgaatagttatggattccatccctattacatggccctagaagaagaaggtaacgctcacggcgtgtttctgctgaatagtaacgcaatggacgtcacattccagcctaccccagctctaacctacaggaccgtaggcggcatattggacttctacatgttcttgggtccaactcctgaggtcgcgactaagcagtaccatgaggttatcgggcaccccgtcatgcctgcttattgggctctcggattccagctctgtcgttatggatatgctaacacctcagaagttagagaactctatgacgccatggtagcagctaacataccgtatgatgtgcaatacactgacattgattatatggaaaggcagctagatttcaccattggggaagccttccaggatctgccacagttcgtggataaaatcaggggcgagggaatgaggtatatcatcattcttgacccggcaatcagtgggaacgaaacaaaaacctatcccgcctttgagcgaggtcaacagaacgatgtgttcgtgaaatggccaaataccaacgacatttgctgggccaaggtgtggcctgatctccccaacataaccatcgacaagaccctgactgaagacgaggccgtcaacgcaagccgtgcccatgtggcattccctgacttcttccgcacttccacagcggagtggtgggcccgcgagattgtggacttttacaacgaaaagatgaagtttgacggcctgtggatcgacatgaatgaacctagttctttcgtaaacgggacaaccacaaatcagtgccgcaacgatgagctgaactaccctccctacttccctgagctcacaaagcggacggatggcctgcatttccgcaccatttgcatggaagccgagcagatccttagcgatggaacttccgtcctgcactacgacgtgcacaacctatatggttggagccagatgaaaccgacccacgacgccttacagaaaacaaccggtaaacgtggaatagtcatctctaggagcacctacccaacatcaggtagatggggcgggcactggcttggagataattacgcacgatgggacaatatggataaaagcataatcggtatgatggagttttccctgtttggaatgtcctatacaggcgcagatatttgcggcttcttcaataacagcgagtatcatctgtgcactcggtggatgcaacttggcgccttctatccctacagtagaaaccacaatatcgcgaatacacggcgacaggatccagcttcatggaatgagacattcgccgagatgagccggaacattctgaacatacgatacacgttgctcccatatttctatacacagatgcatgaaatccatgctaatggaggaactgtcatccgccctctactacatgaattctttgatgaaaaaccaacatgggacatctttaagcagttcctgtgggggccggcctttatggtcactccagttctcgaaccatacgtccagacagtaaacgcatacgttcccaacgcacgctggttcgactaccacaccggcaaggacataggggtccgcgggcagttccaaacctttaatgcatcgtatgacacaattaatctccacgtgagaggaggccacattctgccctgtcaggaaccagctcagaacacgttctatagccgtcaaaaacacatgaaactgatagttgctgcagacgacaatcagatggcacagggatccctcttctgggacgatggcgaaagcatcgacacttacgaacgcgatctctatctctcagtgcagttcaatctaaaccagaccactttaacttctactatcctgaagcgcggctacataaataagtcagagacccggttggggtccctgcacgtgtggggcaagggcacaactccagtcaacgcagtgacccttacttataatggaaataagaacagtttgccctttaacgaagacaccactaatatgattctcagaattgatttgacaacccacaacgtaaccctggaggaacctatagaaatcaattggtcatag

SEQ ID NO: 136515 - DNA, 2616 bp, Artificial Sequence
  Description of Artificial Sequence: Synthetic coding sequence
atgaagtatagttgttgtgccctggtcctggccgtgcttggtaccgaactcctggggagcttatgctcgaccgtgcgctctcctcggttcagggggaggatccagcaggaaaggaagaacatccgccccaacattatcctagttttgaccgacgaccaggatgtggaactgggctcattgcaggtgatgaacaagactaggaaaatcatggagcacggaggagcaactttcatcaacgcttttgtgactactcccatgtgttgcccgagccgctcttccatgctcaccggtaaatatgtgcacaaccacaacgtatacaccaataacgaaaactgcagctctcccagctggcaggccatgcacgagccacgaactttcgctgtatatcttaacaacacaggatatcgaactgctttttttggcaaatatcttaacgagtacaacggcagctatatacctcctggctggagggaatggctgggactgatcaaaaacagtcgcttttataactatactgtctgtagaaatgggatcaaagagaagcatggatttgattatgctaaggattattttacagacctcattacgaatgaaagtattaactacttcaagatgtctaaacggatgtatccacaccgtccagtaatgatggtcatctcccatgccgctcctcacggccctgaagactctgccccccaattctccaaactgtaccccaacgccagccagcatatcaccccgagctataactacgctcctaacatggacaaacactggattatgcagtatactggccccatgctacctatccatatggagtttacgaacatcctacagcgcaaacggctgcagacactcatgtccgtggatgatagcgtggaaagactgtataatatgctggttgagaccggtgagctggaaaacacgtacattatttatacagctgatcacggctaccacattgggcagtttggcctcgtgaaaggaaagtccatgccctatgacttcgatatccgggtgccgtttttcatccgcggcccatccgtggagccaggctctattgtgcctcaaattgtcctgaacattgacctggcccccacaatcctggatatcgcgggtctcgatacccccccagatgtcgacgggaagtcagtgctgaaacttctggatcccgagaaacctggtaaccgcttcaggaccaataagaaggctaaaatatggagggatacctttttggtggaaaggggtaaattcttacgcaaaaaagaggagtcctccaagaacattcagcaatctaaccaccttccaaaatacgagcgggtgaaggagctgtgtcagcaagctcggtatcagacagcgtgtgagcaaccgggacagaagtggcagtgtatcgaagatacatcaggtaagcttcggattcacaagtgtaagggacccagcgacctgcttacagtgaggcagtcaacccgaaacctatatgctcgcgggttccatgacaaagacaaggagtgttcatgcagagaatcgggttatagagcaagccgctcccagaggaagtcccaacgccaattcctgcgaaatcagggtacacccaagtataaacctcggtttgtccatacacgccagacgcggagcctgtcggtcgagttcgaaggggagatctacgacatcaatttggaagaagaagaggagcttcaggtactgcagccaagaaacatagccaagcggcatgacgaaggtcacaagggacctagagatctgcaggccagttctggaggcaatagaggccgaatgttggcagactcatcaaacgccgtgggacctcctactaccgtacgagttacccacaaatgctttatactgccaaatgacagcattcactgtgaacgcgagttataccagtccgcccgagcctggaaggaccacaaggcctacatcgacaaagagattgaggcactgcaagacaaaataaagaatctgcgggaggtccgcggccacctgaaaagaagaaaacccgaagaatgctcttgtagcaagcagtcttattataataaggaaaagggagtaaaaaagcaggaaaagttgaaatctcacctccatccttttaaggaggctgcccaggaggtggactcaaaactgcagttgtttaaggagaataatcgccggcggaagaaggaaagaaaggaaaaacgaaggcagcggaagggcgaagagtgttcactgcccggcctcacgtgttttactcacgataataaccactggcagacagcgcctttttggaatctaggttctttttgcgcctgtacttccagcaataacaacacatattggtgcttgaggacagtgaacgaaacgcacaacttcttgttctgtgagttcgccaccgggtttcttgaatacttcgatatgaacacagatccataccaactcacaaacaccgtccacactgtagaaagagggattctgaaccaacttcatgtacagttgatggagttgcgctcctgtcagggatataaacagtgtaatcccagacctaagaatctggacgttggaaataaggacggaggctcctatgacctgcatagaggccagttatgggacgggtgggagggctag

SEQ ID NO: 136516 - DNA, 2616 bp, Artificial Sequence
  Description of Artificial Sequence: Synthetic coding sequence
atgaaatattcatgctgcgccctggtgcttgccgtcttaggcacggagctcttaggtagcctctgctccactgtacgctcccccagatttcggggtagaattcagcaggaaaggaagaatataagaccgaatatcatcttagtgctgaccgatgaccaagacgtggagctcgggtccttgcaagtcatgaacaaaaccaggaagatcatggaacacggaggcgcaacctttatcaacgcatttgtcaccacccccatgtgttgcccaagcaggtccagcatgcttacagggaaatatgtccacaatcataatgtatacactaacaatgaaaattgttcttctccatcctggcaggcaatgcatgaaccccggacatttgctgtatacctcaacaatactggctatagaactgcattcttcggaaaatatttaaatgaatataacggaagttatattccaccaggttggagagagtggctgggtcttattaagaatagtaggttttataactataccgtatgccgtaacgggataaaagaaaagcacgggttcgattacgccaaggactatttcaccgatctcattacaaacgaatctatcaactattttaaaatgtcgaagcgaatgtaccctcacagacctgtaatgatggtaatttcccacgctgcgcctcatgggcccgaggactccgctcctcaattcagcaagctctaccctaacgccagtcagcatattactccaagctataattatgctccgaacatggacaaacactggatcatgcaatataccggccctatgctgcctatacacatggagttcaccaacatactgcaaaggaagagacttcagacgctcatgtctgtcgatgactccgtggagcgcttatataatatgctggtggagacaggtgaactggaaaatacttatattatctatacggccgatcacggatatcatattggacagttcgggctggtaaaaggcaagagtatgccctacgattttgacatccgagtacctttctttattcggggccctagcgtcgaaccaggcagcatcgttccgcaaatcgttctgaatattgacctggcccccactattcttgatatcgctgggctcgatacgcccccggacgttgacggtaaatcagtccttaaactgctcgacccggaaaagcccggcaatcgcttccggaccaacaaaaaggccaagatctggagggacacttttttggtcgaacggggcaagttcctgagaaagaaggaggagtcttcgaagaacatccaacagtccaaccatctccccaagtacgagagggtgaaagagttgtgtcagcaggccagatatcaaactgcatgtgagcagccgggccagaaatggcagtgcatcgaggacaccagcgggaagcttaggattcataaatgcaagggtccgagtgatctcctgacagttcggcaatcaacccggaatctgtacgcaagaggattccatgacaaagataaagagtgttcttgtcgagagagtggctaccgcgctagccgtagccagcgcaagagccagagacagttcctgagaaaccagggcacgcccaagtacaaaccgcgctttgtgcacaccagacaaactagatctctctccgtggaatttgagggagagatatatgacattaacctggaggaagaggaagaactacaggtcctacaaccaagaaacatcgcgaagcggcatgacgagggccataaggggccacgagacctgcaggcctcctcgggaggaaatagaggccggatgcttgcagactctagtaacgcagttggaccccctaccacagttagagtaactcataagtgttttatcctccctaatgactccatccattgcgagagggagctttatcagtctgctagagcatggaaggatcataaggcgtatatcgataaggagatagaggctttacaggacaaaattaagaaccttcgtgaagtgcgcggacacctgaagcggaggaagcccgaggagtgttcatgttccaaacaatcctattataacaaagagaaaggcgtcaagaaacaagaaaagttaaagtcacatttacacccattcaaagaggccgctcaagaggtggatagtaaattacagttatttaaagagaataaccgacgccgaaagaaggagaggaaggagaagcgtcggcagaggaaaggagaagagtgcagcctccctgggctgacctgctttacccacgacaacaatcactggcaaactgcacctttttggaatctggggagtttctgcgcctgtaccagttctaacaacaacacctactggtgtctgaggaccgttaatgaaacccacaattttttattttgcgagtttgctacgggattcctagaatacttcgacatgaacaccgacccataccaactgacaaatacagtgcatacagtcgagcgagggattctgaaccaactccacgttcagttgatggagctgcgatcctgccagggctacaagcagtgcaaccctaggcctaaaaatcttgatgtggggaacaaggacggaggatcctatgacctgcatagaggacagttatgggatggatgggaaggatag

SEQ ID NO: 136517 - DNA, 2616 bp, Artificial Sequence
  Description of Artificial Sequence: Synthetic coding sequence
atgaagtatagctgctgcgctctggtgctggctgtcttggggacggaacttctggggtcgctctgttcaacagtgagatctcctcgtttcagaggtagaattcagcaggaacgaaagaatatccgccccaacatcatcctggtgcttacagacgaccaggacgttgaattgggctctcttcaggtgatgaacaagacgagaaaaattatggagcacgggggcgccacgtttattaatgccttcgttaccacccccatgtgctgcccatctcgaagctcgatgttaacaggcaagtacgtgcataaccataatgtctacaccaacaacgagaattgctcctccccctcctggcaggcaatgcacgaacctaggaccttcgcagtttacctgaataacacgggatacaggactgcgttctttggtaagtatctgaacgagtacaacggctcttacatacctccggggtggagagagtggctgggcctcatcaaaaactctaggttctataattataccgtgtgccgtaacgggataaaagagaagcatggattcgactacgctaaggactacttcacggacctcataaccaacgaatctattaactatttcaagatgtcgaaaaggatgtatccacatcgacctgtgatgatggtgatttctcacgctgcccctcacggacctgaagacagtgctccccaattctcaaaactttatcccaatgcgtctcagcatataacaccgagctacaactacgccccaaatatggataaacactggatcatgcagtacaccggccccatgttgccaattcatatggagttcactaacatactgcagcgcaaacggctgcagaccctgatgagtgtggatgacagtgtggagagactgtataacatgcttgtggaaactggggaacttgaaaacacctacatcatctatacggctgatcatgggtatcacatcggacagttcggtcttgtcaagggcaagtctatgccttacgattttgacatccgagtgcctttcttcatccgtgggcccagtgtcgaaccaggcagtatcgtgcctcagatcgtcctcaatatcgacctggctccgacaattctagacatcgccggactggacacccctccagatgttgacggaaagagtgtgctcaagctgctagaccccgagaagcctggtaatcgatttagaaccaataagaaggccaagatctggcgagatacattcctggtcgagcgcggcaagtttctacgcaagaaggaagaaagctcgaaaaacattcaacagagcaaccacctgcccaaatacgagagggttaaggagttgtgccagcaggcaagatatcagacagcctgcgaacagcccggccagaagtggcagtgcatcgaagacaccagcggcaagttgaggatacataaatgcaagggcccttcagatttactcaccgttcgccagtcgacccgtaacctgtacgccaggggttttcatgacaaggataaggagtgtagctgtagggagtccggctatcgcgcctcaaggtcacagagaaagagtcaaaggcagttcctgcgtaaccagggtactcccaagtataagcccaggtttgtgcacacaagacaaaccaggagtctgtcagttgaatttgaaggggagatatatgatataaatttagaggaggaagaggagctccaggtgctccagccacgcaacatcgccaagcgtcacgacgaggggcacaagggtcccagagatttgcaggctagctcaggcggcaacagggggagaatgttagccgattcttctaacgcggtggggccacctacgaccgtgagagtgacccacaaatgcttcatcctgcctaacgactctattcactgcgaacgggaactgtatcagtcagcccgcgcctggaaggaccacaaagcatatatcgacaaagagatcgaggcactacaggacaagatcaaaaatctgagggaggtgcgcggacaccttaaacgaaggaaacctgaagaatgctcctgcagcaagcagagttattacaacaaggagaagggggtcaaaaaacaggagaagctgaaaagccacctgcaccctttcaaagaggccgcccaggaagtagatagcaaactgcagctcttcaaggagaataaccgtcgcaggaagaaggagagaaaagagaaacggagacaacgtaaaggagaggagtgtagtctgccaggcctgacatgcttcacccacgataacaatcattggcagaccgcccccttctggaacctcggaagtttttgcgcctgtactagctcaaacaacaacacctattggtgcctcagaacagtgaacgagacccacaactttctgttttgtgagtttgctacagggtttctggaatacttcgatatgaacacagacccctaccagcttactaataccgtccataccgtggagcggggtatcctaaaccaactgcacgtgcagctaatggaactgaggagttgccaaggatacaagcagtgtaatcctcggccaaaaaacctcgacgtggggaacaaggacggagggtcctatgacctacataggggccagctctgggacggatgggagggatag

SEQ ID NO: 136518 - DNA, 2616 bp, Artificial Sequence
  Description of Artificial Sequence: Synthetic coding sequence
atgaagtattcttgttgcgctctcgtcctggccgtgctcgggactgagctactaggctccctgtgctccacggtgcgttctcctaggtttagagggagaattcaacaggagcggaaaaacatcagacctaatattatcttagtcctgaccgacgatcaggatgtggaattgggctcgttacaggtgatgaataagacgaggaagatcatggagcatggcggagctacatttatcaacgcattcgtgaccacccccatgtgctgtcccagcaggtcatcaatgctgaccggaaagtacgtccacaatcacaacgtctatactaacaacgagaactgcagttccccaagctggcaggcgatgcacgagcctcgcacctttgcagtgtacctgaacaataccggatacagaactgccttcttcggaaagtatctgaacgagtataatggctcctatatcccgccggggtggcgcgagtggctgggcctgatcaagaattcaaggttctataattatacagtctgcaggaatggtataaaggaaaagcacggctttgattacgcgaaagattatttcacagatctaatcacaaatgaatcgatcaactacttcaaaatgagcaaaagaatgtacccccatcgacctgtcatgatggtcatctctcacgcggccccccacggtcctgaagacagcgcgccccagttttcaaagctgtaccccaacgctagccaacatattacgccttcctataactatgcgcccaacatggataagcattggatcatgcagtacaccggccctatgctgcctatccatatggagttcaccaatattctacagagaaagagactgcagaccctgatgagtgtcgacgacagcgtcgagagactgtacaacatgctggtcgaaacaggtgaactggagaatacttatatcatttataccgctgatcatgggtaccatattggacaatttggcttggttaaagggaagtccatgccatatgatttcgatattcgggtcccatttttcatcagaggaccctccgttgagcccggatctatcgtgccgcagattgtgcttaatatagacctggcccctaccatactggatatcgccggcctagacactcctccggatgtggatggaaaatccgtccttaagctcttagaccccgaaaagcctggtaaccggttccggacaaacaagaaggcaaagatctggcgcgatacattcctagttgagcgaggcaaattcttacgaaagaaggaagaatctagcaaaaatatccagcagtctaatcacctgcccaagtacgaaagagtaaaggagttatgtcagcaagcccgctatcagacggcctgtgagcagccaggacagaagtggcagtgcatcgaggatacgtcaggaaagctacgcatacacaaatgcaagggccctagtgacttgctgactgtgcgccaatcaacgcgcaacctgtatgctcgaggcttccacgacaaggataaggagtgctcttgcagggagagcggttaccgcgcaagtcgcagccaacggaagtcgcaacgccagttccttaggaaccagggaacacccaagtataaaccaaggtttgtgcacactagacagactcggtcactttcagtggaattcgagggggaaatctacgacataaacttggaggaagaggaagagctccaggtgctacagccaaggaatatcgccaaacggcatgacgagggtcataaagggcccagagatcttcaggcaagtagtggcgggaatcgtggcagaatgctggccgatagtagtaatgcagtggggccccctactaccgtccgggtgactcacaagtgcttcatcttgcccaacgattcgattcattgtgagagggaactgtaccagtccgcacgcgcctggaaggatcataaagcctacatagataaagaaatcgaggctctccaggacaaaattaagaatcttcgagaagtacgaggacacctcaagcgacggaagcccgaggagtgctcctgctccaagcagtcctactataataaggagaagggcgttaaaaagcaagaaaagctgaagtctcaccttcaccccttcaaggaagctgcccaggaagtagactcaaagctacagctgttcaaagagaataataggaggaggaaaaaagaaagaaaggagaaaagaagacagcggaaaggggaagaatgcagcctgcccgggctgacttgcttcacccacgacaataaccactggcagaccgcacctttctggaacctgggcagtttctgtgcatgcacatccagcaataacaatacttactggtgcctcagaaccgtgaacgagacccacaactttcttttctgcgagtttgccaccggttttctcgaatactttgatatgaacacggatccctatcagctcactaatactgttcacaccgtggagcgtggtattttaaaccagctccacgtacagctgatggagctgcggagctgccagggctacaaacaatgcaacccacgcccaaaaaacttggatgttggtaataaagatggcggctcgtacgatctgcacagagggcagctgtgggatggatgggagggttag

SEQ ID NO: 136519 - DNA, 90 bp, Artificial Sequence
  Description of Artificial Sequence: Synthetic coding sequence
atgaaatactcttgctgcgctctagtgctggcggttctgggtaccgaactcctgggttccctgtgttcaaccgtgagatcacctagatag

SEQ ID NO: 136520 - DNA, 519 bp, Artificial Sequence
  Description of Artificial Sequence: Synthetic coding sequence
atgaagtacagttgctgtgcactggtgctggctgtgttgggaacagaactcctaggcagcctctgttctactgtccgtagtccacgtttcagaggtagaatccagcaggagcgcaaaaatattcgccctaacatcattttagtcttaactgacgatcaggatgtggaactggggtctctccaggtgatgaataaaacccggaaaatcatggagcacggcggcgccacgtttatcaatgcatttgtaacgacaccaatgtgttgtcctagccgcagctctatgctgaccgggaagtacgtacataatcacaacgtttatactaacaacgaaaattgcagctctccttcatggcaagcaatgcatgagccccgaacctttgcagtgtatttgaacaataccggctaccggacagcctttttcggaaaatatctgaacgagtacaatggaagctatatccctcccggctggcgcgagtggttggggttgattaagaatagtaggttttacaactacacctag

SEQ ID NO: 136521 - DNA, 231 bp, Artificial Sequence
  Description of Artificial Sequence: Synthetic coding sequence
atgaaatacagttgttgtgctctcgtcctggccgtcctgggaaccgaactattaggctcactttgcagtacagtgcgatcaccccgattcagaggcaggatacagcaggagagaaaaaatatcaggccaaacatcatcctggttctcacggacgaccaagatgtagaactggggtcactgcaggtaatgaacaaaactcgcaagattatggagcatggaggcgccacatag

SEQ ID NO: 136522 - DNA, 258 bp, Artificial Sequence
  Description of Artificial Sequence: Synthetic coding sequence
atgaagtattcttgctgtgcgctagtccttgcagttctgggcactgagcttttaggcagtctttgctcaacggtacgctcgccccgttttcgggggaggatccagcaggaacggaaaaacattcgccccaacattatcctggttttgacagatgaccaggatgtcgagcttgggtccttacaagtgatgaacaaaacacggaagatcatggaacatgggggcgccacattcataaatgcgtttgtgactaccccctag

SEQ ID NO: 136523 - DNA, 171 bp, Artificial Sequence
  Description of Artificial Sequence: Synthetic coding sequence
atgaagtacagctgctgtgcccttgtgctggcagttctcggcaccgaactgctgggatcattatgcagtactgtaagaagtccaaggttccgggggaggattcagcaggagcgaaaaaacatccggccaaatatcatcctggtgctcaccgacgatcaggatgtagagtag

SEQ ID NO: 136524 - DNA, 2613 bp, Artificial Sequence
  Description of Artificial Sequence: Synthetic coding sequence
atggggccaccaagtctggtgttgtgtttactgagtgcgactgtcttctcgttactgggcgggtccagcgccttcttgtcacaccaccggctgaaaggtcggtttcagagggatcgacgcaatatacgacctaacattatcctggtgctaacggatgaccaagatgttgaactgggaagcatgcaggttatgaacaagactagaaggatcatggaacagggaggcgcccatttcatcaacgcctttgtgacaacccctatgtgctgcccgtccagatccagtatactgacagggaagtacgtacataatcacaacacctacacaaacaacgagaattgttcctctccatcgtggcaagcccaacatgagtcacggacctttgcagtgtatttgaactcaaccgggtaccgcaccgctttcttcgggaaatacctgaacgagtacaacggatcttatgtgccccctggctggaaggagtgggtgggcttactgaagaatagcagattttacaattacaccctttgtcgaaatggcgtcaaagagaagcacggcagcgactactccaaagactacctgaccgacctgatcaccaacgattccgtttcattctttaggacgtcgaagaaaatgtatccacaccggccagtcctgatggtaatttcgcacgcagctccgcatgggcctgaggattcagccccccagtacagcagactgtttccaaacgccagtcaacacattaccccatcttacaattatgccccaaacccagacaaacattggatcatgaggtacacgggccccatgaagccaatccacatggaattcactaacatgttgcaaagaaagcggctacagaccctgatgagcgtcgacgactccatggaaaccatctataatatgctagttgagaccggagagctcgacaacacgtatatcgtatacaccgccgaccacggataccatatcggccaattcggactggtcaaaggaaaaagcatgccctatgaattcgacatccgcgtgcctttttacgtgagaggaccgaatgtggaggcaggttgtctgaatcctcacatcgtgttgaacatcgacttggcaccgacaattctggatattgccggactggacattcctgcagacatggacggaaagtcaattctgaaactgctggacaccgagcgacccgtcaatcgtttccaccttaagaagaaaatgagggtctggcgggatagcttcctggtggagagggggaagctgcttcacaagcgcgacaatgataaggtggatgcccaggaagaaaactttcttcccaagtaccagcgcgtcaaagatttatgccagcgagccgaatatcagaccgcatgcgagcagctcggccagaaatggcagtgtgtggaagacgccacggggaagctcaagctgcataagtgtaaaggtccgatgaggctgggcggctcacgtgccctgtccaacttggtgcctaagtattatggccagggcagcgaggcctgtacctgtgacagcggtgattacaaattgtctctggctggaagacgaaagaagctattcaagaagaagtataaggcaagttacgtccgatctcgcagtatcaggtctgtcgccattgaagttgatggccgggtgtatcacgtgggcctgggcgatgctgctcagccaagaaatttgaccaaacgccactggcctggtgccccggaggaccaggacgataaagatggaggtgacttttcaggaaccggcggccttcccgattactctgcggcgaaccccatcaaagtcactcaccgctgctatatacttgaaaacgatacggtacagtgtgacttggacctgtacaagagccttcaagcatggaaagatcacaaactccatattgatcatgaaatcgagacgttgcagaacaaaattaagaatttgagggaagtcagagggcaccttaagaaaaagcgacctgaagagtgtgattgccacaagataagttaccacactcaacacaaaggtcgtctcaagcatcgtggctctagcctgcacccattcaggaaaggcttacaagagaaggacaaagtgtggcttctgagggagcagaagcggaagaaaaagctacggaaattgctcaaacggctgcaaaacaatgacacgtgctctatgccgggactcacatgttttactcatgacaaccagcactggcagaccgcgcccttctggaccctaggtcctttttgtgcatgtaccagcgcaaataataacacatactggtgcatgcgaaccattaacgaaacacacaactttctgttttgcgaatttgcaaccggattcctggaatactttgatctcaacactgacccttatcagttgatgaatgccgtcaacaccctggatcgcgacgtcctgaaccagcttcatgtgcaactgatggagcttcgaagctgcaaaggctacaagcaatgtaatcccagaacacgcaacatggacttggggttaaaggatgggggctcctacgaacagtataggcagttccaaaggcggaagtggcccgagatgaagcgaccttcctctaaaagcctgggacaactttgggagggatgggagggttag

SEQ ID NO: 136525 - DNA, 2559 bp, Artificial Sequence
  Description of Artificial Sequence: Synthetic coding sequence
atgggaccacctagtcttgtattgtgcttattaagtgctacagtgttctcactgctgggcggctctagcgcttttctctctcaccacagacttaaaggacgattccagcgcgatcgtcgaaacatcaggccaaatatcatcttggttttgactgacgaccaagatgtagaactggggtccatgcaagtgatgaacaagacacgcaggataatggagcaggggggggcccatttcattaacgcgtttgtcaccacccccatgtgttgcccatcacggagctctatacttactggaaagtatgtacataatcacaatacatacacaaataatgaaaattgtagcagtccttcctggcaggcgcagcatgagtctcgcacgtttgccgtgtatctgaacagcaccggctaccgcacagctttctttggtaagtatctgaacgaatataatggcagctatgtgcccccaggatggaaagagtgggtgggtcttttgaagaacagtcgtttctacaactatacactgtgcagaaatggggtgaaagagaagcacggcagcgactatagtaaggattatctgacagatctcatcacgaacgacagtgtgagctttttccggacttcaaaaaagatgtatccccaccgccccgtcttgatggtgatatctcacgctgctccccacggacctgaggactccgcaccgcagtactcccgccttttcccaaatgcctcccagcacatcactccatcttacaattatgcccccaaccccgacaagcattggattatgagatacaccgggcctatgaagccaatccatatggagttcacaaatatgttacagaggaaacgcctgcagaccttgatgtcggtagacgattcgatggagacaatctacaatatgctggtagaaaccggagaacttgacaatacttacattgtgtatacggctgaccacggctatcacataggccagttcgggttggttaagggtaagtcgatgccatacgagttcgacatccgcgtccctttctacgtccggggtcctaacgttgaagccggatgtctcaatcctcacatcgtgctaaacatcgatctcgcccctactatcttggacatcgcaggtttggatattcccgcagacatggacggtaaaagtatcctgaagctgctcgatacggagcggcccgtgaatcgctttcacttgaagaaaaagatgcgtgtgtggcgcgatagcttcctggtcgagcgaggcaagcttctccataagagagacaacgacaaggtcgacgcccaggaggaaaatttcttgccaaagtatcaaagggtcaaggacctctgccagcgcgccgaatatcagaccgcatgcgaacaattgggacagaagtggcagtgcgtcgaagacgccacaggaaaactgaagttgcataagtgtaagggtcccatgcgtctgggagggagccgtgctctgtcaaacttagtgcctaaatattacggacaagggtccgaggcctgcacatgcgactcaggcgactataagctgtccctcgccggtcgaagaaagaagctattcaagaagaagtacaaagcttcatacgtccgctctcgctcaatccgaagcgttgcgatcgaggtcgacggacgtgtgtaccatgtgggcttgggcgacgcagcccagcccagaaacttaacaaagaggcattggcctggcgctcctgaggatcaggacgataaggacgggggtgatttcagcgggacgggaggactgcctgactattcagctgcaaatcctattaaggttactcaccgatgctacatccttgaaaacgatactgttcagtgcgacttggacttgtataagtcactacaggcttggaaggatcataagttgcacatcgaccacgaaatagagacactacagaacaaaatcaagaatctaagagaggtgagggggcatctgaaaaaaaagcggcccgaggaatgcgattgccacaagatcagctatcatacccagcataagggacggctgaagcaccgcggaagcagccttcacccattccgtaagggcctccaggagaaagacaaggtttggctgctccgcgaacagaaaaggaaaaagaaactgagaaaactcttgaaacgtcttcagaacaatgatacttgtagtatgccaggtctcacctgtttcactcatgataatcaacattggcagaccgccccattttggacactggggcccttctgcgcctgtacaagcgcaaacaacaacacctattggtgtatgcggacaattaatgagacccataatttcctgttctgcgaattcgccactggattcctggaatattttgaccttaacaccgatccctaccaactcatgaatgccgtgaatacgttggacagagacgtgctgaaccagttgcacgttcaactgatggagctgaggtcgtgtaagggctacaaacagtgcaacccacgaacgaggaatatggacctgggtctgaaggatgggggttcttacgagcagtacagaggacagttgtgggagggctgggagggttag

SEQ ID NO: 136526 - DNA, 870 bp, Artificial Sequence
  Description of Artificial Sequence: Synthetic coding sequence
tttagtggtactggaggcctgcccgactactccgccgctaaccctattaaggtcactcataggtgttacatcttggagaatgacacagtacagtgcgacctggacctctacaaatctctgcaagcctggaaggaccacaagctacacattgaccacgagatagaaaccctacagaataaaatcaagaatctccgggaggtccgcggccatttaaagaaaaagcggcccgaggaatgcgactgccataagatatcataccacacacagcacaagggcagacttaagcatcgggggagcagtctccacccgttcagaaagggcttacaggagaaagataaggtgtggcttctgcgggagcagaagcgtaagaaaaagctgcgcaagttattgaagaggctgcagaataatgacacctgctcgatgcccggactaacctgctttacacacgataaccagcactggcagacggccccattttggaccctcggtccattctgcgcctgcacatccgctaacaacaacacctattggtgcatgaggactattaatgagactcacaattttctcttctgtgaatttgctaccggttttctcgagtacttcgacctaaataccgacccgtaccagctgatgaacgcagtgaatacgcttgatcgtgacgttttaaatcagctgcacgttcagctgatggagctcagatcttgcaaaggatacaaacagtgcaatccaaggacacgaaacatggacctaggactgaaagacgggggatcctacgagcagtacaggcagttccaacgccggaagtggcctgaaatgaagagaccttcgagtaagtcccttggtcaactctgggagggatgggagggttag

SEQ ID NO: 136527 - DNA, 2604 bp, Artificial Sequence
  Description of Artificial Sequence: Synthetic coding sequence
atgggcccacccagcttagttctatgtctcctgtcggccactgtcttcagcctgttaggcgggagctctgcatttctgagtcatcatcgtctcaaagggcgttttcagcgtgacagacgcaacatcagaccgaacattatactggtactcactgatgatcaggacgttgaactaggctctatgcaggttatgaacaaaactcggcgcattatggagcaaggcggtgctcattttatcaatgccttcgtcactacccccatgtgctgtcccagcaggtcctccatcctcactggcaaatatgtccataaccacaacacatatacaaataatgaaaactgctccagcccgtcatggcaggcacagcacgaatctcgcacctttgctgtctaccttaacagcaccggctaccgcaccgcattcttcggcaagtacctcaacgagtacaacgggagctatgttcctcccggctggaaggagtgggttggtctccttaagaacagcaggttctataattacaccttatgtcggaatggggtgaaggagaaacacggcagcgattattcgaaggattacctgactgacctgatcacaaacgacagcgtcagcttctttagaacttctaagaagatgtacccacaccggccggtgctaatggttattagtcacgcagctccgcacggccccgaggacagtgctccccaatacagcaggctgtttccgaatgccagtcagcacatcaccccaagctataactacgctcctaatccggacaagcattggatcatgcggtacacgggccccatgaaacctatccacatggagttcactaacatgctgcaacggaagagactgcagactttgatgtcagtcgatgattcaatggaaactatttataacatgttggtggagactggcgagctggataatacttatatcgtctacactgccgaccatggatatcacattggccaatttgggctggtcaagggaaagagcatgccttatgaatttgacattagagttccattttacgtccgaggacctaatgtcgaagctggttgcctgaaccctcacattgtgcttaacatagacctagcccccacgattctggatatcgcagggctggacattccagcagacatggatggcaagtctatactcaaactgttagacaccgaaagaccggtaaacaggttccaccttaagaaaaaaatgcgggtgtggagagactcatttctggtagaacgagggaaacttttgcataaaagggacaatgacaaggtggatgcacaggaagagaacttcctaccaaagtatcaacgcgtgaaggatctctgccagcgtgctgagtatcagacggcatgcgagcagcttggtcagaaatggcaatgtgtcgaagatgctactggaaagctgaagttgcacaaatgcaaaggcccgatgcggctgggcggttctcgtgccctgtccaatttggtcccaaaatactacggacagggctccgaggcttgtacatgcgattcaggcgattataagctttctttggcgggtagacgcaagaagctgtttaagaagaaatacaaagcgtcatacgtgcggtccagatctattaggtctgttgccatcgaggttgatggccgggtttatcatgtcggcctgggagacgccgcacagccccggaacctgaccaagcggcactggccaggagctccagaggatcaggacgataaagacggaggtgacttttcaggcaccggtggcctccccgactatagcgccgctaaccccatcaaagtgacacatagatgttacatcttggaaaatgacacagtgcagtgtgatttggatctctataagagcctccaggcatggaaagaccacaagctgcacatagatcatgagatcgaaactctgcagaataagatcaaaaacctgagagaggtcaggggccacttaaaaaaaaagagacctgaggaatgcgactgtcacaagatcagctatcacacccaacacaaaggaaggttgaaacaccggggaagtagcttacatccgtttcgcaaagggttgcaggagaaggataaagtgtggctgttaagggagcagaagcgtaaaaagaagttacgtaaactcctgaagagactgcagaataatgacacatgcagcatgccgggtttgacgtgcttcactcacgacaatcagcactggcagaccgctccattttggacgttgggacctttctgcgcctgtacctctgccaacaataacacatactggtgtatgcggactattaatgaaactcacaatttcctcttttgtgagttcgccacaggtttcctggagtatttcgacttaaatacagatccctaccagttgatgaatgctgtcaacaccttggatcgggatgtcctgaaccagctgcatgttcagctgatggaactaagatcgtgcaaggggtataagcagtgcaatcctcgcacaaggaatatggacttggacggagggagctatgagcaatataggcagttccagcggcggaagtggccggaaatgaaacgtccgagttctaaatcactgggccagctgtgggaggggtgggagggctag

SEQ ID NO: 136528 - DNA, 2613 bp, Artificial Sequence
  Description of Artificial Sequence: Synthetic coding sequence
atgggtccaccttccttagttctgtgtctcctttctgcaacagtgttctcccttctgggtggaagctcagccttcctaagtcatcatagactaaagggcaggtttcagagagaccgcaggaatatccgacccaacatcattcttgtgctgaccgacgaccaggatgtggagctcggttccatgcaagtgatgaacaagacccggcgtattatggagcaaggcggggctcactttatcaacgcttttgtgaccaccccaatgtgctgtccatcccggtccagcattctcactggcaagtacgtgcacaatcacaacacctatactaataacgagaactgttcaagcccttcttggcaggcccagcatgagagtcgtacatttgccgtctatttgaactcaactgggtaccgcaccgccttcttcggtaagtacttgaacgaatacaacgggtcttatgtgccgcccggctggaaggagtgggtggggctgcttaagaactcccgattttataactataccttatgtcgcaacggcgtgaaggagaagcacggttccgactattcgaaggattacttgacagatctgatcacgaacgattctgtgagcttctttagaacatccaaaaaaatgtacccccataggcccgtgttaatggtcatttctcatgccgcacctcatgggcctgaggactccgctccacaatacagccgcttgtttccaaacgcatctcagcatatcacacccagttataactatgctccaaatccggacaagcattggatcatgcggtacacaggacctatgaagccgatccatatggagtttacaaacatgctgcagaggaagcggttacagacactgatgtcggtggatgatagcatggagaccatctacaacatgctggtcgagaccggtgaactagataatacctatattgtgtacaccgctgatcatggatatcatatcggccagtttggcttggtcaagggtaagagcatgccatatgaattcgacataagggtacctttctatgtgagaggccccaacgtggaagccggttgtctcaacccccacatcgtgttgaatatcgaccttgctcctactatactcgacatcgccggcttagacatcccagccgacatggatggtaaatccattttaaaattgttggacaccgagaggcccgttaataggtttcacctcaaaaaaaaaatgagagtgtggcgcgattcctttctcgtggagcggggcaaattattacataagcgggacaacgataaggtggatgcgcaggaggaaaactttctgccaaagtatcagagggtgaaggacctgtgccaacgagccgagtaccagacagcttgcgagcaactgggacagaagtggcagtgcgtggaggatgcaaccggcaagctcaagttgcacaagtgcaaagggcctatgagactcggcgggagccgggcgctgtcgaacctggttcctaagtattacggtcagggatctgaagcttgcacctgcgacagcggtgattataagctgagcctcgccggaagacgtaagaagctgttcaaaaagaagtataaggcgtcttacgtgcgcagtcggagtatcagaagtgtcgccattgaggtcgatggacgcgtgtaccacgtcggtctcggcgacgctgcccagcccaggaacttgactaagaggcactggcccggggcgcccgaggaccaggatgacaaggatgggggggacttttctgggacaggaggcctgccagattactctgctgccaatccaatcaaagttacccaccggtgttatattctggaaaacgacaccgtacagtgcgacctagacctgtataaaagcctccaagcctggaaggaccataaactgcacatcgatcatgaaatagagacgcttcagaacaagatcaaaaatctacgggaagtgagaggtcacctcaagaagaaacggccagaggaatgcgactgccacaaaatttcataccatactcagcacaagggtcggctgaagcacagaggcagtagcctgcacccatttcgcaaaggactccaggagaaggataaggtgtggttattgcgcgagcaaaagcggaagaagaaattgcggaagctgctgaaaagacttcagaataatgatacttgttccatgcccggtctcacatgcttcacccatgataaccagcactggcagacggcccccttttggaccctcggacctttctgcgcctgcaccagcgccaacaataatacctattggtgtatgcgcaccattaatgagacccacaattttcttttttgtgagttcgctaccggcttcctcgagtactttgatctgaatacagacccatatcagttgatgaacgcagttaacacactcgaccgagacgttctgaaccagcttcacgtgcagttgatggagctgcggtcttgtaaggggtacaagcaatgcaaccctcgcacacgcaacatggacttgggactgaaagacggaggatcctatgagcagtaccggcaatttcaaagaaggaagtggcctgagatgaagcggccttcgagcaagtccctcgggcagctctgggagggctgggaggggtag

SEQ ID NO: 136529 - DNA, 1125 bp, Artificial Sequence
  Description of Artificial Sequence: Synthetic coding sequence
atggccgccccagctctggggctggtttgcggaaggtgtcccgaactggggctggtcctgctgctccttctgctctctctgctctgcggtgcagccggatcccaggaggcggggactggtgcgggagctggctctctggcgggctcatgcggctgtggtacccctcagaggcctggcgcacacggttcttcggcagctgctcatagatatagtcgcgaggctaatgcaccgggcccagtgccaggggaacggcagctggctcattctaagatggtgcctatccccgccggtgtcttcaccatggggaccgacgatccccagattaagcaagacggcgaggctcctgctcgacgggttacaatcgacgctttctacatggacgcttatgaagtgtctaatactgagtttgaaaaattcgtgaatagcacaggctatctaactgaagccgagaaatttggggactctttcgtgtttgagggaatgttatcagaacaggttaaaacaaatattcagcaagctgtggctgccgctccctggtggctgccagtgaaaggagccaactggaggcacccagaaggcccagattcaactatcctacatcgccccgatcatccagttcttcatgtgtcatggaacgacgccgtcgcttattgcacatgggcaggtaagcggttgcccacggaggccgaatgggaatattcatgcagagggggccttcacaaccgtctgtttccatgggggaacaaactgcagcccaagggtcagcactacgccaacatttggcaaggggagttccccgtcaccaatacgggcgaggatgggtttcagggaaccgctccagtggatgcattccctcctaatgggtacggcctgtacaatatcgtcggcaacgcgtgggagtggacaagcgattggtggactgtgcatcatagtgtggaggagaccctcaaccctaaggggcccccaagcggtaaagatcgggtgaagaaggggggcagttatatgtgtcatcgctcttattgctaccgctaccggtgtgctgccaggtctcagaatacccctgactcctccgcctctaatctaggatttcgctgtgccgctgacagactgcctacaatggactag

SEQ ID NO: 136530 - DNA, 1281 bp, Artificial Sequence
  Description of Artificial Sequence: Synthetic coding sequence
atggcagcccctgccctggggctggtgtgtgggaggtgccctgaacttggcttagttcttctgctgctattgttaagcttgctctgtggcgccgcagggagccaggaggctggcacaggagctggagctggctccctggccggcagttgcggttgcggtactccgcagaggcccggagcccatgggtccagtgccgcagcacatcggtactctagggaagccaacgcacccgggccggtccccggggagaggcaactggctcacagcaagatggttcccatcccggccggggtgttcacaatgggaacagacgacccgcagatcaaacaggatggagaggctcctgccagaagagtgacaattgacgcattttatatggatgcctatgaggtctctaataccgagtttgaaaagttcgttaattccacaggctatcttactgaggctgaaaagtttggagactccttcgtgtttgagggtatgctcagtgagcaggtgaaaacaaatattcaacaggctgtcgccgccgcaccctggtggctacctgtgaaaggcgcgaactggcgtcaccccgagggaccggatagcactatcttacacaggcccgatcatccagtcttgcacgtctcttggaatgacgcggtggcttattgcacctgggccgggaaaaggttgcctaccgaggccgaatgggaatatagctgcagaggcggcttacacaataggttgttcccatggggcaacaagctgcagccaaaaggccagcactacgccaatatttggcagggggaatttcccgtgaccaacacgggtgaggacggattccagggtaccgctccagtggatgcattccctcctaacggctatggcctgtacaatatcgtaggcaacgcgtgggaatggacatctgactggtggaccgtgcaccattctgttgaagagaccctcaacccgaaagggccgccctccggaaaagatagggtgaagaaaggcggatcttacatgtgtcataggtcccaagaatattacgatccatattttcaggatgtcgcctcagagatgctccgtcggcataccgctagccgctggaaagctttcagcagtctggagccctgctgcagtatccggaggcatcagcagtatgccgccatcgagagactgacttgcgggaagttcgaactccggtgtgcgtccctacgaaaaatagattgtctgaacacaaatattgcttgcagttattcaatgcggcaggatgggccacgcttgcactgcgtggactag

SEQ ID NO: 136531 - DNA, 1287 bp, Artificial Sequence
  Description of Artificial Sequence: Synthetic coding sequence
atggcagctcccgccctcgggcttgtgtgtgggaggtgccctgagctagggctcgttctgctccttttgcttctgtccctgctttgtggcgctgccggttctcaagaggccgggaccggtgcgggagccggatctctggccggatcttgtggttgtgggactccgcaacggcctggggcccatggcagctctgcagcggcacatcgctatagccgggaggccaatgctccgggtcccgtgcccggggaacgccagctagctcactcaaaaatggttcccatacccgcgggggtgttcacgatgggcaccgacgacccccagatcaaacaggacggggaagcgcccgccaggcgagtcaccatagacgcattttatatggatgcttacgaggtgtcaaataccgagtttgagaagtttgtgaacagtacaggatacctgactgaggctgaaaaattcggtgacagtttcgtgtttgaaggcatgctatccgaacaagttaaaacaaatattcaacaggccgtggcggcggctccctggtggctgcctgtgaagggcgcgaattggcgccacccagaaggcccagactccactattctgcaccgcccagatcatcctgtccttcacgtgagctggaatgacgccgtggcctattgcacttgggcgggaaagaggctaccaacagaggctgagtgggaatacagttgcagaggcgggctgcacaacagactgtttccctgggggaataaattacagcccaagggacaacattatgccaacatctggcaaggcgagtttccggtgactaatacaggggaagatggattccagggcaccgccccagtggatgcattccctcccaacggctatggcctgtataatatcgtgggcaatgcctgggagtggacctcagattggtggacagtgcaccatagcgttgaggagacgttgaaccctaaagggcctcccagtgggaaagaccgggttaagaaggggggccttagtaaagcccatcaaagaattagccaggaatactatgacccctactttcaagatgtcgccagcgagatgcttagacggcacactgcaagtagatggaaggcgttttcttcacttgagccctgttgctcgataagacgtcatcaacagtacgccgccattgaaagattgacttgtgggaagtttgaattgcgttgcgcgagcctgcggaagattgactgccttaatactaacatagcgtgtagctatagtatgcggcaggacgggcctaggcttcattgcgtcgactag

SEQ ID NO: 136532 - DNA, 1050 bp, Artificial Sequence
  Description of Artificial Sequence: Synthetic coding sequence
atggcggccccggcactgggcttagtttgtggccgctgtcccgagcttggcttggtacttctgctgctccttctttcactgctctgtggcgcagcaggctcccaggaagccgggacaggcgcaggagcaggatccctggctggcagttgcggctgcgggaccccccagaggcccggagcgcatgggagtagcgctgccgcccaccggtactcccgcgaagccaatgcacccggccccgtcccaggagaacggcagcttgctcacagcaaaatggtgccgatccctgctggggtatttacaatggggacagacgatccacaaataaaacaagatggcgaggcaccggcccggcgcgtgactattgacgccttctatatggatgcttacgaagttagtaacaccgagtttgagaaatttgtgaacagcacaggctacctcaccgaagtcgccgctgccccatggtggctgcccgtgaaaggagccaattggcgacaccctgaaggcccagactctaccattttacacaggcctgaccatccggtcctgcatgtttcctggaacgatgcagtcgcctattgtacgtgggccgggaaacgcttacctacagaggcagaatgggaatactcctgcagggggggcctccataaccgactgttcccatgggggaacaaactgcaaccaaaaggtcagcactacgctaatatctggcagggtgaatttcctgtgacgaacactggtgaggatgggtttcagggcacagcccccgtagatgcgttccccccgaacggatatgggctgtacaatattgtcggcaacgcctgggaatggacaagtgattggtggacggtacatcacagtgttgaggaaaccctgaatcctaagggacctccctctggtaaggatagggttaagaaaggcgggtcctatatgtgtcatcgttcctattgctatcgatatcgatgtgctgctcgcagccagaatacacctgattcgagcgcctccaacttaggttttagatgcgctgccgatcgtcttcctactatggattag

SEQ ID NO: 136533 - DNA, 1065 bp, Artificial Sequence
  Description of Artificial Sequence: Synthetic coding sequence
atggcagcgcccgcccttgggctggtgtgcgggcgctgcccagagctggggctggtccttctgctgctgttgctcagtctcctgtgtggagcggctggtagccaggaagcgggcacaggcgcgggagccggatcccttgccggttcctgtggatgtggaaccccacagcggccgggggcgcacgggtcctctgctgctgcccaccggtattcacgggaagcaaacgcacctggacccgtcccaggcgagcgacagctagcacactctaaaatggtgcctatccctgccggagtatttaccatgggtaccgacgatccacaaattaagcaagatggagaggcccctgcccgcagggtgacaatcgatgccttctatatggatgcttatgaggtgtctaacactgaattcgaaaaatttgttaacagcactgggtatctaacagaggctgaaaagtttggagacagctttgtgttcgaaggtatgttaagcgagcaagtgaagacgaacatccaacaggcagttgccgctgccccttggtggctgcccgtgaagggtgccaactggaggcaccctgaaggacccgactcgacaattctccaccgacccgaccatccagtcctgcatgtgagctggaacgatgccgtggcctattgcacgtgggctggtaaacgactccctacagaggccgaatgggagtatagctgccgaggtggccttcataatagattgtttccctggggcaataagctccagcctaaaggacaacactacgccaatatttggcagggcgagttcccagtcaccaatacgggggaggatggttttcagggaacggccccagtagacgcctttccccccaatggctacggattatataatattgtgggaaatgcttgggaatggacctcagactggtggaccgttcaccacagcgtggaagagacactcaacccctcttactgttataggtatcgctgcgctgcccgctctcaaaatacgcccgacagcagcgcttcaaatttggggttccgatgtgcggcagaccggctgcctaccatggactag

SEQ ID NO: 136534 - DNA, 1638 bp, Artificial Sequence
  Description of Artificial Sequence: Synthetic coding sequence
atgttgctgttacaccgcgcagtcgtcttgcgcctgcaacaggcgtgccgactgaaatctatcccttccaggatctgtatccaggcctgctccaccaatgactcttttcagccacagcggccaagcctcacgttctctggtgataacagctcaacacagggctggagggttatggggacattgcttgggcttggtgccgttttagcttaccaggatcatcgatgtagggccgcgcaggagagcactcacatctatactaaagaggaagtcagttcacatacctccccagaaactggcatctgggtcaccctgggctcagaagttttcgatgtaacagagttcgtggacctgcatccgggcgggccttctaaattaatgctggccgccggcggaccactggagcctttctgggccctctacgcagtccataaccaatcccatgtccgggagttattggcacagtataagattggcgagctcaaccctgaggacaaagtggctccaacagtagagaccagcgacccctacgccgatgacccagtgcgtcatccagcattgaaggttaatagccaacgccctttcaacgcagaacctccccccgagctgctgacagaaaattacataacccctaaccccattttctttacccgaaatcacctgcctgttcctaacctggaccctgacacttacaggttgcacgtcgtcggagctcccgggggccaatcactctccttgtctttagacgacctgcacaatttcccgaggtatgaaataactgttacgcttcagtgtgccggaaaccgaaggtccgagatgacccaggtcaaggaggtgaagggcttggagtggagaactggggcaatcagcacagcgcgctgggccggagctaggttatgcgacgtgctggcccaggccgggcaccagctttgtgaaaccgaagcacatgtctgtttcgagggtctggactctgatccaaccgggactgcttacggtgcaagcattccgctggcccgcgcaatggatccagaggctgaggtgctcctcgcctatgaaatgaacggtcagccattaccccgcgatcatggatttcccgtgcgggtggtggtgccaggggtggttggcgcgcgacacgtgaaatggctcggcagagtctcagtgcagcccgaggagtcttactcccactggcagaggagagattataaagggttctccccctccgtcgattgggaaacagttgactttgatagtgcaccaagtattcaggaactgcctgtgcagagcgccattacagagcctcgagacggagaaaccgtagaatccggagaggtgaccataaaaggctatgcctggagcggcggcgggagagcagttatcagggtggacgtgagcctggatgggggactgacatggcaggtggccaaattggatggcgaagaacagagaccacggaaagcctgggcttggcggctttggcagctaaaggctcccgttccggcgggtcagaaggagctaaatatcgtgtgcaaagcagtcgatgatggttataatgtccagccagatactgtggccccaatctggaatttgcggggcgttctcagcaatgcctggcatagggtgcacgtgtacgtgtccccctag

SEQ ID NO: 136535 - DNA, 1638 bp, Artificial Sequence
  Description of Artificial Sequence: Synthetic coding sequence
atgttactgttacaccgtgccgttgtgctgaggctccaacaggcgtgtcgtctgaagtctatacctagtagaatatgcattcaggcatgtagcacgaacgatagttttcagccccagcgcccatcactgaccttttctggtgataattcctctacccaggggtggcgtgttatgggtaccctactcgggctaggcgccgtgttggcataccaggatcataggtgcagagcagcacaggaaagcacccacatttatacaaaagaagaagtgtcgagccacaccagtcctgaaaccggcatatgggtcactctgggatccgaagtgtttgatgttactgagtttgtggacttacatcccggcggtccttcaaagttgatgctggcggccggtggccctctcgaaccattctgggccctgtatgcggtgcacaatcagtcccacgtgcgcgaactgctggcacagtacaagatcggggagctgaatcccgaggacaaggtggccccaactgtggagacgagcgatccatacgcggacgacccggtgcggcacccggctctgaaagtaaacagccagcggccattcaatgccgaaccgcctccagaattgctgacagagaattacataacaccaaacccgattttcttcacacgcaatcatctgcctgtcccaaatcttgatcccgacacataccggttacatgtggtaggtgctccaggcggtcagagcttgagccttagtctggacgatttacataacttcccgaggtatgagataaccgtgacccttcagtgcgccggaaatagaaggtcagagatgacccaggtcaaggaggttaaggggttagagtggaggactggtgccatttctactgcgcggtgggctggcgccaggctctgcgatgttctggctcaagctggccaccagctatgtgaaacagaagcccatgtctgcttcgaaggcttggactccgaccccactggtaccgcttacggagcaagtataccgctggctcgcgccatggaccctgaggcggaagtcctgttggcttacgagatgaatggccaaccgcttcccagggatcatgggttcccagtgagagtcgtggtaccgggagtggtgggggcgcggcacgtgaagtggcttggaagggtttctgttcagcctgaggaaagctactcccattggcaacggcgggattacaagggattctctccctcggtggattgggaaacggtcgattttgacagcgcaccctccatacaggaactacccgtgcaaagtgctatcacggagccacgggacggggaaactgtggagtcgggagaagtcacaattaagggttacgcgtggagcggcggcggcagagcggtgattcgcgtggatgtctcactggatggtggattgacttggcaggtggccaagctggatggcgaggagcagagacccagaaaagcttgggcgtggagactctggcaacttaaagcacctgtgccagccggccaaaaagagctaaatatcgtctgcaaggccgtggacgatggttacaatgtgcagcctgataccgtagcgccaatttggaatcttagaggcgtgctgagcaacgcctggcacagagtgcacgtgtatgtcagcccctag

SEQ ID NO: 136536 - DNA, 1638 bp, Artificial Sequence
  Description of Artificial Sequence: Synthetic coding sequence
atgctgctactccatcgagccgttgtgttgaggctccagcaggcatgccgcctcaaatccattccatcacgaatatgtatccaagcttgcagtactaatgatagcttccaacctcagcgaccgagcctgactttttcgggagacaacagtagtacgcagggatggcgtgtgatggggacactcctgggacttggggctgtgctggcgtatcaggaccaccggtgtagagcagcccaggaatccacgcacatttatactaaggaggaggtctcgagtcacacctcaccagaaaccggaatctgggtaacgctggggagtgaggtctttgatgtcaccgaattcgttgacctgcatcccggcggaccatcaaaactcatgctggccgctggtgggccactggaaccgttctgggctctttatgctgtgcacaatcaaagccacgtaagggaattgctcgcccaatacaaaattggcgagctgaaccccgaggacaaagttgccccaaccgttgagactagtgatccctatgcagacgatccagttagacacccggcactcaaggtgaatagtcagagaccatttaacgcagaaccaccacccgaactgttgacagagaattacataacacctaatcccatcttcttcactcgtaatcatttgccggtgcctaacctcgaccccgatacttatcgactccacgtggttggggctcccggcgggcagtccctcagcttatcactggatgacctgcacaattttcctcgatatgagataacggtaacacttcagtgcgccggaaacaggcgatccgaaatgacccaagtgaaagaggtaaaggggctcgaatggaggaccggcgccatctccactgcccgctgggctggagccaggctgtgcgacgttttggcacaggctgggcaccagctttgtgaaaccgaggctcatgtctgtttcgaggggctggattccgatcctaccggcacagcgtacggggcatcaattcctctggctagggccatggaccccgaagcggaggtgctcctcgcgtatgagatgaacggccagcctttgcccagagaccacggttttccggtgagggtagtcgtgccaggagtggtcggggccaggcatgtcaagtggctgggtagagtttccgttcagccagaagaatcctactcacactggcagaggcgagactacaaaggattctctccctcagttgattgggagacggtcgacttcgatagtgctccctctatccaagaactgccggtgcagagcgccatcactgagcctcgcgatggcgagaccgtcgagtccggagaggtgacaatcaaaggttatgcctggtccggcggagggagggctgtcatcagagtagatgttagcctggacggcggactaacttggcaagtggctaagcttgatggcgaggaacagagacctcggaaggcgtgggcatggcgactgtggcagcttaaagcgcctgtcccagcgggccaaaaagagctaaacatagtgtgtaaggcggtcgacgatggatataatgtgcagcctgacaccgtcgcgcctatctggaaccttagaggcgtcctgagtaacgcgtggcacagggtacacgtgtatgtgtcaccatag

SEQ ID NO: 136537 - DNA, 1638 bp, Artificial Sequence
  Description of Artificial Sequence: Synthetic coding sequence
atgctgctcttgcatcgcgctgttgtgctgaggctacaacaggcgtgtcggttgaagagtatcccatccaggatctgcattcaggcatgctccaccaatgattcattccagccgcagcggccatcactgacctttagcggagataactctagcacacagggatggagggtcatgggaaccctgttggggctcggggccgtgctggcctaccaggaccaccgttgccgggctgcccaggaaagtactcacatttacaccaaggaggaagtgagcagtcacacgtcccctgaaactggcatttgggttacacttggctctgaggttttcgatgtcacagaattcgtcgatcttcatccaggaggaccatcaaaactgatgttggccgcgggaggcccgctggagcccttttgggcgctgtacgcagtgcataaccagtctcacgttcgcgaattgctggctcaatacaagatcggggagctgaacccagaggataaggtggctcctacagtggaaactagcgatccatatgccgatgatcccgtgagacatcctgctctgaaggtgaatagccagcgtcccttcaatgccgagcctccgccggaactgctaacagagaattatatcacccctaatccaatttttttcacaaggaatcacttgcctgtgcccaatttagaccccgacacctacagactccacgtcgtgggagcacccggcggccagtcattgtctctgagcctggatgatctacacaacttcccacgatatgaaattaccgtgacactccagtgcgccggtaatcgtcgaagtgaaatgactcaagttaaggaggtgaaaggattagagtggcgtaccggcgctatctcaaccgcccgatgggccggggcccgcctctgtgatgtgttagcgcaagccggacatcagctgtgtgagaccgaggcacatgtgtgctttgaaggtctggatagcgatccaacagggacagcatacggtgcgtcgatccccttggcccgggcaatggatccagaagccgaggttctcttagcctacgagatgaacggccagcctctcccaagggatcatggttttccggtcagagtggtggtgccaggggttgtgggagcccgacacgtcaagtggctcggccgcgtgtccgtccagccagaggagtcttatagccactggcagcgtcgtgactacaaaggttttagtccaagtgtggactgggagaccgtggatttcgacagcgcaccttccattcaggagctgcccgtgcagtctgccattacggaaccccgggatggcgaaacagttgaatcaggagaggttacaatcaaagggtacgcctggtctggtgggggccgggctgtgattagggttgatgtgtctctggacggagggttaacttggcaggttgctaaactggacggtgaagagcagcggccacgcaaggcatgggcgtggcgcttatggcagcttaaagcacccgtgcccgctgggcagaaagagctaaacattgtctgcaaagccgtcgatgatggttacaacgtccagcctgacaccgtggcaccgatttggaatctccgcggcgtcctgtcaaatgcctggcaccgggtccatgtgtacgtgtcaccctag

SEQ ID NO: 136538 - DNA, 489 bp, Artificial Sequence
  Description of Artificial Sequence: Synthetic coding sequence
atgctccttctccaccgcgcagtcgtgctgaggctgcagcaggcatgccgtctgaagtcaattcctagcaggatctgtatacaggcttgttcaaccaacgactcctttcagccacagagacccagcctgaccttcagcggagacaatagctcgactcaaggatggagggtgatggggactctgttaggcttgggggcagtgctagcataccaggatcacaggtgtagggccgcccaggaaagcactcacatctacacaaaagaagaggtatcttcacatacatctcctgaaacaggtatttgggttacgctgggctctgaggtgttcgatgttacagagttcgtggacttgcaccccggtggcccctcaaaacttatgctggcggctggtgggcctctggaaccgttctgggcactgtacgctgtgcataatcaatcccacgttcgcgaactgctcgcccagtacaagattggggagcttaatccatag

SEQ ID NO: 136539 - DNA, 132 bp, Artificial Sequence
  Description of Artificial Sequence: Synthetic coding sequence
atgcttcttctccacagggcggtagttctaaggcttcagcaggcctgtcgccttaagagcatcccttctaggatttgcatccaggcatgttctactaatgatagtttccagccacagaggccctcactttag

SEQ ID NO: 136540 - DNA, 1638 bp, Artificial Sequence
  Description of Artificial Sequence: Synthetic coding sequence
atgctgttactccatcgggccgtggttctgaggttacagcaggcttgcagattgaagtccattcccagtcggatatgcatccaggcttgttcaaccaacgatagctttcagccccagaggcccagtttgacattctctggtgataattccagcacccagggatggcgcgtaatgggaactctgctcggtctgggggcagtgctggcctatcaggaccatcgatgcagagccgctcaagagtcaactcatatatacaccaaggaagaggtctccagtcacacgagtccagagacaggcatttgggtgacactcggttctgaagtctttgacgtgacagagttcgtcgatctccaccccggcggcccctctaagctgatgttggccgcagggggaccactggagccattttgggctttgtacgctgtgcacaaccagtcgcacgttcgcgagttactggcacagtataaaataggtgagctgaatccagaggacaaagttgcaccaactgtggagacttctgacccctatgcggatgatcccgtcaggcaccccgctctgaaagtaaattctcagcgcccgtttaatgctgaaccccccccagaactattaaccgaaaactatatcactcccaatcctatctttttcacaaggaatcaccttcctgttcccaatttggatccagatacatacagactccatgtcgtgggcgcccccgggggccagtcgctgtctttgtcactagatgatctacataattttccgcgatacgaaatcaccgttacactgcagtgcgcgggtaatcgcagatccgagatgacacaggtgaaagaggtgaagggtctggagtggagaacgggagctatctccacagccaggtgggcgggggcacgcctctgtgatgtgctcgcacaggctggtcaccaactgtgtgaaaccgaagcacatgtgtgctttgaaggcctggatagtgacccaaccgggactgcatacggcgcatccatcccccttgctagagccatggatccagaggctgaggtgcttctggcctacgagatgaacggtcaaccgttgcctcgtgatcatgggtttcccgtgcgcgtggtggtgcctggggtagtgggtgcaaggcacgtgaaatggctcggacgagtctccgtccagccagaggaatcttattctcactggcaaaggagggactacaaaggattcagcccttcagtcgactgggagactgtggattttgactcagcccctagcattcaggagctgcccgttcagtctgcgattaccgagccaagggatggagagacagtggagagtggagaagtaacgataaagggttacgcctggtccgggggtgggcgtgcggttatacgggtcgacgtttccctcgacggaggcctgacgtggcaggtggcgaagctcgacggggaggagcagaggccccggaaagcctgggcttggcggttgtggcaactgaaagcgccagtgcccgctggccagaaggagctcaatatcgtctgtaaggcagtggatgatggctataacgtacagcccgataccgtggcaccaatttggaacttgcgcggtgttttgtctaatgcatggcacagggtgcatgtgtacgtctccccatag

SEQ ID NO: 136541 - DNA, 1638 bp, Artificial Sequence
  Description of Artificial Sequence: Synthetic coding sequence
atgctgctgctccatcgggcagtagtgttgcgcttgcagcaagcatgtcggctcaagagcatcccttctcgcatctgtatccaggcgtgttcaaccaatgatagttttcagccacagcgacccagcctgacttttagcggggacaactcaagtacccaaggttggcgcgtaatgggtaccctgctggggctgggagctgtgctcgcgtaccaggaccacagatgcagggccgctcaagaatctactcacatttatacgaaggaagaggtgagcagccacaccagtcctgagactggaatttgggtgactctggggtctgaggtcttcgacgttacagaattcgtggatctccatccgggcggacccagtaagttaatgctggccgccggtgggcccctggagcccttctgggccctttatgcagtgcacaaccagtcccacgtccgtgagttgctcgcgcaatacaaaatcggcgaattgaacccagaggataaggtggcaccgacagtagaaacatcggacccttacgctgacgaccctgtgagacatcccgctctcaaggtcaacagccaacgcccatttaacgccgaaccacctcctgagctactcacggagaattatataacacctaatcccatctttttcacccgaaatcacttacctgtgccaaatctggaccctgatacttaccggctccatgtggtgggtgcccctggtgggcaaagtctctctttaagtctggacgacctgcacaacttccctcgttacgagatcacagtgaccctgcagtgtgcggggaatcgaaggagtgaaatgactcaggtgaaggaggttaaaggtttggagtggcggactggggcgatctccactgccaggtgggcaggcgctcgcctgtgcgacgtgctggcccaggcgggtcatcaactttgtgaaacggaggcacatgtgtgctttgaagggctagactccgatccaactggcacagcttacggagccagtatcccacttgccagggcaatggatccagaagctgaagtactattggcatacgaaatgaacggacaacccctcccccgagaccacggattccctgtgagggtggtggttcccggagtggtcggtgcgaggcatgttaagtggctgggacgagtcagcgtccagcccgaggaatcctatagccactggcagcggcgcgattacaagggattctctccttccgtggattgggagacagtcgacttcgattccgccccttccatccaggagctgcccgtgcagagtgccattactgagcctagagacggggagactgtggaaagtggcgaggtgactatcaaaggctatgcttggagcggaggaggcagggcagtgataagagtagacgtatccctggacggggggctcacctggcaggtcgccaagctcgatggtgaggaacaaagaccacggaaggcatgggcatggaggctttggcagctgaaggcaccagtcccagctggacagaaggaactgaacattgtttgcaaggccgtggacgacgggtataacgtgcagccggataccgttgccccgatctggaatcttcgaggagtgctcagtaacgcctggcaccgggtacatgtgtatgtttcaccctag

SEQ ID NO: 136542 - DNA, 366 bp, Artificial Sequence
  Description of Artificial Sequence: Synthetic coding sequence
atgctcctgctgcaccgagcagttgtgctcaggctgcaacaagcctgcaggctgaaatcaatcccctcgagaatctgtattcaggcctgctctacaaacgacagcttccagccacaacggccaagcctgacattctccggcgacaattcctcaacacagggatggcgggttatggggaccctgctgggactgggcgctgtgctcgcctaccaagaccaccgttgtagggcagcccaagagagtacccacatttatacaaaggaagaggtatcctcccacactagccccgaaactgggatatgggtgaccttgggctccgaagtattcgacgtgaccgagttcgtcgacctgcaccctggtggttag

SEQ ID NO: 136543 - DNA, 783 bp, Artificial Sequence
  Description of Artificial Sequence: Synthetic coding sequence
atggcggaatccgaagccgaaacacccagtactcctggcgagtttgagagcaaatacttcgagtttcacggcgtgcgcctgccacccttctgtcgtggcaaaatggaggagatcgccaatttcccagtgcgcccttccgatgtctggatcgttacatacccgaaatccggaacctctctcctccaggaggtcgtttatctcgtttcacagggcgcagatcccgatgaaattgggctcatgaatattgatgaacagttgccagttctggagtacccccaacccggtctcgacattattaaagagctgacttcacccagactcataaaaagccacttaccatacaggttcctgccttcagatctgcataatggtgattccaaggttatttatatggccagaaatccaaaggatctcgttgtctcatattatcagttccaccggtccctgcgaacgatgtcctatagagggactttccaagaattctgccggaggttcatgaacgacaaactgggttacggtagttggttcgaacacgtgcaggaattctgggaacatcgaatggactctaatgtgctttttctgaaatatgaggatatgcatcgagatctcgtgaccatggtcgaacagttggctaggtttcttggtgtgtcgtgtgataaggctcagctcgaggccctgacggaacactgccatcagctcgtcgaccagtgctgtaatgctgaagcattgccggtgggccgtgcccattgtgtgttcgcccggaaaattttcctctcttggtag

SEQ ID NO: 136544 - DNA, 855 bp, Artificial Sequence
  Description of Artificial Sequence: Synthetic coding sequence
atggctgagagcgaggccgagacgccatccacacctggcgagttcgagagtaaatactttgagttccatggcgtgagactaccgcctttttgcaggggcaagatggaagaaattgccaatttccctgtcaggccttccgatgtttggattgtcacttaccctaagagcggcacctcattgctgcaagaagtggtatatctcgtatcgcagggagccgatccagacgagatcggattaatgaacattgacgaacaactgcctgtgttggaatatccacagcccggccttgatatcattaaagaactcacctctccccgtctgataaagtctcatctgccataccgcttcctccccagtgacctgcacaatggggatagcaaagttatttatatggcccgaaatcctaaagacctggtggtcagctattatcaattccaccgctccctgcgcaccatgtcttaccgtggaacattccaagaattttgccggcgattcatgaatgacaaattaggttatgggtcgtggttcgagcatgttcaagagttttgggagcatcgaatggacagtaatgtgctgttcctgaaatacgaagatatgcatagagatctcgtaactatggtggagcagctggctcggtttctcggcgtttcatgcgacaaagcccagctagaggccctgaccgaacattgtcaccaactggtagaccagtgttgtaacgccgaggccctcccagtgggccgtgggcgcgtcggtctgtggaaggacatttttacagtaagcatgaacgagaaatttgatctcgtatacaagcagaaaatgggaaaatgcgacctcacctttgatttctacctttag

SEQ ID NO: 136545 - DNA, 516 bp, Artificial Sequence
  Description of Artificial Sequence: Synthetic coding sequence
atggcagaaagcgaagctgaaaccccctctaccccgggagaatttgaatcgaagtactttgagttccatggggttcgcttgcctccattctgtagaggcaaaatggaagagattgcaaacttcccagtgcgaccatcagatgtgtggatcgtgacatatcctaaatctgttgggtacggatcatggtttgagcacgtgcaggagttctgggaacaccgtatggactcgaatgtgctatttttgaagtatgaagatatgcatcgagacctcgtcaccatggtcgagcagttggcaaggttcttgggagtctcttgtgataaggcccagttggaggcgctaaccgagcattgtcatcaactcgtggaccagtgttgtaatgctgaggccctgcctgttgggcgcggacgcgtcggtttgtggaaggacatttttacggtttctatgaatgagaagtttgatctggtgtataagcaaaaaatgggcaagtgtgacttgacttttgacttttatctctag

SEQ ID NO: 136546 - DNA, 171 bp, Artificial Sequence
  Description of Artificial Sequence: Synthetic coding sequence
atgctggctaagctgctatgcgatcaggtggtaggcgcccctatcgccgtgtccgccttttacgccgggatgtcgatactccaggggaaggacgatatttttctagacctgaaacaaaagttttggaatacctacatgcaaacccaatcctggctttggcgctccctgtag

SEQ ID NO: 136547 - DNA, 888 bp, Artificial Sequence
  Description of Artificial Sequence: Synthetic coding sequence
atggaactcattcaggacacatcacggcctcccctggaatatgtcaagggcgtaccacttattaagtatttcgcagaagctctcgggcccttgcagagcttccaggccaggcctgatgatctgctcatttccacctaccctaagagcgggacgacttgggtgagtcagatcttggatatgatctaccagggcggagatttggaaaaatgccatcgagccccaatcttcatgcgcgtgcccttcctggagttcaaggcaccgggaattcccagcgggatggaaacactgaaggatacaccagcccctaggctccttaagacccacctaccactggcactgctgcctcaaacactgctggatcagaaggtgaaggtggtgtatgtcgctcggaatgctaaagatgttgccgtgagctattatcatttttaccatatggcaaaggtacaccccgagccgggaacatgggatagctttttggaaaagttcatggttggagaggtgagctatgggtcatggtatcagcatgttcaggaatggtgggaattatctcgaactcaccccgtgctgtacttgttttacgaggatatgaaggaaaatcccaaaagagagattcagaaaatactggagtttgttggaagatctttgcccgaggagaccgtcgattttgtcgtccagcatacatctttcaaagaaatgaaaaaaaacccaatgacaaattataccacagtgccacaagaattcatggaccactcaatttcccccttcatgagaaagggcatggccggcgattggaagaccactttcaccgtcgcgcaaaacgagcgatttgatgccgattacgctgaaaaaatggcgggctgttcactttcgtttcggtccgagttgtag

SEQ ID NO: 136548 - DNA, 888 bp, Artificial Sequence
  Description of Artificial Sequence: Synthetic coding sequence
atggagctcattcaggacacatcacgccccccactagagtacgtgaaaggtgttcccctaatcaaatacttcgccgaggccttagggcccctccagtcgttccaggcacgtccagatgatctgttgataagtacctacccaaagtctggtaccacctgggttagccagattcttgacatgatctatcagggtggagacctagaaaagtgtcaccgtgctcccatcttcatgagagtcccttttctggaattcaaagccccgggcattcccagtggcatggagaccctgaaggacaccccggcccccaggttgctgaaaacacacctgcctctagcactactcccgcagaccctcctcgaccagaaggtgaaggtggtctatgtggcacggaacgccaaggacgtggccgtgtcttactaccacttctatcatatggctaaggtgcacccagaacctgggacctgggactcttttttggaaaagtttatggtgggtgaagtatcttacggaagctggtatcaacatgtgcaggagtggtgggaactttctcgtactcacccagtcctctacctgttctacgaggatatgaaagagaatcccaagagggaaattcagaagatcctcgagtttgttggtagatccctgcctgaggagacggtggatttcgtagtgcaacacacttcgttcaaagaaatgaagaagaacccaatgaccaactatacaaccgtccctcaagaatttatggaccacagcatctcacccttcatgcgcaagggaatggccggcgattggaaaacaaccttcacagtggcacagaacgaacgctttgatgcagactacgctgagaagatggccggctgttcgttatcatttcgctccgagttatag

SEQ ID NO: 136549 - DNA, 654 bp, Artificial Sequence
  Description of Artificial Sequence: Synthetic coding sequence
atgctggccaaactcctctgcgaccaagtcgtgggcgctccaatcgcagtgagtgctttctatgccggcatgtcaatcctgcagggcaaagatgatatcttcctggacttgaaacagaaattctggaacacgtatatggtcgtgtacgttgctaggaatgctaaagatgtagccgtctcttactaccacttctatcacatggccaaggttcaccccgaacccggaacatgggatagctttctggaaaagtttatggttggggaggtcagctatggttcatggtaccagcatgtccaggagtggtgggaattgagccgcacccacccggtcctgtatctgttctatgaggacatgaaggagaaccctaagagggagatacagaaaatcctggagttcgttggtcgctccctcccggaagagactgttgactttgtggtgcagcacactagctttaaggagatgaagaaaaatcccatgacaaattacaccaccgttccccaggaatttatggaccattcaatctctccttttatgcgtaaaggtatggcaggcgactggaagacaactttcacagttgcccaaaatgagcggttcgatgccgactatgcagagaagatggcaggttgctctttatctttcaggtccgaactgtag

SEQ ID NO: 136550 - DNA, 888 bp, Artificial Sequence
  Description of Artificial Sequence: Synthetic coding sequence
atggaattgatccaggacacctcccggcctcctttagagtatgtaaaaggcgttccactgatcaagtactttgcagaagccctgggcccccttcagtctttccaggcccggccagacgacttgctgatcagcacttaccccaaatccggaacgacatgggtgtcccaaatcctggacatgatttaccagggaggtgacctggagaaatgccacagggcacccatattcatgagggtgccctttctggagtttaaagcccctggaatcccatctggcatggaaacccttaaagacactccagccccccgcctgctcaaaacacaccttcccctcgccctgcttccacagacgctgctggaccagaaggtgaaggtcgtctacgttgcccgtaacgccaaggatgtagctgtaagctactatcatttctatcatatggctaaagtccatcccgaaccgggcacatgggattcctttttggagaaatttatggtgggcgaggtgtcttacggatcctggtatcagcatgtgcaggagtggtgggagctatctcgcactcaccccgtgctctacctattctatgaagacatgaaagagaatccaaagagggaaatccagaaaattctagagttcgttgggaggtctctccctgaagaaaccgtggactttgtggtgcagcacacaagcttcaaggaaatgaagaaaaatccaatgactaattacactaccgtgccacaggagtttatggaccactctattagcccatttatgagaaaaggtatggctggggattggaagacgactttcaccgtcgcccagaacgagcgttttgacgctgactatgctgagaagatggcagggtgttctctttcattccggagcgagctctag

SEQ ID NO: 136551 - DNA, 888 bp, Artificial Sequence
  Description of Artificial Sequence: Synthetic coding sequence
atggaattgatccaagatacaagcagacctcctttagagtatgtgaagggggttcctctgattaaatacttcgctgaagcactggggccgctgcagtcctttcaggcacgcccagacgaccttctgatttccacctatcctaaatcgggaaccacatgggtatcacagattcttgatatgatctaccagggcggggatctcgagaagtgccatcgcgcgcctatcttcatgcgcgtgcccttcctggagttcaaggcccccggcattcccagcggcatggagacactcaaagatacgcctgcacctaggctactcaagactcatctcccccttgctctgcttccacagaccctcttagaccaaaaagttaaggttgtctacgtggcgcgcaatgctaaagatgtagccgtcagctactatcacttttaccacatggccaaagtccatcccgagcctggaacatgggatagctttctcgaaaaattcatggtgggagaagtctcatatggcagttggtaccagcacgttcaagaatggtgggagttgtcccgaactcatccagttctttatctattctacgaggacatgaaggagaaccctaagagggagatccagaagattctcgaatttgttggaagatccctgccggaggagaccgttgattttgtcgtccagcatacaagctttaaggagatgaagaaaaatcctatgacaaactacaccaccgtgccgcaagaatttatggatcacagcatctcgcctttcatgagaaaagggatggccggagactggaagacgacctttaccgtggctcaaaacgagagatttgatgctgactatgcagagaagatggcaggctgcagtctgtctttccgttccgaactatag

SEQ ID NO: 136552 - DNA, 888 bp, Artificial Sequence
  Description of Artificial Sequence: Synthetic coding sequence
atggaactgatccaagatatttctagaccacccctcgaatacgtgaagggtgtgccactcattaaatatttcgccgaggcgctggggccattgcaaagctttcaggcccgcccagatgatctgttaatctctacctaccccaaaagtggtacaacttgggtttcacaaatcctagacatgatctaccagggcggggatctcgagaaatgccacagggcaccaatattcatgagagtgcccttcctcgaattcaaggtgccaggaattccttctgggatggaaaccctgaaaaacacaccggccccccgcctgctgaaaacacacttacccctggccctcctgcctcagacactcttggaccagaaagttaaagtcgtgtatgtggcccgaaacgccaaagacgttgcagtctcttactaccatttctatcatatggcaaaggtctacccgcacccaggaacttgggagagcttcctagagaaattcatggccggtgaggtctcatacgggagttggtaccagcacgttcaggagtggtgggaactgtcccgaacacatcccgtactgtacctcttctacgaagatatgaaggaaaaccctaagcgggagatccagaagattctggaattcgtcggaagaagcctgccagaagaaacggtggacctgatggtggagcacacatcttttaaagaaatgaagaagaaccctatgacaaactacacgacagtgcgacgggagtttatggatcactcaatctctccattcatgcgcaagggtatggcaggcgactggaagactacgttcaccgtggcccaaaacgaacggtttgacgcagattatgcgaaaaagatggctgggtgcagcctctctttccgctccgaactgtag

SEQ ID NO: 136553 - DNA, 888 bp, Artificial Sequence
  Description of Artificial Sequence: Synthetic coding sequence
atggaactgatacaagatatctccagaccgccgcttgaatacgtcaaaggagttccactgatcaagtactttgcagaagccctggggccactacagtcctttcaagcccgcccagatgatttgcttatcagcacctacccgaagtctgggacaacctgggtgagccaaatacttgacatgatctaccaaggtggagatctagaaaagtgccatcgggctcctatattcatgcgagtgccatttctcgagttcaaggtccccgggattccatctggaatggaaacccttaagaatactccagcgccacggctgctgaaaacacacctccccctggctctgctgccacagactttgctcgaccagaaggtcaaagtcgtctatgtagccagaaacgctaaagatgtggctgtgtcctactaccacttctatcatatggccaaagtttatccccaccctggaacctgggaatccttcttggagaaattcatggccggggaggtgtcatacggctcttggtaccagcacgtccaggagtggtgggagctcagtcggacccatcccgtgctctatctgttttacgaggacatgaaagaaaaccccaaacgcgaaatacagaagatcctggagttcgtgggccgttccctgcccgaagaaacagtggatctgatggtcgagcacacttcatttaaagagatgaaaaaaaaccccatgacgaattacaccactgtgcggcgagagtttatggatcattctatctccccattcatgagaaaaggcatggcaggggattggaaaactacatttaccgttgcccagaacgaaagattcgatgcggactacgccaaaaagatggcaggctgcagcttatccttcagaagtgaactctag

SEQ ID NO: 136554 - DNA, 579 bp, Artificial Sequence
  Description of Artificial Sequence: Synthetic coding sequence
atggagctgatccaagacatcagtaggcctccactcgagtacgtaaaaggcgtcccgcttatcaaatactttgccgaggccctcggcccactgcaaagtttccaagcgaggccagacgacctgttgatctcaacatacccaaagagcggcacaacttgggtgagtcagattcttgacatgatttatcagggcggtgacttggagaagtgccaccgcgctcccatctttatgagagtcccatttctagagtttaaggttcctggtatcccctctgggatggagacccttaagaatacacctgctccacggctgctgaagacacacctgccacttgccctcctgccacagacgctgctggaccagaaggtgaaagtggtttatgtggcaagaaacgcgaaggatgttgccgtgagttactatcatttttatcacatggctaaggtgtacccccaccccgggacctgggagtcatttctggagaaattcatggccggcgaagtgtcttatggaagctggtatcagcacgtgcaggaatggtgggagctctcccggacccaccctgtgctgtatctgttttag

SEQ ID NO: 136555 - DNA, 891 bp, Artificial Sequence
  Description of Artificial Sequence: Synthetic coding sequence
atggcccttacctctgatctgggaaaacagataaaactgaaggaagtagaaggaacacttctccaaccagccacagtggacaattggtcacagatccagtcttttgaggctaaacctgatgacctgttgatctgcacctaccctaaggctggcacaacttggatacaagagatcgtcgatatgattgagcaaaatggagacgttgaaaaatgccagagagctatcattcagcacagacacccattcatcgagtgggcccgccctcctcagcccagtggagtggagaaagcgaaagccatgccatctccaagaattctgaagacccatctctccacacaactcctgcctccctcgttttgggagaataattgtaaatttctgtatgtggctagaaatgccaaggactgcatggtctcctattaccacttccaaaggatgaaccatatgcttcctgatccagggacctgggaagagtattttgagacatttatcaacggaaaggttgtttggggcagttggtttgaccacgttaagggatggtgggagatgaaggacaggcatcagatcctgtttctgttctacgaggacatcaaaagggaccctaaacatgagattaggaaggtaatgcaattcatgggcaagaaagtggatgagactgtattagataagatcgtgcaagaaacttctttcgagaaaatgaaggagaaccccatgaccaaccggtcgacggtgtccaaatccatactggatcagagcatcagctctttcatgcgcaaagggactgtcggagactggaagaaccactttaccgtcgcacaaaacgaacgatttgatgagatatatagacgcaagatggaaggcacaagcattaacttctgtatggaactgtag

SEQ ID NO: 136556 - DNA, 924 bp, Artificial Sequence
  Description of Artificial Sequence: Synthetic coding sequence
atggcactgacctcagatctgggcaagcagattaaattgaaagaggtggaaggcactttgcttcagccggctaccgtcgataattggagtcagattcaaagttttgaggccaagcccgacgatctgctgatttgcacctacccaaaggctggcacgacctggatccaggaaatcgtggacatgattgaacaaaacggcgacgtggagaagtgccagcgtgctatcatacagcaccgtcacccgttcatcgagtgggctcgcccgcctcaaccaagtgagaccggatttcatcatgttgcgcaggcgggcctgaaactgctctcttccagtaacccacccgcaagtacaagccagtccgctaagattactgatctgctccctccctccttctgggagaacaactgcaagtttctctatgtagccaggaacgcaaaagactgtatggtatcctactaccattttcagcgaatgaaccacatgctgccagaccccggaacatgggaagaatacttcgaaacttttatcaatgggaaggtcgtctggggctcatggttcgaccatgtcaaagggtggtgggaaatgaaagatcgccatcagatcctgttcctcttctacgaggatataaagcgcgatcctaagcatgagatcagaaaggttatgcagtttatgggaaaaaaagtggacgagactgtgctagacaaaattgtgcaagagaccagcttcgagaaaatgaaggagaatccaatgacgaacaggagtaccgtcagtaaatctatcctggaccagagcatctccagctttatgcgtaaaggcaccgttggagactggaagaatcatttcactgtggcgcagaatgagcgctttgacgaaatttaccgccgcaaaatggaagggactagcataaacttttgtatggagctgtag

SEQ ID NO: 136557 - DNA, 933 bp, Artificial Sequence
  Description of Artificial Sequence: Synthetic coding sequence
atggccctgacatcagatctggggaagcagattaaactgaaggaagtggagggaaccctgctgcagcctgctactgtcgacaactggtcacagatccaatcctttgaagccaaaccggacgatctgcttatatgcacctacccgaaagccggcacaacttggattcaggaaatcgtggacatgatcgagcagaatggggacgtggaaaaatgtcagagggcaatcattcagcatcggcaccctttcattgagtgggccaggccaccacagccaagcgtcctcgtgctccgccgttgttttctgctgagttattttaagggcgtggagaaagccaaggccatgccatctccccggatactcaagacgcatctttctacacagctcctgcctccctcattttgggaaaataattgtaaattcctgtatgtcgctcgaaatgccaaggactgtatggtttcttactaccatttccagagaatgaaccatatgctacccgaccccggcacatgggaggagtacttcgagacttttattaacggtaaggtggtgtggggttcctggttcgatcacgtcaagggatggtgggagatgaaggatagacaccagatccttttcctgttctacgaagacatcaaaagagatccaaaacatgaaatcaggaaggtcatgcaatttatgggcaaaaaagtggacgagaccgtcctcgacaaaatcgtccaggagacctcttttgaaaaaatgaaagagaacccaatgaccaataggtcaactgtgtctaaatctatacttgatcagtctataagtagcttcatgagaaaaggaaccgtgggggattggaaaaatcatttcactgtagctcaaaacgaacgattcgatgaaatttatagaaggaaaatggaagggacctcaattaacttttgtatggagctgtag

SEQ ID NO: 136558 - DNA, 639 bp, Artificial Sequence
  Description of Artificial Sequence: Synthetic coding sequence
atggggcccccatccgcctctccgcaccgtgagtgcattccatggcaggggctgctgcttaccgcatcactgttgaacttttggaatccccccactacagcgaaactgaccatagagtctatgccactttctgtggctgaagggaaagaagtattgcttttagtccacaatctcccacagcacttattcgggtactcgtggtataaaggcgaaagagtggacgggaactccttgatcgtcgggtacgtgatcggaactcaacaggctacacctggtgccgcgtactccggccgcgaaacaatctacacaaatgccagcctcttgatacagaatgtgacacagaacgatatcggcttttatacactgcaggtgatcaagtcagatctggtgaatgaggaggccacaggccagttccatgtttaccaggagaatgcccccggactgcccgtaggcgctgtcgctgggatcgtgactggtgtgctcgtgggagtcgcccttgttgcggctttggtttgttttcttctgcttgccaagaccggacgcccctggtctctcccccagctgtgcttgctcgacgtgccaagtcttcattgtcccggaccgccaacccagccacaggattcgtccttccacctgtag

SEQ ID NO: 136559 - DNA, 1098 bp, Artificial Sequence
  Description of Artificial Sequence: Synthetic coding sequence
atggacggccctgcagaaccgcaaatacctggcctgtgggatacttacgaagacgatatttccgagatttctcagaagctcccaggcgaatactttcgatataagggtgtgccattccctgtggggctgtactctctggagtcaattagtttggcagagaatactcaggatgtgcgtgacgacgacatattcatcataacttatcccaaatccgggaccacttggatgattgaaatcatatgccttattctcaaagagggtgatccttcctggatccgtagcgtgcccatctgggagcgggccccctggtgcgaaactatagtgggcgcattttctctgcctgatcagtattctccccgcctaatgtcctcccacctccctatccagatatttacgaaagcattctttagttccaaggcaaaagtgatatatatggggcggaatcctcgagatgtggtggtctctctgtatcactattctaaaatagccggacagctgaaggatcctggcactcccgatcagtttctgcgggatttccttaagggtgaggttcagttcgggagctggtttgaccacattaaaggctggctaaggatgaaagggaaagacaactttctatttatcacctatgaagagctccagcaagacctccaggggtctgtggaaaggatctgcggttttctgggtagacctctggggaaggaggctctggggtcagtggtggcccacagcaccttcagcgccatgaaggccaataccatgtcaaattatacattgctacccccctcgttgctggatcatcgcaggggtgccttcttgcggaagggcgtctgtggggactggaaaaatcattttaccgtggcccagagtgaagctttcgatagggcatataggaaacaaatgcgaggtatgcccacttttccatgggatgaggacccagaggaagatggatcccctgatccagagccatccccagagcctgagccaaagccatcattagaaccaaacacatccctggaaagagaaccaaggccaaactcgtcaccaagccccagtcctggacaggcgtctgagacgccccatccccgcccatcatag

SEQ ID NO: 136560 - DNA, 1053 bp, Artificial Sequence
  Description of Artificial Sequence: Synthetic coding sequence
atggccagtccccctccttttcactctcaaaagctgcctggagagtactttcggtacaagggcgtgcctttcccagttggcctgtatagtctggagtccatcagcctagctgagaacacacaggatgttcgagatgacgatattttcatcataacatatcctaagagtggaacgacctggatgattgagattatctgtcttatcctcaaagaaggtgacccatcttggatcaggtccgtacccatctgggagagggcgccttggtgcgaaaccatcgtgggtgccttcagcctgcctgaccagtactccccaagattgatgtcttcccatctccccatccagatattcacaaaggcctttttttcctctaaggccaaagtgatctacatgggtcgtaacccaagggatgttgtggtgagcctgtatcactactcaaagattgctgggcagcttaaggacccagggacaccagaccagttcttacgtgatttcctcaagggagaggtgcagttcggatcgtggtttgaccatatcaaagggtggctgcgcatgaagggaaaagataacttcctcttcattacttatgaagaattgcagcaagacctccaagggagcgtggaacgcatttgtggctttttaggcaggcccctcggcaaagaggcccttggttccgtggtggcgcattcaacgttctccgcaatgaaggctaacactatgagcaattacacacttctgcctccctcccttctcgaccatcgtcgaggcgcatttttaaggaaaggggtctgcggagattggaaaaaccattttaccgttgcccagagcgaggcgttcgaccgcgcctacagaaaacagatgcgcggcatgccaacctttccctgggacgaggaccctgaagaagacggttctcccgatcccgaaccctccccagaacctgagccgaaacctagtttggaaccaaataccagcctcgagagggaacccagacccaacagttcaccctcgcctagccctggccaggcaagcgagacaccgcacccccgcccatcatag

SEQ ID NO: 136561 - DNA, 1041 bp, Artificial Sequence
  Description of Artificial Sequence: Synthetic coding sequence
atggttgaaaaggaggaggccggaggaggtataagcgaagaggaagcggcccagtacgaccggcagatcagactttggggactggaggcccagaagcggctgagggcctcaagggtcctcctagttggtcttaaaggcctgggtgccgagatcgccaagaaccttattctggccggagtgaagggactgacgatgttagaccatgaacaggtcacccccgaggatcccggtgctcagttcctgattaggacagggagcgttggacgcaaccgcgccgaggcctccctcgaacgtgcgcagaatctcaatcccatggttgatgttaaagttgacactgaagacatcgagaagaaacctgagtctttttttacacagttcgatgctgtgtgtctgacatgctgttctcgcgatgttattgtgaaagtggatcaaatctgtcacaagaactcaattaagttctttacgggagacgttttcgggtaccacggctacactttcgctaatctgggggagcacgagttcgtggaggaaaaaacaaaagtagctaaagtgagtcagggggtggaggatggaccagatacaaaaagggcaaaacttgatagcagtgagacaacaatggtgaagaaaaaggtcgtgttctgccctgtcaaggaggccctggaggttgattggagctctgaaaaagccaaggccgctctcaagcggacaacgtccgattacttcctgcttcaggtgctcctgaagtttcgtactgataagggccgggatccctcatctgatacctacgaggaagattctgagttgctccttcagatccggaacgatgtgctagatagcctgggcatatcaccagatctgctccccgaagacttcgtaaggtattgtttctccgaaatggcccccgtttgcgccgtagttggagggatcctggcccaggagatcgtcaaggctctgagccagagggacccacctcataacaactttttttttttcgacgggatgaagggcaacgggatagtagaatgtcttggtccgaaatag

SEQ ID NO: 136562 - DNA, 801 bp, Artificial Sequence
  Description of Artificial Sequence: Synthetic coding sequence
atggtggagaaagaagaagctgggggaggaataagtgaagaagaggcagcgcagtatgatcggcagattagactgtgggggctggaggctcagaaaaggctccgggcctccagggttctcctggtgggtttgaaaggtcttggcgccgagattgccaaaaatctgattctggccggagtgaaggggctcacgatgctcgaccacgagcaagtcaccccggaagatccaggggctcagtttttgatcaggactgggagcgtgggcaggaatagagccgaggcgtccttggaacgggcccagaatctgaatccaatggtggacgtgaaggtcgacacggaggacatagaaaagaagcccgagtcgttttttacgcagttcgatgccgtgtgcctgacttgctgctcccgcgacgtaattgtcaaggtggatcagatatgccacaagaacagtatcaagtttttcactggagacgtttttggataccacgggtacactttcgcaaacttaggagaacacgagttcgtggaagagaaaactaaagtggccaaggtgtcccagggagtggaggatggcccggatacaaagagggcaaagctagattctagtgaaactactatggtgaagaagaaagttgtcttctgtcccgtgaaagaagcacttgaggtcgattggtcctctgagaaagctaaagccgccttaaaacggaccacttccgattatttcctgctgcagggcacggccagcccacggtggcctcagtgtgtgcggtggctagaaggcttttggcacaggaagttatag

SEQ ID NO: 136563 - DNA, 900 bp, Artificial Sequence
  Description of Artificial Sequence: Synthetic coding sequence
atggtggaaaaggaagaggccggcggcggcatttctgaggaagaggccgcgcaatacgaccgacagattcggctctgggggctcgaagcacagaaaaggcttagggcctcaagagtgttgcttgtggggttaaaaggactcggggcagagatcgccaaaaatctaatactggctggagttaaagggctgacaatgctggatcacgaacaggtcacaccggaggaccccggagcccagtttttgatccggaccggtagcgtaggcagaaacagggcagaggcctccctggagcgggcacagaacctcaaccctatggtggacgtaaaggtcgacacagaagacatagagaaaaaaccagagtcattttttacgcagttcgacgccgtgtgcttaacctgctgttcccgagatgtgattgtgaaggtggatcagatttgccacaagaacagtatcaaattcttcacgggcgatgtgtttgggtaccatgggtacacctttgccaatctgggggagcacgagttcgtcgaggaaaagacaaaggtggctaaggtgagtcagggcgttgaagatggacctgacacgaagagagctaaactggatagcagtgagacaaccatggtgaaaaaaaaagtggtcttttgccccgtcaaagaggcgttggaagtagattggtcctccgaaaaggccaaagccgcccttaagcgcacaacatctgactattttctcttacaaggccctgtgtcagccggtccttctagccagcaactcctccttctgagatggcacgagggtgaatgggattgcggagtgccgtggccccaggtgaattcccggtttgggtcgcctcgcgatgctaattgctctatgcccacgtgtattccatgtcctctgccttcatag

SEQ ID NO: 136564 - DNA, 900 bp, Artificial Sequence
  Description of Artificial Sequence: Synthetic coding sequence
atggttgaaaaggaagaggccggcggaggcatctcagaggaggaggccgcacagtacgaccgccagatacgcctgtgggggttagaagcccagaagcggctgcgagctagtcgcgtcttgctcgtgggcctgaaaggcctgggggccgagattgccaagaacctgattttagctggggtaaagggactgaccatgctggaccacgaacaggttacaccggaggatccaggggcccagtttcttattagaaccggttcagtgggaagaaatagggctgaggcctccctcgagagagcccagaatcttaatcccatggtcgacgtgaaggtggacactgaagatatcgaaaaaaaaccagagtcattcttcacacagttcgacgcagtgtgtctaacctgctgttctcgcgacgtcatcgtaaaagtggaccagatttgccacaagaatagcattaagtttttcaccggcgatgtgtttggttaccatggttacaccttcgctaatctcggcgagcacgaattcgtggaggagaagactaaagtggccaaggtgagtcagggcgtggaggacggccccgataccaaaagggccaagctagacagctccgaaacaaccatggtgaagaagaaggttgtgttttgcccggtaaaggaagctctagaagtggactggtcctcagagaaagctaaggccgcccttaaaaggaccaccagcgattattttctcctgcaagagctgtttcctcgtattgtggaaagggtgtatgcacagagacacccgagatccacggaaagaacccacgctaaaatgcttatcccttttttaacaaaagagaagcccgggtttctcggagaaatggcggtttctagatcaggagtggggaagctacagtgcagctag

SEQ ID NO: 136565 - DNA, 519 bp, Artificial Sequence
  Description of Artificial Sequence: Synthetic coding sequence
atgttagaaaagaccaaggtggctaaggtaagtcaaggagtggaagatggtcccgataccaaaagagctaagctggatagcagtgagactacaatggtgaagaaaaaggtcgtcttctgtccggtgaaggaggcccttgaggtggattggtcctccgaaaaggctaaggccgccctgaagagaacaaccagcgactactttctgctgcaagtgctactcaagttccggacagacaaaggacgcgacccatcttcagatacctatgaggaagactctgagctgttacttcagattcgcaacgatgtcctcgattcactcggtatttctcctgatctgcttccagaggactttgtccggtactgtttctctgagatggcgcccgtgtgtgccgtcgtgggtggtattctggcgcaagaaattgtgaaggccttgtcccaacgcgatccaccacataataacttctttttcttcgatggtatgaagggaaatgggattgtggagtgtctggggccaaagtag

SEQ ID NO: 136566 - DNA, 1935 bp, Artificial Sequence
  Description of Artificial Sequence: Synthetic coding sequence
atggacgacatcgccgatagaatgagaatggacgcaggcgaagtgacactggtgaaccataacagcgttttcaagacccacctgttgccacagaccggtttcccggaggaccagctgtcactttctgatcagcagattttgagctctagacagggtcacctagatagaagctttacctgctctacacgtagcgctgcgtacaacccttcttattactccgataacccttctagtgattctttcctcgggtcgggagacctgaggacgtttggccagtctgcaaacggtcagtggcgtaactccacaccttcgagctcatcatctctgcagaagtctcgaaattcaaggagcctctatttagagacccgcaaaaccagtagtgggctgtcaaatagttttgccgggaaatcaaaccatcactgccacgtctccgcctacgagaaatcatttcctatcaagcccgtgcccagcccttcctggtccggttcctgcagaagaagcctgctatcacccaagaagacccagcgcaggcatgtctcaactgccgaagagacagtgcaagaagaggagagggaaatctaccgccagctactccagatggtgactggaaagcagttcacaatcgccaaacccactacacacttcccgttacacttgagtagatgtctgagtagctctaagaatacactgaaggactcactttttaagaacggtaacagctgcgcaagccagatcattggcagcgacactagcagttctggctctgctagtatcttaaccaaccaggagcagcttagtcattccgtttacagtctatcttcatatacaccagacgtggccttcggcagtaaagactccggcaccttgcaccaccctcatcaccatcacagtgtgccacaccagcccgacaatcttgctgccagtaatacccaatcagagggatccgactcagtcattctgctgaaggttaaggattcccagacacctacgcctagttcaactttctttcaggccgaactctggatcaaagagcttacttcagtgtatgactccagagccagagaacggttgaggcagatcgaagaacagaaagctctggctctgcaattgcagaaccagcgccttcaagagagagagcacagcgtgcacgacagcgtggagttgcacctccgggtgcccctggagaaggagatcccagtcaccgtcgtccaggaaactcagaaaaaagggcacaagctgaccgactctgaagatgagttccctgaaatcacagaagagatggagaaagagattaagaatgtgttcaggaatgggaatcaggatgaggtgctctcagaagcttttcgcctgaccatcaccaggaaagatatacagactctgaaccatctcaattggttgaacgatgagatcatcaatttctatatgaatatgctcatggagcgctcaaaggagaaggggctacctagtgtacacgcttttaatactttcttttttaccaagctgaaaacagctgggtatcaagcggttaagcgctggaccaagaaagttgacgttttctccgtcgacattctgctagtgcctatccatctgggagtgcactggtgtcttgcagttgtggactttcggaagaaaaacatcacttactatgattccatgggtggtattaataatgaggcttgccgaatcctgctgcagtatctcaagcaggagagtatcgacaagaagcgtaaagagttcgacaccaacggctggcagctgttctctaagaaatcccaggagatcccacagcagatgaacggctctgactgcggtatgtttgcttgcaaatacgccgactgtattaccaaagatagaccaattaactttacccagcaacatatgccttacttccggaaacgcatggtgtgggaaattctccacaggaagttgctctag

SEQ ID NO: 136567 - DNA, 489 bp, Artificial Sequence
  Description of Artificial Sequence: Synthetic coding sequence
atgaaaatccctctgaccgcgacaatatgtcttcccggttcatcccctccaggattgtgcatttttgctaaggtgtctgatgtgaaacggctggagatggatgatatcgcagatcgaatgaggatggatgctggcgaagtcacccttgtaaatcataatagcgtctttaagacacacctcctgcctcaaaccggttttccagaagaccaactgtccctcagtgaccaacagattcttagctcccgacagggacacctggatcgcagctttacatgcagcacccgcagtgcggcgtacaaccccagttattactcagggcccggccttggggtgttggccagatactcctggggcaaaatgcttacctttggcgggcaccacggtgtgactctcatgcagattaggcatatggccgtagcaggattctcctctttcatcaacttccagattattctgcctcagacagtttttcttgcacaggcgatatag

SEQ ID NO: 136568 - DNA, 1932 bp, Artificial Sequence
  Description of Artificial Sequence: Synthetic coding sequence
atggacgatatcgcggatagaatgaggatggacgccggtgaagtaacgctggtaaatcataatagcgtgtttaagacccatctactccctcaaaccggcttccctgaagaccagttatccctgtccgatcaacagatcctcagttcgcggcaggggcatctcgacaggtccttcacatgttctacaaggagtgccgcatacaacccctcgtattattcggacaatcccagttctgattcgtttttggggtcaggggatctccggaccttcgggcaatccgcaaacggccaatggaggaactctactccttcttcgtcgtcaagtctgcagaagagccggaactcacgatcgctgtatttagaaacgaggaaaactagcagtggactatccaactcgtttgcaggaaagagtaatcaccattgccacgtctctgcctacgaaaagtcattccccatcaaaccagtgccgagtccatcttggtcggggtcctgccgacgctcactgctcagccccaaaaagacacagcggagacatgtgagcactgctgaggaaacagtgcaggaagaggagagggagatttacaggcagctgctccagatggtcacggggaaacagtttacaattgcaaagccgactacacactttccactgcatctgagcagatgcctgtcgagtagtaaaaatacactgaaggattcgctgttcaagaacggcaattcgtgcgcctcacaaatcataggctcggatacaagttcttcagggtcggcctcaattctgactaatcaagaacagctttcacactctgtgtactcgctgagttcctacaccccagatgttgcctttggctccaaggactcaggcacccttcaccacccccatcaccaccactccgttccccaccaacccgataacctggcagccagcaacactcagtcggaaggctcagatagcgtcatcctactgaaggtgaaggacagccagacccctaccccatctagcaccttttttcaagccgaactgtggattaaggagctcactagcgtctacgactcacgagcccgcgaacggttgagacagatcgaggaacaaaaagctctggccttacaactacaaaatcagagattacaagagcgcgaacatagtgtccacgactccgttgaactccacttacgggtcccactcgagaaagagatccctgtgactgtggttcaagagacccaaaagaagggccataaactaacggactcagaagacgaattcccagagatcactgaggagatggagaaagaaatcaaaaacgtatttaggaatgggaaccaggatgaagttctgtcggaagccttcagactcactatcaccaggaaggacattcagacgctgaaccacttgaattggctgaatgacgagattatcaatttctatatgaacatgctgatggagcggtccaaagagaagggcctgccttccgtccacgcgtttaacacctttttttttaccaaacttaaaacagccgggtatcaggctgttaaacggtggaccaagaaggtggacgtattctccgtggacatcctactggtacctatccacctgggggttcattggtgcctggccgtggttgatttccggaagaagaatatcacctactatgattccatgggaggcatcaataacgaggcctgtcgtatcctgctgcagtatctgaaacaggagtcgatcgacaagaaacggaaagagttcgacacaaacggatggcagctcttctccaaaaagtctcaaataccacaacagatgaacggttctgattgcggtatgtttgcttgtaaatatgccgattgcattaccaaagaccgccccatcaatttcacccaacagcacatgccatatttccgaaaacggatggtgtgggagatactgcacaggaagctgttgtag

SEQ ID NO: 136569 - DNA, 1935 bp, Artificial Sequence
  Description of Artificial Sequence: Synthetic coding sequence
atggatgacatcgcagatagaatgcgaatggatgctggggaagtgacgctggtcaaccataactctgtgttcaagacccacctcctccctcagacggggtttcccgaggaccagctctctctgagcgatcagcagattctgtctagtcggcagggtcatctcgatcggtcctttacatgctccaccagatctgccgcctacaatccatcttattacagtgacaatccctcctctgatagctttttgggttcaggcgacctgaggaccttcgggcagagtgcgaatggacaatggcgaaactccacccctagcagctccagcagtctgcagaagagccgcaatagtcgctcgctctatctggaaacccgtaaaacttcctccggactgtccaatagcttcgcaggtaagagtaaccatcattgccatgtctcagcatatgaaaagtcttttcccataaaacctgtccctagtccctcctggagcggctcatgcagaagatcgctgctgagccccaagaagacacagaggcggcacgtgagcacggctgaggaaaccgtccaggaggaggagcgcgagatctacagacagttgctgcaaatggtcaccggaaagcagttcactatagcgaagccaaccacccatttccccctgcatctcagccgatgtttgtctagctccaaaaacacactcaaagacagtctgttcaaaaatggcaatagttgcgcaagccagattattgggtctgatacttcctcctccggtagtgcctctattctcaccaaccaggaacaactgtctcattctgtttactctttaagttcctatactccggacgttgccttcggctctaaggactccgggacgctgcatcaccctcaccatcaccatagtgtgccccatcagcccgataatctggctgccagcaacacacagtcggaaggtagtgattccgttattctgctgaaagttaaggattcccagacccccactccgagtagtactttttttcaagccgagctctggatcaaggaactgacatcagtttacgattcaagggcccgagagaggctgagacagatcgaggagcagaaagccttggcactccagcttcagaatcagcgcctccaggaacgggaacacagtgtacatgacagcgtggaactccatctgcgggtgcctctggagaaggagataccagttaccgtcgtacaggagacacagaaaaagggacacaagctgactgacagcgaagacgaattccccgaaattaccgaggagatggaaaaagagatcaagaatgtgttccggaatgggaatcaagatgaagttttgtctgaggccttccgcctcactatcactcggaaagatattcagactctgaaccacctgaactggctgaacgatgagatcataaacttctacatgaacatgctgatggaacggagcaaggagaaagggctcccttctgttcacgcatttaacacttttttcttcactaagctgaagaccgccggatatcaggctgtgaagaggtggactaagaaagttgacgttttctctgtggacatcctcctggtaccaatccatttgggcgtgcactggtgccttgctgtggtggattttcgcaagaaaaacataacttattacgactcaatgggtggcatcaacaatgaagcatgtaggatcctgctgcagtaccttaagcaggagtcaatcgacaagaagcggaaggagtttgacacgaatgggtggcaacttttcagcaagaagagccaggagatcccacagcagatgaacggcagcgactgcggcatgtttgcttgtaaatatgcagattgcattaccaaagacagacccattaactttactcagcagcacatgccctatttccgcaaaaggatggtatgggagattctacacaggaaacttctgtag

SEQ ID NO: 136570 - DNA, 1932 bp, Artificial Sequence
  Description of Artificial Sequence: Synthetic coding sequence
atggatgacatcgccgacaggatgaggatggacgccggcgaagtaacactggtgaaccacaattccgtttttaaaactcacctgctgccccagactgggttccctgaggatcagctgagcctgtccgatcaacaaatcctttccagcagacaggggcaccttgatcgcagttttacatgctcaacgcgttccgctgcctataatcctagttactactctgataatccgagtagcgacagtttccttggctccggagatctccggacattcggccaaagtgccaacggacagtggagaaacagcacccccagctcgtccagttccctgcaaaaaagccgcaacagtcggtccctatacctcgaaacccggaaaacgtcctccgggttgagtaattctttcgccggcaagagcaatcaccattgtcatgtctctgcatacgaaaaatcctttccaattaagccagtcccatccccctcctggtctggtagttgtagaaggtctctgcttagcccgaaaaagacacagagaagacacgtgagcaccgccgaagaaaccgtccaggaagaggagagagagatctacaggcaactgctacagatggtcacggggaagcagttcaccatcgccaagccaacgacacactttccactccacctcagccgatgcctgtctagctcaaaaaacaccctgaaggatagcttgttcaagaacggaaactcctgtgccagtcaaatcatcgggagtgatacctcgtcttccggctctgcctctatcttgactaatcaggaacagttgtcccacagtgtgtattcccttagctcgtacaccccagacgttgcctttggatcgaaagactcaggcacccttcaccacccccaccaccatcactctgtgccacaccagccagataacctggctgcatcaaacacacagtccgaaggcagtgatagtgtgattcttctcaaggtgaaagattcccagactcctacacctagctctactttcttccaggcggaactgtggatcaaagaactgacaagcgtctacgattctcgggctagagagcgactgcgccagatcgaggagcagaaggctctggcgctgcagctccagaatcagcgcctgcaggagcgagagcatagcgtgcacgattcagtagaactacacctcagagtgccattggagaaggaaatcccagtgacagtggttcaggaaacgcagaagaagggtcacaaactgaccgactccgaggatgaattccctgaaattactgaagaaatggagaaagagattaaaaatgtttttagaaatgggaatcaggacgaggtgctaagtgaggcctttcgattgaccattacaagaaaggacattcagaccctgaaccatctgaactggttaaatgatgagataattaacttctacatgaatatgctcatggagaggagcaaggaaaaggggctgccgtctgtacacgccttcaatacttttttctttacaaaacttaagactgcaggatatcaggccgtgaaacgatggactaaaaaagtggacgtgttctcagtagatatcctgcttgtgcctatccacctgggggtgcactggtgtctagccgtggttgattttaggaaaaaaaatataacttactacgattctatgggaggaatcaacaacgaggcttgccggattctgctgcaatatctcaagcaggaatcaattgataagaaacggaaggaatttgatacaaacggatggcagttgttttctaagaaaagtcagatccctcagcagatgaatggttctgactgtgggatgttcgcctgtaagtacgccgactgtattaccaaagacagaccaatcaacttcactcagcagcacatgccctatttccggaaacggatggtgtgggagattctccatcggaaactcttatag

SEQ ID NO: 136571 - DNA, 1935 bp, Artificial Sequence
  Description of Artificial Sequence: Synthetic coding sequence
atggacgatatagccgataggatgcgaatggatgctggtgaggtgacgttggtgaaccataactcagtttttaaaactcacttgctaccccaaactggttttcccgaggatcagctgagtcttagtgaccagcaaatccttagctctagacagggccatctcgacagaagcttcacatgtagcaccagatcagccgcttataacccgtcttattattccgacaatccttcgtcagatagctttcttgggtccggggacctgcgaaccttcgggcaaagtgcgaatggtcagtggcggaactccaccccatcctcctcatcttcactgcagaagtcacgcaatagtcgttccctgtatctggagactcgaaaaacctcatctggactgtctaatagcttcgccggcaagtccaatcaccattgccacgtctcagcctatgaaaaatcttttcctatcaaacctgtgccatcaccctcctggtccgggtcctgtcggagatctttgttgtcaccaaagaaaacacagcgtagacatgtgtccacagccgaggaaacagtgcaagaagaggaacgagaaatttataggcagttacttcagatggtcaccggcaagcagtttaccatagcaaagcctactacacactttcctctccacctctcaagatgtttgtcctcgagcaaaaacacactcaaggactctctgtttaagaatgggaattcgtgcgcctctcagatcatcggcagcgacacatccagttcagggtcagctagtatcctaaccaatcaagagcaactttcgcattcagtttactcgctttcgtcgtatactcccgacgtcgcttttggatccaaagatagcggaaccctgcatcatcctcatcatcaccatagtgtgcctcatcagcctgataatctggcagcctctaacacccagtctgaaggatctgattctgtgatcctcctcaaagtaaaggattcacagacaccgacacctagcagcaccttttttcaagcggagctgtggatcaaggaactcaccagcgtctatgacagtagggctagagagcggctgagacaaatcgaggaacagaaagccctcgccctgcaacttcagaatcagcgattgcaggagagggaacacagcgttcatgactctgtcgaactgcacctgcgcgttccattagagaaagaaatccctgtaacggtcgtacaggagacacagaagaaggggcacaagctgacagactcagaagatgagtttcctgaaatcactgaagaaatggagaaggaaataaaaaacgtgtttcgaaatggaaaccaggacgaagtgctgagtgaagcctttcggctcacgattacaagaaaagacattcagaccctgaaccatctgaactggttgaacgacgagatcattaatttttatatgaacatgctgatggaacggtctaaggagaaaggactgccctccgtgcacgctttcaacacttttttttttacgaagctgaagacagccgggtatcaggccgttaaacgatggaccaagaaggtggacgtgtttagcgtggatatactgcttgtgccaatccatctaggcgtgcattggtgtttggctgtagtggattttaggaaaaagaatatcacctattacgattcaatgggaggtattaataatgaagcttgccggatcttgctgcagtacttaaagcaggagtccatagacaaaaagaggaaggaatttgatacaaacggttggcagctttttagcaagaaatcccaagaaatccctcaacaaatgaatggttctgattgtggcatgtttgcctgtaagtatgctgattgcatcactaaagataggccaatcaacttcacacaacaacatatgccctactttaggaaaagaatggtttgggagatcctgcatcgcaaactgctgtag

SEQ ID NO: 136572 - DNA, 2268 bp, Artificial Sequence
  Description of Artificial Sequence: Synthetic coding sequence
atgaaaaagcagaggaagattctctggagaaaaggcatccacttggcgtttagtgaaaaatggaacaccggtttcgggggatttaaaaaattttatttccatcaacacctatgcatacttaaagcaaaactggggagacctgtcacctggaatagacagctccgacactttcagggacggaaaaaggccctgcagatccaaaagacatggattaaagacgagcccctgtgcgccaagaccaaatttaacgtcgccacccagaatgtcagtacactgagttccaaggtgaagcgaaaagatgcgaaacacttcatctcttccagcaaaacacttctaagactccaagctgagaaactgctgtcgtctgccaagaactcagatcacgagtattgtagggagaaaaacctgctcaaggcggtgacagactttccttctaactctgccctgggacaggccaatggccacaggcccagaaccgatcctcagccctccgattttcctatgaaatttaatggggagagccagtcccctggagagtccgggactatagtggttacactgaacaaccacaagagaaaaggtttctgttacggttgttgtcaaggcccagaacaccacaggaatgggggacctctaattcctaaaaagttccagctcaaccagcacaggagaattaagctttcgccactgatgatgtacgaaaaactgtctatgattcgatttagatatcggatccttcggagtcagcattttcgaaccaaatccaaagtgtgtaagctcagaaaggctcagaggtcatgggtgcaaaaggtgactggggatcatcaggaaactagaagagagaacggggaaggtggaagctgttctccgtttccttccccagagcctaaggacccatcatgccggcaccaaccatatttccccgacatggatagctctgctgtggttaagggaaccaattcccatgtaccagactgccacacaaagggctcgagcttcctgggcaaagagctgtcgcttgatgaagcctttccagaccagcagaacggcagtgcaaccaatgcatgggaccagagcagttgctcatcccctaaatgggagtgtacagagctgatacatgacatccctctgcctgaacaccgatcgaacaccatgttcatctccgagactgaacgagaaatcatgaccctcggacaagagaaccagacaagttcagtgagtgacgacagagtgaagctgagcgttagcggggctgataccagtgtgagttccgtggatggtccagtttctcaaaaggccgttcagaatgagaactcataccagatggaagaggatgggtcactcaaacagtcgatcctttctagtgagctgctcgaccatccctattgtaaaagcccgcttgaggcacctctggtctgttctgggctcaagcttgagaaccaggttgggggcggtaaaaatagccagaaggcatctccagtcgacgacgagcagctatctgtttgcctgagcggctttttggacgaagttatgaaaaaatatggcagtctcgtaccactctccgagaaggaggtgctgggtagattgaaggatgtcttcaatgaagacttcagcaaccgcaaaccatttataaacagagaaatcaccaactaccgagcacggcaccagaagtgtaattttaggatcttctacaataaacacatgcttgatatggatgacttggctacactcgacggtcaaaattggctgaatgaccaggtgatcaatatgtatggtgaactgattatggacgctgttcccgacaaggtgcacttttttaatagttttttccacagacagctggtgacaaagggatataacggggtaaagagatggacgaaaaaagtagacctgttcaaaaagtctctgttgctaatcccaattcacctcgaagtccactggtctctcattaccgtgaccctatcaaataggataatctcattttacgattcccaggggattcattttaaattttgcgttgagaacattcgcaagtatttgttgaccgaagcaagggaaaaaaataggcctgagttcctgcaggggtggcagaccgctgtgacaaaatgcattcctcagcagaaaaacgattcagactgcggcgtgttcgtgctgcaatattgtaaatgtctggccctggagcagccattccaattttctcaagaggatatgcccagagtgcgcaaaaggatttacaaagaactgtgtgagtgtcggctcatggactag

SEQ ID NO: 136573 - DNA, 3318 bp, Artificial Sequence
  Description of Artificial Sequence: Synthetic coding sequence
atggccgccggcaaaagcggtgggagtgcaggcgagattaccttcctcgaagctctggcccgaagcgaaagcaagagagacggcggctttaaaaacaactggtctttcgaccacgaggaagagtctgagggggacaccgacaaggatgggaccaatctgctcagcgtggacgaggacgaggattccgagacgagtaagggcaaaaagctgaatagacgcagcgagatagtggctaattccagtggggaattcatactgaagacctacgtgcgtagaaataaatctgagagttttaagactttgaagggcaacccaataggactaaatatgcttagcaacaataagaagctctctgagaacacccagaacacttcactgtgctccggcaccgtggtgcacgggagacgcttccatcatgcccacgctcaaattccagtggtcaagactgccgctcagcgcaaagagtaccctcctcatgtgcaaaaagtcgaaatcaatcctgttaggctttcccgactgcaaggtgtggagcgtataatgaaaaaaacagaagagagtgagagccaagtggaaccagaaattaagcgtaaggtccagcagaaacgacattgtagcacataccaacccacaccacccctctcccccgcttcaaagaaatgcctgactcatctcgaggacctccagaggaattgccgacaggcaatcacattgaacgaatccactgggcccttgctgcgaacctccatccatcagaatagcggaggccagaagagtcagaataccggcctgaccaccaaaaagttctatggaaacaacgtagagaaggtccccattgatattatcgttaactgcgacgatagcaagcatacttacctgcaaaccaatggtaaggtcattctacccggtgccaaaatccctaagattaccaacctgaaggagagaaagaccagtctctccgatttaaatgatccaattatactttcgtcagatgacgacgatgataacgatcggacaaatcgtcgagaatctatttctccacagccagccgactcagcatgctctagccctgctccgtcaaccggtaaagtcgaagcggcgctcaatgagaacacctgtcgcgcagaacgagaacttcgttcaattccagaagatagtgaactgaatacagtgactctacctcgtaaagcccggatgaaagaccagtttgggaattctattataaacaccccacttaagcgccgcaaggtcttttcacaagagccccccgatgcactggctttgtcttgccagagcagctttgacagtgtgatattgaactgccgctccattcgggtggggaccctgttcaggcttttgatagagccagtcatcttctgtctggactttataaaaatacagctggacgagccggatcacgatccagttgagatcattctgaatactagcgatttgaccaagtgtgagtggtgcaacgtgagaaaattgcctgttgtgtttctgcaagccatccccgcagtatatcaaaagctcagtatccagctgcagatgaacaaagaagacaaggtgtggaacgattgcaagggggtgaataaactgactaacttagaggagcagtatatcatcctgatctttcagaacgggctggatccgcccgccaacatggttttcgaatctattatcaatgaaattggaatcaaaaacaacattagcaacttttttgcaaaaatcccgttcgaagaggcgaacgggcgcctggttgcctgcacccgcacatacgaggaatcaatcaaaggcagctgcgggcaaaaagagaacaaaatcaaaaccgtttcctttgaatccaagatccaattgcgctccaaacaggagttccagttctttgatgaggaggaggaaaccggtgaaaatcacacgatcttcatcggtcccgtcgaaaagctcattgtgtacccacctccaccggccaaaggaggaattagtgtaactaatgaagatttgcactgcttgaacgagggggagtttcttaatgacgttatcatcgacttttatctgaagtatctggtactcgagaaactgaaaaaggaggacgctgatcgcatccacatttttagtagcttcttctataagcggctgaatcaacgcgagcggagaaaccatgaaactactaacctgagcatccaacagaagcgccacggacgcgtcaaaacttggacccggcacgtagacatcttcgaaaaagactttatcttcgttcccttaaatgaagctgcccactggtttctcgcagtggtgtgttttcccggattggagaaacccaagtacgagccgaacccgcattaccatgaaaacgcagtgatccagaagtgctccaccgtcgaggattcctgtattagctcatccgcatcagagatggaaagctgttcacagaatagtagcgctaagcccgttataaagaagatgcttaacaagaagcactgcatagcggtcatagattcaaacccgggacaggaagagtccgacccaaggtacaagaggaacatttgctcagtcaaatacagtgtcaagaagataaaccatacagcaagcgagaacgaagaattcaataaaggggagtccacatcccagaaagttgccgacaggacgaagtcagaaaacgggctacagaatgaatctttgtcatccacccatcacactgatggtttgtccaagatcaggcttaattattcagacgagtccccagaggctggaaaaatgttggaagacgagcttgtagactttagcgaagaccaggataaccaggacgacagcagcgacgacggcttcctggccgacgacaactgttcctcagaaattggtcagtggcacctgaaacccaccatctgtaagcagccctgcatcctactcatggattccctgagagggcctagcagaagtaatgtggtgaaaatattacgggaatatttagaagtggagtgggaagtgaagaagggatcaaagcggtctttcagcaaggacgtcatgaaagggtccaaccctaaggtgccccagcagaataacttctctgattgcggagtatacgtgctgcagtatgtggagagcttctttgagaaccccatactcagctttgagttgcctatgaacctggccaattggttcccacctcctaggatgcgcacaaagagggaggaaattcggaatataattctaaaattgcaggaggatcagtccaaggagaaaaggaaacataaagatacctattcgacggaggcaccactgggagagggcacagagcagtacgtgaatagcatatccgactag

SEQ ID NO: 136574 - DNA, 3339 bp, Artificial Sequence
  Description of Artificial Sequence: Synthetic coding sequence
atggctgctggtaaatctggcggaagcgccggtgagattacatttctggaagccctggcaagatcagaaagcaagagagacggcgggttcaagaataactggtcctttgatcatgaagaggagagtgagggtgatactgacaaggatggcacaaatcttctgagtgtcgacgaggacgaggattccgagacaagcaaaggcaaaaaactgaatagaagaagcgaaatcgtggcaaacagttcaggcgagttcatactgaagacatacgtacgccgcaacaaatcggagtccttcaagacactgaagggaaaccctatcggattgaacatgctgagcaacaacaaaaaactcagcgagaatacacagaatacgtctttatgctctggcactgtggtgcatggaaggcggtttcatcatgcgcatgctcagatccccgtggtgaagaccgccgcccagcgcctgctgtccaatcagatattgaaagaataccctcctcacgtgcagaaagtggagatcaatcccgtgagactctcccgcctccagggggtggaaaggatcatgaagaaaactgaggaaagcgagagtcaggtcgagcccgagataaaaagaaaggtccagcaaaaaaggcactgctccacctaccagccgactccgccactgtctccagcttcaaaaaagtgtctgacgcacctcgaggatctgcagagaaactgcagacaggctattacactgaatgagtccacaggacccctgctgcgtacgtccatccatcaaaactccggcgggcagaaatcccaaaacactggtttaacaacaaaaaaattctacggaaataacgtggagaaggtgcctatcgacattattgtgaactgcgatgatagcaagcacacatatctacagacaaacggtaaggttatactccccggagccaaaattccaaagattacaaatctgaaggaacgaaagactagtcttagcgacttgaacgacccaatcatcctgagctcagacgatgatgatgacaatgacaggacgaatagaagagaaagtatctcaccgcaacctgctgactctgcatgctccagccccgcccctagtacaggtaaggtggaggccgccttgaacgagaatacatgcagggcggaacgcgagctcaggtctattcccgaagacagtgagcttaacacggttaccctccccagaaaagcaaggatgaaggatcagttcggcaacagcattatcaacacccctttgaagaggcgcaaggtgttcagccaggagcctcctgatgccctagcgctttcctgtcaaagctcgtttgactctgtcattctcaactgccggagcatccgagtaggtactctctttaggcttctcattgagcctgtcatcttttgtctggattttatcaagatccaactcgacgagcccgaccatgatcccgtggagatcatactgaacaccagcgatctgactaagtgcgagtggtgtaatgtgcggaagctgcccgtcgtcttcctgcaggcaattcccgcagtttaccagaaactgtccatccaactgcagatgaataaagaagacaaggtgtggaacgactgcaaaggggtgaacaaattgaccaacctagaggagcagtacatcatactgatttttcaaaatggattggaccccccggccaatatggtcttcgagtcgattatcaacgaaattgggatcaaaaataatatttctaacttctttgcgaagattccgttcgaggaagcaaatgggcgtttggtcgcatgcactcgaacttatgaggaaagcatcaaaggctcatgcgggcaaaaggaaaacaagataaagacagtttcctttgaatccaagatacagttacgctcgaagcaggaatttcagttctttgacgaagaggaggagacaggcgaaaatcacactattttcatcgggcccgttgagaaacttatcgtttacccccctcccccagcgaagggcggaatttccgtcaccaatgaagacctacactgtctgaatgagggagaattcttgaatgacgttataattgacttctacctcaagtatcttgtgctggaaaaactcaagaaggaagatgcagaccggatccacatcttcagctccttcttctataaacggctgaatcaacgagaacggcgcaaccacgagaccaccaatctatccatacagcagaaacggcatggacgcgttaagacttggacaaggcacgtagatatattcgaaaaagatttcatctttgtgccattaaatgaagctgcacactggttcctggccgttgtatgtttcccaggcctagaaaagccaaagtacgagcctaacccacattaccacgaaaatgccgtcattcagaagtgctcaaccgtagaagactcttgcattagttcatctgcatccgagatggaatcttgctcacagaatagctcggccaaacccgtcatcaaaaagatgctgaataaaaaacactgtatagccgtgattgatagcaatcccggccaagaggagtccgacccgagatacaagcgcaatatttgtagcgtgaagtatagtgtcaagaagattaaccacaccgcctcagagaatgaggaattcaataagggcgagagtactagccagaaggtcgccgacagaaccaaatccgaaaatgggctgcagaatgagtcactgagctcaacacatcataccgacggtctgtctaagatacgactaaactactcggacgagtctcctgaggctggcaaaatgttggaggacgagctcgtggactttagcgaggatcaggacaaccaggacgactcatcagatgatgggtttctggctgatgacaattgtagctctgagattgggcagtggcatctcaaacctaccatatgtaagcagccctgcattctcctcatggacagtctgcgaggtccgtccaggagtaacgttgtgaagatactgcgggagtaccttgaggttgagtgggaagttaagaaaggctccaagaggagcttcagtaaggatgtgatgaaaggaagcaatcccaaagtacctcagcaaaacaacttctccgactgcggggtatatgtactgcagtatgtggagtcgtttttcgagaatcctattctcagcttcgagttaccgatgaacctagctaactggttccctcccccaagaatgcgcacgaagcgggaggaaatccggaacattatcctgaagttgcaggaagatcaatcaaaggaaaaaagaaaacacaaagacacctactccacagaggcccctctgggggaaggcacagagcagtacgttaatagcataagcgattag

SEQ ID NO: 136575 - DNA, 3339 bp, Artificial Sequence
  Description of Artificial Sequence: Synthetic coding sequence
atggcagcaggcaagtctgggggatcagcgggcgaaattaccttccttgaggcattagcacgatcggaaagcaagcgagacggtgggttcaaaaataattggagcttcgaccacgaagaggaaagtgagggcgataccgataaggatgggactaatctgctctcagtcgatgaggatgaggattccgaaacctcaaagggaaaaaaactgaaccgaaggagcgagatagttgcaaacagcagcggagagttcattctcaaaacatacgtgaggcggaacaagagtgaatcttttaaaactctgaaaggaaatccaattgggctgaatatgctttctaacaacaagaaactctctgaaaacacccagaatacttctctgtgttcaggcaccgtcgtgcatggacgaaggttccaccatgcccacgcgcaaattcctgtggtcaaaaccgctgcacagtcatcgctggacaggaaggagaggaaagagtatcctccacacgtgcagaaggtggagattaatcctgtgagacttagccgactgcagggggttgaacgcatcatgaaaaaaaccgaagagtccgaatcgcaggtagaacctgagattaaacgtaaggtacagcagaaacgacattgcagcacttaccagcccacccctcccctgtctcctgcatcaaagaagtgccttactcatctggaagacctacaaagaaactgcagacaggctattacattaaatgagtcaaccggacctctcctccggacgagtattcatcaaaactcgggtggacagaagagtcagaatactggcctgactaccaaaaaattctacgggaataatgtggaaaaagtgcctattgatattattgtaaattgtgatgactcaaagcacacctatcttcagaccaacgggaaagtcatcctgcccggagccaagatcccaaaaataaccaatctcaaagagcgcaagacatcacttagcgacctgaacgatcccatcatcttgagttccgacgacgacgacgataatgataggaccaataggcgggagagcatttccccccagcccgccgactcagcatgctcaagccctgctccctctaccgggaaggtggaggccgcattaaatgagaacacctgcagagccgagagagagctccgatcaatccccgaagatagcgagctcaataccgttacactacccagaaaagctagaatgaaggaccagttcgggaacagcattataaacactcctctcaagagacgtaaagtcttcagccaggaacctcctgacgccttagcgctgagctgtcagtcctctttcgattccgttatcctgaattgcagaagcatccgcgtgggaacactgttcagactcttgatcgagccagtcattttctgcttagattttattaagatacagctcgatgaacctgaccatgaccctgtggaaatcatactgaataccagcgatctcactaagtgtgagtggtgtaatgtgaggaagctgccagttgttttcctccaagccattcccgccgtctaccagaagctgtcaatccagctccagatgaacaaggaagataaagtgtggaacgactgcaaaggggtaaataagctgaccaatctggaagagcagtacataattttgatctttcagaatggactggatccacctgccaacatggttttcgaaagcattattaatgagattggaattaaaaataacataagtaacttttttgccaaaattcccttcgaggaggcaaacggtcggttagtggcgtgtactagaacctacgaagagtcaattaagggcagctgcgggcagaaagagaacaagatcaaaactgttagcttcgagagcaaaattcagctgcggagcaagcaggaatttcagtttttcgacgaggaagaggagacgggtgaaaaccacactatcttcatcggaccagtggagaagctgattgtgtacccacctccgccagctaagggcggcatttcggtgacaaatgaggacctccactgcttgaacgaaggtgagttcctcaacgatgtaattattgacttttaccttaagtaccttgtgctggagaaactcaaaaaggaggatgccgacaggatccacatattcagttcatttttttacaagagactcaatcagcgtgagcgtaggaaccacgagactactaatctgtcaattcagcagaagcgtcacggccgagtgaagacatggactagacatgtagatatcttcgagaaagactttattttcgtgcctctcaatgaagcggctcattggttcctggctgtggtgtgctttccaggcctcgagaagcccaaatatgagcctaacccacattatcacgagaatgcagtgatccagaaatgctcaacggtagaagattcatgcatttcaagctctgccagcgagatggaaagttgctcacagaactcatctgctaaaccagtcattaagaagatgctgaacaagaaacactgcattgctgtgattgatagtaacccgggacaggaggaaagcgatcctaggtacaaacgcaacatttgctccgtcaaatacagcgtcaagaaaatcaaccataccgcctcagaaaacgaggaattcaacaagggggagagtacctcccagaaggtggccgatagaacaaaatctgagaacggcctgcagaatgaaagcctgagcagcacccaccataccgatggcctgtccaaaatacggctgaactacagcgacgaaagcccagaagcagggaaaatgctcgaagatgagctggtggactttagtgaggatcaggataatcaagacgattccagtgatgatgggttcctagctgacgacaactgctcgagcgaaataggccagtggcatctgaaacctacaatttgcaaacagccatgcattctgctaatggacagtctgaggggccccagtagaagcaacgttgttaagattctccgagagtatctcgaggtggaatgggaggttaagaaagggagtaaaaggagctttagcaaagatgtgatgaaaggctctaatccgaaagtgccacagcagaataacttctccgactgtggtgtgtacgtgctgcaatatgtggaaagcttctttgaaaatcctatcctgagtttcgaactgccgatgaacctggccaactggtttccccctccaagaatgcgcaccaagagggaggagatcaggaacattattctcaaattacaagaggaccaatctaaagaaaagcgtaaacacaaagatacatactccacagaagcccctctgggcgagggtacagagcaatacgtcaattccatatccgactag

SEQ ID NO: 136576 - DNA, 1074 bp, Artificial Sequence
  Description of Artificial Sequence: Synthetic coding sequence
atggccgcggggaaatcaggagggagtgcaggagagatcacctttctggaggccttagcgcgctctgagtctaaaagagatgggggctttaaaaataattggtcttttgaccacgaggaagagtctgagggcgacactgacaaggacggaacaaatctgctaagcgttgacgaggatgaggactccgaaaccagcaaagggaaaaaactcaacagacgctctgaaatcgtggctaattcatcaggagagttcattctcaagacatacgtccgtaggaataaaagcgaatcctttaaaacccttaaaggcaaccccatcggcctgaacatgctctccaataataaaaagttgagtgaaaatacacagaataccagtttgtgttctggtactgtggtgcacgggcgccggttccaccacgcccacgcacagatccccgtggtcaaaacggctgcacagtccaaccagatcctaaaggaatatccccctcacgtgcaaaaggtggagataaatccggtcagactcagtcgactccagggggttgtgatcctgagctccgacgacgacgacgataacgacagaactaatcgccgagaatccatctcacctcagccggcggatagtgcttgcagtagcccagcacctagtacggggaaagtggaggccgcccttaatgagaatacctgccgcgcagagagggagttgagatccattcccgaagattctgaattaaataccgtgacattgccaaggaaggccagaatgaaagaccaatttgggaattcaattataaacacccctctgaagcgaagaaaggttttcagccaagagccccctgatgcactcgcactctcctgtcagtcctcttttgattcagtaatccttaattgcagatcaatccgggtgggcactctctttcgtctgctgattgagcctgtgatcgtgattatcaaaatattctttattactcacaagaaaccggaccacgatccagtggagatcatactgaacaccagcgaccttactaaatgtgagtggtgcaacgtacggaagctgcccgtggtgtttctgcagtag

SEQ ID NO: 136577 - DNA, 1107 bp, Artificial Sequence
  Description of Artificial Sequence: Synthetic coding sequence
atgaaagaccagtttggaaactccattataaacactcctctcaaacggcggaaggtgttttcccaagagccaccagatgccctggcacttagttgtcaatcgtcctttgactctgtgatcctcaactgccgatccatcagagttgggactctgttccgcctgctgattgagcctgtaattttttgcttggactttatcaaaattcaactggatgagccagatcacgaccccgtggagataattctcaatacttccgacttgacaaaatgcgagtggtgtaacgtgaggaaactccccgttgtattccttcaggcaatacccgccgtgtaccaaaagctgagcattcagcttcagatgaacaaggaagacaaggtgtggaacgactgtaagggagttaacaagctgaccaatctggaagaacagtatataatacttatttttcagaatgggctggatcctcctgccaatatggtctttgaatccataatcaatgagataggcatcaagaataacatctcaaattttttcgctaaaatcccatttgaggaggcaaatgggcggctggtggcatgcacccgcacttatgaggagtccatcaagggaagctgtggacagaaggagaacaaaatcaagaccgtctctttcgaaagcaaaatccagctgcgctcgaagcaggaatttcagttttttgacgaggaggaggagactggagagaatcacaccatttttatcggccccgtggagaaactaatcgtgtaccctcccccccccgctaaaggcggcatcagcgtaaccaacgaagacttacactgcttgaatgagggagaattcttgaatgacgttattattgatttctatctgaagtatctggtgctcgaaaaactgaaaaaggaggacgccgatagaatccatattttctcatcgttcttctataaaaggctaaatcagagggaaagacggaaccatgagacgactaatctctcaatccaacagaaacgacatggacgcgtgaagacgtggaccagacacgtcgatattttcgaaaaggacttcatcttcgttccactgaatgaggcatggctgaaacaaaatcagactaagctttag

SEQ ID NO: 136578 - DNA, 2955 bp, Artificial Sequence
  Description of Artificial Sequence: Synthetic coding sequence
atggacaaacgcaaactcggccgccggccaagcagctccgaaattatcactgaaggaaagcgcaagaagagtagcagtgacctgtccgagataagaaaaatgcttaatgcaaagccagaggacgtccacgtgcagtctcccttgtccaaattccggagttcagagaggtggactttgcccctgcaatgggagagatcactacgcaataaggtcataagcttggaccacaagaacaagaagcatatccgcggctgccccgttactagtaagtctagtccagagaggatacccagagtcatcctcacaaatgttctcggaaccgagctgggaagaaagtacatccggacccccccagttaccgaaggcagtctcagtgacactgacaatttgcagagcgagcagctgagcagctcctctgatggaagtctggaatcttaccagaacctcaacccacataagagttgctatctctccgaaagaggctctcagcgttcaaaaaccgtagatgataactcagctaaacagactgcccataacaaagagaaacgaagaaaggatgacggcatatcactcttaatcagtgatacacaacccgaggatttaaatagtggcagcaggggttgcgatcatctcgaacaggagtcccgcaataaggatgtgaagtattctgattctaaagttgagctgaccttaatctcacggaagaccaagcgtaggcttaggaataatctgcccgatagtcagtactgtacatccctcgacaagtccactgaacagacaaagaagcaggaggatgattctaccatttcaacggagtttgaaaagcctagtgagaattatcaccaggaccctaaactaccagaagagatcaccaccaaacccacaaagtctgattttacgaaacttagcagcctgaattcccaggaactgaccctgagcaacgccacaaagtccgcttctgcgggctctacaactgagactgtagagaactccaactctattgatattgtcgggatcagttcccttgtagagaaggacgaaaacgagctgaacacaattgaaaaacctatcttgcgagggcacaacgaggggaatcagtcacttatttcagctgagcctatcgtagtctcctcagatgaggagggacccgtagaacataagtcttccgagattttgaagctccagtctaagcaggacagggagacgaccaacgagaatgagagcactagcgaaagcgctctgcttgagcttcccctaattacctgcgagagcgtccagatgagttctgaattgtgtccgtacaacccggtcatggaaaacatcagtagcattatgccatccaatgagatggatttgcagttagactttatcttcacgtctgtgtacattggtaaaataaaaggtgcaagcaagggctgcgtgactataaccaagaagtatatcaagatcccattccaggtcagcctgaatgaaatctcactcctcgtggacacaactcaccttaaaagattcggactgtggaaaagcaaagatgataatcactccaagagatcccatgcaattctctttttttgggtaagctccgactacctgcaggaaatccagacacagttggagcacagcgtcctctcacagcagtccaagtcaagcgagtttatcttcttggaactccacaatcctgtctcccaacgcgaggagttgaaactcaaagacattatgaccgagatctcaatcatttccggcgagctggaactgagctatccactgagctgggtgcaggcgttccccctattccagaatctgtcttccaaggagagctcctttatccattattattgcgtttctacctgcagtttccctgcgggggtggcagtggcggaagagatgaagttgaagagcgttagccaaccctccaatacggacgcggccaaacctacctatactttcctgcagaagcagagtagcgggtgctactctctgagtataactagcaacccagacgaagaatggcgagaggtccgtcacacaggattagttcaaaagctgattgtatatccgccacctcctacaaaaggaggtttaggcgtcaccaacgaggacctcgaatgcctggaggaaggcgagtttctgaacgacgtgatcatagatttctatctgaaatatctgatactggaaaaggccagcgatgagttagtagagagaagccatatcttctcctccttcttctataaatgtcttaccaggaaggaaaataatctcactgaagacaacccaaacctttcaatggcacagaggcggcacaaacgagttcggacctggacacggcatattaatatcttcaacaaagattatatcttcgtgccagtcaacgagtctagccattggtacctcgccgttatctgttttccctggctagaggaggcagtgtacgaggattttccccaaacggtgagccagcagtcccaagctcagcagtcccagaatgacaataaaacaattgataacgacttgagaaccacgtctactctgtcactcagcgccgaagattcacagtcaacagagtctaacatgtcagtgcctaagaagatgtgcaagcggccttgtatcctgatcttggatagcctgaaagccgcgagtgttcaaaatacagtgcagaatctgcgggagtacctggaggtcgagtgggaggtgaagctgaaaacgcaccggcagttctccaaaacgaatatggtcgacctgtgtcctaaggttcccaagcaggacaattctagtgactgtggagtttacctcctccagtatgtcgaatcttttttcaaagatcccattgtcaacttcgaacttccaattcatttggagaaatggttcccccggcacgtcatcaaaaccaagcgagaagacattcgggagttaatcctcaaactgcatctccagcagcagaaaggctccagctcctag

SEQ ID NO: 136579 - DNA, 3054 bp, Artificial Sequence
  Description of Artificial Sequence: Synthetic coding sequence
atgttaaacgcaaaacctgaagatgtgcacgtgcagtcacccttatctaaattccgctcttcagagaggtggaccctacccctgcagtgggaacgctcattaaggaataaagttatttcacttgaccacaaaaataaaaaacatattagaggctgccctgtgactagtaagtcttccccagagaggcagcttaaggttatgctcaccaatgtgttatggaccgacctaggaagaaaatttcgcaaaaccctgccacgaaatgacgcaaacctgtgcgacgcgaataaggttcaatctgatagcctgccttctacaagcgtggatagcttggaaacctgccagaaacttgagcccctgcgccaaagcctgaatctcagcgagaggattccaagagttatcctgacaaacgtgttgggaaccgaactggggcgtaagtatatccggaccccgccagtcaccgaggggtcactgtccgacactgataacctgcagagtgagcagcttagtagctctagcgacggctccctggagtcataccagaacctcaacccgcataagagctgttacctctctgagcgaggtagtcaacgctctaagacagttgatgacaatagcgctaagcagactgctcacaacaaggaaaaacgcaggaaagatgacggcatttccctcttaataagcgatacacagcctgaagacttgaattctggatcgaggggctgcgaccatctggaacaagagagcaggaacaaggacgttaaatactcagacagtaaggtggagctgacgctgatcagccgcaaaacaaaaaggcggctcagaaataacctgcctgatagccaatactgcaccagcctggacaagagtaccgaacaaacaaaaaagcaagaagatgattctacgatctccacagaatttgaaaagccttctgaaaactaccaccaggatcccaagttgccagaagaaataacgaccaagccaacaaagagtgactttacgaaattgagctctctgaactctcaggagctgacacttagtaacgcaacaaaatctgccagtgcgggctcaacaacagagaccgtggaaaactctaactcgatagacatcgttggtatctcttcgctagtggagaaagatgagaacgagcttaacactattgaaaagcctattctgaggggtcacaacgagggaaatcagtctctcatctcagctgaaccaatcgtggtaagcagtgatgaggaggggcccgtcgaacataagtcctctgagatcctgaaattgcagtccaaacaggaccgtgagacaactaacgagaacgagtccacctcagagtcagccttgctcgaactccccctgattacgtgcgaatctgtgcagatgagctctgagctatgtccctataatcctgtaatggagaatatatcttcaatcatgccaagcaacgaaatggatctgcaactcgattttattttcaccagtgtgtacattggaaaaatcaagggcgcctcaaaggggtgcgttaccataacgaaaaagtatataaaaattccttttcaggtgtcccttaatgaaatttccctcctggtggacacgacccacctgaagcgcttcggcctgtggaagagtaaggacgacaaccactccaagcggtctcacgccatactctttttctgggtcagttctgattatctacaggagatccagacccagctcgaacactccgtgctgagtcaacagtccaaaagttccgagtttatattcctggaacttcacaaccccgtatcgcaacgagaagaactgaaactcaaggatataatgacagaaatctccataatctcgggtgaactggaactaagctatcccttgagctgggttcaagcttttcccttgttccaaaacctttcctccaaagaatcgagtttcatccattactattgtgtgagcacatgcagctttcccgccggtgtggcagtggcagaggagatgaagctgaaatcagtcagtcagccatccaacacggatgccgcaaaaccaacttacacattcctgcagaagcaatcctccggctgttattcgctgagtatcacctcgaaccctgatgaagaatggcgggaggtgcggcacaccggcctggtccagaaactgattgtgtatccccctcctcctaccaaagggggacttggagtgacgaacgaggacttagaatgcctggaggaaggcgagttcctgaatgacgtgatcatagatttttatctgaaatacctgatcttagaaaaagccagtgacgaattagtagaacggtcccatatcttttcctcattcttctataaatgcctgacacgcaaggagaataacttgacggaagataacccaaacctgtcaatggctcagaggcgtcataagagagtgaggacctggaccaggcacattaacatattcaacaaagactacatctttgttcccgttaatgaatcatctcactggtacctggctgtgatatgcttcccgtggctggaggaggcggtctatgaggactttccacaaacagtgtcacagcagagccaggcgcagcagagccagaatgacaacaaaacgatagataatgatctccgcactacctcaacactgagcttatccgctgaggacagccagtccactgaaagcaatatgtcagtgccaaagaaaatgtgtaaacggccgtgcatcttgattcttgactctttgaaggccgcctcagtgcagaacacagtgcagaatctgcgagagtaccttgaagttgagtgggaagtaaaattgaagactcatcgccaattttctaagaccaacatggtggatctctgcccaaaggttccaaagcaagacaacagctctgactgtggcgtctacctgctgcagtatgtggagagcttttttaaagatcctatcgtgaactttgaactcccgatacatctggaaaaatggtttcctcggcacgtgataaaaaccaagcgggaagacatacgggagctgattctcaaactccatctccagcagcaaaaaggcagctcctcatag

SEQ ID NO: 136580 - DNA, 2661 bp, Artificial Sequence
  Description of Artificial Sequence: Synthetic coding sequence
atgctgaacgccaaacccgaggacgtgcatgtgcagagtcccctgtccaaattcaggtccagcgaaaggtggacccttcccctgcagtgggaacgctcgcttaggaacaaggttatcagtttagatcacaaaaataagaagcacatcagggggtgtcctgttacgtccaagagcagtccagagaggggctcccagagatctaaaacagtggacgataacagtgcaaagcagaccgcgcataataaagaaaagcggagaaaggatgatggaatatccctccttatctctgacactcagccagaagatctgaatagcggaagcaggggctgtgaccacctcgaacaggaatcccgcaacaaggacgtcaagtactccgactctaaggtggaacttacactcatttccagaaaaactaagcgccgactgcggaataatctccccgactcccagtactgtacctcacttgacaaaagtacggagcagacaaaaaaacaggaagacgacagtaccatttctaccgagtttgagaaaccatctgaaaattaccaccaggatccaaagctgcctgaggaaatcactactaaacctaccaaatcggatttcacgaagctgtcaagtctgaacagccaggaactgaccctttctaacgctacgaaaagcgcttccgctggctcaaccacagagacggtcgaaaatagtaactccatcgatatcgtcggtattagctccctggtggaaaaggacgagaatgagttgaacacaatcgaaaaaccgatactgcgtgggcataatgagggcaaccagtcgctgatctcagccgaacctatcgtggtttcatccgatgaagagggccccgtagagcacaaatcatctgagatactcaagctgcagagcaagcaggatagggaaacaacaaacgaaaacgaatcaacctccgagtctgccttattggaactgccactgattacctgcgagtcagtacaaatgagctcagagttgtgcccatacaaccctgtaatggagaacatcagtagtatcatgccttcaaatgaaatggacctccagcttgactttatttttacttcggtctacatagggaaaatcaagggagcttctaaaggctgcgtaacaattaccaagaaatacattaaaattcctttccaggtctctctcaatgagatttctctcttagtggacaccacccacctgaagcgctttggcctctggaagagtaaggatgacaatcatagtaaacgaagtcacgcaattttgtttttctgggtgtcttccgactacttacaagagatccagacccagctagagcacagtgtgctatcacagcagtccaaatcctctgaatttatctttctcgagttgcacaaccctgtttcccagagagaggagttgaagcttaaagacatcatgactgaaattagtatcatttcaggggagttggagctgtcttacccattgagttgggtccaggcttttcccctcttccagaacctgtcctcgaaggaatctagttttattcattattattgtgtgtccacttgcagtttcccagctggcgtcgcagtggccgaagaaatgaaactgaagtccgtcagccagccctctaacactgacgccgcgaaaccgacctatactttcctgcagaaacagagctctgggtgctattcccttagcatcacaagcaatcctgacgaggagtggcgcgaagtaaggcacactgggctggtccagaagttgatcgtgtatccaccccctccgacaaaaggcggcttgggagtgaccaacgaggacctggagtgtctggaagaaggagaattccttaatgacgtgatcatcgacttctacttgaagtacctaattttggagaaggcgagcgacgaattggttgaaaggtcacacatattctccagttttttctataaatgcttgacacggaaggagaacaatctcaccgaggataatccgaacctgtccatggcccagaggaggcataaacgagttcgaacttggacacggcacatcaatatcttcaataaagactacatttttgttcccgtgaatgagtccagtcattggtacctggctgtcatctgcttcccctggcttgaggaggccgtgtatgaagacttcccacagactgtgagtcagcaaagccaggcccaacagagtcagaacgataacaagaccattgataacgacctgaggactacttctacgctttccctgagcgcagaggactcgcagtcaacagagtctaacatgagcgtcccaaaaaaaatgtgtaagcgcccttgcattctgatcctcgattctttaaaggccgcttccgtacagaataccgttcagaatctgagagaatacttagaagtcgagtgggaggtgaaattaaagacccacaggcagttctcaaagacgaatatggtggacctatgcccaaaggttccaaagcaagataactcatcagattgtggagtttatcttttgcagtacgtggagtctttcttcaaagaccctatagtcaattttgaactccccattcacctagagaaatggttcccacgacacgtaataaagaccaaacgagaggatattagagaacttatcctgaagttgcacctgcagcagcagaagggctcgagctcgtag

SEQ ID NO: 136581 - DNA, 717 bp, Artificial Sequence
  Description of Artificial Sequence: Synthetic coding sequence
atgaaaaaatttttgtacatcaagtcagtgtttcacacacttcggatggcccagaggagacacaagcgcgtgcgaacctggactaggcatataaacatcttcaataaagactacatattcgtaccagtgaacgaatctagccattggtatctggcagtgatatgttttccttggttggaggaggcagtgtatgaggactttcctcagacagtgagccaacagtcacaggcccagcagagtcagaacgacaataaaaccatagataatgacttgagaacaacgagcactctatccctgagcgccgaggacagtcaaagcacagaatctaacatgtctgtgcccaaaaagatgtgcaagcgaccctgtatcttaatccttgactccctgaaggctgcgtccgtacagaacacagtgcagaatctgcgcgaatacctggaggttgaatgggaggttaaactcaaaactcacagacagttttctaaaacgaacatggttgatctgtgcccgaaagtgcccaaacaggacaactccagtgactgcggggtttaccttttgcaatatgttgaaagcttcttcaaagatcccatagtgaattttgagctgcccatccacctggaaaaatggttcccccgtcacgtaattaagacgaagcgcgaggatatcagagagcttattctgaagttgcatctccagcaacagaagggcagtagtagttag

SEQ ID NO: 136582 - DNA, 2958 bp, Artificial Sequence
  Description of Artificial Sequence: Synthetic coding sequence
atggacaagaggaaacttgggagaagaccctcctcttcagaaatcatcactgaagggaagagaaaaaaatcttcttctgatctgagcgaaattcgtaagatgttgaatgccaaacccgaagacgtgcacgtccaaagcccattatctaagttcaggtcctcggaacgctggaccctccccctacaatgggaacgatcccttagaaataaggtgatctcactggaccacaaaaataagaagcacattcgcggctgtcctgtgaccagcaagtcgagcccagagcgccaattaaaagtgatgcttaccaacgtcctgtggacggacctgggcaggaagtttaggaaaactctgccaagaaacgacgccaacctgtgcgatgccaataaggtccagtccgactcattgccaagcaccagcgtggactcccttgagacttgtcagaagctggagcctctcagacagtctctgaatctgtccgaaaggggatcacagaggtcgaaaactgtggatgataatagtgctaagcagacagcacacaacaaggaaaagcggcggaaggacgatggtatctctctgctaatcagtgatactcagcctgaagacttgaacagcggcagtaggggctgtgaccacctggagcaggagagtcgtaataaggacgtgaaatatagtgattccaaagtcgagctgacattgataagccggaaaactaaaaggaggctcaggaataacctgcctgacagtcagtactgcacatcgcttgataagtctacggagcagaccaaaaaacaggaggatgacagtaccatcagtaccgagttcgaaaagcccagcgaaaactaccatcaggaccccaagctaccagaggaaattacaaccaaacccaccaagtccgattttactaaactgtcttccctgaatagtcaggagttgacgctgtctaacgccaccaagagcgcgagtgccgggtctactaccgagactgtcgaaaacagcaacagcatagatatcgttggcatctcgtctctcgtcgagaaggatgagaatgaacttaacacaatcgagaagcccattttgcggggtcacaatgaagggaaccagagcctcatctccgctgagccaatcgttgtgtcatccgatgaagaaggaccagtggagcacaagagctctgagattcttaaactccaatctaaacaggatagagaaaccaccaatgagaatgaatcgaccagcgagagcgctcttctcgagctgccattaattacctgcgagtccgtccagatgtctagtgagctgtgcccctataatcccgttatggaaaacatctcctctattatgccaagcaacgagatggacttgcagcttgacttcatttttaccagcgtatatatcggaaaaataaagggagctagtaaaggctgtgtaaccatcactaagaagtacattaaaattcccttccaggtttccttaaatgaaatatctttgctcgtggacaccactcatctgaagcgttttggcctgtggaaatccaaagatgataatcacagcaaaaggagccacgctattctctttttttgggtgagctctgactatctgcaagaaatccagacacagctcgagcactcagtcctgtcccaacaatccaaatcatcagagtttattttcctggaactccataacccggttagccaacgggaggagttgaagttgaaggatatcatgaccgagatttcaattatctcaggcgaactcgaactgagctacccgttgtcatgggtccaggcctttccgctttttcagaatctctcctctaaggagtcaagctttatccactattattgcgtgtccacgtgctcctttcctgctggcgtggcagtagccgaggagatgaaactgaaatccgtgtctcagccctcaaacactgatgcagctaagcctacttatacttttctgcaaaagcaatcctctggatgttactctttaagtattacctccaaccctgacgaagaatggcgagaagtccgacacactgggctggtccaaaagcttatcgtctatcccccaccacctacaaaaggcggcctgggagttacaaacgaagatctggagtgcttggaggaaggggaatttctcaatgatgtgataattgatttttatcttaagtacctgattttagaaaaggcgtccgacgaactggtggagcggtctcacatcttctcttcttttttctacaagtgcctcactagaaaagagaataaccttaccgaggataatccaaacttgtctatggcgcagaggcgccacaagagagtccggacttggactagacacatcaatatctttaacaaagattatatttttgtaccggtaaacgagtcctcacattggtacctggcggtaatctgctttccatggctcgaggaagcggtgtatgaagactttccacagacagtgtcgcagcagtctcaagcacagcagtctcagaatgacaacaagactatcgataatgacctgaggaccaccagcacactttcgttgagcgctgaggatagccaaagtaccgagagtaatatgtctgtgcccaagaagatgtgtaagaggccctgcattctgatcctggacagtttgaaggctgcatctgtccagaacactgttcaaaatcttagagagtacctagaggtcgaatgggaggtaaaactaaaaacccaccgccagttcagcaaaacgaatatggttgatctttgtcctaaagtgcccaaacaggataactccagtgattgtggcgtgtatctgctgcagtacgtggagtccttctttaaggatcccattgttaatttcgagctacccattcacttagaaaaatggtttccccgtcacgtcataaagactaaacgagaggatatacgggagctgatcctcaaactccacctccagcaacagaaaggtagctcctcttag

SEQ ID NO: 136583 - DNA, 3153 bp, Artificial Sequence
  Description of Artificial Sequence: Synthetic coding sequence
atggacaaacgaaagctgggccgccgcccatcctcatctgaaattatcactgagggcaagcggaagaagtcgtcctccgatctatccgaaatcagaaagatgctgaacgccaagcctgaggacgttcacgtacagagccccctctcaaagtttaggtcttcagagagatggacccttcctctgcagtgggaacggagcctgcggaataaggtcataagcctggatcacaagaataagaagcatatcagaggatgtcccgtgacatctaaatctagccctgagcggcaattaaaggttatgctaacaaacgttctgtggactgatctggggaggaagtttcggaagactctccctcgcaacgacgcaaacctttgcgacgcaaataaggtacaaagcgattcgttaccatcgacttcagtcgactccttagagacctgccagaagctcgagcccctgcgacagtctttgaatctcagcgaaagaatcccacgtgtgattctgacaaatgtgctgggaacagaactcggcaggaaatatatcaggacgcccccggtgacagaagggtctctgagtgacactgacaacctgcaaagcgagcaactctcaagtagttccgacgggtccctcgagtcttaccagaacctgaacccgcacaaaagctgctacctgagcgagcgcggaagccagcggtccaagaccgtcgacgacaattctgctaaacagaccgcccataacaaagagaagaggcgcaaagacgacggcatcagtctcctgatctctgatacccagcctgaagatctgaactctgggtctcgaggttgtgaccatctcgaacaagaatccaggaacaaggacgtgaaatacagcgactccaaagtcgaactcaccctcatttcacgcaaaactaaacgcagactgcggaataatttgcccgacagccagtattgcacctccctagacaagtccactgaacagacaaagaaacaggaagatgattctaccatttctaccgaatttgagaagccaagtgagaactatcaccaggaccccaagttaccagaagagatcaccaccaagcctaccaagtccgatttcaccaagttgtcttctctgaattcgcaggagctaaccctctccaatgcaactaaaagcgcatccgctggaagcacaactgagacagttgagaattcaaacagtatagacatcgtaggcatctcttcgttggtggagaaagatgagaacgaactgaacactattgaaaagccaatcctgagaggacataacgaagggaatcagtctcttatctctgccgagcctattgtggttagctcagacgaagagggacctgtcgaacataagagcagtgaaatacttaagctccagagtaagcaggatagggagaccacaaacgagaacgagtctacgagcgagtccgctctcttagagcttcccctcatcacgtgtgagtccgtgcagatgtcaagtgagctctgcccttataaccccgttatggagaatatttcttctattatgcccagcaatgaaatggacctgcagctggatttcatctttacatccgtgtatattggcaaaattaagggcgcaagcaagggatgcgtgacaatcaccaaaaaatatataaagatcccatttcaggtgagcctgaacgagatctccttgctagttgacactacccatctcaaaaggttcggattatggaagtccaaggatgataaccattcaaaacgatctcatgctatcctttttttctgggtatccagcgattacctccaagaaatccagactcagctggaacattccgtgctgagtcagcaaagtaagagttccgagtttatcttcctcgagcttcataaccccgtgtctcaacgggaggagctcaaactcaaagatattatgacggagatttccattatcagcggcgagctggagcttagttatccgctctcatgggtgcaggcctttcctctgttccagaatctgtccagcaaagaaagttcatttatccactactactgtgtgagcacctgctccttcccagccggcgttgccgtggcggaagagatgaagctcaagtcagtcagtcaacccagtaacacagacgcggcgaagccgacttacacctttcttcagaagcagtcaagtggctgttactccctctctatcacttcaaatccggacgaagagtggcgggaagtgagacacactggattggtccagaagctgatcgtgtaccctcctccacctacaaaggggggacttggcgtgacaaacgaagatcttgagtgcctggaagaaggagaatttttgaacgatgtcattatcgatttctacctgaaatatctaatcctagaaaaagcctccgacgagctcgttgagagatcacatattttttccagcttcttctacaagtgtctgacacggaaggagaacaacttgaccgaggacaatcctaacttgtctatggctcagagaaggcacaagcgggtgcgaacctggacacgtcacatcaatatatttaacaaggactacattttcgtaccagtgaacgagagctcccattggtacctcgcagtgatttgcttcccgtggttagaggaagctgtctatgaggacttcccacaaacagtcagtcagcagtctcaggcgcagcagagccagaacgacaataaaacaatcgataatgatctgaggacgacttcaacactgtccctgtccgccgaggatagtcagagcaccgagagcaacatgtctgtgccaaagaagatgtgcaaaaggccttgcatccttatcctggattcccttaaagcggcatcagtgcagaacaccgtacagaatctgagagagtacttagaggtggaatgggaagtcaaacttaagacccaccggcagtttagtaagactaacatggtggatctatgtccaaaagttccaaagcaagataactccagtgattgcggcgtctacctgctccagtacgtggagtctttcttcaaggaccccattgttaactttgagctccccattcacctggaaaagtggtttccacgccatgtaattaaaaccaaacgagaggatatacgggagcttatcctcaaactgcacctgcagcagcagaaggggagcagctcttag

SEQ ID NO: 136584 - DNA, 1770 bp, Artificial Sequence
  Description of Artificial Sequence: Synthetic coding sequence
atgtaccgatggctggtgaggattttgggtaccatcttcaggttttgtgatagaagcgtgcccccagccagagccctgcttaaacgccgtagatctgacagtacactgttcagcaccgtcgatacagacgaaatcccagcgaagcgtcccagactggactgctttatccaccaggtgaagaattctctgtataacgcagcttccttgttcggcttcccctttcagctcactacaaaacctatggtgacctcagcctgcaatgggacacgtaatgtggccccttcaggagaagtgtttagcaactctagctcttgtgagttgactggatccggttcctggaataacatgctgaagctcgggaataaatcaccaaatggaatctccgactatcccaaaatccgcgttaccgtaacccgggaccagccacggcgggtcctgccaagcttcggattcactctgaattctgaaggctgcaataggcgaccgggcggccgtagacattccaaaggcaatcctgagtcgtccctgatgtggaagccgcaggagcaggccgtaaccgagatgatctcagaagagtctggcaaaggtctcaggcggccacactgcacagttgaagaaggtgtgcagaaagaggaacgcgagaaatataggaagctacttgaacgtttgaaagagagtggacacggcaacagcgtctgtcccgtcacttccaactaccactcatctcagcggtcccagatggacaccctgaaaaccaaagggtggggcgaggaacagaatcatggtgtgaaaacaactcagttcgttccaaaacagtaccgccttgttgaaacgcggggccccctctgttcactgaggtctgagaagagatgctccaagggcaaaattactgataccgaaaccatggtgggcatcagattcgagaatgagtctcggagaggctatcagctcgaacccgacctctccgaggaagtgagtgctcgacttcgtttaggctcagggtcaaacgggctgcttcggcgcaaagtctctatcatagagaccaaggagaagaattgctccggaaaagaacgggataggcggacggacgatcttcttgaacttacggaagacatggagaaggagatctcaaatgcacttggacacggccctcaggacgagattctttcttcggcattcaaacttaggataacacgtggtgatatccagacattgaaaaactaccattggctgaatgacgaagtcataaacttttatatgaacctgttggttgagcgcaacaagaagcagggatatcctgccttacatgtttttagtaccttcttttatcctaagttgaaatcaggcggctaccaggccgtgaagcggtggaccaagggggtcaacctgttcgaacaagaaattatcctggtgccaatccaccgcaaagtacactggtctttggtggtaattgatctgagaaaaaagtgtcttaaatatctggactccatgggccagaaaggacatcgcatttgcgagattctccttcagtatctgcaggatgaaagcaaaactaaacggaactccgatcttaatcttctggagtggacgcaccactctatgaaaccacacgaaattcctcaacagctaaatgggtccgattgtgggatgttcacttgcaagtatgccgactacatcagtcgagacaagcccattaccttcacgcaacatcagatgccactgttccgcaaaaaaatggtttgggagatcctgcatcaacaactgctgtag

SEQ ID NO: 136585 - DNA, 1242 bp, Artificial Sequence
  Description of Artificial Sequence: Synthetic coding sequence
atgtggaagccccaggaacaggctgtgactgagatgatctcagaggaatctggaaagggcctgcgccgaccccattgcactgtggaggagggagtccagaaggaagaaagagaaaagtacaggaagctgcttgagagactgaaggaatccggacatggcaacagcgtgtgccctgtgaccagcaattaccatagctcacagaggtcacagatggacacattgaaaacaaagggctggggcgaagaacaaaaccacggtgtgaagacaactcagtttgtccctaaacagtaccgcttagtggaaaccagaggccctctgtgttctctgcggtctgagaaacgctgctccaaggggaagatcacagacaccgagacgatggtcggaattaggttcgaaaacgagagtcggcggggataccaattggagccggacctgtctgaggaggtgagcgcccgtttgaggttgggttctggttcaaacggactgctccgaaggaaggtcagcataatcgagacaaaagaaaaaaattgctctggcaaggaacgcgatcgtagaactgatgatctactggagctcacggaagacatggaaaaagagatcagtaatgccttaggccacgggccacaggacgagatcctgtcttcagccttcaagctgcggataacccgaggagatattcagaccctgaaaaattaccactggctgaacgacgaggttattaatttctacatgaacctcctggtagaaagaaacaagaagcagggctacccggcactgcatgtgttttcgaccttcttttatcccaagctcaagagcggcgggtaccaggccgtcaaacggtggactaagggggtcaacctatttgagcaagagattattttggttcccattcaccgaaaagtgcactggtcgcttgtagtcatcgacttgagaaagaagtgccttaaatatctggatagtatggggcagaaggggcacagaatctgcgagatcttattacagtatctgcaggatgaatcaaaaactaagaggaactcagacctcaacctgctcgaatggacccatcacagtatgaaaccacacgagattcctcagcaacttaatggcagcgattgcggtatgttcacctgtaaatatgctgattatatcagcagagataaaccaattaccttcactcagcatcagatgcccctgtttagaaagaagatggtttgggagatcctgcaccaacagttgctgtag

SEQ ID NO: 136586 - DNA, 1383 bp, Artificial Sequence
  Description of Artificial Sequence: Synthetic coding sequence
atgtatcgatggctagtgcggatcctcgggaccatcttccgattctgtgaccgcagcgtgccaccggctcgagctctgctcaaaagacggcgttctgattccactctgttcagtacagtggatactgacgaaatccctgctaaacgcccccgtctagattgtttcatccaccaagttaagaactccctctacaacgcagcctctctgttcgggttccctttccagttgactaccaagcccatggtcacctctgcctgcaatggaactcgaaatgtagcaccctctggagaagtgaatggaaactcagtttgtcccgtgacaagcaactaccactctagtcagagatctcagatggatacccttaagaccaaggggtggggcgaagaacagaaccacggcgtgaaaacaacccagttcgtccccaagcagtaccgtctcgtcgagacaagggggcctctgtgttctctccggtccgagaagcgctgcagtaaaggcaaaatcactgacaccgagaccatggtgggcattcgctttgagaacgagtcccgcaggggctaccagctggaacccgatctttcagaggaggtgtctgcaaggctgcggcttggcagtggatctaatggcctgctacggcgcaaggtgagtattattgaaactaaggaaaaaaattgttctggaaaggaacgggaccgcagaactgacgacctactcgaactgaccgaggacatggagaaggagattagtaacgctctgggacacgggccccaggatgagatactctcaagcgcatttaagcttcggatcaccaggggtgacattcaaactctcaagaactatcactggctgaacgacgaagtcatcaatttctatatgaatcttctggtcgagagaaataagaaacagggataccccgccctccacgtattcagtacattcttttaccctaagcttaaatcggggggataccaagccgttaaaaggtggacgaaaggcgtgaatctttttgagcaggagattattcttgtgccaattcataggaaagttcattggtctttggtggtgatcgacttgcgcaaaaagtgccttaaatatttggactccatgggacaaaaaggccacaggatttgtgagatactgctgcagtaccttcaggatgagtcaaaaaccaagaggaatagtgatctgaacctcttggaatggacccatcatagcatgaagccccatgagattcctcagcaactcaatggtagcgattgcggaatgttcacgtgcaagtatgcagactacatttcacgtgacaaacccattacattcacgcagcatcaaatgcctctcttccgcaaaaaaatggtatgggagatcctgcatcaacagctgctgtag

SEQ ID NO: 136587 - DNA, 1740 bp, Artificial Sequence
  Description of Artificial Sequence: Synthetic coding sequence
atggacagccacccctgtttgtactgcgggccacaggacagtgaggggacgaattggcagacctctccatctacgctgttttccacagtcgatacagatgagatccccgcaaagagaccacgtttggattgctttatccaccaggtcaaaaatagcctgtataatgccgcctctttgtttgggttcccatttcagctaaccaccaagccaatggtcacatctgcgtgtaatgggacccgaaacgtggccccctcaggcgaggtcttctccaatagctccagctgcgagcttactgggtccgggtcatggaacaatatgctgaaactaggcaacaaatcacccaatggcatcagcgactaccccaagatccgagtgactgtcactcgagaccagccccgacgcgtgctgccaagctttgggttcaccctaaattccgaaggttgcaacaggaggcccggagggaggagacattctaaaggcaaccctgagagctcactgatgtggaagccccaggagcaggctgtgacagaaatgatatcagaggagtcggggaagggactgcgccgaccacactgcaccgtggaggagggcgtccagaaagaagagagagagaagtatcggaagctacttgagcggctgaaagagtctggtcacgggaatagcgtctgccccgtaacctccaactatcatagctcacaaaggtcacagatggacaccctgaagactaaaggttggggggaggaacagaaccacggggtgaagactacgcagtttgtcccaaaacagtacagactagtggaaacaagaggtcctctgtgcagtctgcgaagcgagaaaaggtgctccaagggaaagatcactgatacagagaccatggtgggcattcgatttgaaaatgagtcacgacgcggttaccagcttgaaccggatctgtcggaggaggtgagcgcgagactgcgcctggggtctggctccaatggactcctgcggcggaaggtttcgatcatcgagacaaaggagaagaattgctcaggcaaagagagagacaggcggaccgatgatctgctggaacttaccgaggacatggaaaaagagatatctaacgcccttggacacggcccccaggatgagatcctcagctccgcttttaaactgcggatcacacgtggcgatattcaaacccttaagaactaccactggctcaacgacgaggttatcaatttctacatgaacctgctggtggaacgaaacaaaaagcaagggtacccagcgctgcacgtctttagcaccttcttttatcccaaactcaagtccggcggctaccaagccgtgaagagatggacaaaaggagtgaacctcttcgaacaggagatcatcctggtacccattcatcggaaggtgcattggtcactggtggtcatcgatctgcgtaagaagtgcctgaaatacctagattcgatgggccagaagggccaccgaatctgtgagatcctgcttcaatacctgcaggacgaatccaagacaaaaagaaacagtgatctgaatcttctagaatggactcaccatagtatgaagccccacgagatcccacagcagcttaatggatctgactgcgggatgttcacctgtaagtatgcagactacatctcacgcgataagccaataacttttacccaacatcagatgccgctcttcaggaaaaaaatggtctgggagatccttcaccaacagctgctctag

SEQ ID NO: 136588 - DNA, 1722 bp, Artificial Sequence
  Description of Artificial Sequence: Synthetic coding sequence
atgaaagagacgatacaggggactggctcatggggcccagagccgccaggcccaggaatacctcctgcatactcgagcccacgcagggagaggcttagatggccccctcctcctaagccgagattaaagagcggggggggcttcgggccagaccccggatccggcaccaccgttcccgccagaaggctaccagtacccaggcccagcttcgacgcaagcgcctcggaagaagaagaggaggaggaggaagaagaggatgaggatgaggaggaagaggtagcagcttggcgcctgcccccacgatggtcacaactgggcacaagccagcggcccagaccctcaagacccacccataggaaaacatgttcgcagaggcgcagaagggctatgagagcttttagaatgctgctgtacagcaagagtacctctctgacctttcattggaagctgtggggccggcaccgcgggagacggaggggccttgctcatcccaaaaatcatctgtcaccccagcaaggcggcgctaccccgcaggtcccaagcccctgttgtcgatttgatagccctcgtggccccccgcccccccggctgggattgctcggggctctcatggccgaggatggcgttcgggggtctccgcccgtcccgtctggtccgcccatggaggaagatggattacgctggacacctaagtcccccttggaccccgactccggcttgctatcctgcactttgcctaacggattcggcgggcagagcggtcccgaaggggaacggtctctggcacccccagatgcctccatcctgatctccaatgtctgcagcatcggtgaccatgtcgctcaggagctgttccagggaagtgaccttgggatggcagaggaggccgagagaccgggagaaaaagcaggacagcacagtccattacgcgaggagcacgtaacttgtgtgcagagcattttggatgaattcctgcagacctacggatctctgataccactgagtaccgacgaagttgtcgagaagctggaggacatcttccagcaggagttttccaccccaagtcgtaaggggttggttctccagcttatccagagctaccagaggatgcctggaaacgcaatggtacgggggttcagagtcgcttataagcgccatgtgctaacgatggatgacctggggaccttgtatggtcagaattggcttaacgatcaggtgatgaacatgtacggcgacctggtgatggacactgtgccagaaaaagtacactttttcaactcattcttttatgacaagttgaggactgggtacgatggagtgaagcggtggaccaagaatgtggatatcttcaacaaagaacttctgctgattcccattcacctggaggtacattggagcctgatttcagtcgacgtgcggcgcaggacaattacttattttgactcccagcgcacgctcaacagaagatgccccaagcacatcgccaaatatcttcaggcagaagcggtgaagaaggatcgactggacttccatcagggctggaagggctattttaaaatgaacgtggcgcggcaaaacaatgatagcgattgtggtgctttcgttttgcagtactgtaaacatctggcgttgtcacagcctttttcgttcacccagcaggatatgcccaagctccgcagacaaatatataaggagctctgccattgtaaactcacagtatag

SEQ ID NO: 136589 - DNA, 1725 bp, Artificial Sequence
  Description of Artificial Sequence: Synthetic coding sequence
atgaaggagacgattcagggcacagggtcttggggtccagagcctccaggacccggaatacctccagcctattctagcccgcgacgggagcggctgcggtggccacctcccccaaagcctcgcctgaagtcaggtggtggcttcggacccgaccccgggagtggaactacagtccctgcacggcgacttcctgttccgcggccctcctttgacgcatctgcaagcgaggaagaggaggaagaggaagaagaggaggatgaggatgaagaggaggaggttgccgcctggcgactcccgccacggtggtcgcaattgggaacgagccagcgcccccgtccttcacgacccactcaccgcaagacatgtagtcagaggcgacgcagagccatgcgagcgtttcgaatgctgctgtactcaaaatccaccagtctgaccttccactggaaactgtggggaaggcaccgtggccgaagaagaggcctggcccatcctaagaatcacctgagtccgcagcaggggggggctaccccgcaggtaccgagcccgtgttgcaggtttgactcaccccgcggaccacccccccccaggctagggctcctaggcgccctaatggcagaagacggagtgagaggcagtccaccggtccccagcgggccccctatggaagaggacggccttcggtggactccaaaatcaccattagatcccgattcagggctgctcagctgtacgctgcctaatggattcggcggacagagtggaccggagggggagagaagcctcgccccacccgacgcttctatccttataagcaacgtgtgctccatcggcgaccatgtagcgcaagagctgtttcagggctcggacctgggaatggccgaggaagccgaacggcccggagaaaaagccgggcaacatagtcctctgagggaagaacacgtcacctgcgttcagtcgatactcgacgaatttttacagacatatgggagtcttatccctctcagtacggacgaagtggtggagaagctcgaggacattttccagcaggagttttctacaccaagccggaaaggactggttctgcagctgattcaatcctaccagagaatgccaggtaacgcaatggtgcgggggttccgggtagcttacaagcgacatgtactcacgatggatgatctggggacactgtacggccagaactggttaaatgaccaggttatgaacatgtacggcgacttagttatggacactgtcccagagaaggtgcacttttttaatagttttttctatgacaagctcaggaccaaagggtacgatggcgtgaagcgctggacaaaaaatgttgatatctttaacaaggagctgcttctcatcccaatccacctggaagtccattggtcactgattagcgtagacgtaagacggcggaccatcacgtattttgactctcagcggacactcaaccgacggtgcccaaagcatatagctaagtaccttcaggccgaggccgtcaagaaggataggctcgactttcaccagggctggaaggggtacttcaagatgaacgtcgcgagacagaacaatgactcagactgcggcgcttttgttctgcaatactgtaaacacctcgcgctttcgcagccattctctttcactcagcaggacatgccaaaactcaggaggcagatctataaggaactttgccattgtaaacttactgtctag

SEQ ID NO: 136590 - DNA, 3741 bp, Artificial Sequence
  Description of Artificial Sequence: Synthetic coding sequence
atgatggagaccgaacggctcgtgctcccccctcctgaccccttagatctgcctctacgggctgtagagcttgggtgcaccggacattgggaactattgaatctccccggagccccagagagcagcctgccacatggcttgcccccttgtgcgcccgacctacagcaggaagcagagcagctgttcctctcttctccggcatggctgcctctacatggagttgagcactcggcccgaaagtggcagcgcaaaaccgacccatggtccctgttagccgtgttgggggcgcccgtaccctcagatctgcaggcacagcggcaccccaccaccggacaaatattaggctacaaagaggttctgctggaaaacaccaaccttagcgccaccacctcattatccctgaggcgcccgcctggcccggcttcacagagcctgtgggggaacccaacccagtacccattctggccaggggggatggacgaaccaacaatcacagacctcaacacacgggaggaggcagaggaggagattgattttgaaaaggacttgctcacaatcccacctggatttaagaaggggatggacttcgccccaaaggattgccccacaccagcacccgggctgcttagtctgtcttgtatgctcgagccactagatctgggcggcggagacgaggacgagaacgaagcagtagggcaaccgggcggtccacgcggggatactgtcagcgcctcgccttgcagcgcaccattggccagagcatcaagtttggaggatctggtgctcaaggaagcaagcactgctgtttccacacctgaggcccctgagcctccctcacaggagcagtgggccatcccagtagacgctacgtctcctgtcggtgatttttacaggctgataccccagcctgcttttcagtgggcctttgaacctgatgtttttcagaagcaagcaattctgcacctggagaggcacgattccgtctttgtggcagcacacaccagtgccggcaaaaccgtggtggccgaatacgctattgccttggcccagaaacatatgacaagaaccatatacactagtccgattaaggccctttccaaccaaaagttccgggactttcgcaatacattcggcgatgtgggtttgctcaccggcgacgtgcagcttcatcctgaagcatcatgcttaatcatgaccaccgaaatcctccggagcatgctctactcaggaagtgacgtgattagagacctcgaatgggtcattttcgacgaagtgcattatatcaatgacgtcgaacgaggagtcgtgtgggaggaagtgctcatcatgctgcccgatcacgtgagcatcatactcctgtcagctactgtgccgaatgctcttgagttcgcagattggatcggccggctcaaacgccggcaaatttacgtgatctcgacagtgactaggcctgtgccccttgagcactacttattcacaggcaactctagtaagacccagggggagctgtttttactgctagacagcaggggtgcgtttcacacaaaaggttattatgcagcagttgaggctaaaaaagagcgcatgtcaaagcacgctcagaccttcggcgccaaacaaccaacgcaccagggcggcccagcgcaggaccgcggagtctacttatccctgctcgccagtctcaggacccgagcacaacttccagttgtggtgttcaccttctctagaggccggtgcgatgagcaggcatccggactcactagtttagacttgactaccagctccgagaagtcagagattcacctttttctccagcgttgcctggctaggttacgtggctctgatcgacagttaccacaggtgctccacatgagcgagctcctcaaccggggcctcggggtgcatcatagcggtattttgcctatactcaaggaaattgtcgagatgctgttttctcgtggtctggtgaaagtactatttgcgacggaaacttttgcaatgggagtgaacatgcccgcccgaaccgtcgtgttcgactccatgcgcaagcacgacgggtctacgtttcgggacttgttgcctggggaatatgtgcaaatggctggacgggctggccgacggggcctggacccgaccggaactgtaatactgctatgcaagggccgggtgccagagatggcggacctgcataggatgatgatgggcaagcctagccagttacagtcccagttccgtctgacctacacaatgattcttaatctgttacgcgtagacgcactccgcgtcgaagacatgatgaagcggtctttcagtgaattcccctctcggaaagactctaaggcacacgaacaggcactagcggaactcaccaaaaggttaggagccctcgaggagcctgacatgaccggacaactcgttgatctgcctgagtactactcttggggcgaagagctgaccgaaacacagcatatgattcagaggcggataatggaatctgtaaatgggctgaagtctttgtcagctggcagagtcgttgtagtgaagaaccaggaacaccacaacgccttgggagtcattctgcaagtaagctcgaactccacctctagagtgtttacaaccctcgtgttatgcgacaagccattgtcccaggatccccaggaccggggacccgccactgccgaagttccataccctgacgacctggtcgggttcaaactgttcctgcctgaggggccctgcgaccacaccgtggtgaaactccagcctggagacatggccgctatcacgaccaaggtgctacgcgttaacggcgaaaagattctggaggacttctctaaaagacagcagcctaaattcaagaaggacccgcctttggcagctgtgacaaccgccgtgcaagagcttctccgactagcacaggcccatcccgcaggccccccaaccctggaccccgtgaatgacctacagctgaaagacatgtcagtggttgaggggggccttagagctcgaaagttagaagaattgattcagggagcccagtgtgtgcattcccctagattcccagcacagtatctgaagctgagggagaggatgcaaatccagaaagaaatggagcgcctgcgattcctgctgtctgaccagagtctgctgcttctgccggagtaccatcagagggtcgaggtgcttcggacactaggctatgtcgatgaagccgggacggtgaaactcgccggccgggtagcatgcgccatgagctctcacgaattgctgctgactgaattgatgttcgacaatgccctgagtactctgcggcccgaagagatagcggcattattgtcagggctggtgtgtcaatctccaggagacgccggcgaccagctcccaaataccctgaaacaaggcatcgagagggttcgagccgtagccaagcgtataggcgaggttcaggtggcatgtggtttgaatcagaccgtggaagaattcgtcggcgaactgaacttcggcctagtggaagtggtctacgagtgggcgcggggaatgcctttctccgagctggctggactgtctgggactcctgagggactggttgttcggtgcatacagcggcttgcagaaatgtgccggtccctacgcggtgccgctcggctggtcggggagcctgtcctgggtgctaaaatggaaacagctgccacactgctccgccgtgatatagtctttgccgcttcgttatacacccagtag

SEQ ID NO: 136591 - DNA, 3741 bp, Artificial Sequence
  Description of Artificial Sequence: Synthetic coding sequence
atgatggaaactgaacggctcgtcctgcctccgcccgaccccctagatttaccattgagagcagtggagctcggatgtacaggccattgggaactgctgaatctgcccggcgctcccgaatcatcactgccacacggactccccccatgcgctcccgatcttcagcaagaagccgaacaactttttctctcttctccggcttggcttcctctgcacggcgtggagcacagtgcccgtaagtggcagcgcaagaccgatccatggagtctgctggctgtcttaggcgcacccgtgccctctgacctacaggctcagcgccacccaaccactggacaaatcctcgggtacaaagaggtgctcctcgagaatacaaatctgagcgccacaacctccctctctctgcggagaccgccaggccccgcgtcccagtcattatggggcaaccctactcagtatcccttctggccaggcggcatggatgaacccacgataaccgacctgaacacaagggaggaagctgaagaagagatcgatttcgaaaaagatttgctgaccatccctcctggctttaagaaaggaatggatttcgcacctaaggattgccccactccagcacccggcctcctctcgctaagctgtctgctcgaacccttggatctgggcggcggcgatgaggatgagaacgaggccgtagggcagcccggcggtcccaggggggatactgtatcagctagcccctgctctgctcccctggcccgcgcctcatcactcgaggatctcgtgttaaaggaagccagcacagcagtgtcaacaccagaggcgcctgagcctccgagccaggagcagtgggctattcctgtggacgccacgtccccagtgggagacttctacagattaatcccccagcctgcattccagtgggctttcgaaccagacgtgttccaaaagcaggcaatcctccatttggagaggcatgattcggttttcgtagctgcccacacctctgccggcaagacagtcgtggccgaatatgcaatagcactcgctcagaagcacatgactcgtaccatttatacaagcccaatcaaggcactgtccaatcagaagttcagagatttccgcaatactttcggggatgtgggcctcctgaccggagacgtgcaactgcaccccgaagccagttgtctgattatgacaacagagatcttacggagcatgctctactccggttcggatgtgataagagacctggagtgggtcatttttgatgaagtgcattacatcaacgacgtcgagcgtggcgtggtttgggaggaggtcctgatcatgctccctgaccacgtgtccatcatactcctaagcgccacggtgccaaacgccctggagttcgctgactggattggacgactcaagcgccgccagatctatgtcatcagtacagtgacaagaccagtgcccctcgagcactaccttttcaccggcaattcctcgaaaacccagggagaactcttcctgctactggattctcgaggcgcttttcacactaaaggctactatgccgcggtggaggctaaaaaggaacgcatgtcaaagcacgcccagacatttggagccaaacagcctacccaccagggcggacctgctcaagaccgcggagtgtacctttctttattagcctcgctccgaacgagagcccagctgccagttgtggtgttcactttcagtcggggcagatgcgatgagcaggcctccggtctcacgagcttagacttgacgactagttcggagaaatctgagatccatttgtttttgcaaagatgtcttgctagattgcgggggagtgatcgacagctgcctcaggttttgcacatgtctgagttgttgaatcggggcctgggagtgcaccattcaggaatcctgcctattctgaaagagattgtggagatgctgttctcccggggcctcgtgaaagtgctattcgcaacagaaacgtttgctatgggcgtgaacatgccagcaaggacagtagtgtttgactccatgcgcaagcacgatggcagcacattcagagatttactgcctggtgagtatgtgcagatggccggacgggcaggtagacgggggctcgacccaacgggcacagtgatcctgttgtgcaagggccgcgtgccagagatggcggatctgcatcgcatgatgatgggaaaaccctctcagctccagtcgcagttccgcttgacttacacaatgatccttaacctgctgcgggtggatgctctgagagtggaggatatgatgaagcgttcttttagtgagtttccctcccgcaaggactctaaagcccacgagcaggccctcgccgagctgaccaaacggctcggagcactcgaggagcctgatatgaccggacagctggttgacctaccagagtactacagctggggggaggaactcactgagactcagcacatgattcagagacggatcatggagtcagtgaacggcctaaaaagcttgtcggcaggcagagtggtggtggtgaaaaatcaggagcaccataatgcactcggtgtaatcctgcaagtgagtagtaattccacatccagagtttttaccacgctggtgctatgtgacaaacccctgtctcaagatccccaggacagggggcctgcaactgcagaggtgccctatcccgatgacctggtcggattcaagttatttcttcccgagggtccgtgcgatcacacggttgtgaaactgcagccaggcgatatggctgctatcactactaaagtgttgcgagtgaacggagaaaagatcttagaagatttttccaaacggcaacagcccaagtttaagaaggatccaccactagccgcagttaccacggccgtgcaggaattgctcagactcgcccaggcccacccagctgggcctcctacgcttgacccagtgaacgatctgcagttgaaggacatgagtgtggtcgaaggtggactgagggcccgtaagctggaagaactgattcagggcgcccagtgtgttcacagtccaagatttccagctcagtacctgaaactcagggaacgcatgcagatccaaaaggagatggaacgactgcggttcctgctgtcagatcagagcctcttgctgctcccagagtaccaccagagggtggaagtgctccgaaccttggggtacgtagatgaagcagggaccgtaaagctcgccgggcgagttgcctgcgccatgagttcacacgaacttttgctgactgaactgatgttcgacaatgctcttagcactctgcgcccagaagaaatcgccgcgctgctgtcaggcctggtgtgtcaatcacccggcgatgccggtgaccagctgccaaacacccttaaacagggtattgaacgcgtaagagccgtagcaaaacgcattggtgaggtgcaagtggcctgtggcttgaatcagactgtggaggagtttgtgggagagttgaacttcggactcgttgaggtagtctacgagtgggcccgtggcatgcccttctccgaacttgctggcctgtcaggaaccccagaaggactggtggtgagatgtatacaacgcctggcggagatgtgcaggtcgttgcgaggagcagcccgcctggttggagaaccagtgctaggcgcaaaaatggagacagctgcgacactgttgcgccgcgacatcgtctttgctgcatccctatacactcagtag

SEQ ID NO: 136592 - DNA, 3741 bp, Artificial Sequence
  Description of Artificial Sequence: Synthetic coding sequence
atgatggaaactgagagattagtccttccacccccagatccactcgacctgccgcttcgggccgtagaactgggatgcaccggccactgggagctgctgaacctgcctggggcacctgagagttcgcttccgcacggactacccccctgtgcaccagatctacagcaggaagccgagcagttgtttttatcctccccagcttggttgcccctgcacggcgtcgaacacagcgcaaggaagtggcagaggaagaccgatccctggagcctgctggcagttctgggggcacctgtgccgtcggacctgcaggctcaacgccaccctacgaccggtcagattctgggctataaagaggtcctgctagaaaacaccaatcttagcgccacaacaagcctgagccttagacgacccccaggacctgctagtcagagcctttggggcaatccgactcagtaccccttttggccaggtgggatggatgagcccactattaccgacctgaacacaagagaggaggccgaggaagaaatcgacttcgagaaagacctcctgacaatcccaccgggtttcaaaaagggcatggacttcgctcctaaagactgcccgacccccgcaccaggactgctctcgctgagctgcctgcttgagccattggacctgggtggtggcgatgaggatgagaacgaagctgttggccagccaggtggaccaaggggagatactgtcagcgcttccccttgtagtgctccccttgccagagcaagctctctggaagaccttgtgttgaaagaagcaagtaccgcagttagcaccccagaggcgcccgagcccccctctcaggaacagtgggccattcctgtcgacgccactagtcccgtaggggacttttataggcttatacctcagcctgccttccagtgggcgtttgagccagacgtgttccagaaacaggccatcctgcatctggagcgtcacgacagcgtctttgtcgccgcgcacaccagcgccgggaagacagtggtcgctgagtacgctatcgcattggcacagaagcatatgacacgcactatctacacatcccccatcaaggcattgtcaaatcaaaaatttcgcgatttcaggaacacctttggcgatgtcggtctgttgacaggtgacgtacagctccacccagaagcctcctgcctcattatgactacggagattttgcgctctatgctttacagcggcagcgatgtcatacgcgaccttgaatgggtcatttttgacgaagttcactatatcaatgacgtggagaggggggtagtctgggaggaagtgctcattatgctgcctgaccacgttagtatcattctcctgagcgctacagtccccaatgcgctcgagtttgcggactggattgggcggctgaagagaagacagatatatgtgataagcacagtgacccgaccagtgccactggaacactatctgttcaccgggaactcgagtaagacccagggagaactcttcctgctgctcgactctcgcggggccttccataccaagggatattacgcagccgtggaggctaagaaggagagaatgagcaaacacgcacagacattcggggccaagcagccaacacatcagggggggcctgcccaggaccgcggcgtttacttatctttgcttgccagtctccggactagggcccaattgcctgtcgttgtgtttacgttcagcagaggtagatgcgatgagcaggctagcggtctcacatccctggatcttaccactagctcagagaaatcagagattcatctgttccttcagaggtgtctggcacggcttcggggcagcgatcggcaactgccacaggtgttgcatatgagcgagttgctgaaccgcggcctcggggtgcaccatagcggaatactgcccatcctcaaggagatcgtggaaatgttgttcagtaggggtcttgtgaaagtgctgtttgcaacggaaaccttcgccatgggcgtcaacatgccagcccgcacagtcgtcttcgattccatgaggaagcacgacggatccaccttccgtgacctcttaccgggcgaatacgttcagatggccggtcgcgccggacgacggggcttggaccccactggtactgtgattctgttgtgtaagggacgggtgccagagatggccgacctgcaccggatgatgatgggtaaacctagtcagctgcagtcccaattccgcttaacctatacaatgattttgaacttgctccgggtggatgctttgcgtgttgaggacatgatgaagcgctctttttctgaattcccttcacgcaaggattccaaagctcatgagcaggcactggccgagctaactaaaagactgggagctctcgaagaacccgacatgactggtcagctagtggacctgcctgaatactacagctggggtgaagagctgaccgaaacccagcatatgatccaacggagaatcatggagtccgtcaacggcctcaaaagtttgtccgctgggcgggtagtcgtggtcaagaaccaagagcatcataacgctctcggcgtcattctccaggtgtctagtaattctaccagtagagtgttcacaactctcgtgctctgtgacaagccactatcccaagatcctcaggatcgcggtcccgctactgccgaggtcccttatcctgatgaccttgtggggtttaagctgttcctgcctgaggggccttgtgatcatacagtggtcaaactccagccaggggacatggccgctataactaccaaagtgcttcgagtgaatggggagaagatcctagaagacttctctaagaggcagcagccaaagttcaagaaggacccgcccctagcagcagtgaccacggcagtgcaggagctgctgaggctggctcaggcacatccagccggacccccgactctggatcccgtgaatgacctgcagctcaaggatatgtccgtggtcgagggtggcctaagagccaggaaactggaggagttgatccagggagcccagtgcgtgcacagtccacggtttcccgctcaatatcttaagttaagagagaggatgcagattcagaaagagatggaacgccttcgtttcctattgtccgaccagtctcttctgctcctcccagagtatcatcaacgggtggaggtactgaggaccttgggatatgtcgatgaggccgggaccgtaaagctagcaggtcgggtagcctgtgccatgtcatcccatgaacttctgctcactgagctgatgttcgacaatgctctctccacactacggcccgaagagattgcagccctcctatctggacttgtgtgtcagagcccaggcgatgccggtgaccaactgccaaacacgctcaagcagggtatcgagagagtcagagcggtggccaagcgtatcggcgaggtccaggtggcctgtggcctgaatcagaccgttgaagagtttgtgggcgaactcaactttggcctggtggaggttgtatacgagtgggccagaggcatgcccttctccgagttagccggtctgagcggaaccccggaaggacttgtcgtgaggtgcattcaacggttagcagaaatgtgcagaagcctgcgtggtgccgcccgcctggtgggggagccagtcctcggagcgaaaatggagaccgctgccaccctgctgagaagggatatagtattcgccgcttcgctgtatacgcagtag

SEQ ID NO: 136593 - DNA, 3741 bp, Artificial Sequence
  Description of Artificial Sequence: Synthetic coding sequence
atgatggaaacagagaggctagtgctcccaccacccgaccctctcgacttgccactacgcgcagtcgagttgggctgcaccggtcattgggagttactgaatctcccgggagctcccgagtcgtccctgcctcacgggcttcccccctgtgcccctgatcttcagcaggaggccgagcagcttttcctgagtagccctgcttggctgcctctgcacggagttgagcacagtgcccgtaagtggcaacggaagactgacccctggtcactgctcgccgttttgggagctccggtgccctcggatttgcaggcgcagcgccatcccacaaccgggcagatactaggatacaaagaggtgttgctggagaatacaaatctgtccgccacaactagtctgtctctcagacggccccccgggcctgcctcacagtccctatggggaaaccccacgcagtacccattctggcccggcggcatggacgaacctaccataaccgatttaaatacacgcgaagaggccgaggaagaaattgattttgagaaagacctactaacaatcccccctgggtttaagaagggtatggactttgcccccaaggactgccccactcccgcacccggcctactgtccctgtcctgtctgctcgaaccgttggatctggggggcggcgatgaggatgagaatgaggcagtgggtcagcctggaggtccccggggagacacggtctctgcttccccatgtagcgccccactggcaagggccagttcacttgaggacctggtgctcaaagaggccagtactgccgtctccacccccgaagcacccgaaccacccagccaggagcagtgggctatcccagtggacgctacttcccctgtcggcgatttttacagactaatcccacagccggctttccagtgggcgttcgagcctgacgtctttcagaagcaggctatcttgcaccttgaacggcacgacagtgtatttgtcgccgcccatacctctgcaggaaaaaccgtggtggccgaatatgcgatcgctctagcacagaaacatatgacaagaactatctacacctcccccatcaaggccctgtctaatcaaaagtttagggacttccggaacacattcggcgacgtaggcctgctgacgggcgacgtccagctgcacccggaggcaagttgcctcatcatgacaacggagatcctaagatctatgctgtactctggatctgatgtaattcgcgatctggagtgggtaatattcgatgaagtgcactatattaatgatgtcgagagaggtgtggtttgggaagaggtcctgatcatgctgccagatcatgtctcaatcattctactgtccgccacggtgcccaacgctctggagtttgccgactggatcggcagactcaaaaggcggcaaatatatgtgatctccaccgtgacaaggcctgtgcccttggaacactatctttttacgggtaatagcagtaaaacccagggagagctcttcctgctgcttgatagccgcggagcgttccataccaagggatactacgctgcggttgaggcaaaaaaagagaggatgagcaagcacgctcagaccttcggggctaagcaacctacccatcaaggcggtccagctcaggatcggggggtgtatcttagcctccttgcctccttgcggacacgggctcagctacccgtggttgtgttcactttctctcggggtcgctgcgacgaacaggcatccggactcacctcactcgatctgaccacatcaagcgaaaagagtgagattcatctgtttctacagcgctgcctggcgcgactgcgcggcagcgaccgacagcttcctcaggttctgcatatgtcagaattgttgaatcggggattgggtgtacaccacagtggaatcctccctatcctaaaagaaattgtggaaatgctgttttcaagagggcttgtaaaggtcctttttgccacggaaacatttgccatgggagttaatatgcctgccaggacagtggtgttcgactccatgcggaagcatgacggtagtacattccgagatctgttacctggagaatatgttcaaatggctgggcgggccggtcgccgcgggttggatccaacaggcactgtgatcctcctctgcaaaggacgcgtcccagagatggcagatcttcatcgtatgatgatggggaaaccctctcagctgcaaagccagttccgcctaacctatacgatgattctgaatctgttacgggtcgatgctctcagagttgaggacatgatgaaacgatccttcagtgaatttcccagtcgaaaggactccaaagcccacgagcaggcccttgcagagctcaccaagcgcttaggcgcactcgaggaaccggatatgaccggacagctggtcgacctgccagaatattattcatggggtgaggagctcacggagacacaacacatgatccagcgacgaatcatggaatccgtgaacggactgaagagtttatccgccgggcgtgtggtcgtggtgaagaaccaggaacaccataacgctttgggagttattttacaagtttcatcaaacagcacatctcgagtgtttacaacacttgttttgtgcgacaagcctctgagccaagatccccaggacagaggccctgcaactgcagaggtcccctatccagatgatctggttggcttcaaactgttcctgccggaggggccttgtgaccataccgtggtcaaacttcaaccaggagatatggccgcgatcactacaaaagttttgagggtcaacggcgagaaaattcttgaggacttctccaaacgacaacagcccaaattcaagaaggacccaccgcttgcagctgtaaccaccgccgtgcaggaacttttaaggctggcccaggcgcaccctgcaggaccaccaacactggatcccgtaaacgatctccaactgaaggatatgagcgtagtcgagggtggactgcgagccagaaaattggaagaactgatacagggcgcccagtgtgttcacagtccacggttcccagcacagtatctgaagcttcgtgaaaggatgcagatccagaaagagatggaacgcctgaggttcctactctctgaccaaagcttgctgctgttgcctgaataccaccagcgggttgaggttttgagaacactagggtacgtggacgaagcaggcaccgtcaaactggccggtcgggttgcctgtgcaatgagctctcacgaactattgctcacagaattgatgttcgacaatgccttgtccaccctgaggccagaggagatcgccgctctactcagcggcctggtgtgtcaaagccctggagatgccggcgatcagttgccaaacactctgaagcagggcattgaacgcgtgcgcgccgtggccaagcgaatcggagaggtgcaagtcgcgtgtggacttaatcagactgtcgaggagtttgtgggagaactcaatttcggcctcgtcgaggtggtgtatgaatgggcgcgggggatgcccttctctgagctcgctggcctgtcaggtacgcctgaggggctcgtggtgcgttgtattcagcgactggctgaaatgtgcagatcactgagaggggcagctcgcctggtcggagaaccggttctgggagcgaaaatggaaacagccgccacactgctgagacgtgacattgtgtttgcagcttcactgtatactcagtag

SEQ ID NO: 136594 - DNA, 3741 bp, Artificial Sequence
  Description of Artificial Sequence: Synthetic coding sequence
atgatggagactgagcggcttgtccttcccccacccgacccacttgatctgcccctcagagcagtggagctgggatgcaccggacactgggaactgttgaacctgcccggggcccccgaatctagcctgcctcacgggttaccaccatgcgcccctgacctccagcaggaggccgagcaactctttctcagctctcctgcttggctgccgttacacggggtggaacatagtgcaagaaagtggcagcgaaaaacagatccttggagtcttctcgccgttttgggcgctccggtcccaagcgacctgcaggcccaacggcatccaacaactgggcagatcctgggctacaaagaagtcctcttagaaaacacaaacctctccgccactacaagcctgagtctgagaaggcctcctggacctgccagtcagtccctctggggaaatcctacccagtaccctttctggcccggaggcatggatgaacccactataaccgacttgaatactagggaggaagccgaggaagagatcgactttgaaaaggacttgctgacaattccccccggcttcaagaaaggcatggatttcgcacctaaggattgcccgacacccgcacccggactgctgtctttgtcctgcttattagagcccctggatctggggggcggcgacgaagatgaaaatgaagccgtggggcagcccggaggccctcggggtgacaccgtgtccgctagtccgtgtagcgcacctctggcaagggctagttcacttgaggatctagtcttaaaggaagcctctaccgccgtgtcaactcctgaggctcccgagccacccagtcaggaacaatgggcaatacccgttgacgcgactagcccagttggagatttttacagactgatcccgcaacccgctttccaatgggccttcgaacctgatgtcttccagaaacaggcgattttgcacttggaaagacacgactcagtttttgtcgccgcccacacaagcgctggcaagacagtggtggcggagtatgcaatagctctcgcccaaaaacacatgacacgtaccatttacacaagtccaatcaaagctctctccaaccagaaattccgagactttcgcaatacatttggggacgtcggtctcctcaccggagatgtgcagctgcaccccgaggctagctgtctgatcatgacgaccgagatcctcagatcgatgctgtatagcggttctgatgtgatccgcgacctggagtgggtgatctttgatgaagtgcactatataaacgatgtggaacgcggagtcgtctgggaagaggtgctcatcatgcttcccgatcacgtgagtattatcttactgtccgcaacagtgccaaacgctttggaattcgcggactggattgggcgcctgaagaggcggcagatatacgtgatctccaccgtcacaagacccgtgcccctcgagcattacctgtttacgggaaattcgtctaagacccaaggggagctctttctgttgttggatagtcggggcgcttttcacaccaaagggtactacgctgccgtggaggcaaaaaaggagaggatgagtaaacacgctcagacttttggtgctaagcaaccgacacaccagggcggaccagcacaggaccgtggggtgtatctttcgctgcttgcttcgctgcggactcgtgcgcagctgccagtcgtggtgttcacattttctcgagggcgatgcgatgagcaagcaagcggtctcacctcgctagatctgacaacttcttccgagaaatctgagatccacctcttcttgcagcgatgcctggcccgccttagaggcagtgaccggcagctaccacaagtgcttcatatgtcagaacttctcaatcggggcctaggcgtccaccactctggcattcttcccatcctcaaggaaatcgtggaaatgctgttctctcgaggactagttaaggtgcttttcgccaccgaaactttcgctatgggcgtgaatatgcctgcccggaccgtggtgtttgatagcatgcgaaagcacgacggcagtacattccgggatttgctgccgggagagtacgtccagatggcgggccgcgccggaagacgcggacttgacccgacgggtacagttattctcttgtgtaagggtcgcgtaccagagatggctgacctacatcggatgatgatgggcaagcctagccaattacagtcccagttcaggcttacttacacaatgatcctaaacctattgcgtgtcgatgctctgagagttgaggatatgatgaaacgttctttttctgagtttccctctagaaaagattctaaagcccacgaacaggccctcgccgagctgactaagcggctcggtgcgctggaggaaccagacatgactggccaattggtggacctgcctgagtactattcctggggagaagagctaaccgagacacagcacatgattcaacgtcgtattatggaatccgtgaatggcttaaagtctctcagcgctggacgagttgtcgtggttaagaaccaggaacaccataacgccttgggcgtcatactacaagtcagctccaactctacatcaagggttttcaccaccctggtgctatgcgataaacccctgtcccaggatccccaggaccgaggccctgccaccgccgaggtcccttatccagatgacttagtgggcttcaagctctttctgccggaaggcccatgcgaccatacagtagtgaaactccagccaggggatatggcagccattacgacgaaggtgctaagagtgaacggggaaaagatactggaagatttttctaagcgccagcagcctaagtttaaaaaggacccccccctcgctgctgttactactgcagtccaggagctgctcagacttgcccaggcgcatcccgctggccccccaactctggacccagtgaacgacctgcagctgaaggatatgtccgttgtggagggcggcctgcgtgctcggaagttggaggagctgatacagggggctcagtgcgtgcattcgccgcgttttcccgcgcagtatctaaagctgcgcgagcgtatgcagatacaaaaggagatggaacggctccgttttctgctgagcgaccagtccctccttttgcttcccgagtaccatcagagagtagaggtcctgcgaactctggggtacgtggatgaagccggcaccgtgaagctggccggaagggttgcatgtgctatgtcctcacacgagctgcttctgacagaacttatgtttgataacgctctttcaacgctgaggcccgaagaaatcgctgccctcctcagtggactggtgtgccagtcgcccggtgacgctggcgaccaactgcctaacactctgaagcaggggatagaacgtgttagggcagtcgccaagcgaatcggtgaggtgcaggtggcttgcggccttaatcagacagttgaggagtttgtcggagagctgaactttggcctggtcgaggttgtgtacgagtgggcacgcggcatgcctttttctgagttagccggcttgagcggtactcccgaaggactcgttgtgcggtgtatccagcggctcgccgagatgtgtcggtctctcagaggggcggcgagactcgtgggtgagccagtgctaggcgctaaaatggagacggccgccacactgctcaggcgagacatcgtatttgccgcatctctttatacacagtag

SEQ ID NO: 136595 - DNA, 3267 bp, Artificial Sequence
  Description of Artificial Sequence: Synthetic coding sequence
atggatgagcctactattacagacctcaatacaagggaagaggcggaggaagaaatcgactttgaaaaggacttattgacaatcccacctggattcaaaaaaggaatggatttcgctcctaaagattgtccaacccctgcgcctgggctgctgtctttgtcctgtatgcttgagcccctcgacctaggcggaggggatgaggatgagaatgaggcggttggccagcctggcggtcctcgtggagatactgttagcgcctccccctgcagcgcacctctggcgagggcatcaagcctcgaggacctagtgttgaaagaggcatccacggccgtgtctactccagaggcacctgagcctccctcccaggaacagtgggcaattccagttgatgcgacatcacctgtcggggatttctataggctaatacctcagccggcctttcagtgggccttcgagcccgatgtgttccagaagcaggcaattctgcatctggagcgccacgattcagtgtttgtggctgcccatacatccgctgggaaaaccgttgtcgcagagtacgctatcgcactcgctcaaaaacacatgactcgaaccatatataccagccccataaaggctctgagtaaccaaaaattcagggacttccggaacacattcggtgatgttggactgctgactggagatgtgcagttgcatccagaggcctcctgtcttataatgaccaccgagattctgcgatccatgctgtacagtggatctgacgtgatacgcgacctggagtgggtgatctttgatgaggtccattacattaatgacgtcgaaagaggtgtcgtatgggaggaggtgctgattatgcttccagaccatgtctccatcatcctgctgagcgctaccgttcctaatgccttggagttcgccgactggatcggtcgccttaaacgccgtcagatatacgtaatcagcacagtgacacgcccggtccctcttgagcactacctgtttaccggaaatagctccaagacacagggcgaactgtttctgttactggattccagaggggcttttcataccaagggctactatgcggctgtggaggccaaaaaagagaggatgagcaagcacgcccagacgttcggagctaagcaacctacccaccagggcgggccagcacaggacaggggtgtgtacctgtcactgttagcctccctcagaacacgtgcccaactccctgttgtggtttttaccttctcccgggggcgatgcgatgaacaggcttccggtctgacctctctggacctgacgacttcttccgagaaatccgaaattcatctgtttcttcagaggtgcctagcaaggttgcgtggctccgacaggcagcttccccaggtactgcacatgtcggaactgctcaaccgcgggctgggtgtccaccacagcggcattctgcccatactgaaagagattgttgaaatgctgttttcccggggcctcgtgaaagtcctgtttgccaccgagacattcgcaatgggagtgaacatgccagcacgtactgtggtattcgattctatgagaaagcacgacggaagcaccttcagggacctgcttcctggagagtatgttcagatggcagggagagccggtcgtagaggcctggaccccaccggaacagtgattctgttgtgtaaagggagagttcctgagatggcagatctgcaccggatgatgatggggaagccctcccagctacagtctcagtttaggttgacctacacaatgattctcaacctcctgcgggtagacgctctccgggtggaggatatgatgaagagatcctttagcgagtttccctccagaaaggacagcaaggcgcacgagcaggctttggcagaactaaccaaaaggctgggggcgttagaggagccggacatgaccgggcagcttgtggaccttccagaatattactcctggggagaggagttaacagaaacacaacacatgatacagagaagaattatggagtctgtgaatggcctgaaatctctgtccgccggccgtgttgtggtggtgaaaaaccaggagcaccataatgctcttggggttattttacaggttagtagtaactctacctcaagggtgtttaccacattggtgctttgtgataagccgctgagccaggatcctcaagatcgaggccctgctacagcggaagtcccgtatccagatgatttggttgggtttaagctgttccttccggaaggcccttgtgatcataccgttgtgaaattgcaacctggggacatggccgctatcacgactaaggtgctgagagtgaacggagaaaagattctggaggacttcagcaaacggcagcaacctaaattcaagaaggaccctccacttgcagccgttaccaccgccgtgcaggagctgctgagactcgcgcaggctcaccctgcagggccaccaacccttgaccctgtgaacgacctccagcttaaggacatgagcgtcgtggagggaggcctgcgcgctagaaagctggaagagctaattcagggagcccaatgtgttcattctcctagattcccagcccaatacctgaagctgcgggagcggatgcagatccagaaggagatggaaagactgaggtttctgctgtcagaccagagcttactcctcttacccgaatatcaccagcgggttgaggtgctgcgcactttgggctatgttgacgaagctggtaccgtgaaactcgctggcagagtggcgtgtgccatgtctagccatgaactcctactgaccgagttaatgttcgataatgcactgtcgaccctcaggccggaggaaatcgcggctcttctcagcgggctggtttgccagagccctggcgacgccggagaccagctaccgaataccctgaagcagggcatcgagagggtccgggccgttgctaaaagaatcggggaggtgcaggtagcttgcgggctgaatcagaccgtggaggaattcgtcggagagctgaacttcggcttggtggaggtagtatacgaatgggccagagggatgcctttctcggagcttgccggcctgagtggcacccccgaaggattggtggtgagatgtatacaacggctcgcagagatgtgtagatctcttaggggcgccgcacgactagtgggggagcccgttttgggagccaagatggaaacagcggccactctgcttagaagagatatcgtttttgccgcctctctctacacccaatag

SEQ ID NO: 136596 - DNA, 3741 bp, Artificial Sequence
  Description of Artificial Sequence: Synthetic coding sequence
atgatggaaacagagcggcttgttctgcccccccctgacccactcgacttgcctttgcgagcagtggaattgggctgtacaggccactgggagctcctgaatctgcccggagcacccgagtcttcccttcctcatggcctgccgccatgcgcccctgatttgcagcaggaggccgaacaacttttcctgagctcacctgcatggctgcctcttcatggggttgaacattccgcccgaaagtggcagcgcaaaacagatccatggagcttgttagccgtcctgggggccccagtgccttccgacctacaggcccagagacatccaacgacagggcaaatccttggttataaagaagtgctgctagagaacactaatctgagtgctactactagcctctcccttcggcgtcccccgggcccagcatcccagtccctttggggcaaccccacgcagtatcccttttggccaggaggcatggacgaaccgacaataaccgatcttaatacacgcgaggaagccgaggaggagatcgatttcgaaaaagatcttttgactataccaccaggctttaagaagggcatggattttgcacctaaagactgccccacccccgcccctggactgctatcactctcctgcatgttggagcctctcgacctcgggggcggcgatgaagatgagaatgaggccgtgggtcagcccgggggcccgaggggggatacggtctctgccagtccatgctcggcgccgctggcaagagcaagttcacttgaggacctggtgctgaaagaggctagtactgcagtgtccacccccgaggctccggaaccgccttcccaggagcagtgggccattcccgtggatgcaacatctcctgttggtgacttttaccgccttattcctcagccagctttccagtgggcatttgagccagacgtgttccagaagcaggcgatcctgcacttggagcggcacgattcagtgtttgtggccgcacacaccagtgccggcaagaccgtagttgccgagtatgccatagccttggcgcaaaagcacatgaccagaacaatttacaccagcccgatcaaggctctgagtaatcagaaatttagggacttccggaatactttcggagacgtaggtctcttgacaggcgacgtgcagctccaccctgaggcttcatgcctgattatgactacagagattctccgttctatgctttactctggcagtgacgtgatccgcgatctcgagtgggtcatctttgacgaggtacactatattaatgacgtggaacgaggcgtggtgtgggaggaagtgcttattatgctgccagatcacgtatccatcatactcctgagtgctaccgtcccaaacgctctggaattcgctgattggatcggaaggctcaagaggagacaaatttacgtcatctcaaccgtcactagaccagtccctttggagcattacctgtttacagggaactctagcaagacacagggagaactgtttctgttattggattctcgcggggcgttccatacgaagggctactacgccgcggtggaggccaagaaggaaagaatgtctaagcacgcccaaacattcggagctaagcaacctacccatcagggcggtccagcacaggatcggggcgtttatttgtctctgcttgcctccctgagaaccagagctcagttgccagttgttgtgtttactttcagtagagggaggtgtgacgaacaagcaagcgggctgacttctctggacctgacaacaagcagcgaaaagagcgagatccacctgtttctccaaagatgcctggccaggctgagaggctccgaccggcaactgccccaagtcctccatatgtcagaactgctgaatagaggtttaggagtgcatcactctggcattttaccaattttgaaggagatcgtagaaatgctgttcagtcgcggcttggtgaaagtcctctttgcaaccgaaactttcgctatgggtgttaatatgcctgccagaaccgtagtgtttgattccatgaggaagcacgatggctccacctttagggatctgctgcccggcgaatatgtacagatggcagggagagccgggagacgcggacttgatccaaccggcacagtgattttgctctgcaagggacgcgttcctgaaatggccgatctgcaccggatgatgatgggcaagccctcccagctccagagtcagttccgtctgacctatacaatgattctcaatctactgcgagtcgatgcactacgcgtggaagacatgatgaagcgatcctttagtgagttcccctcccggaaagactctaaggcacacgagcaagccctggctgagcttactaaaaggctgggggctctggaagagcctgacatgacgggccagctcgtggacctacccgagtattacagttggggagaggagctaaccgaaacgcagcacatgatccagcgtcggatcatggaatctgtgaacggcctgaaatcactctccgcgggcagggtagtggtggtgaagaatcaagaacatcataacgccctcggcgtcatccttcaagtcagcagcaatagcacatcaagagttttcacaaccctagttttgtgtgacaaaccgttatcacaggacccccaggatcggggacccgccaccgccgaagtgccttatcccgacgacctggtggggttcaaattattcctgcccgagggaccatgtgatcacaccgtcgtaaagttacagccaggggatatggctgctatcaccaccaaggtcttacgagtaaacggcgaaaagattctggaggacttctccaaaaggcagcagcctaagttcaagaaggatcctcctttggcagctgtgaccacagctgtgcaagagcttttaaggctggctcaagcacacccagctggtccgcccacccttgaccccgtgaacgatttgcaactcaaagacatgtcggtcgtggagggggggctgcgggctcgtaagctggaggagctcatccagggggcacagtgtgtacactcaccacgcttccctgcccagtatctaaagttacgggaacgcatgcagatccagaaggagatggagcgcctgagatttctcttaagtgaccagagccttcttctgctgcccgagtatcaccaaagagttgaagtgctgcgaactcttgggtacgtcgatgaggcagggactgtgaagcttgctggaagagtcgcctgtgctatgtccagccacgagctgcttctgactgaattaatgtttgacaatgctttgtctacactgcggcctgaggaaatcgccgccctgctctccggccttgtgtgccagagtcctggggatgctggggaccagctgcccaatacgctgaaacaaggaatcgaacgggtacgcgcagtcgccaagaggatcggcgaagttcaggtggcttgcggccttaatcagaccgttgaggaattcgtcggagagctgaatttcggcttggtcgaagtagtgtacgagtgggctagagggatgccatttagcgaactagctggtctgtccggcacaccagaaggcctcgtcgtcaggtgtattcagcgccttgctgaaatgtgtaggagcctacggggtgctgctcgtctcgtcggggaacctgtgctcggggcgaagatggaaaccgccgccaccctattgcgcagagacatcgtgttcgccgccagcctttacacccagtag

SEQ ID NO: 136597 - DNA, 3162 bp, Artificial Sequence
  Description of Artificial Sequence: Synthetic coding sequence
atggatttcgcaccaaaagactgccctacacccgcaccaggactgctcagtctctcttgtatgctggaacctttagatctaggaggcggcgatgaggatgagaacgaagccgttggccagcctggtggaccacgtggcgacaccgtgtccgcaagcccatgctctgctccattggctcgcgcgagttcactggaggacctcgtgctgaaagaggctagcaccgccgtgtcaaccccggaggcccccgagcctcccagccaggagcagtgggccattcccgtggatgctaccagtcccgtcggagatttttatagactcatcccgcagcccgcctttcagtgggccttcgagccagacgtgttccagaagcaggccattcttcacctcgaaagacacgactcagtcttcgttgctgcgcatacttcggctgggaagactgtggtcgccgaatacgccatcgccctggcccagaaacatatgaccagaacaatttacaccagcccaatcaaagctctctccaaccaaaaatttcgcgatttccgcaacacctttggcgacgttggcctcctcacgggtgacgtgcaattacatcccgaggcaagttgtctgataatgacaacagagattctgcgcagcatgctgtactctgggtccgatgtgatcagagacctcgagtgggttatttttgatgaggtgcattacattaatgacgttgaaaggggagtcgtctgggaagaggtgctgatcatgctgcctgatcacgtgtctataattttactctccgccactgttcctaatgcactcgagtttgctgactggatcggccgtttgaagagaaggcagatctatgtcattagtaccgtgacccgaccagtgcccctggaacattacctcttcacgggtaacagcagcaagacgcaaggggaactgtttttgctcctggatagcaggggggctttccacactaaaggctattacgccgcggtggaggcaaagaaagagagaatgagcaagcacgcacagacttttggcgccaagcagcccacccaccaaggtggacccgcccaggaccgcggcgtatacctgtccctactcgcatctcttcggactcgagcacaactgcccgtcgtagtctttaccttcagtcgcggcaggtgcgatgagcaagcatccggcctcacatccttagatcttacaacctcctccgaaaaatcagagattcatcttttcctacaaaggtgtctggctcgcctgaggggatctgataggcagctgcctcaggtgttgcacatgagcgagctgctcaaccgagggctgggagtccaccacagcggtatactcccgatacttaaagaaatcgttgaaatgctcttttcaagggggctagtaaaagttttgtttgccactgaaacatttgctatgggagttaacatgcctgctaggaccgttgtcttcgactctatgagaaaacacgacggcagcacttttagggatctgttgcctggcgagtatgtgcagatggccggacgagccggccgtcgggggctggatcccaccggaacagtcattcttttatgcaaaggccgcgtccccgagatggctgacctgcaccggatgatgatgggcaagccttcccagctccagagccagtttaggcttacttacacaatgatactcaacctcttgagagtcgacgctctgcgtgttgaggatatgatgaaacgtagcttctccgaattccccagccgaaaagatagtaaggcccacgagcaggcacttgcggagcttacgaaacgcctcggtgccttagaggaaccggacatgaccggccagctggtcgacttgccggagtattattcttggggcgaggaactaaccgaaactcaacacatgattcagagaagaatcatggagtctgtgaatggacttaagtcactctccgccgggcgtgttgtcgtagtgaaaaatcaggaacaccacaacgccttaggtgtgatcctgcaggtgagtagcaacagtacatcccgagtatttaccactctggtgctttgtgataaaccactgagtcaggatcctcaggacagagggcccgcgaccgccgaggtgccataccccgacgacctcgtgggctttaagctgtttctccctgagggcccctgtgatcataccgtagtgaaattacagccaggtgacatggccgctataaccacaaaagtcctgagagttaacggggaaaagatccttgaagatttttcaaagagacagcagcccaagttcaaaaaagacccacctctggccgccgtgaccacggccgtccaggagctactgagactggctcaggcccatcctgccggccctcccaccctggatccagtaaatgatctgcagctcaaggatatgtccgtggtcgaggggggattacgcgctcgcaaactggaggaacttattcaaggggcccagtgtgtacattccccccggtttcctgcccagtacctgaaactgcgcgagcgcatgcagatccagaaggagatggaaagattacggttcttgttgagtgaccagagcctgctgctgctgcctgaataccatcagcgcgtggaggtattaaggacgttggggtatgtcgacgaggccgggaccgtcaagctggcgggccgggtcgcatgtgcgatgtcctctcacgaactcctgcttaccgagctcatgtttgataacgcacttagcacacttagaccagaggaaatagctgctctcctgtctggactagtgtgtcagtcccctggagacgccggcgatcagctgcctaacacactcaagcaaggtatcgagcgcgtcagagccgtggccaaacggatcggcgaggtccaagttgcgtgcggactgaatcaaacagttgaagagttcgtgggcgagctgaacttcggcctggtggaagtcgtgtacgaatgggcgcgtggtatgcctttttccgagttggcaggtctgtccggaactcccgagggtctcgtggtgaggtgcattcaacgactcgctgagatgtgtcgcagccttaggggcgctgcccgtctggtaggggagccggtccttggcgccaagatggagacagccgcaaccttgcttcggcgcgatatagttttcgctgcatcactctacactcagtag

SEQ ID NO: 136598 - DNA, 3162 bp, Artificial Sequence
  Description of Artificial Sequence: Synthetic coding sequence
atggatttcgctccaaaggactgtccgacgcctgctccgggcctactgtcacttagctgtatgcttgagcccctcgatctgggtggcggcgacgaggacgaaaacgaggctgtgggccagcctggtggaccaaggggagatacggtcagcgcctcaccttgtagtgcaccactggctcgcgcttccagcctggaagacctggtgcttaaagaggcgtcgactgcggtgtccacgccggaggcgcccgagccccccagccaggagcagtgggcaatccccgtcgacgccacctctcctgtaggggatttttatagactaatccctcaacccgcatttcaatgggctttcgaacctgacgtgttccagaagcaggctatcctgcatctcgaaagacacgatagtgtgttcgtcgctgcccatacctccgctgggaagactgttgtggcggagtatgccatcgccctcgcacagaagcatatgacacgtacaatttacacctcccctatcaaggctctatccaaccagaaatttagggactttcgcaacacgtttggggatgtgggactgctcacaggcgatgtgcagctacaccccgaagcctcatgcctgatcatgaccacagagatcctgcgttcaatgctgtactccggatcagacgtcataagggatctggagtgggtcatattcgatgaggtccactatatcaacgatgtcgaacggggggtagtgtgggaggaagtgctcattatgctgccagatcacgtgtccatcatccttctgagtgccacggtccccaatgctctcgagttcgcagactggatcggtcggctgaaaaggaggcagatctatgttatcagcaccgtcacgcgaccagtgccactggagcactacttgttcacgggtaattcttcaaagacacagggagagctgttcctgctgctcgattcacgtggagcatttcacacaaagggctactacgcggctgtggaggccaaaaaggagagaatgtctaaacacgcccaaactttcggcgcgaagcagcctacccatcagggagggccagcccaggaccgaggggtttacctgtcactcttagcctccctgaggactcgcgctcagctgccagtcgtggttttcacgtttagccggggcagatgcgacgagcaggcctccggactaaccagcctggacctgaccacgtcaagtgagaagagtgaaattcacctgttcctccaacgatgcctggcccggctgagaggcagcgaccgacagctgccgcaagtgcttcatatgtcggaactattgaatcggggactcggtgtgcatcactctgggatcctgcctatcttaaaggagattgtggagatgctgttcagccgcggtcttgtgaaggtgttattcgccactgaaaccttcgccatgggagtcaacatgccagcacggaccgtcgtgtttgactcaatgcggaaacatgacggatccacgtttagagacctgctgccgggcgagtacgtccaaatggcagggcgcgctggaaggaggggattagatccaacgggaactgtcattctgctgtgtaagggtcgtgtgcccgagatggccgacctgcacagaatgatgatgggaaagccatctcagctgcagtctcagttccgcctcacctacacgatgattctgaatctgcttcgtgtcgacgctctgcgcgttgaagacatgatgaaaagatcctttagtgaatttccttctcgcaaggattctaaggctcacgagcaggcccttgccgagctgacgaaaaggctgggagctctagaggaaccagacatgactggccaactggtagacttgccagagtactactcgtggggtgaggaactgacagagacccaacacatgatccaacgccgcataatggagtctgtcaacgggctgaagtctctctctgcaggaagggtggtggtggtaaaaaatcaggaacatcacaacgcactgggcgtgattttgcaagtgtcaagcaacagcacatctagagtttttactacactggtcctgtgtgataagccactctctcaagaccctcaggaccgcggaccggcaacggctgaggtgccatatccagacgatctagtagggttcaagctgttcctaccagagggcccctgcgatcatacagtcgttaagctgcagccgggcgacatggctgccataactactaaggtgctgcgggttaacggggagaaaattctcgaagattttagcaagcggcagcaaccgaaatttaagaaagaccccccccttgcagccgtgaccactgctgtgcaggagctgctccgtctcgctcaggctcacccagctgggccaccgacattggatccagtaaatgatctgcagctcaaggatatgagtgttgttgagggaggcctgagagcgcggaaactcgaggaactcatccagggtgcccagtgcgtgcacagcccaaggttccctgcgcagtaccttaaactgagagagcgaatgcagatccaaaaagagatggaaaggcttaggtttctgttgtccgatcagagtctcctgcttctgccagaataccaccagcgtgtggaggtccttcggaccctgggttacgtggatgaggcaggcaccgtgaaactcgctggaagggtggcctgtgctatgtccagccatgagctgctgctcacagagttaatgttcgataacgctttaagcacactacggcctgaggaaattgccgctctgttgagtggactggtttgtcagagccccggggatgcgggcgatcagctgccgaatacgctcaagcaggggatcgaaagggtcagagccgtcgcgaagaggattggcgaggtgcaagtagcgtgtgggttaaatcagactgttgaggagtttgttggagaactcaactttgggctcgttgaagtggtatatgagtgggctagaggaatgccattttccgagctggccggactctctggcacccccgagggactggtcgtaagatgtatccaacgcctggcagagatgtgtagaagcttgcggggagcagccagattggtgggtgagcctgtcctgggagccaaaatggaaactgcagctacactcctcagacgggacattgttttcgctgcctcgctgtacacccagtag

SEQ ID NO: 136599 - DNA, 693 bp, Artificial Sequence
  Description of Artificial Sequence: Synthetic coding sequence
atgatggaaacggagagactcgtacttccaccacctgaccctcttgatctgccactgcgcgctgttgaactggggtgtactggccactgggaactattgaacttgcccggggccccagaatccagcctgccccacggattacccccctgcgcccccgatctgcaacaagaggctgagcagctgttcctctctagccccgcttggctgcctctgcacggggtggaacattctgccaggaaatggcaacgcaagactgatccttggtccttgcttgcagttctgggcgctcctgtcccgagcgatctccaggctcaaagacacccaacaaccgggcaaattctcggatataaagaagttttgctggagaacactaatctgagtgcaacaacctcgttgtctctgcggcggccacccggtccagcatcccaatccctgtggggaaaccctacacaataccccttctggccaggcggcatggacgagcccaccataacagacctaaacactcgggaagaggctgaggaggagattgatttcgaaaaggatttgctcaccatccctcccgggttcaagaaaggtatggacttcgcgcccaaggggagcgtacatagctgtatccacccacggggcccacgagctagcatttcgggagcggtgggccacccatgcgggagacatttaccctgctggtag

SEQ ID NO: 136600 - DNA, 3267 bp, Artificial Sequence
  Description of Artificial Sequence: Synthetic coding sequence
atggatgaaccgaccattaccgatttaaatacgagagaggaagctgaagaggagatagatttcgagaaggacttgctgactattccacccggttttaagaagggaatggacttcgctcccaaggactgcccaacccctgctccgggtttactgtccctttcctgcttgctggaacccctggatctgggcggcggcgatgaagacgagaacgaggcagtaggccagccaggcggccctaggggcgatacagtgtccgccagcccctgcagtgcccctctcgcccgggcttctagcttagaggacctggttctcaaggaggcgtcaacagccgtgtcaaccccagaagctcctgagccaccttcacaggagcaatgggccattccagtcgacgcaacatctcccgtgggagatttctaccggttgatccctcagcccgccttccagtgggctttcgaaccagatgtgttccagaaacaggccatcctgcacctcgagaggcatgatagcgtttttgttgctgcccatacctccgcgggaaagaccgtcgtagccgagtacgctatcgctctggcccagaaacacatgaccaggactatttacacctcccctatcaaggctctgagcaatcagaagttcagagatttcaggaacacttttggagacgtcgggctccttaccggggatgtgcaactccaccccgaggcaagctgtctgatcatgactacggaaatcttgagaagtatgctgtactcagggtctgatgttatccgggacctggaatgggtaatcttcgacgaagtgcactatataaacgatgtggagcggggcgtggtgtgggaggaggttttgatcatgctgcccgatcacgttagcattatcctgctcagcgccaccgtgccaaacgccctcgagtttgccgactggattgggcggctgaaacggcgtcagatttacgtgatttctaccgtgacacgccccgtccctctggagcactatctcttcacgggcaacagctctaaaactcagggtgagctgttcctgctcctagattccagaggcgctttccacacaaagggctactatgccgctgtcgaggctaaaaaagaacggatgtcaaaacatgcacaaaccttcggtgcaaagcaaccaacccatcaaggcggcccagcccaggaccgtggggtgtaccttagtcttctggcttcactacggacgagagctcagctgccagtggtggtgttcactttcagcaggggccgctgtgatgagcaggcgtcaggcctcacgtccctggacctgacaacttccagcgaaaaatccgagatccatctgttcttacagagatgccttgcaagacttagaggcagcgaccggcaactgccacaggtacttcacatgagcgaattactgaatcgtggactgggggtgcatcattccgggattctgccgatcctgaaggagatagtggagatgctattcagccgggggctggtgaaagtccttttcgcaactgaaacctttgccatgggagttaacatgccagcccggaccgtggtgttcgactccatgcgcaaacatgatgggtctacctttagggacctcttgcccggcgagtacgttcaaatggccggtcgggcaggcaggcggggcctcgatcctacgggtaccgtcatattactttgtaagggcagagtgcccgagatggcagacctgcaccggatgatgatgggaaaacctagccagctccagtcccaatttcgtctgacatatacaatgatcctgaatttactccgagtagatgccctcagggtagaggacatgatgaaaaggtctttctccgaatttccttctcggaaggattctaaggcgcacgagcaagcccttgcagaactgacgaaacgcctaggggccctggaagagccagacatgacgggacagcttgtcgatctccccgagtactacagctggggcgaggaactgacagagactcaacatatgattcagcggcggatcatggaatctgtcaatgggttgaagagcttgagcgccgggagggtagttgttgtgaagaatcaggaacatcataatgcactgggagttatcctccaagtaagtagcaattccacctctcgggtctttactacgctcgtcctgtgcgataagcccttaagtcaggatccgcaagatcggggccccgctaccgctgaggtcccatatccagacgacctggtggggtttaaattgttcctgccagaaggaccttgcgaccataccgttgttaagctgcaaccaggcgatatggccgcaatcaccacaaaggtgttgagggttaacggcgagaagatactggaagacttttctaagcgccagcagccaaaattcaagaaggacccccctctggccgcggtgaccaccgctgtgcaggaactcctccggctagcccaggctcaccccgctggaccacctaccttagatccagtgaatgatcttcagctcaaggatatgagtgtagtagagggcggcttaagggccaggaagctggaagagctgatccagggggcccagtgtgtgcactcccccagatttcctgcgcagtacctcaagctccgtgagcgcatgcagatccagaaggaaatggagcgactgcgattcttgctgagcgaccagtccctgctgctcctgccggaataccatcaacgcgtggaggtattgcggaccctgggctatgtggatgaagccggcacggtgaagctcgcggggagggttgcttgcgcaatgagttcccatgaactcctactgacagagttgatgttcgataacgcgttgtcaactctaaggccagaggaaattgcagctttattaagcggtttagtgtgccagtctccaggcgatgcaggcgatcagctccctaatacgttgaaacagggcatcgagcgcgtgcgagccgtcgcgaaaaggattggagaggttcaggtggcttgtggtttaaaccaaacagttgaagagttcgtgggggagctgaactttggcctggtcgaggtcgtctacgagtgggccaggggcatgcccttcagtgagcttgcggggttgtccggcacccctgagggactggtggtgcggtgtatccaacgattggcagagatgtgtcggtcccttcgaggagctgctaggttagtcggagagcctgtactgggtgcaaagatggagacagcggctacgctgttgcgcagggacatcgtttttgcagctagcctgtatacacagtag

SEQ ID NO: 136601 - DNA, 3162 bp, Artificial Sequence
  Description of Artificial Sequence: Synthetic coding sequence
atggacttcgccccaaaagactgtcctaccccagccccagggctgcttagcctgtcttgtctcctggagcccctcgatttagggggcggcgatgaggatgagaatgaggccgtggggcaacccgggggaccaagaggtgatacagtatcggcgagcccatgcagcgctcctttggctcgtgcgtccagcttggaggacttggtgctcaaggaggctagcactgccgtttcaacacccgaagcccccgaacccccgagccaggaacaatgggccatccctgtggacgcaacctcccccgttggcgacttctatcggctcatacctcagcctgcttttcagtgggctttcgaaccagatgttttccagaagcaggctatcctccatctggagagacacgatagcgtcttcgttgccgcacatacatctgccggaaaaaccgtagtcgccgagtacgccatcgccctcgcccagaagcacatgacacgcaccatctacacttcacctattaaagccctgtccaatcagaagtttagagatttccgtaatacgttcggagatgttgggctgctgaccggcgatgtgcagctacaccccgaagccagttgcttgatcatgactactgagatactgcgcagcatgctgtactccggttccgacgtgatccgcgacttggaatgggtgatcttcgacgaggtccattatatcaacgacgttgagagaggggtggtgtgggaagaagtcctcatcatgctgcctgaccatgtttccattattctgctgagtgcaacagtgcccaacgcactagagttcgccgattggatcggtagattgaagcgcagacagatctacgtgattagtactgtaacgaggcccgtgccactggaacactacttgttcacaggaaacagctcgaagacccaaggcgaattgtttctgctgctggactccaggggggcattccacacgaaggggtactacgctgccgtcgaagctaaaaaggagcgcatgagtaagcacgcccagacttttggcgcaaaacagcccactcaccagggtgggcccgcccaagataggggtgtatacttgtcactgcttgcttccctgaggacaagggctcaactgcctgttgttgtctttaccttctccagaggccggtgcgatgagcaggcttcgggactgacttccctggacttgaccacgtcttccgagaagtcagaaattcatctctttctgcagcgatgcctggcccgcctgcggggctcagaccgacagctgccacaggtccttcacatgtctgaactcctgaacagagggctaggcgtgcaccactctggcatacttccaatcctcaaggagattgtggaaatgctcttctccaggggactggtgaaggtcctgtttgcaaccgaaaccttcgctatgggtgtgaatatgccagctcgaactgtcgtatttgattctatgagaaagcacgatggttccacatttagggatctcttaccgggggagtatgtgcagatggcagggcgggctggtcggcggggtctagatcctaccgggacagtgattcttctgtgcaaggggcgcgtccccgagatggctgacctgcatagaatgatgatgggtaagccgagtcaactccaaagtcagtttagattgacctacaccatgatcctcaatttgcttagagtagacgccctgcgggtggaggatatgatgaaacgatccttctcagagttcccttccaggaaggactctaaggcccatgagcaggctcttgcggaacttacaaagagactcggggctctggaagagcctgatatgacaggccagctggtcgatttgcccgagtattactcatggggggaggaactcactgaaactcagcacatgatccagcggcgaattatggagtctgtgaatgggctgaaatcactatcagcaggtcgggtggtggtggttaagaatcaggagcaccacaatgccttgggggtaattttacaggtgagcagtaactccacctcccgcgtctttaccactctggttttgtgcgataagcctctctcccaggatccccaagaccggggacccgccactgcagaagtgccttatccagacgacctggtgggcttcaagctcttcctgccagaaggcccatgtgatcatacagttgtcaaattacaaccgggggatatggccgctattaccactaaggttctcagggtgaacggcgaaaaaatcttggaagatttctccaaacgacagcagcccaagtttaaaaaggatccgcctctcgccgccgtgactactgcagtgcaggaactccttaggttagcccaagctcatcctgccggtcccccaacactagatccggtgaatgacctccagctgaaggatatgtcagtggttgagggaggactgagggcacgaaaactggaggagttgatccagggagcacagtgtgtccactccccacgctttcccgcccagtacttaaagctccgggagaggatgcagatacagaaagaaatggagaggctccgattcttgttgtcagatcagtccctgctgctcctgcctgagtaccatcagcgtgttgaggtgctaagaaccttgggctatgttgacgaggccggaaccgtaaagctggccggaagggtagcgtgtgctatgtcaagtcacgaactgctgcttacggagttaatgttcgataatgccctctcgaccctgcggcccgaagagatcgccgcccttcttagcggcttggtctgccagagcccaggcgacgccggggatcagctgccaaatacactcaagcagggcatcgaacgggtgagagcagtcgctaaacgaattggtgaggtccaggtggcctgtggcctcaaccagacggttgaggaattcgtgggtgagctgaattttgggctcgtagaggtcgtgtatgagtgggcgcgaggtatgcctttcagcgagcttgccggcctgagtggtacaccagaggggctggtggtgcggtgcatccagcgcctcgctgagatgtgcaggagcttacgcggagcagctcgtcttgtgggcgagcccgttcttggcgccaaaatggagacagcagctactctcctaagacgagatatcgtatttgccgctagtctgtatacccagtag

SEQ ID NO: 136602 - DNA, 2643 bp, Artificial Sequence
  Description of Artificial Sequence: Synthetic coding sequence
atgatggagacggaacggttggttcttccacccccagacccgctggatctccctcttcgggctgtggaattgggctgtacgggacattgggaacttcttaatctcccaggggctccggagtccagtttgcctcacggtctgcctccttgcgccccggacctccagcaggaagccgagcagctctttctttccagtccagcctggctccccctgcacggtgtagaacattccgcccgcaagtggcagaggaagactgacccttggtctctcctcgccgttctgggcgctcccgtgccatctgatcttcaagcacaaagacaccctactaccgggcagattctggggtataaagaggtcctgctggaacactacctgttcactggcaatagtagtaagacgcagggggaattatttttgctgctcgattctcgcggcgcttttcatacaaaggggtactacgctgccgtggaggctaaaaaagaaaggatgtccaaacatgcacagaccttcggcgctaaacagccgacacaccagggaggcccagcccaggatcgaggagtgtacctgagccttctggcatccctgagaactcgcgcgcaattgccagtggtggtattcacgttcagccggggccgctgtgacgagcaggcaagtggattgacttcattggacctgacaacctcttccgagaaaagcgagattcacttgttcctgcagaggtgtctggcccgactccgcggcagcgatagacaactgccacaggtactccacatgagtgaattgctgaatcggggtttgggggtgcaccactccggcatcctcccgattctgaaagagatcgttgagatgctgtttagtcgcgggcttgtgaaagtattattcgcaacagaaaccttcgctatgggcgtgaacatgcccgctcgcaccgtggtgttcgactcaatgcggaaacacgatgggtcgacattccgcgacctgctgccaggggagtatgtgcagatggccggaagagccggaagacgcggtctagaccccaccgggactgtgattctcctgtgcaagggaagggtgcctgagatggcagaccttcaccggatgatgatggggaagccatcgcagctgcaatcccagttccgcctgacttacactatgatcttaaatcttttgagggttgatgctctccgcgtagaggacatgatgaagagatctttctccgaatttccatctaggaaagactctaaagcacacgagcaggctctggcggagctgaccaagcgactgggcgcgctcgaggagcctgatatgactggccagcttgtcgacctgcctgaatattatagttggggtgaagagttgaccgaaacccaacatatgatccagcgcaggatcatggagtctgtgaacggtctgaagagcctgagcgccgggcgggtcgtcgttgtcaaaaaccaggaacaccataacgccttaggcgtcatcttacaggtgagtagcaattctaccagccgggtctttaccacactcgtactatgtgataaaccactgtctcaagatcctcaggatcgcggacccgccacggctgaggtgccctaccccgacgatctagtcggcttcaaattattcttgcctgagggcccctgcgatcacactgtggtgaagctgcagcctggcgatatggccgccattactacgaaagtgctgcgggtgaatggcgagaagatcttagaggacttttccaaacggcagcagcccaagtttaagaaggaccctccactggccgctgtcactacagccgtgcaggagttgttgaggctcgcccaggcacacccagcaggtccccccactctggacccagtgaatgatctgcagctgaaagatatgtcagtagtagaaggcgggctccgtgctagaaaactggaggaactgattcagggggctcagtgcgttcatagccccaggttccccgcccagtatttgaagctgcgtgagcgtatgcagattcaaaaggagatggaaagactccgatttctgctgagcgatcagtctctcttgttgctgcctgagtatcaccagagagtggaagtgctacgaacgttgggatatgtggatgaagcaggtaccgtcaagctagccgggcgtgtggcctgcgctatgtcttcccacgagcttctgttaactgagttgatgttcgataacgccctctccacactccggcccgaagaaatcgccgccctgctgagcggcctggtgtgtcagtcaccgggggatgctggggaccagcttcccaataccctcaagcaaggcatcgagagggttcgggccgtcgctaagagaatcggggaggttcaagtcgcctgcggcctgaaccagacagtggaggagttcgtaggggagttgaattttgggcttgtggaagtggtctacgagtgggccagggggatgccatttagcgaactcgccggacttagtggcacccctgaggggcttgttgtgcgctgcattcagcggttggcggagatgtgcagaagcctgcggggcgcagctcgactggtgggagagcccgtactaggcgctaagatggagacagctgcaacactgctgaggagagacattgtgttcgccgcaagtctttatacccaatag

SEQ ID NO: 136603 - DNA, 3267 bp, Artificial Sequence
  Description of Artificial Sequence: Synthetic coding sequence
atggatgaacctacaatcaccgatctcaatactcgtgaagaagccgaggaagaaattgattttgagaaagacctccttaccatccctcccggcttcaaaaaaggcatggatttcgctcctaaggactgtcctacaccagcaccaggcttactttctctgagttgcctcctggagcccctggatctggggggcggcgatgaggatgagaacgaagccgtggggcagcccggggggccacggggagatacagtcagcgcttcaccttgtagcgcgcctttagcacgggcctcttcccttgaggacctggtcctgaaagaggccagcactgcagtgtccacccctgaagccccagaacctccaagccaggaacagtgggctattcccgttgatgcgaccagtcctgtaggcgatttctaccggctgattccccaacctgcgtttcagtgggcgttcgaaccggacgtattccagaaacaggcgattctgcacctggaaagacacgatagcgtgtttgtcgccgctcatacctctgccggcaaaacagtcgtggcggagtacgctattgctctggcccagaagcatatgacaaggacgatctacacatctcctattaaggctctgtctaaccagaaattccgggattttcgaaataccttcggcgatgtgggcctgctgaccggggacgtgcagcttcaccctgaagccagctgtctgatcatgacaacagagatcttgagaagcatgctgtactcagggtcagacgtgattcgggatctggagtgggtgatctttgacgaagtgcactacattaacgacgttgagcgcggagtcgtgtgggaagaggtcctgattatgctgccggatcacgtgtctatcatcctcctctcggccaccgttcctaatgctctcgagttcgcggattggatagggagattgaagcgccgccagatctacgtgatttctactgtgactagaccagttcccttggagcattacttattcaccggcaattctagcaagacacagggggagctttttctgctgctcgacagtcgcggcgcttttcatactaaaggctattacgcagctgtggaggccaagaaggagcgtatgtccaagcacgcccagacttttggggctaaacaacctactcatcaggggggcccagctcaagacagaggtgtgtacctttctctacttgcctctctgcgcactagagcccaactgcctgtggttgtgtttactttttctcggggcagatgcgacgagcaagcctcaggcttaacgagcctcgatctgactacgtctagtgaaaagagtgaaattcacctcttcctgcagcgatgcctagctcggctgagaggatccgacaggcagctccctcaggtcctgcatatgagtgagctgcttaacagggggctgggggttcatcacagtggaatcttacccattctgaaggagatcgtggagatgctgttctcacggggcctggtaaaggttctttttgcaacagaaacattcgcaatgggcgtcaacatgcctgctcggactgtagtgttcgatagtatgagaaaacacgacgggagtacatttcgggacttgcttcccggcgaatacgtacagatggcagggcgggccggtcgccgcggtctcgatccgaccgggaccgtcatcctgctctgtaaaggccgcgttcctgagatggcagacctccaccggatgatgatggggaagccttctcaactgcaatctcaatttcgattgacttacacaatgatcctgaatctgcttcgcgtggacgccctgcgggttgaggatatgatgaagcgtagcttcagcgagtttccaagtcgcaaagactctaaggctcatgagcaggcgctagcggagttgaccaaaaggctgggcgccctggaggagcccgatatgacggggcagctggtcgacctgcctgaatattattcttggggtgaggaattgacagaaacccagcacatgattcagcgccgcattatggaaagtgtgaatgggctcaagtcgttgtcagccggaagagtggtggtggtgaaaaaccaggagcaccacaacgctctgggcgtcatcctgcaggtctcatccaactcaacatctcgcgtgtttacaaccctggtgctgtgtgacaagccactgagtcaggatccacaggaccgcggtccagcaaccgccgaggtcccatatcctgacgatctcgtgggattcaaactcttcctgcccgaaggtccctgtgaccatactgtcgtgaagctccaacccggggatatggcagctatcacaaccaaggtgttgagggtaaacggagagaagattctcgaagatttttcaaaaagacagcagcctaagtttaaaaaggatccccccttggcggctgttaccacagccgtgcaggagttactgcgcctagcccaggcccatccagcaggaccccctacactggacccagtgaacgatctccagttaaaggacatgtctgtcgtggaaggggggctcagggcacgcaagctggaagagttgatacaaggcgctcagtgtgtgcacagtccaaggttccccgcccaatacctcaagttaagagagcggatgcagatccagaaggagatggaaagactccgcttccttctctctgatcagtctctactgcttctacccgagtaccaccagcgtgtggaggttttgaggaccctcggatatgtggacgaggcaggcacagtaaaattagcgggccgagtagcttgtgctatgagttctcatgaattacttcttactgagctgatgttcgacaacgcactgagtacactgcgccccgaggagatcgccgctctgctgagcggcctagtgtgccaaagcccaggcgacgccggggatcagctccctaatactctgaagcaagggatcgagcgcgtgcgggctgttgccaaacgcatcggtgaggttcaggtggcgtgcggcctgaaccagaccgtcgaggagttcgtaggtgagctcaatttcggcctcgtggaagtggtgtatgagtgggcccgcgggatgcctttctcagagttggcaggactttcaggcacccccgagggactagtggtgcgctgcatacagaggcttgccgagatgtgccggtctttgagaggagctgctcggcttgtcggtgaacctgttttgggcgcaaaaatggagactgcagccaccctgttaaggagggatatagttttcgccgccagtctgtatacccagtag

SEQ ID NO: 136604 - DNA, 2643 bp, Artificial Sequence
  Description of Artificial Sequence: Synthetic coding sequence
atgatggagacagagcgacttgttcttcctccccctgacccactggatctgcccctgagggcggttgagcttggatgcaccggtcactgggagctcctcaatttaccgggggctccagaaagcagcctgccacacggccttccaccttgcgctcccgacctgcagcaggaggcagagcaactgtttttgtcctctccagcctggctgccactacatggtgtggagcactccgcacggaagtggcaacgaaaaaccgatccttggtccctgttagccgtcctgggagcacccgtgccaagtgacctgcaggcccagagacaccctaccaccggtcagattcttggatacaaggaagtgttactcgagcattatctgttcactgggaactcttctaagacacagggtgagctttttctgctcctcgatagtcgaggcgcgttccataccaaaggctattacgcagctgtggaggccaagaaagaacgaatgagtaaacacgcacagaccttcggagccaaacagccaacacaccagggtggaccagctcaggaccggggggtttacttaagccttctggcctccttacgaactagagcccagctcccggttgtagtgttcactttctcacggggcaggtgtgatgaacaggcctccgggttaacatcgttagacctcacgacctcctcagaaaaatccgaaatccacttgttcctccagcggtgcctggccagacttcgcggaagtgaccgtcagcttccccaggtgctccatatgtcggaacttctgaacagaggattaggtgttcatcactccggaatattaccaattctcaaagagattgtggagatgctgttctctagggggttggtaaaggtcctattcgccacggaaacctttgctatgggtgtgaatatgccggctaggaccgtcgtcttcgattctatgcgaaagcacgatggcagtaccttccgagaccttcttcctggcgagtatgttcagatggcggggcgggcaggccggcggggactcgacccgactgggacggttatccttctgtgtaagggacgcgtcccagaaatggcagacctacaccgtatgatgatgggtaagccctcccagctccagtcccagtttcggctaacttacacaatgatcctcaacctcttgagggttgatgccttaagagtggaagacatgatgaagcgttcattcagtgagttcccttcacgcaaggactcaaaggcgcacgaacaggccctcgctgagctgacgaaaagattgggggcccttgaggagcccgatatgaccggccagctagtagacttgcctgagtattatagctggggcgaggaactgaccgagacgcagcacatgattcagaggcgaatcatggagtctgtgaatggactcaaatctctcagcgccggtagagttgtcgttgtgaagaatcaggaacatcacaatgccttaggcgtgattctgcaggtatccagtaattcaacgtcccgggtgtttactactttggttctgtgtgacaagcccctctctcaggatcctcaagaccggggacccgcaacagcagaggtaccttacccggacgatcttgtcggctttaaactgttcttgccggaggggccctgcgaccacacagtggtgaagctccagcctggcgacatggccgctatcacaaccaaggtgctacgcgtgaacggtgagaaaatcttagaggacttttccaagcgccagcagcctaagttcaaaaaagatcccccactggcggctgtcactaccgcggtgcaggagctgctgcggcttgcccaagctcaccccgccggaccacccactctggatccagttaacgatcttcagctcaaagacatgtcagtggtggagggcggtctccgagcccgcaaattagaggaactgattcagggcgctcagtgcgtccacagcccacgttttcccgctcagtatctaaaacttcgggagcgcatgcagatccagaaggaaatggaaagactgcggttccttctgagcgatcagagcctcttgctcttgcccgagtatcaccaacgagttgaggtcctccggaccttagggtacgtagacgaagcaggcactgtgaagttggccggccgggtggcctgcgcgatgtcatcccacgagctactgttgaccgagctgatgttcgataatgccctgtccaccctgcgacccgaggagattgcagccctcctctcaggactggtgtgtcaaagcccaggtgatgccggagaccagctccccaatacactgaagcaggggattgaaagagtgcgagcagtcgcaaaacgaattggcgaggtgcaggtggcttgcggcctcaaccaaacagttgaggagttcgtgggcgagctgaattttggcctagtagaggtggtgtacgagtgggcgcgggggatgcctttcagcgagctggctggtctgagtggaacccctgagggactcgtcgtgaggtgcattcagagactagctgagatgtgtcgatccctacggggagccgcacggctcgtgggagaacccgttcttggcgctaagatggagactgctgccactcttctgcgccgcgatatcgtcttcgcggcatcattatacacccagtag

SEQ ID NO: 136605 - DNA, 2643 bp, Artificial Sequence
  Description of Artificial Sequence: Synthetic coding sequence
atgatggagacagaaagattagtgctgccccccccggacccacttgatcttccattacgtgcagttgaacttggctgcacaggccactgggagctgttgaatttgcctggtgccccagagtcttccctaccccacgggttgcctccgtgtgctcctgatctgcagcaggaggcggaacagttatttttgtcctccccggcttggcttcccttgcatggagtcgaacattccgctagaaagtggcagagaaagacggacccgtggagcctgctggccgttctcggcgcccccgtcccgtcagatctccaggcgcaacgacacccgactactgggcaaatcctaggctacaaggaggtcctgcttgagcattatctcttcacaggaaactcctcaaaaactcaaggggagctctttctgctcctggactctagaggtgctttccataccaaagggtactacgctgcagtggaggccaaaaaagagcgcatgagtaaacatgcgcagacctttggcgccaaacagccaacgcatcaaggcggcccagctcaggatcgaggggtctatttgtcgctactcgcctccctgcgaactcgggctcagctgcctgtggtcgtgttcactttcagtcggggtcggtgtgacgaacaagcaagtggactgactagcttagaccttacaacctcttctgagaaaagtgaaattcacctgttcctccagcggtgtcttgcccgactgagaggctcagatcgtcagttgccacaagtgttacatatgtccgagttgttgaataggggcttgggtgtgcatcactctggaatccttccaatcctcaaggagattgttgagatgctcttctcgcggggactcgtaaaagtattattcgccacagaaacattcgcaatgggggtgaacatgccagcccggacagtggtgtttgactcgatgcgaaaacatgatggatctacatttcgggatctgctcccgggtgagtatgttcagatggcaggcagagccggaagaagaggcctcgatcccacaggcaccgtcattcttctctgcaaggggagggttcccgagatggctgacctgcatcgtatgatgatgggaaaacccagccaactgcagtctcagttccgtctgacgtatacgatgatcctcaacctgcttagagtggacgcactgcgcgtggaggacatgatgaaacggtctttttcagaattccctagccggaaggactccaaggctcacgagcaggcattagccgagctcactaagcggcttggggcactggaggagcctgacatgactggacagctcgtagacctgcccgagtattactcgtggggagaagagcttacagagactcagcacatgatccagcgccgtatcatggagtcagtaaacggattgaagagtctctctgcaggacgtgtagtcgttgtcaaaaaccaggagcatcataatgctttaggtgttattctgcaggtgagctctaacagcaccagccgtgtcttcactactttagtgctatgcgataaacccttgagccaggacccacaggacaggggacctgccaccgccgaggtaccataccctgacgatctggtcggctttaagctgttcttgccagaaggaccctgcgatcacacagtcgtgaagctgcaacccggggacatggcagctatcactacaaaagtattacgcgtgaacggggagaaaatactggaagacttttcaaagagacaacagccaaaattcaagaaggaccctcccttagccgcagttaccacagcggtgcaggaactgctcagactggcgcaagcgcatcccgcggggcctcctactttggaccccgtgaatgaccttcagttgaaagacatgtccgttgtggagggcgggctgagagcacgcaagctggaagaattgattcagggcgctcagtgcgtacacagcccaagatttcctgcacagtacctgaagctaagagagaggatgcaaatccaaaaggagatggagaggcttagatttcttctgagtgaccagagtctgttgcttctcccagaataccaccagagggtcgaggtgctgcgaacgctgggatacgtggatgaggcagggaccgtgaaattggcggggcgcgtcgcatgcgctatgtccagccatgagctgctccttacagaattaatgttcgataacgccctgtcaactctcaggcccgaggaaattgctgcactgcttagcggacttgtttgtcagtctcccggggatgccggagatcaactgcccaatacactgaaacagggcatcgagcgagtgcgggctgtggcaaaacggattggtgaggtgcaggtggcttgcgggctgaatcagacagttgaggagtttgtaggtgagcttaacttcggactcgtggaggtcgtgtacgagtgggcaagaggaatgcccttctccgagctagccggactcagcggaacccccgaaggtctggtcgttagatgcattcagcgccttgccgaaatgtgccggtccttaagaggtgcagcgcgcttagtgggcgaacccgtcctcggggccaaaatggagacggccgccacccttctcaggagagatatcgtattcgcagcttcactatatacccagtag

SEQ ID NO: 136606 - DNA, 693 bp, Artificial Sequence
  Description of Artificial Sequence: Synthetic coding sequence
atgatggaaaccgaacgactggtcctgccaccgcctgatcctctcgatttgcctcttcgggcagtcgagttaggatgcactgggcactgggagctcctgaacctcccaggtgccccagaaagcagcctcccacacggtttgcccccctgcgcacctgaccttcaacaagaggccgaacaactcttcctaagtagtccagcatggctgcctctgcatggcgtagaacattcagccagaaagtggcaacggaaaacagacccttggtccctgctcgccgtcctgggggcccccgtgccaagtgaccttcaagcgcagcgacatccaactaccggccagattctgggatacaaggaagtacttttagagaacactaatctaagtgccacaacctccttgtccctgaggcggcccccaggccccgcctcacagagtctttggggcaacccaacccagtatccgttctggcctggcggcatggacgagccgaccattaccgatctaaacaccagggaggaggctgaagaagagattgattttgagaaggacctgttgactatccctcccggttttaagaagggtatggattttgcccccaagggttctgtgcacagttgcattcaccctagggggccccgcgcatcgatttctggagctgttggccacccttgtgggaggcacctcccctgctggtag

SEQ ID NO: 136607 - DNA, 2643 bp, Artificial Sequence
  Description of Artificial Sequence: Synthetic coding sequence
atgatggaaactgagcgccttgtgctacctccacccgaccccttggacctgcctctcagggcggtggaacttggttgcacgggtcattgggagctcctcaacctcccaggtgcaccagagtcatccctgccccacggcctcccaccatgcgcacccgacctccagcaagaagctgaacagttatttctgagctcaccggcatggctaccgctccacggcgttgaacacagcgccagaaagtggcagcgaaaaacggacccttggtcccttctggctgtactcggggcacctgtaccctccgatctgcaggcccagagacacccaaccacagggcagatcttgggctacaaggaagtgctgctggaacattacctgtttacggggaattcatcgaaaactcagggagagctctttctgctgctcgacagccgaggtgctttccacacaaaggggtactacgcagccgtagaggccaagaaggagaggatgtcaaagcacgcccagacttttggggctaaacaaccgacacatcagggtgggccagctcaggaccgtggggtatatttgtcgcttctggcatctttgcgtactcgggcccaacttcctgtggttgtgttcacgttttcacgcggtagatgtgacgaacaggcctctggcctgactagtctagaccttactacaagcagtgaaaagtctgagattcacctctttctgcagcgctgtcttgcgcgtctgcgaggttccgacaggcagctgccgcaggtgctgcatatgtccgagttgctgaaccgtggcctgggggtccaccactcgggcatcctgccaattctcaaagagatcgtggagatgctatttagtaggggcctcgtgaaggtcctctttgcaacagagacgtttgccatgggcgtcaatatgcctgcccgcacagttgtgtttgactcaatgcggaaacacgacggctcaacgttcagggatctcttgcccggcgagtacgtgcagatggccggtagagcgggccgcagaggcttggatcctaccgggacagtcattctactgtgtaaaggaagggtgcctgagatggccgacctccaccgtatgatgatgggtaaaccaagccagttgcagtcgcagtttcgcctgacttatacgatgatcctgaacttattgagagtggatgcactacgggtggaagatatgatgaagcgtagttttagtgagtttccatcccgtaaagatagcaaggcacacgagcaggccctggctgagctcacaaagcgactgggcgctctcgaggaacccgatatgaccggccaactggtggatctccctgagtactattcctggggcgaggagttgactgaaacccagcacatgattcagcggcgaatcatggagtctgtgaatggattgaagtcgctgagcgccggcagggtcgtggtcgttaaaaatcaggagcatcataatgcgctaggagtgatactgcaggtgtctagtaacagcacatctcgagttttcacaacacttgtcttgtgcgataaaccgctgtctcaagatccacaggacaggggcccggccaccgcggaggtgccataccctgacgacttagttggtttcaaactgttcctccctgagggaccttgcgatcatactgtggtgaagttgcaaccaggtgacatggccgctattacaacaaaggtgcttcgagtgaacggtgaaaaaatactcgaggacttctccaagcggcagcagccgaaattcaaaaaagaccctcctttagctgctgtgactacagctgtgcaggagctcttgcggcttgcgcaggcacacccagcgggcccacccaccttagaccctgtcaacgacctgcagctgaaggatatgtctgttgtagagggggggctccgcgctcgtaagctagaagaacttattcagggcgcgcagtgtgtgcatagtcccagattccctgcccagtatctaaaactgcgcgaaaggatgcagatccaaaaggaaatggagaggttgaggttcctgttaagcgatcagagcctgttgctcttgcccgagtatcaccaaagggtcgaagtgctgcgaactcttggctacgtcgacgaggctgggactgtgaagctagcagggagagtggcctgtgctatgtcttcgcatgagttgctgctcaccgaattgatgttcgataacgctctgtcaaccctcaggcctgaggaaatcgctgctttgctgtcaggactggtctgtcagagcccgggcgacgccggcgatcagctgccgaacactctcaagcaagggatcgaaagggtgagggcagtagccaagcgcattggagaggtgcaagtagcgtgcggactgaatcaaactgtggaggagttcgttggcgaactaaactttggattagttgaggtggtttacgaatgggccaggggcatgcccttttcagaactggctggactgtctgggaccccagagggtctcgtggtacgctgcattcaacgcctggccgagatgtgccggtcgttgcggggcgcagctcgcctcgtcggtgaacctgttcttggggctaagatggaaactgccgccactttgcttagaagagacatcgtgttcgctgcatcactgtacacccagtag

SEQ ID NO: 136608 - DNA, 3267 bp, Artificial Sequence
  Description of Artificial Sequence: Synthetic coding sequence
atggatgaacctacaattacggaccttaacacaagggaagaagcagaagaggagatcgattttgagaaggatctgttgactatacctcccggattcaagaaaggcatggactttgctccaaaagattgcccgacccctgcacccggactactgtctctcagttgccttctagagcccctcgatttgggggggggcgacgaagacgaaaatgaggccgtgggtcagccagggggaccaaggggtgatacggtgtccgcttcaccctgcagcgctcctctggcccgcgccagctcattggaggatttggttctgaaggaggcatctaccgcagtctcgacacccgaggctccagagccaccctcccaagagcagtgggcaatcccagtggacgccacatcccccgtgggagacttttaccgcctgatccctcagccagcctttcagtgggcattcgagccggatgtctttcagaagcaggccatcttacacctcgaaagacatgactctgtctttgtagctgcccacacgtccgccgggaaaaccgtcgtcgcagagtatgcgatcgctcttgcccaaaaacacatgaccaggactatatatacatcccccatcaaggccctctccaatcagaaatttcgggacttcaggaatacattcggggatgtgggattacttactggagacgtccagttgcaccctgaggcctcctgtcttatcatgactacagagattctaagaagtatgctatactcaggcagtgatgtgatccgtgaccttgagtgggtcatcttcgacgaagtacactacatcaatgacgttgagcgcggtgtggtctgggaggaggtcttgattatgctgcctgatcatgtaagcatcatcctcttgtctgcgaccgttcctaatgcgcttgaattcgccgactggattggccgcctgaagcgacggcaaatttacgttatttccacagtgacccggcctgtacccttggaacattacctgttcaccggcaactccagcaaaactcagggcgaactctttctcttgttggatagtcgaggagcctttcatactaaaggatactacgctgcagttgaagccaaaaaggagcggatgtctaaacatgcacagacattcggcgccaagcaacccacccaccagggcggccctgcacaggacagaggggtctatctttctctgctcgcatctctgagaacacgagcccaactgccagtggtagtgttcacattttctagaggacgctgtgacgagcaggcctccggtctgacctcactggatcttaccacatcctcagagaaatccgagattcacctcttcctgcagcgatgcctagctcgcttgcgcggctcagatcgtcagctgccccaggttctgcacatgagtgagttactgaaccgcggccttggcgtgcatcattcaggcatcttgcccattcttaaggagatcgtggaaatgctgttttccaggggtctggtaaaagtgttatttgcaactgaaactttcgcgatgggagtcaacatgcctgctagaaccgtagtctttgatagcatgaggaaacacgacggatcgaccttcagagatcttttaccaggggagtacgttcaaatggcgggtcgagccgggcggagaggtcttgaccccactggaaccgtgattctgttatgtaagggaagagtgccagaaatggctgatctgcaccgaatgatgatggggaagccctctcagctgcaaagccagttccgactgacgtataccatgattttaaacctgttaagggtcgacgctttaagggtggaagacatgatgaagaggagcttttctgagttcccttccagaaaggattccaaggcccacgagcaggctcttgctgagctgaccaagagactcggcgcattagaggagcctgacatgaccggtcagctggttgatctccctgagtactatagctggggcgaggagctgaccgaaacccaacacatgatccaaagaagaattatggagtcagttaatggcctcaagagtctcagcgctgggcgggtcgttgtggtcaagaaccaagagcatcataacgccctaggagtgatcctacaggtttcgtctaatagtacatcacgtgttttcaccacacttgtgttatgcgacaaacccctgtctcaggaccctcaagatcgaggtccagcgaccgccgaagtgccataccctgacgatctcgttgggttcaagctgttcctccccgagggcccctgcgatcatacagtggtgaaactgcaacccggcgatatggctgccattaccacaaaggtgctgagggtcaatggcgagaagatactcgaagatttttctaagcgccagcaaccaaagttcaagaaggaccctccgctcgccgcagtgacaaccgcagtccaggagctgttgagactagcacaagctcatcctgctggacctcccactctggatcccgtgaacgaccttcaactgaaagatatgtccgtggtagagggggggctgagagctcgcaaactggaggagctcattcagggagctcagtgcgtacatagtccacgcttccccgctcagtaccttaaactgagagagcgcatgcagattcaaaaggagatggaaaggcttaggttcctcttgtcagatcagtctcttctcttgctgcccgagtatcatcaacgagtggaggttctccggaccctgggttatgtggatgaagcgggaacagtgaagctggctggaagggtggcttgcgctatgagcagccatgaactgctgttgacggagttgatgttcgataatgccctgtctactctgcgtcccgaagaaatagcagcactgctgtccggcctggtgtgtcagagccctggtgatgcaggtgaccagctccctaataccctgaagcagggcatcgaacgtgtgcgcgccgtggcgaaaagaataggggaggttcaggtggcatgcgggctgaatcagacagtggaggagtttgtcggggaactgaatttcggtctcgtggaggttgtctacgagtgggcacgcggcatgcccttttctgagttggctggtcttagcggcaccccggaggggctggtcgttcggtgcattcagcggctggctgagatgtgcagaagcctgcggggggcagcccgcctggttggagagcccgtgctgggcgccaagatggagactgccgccacccttcttcgacgcgatatcgtgttcgcagcatcactgtacacccagtag

SEQ ID NO: 136609 - DNA, 3267 bp, Artificial Sequence
  Description of Artificial Sequence: Synthetic coding sequence
atggacgagccaactataacagacctgaacaccagagaggaagctgaggaagaaattgactttgaaaaagatctgctcactattccgcccggattcaaaaagggcatggatttcgcacccaaagattgtcccactcctgccccagggctactctctttgagttgcctgctcgagccccttgacctcggcggtggagacgaagacgagaatgaggccgtcggacagccaggaggacctcgcggcgatacagtcagtgctagcccttgttcggcccccttggcgcgagcatcttctctcgaagaccttgtgctgaaagaagcaagtaccgccgtctctaccccagaggcacccgaaccaccgtcccaagagcagtgggccatacccgtcgacgccacatctccagtgggagacttttacaggctgatcccgcagccagcttttcagtgggccttcgaacccgatgtgttccagaaacaggcaatcttgcacttggaaagacacgatagcgtcttcgtggcggctcatactagtgcaggaaaaacggtggtggccgagtatgcgatcgccctcgcccagaaacatatgacaaggacgatctatacttctcccatcaaagccctgtcgaaccagaaattcagggatttccgtaacaccttcggtgacgtcggactactgactggcgatgttcagctgcatccagaggcttcatgcttgatcatgaccaccgagatcctccgttcaatgttatattcgggctctgatgttattagggacttagaatgggtgatcttcgatgaggttcactacataaatgacgtggagcggggcgtggtgtgggaggaggtattaatcatgcttcccgatcacgtcagcatcattctcctatctgcgaccgtaccgaacgccctcgaatttgccgattggatcgggcgactgaaacggaggcagatctatgtaatatcaaccgttacccgacctgtgcccctggagcactacctcttcaccgggaattctagtaagacccagggagagctctttctgctcctcgacagtagaggggccttccataccaagggatactatgctgcggtggaggctaaaaaggagcggatgtctaaacatgcacagacattcggtgcaaagcaacctactcatcaggggggccctgcacaggatcgaggagtctacctcagtttgctcgccagcctgagaaccagggcccagctgcctgtggtcgtgtttactttttctcgggggagatgcgacgagcaagcgtcagggctcacttccctggatctcactacctcaagcgagaagagcgaaattcatctgtttctccagagatgtctcgcgcgcctccgcggaagtgatagacaacttcctcaggttctgcacatgtcagaactcctcaaccgggggctgggtgtccatcactctggaatccttccaatactcaaagagattgtggagatgctgttcagccggggactggtgaaagtactttttgccacagagaccttcgccatgggcgtgaacatgccagctcgaaccgtggttttcgatagtatgagaaagcacgatgggagcacgtttcgtgacctcctgccaggagagtacgtgcagatggccggtcgcgccggccgccggggcctcgatcctacggggacggttattttgctctgcaagggcagagtacctgaaatggctgatctgcataggatgatgatgggcaagccttcgcagctgcagtcccaatttcgcctgacctataccatgatattaaaccttctgcgcgttgatgcattgcgagttgaagacatgatgaagcggtccttttcagaatttcctagcaggaaagactcaaaggcccacgagcaggcccttgctgaactgacaaagaggctcggcgccctagaggagccggatatgacaggccagctcgttgaccttcccgagtattattcatggggagaagagctcactgaaacacagcatatgattcagagacggatcatggaatccgtcaatgggctgaaaagcctttccgctggacgagtagttgtggtgaagaaccaggagcaccataatgcacttggcgtgattctgcaggtaagcagtaacagcaccagccgggtattcactacgctggtattgtgtgacaaacctctctcccaggatccgcaagatcgtggacccgcaaccgcagaggtcccgtaccccgacgacttggttgggtttaagctgttcttacctgaaggaccctgtgatcataccgtggtcaaacttcagcccggagacatggccgctataaccacaaaggttttgagggtgaatggcgaaaagatccttgaggattttagcaagaggcagcagcctaagtttaagaaagacccacccctcgcggctgttacgactgcagtccaggagctgctccgactagctcaagcacaccccgcaggtccacctactctggacccagtgaatgatctgcagctcaaagacatgagcgtggtcgaaggaggtctcagagcccgaaagctggaagaacttatacagggtgcacagtgcgtgcactcgccaaggttccctgctcagtacctgaagctacgcgagaggatgcaaatacagaaggagatggagcggctgaggttccttctctccgaccagtcactgctgttgttacccgaatatcatcagagagtggaagtccttagaaccctggggtacgtcgacgaagccggaacagtcaaattagcagggagggtcgcgtgtgcaatgtcatcacacgaactgcttctgacggagctcatgtttgataacgccttgagtacattgagaccagaagagatcgctgctctcctcagcggtcttgtgtgccagagtccaggggatgccggagatcagcttccaaacacattaaaacagggcatagagagggtgagggccgtcgctaaacgaatcggagaggttcaggtggcatgtggtttgaatcagacggtggaggaatttgtaggagagctcaatttcggcttggtggaagtggtttatgagtgggcccgaggtatgcccttttctgagcttgctggactgagcgggacccctgaagggctggtggtccgatgcatacagagactggcggagatgtgtcggtcgctcagaggagcagcacgcttggtgggagagcctgtgttgggggctaaaatggagaccgcggctaccctcctgcgccgggacatcgttttcgctgcatctctctatactcaatag

SEQ ID NO: 136610 - DNA, 693 bp, Artificial Sequence
  Description of Artificial Sequence: Synthetic coding sequence
atgatggagacggagcgcctcgtgctgccacctccagacccattggatctccccctccgggccgtggagctgggatgtacggggcactgggaactgctcaacctaccaggcgcacccgagagctccctccctcacgggctgcccccttgcgcccctgatttgcagcaagaggccgaacaactcttcctctcgagcccagcgtggctcccactgcacggcgtagaacattccgcgagaaagtggcagcgaaaaacagatccttggagcctgctagcggtgctcggtgctcctgttccctccgacctgcaagcacagaggcatccgaccactgggcagatcctcgggtacaaagaggtgttactagagaacaccaacctgtcagctacaacgagccttagcctgcgcaggccaccaggcccggccagtcaatctctatgggggaacccgacccagtaccctttctggccaggtggcatggacgagcctaccatcactgacctgaacactcgcgaggaagctgaggaggaaatcgattttgagaaggacctcctgacaattcctccggggtttaaaaaggggatggacttcgcccccaaaggctcagtccacagctgtatccaccctaggggtcctagagcaagcatctcgggggccgtggggcacccctgcggacggcatctcccatgctggtag

SEQ ID NO: 136611 - DNA, 3267 bp, Artificial Sequence
  Description of Artificial Sequence: Synthetic coding sequence
atggatgagccgactatcactgatttgaacactcgggaggaagccgaggaagagatcgactttgagaaagatctcttgacgatcccacctggattcaagaagggtatggactttgccccaaaagactgtcccacccccgcacctggcctcctgtcactttcatgtatgttggagcctctggatttgggaggaggagatgaggacgaaaatgaagctgtgggacagccaggagggccgcgaggggacacagtctcagcatccccctgctcagcccccttagcaagggcttcaagtcttgaggacctggtgttaaaggaagcctccaccgcagtttcaactcctgaagccccggagccccctagtcaagaacagtgggccataccagtggatgcaaccagcccagttggtgatttctataggctgattcctcagcccgcatttcagtgggctttcgaacctgatgtcttccagaaacaagccatactgcatctggagcgccacgatagcgtcttcgtcgcagctcacaccagcgccggcaaaaccgtcgtggctgagtacgccatcgcactggcacagaagcatatgacacgtacaatctacaccagtccaatcaaagctctcagcaaccagaagttccgcgacttcaggaacacctttggcgatgtcggactgctgacaggcgacgtgcaactccatcccgaggcatcttgtctgataatgaccacagaaatactgaggagtatgctttacagtggtagtgacgtgatccgagacctggaatgggtgatcttcgatgaagtgcattacattaatgatgtcgaaagaggcgttgtttgggaggaagtgctgatcatgctgccagatcacgtgagcattatcctgctgtccgccaccgtacctaatgctcttgagttcgcagattggatcggcaggctcaaaagacggcagatatatgtgatctctacagtgacaagacctgtgcctcttgagcactatctcttcaccggtaatagcagcaaaacacagggcgaactttttcttctcctcgatagccgtggagcattccacactaaggggtactacgcagcggtggaggcgaaaaaggaaaggatgtcaaaacatgcccagacattcggcgctaaacagccaacccaccagggaggtcctgcccaggatcgaggggtgtacctcagcctcctggcatccctgcgtacgagagcgcagctgccagttgtggtgttcacattttcccgcgggcgctgtgatgaacaggcttccggtctgacctctttagaccttactacgtctagcgagaaatccgagatccacctcttcctgcagcggtgtcttgcccgactacgcggcagtgatcgccaactcccccaggtccttcacatgagcgagcttctcaatcgtggattaggcgtgcatcatagtggaatcctgcctattcttaaggaaattgttgaaatgctgttttcccgtggactggtaaaagtcctgtttgctactgaaacatttgccatgggagtcaacatgcccgcacgcacagttgtatttgatagcatgaggaagcacgacggtagcactttcagggatctattgccaggtgagtatgtgcaaatggctgggagagcggggagaagggggctggatcccactggaaccgtgatcttactctgtaaggggagggtcccggaaatggcggatctgcaccgtatgatgatggggaagccctcccaactgcagtctcagttcaggctcacctacactatgatcctgaacctactccgggtagatgccctgcgagtggaggacatgatgaagcgcagcttttccgagttcccatctaggaaggactcaaaggctcatgaacaggccctggctgaactgaccaagagactgggtgcactggaagagcccgatatgactggccagctcgtagatcttccagagtattacagttggggagaggagctgaccgaaacgcagcatatgatccaacggagaatcatggagtctgtgaatggcttgaagtcgctgtccgcaggaagggtggtcgttgttaagaatcaagaacaccataacgccctgggggtcatacttcaggtatcttctaatagcacctcgcgggtattcaccactttagttctgtgtgataagcccctcagtcaagacccacaggacaggggacctgccacggccgaagtcccctaccccgatgatctcgtcggttttaaattgttcctgccagagggcccttgtgaccacaccgtggtgaagctgcagcccggcgatatggccgccatcaccacaaaagtgctgcgcgtaaatggagagaagatattagaggatttttcgaaaagacaacaaccaaagttcaagaaagatcctccgctggccgctgtcaccaccgccgtgcaagaactattgaggcttgcccaggcgcaccctgccggccccccaacgcttgacccagtaaacgacctccagttgaaggacatgagcgtggtggaaggaggattacgggcacggaagctggaagaactgattcagggtgctcagtgcgtgcactcaccaaggtttcctgcccagtatttgaagctgagggaaagaatgcagatccaaaaggagatggaacgtctcagatttttgcttagcgaccagagcctgttgcttctaccggagtatcatcagagggtcgaggtcctgcgaaccctggggtacgtggacgaggctggcacggtgaaactcgccggccgagtcgcatgtgctatgtcgagccacgagctcctgctaactgagctgatgtttgataacgctctgtcaactctcagaccagaagagattgcagctttgctgagtggcttggtgtgccagtcccctggcgatgcaggcgatcaactaccaaatacactgaaacaagggattgaaagggtccgcgccgtagcaaaacgcatcggagaggtccaggtcgcctgtggcctgaaccagaccgtggaagagtttgtgggggagcttaatttcggccttgtcgaggtggtgtatgagtgggcccggggcatgcccttttccgagctggctggactttcaggcactccagaggggctggtcgtgagatgcatccagagactggccgagatgtgcaggagcttgcggggagcagcccgtctcgttggcgaacctgtacttggagccaaaatggaaacagcggcaacactgttgcgcagagacatcgtcttcgctgcatctctgtacacccagtag

SEQ ID NO: 136612 - DNA, 693 bp, Artificial Sequence
  Description of Artificial Sequence: Synthetic coding sequence
atgatggaaactgaacggctggttcttcctccacctgatccattggacctgcctctgcgcgcggttgaactggggtgcaccggtcactgggaattgttaaacctgccaggcgcgccggaatcctccttaccacacggcctgcctccatgcgctccggatctgcagcaggaagcagagcagttgttcctatcttccccagcttggttgccccttcacggggtagagcatagtgctcgaaagtggcagcggaaaaccgacccctggtctctgctcgccgtcctgggggctccagtgccatccgatctgcaggcacaacggcaccctactacaggtcagatcctgggctacaaggaagtgctgttggaaaacaccaacctatctgcaacgactagcttatctctccggcggccacctgggcccgctagccaaagtttatggggtaaccccactcaatatcctttctggcccggaggaatggatgagccaactataacggatttgaatactcgtgaagaggccgaagaggaaattgacttcgagaaggaccttcttacgattccgcctgggttcaagaagggcatggattttgcccccaaagggagcgtccacagctgtatccatccacgaggcccccgggcatccataagcggagcggtgggtcacccttgtggtcgtcacctgccatgctggtag

SEQ ID NO: 136613 - DNA, 2643 bp, Artificial Sequence
  Description of Artificial Sequence: Synthetic coding sequence
atgatggagactgagcgacttgtactgccacctcccgacccgttagaccttcctcttagagcagtcgaattaggatgcactggccattgggagctgcttaatctccccggcgcccccgaatccagcttgccgcacggactgcccccttgtgctccagatttgcaacaggaagccgaacagctatttttatcaagcccagcttggctgccactccatggcgttgaacactccgcccgaaagtggcagagaaaaacggatccatggagtctgctggccgtgcttggagctcctgtccctagcgatctacaagcacaacggcaccccactaccggccagattctggggtacaaggaggtgctgctggagcattatctatttacaggtaactcttcaaagacccagggggagctgtttctgctgctggattcacgtggcgctttccacaccaaaggatattatgcagctgtcgaggccaaaaaggagcggatgtccaaacatgctcaaacattcggcgccaaacagcccactcaccaaggtgggcctgcccaagataggggggtatacctaagcctcttagcatccctcaggaccagggcacagctcccagtcgtggtcttcactttctcaaggggacggtgtgatgaacaggctagcggcttaaccagccttgacctgacaacctcctctgagaagtctgaaattcacctattcttacagcggtgtctggccagactgcgggggtctgacagacagcttccacaggtactccacatgtcagagctcttgaaccgcggcctcggcgtgcatcattcagggatcttacctatcctcaaggaaatcgtagaaatgctcttctctcggggtctggtgaaggtactttttgcgactgaaacctttgccatgggtgtcaacatgccagcgcggaccgttgtttttgattccatgcggaagcatgacggatccaccttccgagatctgctgcctggcgagtatgtacagatggcaggacgggcaggtcgccgggggcttgatcccactgggacagtgattctgttgtgcaaggggcgagtgcccgagatggctgacctccatagaatgatgatggggaaaccatcacagttgcaaagccagtttagactcacgtataccatgattctgaacctcttgcgggtcgatgctctgcgcgtcgaggacatgatgaagcgaagtttcagtgaattcccctcccgcaaagactccaaagctcatgagcaggcccttgccgagctcactaagcgcctgggagccttggaagaacctgacatgacagggcagcttgtggacctgcctgagtattactcatggggagaggagctgacggaaactcagcacatgatacaaagacgtatcatggagtccgtaaacggcctcaagtccttgtcagccggccgggtagttgtggtgaaaaatcaagagcaccacaatgccctaggagtgatcctgcaggtgtcctccaacagcacatcccgtgtctttacgactttggtgctgtgcgacaagcccctaagccaggatccacaggaccggggccctgcgacggcagaggtgccatatccagacgatctagttggatttaaactgttccttcctgagggtccatgtgatcatacagttgtgaaattgcagcctggcgatatggccgcaattacaacaaaggtgcttagggtaaacggggaaaaaatcctggaagacttctctaaacgccagcagccaaaattcaagaaagatccccctctagctgctgtaactacggcggtgcaagagctccttcgccttgctcaagcccacccagctggaccaccaacccttgatcctgtaaacgacctccagttaaaggatatgtccgtcgtagaaggtgggctgagggctaggaagctcgaggagctaattcagggcgctcagtgtgtgcactctcctcgcttccccgctcagtatctgaagctgcgggaacgaatgcagatacagaaggagatggaaagactgcgttttctcctaagtgatcagagtctgctcttgcttccagagtaccatcaacgagtggaagtcctgcggactctaggatatgtcgatgaggctgggacggtaaagctggctggcagggttgcgtgcgctatgagcagtcatgaactgctcttaaccgaacttatgtttgacaacgcactgtccacactgagacccgaggagatcgctgctctgctcagcgggctcgtgtgtcagagtccaggagatgcgggtgaccagctgccaaacaccctgaaacagggcatcgagcgcgtgcgcgctgtcgctaaaaggattggggaagttcaggtcgcttgcggactgaaccagactgtagaagagttcgtgggggaattgaattttggtcttgttgaggttgtgtatgaatgggctaggggcatgcccttttccgagctggcaggcctatctggaacccccgaaggactggtcgtgcgctgcattcagcgccttgctgaaatgtgccggagcttgcgcggcgccgcccggctcgttggggaacctgtgctaggcgctaaaatggagactgccgccaccttgttgaggagagacatcgtgttcgctgcatcattatacacccagtag

SEQ ID NO: 136614 - DNA, 693 bp, Artificial Sequence
  Description of Artificial Sequence: Synthetic coding sequence
atgatggaaaccgagaggttagttctcccaccacccgaccccctggatctgccattgcgggccgtcgagttgggctgcacgggccactgggagctcctgaacttgccgggcgcccctgaaagctccttgccccacgggctaccaccgtgtgctcctgatcttcagcaggaggccgagcagctgttcctcagctccccggcatggctgccattacatggagtggaacactcagctcggaaatggcaaaggaagaccgacccctggagtttgctggccgtgcttggagcccctgtgccgtcagacttgcaggcccagcggcacccaacaaccggacagatcctgggctacaaagaagtactgcttgaaaatactaacctctccgcaacaacaagcttatccttgcggagacctcctggccccgcctcccagtctctatggggaaaccctactcaatacccattttggccagggggtatggacgaacctaccataacagacttaaacacacgcgaggaagcggaggaggagatcgacttcgaaaaagatctgctaactatcccacccgggttcaaaaaaggcatggatttcgcacccaagggcagcgtacacagctgcattcaccctcggggaccccgcgctagcatcagtggcgccgtgggccacccctgcggccgccatctcccctgctggtag

SEQ ID NO: 136615 - DNA, 3162 bp, Artificial Sequence
  Description of Artificial Sequence: Synthetic coding sequence
atggacttcgctccaaaggactgtcccactccagccccgggcctcctcagcctgagctgtctcctggaaccgctggacctgggaggcggtgacgaggacgagaacgaagccgtcggacagcctgggggcccacgaggcgataccgtgagcgcttcaccctgttctgccccgttggcgagagcctcatcactcgaggacttggttctgaaggaagcctctaccgctgtttctaccccagaagctcccgaacccccttctcaagagcagtgggcaattcccgtggatgcaacctctcccgtgggcgacttttacaggctcatccctcagcccgcatttcagtgggcttttgagcccgacgtcttccaaaaacaggctattctacatctcgagcggcacgacagcgttttcgtagcagcacatacaagtgcaggaaaaacagtggtggccgagtacgccatagctctggcccaaaaacacatgactagaacaatatatacatccccaatcaaagccctgagtaatcagaagtttagggatttcaggaacactttcggcgacgttggactactcactggggacgtccagctgcatccagaagcctcttgtctcattatgacaacagaaatcctccgaagcatgctgtatagtggatctgacgtcatccgtgatctggaatgggtaatttttgacgaggttcattacataaatgatgtggaaaggggggtggtctgggaggaggtattaatcatgctgcccgaccacgtctcaattatactcctttcggcaaccgtccccaacgcactggaatttgctgactggatcggacgattaaagcgaagacagatatatgtgatctctactgtgaccagacctgtcccattggagcactatcttttcactggtaactcctcaaagacacaaggggagctctttctgctactagactcgcgcggggctttccataccaaaggttattatgcggcggtggaagcaaaaaaagagagaatgtctaaacatgcccagacattcggggctaaacaacccacacatcagggcggcccggcacaagaccgtggcgtgtacctatcattattagccagcctgcggacaagggcccagctgccggtggtggtctttaccttctctagaggcaggtgcgatgaacaggcgtctggactgacctctttggacctgacaaccagctctgaaaaatccgagattcacttattcttgcagaggtgccttgcccgattacggggcagtgaccgtcagctgccacaggtcctccatatgtcggaactactcaacagagggctgggcgtccatcattcaggtatcctgcccatcctaaaagagattgtggaaatgctcttctcacggggcctggtcaaggtgctgtttgctaccgaaacatttgcaatgggggtgaacatgccagcacggaccgtggtgtttgactccatgaggaagcacgacggctctactttccgcgacctgctcccaggggagtacgtccagatggctggtagggctggcaggagaggcctggatcctacaggcactgttatcctgctgtgtaagggccgcgtgcctgagatggctgatctgcaccgcatgatgatggggaaaccaagccaactgcagtcccaatttcgcttgacttacacgatgatcctgaatctgcttcgggtagacgcattaagggtagaggacatgatgaaaagatcattctctgaattcccttcccgcaaagatagcaaagcccacgaacaggctctggccgagctgacaaaacggttaggtgcgcttgaggaacccgatatgactggacaactggtcgatctgccagagtattacagctggggtgaggagctcactgaaacccaacatatgatccagcggcgaatcatggagagtgttaatgggctgaagtccctttcagccggcagggtggtagttgtaaaaaaccaagagcaccacaatgcattgggtgttatcctgcaggtgagctctaactccacctcaagagttttcacgacacttgtgctgtgtgataagcccttgtcccaggatccacaggatcgcgggcccgctactgctgaggtgccctatcccgatgacctcgtcggctttaagctctttctccctgaaggcccttgcgaccatacagtggtgaaactgcaacccggtgatatggctgcaattacgactaaggtcctccgggttaacggtgagaagatcctcgaagacttttcaaagcgtcagcaaccaaaatttaagaaggatccaccgctcgcggccgtgaccacagccgtgcaggagttgctcagactggcacaggcacaccccgcaggacccccgactttagatccagttaacgatctgcaattgaaggacatgtccgtagtggagggaggtctgcgggcacgtaaacttgaggaactcatccagggagcgcaatgtgtccattccccccgtttccccgcacagtacctcaagctgagggaacggatgcagatccagaaagagatggagagattacgattcctcctttctgaccagtctctcctgctcctgcctgagtatcaccagcgtgtcgaggtgctcagaacacttgggtacgtggacgaggcggggacggtgaaactggcaggaagagttgcctgcgccatgtcttcgcatgaactactgctgaccgagttaatgttcgataacgccctttccacattacgccccgaagaaatcgcagcgctcttatccggactggtttgtcagtcccctggcgacgccggagaccaactcccaaacacattaaaacaagggatagaacgcgtgcgcgccgttgcgaagcggattggagaagtacaagtcgcatgtggactgaatcaaaccgttgaagaattcgtgggcgaactcaattttggactggtggaagttgtatatgagtgggcccggggcatgcctttttccgaacttgccggactgtcgggtactcccgagggtctggtggtcagatgcatccagcgacttgcggagatgtgtcgcagcctgcggggggcagcacgactggtgggcgagcccgtactcggagccaagatggaaactgcagctactctcctgcggcgggatattgtttttgctgcaagcctgtacacccaatag

SEQ ID NO: 136616 - DNA, 3162 bp, Artificial Sequence
  Description of Artificial Sequence: Synthetic coding sequence
atggactttgctccgaaagattgtcctaccccagcaccggggttgttgagcctgtcgtgcctcctggagccacttgacctgggaggcggggatgaagatgaaaacgaggcagtgggtcagcctggtggcccccgcggagacaccgtctctgcgagcccctgcagtgctccactggcccgcgcttccagcctggaggacctggttctgaaggaggcatctaccgcagttagtacgccagaggcccctgagccaccttcccaggaacagtgggccatcccggtcgacgccacatcccctgttggtgatttctaccggctcatcccgcagccggctttccaatgggccttcgaacccgatgtttttcagaagcaggcaattctgcatcttgagcgacatgatagcgtgttcgttgccgcccacactagtgccgggaagacagtagttgcggaatacgctatcgctttagcccaaaagcacatgacaagaacaatttacacttcacctattaaagctttgagcaaccagaagtttcgagacttcagaaacaccttcggtgatgttgggttgttaacgggcgacgtgcagctccaccctgaggcttcttgcttaattatgactacagaaattctcagatccatgctgtacagcggcagcgacgtgatcagagacctagagtgggtaatcttcgatgaagtgcattacatcaacgatgttgagaggggggtggtgtgggaagaggtgctcattatgctgccggaccatgtgagtattattctgctctcagcaactgtaccaaatgccctggagtttgctgactggatcggccgactaaagcggcgacagatttatgtgatatccaccgtgacacggcccgtccccttagagcactaccttttcaccgggaactcgagtaaaacccagggcgaactgttcttacttttggactccaggggcgcattccatacaaaaggctactacgccgccgtcgaggcaaaaaaagagcggatgtccaagcacgcccaaacattcggggctaaacagccgacacatcaggggggccctgcacaagatagaggcgtctacttatcactgctcgccagcctgcgcacacgcgctcaactgccagtggtggttttcaccttcagcaggggtagatgtgacgagcaggcctccggactgactagtctcgatctgactacctctagcgagaagtccgaaattcacctgtttctgcagcggtgtcttgcccggttacgaggctccgataggcagctcccccaagtgttacatatgtccgaactactgaaccgaggcctgggggtgcatcattctggcatcttacccattctgaaagagatcgtggagatgctgttttcgcgaggattagtaaaagtgctcttcgccacagagaccttcgcgatgggcgtaaacatgcctgcacgcacagtcgtgttcgatagtatgcgcaaacacgacgggtccaccttcagggacctgttgcctggtgaatatgtgcagatggcaggccgcgctggaaggcgagggcttgatccaaccggaacggtaattttactctgtaaggggcgagtcccagagatggccgacctacaccggatgatgatgggcaagcccagccaacttcagagtcagttcagactgacatatacaatgatactgaatttgcttcgagtggacgccttgcgtgtggaggatatgatgaaacggagcttctccgaatttccttctcgaaaagactctaaggcgcacgagcaggctctcgccgagctgactaagcgcctgggggccctggaagaacctgacatgactggccagctcgttgatctgccagaatactactcctggggcgaggaactcaccgagacccagcacatgattcagcggaggattatggagagtgttaacggattgaaatccttgagcgcggggagggtggttgtggtgaaaaaccaagagcatcataacgcactgggtgtgatcctgcaggtgagctctaattccacgtctagggtctttactactttggtcctgtgcgacaagcccttgagtcaggatcctcaggatagaggccccgccacagctgaggtcccataccccgatgatcttgtcggttttaaactatttcttcctgagggtccttgcgaccacaccgtggtcaagctgcagcccggcgatatggcggctattacaacgaaggtgcttcgggtgaatggagagaagatcctagaagacttctcaaagagacagcagcccaaattcaaaaaggatccaccactggccgccgtcaccaccgctgtccaggaactcttaagactggcccaggcccaccctgcagggcctcctactctcgatccggtaaatgatctgcagctcaaggatatgtccgtggtagaaggtggccttagagctagaaagttggaggagctgatccagggtgctcagtgcgtgcactccccacgctttcccgctcagtacctcaagcttagagaacggatgcagattcagaaagagatggagaggttgaggttcctgttatcagatcagtcactgctgctcctccctgagtaccaccagagggtagaggtactgagaaccctgggttatgtggatgaggctggcactgtaaaattggctggccgcgtcgcctgtgctatgtcatctcacgaactgctgttaactgagctcatgttcgacaacgcactctccaccctgcgtcctgaagaaatcgcagccctgctcagcggcctagtgtgccaatcccccggggatgccggggatcagttgccaaataccctgaagcagggaatcgagagggttcgagctgtggcaaagcgcattggtgaggttcaggttgcctgcggccttaatcagactgtggaagagtttgttggagagttgaactttgggcttgtagaagtcgtgtacgagtgggcccgcggaatgcccttttcagagctcgcaggcctgagcgggaccccagaagggttagtggtgaggtgtatccagagactggccgagatgtgcagatcactgcgtggggcggcccggctcgtgggggagccagttctcggagctaagatggagaccgcggcaaccctcctgcgccgcgacatagtctttgcggctagcctgtatactcagtag

SEQ ID NO: 136617 - DNA, 3162 bp, Artificial Sequence
  Description of Artificial Sequence: Synthetic coding sequence
atggactttgctcccaaggattgtccaacaccggcacctggcctgctgtccctcagctgtcttcttgagccacttgacctgggaggcggagatgaagacgaaaacgaagctgtcggccagccaggcggtccaaggggggacactgtctccgccagtccatgcagcgcacctctcgctcgagcttcgtctcttgaagatcttgtacttaaagaagcatctacagccgtaagcacccccgaggccccagaacccccctcccaggagcagtgggccatacccgtggacgctacgtcgccagttggtgatttctataggctcatcccacaaccggccttccagtgggccttcgagcctgacgtgttccagaaacaggccatactgcatctcgagcggcatgactcagtgtttgtcgccgcacatacatctgcagggaagactgtagtcgccgaatacgccattgcgctggctcagaaacatatgacgagaaccatctacactagccctatcaaggcgctctctaaccaaaagttcagagattttcggaacacctttggagacgtggggctcctcaccggagatgttcagctacacccagaggccagttgcttaattatgaccacggagatcctccgctcaatgctctatagcgggagtgatgtgattagagacctggagtgggtgatcttcgacgaagttcattacattaatgatgtcgaaagaggcgtggtctgggaagaggtcctcatcatgttaccagaccatgtgtccatcatcctgttgagcgcgactgtgcctaacgctttagaattcgccgactggattgggaggctcaaacgccgtcagatttacgtgatctctactgttacccggccagttcccctcgagcactacctgtttactggcaattcctcaaagacacagggagaacttttcctcctcctggatagtaggggcgcatttcacacaaaaggatattatgccgccgtggaagctaaaaaggagagaatgtcaaagcacgcgcaaacatttggagccaaacagccaacccaccagggaggccccgcacaagataggggggtataccttagcctgctagcctcgttgcgaactagagcccagctgccagtagtcgtgttcaccttttcccgcggccgttgtgacgagcaggcgtccggcttgaccagcttggatctgaccacatccagcgaaaaatccgaaattcatcttttcctccagcgctgtctggcccgcctgagaggcagcgacaggcagctgccacaggtactgcacatgagcgagctgcttaaccgaggcttaggggtgcatcatagcggtatcctgcccatccttaaagagatagttgaaatgctgttctcaagaggcctggtgaaagtgctttttgcaaccgagacctttgcgatgggcgtgaacatgcctgctaggaccgtggtttttgacagtatgaggaaacacgacggaagcaccttccgggatcttcttccgggcgagtatgtgcagatggccggaagggccggtaggcggggtctagacccaaccggcactgtcattctcctttgcaaaggccgagtgcctgagatggcagacttacatagaatgatgatgggtaagccctctcagttacagtctcagttcagactgacctatacgatgatcttgaacctgcttcgggtggatgccctccgtgttgaggacatgatgaagcgatctttctcagaattcccctcaaggaaagattccaaggcccatgaacaggcgttggcagagctcacaaaaaggctcggcgccttggaagagcccgacatgacagggcagttggtcgacctgccagagtattactcatggggagaagaactgacagaaacacaacacatgatacagaggcgcatcatggagagtgtaaatggcctgaaatccctgtctgctggtagagttgtggtggtgaaaaaccaggagcaccacaatgcccttggcgtgatcctccaggtgagttcgaattctacctcacgggtttttaccactctggtgctgtgcgataaacctttaagtcaggacccccaggatcgtggccccgccacggccgaagtcccctaccctgatgacctggtcggatttaagctgttcctccccgaaggaccttgcgatcacacagtcgtcaaattgcagcctggcgacatggctgccatcacgacaaaggtgctccgggtaaatggagaaaagatcctggaagactttagcaagcggcagcaaccgaagtttaaaaaggatcctcccttggctgccgtgaccacagccgtacaggaactgctgaggctggcccaggctcaccctgccgggccccctaccctggatcctgtcaacgacctccagctaaaggatatgtctgtggttgaaggaggtttgcgcgctcgaaagttagaggagctcatacagggtgcacagtgtgtgcattctcccaggttccctgctcagtacttgaaactgagagaacggatgcagattcaaaaggagatggaaagactacggttcctcctgagcgatcaaagtttgctgctgctccctgagtatcaccagagggtggaggtcttgcggactctgggatacgtggatgaggccggcacggttaagctggcgggtagggttgcttgcgcgatgagttctcatgagttactcctgaccgagcttatgtttgacaacgccttatctacgcttaggccagaagagatcgcagccctgctgtcaggccttgtgtgtcagagtcccggggacgctggggatcagttgcccaacacattgaaacaaggcatcgaacgcgtccgagcagtcgccaagcgcatcggagaggtacaggttgcttgcgggctgaaccagaccgtggaggagttcgtgggggagctgaactttggattggtagaggtggtatatgagtgggctcgcgggatgccattctccgaacttgcgggcttgtctgggacgcctgagggactggtggtgaggtgcatccagaggctcgctgaaatgtgtcgctccctcagaggcgctgccaggctggtgggggaaccggttctgggagccaagatggaaaccgctgccacgctacttcgcagggacatcgtatttgccgcatcgctatatacacagtag

SEQ ID NO: 136618 - DNA, 465 bp, Artificial Sequence
  Description of Artificial Sequence: Synthetic coding sequence
atggccacaaaggcagtgtgtgtcctgaagggggacggacccgtacagggtattattaacttcgagcagaaagaatccaatgggcctgtgaaagtatggggcagtatcaagggcctgaccgaaggcctgcacggcttccatgtgcacgagtttggcgacaacacagctgggtgcactagcgcaggtcctcatttcaaccctctgtcaaggaagcacggtgggcccaaggatgaggagcgccacgtgggagacctggggaatgtgactgctgataaagacggggtagcagatgtgtctatcgaggattcagtgatctcgctgagcggcgaccactgtattatcggtcgtaccttggtcgtgcacgagaaggccgacgatctcgggaagggcggcaatgaggagtccacaaagacgggcaatgctgggtctcgcttagcctgtggagtaatcgggatcgctcaatag

SEQ ID NO: 136619 - DNA, 108 bp, Artificial Sequence
  Description of Artificial Sequence: Synthetic coding sequence
atggcaacgaaagcggtgtgtgtactcaaaggagatggccctgtgcaaggaattatcaatttcgaacagaaagaaagcaacgggcctgagggtgtgggtaagcactag

SEQ ID NO: 136620 - DNA, 1074 bp, Artificial Sequence
  Description of Artificial Sequence: Synthetic coding sequence
atggattcagtagagaagacaaccaacagatcggagcagaaatctcggaagtttttgaaatctttaatacggaaacagccgcaagaactgctattagtgatagggaccggcgtttccgcggctgtggcaccggggatacccgctctgtgctcatggaggagctgtatcgaagccgtgattgaggcagcagagcagttggaggtgcttcaccccggagacgtagcagaattccgccggaaggtgacaaaagatagggatctgctggtggtggcgcatgatctcattaggaagatgtctccccgcaccggggatgccaagccttcatttttccaggactgtctcatggaggtcttcgacgaccttgagcaacacatacgaagcccagttgtattacagtccattttgagccttatggaccggggggcgatggtcctaacaacaaactacgataacctcctcgaagccttcggcaggcgccagaacaaacccatggaatccctagacttaaaagacaaaaccaaggtacttgagtgggcccggggccatatgaagtacggagtacttcatatccatgggctctataccgatccgtgcggcgtcgtgctggacccaagcgggtataaggacgtgacgcaggacgccgaggtgatggaggtcttgcagaatctgtaccgaacaaaaagtttcttattcgtaggctgtggagagacgctgagggaccaaatatttcaagctctttttttgtacagtgtacctaacaaggtagatctcgagcactatatgctggtgctgaaagagaacgaggaccacttctttaagcaccaggctgacatgttgctccatggcatcaaggtcgtgtcctacggcgactgctttgaccattttccgggctacgtccaagacctggccacgcagatctgcaaacagcagtctcctgacgctgaccgcgttgacagcactaccctcctaggtaacgcttgccaggactgcgctaagcgaaagttggaagaaaacggcatcgaggtgtctaaaaagcggactcagagcgacacggacgacgcagggggtagctag

SEQ ID NO: 136621 - DNA, 636 bp, Artificial Sequence
  Description of Artificial Sequence: Synthetic coding sequence
atggacccacgtaaggtgaacgagctcagagctttcgtgaaaatgtgcaagcaggacccctctgtccttcataccgaggaaatgaggtttctgcgggagtgggtggagtcgatgggagggaaagtccccccggcaacacagaaagccaaaagcgaagaaaacaccaaggaagagaagcccgactcaaagaaagttgaggaagacctgaaggctgacgagccaagttcggaggagtcagacctggagattgacaaggaaggggtgatcgagcccgacacagacgccccgcaggaaatgggtgatgagaatgctgagatcaccgaagaaatgatggaccaagccaatgataagaaagtggccgcaatcgaggcgcttaatgatggcgagctccagaaggctatcgacctgtttacagacgcaattaagcttaatcctcgacttgccatcctctatgccaagagggcttccgtctttgtgaaattgcaaaaacccaacgctgccattagggactgcgatagagccatagaaatcaatcctgactcggcccaaccgtacaagtggagggggaaagcacatagactactgggccactgggaggaagccgcgcatgatctcgccctcgcatggactcagtag

SEQ ID NO: 136622 - DNA, 489 bp, Artificial Sequence
  Description of Artificial Sequence: Synthetic coding sequence
atgggtgggaaagtgcctccggctacacagaaagccaagagtgaagaaaacacaaaggaagagaagccagattccaagaaagtcgaggaggacctgaaggccgatgagccatcttcagaagaatcagacctggagatcgacaaggagggcgttattgaaccagatactgacgctccccaggagatgggagacgaaaatgccgaaattaccgaggaaatgatggatcaagctaatgataaaaaagtagcagccattgaagcactcaatgatggggagctacaaaaggctattgacctgttcaccgatgcaatcaaactgaatcccagactggctatcctctatgcaaaacgcgctagtgtatttgtgaagctccagaaaccaaatgccgccattcgcgactgtgatagggccatcgaaattaatcccgattccgctcagccgtataaatggagaggtaaagcacaccgtctattgggacattgggagtag

SEQ ID NO: 136623 - DNA, 366 bp, Artificial Sequence
  Description of Artificial Sequence: Synthetic coding sequence
atggatcctcggaaggtcaatgagttacgtgcttttgttaagatgtgtaagcaggacccgtcagttcttcatacggaagagatgcgctttctgcgggagtgggttgaaagcatggggggtaaagtgcctccggccacccaaaaagctaagagcgaggagaacactaaggaagaaaagcccgattcaaagaaagtggaggaggacctcaaggccgatgagccatcctctgaagagtcggacctcgaaattgacaaggagggagtgattgagcccgacaccgacgcccctcaggaaatgggtgatgagaatgccgaaatcactgaagagatgatggaccaggccaatgacaagtcggggtgttattag

SEQ ID NO: 136624 - DNA, 2568 bp, Artificial Sequence
  Description of Artificial Sequence: Synthetic coding sequence
atggggagcgatcgcgcccgcaagggcggtggcgggccgaaagatttcggtgccggattgaagtataatagccggcacgagaaggtcaacggattggaggaaggcgtggagtttctgcccgtgaacaacgtcaaaaaggtcgaaaaacacggccccggtcggtgggtcgtactggccgctgtgctgatagggctgctactcgtcctgctggggatcgggttcttagtgtggcacctgcagtacagagacgttcgggtccagaaagtgtttaacggctatatgcggatcacaaacgagaactttgttgacgcatacgagaacagcaactcaactgagtttgtttctctggctagtaaagtgaaggatgctttgaagctgctgtatagcggcgtgcccttcctaggcccgtatcacaaggagtccgccgtgaccgcattctctgaggggagtgtgattgcctattactggagtgaattctctatcccacaacaccttgtcgaggaggccgaacgggtgatggccgaggagagagtcgtgatgctgccccctagagcacgaagtctaaagtctttcgtggtaaccagcgtggtggctttcccgacagatagtaaaactgttcagcggacacaggataactcctgcagctttggactccacgcccggggcgtggagcttatgagattcaccacgccgggattcccagattcaccataccctgcccacgcaagatgtcagtgggctttgaggggagacgccgattccgtgctctctctcacttttcgttccttcgacttggcctcctgcgacgagagaggctccgacctggtgactgtctataatactctgagtccaatggagccacatgccctcgtgcagctgtgcggcacataccctcccagctacaacctaacatttcattccagccaaaacgtgctgttgatcacactcattaccaatactgagcgccggcatcccggatttgaggctacgtttttccagctcccgcgcatgtcttcatgtggtggtcggctgcgcaaggcgcagggaacattcaatagcccctactacccaggtcattatccccctaacatcgactgtacctggaacattgaagtgcctaacaaccagcacgtaaaggtgcgatttaaatttttctatctgctggagcctggagtgcctgccgggacatgcccaaaggattatgtcgaaatcaatggggaaaaatattgcggtgagaggagccagttcgtggttacctccaacagtaataagataacagtacggtttcatagcgaccagagctataccgatacggggtttctcgccgaatacctctcttacgactcaagcgatccctgccccgggcagtttacctgccgtactggcagatgtattagaaaagagctgcgttgcgatggctgggccgactgtaccgatcactcagacgagctgaattgctcctgtgacgcaggtcaccagttcacctgcaaaaataagttctgtaaacctctattttgggtgtgcgacagcgtgaacgattgcggagacaattccgacgaacagggctgctcatgtcccgcacagactttccgttgcagcaacggaaagtgcctttctaaaagtcagcagtgcaacggaaaagatgactgtggcgatgggtccgacgaggcaagctgccccaaagtgaacgtggtcacctgcacaaaacatacttacagatgcctgaatggactgtgcctgagcaagggcaatccggaatgtgacggaaaggaagactgctcagacggctctgatgagaaggattgcgactgtggccttcggagttttacaaggcaagctcgcgttgtggggggcactgacgcagatgaaggggaatggccgtggcaggtcagcttgcacgcccttggccagggccacatttgcggagcttcactgatcagccctaactggctggtgtcagccgcccattgttacatagatgacagaggcttccgctattcagacccgacacagtggaccgctttcctcggactgcacgatcagtcccagcgaagcgcccccggcgtgcaggaacggcggttgaagcgtattatatctcacccattttttaacgacttcacatttgactacgatatcgcccttctggaactggaaaaacctgctgagtattcttccatggtccgcccgatctgcctccctgatgcatcacacgtgttcccagccggaaaggcgatctgggtgacaggctggggacatacacaatacggcggcacaggagctctgatcttgcaaaaaggagagatccgagtgataaatcagactacctgtgagaatcttctcccacaacagattacaccccgcatgatgtgcgttgggttcctttccgggggagtggacagctgccaaggtgacagcgggggaccgctttccagcgtcgaggccgacggcaggatctttcaggccggagtggtgagctggggtgacggttgcgcgcagcgcaataagcctggagtgtataccaggctgcccctgttcagggactggataaaagagaacacaggcgtgtag

SEQ ID NO: 136625 - DNA, 3414 bp, Artificial Sequence
  Description of Artificial Sequence: Synthetic coding sequence
atgaccatgaccgctaataaaaattcctccatcacgcatggcgccggaggcactaaggcgccaagaggcaccctttctaggtcccaatcagtctctcccccgcctgtactatcacctcctagaagccccatatatccattgagcgattctgaaacttcggcttgtcggtacccctctcactcctcctctcgagttttactgaaggatcgacaccccccggccccatctccccaaaacccccaagatccgtctccagacacctctccacccacttgcccttttaagaccgcctcgtttggatacctcgacaggagtccatcagcgtgcaagcgagacgctcagaaagagagcgttcagggggcggcccaggatgttgccggtgtcgccgcctgcttgcctctggcccaaagtacaccatttccaggtccagctgccggaccacgcggggtgttattgacacggacagggactcgcgctcattcccttgggatacgtgaaaaaatatctgcctgggaggggcgtagagaggcttctcccaggatgagtatgtgtggggaaaagcgggagggatcaggaagcgagtgggccgcctcagagggctgtccatccttggggtgccccagcgttgtgccatccccatgtagctccgagaagaccttcgacttcaagggcctgaggaggatgtccagaacattttccgagtgttcttaccccgaaaccgaggaggagggcgaggctctgccagtgcgcgactcattttaccggcttgagaagcgtctggggaggagcgagccatcagcctttcttcgaggccacggaagcagaaaggagtcttctgctgttctgagtcgcatccaaaagattgagcaggttctgaaggagcagccaggccgggggctccctcaattgccaagttcatgttattccgtagatcgcggcaagagaaagaccggcacactgggtagcctcgaggaacccgccggtggagcttcagtgtccgctggaagcagggcagtaggagtggccggtgtggcaggcgaagctggaccccctcctgagcgggagggatcaggttccacaaaaccaggcaccccagggaattcaccttcctcccaaaggctgccatctaagtcaagcctggatccggctgtcaaccctgtgccgaaacccaagcgcacttttgaatacgaggctgacaaaaatcctaagagcaagccctcaaacggcttacctccttcacctactccagccgctcctcctcctttaccttctactccagctcctccagtcacaagacggcccaagaaagacatgagggggcataggaagtctcagagcaggaagagtttcgagttcgaggatgcttcctccttacagagcctctatcctagctctcccacagaaaatgggacggaaaatcaacccaaattcgggtcaaaatcgaccttggaggagaatgcttatgaagatattgtgggagatctgcctaaggagaatccttatgaagatgttgatttgaagtctcgcagagctgggagaaagagtcagcagctgtctgagaactcactcgactcccttcatcgcatgtggagtccccaggacagaaagtataattcccctcctacacagctgagcctaaaaccaaattcacagtcactgcgctctggcaactggagtgaacgaaagagtcaccgcctgccgcggttacccaaaaggcatagccatgacgacatgctgctgctagctcagctttctctgccatcgtctcctagcagcctgaatgaggattctctgtccaccacatctgagcttctgagttctcgtcgtgccagaaggatcccaaagctagtgcagcgcattaactccatctacaatgctaagcgggggaaaaagcggctcaagaaactcagcatgtcatccattgaaacggcgagcctcagggacgagaactctgagtctgaatctgacagtgatgatcggttcaaagctcacacccagcggctagtccatatccagtctatgttgaaaagggcccccagttacaggactcttgaactcgaacttctggagtggcaagaacgcgagttgtttgaatatttcgtggttgtgtctctgaagaagaaaccatctcggaacacgtatctgccagaggtcagctatcagttccctaagctggaccgaccaactaagcaaatgagggaggctgaagagcggctaaaggccatcccgcagttctgctttccagatgccaaggactggctgcccgtctctgaatacagctcagagacattctccttcatgttgacgggcgaggatggatctcgcaggtttggatactgcagacggcttttgccctctgggaaaggcccgcgcttgccagaagtctattgcgtcatcagtaggctgggctgtttcggcctttttagtaaagtgctggatgaagtagagcgcaggcggggaatctccgccgcactggtttaccccttcatgagatccctgatggagagccccttccctgcccccggaaaaacaattaaggtgaaaactttcttgccaggagcaggaaatgaggtgctagagttaaggcgtcctatggatagtaggcttgagcacgttgatttcgagtgtttgttcacttgcttgtcagtgcgccaattgattcggatcttcgcctcattacttcttgagcggagggtgatctttgtcgccgataagctcagcaccctgagctcatgttcccacgctgtcgtggcattactgtatccattttcctggcaacataccttcattccggtcctgcccgccagcatgatcgatattgtgtgctgtccaaccccgttcctcgtcggcctcctgtcctcgtccctgcctaaactcaaagaactaccagtggaggaagccctgatggtcaaccttggctcagatcgtttcatcaggcagatggacgacgaggacactctgctccctagaaagctgcaagccgccttggagcaggcgttagagagaaagaacgagctgattagccaagactctgatagtgatagcgatgatgagtgtaatacactgaatggactggtgtcagaggtgttcatccgttttttcgtggagactgtgggtcactatagcctgtttttgacacaatcagagaagggcgaaagggcattccaaagagaggcttttcgcaaatctgtcgcatccaagagcatccgccgcttcctcgaggtgttcatggaatcacagatgtttgccggcttcatccaagaccgggagctgcggaaatgccgtgccaagggactgtttgaacagcgcgtggaacagtacctggaagagctgcccgataccgaacagagtggcatgaataaattcctcaggggtttgggtaataaaatgaaattcctccacaagaagaattag

SEQ ID NO: 136626 - DNA, 3414 bp, Artificial Sequence
  Description of Artificial Sequence: Synthetic coding sequence
atgaccatgacagcgaacaaaaattcctccataacacatggcgctggaggaactaaggcccctcggggtactttgagccggagccagagcgtgtcccctccaccagtgctgtctccccccaggtccccgatatacccgctgagcgatagtgagacaagtgcgtgtagataccccagtcattcctcttcccgcgttcttttgaaagacaggcaccccccagccccgtccccccagaaccctcaggatcccagccccgatacctccccacccacctgtccttttaagacagcctccttcggctatctggataggtcgccgtcagcctgcaagcgcgatgcgcaaaaagagagcgttcagggtgccgcccaggacgttgccggggtggcggcttgtcttcccctagcccagagcacgccctttcccggacctgcagccggcccacgcggtgtgctgctcacgcgaacgggcacccgagctcacagtctgggaattcgcgaaaaaatatcagcctgggaggggcgccgcgaagcatccccacgcatgtcaatgtgtggtgaaaagcgcgaagggtctggaagtgagtgggctgctagcgagggatgccccagcttgggctgcccctctgtggtccctagcccttgttcttccgagaaaacctttgacttcaaggggctgaggagaatgagccgcacgttcagcgaatgttcctaccctgaaaccgaagaggaaggagaggccttgcctgtgagggacagcttctataggctggaaaagagactcggaaggagtgaaccaagtgcatttctgcggggacatggcagcagaaaggagtcctccgctgtcctatctcgcatccagaagatcgagcaggtgctcaaggaacagcccggaagaggactcccacagctcccctcatcctgttactcagtggacaggggcaagcgaaaaaccgggactttgggtagtctcgaagagccagcgggaggagcaagtgtctccgccggatctcgcgccgtgggcgtggccggtgtggctggggaggctgggccacccccagaacgagaggggagcggcagcacaaaaccggggaccccaggcaatagccctagttcccagaggctgccaagcaagagctcacttgatccggctgtgaaccccgttcccaagcccaaacgtacctttgaatatgaagccgataaaaacccaaagtcaaaaccttctaacgggctcccccctagccctacccccgctgcaccacccccgctgccaagtaccccggccccccccgttacccgccgacctaagaaagatatgaggggacatcgcaagtctcagagccggaaaagttttgaattcgaggatgcctcgagcctccaaagtctgtatcccagctcacctactgaaaacggaaccgaaaaccaaccaaagttcggatccaagtcaaccctggaggaaaatgcttacgaagacattgtgggcgatttgccaaaggagaacccatacgaggacgtggacttaaagtccagaagggccggcagaaaaagtcagcaactctcagaaaactccttggacagcctccatcgaatgtggtctcctcaggacagaaaatataattctccccctacccaactctctttgaaacccaactcacagagtctacggagcgggaactggagtgagcgcaaatcccatcgactgccccggctcccaaagagacactcgcacgacgacatgctgctgctggcacagctgtctctcccgtcctccccttcatccctgaacgaagatagtttgtcaaccacctccgaactgttgtcctctagacgggctaggaggatacccaaactggtccaacggattaattcaatatacaacgccaaaagaggcaagaagcggttgaaaaaactgtctatgtccagtatcgagaccgcaagcctgcgcgatgagaactccgagtcagagtctgactctgatgatcgctttaaggctcacacccaacggcttgtgcacattcagtctatgctaaaacgggcaccgtcctaccggacacttgagctcgagctgttggaatggcaagaacgagagctatttgagtatttcgtggtggtgtccttaaaaaaaaagccatctcggaacacatacctgcccgaggttagctaccagttccccaaactcgaccgtcccaccaaacagatgagagaggctgaggagcgcctaaaggccatcccgcagttctgtttcccagacgcaaaggattggctgccagtgtctgagtactcttccgagaccttttcttttatgctcacaggagaagacggcagtcggcgtttcggttattgcagaagactcctcccaagcggcaagggcccaagactaccagaagtttattgtgtaatctctcgcttgggatgctttggcctgtttagcaaagttctggacgaagtggagcgcagaagaggcatcagcgctgccctggtttaccccttcatgaggagcttaatggagagtccttttcctgctcctggcaaaactataaaagtaaaaacttttctgccaggtgctggaaacgaggtgctcgaattgcggaggcctatggattccagactagagcacgttgattttgagtgtctgttcacctgcctgagtgtgagacagttgattcggatttttgccagccttttgctcgaaagacgcgtaatctttgttgctgacaagctctcaactttaagcagctgttcacacgctgtggtggcactgctgtaccctttttcttggcagcacacatttatacccgtgttgcctgcatcaatgattgatattgtgtgctgtcccacaccgttcctggtgggcctgcttagttccagcttgccaaaacttaaggagttaccagtcgaagaagctctgatggttaatttgggctctgaccgctttattaggcagatggatgatgaagacaccctcctgccccgcaagctgcaggcagctctggaacaggcattggaaagaaaaaacgagctaatctcacaggactcagattccgatagcgacgacgagtgcaatacgctcaatgggctggtgtctgaggtgttcatacggttcttcgtcgagacagttggccactacagcctgtttcttacccagtctgaaaagggcgagcgagcctttcagagggaggcttttcgcaagtctgtcgccagcaaatctatccgtagatttctcgaggtttttatggagtcccagatgtttgcgggcttcatccaggatcgggaattgcgaaagtgtagggccaagggactctttgaacagcgggtggaacagtacctggaagaattacccgacactgaacagtcaggtatgaataagttcttgagaggccttggtaacaagatgaagtttctccataagaagaattag

SEQ ID NO: 136627 - DNA, 1263 bp, Artificial Sequence
  Description of Artificial Sequence: Synthetic coding sequence
atgacttctcgcaagaacggggggggggctcacagctggcaggaaacgccctgggagcagcgtcgcgctctggggctccagcgggcagagatgaccatgactgctaataagaacagttcgatcactcacggggccggtggaactaaagccccccggggtactttgtcccgaaaatcattcgagtttgaagacgcgtcttccctgcagtcactgtatccttcatccccgactgagaatggaactgagaaccagccaaaattcgggagcaagtccactctcgaggagaatgcctatgaagacatagtgggagacttaccgaaggagaacccatatgaagatgtcgatctgaaatcaagacgtgctggaaggaagtcacagcagctcagcgaaaactctctggacagtcttcatagaatgtggtctcctcaggatcggaaatacaatagcccaccaactcagttaagtttgaagcctaattctcagagcctgcgatccgggaattggtctgaaagaaagtcccatcggttgccaaggctgcctaagaggcatagtcatgacgacatgctcctcttagcccaactgtcactcccgtcatctccaagcagtctcaacgaggatagcctgagtaccactagtgaactcctatcttcacgcagagcgaggcgtatccccaaattggtccagagaatcaacagcatttacaacgcaaaacggggcaaaaagcgacttaagaagttatctatgtctagcatcgagaccgccagccttcgggacgagaactccgagtccgaaagtgattccgacgataggtttaaggcccacactcagcgactagttcacatccaatctatgcttaagcgagcaccttcttacagaacattagagcttgaattgctggaatggcaggagcgggagctcctgtccaccctttggtggtgcccatcaaggcgtagtcaccgcgaaactcccacctcgccaaaatctcccacttcctttccacgcaacgtgctgtcacccgccctgcatgtggcagccggcagcttctcatttctcaggctctgctcaagcagaacgagcttccgccggtcagtacaaactccggcttggtccccttccccagctcagctcgcattactagaccggccgacgaagcagatgagagaggccgaagagaggctgaaagcaattccccagttttgcttccccgatgcgaaggattggctgcccgttagcgaatacatgcggcctttcttaagctgctag

SEQ ID NO: 136628 - DNA, 174 bp, Artificial Sequence
  Description of Artificial Sequence: Synthetic coding sequence
atgacaatgacggcaaacaagaactcttctattacccacggtgctggcggcacgaaggccccgcgtggcaccctgtcccgctcccagagtgtgagtccccctcccgtgctcagcccaccccgatctccaatttatcccctctcagattccgaaacctcagcctgccggtactag

SEQ ID NO: 136629 - DNA, 123 bp, Artificial Sequence
  Description of Artificial Sequence: Synthetic coding sequence
atgacaatgaccgccaataagaattccagcatcactcacggtgctggtgggactaaggcccccagaggtaccctgtcacgcagtcagtccgtgtcaccgccacccgtcttgtcacctccatag

SEQ ID NO: 136630 - DNA, 144 bp, Artificial Sequence
  Description of Artificial Sequence: Synthetic coding sequence
atgtggagcccacaggacagaaagtacaactcccctcccactcagctgtcactaaagcccaattcccagagcctccgctccggcaactggagtgagcgcaagtcccaccggttacctcgactgcccaaaaggcatagccattag

SEQ ID NO: 136631 - DNA, 219 bp, Artificial Sequence
  Description of Artificial Sequence: Synthetic coding sequence
atgacaatgacagctaacaaaaatagctcgatcactcatggcgccggggggaccaaggccccccggggcactctgagccgcaaatcatttgagtttgaggatgcttccagccttcagtccctgtaccccagcagccctacggaaaacggtacagaaaaccagcccaaatttggctctaaatctactctggaggaaaacgcatacgaagacatagtgtag

SEQ ID NO: 136632 - DNA, 375 bp, Artificial Sequence
  Description of Artificial Sequence: Synthetic coding sequence
atgactatgactgctaataaaaattcctcaataactcacggcgccgggggaaccaaggcccccaggggaactctctctcgtagccaaagtgtctcacctccccctgtgctttcacctcctcgctcgcctatctatcctctctctgacagtgagactagtgcgtgccgatatccctcacactcttcaagcagagttctgctgaaggatcggcacccaccagcaccatcccctcagaatccacaggatcctagtccagacacttcaccccctacttgtccatttaagaccgcgagttttgggtatcttgatcggtctccttcagcttgtaaacgggacgctcagaaggaaagcgtgcaaggcgccgcacaggactag

SEQ ID NO: 136633 - DNA, 429 bp, Artificial Sequence
  Description of Artificial Sequence: Synthetic coding sequence
atgaccatgaccgctaataagaactctagcataacccatggtgcaggcggtaccaaggcaccgaggggcacgctctctcgttcgcaatccgtgtctcctccgcccgttttgtctcctcccaggtcacccatctatcccctgagtgattccgaaaccagcgcctgcaggtacccctcacatagctcctccagagtcctgctgaaagataggcatccacccgcgcccagtcctcagaacccccaagatccttctcccgatacatccccaccgacatgtcccttcaaaacggctagtttcggatacctcgacagaagtccaagtgcgtgcaagcgtgatgcacagaaggagtctgtgcagggggccgcccaggacgtggcaggagtggcagcttgcctcccactggctcaaagcacccccttccctggctag

SEQ ID NO: 136634 - DNA, 2154 bp, Artificial Sequence
  Description of Artificial Sequence: Synthetic coding sequence
atgacgatgactgcaaacaaaaattctagcataacccacggcgcagggggaacgaaagctccccggggaaccctgagtaggaagagtttcgaattcgaggacgcctcatccctgcagagcctctaccctagtagtcctaccgaaaacggcactgagaatcagcccaagtttggatctaaatccacactggaggagaacgcttacgaggacattgtgggtgatttacctaaggagaacccatacgaagacgtcgatctcaagtctcgtcgcgcaggaaggaaaagtcagcaactctcagagaactctttggacagtctgcatcggatgtggtcaccgcaagaccgtaaatacaactcgccacccactcagctgagccttaagcccaactcacagtctctcaggtcagggaactggtccgaacgcaaatctcaccgactgcctagattgcctaaaaggcactcacatgacgatatgctgctgctggcccagctgagcttaccaagcagccccagctctttgaatgaagatagcctatcaacaacttctgaactcctttccagtagacgggcacgccggatccctaagctcgttcagcgcattaatagcatctataatgcaaagagggggaaaaaaaggttaaaaaagctttctatgagtagcatcgagacagcctccctgcgagacgagaacagcgagagtgagtctgatagcgatgaccgatttaaagctcacacgcagaggttggtacacattcagtcaatgttaaagcgcgctccttcttatcgcacactggaactagagctgttggaatggcaagagagagaactgtttgagtacttcgtcgtggtctccctgaagaagaaaccaagcaggaacacctatttacctgaagtgagttaccaatttccaaagctagacaggcccacgaagcagatgcgtgaagcggaggagagactcaaggctattccccagttttgctttcccgacgcgaaggactggctgcctgtcagcgaatacagcagcgaaacgttcagtttcatgctcaccggggaagatggctcacgtcgcttcggctactgccgacgcctgctgccatccggcaaaggtccgaggctcccggaggtttattgtgttatttcccgcctgggctgtttcgggctgttttccaaggttttggatgaagtggaaagaagaaggggcatctcagcagccttagtatacccattcatgaggagcctgatggaatctccatttcccgcacctggaaagactatcaaagtaaaaaccttcttgccaggagcaggcaacgaggtccttgaactgaggagacccatggatagccgtctcgaacatgtagactttgagtgtctgtttacgtgcctctctgtgcgccagttgattcgcatatttgcatcccttttactggaacgcagggtgattttcgtggctgataagctgtcaaccttatcctcctgcagccacgcagtagtagcactgctttatccattttcctggcagcacacatttattccagtgctgcccgccagcatgatagacatcgtgtgctgcccgaccccatttctggtgggtcttttatcctcttcactccctaagctcaaagaactgcccgtggaggaggcccttatggttaacttaggatcggaccggttcattcgccagatggacgacgaggataccttgcttcccaggaaactgcaagctgccctcgaacaggccttagagaggaaaaatgaactgatctcccaggacagtgattcagacagcgacgatgagtgcaacactctgaatgggctggtatctgaggtgttcattaggttttttgtggaaaccgttggccattattccctgttcctgactcagtcagagaagggagagcgagcattccagagggaggcttttcgcaaatcagtggcctccaagagcatccggaggtttctcgaggtgttcatggaatcccaaatgtttgcaggctttatccaggatcgagaacttcgcaagtgtcgcgctaaaggcctgtttgagcaacgggtggagcagtatttggaggagctgcctgatactgaacagtctggtatgaacaaatttctgagggggctcggcaataagatgaaattcttacacaagaagaattag

SEQ ID NO: 136635 - DNA, 159 bp, Artificial Sequence
  Description of Artificial Sequence: Synthetic coding sequence
atgacgatgaccgcaaataagaacagcagcattactcatggagctggaggtaccaaggccccacgcgggacactctcacggtctcagtccgtgtcgcctccaccggtcctgagccccccaaggagccccatttatcctttatcggacagcgagacctag

SEQ ID NO: 136636 - DNA, 336 bp, Artificial Sequence
  Description of Artificial Sequence: Synthetic coding sequence
atgaccatgaccgccaacaagaattcctcgataactcatggcgcaggcggtaccaaggcccccaggggaactttatccaggagtcagagtgtttctccaccgcctgtgctgagccctccacgctcgcccatctaccccctctctgatagcgagacaagcgcttgtcgatacccttctcactcgagcagccgggtcttgctcaaggacaggcatccacccgccccaagtccccagaatcctcaggacccttccccagatacttcacccccaacttgccctttcaaaacagccagcttcgggtacctggacaggagcccatctgcctgcaagaggtag

SEQ ID NO: 136637 - DNA, 162 bp, Artificial Sequence
  Description of Artificial Sequence: Synthetic coding sequence
atgaccatgaccgccaataagaattcatctatcactcacggggccggcggaactaaggcacctcgcggaactctttcccgatctcaaagtgtctccccacccccggtgctgagccccccaaggtccccgatctaccctctcagtgattccgagacctcgtag

SEQ ID NO: 136638 - DNA, 252 bp, Artificial Sequence
  Description of Artificial Sequence: Synthetic coding sequence
atgaccatgactgctaacaagaattccagcataactcatggtgccgggggcacaaaggcccctaggggtacattaagtcggtcccagagcgttagtccgcctccggtgttgagtcccccgagatcacctatatatcctctgtccgatagtgagacatccgcctgccggtatcccagtcattcaagctcccgcgtgttacttaaagataggcatcctccagccccttcaccacagaatccacaagacccgtag

SEQ ID NO: 136639 - DNA, 288 bp, Artificial Sequence
  Description of Artificial Sequence: Synthetic coding sequence
atgacaatgaccgccaacaaaaacagttccattacccacggagctggaggtacaaaggcaccgcgggggacgttgagcaggagccagtccgtttcgcctcctcctgtgctctcaccacctagaagccctatataccctctcagtgactctgagaccagtgcctgccgctacccatcacactccagtagtcgagtcctcttaaaagatcgccatccgccagcaccatctccccagaacccacaggaccctagtccagacacctcgccaccgacctgtccctttaagtag

SEQ ID NO: 136640 - DNA, 465 bp, Artificial Sequence
  Description of Artificial Sequence: Synthetic coding sequence
atgactatgaccgcaaataaaaattcatccataacccacggagctggcgggacaaaggctccccgggggaccctgtctaggtcacaatcagtttctcccccgccagtgctgagcccaccaaggtctccgatctatcctctgagtgacagcgagacgagcgcatgccgttatccaagccactctagcagcagagtcctcctcaaggaccgtcatccccccgccccaagcccccaaaatccgcaggaccccagtcctgataccagtccccctacgtgccccttcaaaacggcttcctttggctatttggatcgatcaccttccgcctgcaagcgggatgcccagaaagaatcagtgcaaggcgccgcccaggacgttgcaggcgtggctgcttgtctcccattggcccagtccaccccatttcctggtcctgctgctggtcctagaggagtgttgttgactagatag

SEQ ID NO: 136641 - DNA, 540 bp, Artificial Sequence
  Description of Artificial Sequence: Synthetic coding sequence
atgtggtccccccaagataggaagtataattcgccgccaacgcagttgtctcttaagcccaattctcagtctctgagatccggaaattggtccgagcgtaagtctcaccggctgccccgactgccaaaacgacactcccatgatgacatgctcctgctggcacagcttagcctaccgtcaagccccagttccctcaacgaggactctctatcaactacctctgagctactgtccagtagaagggctcggcggatcccaaagctcgtacagaggattaattcgatatacaatgcaaagcgtggtaaaaaacgcctaaagaagctgagtatgtcctcaatcgagacagcgtctctacgcgacgaaaactccgagagcgaaagtgactctgacgacagattcaaagcccacacccagaggctggtgcatattcagtcaatgctgaagcgggccccttcgtaccgcactctggaactcgagttgttagaatggcaggaaagggagctgtttgaatattttgttgtcgtgtcactcaagaagtag

SEQ ID NO: 136642 - DNA, 2154 bp, Artificial Sequence
  Description of Artificial Sequence: Synthetic coding sequence
atgaccatgaccgcaaataagaactcctcaatcactcacggggctggagggactaaagcccccagaggaactctttcgcggaagtcgtttgagttcgaggacgcgagcagtcttcagtccctgtatccaagctcaccgacggagaacggaaccgagaaccaacccaagtttggtagtaagagcaccctggaggagaacgcctatgaggacatcgtgggcgatctcccaaaggaaaacccctatgaggatgtagatctgaaatctcgaagagctggacgcaaaagtcagcagttatcggagaacagtttggattcgttgcacagaatgtggtccccccaggatcggaagtataacagcccaccaacccagctgagccttaagccgaactctcagtccttgcggtcgggcaattggagcgagcgcaagagccataggctgccccggcttcctaaacgacatagtcatgacgacatgttgctcttagctcaattgtctctgccgagcagtcccagcagtctgaatgaggatagccttagcaccaccagtgaacttctaagctcaaggcgcgcaagacgaatcccaaaactggtgcagaggattaacagtatttataacgcaaaacggggcaagaaacgcctcaagaagctgagcatgagctctatcgagaccgcttctttgcgtgatgaaaactctgaaagcgagtctgattccgatgacagattcaaggcccatacccagcgactggtgcatatccagtctatgctcaagagagctcccagttatcgcaccctagaactggaattacttgagtggcaggaaagggagctcttcgagtattttgtcgtggtgtctctgaagaaaaagccctcccgaaatacatacctgccagaagtgtcttatcagttccccaagctggaccggcctacaaagcagatgagagaagccgaagagcgtcttaaagcaattcctcagttctgctttcctgacgccaaggattggctgccagtttccgagtacagttcggaaaccttctcatttatgctcacaggcgaagacggttccagaagatttggatactgccgccgcctactgccgtccggcaaggggccaagacttcctgaggtttactgtgtgatcagccgcttgggctgtttcggccttttcagtaaggtcctggatgaggtggaacgacgaagggggatctccgcagccttggtgtatcccttcatgagaagcctcatggagagtccattccctgctccaggaaagaccatcaaggtaaaaactttcctgccaggtgcgggcaacgaagtgttagaacttcggcgacccatggactcccgactggaacacgtggactttgaatgcttgtttacatgtctctccgtacggcaacttatccgtattttcgctagcctgctcctagaacgaagggtcattttcgtcgcagataagctgagcacgctgagctcttgctcccatgccgtagtggccctactctatccgttcagttggcaacatacattcatccctgtgctccctgcctctatgatcgacatagtttgctgccctacaccattcctggtcggtctgctgtcatcctctctccccaagctaaaagagctgccagtggaggaggccctcatggtgaatttggggtcagataggtttatccgtcagatggacgatgaagatactctgttaccacggaaactgcaggccgccttggagcaggccctcgaacggaagaatgaactaatctcccaggatagcgattcggattctgatgatgagtgcaatacattaaatggccttgttagtgaagtgtttattcggtttttcgtggaaactgtcggccactactctctgttcctgactcaatcagagaagggagaaagagctttccagcgagaggcttttcgcaagagcgttgcatctaaatctataagacgcttcttagaagttttcatggagagtcagatgttcgccgggtttattcaagaccgcgaattgaggaagtgtagggccaagggtctgtttgaacaacgtgtggagcagtatttagaggagcttccagataccgaacagtccggcatgaacaagtttctgcgaggactaggaaataagatgaagttcctacataagaaaaattag

SEQ ID NO: 136643 - DNA, 411 bp, Artificial Sequence
  Description of Artificial Sequence: Synthetic coding sequence
atgacaatgaccgctaacaagaacagcagcataacgcacggggccggaggcactaaggcccctcgcggaaccctttcgcggaaatcattcgaatttgaggacgcttccagtcttcagtcactgtacccatcctctcccacagaaaacggcactgaaaaccagcctaaattcggctctaagtctacactggaggagaacgcctatgaggacatcgtgggcgatcttcctaaggagaacccgtatgaagatgtcgacctgaaatctcggagggccgggcgcaagagtcagcaattgtccgaaaattccttggatagcctgcacaggatgtggtcacctcaggatcgtaaatacaactctccaccaacccagttatccctgaaacccaactctcaaagtcttaggagtggctag

SEQ ID NO: 136644 - DNA, 225 bp, Artificial Sequence
  Description of Artificial Sequence: Synthetic coding sequence
atgactatgactgcaaacaaaaatagctccatcacccatggcgctggaggtacaaaggccccgagaggcactctgagtcgcagccagagcgtgtcaccgcctcccgtcttatcacctccaaggtcacccatttaccctttgtctgacagtgagaccagcgcttgccgatacccctctcactcatcctcaagagtgcttctgaaggatcgacatcctcctgcatag

SEQ ID NO: 136645 - DNA, 420 bp, Artificial Sequence
  Description of Artificial Sequence: Synthetic coding sequence
atgacaatgaccgcaaataagaattcctctattacacacggggctggggggacaaaggcccctcgagggaccctttctagaagccagagcgtttccccaccccccgtgctttccccgccacgatctccaatttatccactgtccgactctgaaaccagtgcctgcagatacccgtcacacagctctagccgcgtgctgctgaaagaccgccaccctcctgcaccctccccccaaaatccacaggaccccagtcctgatacatccccgcctacctgcccctttaaaaccgcatcatttggatacctggacagaagcccaagcgcctgcaagcgagatgcgcagaaagaatccgtgcagggcgccgcccaggacgttgcgggggtggccgcctgtttaccacttgctcagagtactccctag

SEQ ID NO: 136646 - DNA, 1830 bp, Artificial Sequence
  Description of Artificial Sequence: Synthetic coding sequence
atgtggagcccccaggacaggaaatataactcccctcccactcagctgtccctgaaaccgaacagtcagtccctacggagcggaaattggtccgaacgaaaatctcaccggctcccccgcctgcccaagagacacagccacgatgacatgttactgctggcgcagctgtctctcccttcctccccatcttccctcaacgaagattcgttgtcgacaacctccgagcttttatctagcaggcgggcgcggaggatcccaaagctggtccagcggattaattcaatctataatgccaagcgcggtaaaaaaagactaaagaagctcagtatgtcttcgattgaaacagcaagcctgagggatgagaacagcgagagcgagtctgactccgatgaccgttttaaagcacatacacaacgactggtgcatatccaaagcatgctcaagcgcgccccgagctatcgaaccctggaactggagcttctggaatggcaggagcgagagctttttgagtacttcgtggtggtgtctctgaaaaagaagccgagtaggaatacctacctacctgaggtcagctaccagtttcctaagttggacagaccaacgaaacagatgagggaggccgaggaaaggctcaaggctatccctcagttctgcttccctgatgctaaggactggttacccgtgtctgaatactctagcgagactttttccttcatgttgaccggcgaggacgggtctcgccggttcgggtattgtagacggcttttgccatccggaaagggccctaggttaccagaggtgtactgtgttatctccagactggggtgttttgggctctttagtaaggtgttagatgaggtggagcgcagacgcggcatcagtgccgcactggtctatccatttatgcggtctctaatggagtccccttttccagccccaggaaaaactattaaggtcaaaactttcctccctggggctggaaatgaggtgcttgagttgcgtcgaccaatggatagtaggctagaacacgtggatttcgaatgtctatttacttgtctcagcgtgcggcagcttataagaatctttgcatctctgctgcttgaaaggagggtaatctttgtagccgataagctgagcaccctgtccagttgttcacatgccgtcgtcgctcttctatatccattctcgtggcagcacacattcattccggtactaccagcttccatgatagacattgtatgctgccctacacccttcctggtcggcctgcttagctcaagcctgccaaaactaaaggagctgcccgttgaagaggcactgatggttaacttagggtcagacaggtttatccgccaaatggatgatgaggatactctcttaccgaggaaactgcaggccgctctggaacaagctctcgagagaaagaacgaattaatctcacaggattccgactctgactcggacgacgagtgcaatactctgaatgggctggtgtctgaggtcttcatccggtttttcgtagaaaccgtgggccactatagtttgtttttaacacagagcgagaagggggaaagggcttttcagagagaagcttttcgaaagtcggtggcctcaaaatctataagacgattcctggaggtgttcatggaatcccagatgttcgccggctttattcaggaccgcgaactgcggaaatgtagggcgaagggtctcttcgagcaacgagtggaacagtacctggaagaactgccagacaccgaacaaagcggaatgaataagtttttgcgaggactcggaaacaagatgaaatttctgcataagaagaactag

SEQ ID NO: 136647 - DNA, 234 bp, Artificial Sequence
  Description of Artificial Sequence: Synthetic coding sequence
atgactatgaccgcaaataagaactcttctattacccacggagccggcggtactaaagccccaaggggcacactgtcacggaaatcatttgagttcgaagatgcctctagtctgcagtcgctttatccatcatcacctacggaaaacgggactgaaaaccaacctaagtttggaagtaagtcaacactcgaggagaacgcttacgaagatattgtgggtgatctcccaaagtag

SEQ ID NO: 136648 - DNA, 81 bp, Artificial Sequence
  Description of Artificial Sequence: Synthetic coding sequence
atgacaatgaccgcgaataagaatagttccattacccacggcgccggcggcaccaaggcacctagaggaacccttagttag

SEQ ID NO: 136649 - DNA, 1035 bp, Artificial Sequence
  Description of Artificial Sequence: Synthetic coding sequence
atgtggtccccccaggaccgtaagtacaatagcccacccacccagttgagcctcaagcccaatagtcagtccctgaggtctggtaactggtctgagagaaagtctcacagactgcccagactccctaaacggcattcacacgatgatatgctgctgctcgctcaactgagtttgccctctagtcccagttctctcaacgaggacagcctcagtaccacttctgagttgctctcttcccgcagggccagacgaatccccaagctcgtgcagcggatcaacagcatttacaacgctaaacggggaaaaaaaaggctcaagaagctgtcaatgtcttcgattgaaacagcctccctcagagacgagaacagtgagtctgaaagcgactccgatgaccggtttaaggcccatacgcaacgtctagttcacatccaatctatgcttaaacgcgcaccctcctacagaactctagagctggaactattagagtggcaagaaagggaacttttcgagtactttgttgtggtgagtctgaaaaagaagccatcccggaatacatatcttcccgaggtaagttatcaatttccaaagctggaccggccaacaaaacagatgagagaggccgaagaacgcctgaaagccatcccgcaattttgtttcccagatgccaaggattggctccctgtctccgaatactcatccgaaaccttttctttcatgctaactggggaggatggatccaggcgtttcggttactgtcgtcgcctgctgccctccgggaaggggcccagacttcccgaagtctactgcgtaattagccgtttgggctgttttggactgtttagcaaagtgctcgacgaggtcgaacgtagacgaggcatctctgcggcacttgtttatccctttatgcgatcccttatggagtcacctttcccagctcccgggaagaccattaaggtcaaaacgtttcttccgggcgcagggaatgaggtactcgagctgagaagaccaatggacagtcggctggaacacgtttag

SEQ ID NO: 136650 - DNA, 231 bp, Artificial Sequence
  Description of Artificial Sequence: Synthetic coding sequence
atgacaatgactgctaataagaattcaagcatcacccatggcgctgggggtacgaaggcccctagagggacactgagccgcaaatcttttgaatttgaggacgccagttcactgcagtccctctacccctcatcccctactgagaacggtactgagaaccagccaaaattcggtagtaagtccacactcgaggaaaatgcctacgaagacattgttggcgacctgccctag

SEQ ID NO: 136651 - DNA, 225 bp, Artificial Sequence
  Description of Artificial Sequence: Synthetic coding sequence
atgacaatgaccgccaacaagaacagtagcattactcatggggccggtggcacgaaggcgccaaggggcaccttatcaagatcacagtccgtctcaccacctccagtcctctcaccgcccaggtcaccaatatatccgttgtccgatagcgagacatctgcttgccgatacccaagccactctagttctagggtgctcctgaaggatcgacatccccccgcctag

SEQ ID NO: 136652 - DNA, 435 bp, Artificial Sequence
  Description of Artificial Sequence: Synthetic coding sequence
atgaccatgacagcaaacaaaaactcctccatcacccatggagccggcggaacaaaagccccaaggggaacactgtcaagaagccagagtgtgtcacccccgccagttttaagcccaccgagaagccctatttatcctctgagtgattctgaaacgtccgcttgtcgttatccatcccactcaagctcccgtgtgctgctcaaggatcgacatccgccggcgcccagcccacagaaccctcaggacccttctcctgataccagcccccccacatgtccattcaagacggcttccttcggctatcttgatagaagtccctctgcttgtaaacgagacgcacagaaagagtcagtccaaggtgccgcccaggacgtggccggcgtggccgcctgtctgcccctggcacagagcactccatttcctggtcccgcgtag

SEQ ID NO: 136653 - DNA, 3414 bp, Artificial Sequence
  Description of Artificial Sequence: Synthetic coding sequence
atgactatgactgccaataaaaattcgtctatcacacacggcgccggcgggactaaggcaccaaggggtacccttagccgtagtcagtccgtctctccacctccagtgctctcacccccgcggagtcctatctacccgctcagcgattcagaaacctcggcctgccggtacccgagtcatagcagttcccgagtgctgctgaaggatcgccaccctcccgctccttcgccacagaacccccaggacccctccccagacacctctccacccacttgcccatttaaaactgcatcttttggatatctcgatcgatcacctagcgcgtgtaagagagatgcgcagaaagagtctgtgcagggcgctgcccaagatgttgccggggtggctgcctgtctgcccttagcccagagcacccctttccccggtcccgccgccgggcctcgcggtgtcttgctaacaagaaccggtacacgcgcccacagtctcggaatacgcgaaaagataagtgcctgggagggacgcagagaggcctctcctcgcatgtccatgtgcggcgagaagcgagaggggtccgggagtgaatgggccgcctccgagggctgtcccagcttgggatgccccagtgtggtgccttctccttgttcctctgagaagacatttgacttcaaagggctgaggcggatgagtagaacctttagtgagtgctcgtaccccgagacagaagaggagggcgaggccttgcccgtgagggatagcttttatagactggagaagagactgggacgttcagaaccatcagcctttcttcgcggccacggaagccgcaaggagagttcagcagtacttagtagaatccaaaagatcgagcaggttctgaaagagcaaccaggaagagggctgccacagctcccaagttcctgttacagcgtcgaccggggcaagcggaagaccggtacattgggttccctggaagagccggctggtggcgctagtgtctcagcaggcagtcgagccgttggggtagccggagtggctggggaggccggacccccacccgaaagggaaggtagcggaagtactaagcctgggactcctggcaattcaccttcttcacagcggctcccctctaagagtagcttggaccccgctgtcaatcctgtgccaaagcccaaaaggacattcgagtatgaggccgataagaacccaaaatccaagccttctaacggtctgccaccttcccccactcccgccgccccaccacctctgccatcgacgcctgctccccctgttacacgtcggccaaagaaggacatgagaggccatcgtaagagccagagcaggaaaagctttgagtttgaagatgccagctcattgcagtccctatatcctagttcccccaccgaaaacggtactgagaaccagcccaaattcgggtcaaagagcactctggaggagaatgcttacgaagatattgttggcgaccttcccaaggaaaacccctacgaggatgtcgatcttaaatctagacgcgccggtcgaaaatcccagcagctgtcggaaaactctctggattcattgcaccgtatgtggtccccacaagaccgtaagtacaacagtccgcccactcagctgtctctgaaaccaaattctcaaagcttgcggtctggcaattggtccgagaggaaatcccaccgtctgcccaggttacctaaacgacattcccatgacgacatgctgctgctcgcccagctgtccctcccctcaagccctagttccttgaatgaagatagcctgagcaccacttccgagctgctgagtagccggcgtgccaggcgtatcccaaagctagttcagcggataaactccatttataatgccaagcgcgggaaaaagcggctgaaaaagttaagtatgtcctctattgagacagcctcattgcgggacgaaaactctgaaagtgagagcgacagcgacgaccgattcaaggcacatactcagagacttgttcatattcaaagcatgctgaaaagagccccatcctatcgcacacttgagttggagctgttggaatggcaggaacgcgaactgtttgagtatttcgttgtggtttccctcaagaaaaaaccgtcaaggaacacctatcttccagaagtgagttaccagttccctaagctcgacaggcctaccaaacagatgagggaagccgaagagaggttgaaagccattccacaattctgttttcctgacgccaaggattggctgcccgtttcagagtactccagtgagaccttttcatttatgctcacaggagaagatggtagtagaaggttcggttattgcaggcggctgttaccatccgggaagggcccgagactccccgaggtgtactgtgtgatcagccgtctgggctgctttggcctcttttcaaaggtgttggatgaggtggaaagacgtagggggatcagcgcggcactggtttacccatttatgcgctctcttatggaatcgccattccctgcacccggcaagaccataaaagtgaagacgtttctgccaggggcaggaaatgaggttctcgaactgcgccgcccaatggatagccggctcgagcatgtggatttcgagtgtctcttcacatgtctttcagtccgtcagctgatcagaatttttgcctctctcctgctggaacggagagtgatatttgtcgcagataagctgtctaccctgagcagctgctctcatgccgtggtagcattgttgtaccccttctcctggcaacacaccttcatacccgtgctcccggcttctatgatagatatcgtctgttgtccaacacccttcttagtagggctccttagttccagcctgccgaagctgaaagaactgccggtggaagaggccctgatggttaatctgggttccgacaggtttatccggcagatggatgacgaggataccctgttgccccgcaagttacaggcggccttagaacaggccctggaacggaaaaatgagctgatctcacaggactctgacagtgattccgatgatgaatgtaatacactaaatggcctagttagcgaagtgttcataaggttctttgtcgaaaccgtcggccattacagcctcttcctgacccagagcgagaaaggcgaacgggcttttcaaagggaggccttccgaaagagcgtcgcatcaaagagcattaggcgctttttggaagtttttatggaaagccagatgttcgccggcttcatccaggatagagaactgaggaaatgtcgcgctaaaggactgttcgagcagagggtggaacagtatctggaggagcttcctgatacagaacagtcgggcatgaacaagtttttacgaggcctcggcaacaaaatgaagtttctccacaagaaaaattag

SEQ ID NO: 136654 - DNA, 369 bp, Artificial Sequence
  Description of Artificial Sequence: Synthetic coding sequence
atgacaatgacagccaataagaactcgagcatcacacacggcgccggtggcacaaaggcaccaagaggaacgctctctcgtagtcagtcagtgtccccccctcccgtgctgagcccaccgcgatcacccatatacccactgagtgactccgaaactagcgcctgtcggtatccatcccattcttcctcacgcgttctactcaaagatcgacaccctccagctcctagcccacagaacccccaagaccccagcccggacacatctccccccacttgcccctttaaaacggcatcgtttgggtaccttgaccgctccccaagtgcctgtaagagagacgcacaaaaagaaagcgtccagggggccgcatag

SEQ ID NO: 136655 - DNA, 93 bp, Artificial Sequence
  Description of Artificial Sequence: Synthetic coding sequence
atgaccatgacagcaaataaaaattctagcatcacacacggggcaggggggactaaggctccccgtggaaccctgtctaggagccagtcttag

SEQ ID NO: 136656 - DNA, 1758 bp, Artificial Sequence
  Description of Artificial Sequence: Synthetic coding sequence
atggccgaggccgccacagggtttctagagcagctgaaaagctgtatcgtctggtcctggacgtatttgtggacagtgtggttctttattgtgctgttcttggtttatatcctacgggtgcctctcaaaattaacgataatttgtctactgtaagtatgttcctgaacaccctgacacccaagttctatgtggctctcaccgggactagctccctcatttccggccttatcctaatcttcgagtggtggtattttcgcaaatacggaaccagcttcatcgagcaagtctccgtgtcgcatctgagacctttattaggcggagtggataataactctagcaataattccaactcttcaaatggtgattctgattctaacaggcagtcggtgtccgaatgcaaagtttggaggaatccccttaatctctttagaggtgcagaatataatcggtacacttgggttactggacgggagccactgacatattatgacatgaatctttccgctcaggaccatcaaacatttttcacctgcgattcggatcaccttagaccggccgacgctatcatgcaaaaagcatggcgcgaaagaaatcctcaagccagaatctcagcagcccacgaagccctggagatcaacgagattaggtcacgcgttgaagtgccactaatcgcttctagtaccatctgggagatcaaactgctccccaagtgtgcaacagcttacatactgttagccgaagaggaggccacgaccatcgccgaggcggaaaagctgtttaaacaggctctgaaagcgggtgacggctgttatagaaggtcccaacagctacagcaccatgggtctcagtacgaggcccaacacaggagggataccaacgtgttggtgtacattaagagaagactggctatgtgcgcccgcaggttaggccgtacccgcgaggctgtgaagatgatgcgtgatttaatgaaggaatttccgctcctgagcatgtttaacatccacgaaaacctgcttgaggctctccttgagctgcaagcatatgccgatgtgcaggcagtactcgctaaatacgacgacatctctctccctaaatcagcaacaatctgttataccgcggcattattgaaggcgagggccgtctctgataaattctctccggaagctgcttcaagaaggggcctgtccacagcggagatgaacgccgtggaagccatccatcgggctgttgagttcaatccccacgtgcctaagtacctgctagagatgaaatcactgatcctcccacctgagcacatcctaaaacgtggcgactccgaggccatcgcttatgccttctttcaccttgctcattggaagagagtggagggggcccttaatctgctccattgcacatgggagggaaccttccgaatgattccatacccactggagaaaggacatttgttttacccctatcccatctgcaccgaaacggccgacagagagctcctaccatctttccacgaggtgtctgtctaccctaagaaggagttaccattctttatactgttcactgccggtctctgttcattcacagctatgctggccctactcacacaccaattccctgaacttatgggcgtattcgccaaggctatgatcgacattttctgctccgccgagtttagagactggaactgcaaaagcatcttcatgagagtggaagacgagttggaaattccgcctgcacctcagagtcaacatttccagaattag

SEQ ID NO: 136657 - DNA, 1500 bp, Artificial Sequence
  Description of Artificial Sequence: Synthetic coding sequence
atgagtatgtttcttaatacactgactcccaaattctacgtggctttaacgggaaccagttccctaatctcggggttaattcttattttcgaatggtggtacttcagaaaatatggaacatctttcattgagcaagtgtccgtgagccacctgcggccacttctgggcggagtggataataatagcagtaataatagtaattcatctaacggcgatagtgattccaatcgtcagtcagtctctgagtgtaaagtctggaggaatccacttaacctcttcagaggcgccgagtataaccgctacacctgggtgacgggacgcgagcctctgacctattatgatatgaacctatcagctcaggaccatcagacattcttcacgtgcgacagcgaccatctccgtcctgctgatgccataatgcagaaggcatggcgggaaaggaatcctcaggcccgaatctcagcagcacatgaggctctggagataaacgagtgtgctacagcatacatattgctggccgaggaagaggcaacgacgatagctgaagccgaaaaactgtttaagcaggcactgaaagcgggtgacggttgctaccgcagatcacaacagctgcaacaccacggatcacagtacgaagcacagcataggcgggacacgaacgttctcgtgtacataaaaaggaggctggccatgtgcgccaggagacttgggcggacaagggaggcagtcaagatgatgagggaccttatgaaggagtttccactactttccatgttcaatattcatgagaacctgctcgaggccttacttgagctgcaggcctatgccgacgtgcaggctgtgctggccaagtatgatgatatctctctacccaaaagtgcaaccatatgttacacggctgccttattgaaggctagggccgtcagcgataaattcagcccggaagctgcttcgaggcgcggcctttcaactgcagaaatgaacgccgttgaagccatccacagggccgttgagtttaatccccacgtgccaaagtatcttttggagatgaagagcctgatcttgccaccagaacacatattgaaacggggtgactctgaagctatcgcctacgcgttcttccacctcgctcattggaaaagagttgaaggcgccctgaaccttctgcactccttccgcatgattccctacccactcgaaaagggccatctattttacccttaccctatttgtacagaaacagctgaccgcgaattattacccagttttcacgaggtctccgtatatcctaagaaagagttgccttttttcatcctgtttaccgccgggctctgttctttcaccgccatgctcgctctattgacacaccagtttccggaactgatgggcgtgttcgctaaggccttcctcagcacactgttcgctcccctgaattttgtgatggagaaggtggagtctatcttgccatcttccctgtggcatcaactcaccagaatttag

SEQ ID NO: 136658 - DNA, 1536 bp, Artificial Sequence
  Description of Artificial Sequence: Synthetic coding sequence
atgttcggtacagaatcttcactgtccatgtttctgaacacgctgacaccaaagttctatgtggccctaacaggcacctcatcacttatatccggccttatcctgattttcgagtggtggtacttccgcaagtatggtactagcttcattgaacaggtgagcgtaagccaccttagacctctcctgggaggggtagacaataattcatcaaacaactcaaactcatcaaatggcgattctgactctaaccggcagagcgtgagtgaatgtaaagtatggaggaaccccctgaacttattccgcggggcagagtacaacagatatacatgggtaaccggaagagagcccctcacttactatgacatgaacttgtccgctcaggatcatcagacctttttcacctgcgactcagaccaccttaggcccgctgacgccatcatgcagaaggcctggcgggagaggaacccacaggctaggatttcggctgcgcacgaagcgctggagattaatgagtgtgcgaccgcctatattctactggccgaggaggaggctaccacaatcgccgaagccgagaagctgttcaaacaggccctgaaagccggtgatggatgctataggaggtctcagcagctgcagcaccacgggtcacaatatgaggcccaacatcggcgggacaccaacgtcctagtgtatatcaagaggaggttggctatgtgtgcccggaggttgggacgtacccgggaagccgtgaagatgatgagagatctgatgaaagagtttcctctgctatccatgtttaatattcacgagaatctgttggaggcactgttggagttgcaagcatacgcggacgtccaggccgtcctggccaagtatgacgacatatctctgcctaaaagcgctacaatctgctacacagctgcactcctaaaggcacgcgctgtgtcggacaagttcagccccgaggccgctagcagacgcggtttgtctacagccgagatgaatgcagttgaagccattcaccgagccgtagaatttaatccgcacgtccccaagtatcttctagagatgaagtctctcattctaccacccgagcatattcttaaaagaggggactctgaagccatagcatatgcattcttccatctggcccattggaaaagagttgagggagccttgaatcttctgcactgtacttgggaaggtaccttccggatgatcccttaccctctcgagaaaggccatctgttctatccataccccatctgcactgaaacggctgaccgcgaacttctgccctcttttcatgaggtcagtgtctacccaaagaaagagctgccatttttcatcctgtttactgccggtctgtgctccttcacagccatgctcgccctgctgactcaccaatttccagagctcatgggggtttttgccaaggccttcctaagtaccctgttcgctccattgaactttgtgatggagaaagttgagtccattctgccatcttccttgtggcaccaactgacacggatttag

SEQ ID NO: 136659 - DNA, 1605 bp, Artificial Sequence
  Description of Artificial Sequence: Synthetic coding sequence
atgttcggtaccgagagttctcttagcatgtttctgaacacactcacacccaagttctacgtcgcgctcactggtacctcttccctgataagcggcttaattctcatttttgagtggtggtacttcagaaagtatgggacttctttcattgagcaggtgtctgtcagtcacctccggccactgcttggtggggtggacaacaattcatctaacaacagcaactccagtaatggggacagcgactccaacaggcagtctgtcagtgagtgtaaagtgtggcgaaatcctcttaacctgttcagaggagcagagtacaatcggtatacctgggttactggacgggaacctctgacttactacgacatgaatctcagtgcccaagaccaccagactttctttacttgtgatagcgatcatctccgccccgccgacgctattatgcagaaggcttggcgtgagaggaatccccaggctcgaatatccgcagcccacgaagcactagagataaacgagatacgttctagagttgaagtgcctctgatcgcgtcctctactatttgggaaatcaaactattgccaaagtgcgcgacggcctatattctactcgccgaggaggaggcaacaactatcgccgaagccgaaaagctgtttaagcaggccttgaaggccggtgatgggtgttaccgcaggtctcagcagttgcagcaccatgggtcccagtatgaggcccagcacaggcgggacacaaacgtgctagtctatatcaagcggaggctggctatgtgtgccagaagactcggacgtacaagagaggctgtgaagatgatgagagacttgatgaaggagttcccactactgtcaatgtttaacatacacgaaaaccttctggaggccctgttggagctccaggcatatgctgacgtgcaggctgtgctggctaagtacgacgatatctcacttccaaagtcagcaacgatttgctacaccgcagccctgctgaaggcgagagccgtgtctgacaagttttcccctgaggcagcttctcgccgcggcctctccacagccgagatgaatgccgttgaggcgattcaccgtgcagtcgaattcaatccacatgtccctaagtatctactggaaatgaagtccctcattctgccacctgagcatattctgaaacgcggagattccgaagcaatagcctatgcatttttccatctcgcccactggaaaagggtggaaggcgcactgaatctgctgcattgtacttgggagggcacgttccgcatgattccctacccgctcgaaaaggggcacctgttctatccttatcctatatgcactgaaacagccgatagagagttgctgccgtcctttcatgaagtgagcgtatatcccaagaaagagctgccttttttcatcctcttcactgcagggctttgttccttcacagcaatgctggccttactgacgcatcagtttccggagctcatgggtgtgtttgccaaagccttcctcagcaccctctttgctcccctaaatttcgtgatggaaaaagtagaatcaattctgcccagttcattgtggcaccagctgaccaggatctag

SEQ ID NO: 136660 - DNA, 1665 bp, Artificial Sequence
  Description of Artificial Sequence: Synthetic coding sequence
atggcggaggctgccaccggcttcctggaacagcttaaatcatgcatcgtgtggtcttggacatatctttggaccgtctggttcttcatagtattgtttttggtgtacatactaagggttccgctgaaaattaacgacaatctatccactgtctcaatgtttctcaatacgttgacacctaagttttatgttgccctgacgggtacaagctcactaattagtggcctgattctgatcttcgagtggtggtatttcagaaaatatggaacttcctttatcgagcaggtgtcagtaagtcacctcagacccttactaggaggagtagataacaactcttccaataatagtaacagcagcaacggtgatagtgattcaaaccgacagtcagtcagcgagtgtaaggtgtggaggaaccctctaaacctattccgcggagcagaatataaccgctatacctgggttaccggacgtgagcctttaacttattacgatatgaacctctcagctcaggaccaccagacgttcttcacctgcgattccgatcatctaaggcctgcagatgctatcatgcaaaaggcctggcgggaacgtaacccccaggcccgtattagcgcagcacatgaagctctggagatcaatgagtgcgccactgcatatatcctgctggccgaagaggaagccaccacaattgctgaagccgaaaagctctttaagcaggcactgaaagctggcgacgggtgctatcgccgctcccagcagctgcaacaccatgggtcacaatacgaggcacaacatcgccgagacaccaatgttcttgtatacatcaagaggaggctcgctatgtgcgccaggaggctcggccgtaccagggaggccgtgaaaatgatgcgagatctcatgaaagagttcccattgcttagtatgtttaatatccatgagaacttactcgaggccctcctggagctccaggcttatgccgatgtacaggctgtgcttgcaaagtatgatgatatttcattacccaaatccgcgaccatttgttatacagctgccctgctgaaagctagagcggtatcagacaaattttcccccgaggcagcctcacgtcgtggcctcagcacagccgaaatgaacgccgtggaggccatccaccgcgcagtggagttcaatccacacgttcccaagtatctcctggaaatgaagtcactaatccttccccctgaacatatcctcaaaaggggcgacagcgaagcaattgcctatgcctttttccatctcgcccattggaaacgcgtcgagggtgcactgaacctgctgcattgcacgtgggaagggacttttcggatgattccttaccctcttgaaaagggccacttgttttatccctaccccatctgcactgagactgcagatcgggagctgttgcctagttttcacgaggtcagcgtctatccaaagaaagagttgccatttttcatactctttaccgctggactgtgctcttttacagccatgctagcattactaacacaccagttcccagagttgatgggtgtttttgcaaaagcttttctttcaacactgttcgcacccttaaacttcgtgatggaaaaggtggaatctatacttccttcctccctgtggcatcagctaaccagaatatag

SEQ ID NO: 136661 - DNA, 189 bp, Artificial Sequence
  Description of Artificial Sequence: Synthetic coding sequence
atgagtatgtttctgaacaccctgactccgaagttctatgtagcactgactggaacttcttccttgatttcaggcctgattttaatcttcgagtggtggtattttaggaagtatggcacctctttcattgaacaagtctcagtgtcccacctccggcctctcctgggcggtgttgacaataattcttag

SEQ ID NO: 136662 - DNA, 264 bp, Artificial Sequence
  Description of Artificial Sequence: Synthetic coding sequence
atgtccatgtttctcaacacactaactccaaaattttacgtcgccctgaccggaacgtcctccctgatttccggactgattttgatatttgaatggtggtactttcggaagtatggcacctcttttatagaacaggttagcgtgagccacctaagacccctactggggggtgtggacaataattccagcaataatagcaacagctcaaacggagatagtgacagcaaccgccagtctgtctccgagtgcaaagtctggaggtag

SEQ ID NO: 136663 - DNA, 1323 bp, Artificial Sequence
  Description of Artificial Sequence: Synthetic coding sequence
atggccgaaaacaatgagaatattagcaagaacgtggacgtacgaccaaaaacgtctcggtctcgctcagccgacaggaaagacgggtatgtctggagcggtaaaaagcttagttggtcaaagaagtctgagtcttactccgacgccgaaacagtaaacggaatcgagaaaaccgaggtatccctcagaaatcaagagcgcaagcactcatgctcaagcatcgaattggacttagaccattcatgtggccacagatttcttggaaggtcattgaaacagaaactgcaggacgctgtgggacaatgctttccgattaagaattgctcttctagacattcatccggactgcccagcaaacgcaaaatccatatttccgagttaatgctggacaagtgcccattcccccctcggtccgatctagcattcagatggcacttcataaagcggcatacggcccccattaacagcaagagcgatgaatgggttagtaccgatctaagccagaccgagcttagggacggacagctaaaacgacggaacatggaagaaaacatcaactgctttagccacactaacgtacagccatgcgttattaccacggacaacgcactgtgcagagagggccccatgaccggaagcgtgatgaatctcgtttctaataactctatagaggatagcgacatggacagcgacgacgagatcctcacactgtgcacatcctcgaggaaacgtaataaaccaaaatgggacctggatgacgagatcctgcagctggaaaccccccccaagtaccacacacagatagactatgttcactgtctcgtgcctgacctgctgcaaattaacaataacccttgctattggggcgtcatggacaaatatgctgctgaggcactgcttgaggggaagccagaaggcactttcctgctacgtgactctgcccaggaagactatttatttagcgtgtcattccgcagatactcaagaagcttacatgctagaatcgagcagtggaatcataatttttctttcgatgcccacgatccctgcgtcttccactccccagacattactggcctgctggagcactataaggatccttccgcctgcatgtttttcgagcccctgttgtctacccctctgattcgcacctttccttttagccttcagcacatctgtagaacggtaatatgcaactgtacaacttatgacggaatagatgccctccccatcccttcgagtatgaagctctacctgaaagagtaccactacaaatcaaaagtcagggtgctgcggattgacgcgcccgaacagcagtgttag

SEQ ID NO: 136664 - DNA, 1323 bp, Artificial Sequence
  Description of Artificial Sequence: Synthetic coding sequence
atggccgaaaacaatgagaatatctcaaaaaacgtcgacgtgcgacctaaaacctcccgctctagatccgccgaccgcaaagacggttacgtgtggtccggcaaaaagctgagttggtctaagaagtcagagagctactctgacgcagaaaccgtcaatggcattgagaaaactgaggtatccttaaggaatcaggagcggaagcatagttgttctagcatcgaactggatctggatcattcctgcgggcaccgcttcctgggacgatccttaaagcagaagttgcaggacgcagtcggacagtgctttccaatcaagaactgcagctctaggcactcctccgggctaccttctaagcgcaaaatccatatctccgagcttatgctggacaagtgccccttccctcccaggtccgacctcgcattcaggtggcactttattaaacgtcacaccgctcctatcaactccaagtccgacgagtgggtgtccaccgacctgtcccaaactgagctacgcgacggtcaactaaagaggcgaaacatggaggagaacattaattgcttttcgcacacgaatgttcagccgtgcgtgattactaccgacaatgccctttgccgagaggggccaatgaccggctcagttatgaatcttgtgtctaataactcaatcgaagatagcgatatggattcagatgacgaaattctgacattgtgcacatcatctagaaagcgaaacaaacctaagtgggacctagatgatgagatccttcaacttgagaccccccccaagtatcatacccagatagactacgtccactgtttggttcctgatctcctccagattaacaataacccttgttattggggcgtcatggataagtatgctgccgaggctctcctagagggcaaaccggagggaacatttcttctccgcgacagcgctcaggaggactatctgttttcagtttccttccgtaggtatagcaggagtttacacgcacgcatcgaacaatggaatcacaacttttcttttgacgctcatgacccctgtgtgttccacagtccagatattacaggcctcttagagcactataaggacccctccgcgtgtatgtttttcgaacctctactgtccacacccttgatcagaacctttccgtttagtctacagcacatctgtagaacggttatttgtaactgtactacttacgacggaatcgacgccctcccaattccttctagcatgaagctctacctcaaggagtatcattacaaatccaaagtcagagtactgcgaatcgacgctcccgagcagcaatgttag

SEQ ID NO: 136665 - DNA, 1323 bp, Artificial Sequence
  Description of Artificial Sequence: Synthetic coding sequence
atggctgagaataacgaaaacatcagcaaaaatgtggatgtgcgtccaaagacctcaagatcacgaagcgcggaccggaaggatgggtacgtgtggagtgggaaaaagttgtcttggtcaaaaaaatctgagagttattcagacgcagagacggtgaacgggattgaaaagaccgaggtctcactgcgcaaccaggaacgtaagcatagctgctcaagcatcgagctcgacttagaccatagctgcgggcaccgctttttgggacggagcttaaagcaaaaactacaggatgctgtagggcagtgcttccccattaaaaactgctccagccgacactctagcggcttacctagcaaaagaaaaattcacatttccgaactgatgctcgacaagtgtcccttccctcctagaagcgacttagcattccgctggcactttatcaaaagacacactgctccaatcaacagcaagagcgatgagtgggtgtccacagaccttagccagaccgaactgagggatggccagttaaaacgacgaaacatggaagaaaatataaactgcttctcccatacaaatgtacagccctgcgtgatcactaccgataacgcattatgtcgagagggtcctatgaccggctcggtgatgaacctcgtgtccaataacagtatagaggacagtgatatggattctgacgatgagattctgacactatgtacgagcagtaggaaacgcaacaaacccaaatgggatctggatgacgagatccttcaactggagacaccaccaaaataccatactcagatcgattatgttcattgtttggttcctgaccttctgcagatcaacaataatccatgttactggggcgtgatggataagtacgcagccgaggctttgcttgaaggtaagcctgagggaaccttcctgttaagggatagcgcccaggaagactatctcttttctgtgtccttccggcgatactctcggtcactgcacgccaggatcgaacagtggaaccacaatttttccttcgatgcacacgacccatgcgtcttccacagtccagacataaccgggctccttgaacattataaggatccaagcgcctgtatgtttttcgaaccgctcctgtctacaccgttgattcggaccttcccgttcagtttacaacacatttgtcgaaccgtcatctgcaattgtacaacttacgatggcatcgacgctttgcccatcccttcatctatgaagctgtacttaaaagagtaccactacaagagtaaggtgagggttctgaggatagatgcacccgaacaacaatgctag

SEQ ID NO: 136666 - DNA, 1611 bp, Artificial Sequence
  Description of Artificial Sequence: Synthetic coding sequence
atggacaaagtgggcaaaatgtggaataacttcaagtacaggtgccaaaacctttttggtcacgaggggggcagtaggagcgagaatgtcgacatgaactctaatcggtgtttaagcgtcaaagaaaagaacatctccattggcgactctactccgcagcagcagtcatcccctctgagggagaatattgcactgcagcttggcttgtcaccatcaaagaactcaagtagaaggaaccagaactgtgctaccgagatccctcagatcgtggaaattagtatcgaaaaggataacgatagctgcgtaacacccggcacgcgactcgccaggagagactcttactccaggcacgcaccctgggggggaaaaaaaaagcattcctgtagtactaagacacagagctctttagatgccgacaagaaattcgggcgtacaaggtccgggctgcagcggagagagcgccgctatggcgtgagcagcgtgcacgatatggacagcgtctctagcagaaccgttggatcccggagcctgagacaaagacttcaggacactgttggtctgtgtttccccatgagaacgtactccaaacagtctaaacccctcttcagtaataaacgaaagatccatttgagcgaactgatgctggagaagtgcccatttcctgccggatccgacctggcacagaagtggcacctgataaaacaacacacagcaccagtgtccccacatagtaccttcttcgacacttttgaccctagtctcgtgtccaccgaggacgaggaggataggctccgcgaacgcagacggctgtccatcgaagagggcgtcgacccacctcccaacgctcagatccacacatttgaggccactgcgcaggtaaacccactgtacaagctgggaccgaaacttgcgccaggcatgactgagatttcgggcgacagcagtgccatcccacaggcaaattgtgattctgaggaagacacgacaaccctttgcttgcaaagccggcgccaaaaacagaggcaaatttctggtgattcccacacacatgtgtctcgtcaaggcgcatggaaggttcatactcaaatcgattacattcactgtttggtccctgacctccttcaaatcactgggaacccctgttactggggcgttatggaccgatatgaagcagaagccctgctcgagggaaagcccgaagggacctttctgctgcgggatagcgctcaagaggactatctgttctctgtctctttcaggagatacaatcggtctctccacgcacgcatcgagcagtggaatcataatttctccttcgatgcccatgacccctgtgtgttccactctagtactgtgacaggactgttggagcactacaaggatccatccagctgcatgttcttcgagcccttacttacaattagcttaaatcgaacgttccccttctcattgcagtacatttgtagggccgtgatctgccggtgcaccacatatgacggaatcgacggtctgcccttgccatcaatgttgcaggactttctcaaggagtaccactacaagcaaaaggtcagagtgcggtggctggaacgcgaacctgtgaaagctaagtag

SEQ ID NO: 136667 - DNA, 1611 bp, Artificial Sequence
  Description of Artificial Sequence: Synthetic coding sequence
atggacaaagtcggtaagatgtggaacaacttcaaataccgctgccaaaacctttttggtcatgagggcggcagtcgcagcgaaaacgtggacatgaatagcaatcgatgtctcagtgtgaaggagaagaatatctccattggtgattctacccctcagcaacagagctcaccattgcgggagaatattgctctgcagctgggcctctccccaagcaagaatagtagccgcagaaaccagaactgtgctacggagatccctcagatcgtcgagatatctattgagaaagataatgattcatgcgtcacgcctggaacccggttggctaggcgggattcttactcaaggcacgcaccttggggagggaagaaaaaacattcttgttctacaaaaactcagtcttcgctagacgcagataagaagtttggcagaacaaggagcggcctgcaacgaagggagcggcggtatggagtgagcagcgtccacgacatggacagtgtcagctctcgtactgtcggttcgcgtagtctcaggcagagactacaggacaccgtgggcttgtgtttccctatgagaacttattctaaacagtccaagcctctgtttagcaataagaggaagattcatctgagcgagcttatgctggagaagtgcccattcccggcaggatcagacctggctcagaagtggcaccttataaaacagcacactgcacctgttagccctcactcaaccttttttgatacatttgacccctctctcgtaagtacagaagatgaggaggaccggctcagagagcggaggagactaagcattgaagaaggagtggacccccctcctaatgcacagatacacaccttcgaggccactgctcaggtgaaccctttgtacaagctggggccaaagctggcaccggggatgactgagatctctggtgacagtagcgcaattccccaggccaactgcgattctgaggaagatacgaccacgttatgtctacagagcaggagacagaagcagagacagatctccggcgattcccacacccatgtgagtcgccagggagcatggaaggtccatacacagatcgattacatccactgtttggttccagatctcctccagattacaggcaacccgtgctactggggagttatggatagatacgaggcagaagccctgctggaagggaaaccagaaggcactttcctgctgagagattctgcccaagaagactacctctttagtgtgagttttcgcagatataaccggtctctgcacgcgcgcatcgaacaatggaaccataatttctccttcgatgcccacgacccctgcgtgttccactcctcaacagtcaccggtttgttggagcattacaaggacccttcatcttgtatgttcttcgaaccactgctcactatcagcctgaatcgcactttcccatttagcctgcagtatatttgtagggctgtgatttgccggtgcacaacctacgatggaattgacggtctgccgctgccctctatgctacaggacttcctgaaggaataccactacaaacagaaggtgcgggttagatggcttgaaagggaacccgtgaaggcgaagtag

SEQ ID NO: 136668 - DNA, 3264 bp, Artificial Sequence
  Description of Artificial Sequence: Synthetic coding sequence
atgtccgacagtgaggactccaactttagcgaggaggaggactctgagcggtccagcgatggagaggaggctgaagtagacgaagagaggaggagtgcggctggctcagagaaggaagaagaaccagaggacgaggaggaagaagaagaagaggaggaatacgacgaggaggaagaggaggaggatgacgatcgcccaccgaaaaaaccaaggcacgggggattcattctggacgaggccgacgtggatgacgaatatgaggacgaggatcaatgggaagacggagctgaagacatccttgaaaaagaagagatcgaggcaagtaacatagacaatgtggtgttggatgaggatcggtccggcgcaaggcgcctgcagaacttgtggcgcgatcagagggaggaagagttaggcgagtattatatgaaaaagtatgcaaaaagcagtgtgggcgagactgtgtatggaggctccgatgagctcagcgacgacattacacagcaacagttattgcctggtgtgaaagaccccaacttatggaccgtgaaatgtaaaattggcgaggagcgggcgacggctatttcccttatgagaaagtttattgcttaccagttcaccgacacaccccttcaaattaagagtgtggtggcccccgagcatgttaaaggctatatttatgtggaggcatataaacagacccacgttaagcaagcgatcgaaggagttgggaacctgcgactaggatattggaatcagcagatggtccccattaaagaaatgactgacgtactaaaagtggtgaaggaggtcgcgaatttaaagcctaagtcttgggtgcgcctgaagcgtggcatttataaagatgacatcgctcaggtcgactatgtggagccatcgcagaatactatctctctcaagatgattccccgcatagattatgatcgcatcaaggcacgcatgagtcttaaagattggtttgcaaagcgcaagaagttcaaacggccaccgcagagactcttcgatgcagagaagatccgaagtctggggggcgacgtggcctccgacggggatttcctaatttttgagggaaatcggtatagccgcaagggctttttgttcaaaagcttcgcaatgagcgctgtcatcactgagggcgttaagcccacattgtccgagctcgagaagttcgaagatcaaccagaaggaatcgatctcgaggtcgttaccgaatcaactggtaaggagcgcgagcacaactttcagcctggcgataatgtggaagtctgcgaaggcgaactgattaatctccaaggaaaaattctttctgtagatggaaataagatcactataatgcctaagcacgaggacctgaaggacatgttagaatttcccgcccaagagttaagaaagtactttaaaatgggggaccacgtgaaggtgatcgccggaagatttgaaggcgacaccggcttgatcgtgagagtggaggagaactttgtcatcctgttcagtgacttaactatgcacgaactgaaagtgctccccagagacctacagctgtgcagcgaaacagccagtggtgtggatgttgggggtcagcatgaatggggagaactggtgcagttagatccccagacagttggggtgatagtcagactagagcgcgagaccttccaggtcctgaatatgtatgggaaagtggtgacggttagacatcaagctgtcactagaaagaaggacaaccgcttcgctgttgctttggactccgaacaaaacaatatccatgtcaaagatattgtgaaagtcattgacgggccgcactctgggcgggaaggtgagatcagacatctcttccggtcttttgcattcttacactgcaaaaagctggtggagaacggcggtatgtttgtttgtaagacaagacacctagtgttggctgggggatcaaaaccacgggatgtcacaaacttcacagtgggtggtttcgcccccatgtctcctcgcatttcaagccctatgcacccctccgcaggaggacagagaggtggttttggtagccccgggggcggtagtggtggcatgtcccgcgggaggggccggcgggacaatgagcttatcgggcagacagtgcgcattagtcaaggcccctataagggctatattggtgtagtgaaagatgcaactgaatccaccgctcgggtagaactccatagcacatgtcagaccatttcggtcgaccggcagaggcttacaacagtgggatctcgccgccccggcgggatgacctctacctatggacgcactcctatgtatggctctcaaacaccaatgtatggtagtggcagtcgcacccctatgtacgggtcacagacgcctttacaggacgggtcaagaacaccacactacggcagtcagacgccgctacacgacggcagtagaacaccagcccagagtggagcctgggaccctaataaccccaacacaccatccagagctgaagaagaatatgaatacgcatttgacgacgaaccaacaccatctccgcaggcttatgggggcactccaaacccacagactccaggctacccagatccctcctcgcctcaggtgaatccccaatacaaccctcaaactcctggcacaccagctatgtataacaccgatcaattctctccttacgccgctcctagcccccagggctcataccaaccttcaccctcaccacagtcctatcaccaggtggcaccgagccccgcaggataccagaacactcactctcctgcttcctatcatccaactccttcccccatggcgtatcaagccagtccatctcctagccccgtcggctacagccctatgaccccaggggccccaagccccgggggctataacccccacacacccggttccggcatagaacagaatagtagtgactgggttactacggatatccaggtcaaggttcgcgatacctatctggatacacaagtcgtagggcagactggggtcatccgctccgtgaccggaggaatgtgctccgtctatctgaaggacagtgaaaaagttgtctcgatttcctcggagcatctagaacctatcacccctactaagaacaataaggtgaaagtcatcttgggagaggatagagaagccactggggtcctactgtctattgatggcgaggatggtatcgtacgcatggacctggacgaacagttgaaaattttgaacttgcggttcctggggaagctgttggaggcttag

SEQ ID NO: 136669 - DNA, 3198 bp, Artificial Sequence
  Description of Artificial Sequence: Synthetic coding sequence
atgagcgactccgaagactccaacttcagtgaggaagaggactctgagcgctcgtcggatggagaggaggccgaagttgatgaggagcggcgtagcgcagcaggaagcgaaaaagaagacgatgatcgcccccctaagaagccaaggcatggggggtttatcctggatgaggccgacgtggacgatgaatatgaggacgaagaccaatgggaggacggagcggaagatatactcgagaaggaggagatcgaagcatccaacatcgacaatgtggttttggatgaggacaggagcggtgctcggcggctccaaaatctgtggagggatcagagagaggaagagttaggggagtattacatgaaaaagtacgcgaagtccagtgtgggagagaccgtgtatggcggcagcgatgaactgtccgatgacatcacacagcagcagctactgcctggcgtgaaggaccccaatctgtggactgtgaaatgcaagatcggggaagaacgggccaccgccatctccctgatgcgcaagtttatcgcttatcagttcacagatactcctctgcaaattaaatctgtcgtggccccagagcacgtgaagggctacatatatgtggaagcgtacaagcagacacacgtgaagcaggctatcgagggcgtaggcaacctgagattggggtattggaatcagcagatggttcctattaaagagatgacagatgtattaaaggtggtgaaagaggtggctaacctcaaaccaaaaagctgggtgcgccttaaaagaggcatctataaggacgacatcgcgcaagtggattatgtcgagcccagtcaaaacaccatcagcctgaaaatgatacctcgtattgactatgatagaatcaaggccagaatgagtcttaaagattggttcgccaaacgcaagaaatttaaacggccccctcagcgcttgttcgatgctgaaaagatcagaagtcttggcggcgatgtggcgtcagacggagattttctgatcttcgaggggaatcgctacagcaggaagggatttctctttaagtcttttgccatgagcgccgttatcactgagggagtgaaacccaccttgtccgagctggagaagttcgaggatcagccggaaggcatcgatctcgaggtggtgactgagtccacgggaaaagaaagggaacataattttcaaccgggagataacgttgaagtttgtgaaggagaactgattaacctccaagggaagatccttagtgtggacggcaataaaatcaccatcatgcctaaacacgaggatctgaaggatatgttagaattccccgctcaggagctgcgtaaatattttaaaatgggggaccacgtcaaagtcatagcaggacggttcgaaggcgacacggggctcattgtgcgggtggaggaaaactttgtcatcctgttttccgacctgacaatgcacgagctgaaagtgctgccacgggacctgcagctttgcagtgagactgcgtccggagtggacgtgggcggccagcacgagtggggcgaactcgtgcagcttgaccctcagacagtgggcgtcattgttaggcttgagcgcgagacgtttcaggtgctcaatatgtatggcaaagttgtaaccgttcgccaccaggcggtgaccagaaagaaggataaccgcttcgcagtggccctagattctgaacagaacaacattcacgtgaaagatattgtgaaggtaattgacggccctcactccggtcgcgaaggagaaatccggcatctctttcggagcttcgcatttctgcattgcaaaaagctagttgaaaatggcggaatgtttgtgtgcaagacaagacacctggttctagcaggaggaagtaagccccgcgatgtcaccaacttcaccgtaggaggtttcgcgcccatgtcaccacgcatttcctctcctatgcatcctagtgctggtggacagcgaggcgggttcggttcgccaggcgggggttcaggcggaatgtcaaggggtagaggccgaagagataatgaactgattggccagactgtacgaatctcacaaggcccttacaaaggttacataggcgtggtgaaggacgctactgagagtactgccagggtcgaactgcattccacctgtcaaactatcagcgtcgatcgacaacgactgacaactgtaggtagccggaggccaggcggaatgaccagtacttatgggcgaacccctatgtatggaagccagaccccaatgtacggttccggctcacgcacacccatgtacggatcccaaacacccctccaggacggcagccgaacaccacactacggctcccagacaccactccatgacgggtccagaactccagcacagtcaggcgcttgggaccccaataatccaaacaccccttccagggccgaggaggagtatgagtatgcatttgatgatgagccgacaccaagccctcaggcctacggcggaactcccaacccacagacacctggctatcctgacccaagttctccacaagtcaatccacagtacaacccccagacaccaggcacaccagctatgtacaatactgaccagttcagtccgtacgcggcaccaagccctcagggatcgtatcaaccatcaccatcaccgcagtcttatcatcaggtggctccaagtccagcagggtaccaaaacacgcactcacctgctagctaccatcccaccccctcaccaatggcatatcaagcctcaccatcccccagccctgtgggatatagccccatgaccccaggtgcacccagtcccggaggctacaacccacacaccccaggttccggcatagagcagaactcctctgactgggtgacaaccgatatacaagtgaaggtaagggacacgtacctggatacgcaggtagttggtcaaaccggtgtgatcagaagtgttactggcggaatgtgttctgtttaccttaaagactctgagaaagtagtctccatcagctcagagcacctggaaccaattactccgaccaagaacaacaaagtaaaggtgatcctgggtgaggacagggaagcaacaggagtgttgcttagtattgacggtgaagacggtattgtgcggatggaccttgacgagcagctaaaaattcttaaccttcgatttctcggcaagttgttggaagcatag

SEQ ID NO: 136670 - DNA, 3252 bp, Artificial Sequence
  Description of Artificial Sequence: Synthetic coding sequence
atgtcagacagtgaagatagcaatttctcagaagaagaagatagcgagaggagttcggacggggaggaggccgaagttgatgaagagcgaaggtccgccgccggctccgagaaggaagaagaacccgaggacgaggaagaggaagaggaggaagaggagtacgacgaggaggaggaggaagaagatgatgaccgacccccaaagaagcccaggcatggcggatttatactggacgaagccgatgtcgatgacgaatatgaggatgaagatcagtgggaggacggcgccgaagatatcctcgagaaggcatctaacatcgataatgtggtgctagatgaagatcgcagtggggcacggagattacagaacttatggagggatcagagggaagaggagctgggggagtactacatgaagaaatatgccaaatcaagcgtcggagaaacggtgtatggaggtagcgacgaactgtccgatgacataacccagcaacagcttcttcccggggtcaaagatcctaatttgtggaccgtcaagtgcaaaattggcgaggagagagctaccgcaatatcactgatgcgtaagtttatagcttaccagttcacagacactcctctacagattaaaagtgttgtggccccggaacatgttaaagggtatatttacgtggaggcatataaacaaacgcacgtcaagcaagcgatagaaggagtcgggaatctgaggcttggttattggaaccagcagatggtcccaatcaaggagatgacagacgtcctgaaggttgttaaggaggtggctaacttaaaaccaaaaagttgggtacgcttaaagcgaggcatttacaaggacgatattgcccaggtcgattacgtggagccaagtcagaataccatctcgttgaaaatgatcccaagaatcgactacgaccggatcaaagcccgcatgagtctgaaagattggtttgcaaagcggaagaagttcaaaagacccccacagcggctgttcgatgctgagaaaattcgttcccttggcggcgacgtggcctcagacggcgactttttgatctttgaaggtaataggtattctagaaagggctttctttttaagtctttcgccatgtctgcagtcattaccgagggtgtgaagcctacgctgagcgaacttgagaagtttgaggaccagccagagggcattgaccttgaagtggtcactgagagtacaggtaaagaacgagaacacaattttcagccaggagataacgtagaagtgtgcgaaggggagctcatcaaccttcagggaaaaattctcagtgtagatggcaataaaatcaccattatgccaaaacacgaagacctgaaggacatgcttgagttcccggcccaggagctaaggaaatatttcaaaatgggggaccatgtcaaagtgattgctggcaggttcgagggcgacacagggctgatcgttcgcgtggaggagaatttcgtgatcctttttagcgatttaaccatgcacgagctcaaggtcttgcccagagatttgcaattgtgcagtgagaccgcttccggagtggatgtgggcggtcaacatgagtggggagagcttgtgcagttggatccacaaacagtcggcgtcattgttagactggaaagggagacatttcaggtcctgaacatgtatggcaaggtggtgacagtgcggcatcaggctgtcacgcggaaaaaagacaaccggtttgcggtggctctcgactctgagcagaataatattcacgtcaaagatatcgttaaagttatcgacggccctcacagcgggcgcgaaggcgagatccgccatctgttcaggtcttttgcctttctgcattgtaaaaagctggtggagaatgggggcatgtttgtgtgtaagactaggcatttagtcctggctggtggcagcaagccgagggacgtaactaatttcaccgttggtggattcgccccaatgtctcccagaatctcttcccctatgcatccctccgcgggaggccaacggggcggatttgggtctcccgggggaggatcgggagggatgtcacggggccgcgggagaagagacaatgagttgataggacagaccgtgcgaatctcgcagggcccctataaaggttatataggagtcgtgaaggatgctactgaaagcacggcccgcgtggaacttcactccacatgccaaacaatttccgtcgatagacaaagactaacaaccgtgggatctcgtcggccaggcggcatgacctctacttacggcaggacaccgatgtatggttcgcagacccccatgtacgggtcaggcagccggactccaatgtacggatcccagacgcctctccaagacggctctcgcacaccccactacggcagtcagaccccattacacgacgggtccaggaccccagcgcagtcaggcgcttgggatccaaataatccaaataccccttcacgggccgaagaggagtatgagtacgcatttgatgatgagcctacgccatcaccacaggcgtatggaggaacacccaacccccaaactcctggctaccccgatccatcttctccacaggtgaatccacagtataatccacaaacaccagggactccagctatgtataatacagaccaattttctccctatgcagcacccagccctcaaggctcatatcagcccagccctagcccccagagttatcaccaggtggcaccctctcctgctggataccagaatacacactcccccgcatcctaccaccctacccccagcccaatggcctatcaagccagtccgtccccgtctcctgtgggttattcacccatgacacccggagcccctagtccgggtgggtataatccacatacacccggatcgggaattgagcaaaactcttccgactgggtcaccacggatatccaagtgaaagtacgggatacttatctggatactcaggtggtcggccagacaggcgtgattaggagcgtcactggcggaatgtgctccgtgtatttaaaggactccgaaaaagtggtctcgatttcttccgagcacttggagcctatcaccccaactaagaacaacaaggttaaagtgatcctgggggaggatagagaagctaccggagtcttgctgtctattgatggcgaggacggtatcgtcaggatggatctggatgagcaactcaaaatactgaacctgagattcctgggaaaactgctggaggcctag

SEQ ID NO: 136671 - DNA, 3264 bp, Artificial Sequence
  Description of Artificial Sequence: Synthetic coding sequence
atgtccgacagcgaggacagtaatttcagtgaagaagaagacagcgagcgctcctccgatggcgaagaggcagaagtggatgaagagcgaagaagcgccgccggaagcgagaaggaagaagagcctgaggatgaagaagaagaggaagaggaggaagaatacgatgaggaggaagaagaagaggacgatgatcgacccccaaaaaagcctagacatggaggctttattctcgatgaggccgatgttgacgacgaatatgaggacgaggatcagtgggaggacggcgccgaggatatcctggagaaagaggagatcgaagcatctaatatcgataacgtcgtattagacgaggatcgtagtggggcaaggcggttgcagaatctttggagggaccagcgcgaagaagaacttggggagtattatatgaaaaagtacgctaaatctagcgttggtgagacagtctatgggggtagtgatgaattgtcagacgatataacacagcaacagttgctacccggagtgaaggaccctaatttatggacagtaaagtgtaagatcggggaggagagggccaccgcgatatccctgatgagaaaatttatcgcctatcagttcacggatactccgctgcaaattaagtccgtggtggctccagagcatgtgaagggttatatctacgtcgaggcctataagcagacccacgttaaacaggccatcgaaggcgtgggaaatctccgcctcggctattggaatcagcagatggtgcctatcaaggaaatgacagacgtcctcaaggtagtgaaagaggtcgcaaacctcaagcctaaatcctgggtgcgattgaagcgcggaatatataaagacgatatcgcacaggtcgactacgttgaaccttctcagaacaccattagcctgaagatgattccgcggatagattatgaccggatcaaggcgcggatgtcactgaaagactggttcgctaaacggaagaaattcaaaagacccccgcagcggctcttcgatgccgaaaagattcgatctcttgggggggatgtcgcgagcgatggtgacttcctaatcttcgaagggaatagatattcacgaaagggttttctgtttaaaagctttgcgatgtcagcggtcattactgagggtgtgaaacctacgctgtccgaactggaaaagtttgaggatcagcccgagggaattgatctcgaagtggttacggaatccacgggcaaagaaagggagcacaattttcagccaggtgacaatgtggaagtgtgcgagggagaactgatcaacctgcaaggaaaaattctctctgtggacggaaacaaaattactattatgcctaaacatgaggacctgaaagacatgttagagttccctgcccaggaactgcgcaagtattttaaaatgggtgaccacgtgaaggtgattgctggacgctttgagggcgacacagggctgattgtcagagtggaggagaactttgtcatcctgttctcagacctcaccatgcacgaattgaaagtgctgccacgggacctgcagctatgcagcgagaccgcatcgggggtggatgttggcggccaacatgaatggggcgagttagttcagttggacccgcagactgtaggagtaattgtcaggttggagcgagagaccttccaggtgctgaatatgtacggcaaagtggtcacggtccgccatcaggctgtgactagaaaaaaagacaataggttcgcggtggctctcgactcagaacaaaataatattcacgtcaaagatatcgttaaggtgatagacgggccacattcgggccgagaaggtgagataagacacctattcaggtccttcgctttcctgcactgtaaaaaactggtggaaaatgggggtatgttcgtgtgcaagaccagacatctagtgctcgcaggcggctccaagcctcgagacgtaaccaacttcacagtgggggggttcgcacctatgtcccctcgtatcagctcccccatgcatccaagcgccgggggccaaaggggaggcttcggatctcctggaggaggctcaggagggatgagtcgtggcagaggacggagggacaatgagttgataggccagaccgtaaggatcagccagggaccctataagggttacattggagtggtaaaagacgcgaccgaaagtaccgctcgcgttgagctccatagcacatgtcagacgatctcagtcgataggcagcggctgacaactgttgggtcccggcggcccggaggcatgacttcaacctacggacgtacaccaatgtacggcagccagacacctatgtatggcagcggcagcaggacccccatgtatgggtcacagacaccccttcaagatggctctcggaccccgcactatggctcccagacaccactgcacgatggtagtcggactcctgcacaaagtggtgcatgggaccccaacaatcccaacacgcccagccgagccgaggaggagtacgagtacgctttcgacgacgagcccactccctccccccaggcatatggaggaacacctaatccccagacacctggatacccagatccctctagtcctcaagtgaatcctcagtacaacccacaaacacccggtactccggcgatgtataatacagaccaattttccccttatgctgccccttctccacagggatcataccagccctccccctctccacaaagctaccatcaagtcgcccctagcccggccggataccagaatacccactcacctgcaagctaccacccaacccccagccctatggcatatcaggcgtctccttcaccctctcccgtggggtactcaccaatgactccgggtgctcccagtcccggcggatacaatccacacactcctggaagcggcatcgaacagaacagtagtgattgggtgacaaccgacattcaggtcaaggtgcgggacacctatctggatacacaagtggttggtcagaccggggtgattcgctcagtcacaggtggaatgtgttctgtctacctcaaggattctgagaaggtggtgtccatctcttcggagcacctcgaacccattacccccactaagaacaacaaggtgaaagttatcctcggcgaggaccgggaggcaaccggcgtactgctctctattgacggagaggatggaatcgtgagaatggacctcgacgaacaactcaaaatcctgaacctccgctttttgggtaaactgttggaggcttag

SEQ ID NO: 136672 - DNA, 3264 bp, Artificial Sequence
  Description of Artificial Sequence: Synthetic coding sequence
atgtccgatagcgaggacagcaacttttccgaagaggaagacagcgagagatcctcagacggggaggaggccgaagttgatgaagaaaggaggagtgcggcaggatcggagaaagaggaggaaccagaagacgaggaagaggaagaggaggaagaggaatacgatgaggaggaagaggaagaggatgatgatcgccctccgaagaaacccagacacggtggatttatcctggatgaggcagatgttgacgacgagtatgaggacgaggaccagtgggaagacggagcggaagacattttagagaaagaggagatcgaagcctcgaatattgataacgtggtacttgatgaggatcgcagcggcgcaagacgcctccagaatttgtggcgtgaccagcgggaagaagagctcggcgagtactacatgaagaaatacgctaaaagcagcgtcggagaaacagtgtacggcggatccgatgagctgtctgacgatataacccaacaacagctcctcccaggagtcaaggatcccaacctttggaccgtgaaatgcaaaatcggtgaggaaagagccacagccatttcgctgatgcgcaaatttatagcctaccaattcactgacaccccacttcagatcaagtctgtggtggcgcctgaacacgtgaaaggatacatttacgttgaagcttacaaacagacacacgtaaagcaagccattgagggtgtggggaacctgagacttgggtattggaaccagcaaatggtacccatcaaagaaatgacagatgtgttgaaggtcgtgaaggaagtcgcgaatctcaagcctaagtcatgggtccggctgaagcgaggaatctataaagacgatatagcacaggtggattacgtggagccttcccaaaacaccattagcttgaagatgattccaaggatcgactacgaccggatcaaggcccgcatgagtcttaaggactggttcgcaaagcggaagaaatttaaaaggcctccgcagcggctctttgacgctgaaaagatccgtagtcttggtggcgacgttgcttcagacggcgacttcctgatattcgagggtaataggtattcgcgtaaaggatttttgttcaagagttttgctatgtcggcagtaataacggaaggcgttaaacccaccctctccgagctcgaaaagtttgaggatcaaccggagggaatagacctcgaggtagtgacagagagcaccggtaaagagcgcgaacataattttcagcccggggataatgttgaggtgtgcgagggcgagctcatcaatctgcagggcaagatcctcagcgtggacgggaataaaatcactataatgcccaaacacgaggaccttaaggacatgctggaattccctgcacaggagttaaggaaatatttcaagatgggtgatcacgtcaaggtgattgctggccggtttgaaggtgacaccggcctcattgtccgagtggaggagaactttgtcatcctgttcagcgaccttacgatgcacgaactgaaagtcctgccccgggacttacagctgtgcagcgaaaccgcctcgggggttgacgtcggaggacagcatgagtggggagagcttgtgcagctagatccacaaactgtaggcgtaatcgtacgcctcgagagagaaacttttcaggtcctgaacatgtatggaaaggtcgtgaccgtgaggcaccaggctgtcactcggaagaaagacaacagatttgcggtcgccttggattctgaacagaacaatattcacgtgaaggatatcgtaaaggtgatcgacggtccacatagcggtcgagagggcgagattaggcatttgtttaggtctttcgccttcctgcattgcaaaaaactcgttgaaaatggtggtatgtttgtgtgtaaaacaaggcatcttgtgctggccggcggcagtaagccaagggacgttaccaacttcaccgttggcggtttcgccccaatgtcccctagaatttccagtcctatgcacccgagcgctggaggacaacgcggcggcttcgggtccccaggcggcggatcaggcggcatgtcccggggaagagggcggagggataacgaacttatcgggcagacagtgagaataagtcagggcccttataaggggtacatcggtgtagtcaaggacgccacggagtccactgcacgcgttgaactgcactccacttgccagaccattagtgtggaccggcaaagacttactacagtgggaagcagacggccaggggggatgaccagtacgtatggcagaaccccaatgtacgggagccagacacccatgtatggctcaggcagccgcactccaatgtacgggagccagactcctctgcaagacgggagccgcacgccccactatggttctcagactccactccacgacggttcacgcacgccggcacagagtggcgcttgggatcccaacaacccgaatacccctagcagggcagaggaggagtatgaatacgccttcgatgacgagccgactcctagtccccaggcttatggggggacccctaatccccagactcctggctaccctgacccaagtagtcctcaggtgaacccacagtacaatccccagacccctgggaccccggcgatgtacaataccgatcaattctccccctacgccgcacccagtccccaaggatcctatcagccttcacctagtccgcaaagttaccaccaagtggcgcccagtcctgcgggctaccagaatacccattctccagcttcatatcaccccactccttcacctatggcctaccaggcctcaccctccccttctccagtcggatactcaccaatgaccccaggcgctccatcccccggcggctacaatccccatacacccggatcgggtattgagcagaattcctctgactgggtgactaccgacatacaggtcaaggtgcgggacacctatctcgatacacaagttgtcgggcaaactggagtcatccggtctgtgaccggggggatgtgtagtgtgtacctgaaagacagcgagaaggtggtttcaattagcagtgaacatctcgagccgatcacgcctacaaaaaataacaaagtcaaggttatactcggcgaggatcgcgaggccaccggagtattgctgagtattgacggagaggacggaatcgtcagaatggacctcgatgagcagttgaaaattttgaacctcaggttcctcggaaaattactggaggcctag

SEQ ID NO: 136673 - DNA, 3264 bp, Artificial Sequence
  Description of Artificial Sequence: Synthetic coding sequence
atgtccgattcagaagacagcaattttagcgaggaggaggactcagagcgcagttcggatggggaagaggccgaggtggacgaggagagacgctctgctgccggaagcgaaaaggaagaggaaccagaggacgaggaggaagaggaagaggaggaggagtacgatgaagaggaagaagaagaggacgacgaccgccctcccaagaagccacggcatgggggattcatcctggacgaggcagatgtcgatgacgagtatgaagacgaagatcaatgggaggatggtgcagaggatatcctcgagaaggaagaaattgaagccagcaacatcgataacgtcgtgctcgatgaggatcggtcgggcgctcgccggctgcagaatttgtggagagatcaaagggaggaagagctgggggaatattacatgaaaaaatatgcgaagtctagcgtgggggaaaccgtgtacggaggcagtgacgaactgtccgatgatattacacagcagcaactgctccccggcgtgaaggacccgaatctttggacagtgaagtgtaagataggcgaggagcgggcaacagccatcagccttatgaggaagttcatcgcctatcagtttacggatacccccctgcagataaaatccgtcgttgcaccagagcacgtgaaaggatatatctatgtggaagcttacaaacagacacacgtgaagcaggctatagagggagtggggaatttgcgtctcggttactggaaccagcaaatggtccctataaaggagatgactgacgtgctgaaggttgtcaaagaggttgccaatctgaaaccaaaaagctgggtgcgcctgaaaagggggatttataaggacgacatcgcccaggttgactatgtcgagcccagccagaacacaatctcactcaagatgatccccagaattgattatgaccgcatcaaagccaggatgtcattaaaggactggtttgcaaaaaggaagaagtttaagaggcccccccagaggctcttcgacgctgagaagatccgctccctggggggtgatgtggcttccgacggagattttcttatcttcgagggcaataggtactcgagaaagggctttttattcaaatctttcgcaatgtcggctgtgataacagagggtgtaaaaccaactctgtccgagctcgaaaaatttgaagaccagcccgaagggattgatttagaagtcgtgacagaaagcaccggcaaggagagagaacataattttcagcctggtgacaatgtggaggtgtgtgagggagagctgattaacctccaggggaagattttgagcgttgatggaaataagataactattatgcctaaacatgaagatttgaaggatatgctggaatttcccgcgcaggagctgagaaagtacttcaaaatgggagaccacgtgaaggtgatcgccgggcggtttgagggagatactggacttattgtgcgtgtggaagaaaactttgtgatcctttttagcgatctgaccatgcatgaacttaaggtattgcctagagatctgcagttatgtagcgagactgcctctggagtggatgtcggcggacagcacgagtggggcgagttagtgcaactcgatccccagacggttggcgtgatcgttcgcttggaacgcgagactttccaggtgcttaacatgtacggaaaggtcgtaacagtgcgacatcaagccgtcactcggaaaaaagacaacaggtttgcagtggcgctcgactccgagcagaataacatacatgttaaggatattgtgaaagttatagatggaccccactctggcagggagggcgagatacgtcatctgtttaggtcctttgcttttttgcattgcaaaaagctggtggagaacgggggcatgtttgtgtgcaagacaaggcaccttgtccttgccggtggctcaaaacctagagatgttactaacttcacagtcggtggctttgctcctatgtcgcccaggatctcttctcctatgcacccttctgctgggggacaacggggcggttttggcagcccaggcggggggagcgggggaatgtcacggggaagggggcggagagacaacgagctcatagggcaaactgtccggatttcacagggaccctacaagggctacatcggcgtagtcaaggatgcaaccgagtccaccgcccgggtcgaactgcattccacctgtcaaacgatttccgtggatcgtcaacggctcactacggtgggcagcagacggcccggggggatgacaagtacttacggccggacccctatgtatggatctcaaaccccaatgtatgggagcggcagcaggactccgatgtacggttcacagactcccctgcaggacggaagcaggactcctcactatggcagccagacccccttgcatgacggcagtcggacgccagcccagagtggcgcgtgggaccctaataatccaaacacaccgtccagagcagaagaggaatacgagtacgcatttgacgatgaacccactccctctccccaggcatacggggggactcccaatccccaaacaccgggctatccggacccctcaagtccacaagtgaatcctcaatacaatccgcaaacccccggcacacccgccatgtacaacaccgatcagttcagcccatatgcagctcccagtccccaggggagctatcagccttctccctcaccacagtcataccaccaggtggcacccagccctgcaggttaccagaatactcatagtcctgcaagctatcaccccacgcctagccctatggcctaccaggcatccccaagcccctctcccgttggatatagccctatgactcctggcgccccgtcgcctggaggatacaatccacacacaccagggtccggaattgagcaaaattcaagcgactgggtgaccacagacattcaggtgaaggtccgggatacatatctggacacgcaggtagtcggacagaccggtgtgattaggtcagtgacaggtggaatgtgtagtgtgtatctgaaggattcggaaaaagttgtgagcataagcagtgaacatcttgagccaattacccccaccaaaaataataaggtcaaggtcatcctgggggaagatcgcgaagctacaggagtactgctcagcatcgatggcgaggatggtatagtgcgcatggacctcgatgagcagctcaagatactcaacttacggttcttggggaaactgttagaagcatag

SEQ ID NO: 136674 - DNA, 5181 bp, Artificial Sequence
  Description of Artificial Sequence: Synthetic coding sequence
atgtccgacttcgtggagagcgaggctgaggagagcgaagaggaatacaatgatgagggagaggtggtacctagagtaactaaaaaatttgttgaagaagaggacgacgacgaagaggaggaagaggagaaccttgacgaccaggacgagcagggaaatctcaaagggtttataaacgacgacgatgacgaggacgaaggggaggaggatgagggctcagactccggggatagcgaggacgacgtaggccataagaaaaggaagcgcaccagtttcgatgataggcttgaggacgatgacttcgatctcatagaagaaaacctgggggttaaggtgaagcgcggccagaagtaccgtcgggtaaagaagatgtccgatgatgaagatgacgatgaagaagaatacgggaaggaggaacatgagaaagaggcaatcgctgaggaaatcttccaggatggcgagggggaggaaggtcaggaagcaatggaagcccccatggcccctcctgaagaagaggaggaagacgatgaggagagtgacatagacgattttatagtggacgacgatgggcagcctctaaagaagcccaagtggaggaaaaaattgcccggctacacagacgccgccttacaggaggctcaggagattttcggagtagattttgactacgacgaatttgaaaaatataatgagtatgacgaagagcttgaggaggagtatgagtatgaggatgacgaggccgagggtgaaatacgtgtaaggcccaagaagacaactaagaagcgagtgagtagacgctccatcttcgagatgtatgagccttctgagttagaatcatcccaccttacagaccaggacaacgaaatcagagcaaccgacctgccagaacgctttcaactgcgttcgatcccagtaaaaggcgcagaagacgacgagctcgaagaggaagctgattggatttaccgcaatgcattcgccactccaaccatctcccttcaggagagttgtgattaccttgacagagggcagcctgcatctagcttcagcagaaaggggccctcaaccattcaaaagataaaagaggccttgggctttatgcgtaaccaacactttgaggtccccttcatagctttttacaggaaagagtacgtggagcccgagctgcacatcaacgatctctggcgtgtctggcagtgggatgagaaatggacacagctacgtattcggaaggaaaaccttacaaggctgtttgagaagatgcaggcttaccagtacgagcagatcagtgctgaccctgacaagcctctcgcggatggtatacgggccctcgataccacagatatggagaggctcaaggatgtacagtctatggatgagctaaaggacgtgtacaaccacttcctcctgtattatggccgcgatatcccaaagatgcagaatgccgcaaaggcttcaagaaagaagctgaagcgggtcagggaggagggggatgaggagggagaaggtgacgaagctgaggacgaggaacagcggggtcctgagctcaaacaagctagtcggagggacatgtacaccatctgccaatctgctgggttggacgggttggctaagaaattcggtctgacaccagaacagtttggcgaaaatcttcgtgattcctatcagcgacacgagaccgaacagttccctgcagagccactggaattggccaaggattacgtttgctcccagtttccaacccccgaggccgttctcgaaggcgcgcgctatatggtggctctccagatcgcccgagagccgctggtgaggcaagtgctgcgccagacttttcaggagcgagcaaaattgaatatcacacccacaaagaagggtcgaaaggatgtggacgaggcgcactatgcttacagctttaaatacctgaagaataagcccgtaaaggagcttcgtgatgatcagttccttaaaatttgcttggcagaagatgagggcctcctcacaaccgatatctccatcgacctgaagggcgtcgagggttacggaaacgaccaaacttatttcgaagagatcaagcagttttactacagagatgagttctctcatcaggtccaggagtggaatcgccagagaacaatggccattgagagggcgttgcagcaattcctgtatgtgcaaatggccaaagaattgaaaaacaagcttctggctgaggctaaggagtatgtcatcaaggcctgctcccggaaactttataactggcttagagttgctccctaccggcccgaccaacaggtggaagaggacgacgatttcatggatgaaaaccaggggaagggtatcagggttcttggaatcgcattctcatccgccagggaccatccagttttctgcgccctggttaatggcgaaggtgaggtgacagattttctcagactaccgcattttactaaacggagaactgcctggcgcgaagaagagagggaaaagaaagcccaggatattgagaccctgaagaagttcctgctgaacaagaagccgcatgtggttaccgtcgctggcgagaatcgagacgcgcagatgctgattgaagacgtgaagagaatcgtccacgagctcgaccagggacaacagctgtccagcattggagtggaattggtcgacaacgaactcgccatcctgtacatgaactcgaagaaaagtgaagcagagttccgcgactaccccccagttctgaggcaggccgtgtccttggcccgccggatccaggatccattgatcgagtttgcccaggtttgtagctcagacgaggatatcctgtgcctcaaatttcacccactccaggagcacgtcgtgaaagaggagctgctgaacgcgctctactgtgaattcataaacagggtgaacgaagtgggagtcgatgtcaaccgtgccatagcgcacccatattctcaggctctcatacagtatgtgtgtggccttggtccgcgaaagggaactcaccttctcaagattcttaagcaaaataacaccaggctggagtcccgcacacagttagtcaccatgtgtcacatgggacctaaagtgtttatgaattgtgccggctttctgaaaatcgacaccgcgtcactcggcgatagtacagactcctatattgaggttcttgacggctcgcgggtccatcctgagacctacgaatgggccaggaagatggccgtggatgctctggagtacgatgagtccgcagaggatgctaatcccgctggagctctcgaggaaattctggaaaatcctgagcgcttaaaggacctggatctggacgccttcgccgaggaactcgagagacagggctatggtgataaacatatcaccctgtatgatattagagcggagctctcatgcagatacaaggacctacggaccgcttaccgcagtcccaacactgaggagatatttaacatgctaaccaaggaaacaccagagactttttacattgggaagttaattatctgcaacgtgaccgggatcgcccataggcgtccccaaggcgagtcttacgatcaggcaattcgcaatgatgagacaggtctgtggcagtgccctttttgccaacaggacaattttccagagctaagcgaagtgtggaaccacttcgactccgggtcttgccccggccaggccatcggtgtgaagactagactggataatggcgtcaccggctttatacccaccaaattcctatctgacaaagtggtcaagcgccctgaggagagagtgaaggtagggatgactgtacattgcaggattatgaaaatagatattgaaaaattttcagccgacttgacgtgccgaaccagtgatctgatggaccgtaataacgagtggaagttgccaaaggatacatattatgacttcgacgctgaggccgccgaccacaagcaagaagaggacatgaagcggaagcagcagagaacgacatatataaaaagggtgatcgctcacccgtcatttcacaatattaacttcaagcaagcggaaaagatgatggaaaccatggatcaaggggacgtgataattcgaccatcatctaaaggtgagaaccaccttacggttacttggaaagtgtccgatggaatttaccagcacgttgacgtcagagaggagggtaaagaaaatgccttctcgttgggcgctactctttggattaactccgaggagtttgaggacttggacgagatcgtggcaaggtacgtccagccaatggccagcttcgcacgcgatttgctgaaccataagtactatcaggattgctcaggcggagatcgcaagaagcttgaggaattgctgattaagaccaagaaagagaaacccacatttataccttactttatttgcgcttgtaaagagttaccaggaaaattcctgttgggctaccagcctcgcgggaagccaagaattgaatacgtgactgtgaccccagaaggatttagatacaggggccagatctttcctaccgtgaacggcctatttagatggtttaaggatcactatcaagatcccgtaccgggcattacgccttccagttcctccaggaccagaaccccagcttctatcaatgcaacacccgccaatataaacctcgccgacctcaccagagctgtaaatgccctgccccaaaatatgactagccagatgttttcggcaatcgcagccgtgacagggcagggtcagaaccccaacgccactcctgcgcagtgggcgtcctcccagtacggatatggcggctctggtggtgggagctctgcttatcatgtttttccaacccctgcgcaacagcctgtggcaactccgttaatgactccctcatattcctacactacaccctcccaacccatcactacacctcagtaccaccagctgcaggcctctacaactccgcagagcgcccaggctcagccacagccaagcagtagttcgagacaacgacagcaacagcctaaaagtaattcccacgccgcgattgattggggaaagatggccgagcagtggcttcaggagaaagaggctgagagaagaaagcagaaacagaggctcaccccccggccctctcctagtccgatgattgagtcgactcctatgtcgatcgccggtgacgcaacgccgctactcgacgagatggacagatag

SEQ ID NO: 136675 - DNA, 2181 bp, Artificial Sequence
  Description of Artificial Sequence: Synthetic coding sequence
atgagtgactttgtggaaagcgaggcagaggaatccgaggaggaatataacgacgaaggagaagtagtgccccgcgtaacaaagaagtttgtggaggaggaggatgatgatgaagaggaagaagaagaaaacctcgatgaccaagatgagcagggtaatctgaaggggtttatcaatgacgatgacgatgaggacgagggcgaagaggacgaggggtccgatagcggtgactccgaggatgatgttggtcacaaaaaaaggaaacggacttccttcgatgacagattggaagatgatgattttgatttgattgaagagaacctcggtgtgaaggttaaaagaggtcagaagtaccgacgcgtgaaaaaaatgtccgacgacgaagacgatgacgaagaggagtatggtaaggaggagcatgagaaagaggccatcgctgaggagatcttccaagacggcgagggagaggagggccaagaagctatggaggcccctatggcccctcccgaggaggaagaagaagatgacgaggagagcgatatcgatgattttatcgtagatgacgacgggcagccactgaagaaacccaaatggcggaaaaagctccccggatataccgatgcagcgctgcaggaagcgcaggagatttttggggtggacttcgactatgacgagtttgaaaagtacaatgagtacgatgaagagctggaggaagagtacgagtatgaagatgacgaagctgagggtgagatcagagtgagacccaaaaagacaactaaaaagcgcgtgagcaggcgctcaattttcgaaatgtacgaaccttccgagttagaatcctcccacctgacagatcaggacaatgagattcgtgctaccgacttgccagaaagatttcaactgaggtctatcccagtgaagggcgccgaggatgatgaactagaggaagaggcagactggatctatcggaatgctttcgccacacctactatcagccttcaagagagttgcgattacctcgaccgcgggcagccggcgtcctctttctctcggaaaggccccagcaccatacaaaagatcaaagaggcccttgggtttatgcgcaatcaacattttgaagtgcccttcatcgctttttatagaaaggagtacgtggagccggaactccacataaatgacctttggcgcgtatggcagtgggacgaaaagtggactcagttacggatccggaaggagaacctgacccgcttgttcgagaagatgcaggcttatcagtatgagcagatttctgctgatcctgataagcctctggcagacggaattcgggcccttgacacaacggatatggagcgcctcaaagacgtgcagtccatggacgaactgaaagatgtatacaaccactttctcctctattatgggcgagatataccgaaaatgcagaatgctgccaaagcgtctcgcaagaagctcaagagggtgagggaagagggggatgaggagggagaaggcgacgaggccgaagatgaagagcaaagaggccccgagttgaagcaggctagccgccgggacatgtatactatttgccaatctgccggtctcgatggcttggcaaaaaagtttggcctgacacccgagcagtttggagaaaacctgcgggatagttatcagagacacgaaaccgaacagtttcctgccgagccacttgagctcgctaaggactatgtgtgtagtcagttccccacgcccgaggccgttcttgaaggcgccagatatatggtcgcattgcagatagccagagagcccttagtccgtcaggtcttacgtcagacttttcaggaacgcgcgaagttaatgacccctagctatagttacaccactccaagccagcctataactaccccgcagtaccatcagctgcaggcaagcactaccccacaatcagctcaggcccagccacagcctagtagtagctccaggcagagacaacagcagccaaaaagtaatagtcacgccgccatcgactggggaaaaatggctgaacagtggttgcaagagaaagaggctgagagaagaaagcaaaaacagagactcactccgcggccatcccccagcccaatgatcgaatccactcccatgtctatcgcaggcgacgccacgccactgttagacgagatggatcggtag

SEQ ID NO: 136676 - DNA, 2361 bp, Artificial Sequence
  Description of Artificial Sequence: Synthetic coding sequence
atgtcattcagtagagccctgctgtgggctaggctgccggctggtagacaggctggtcacagagcggcaatttgctcggctcttagaccacatttcggcccttttcctggagtactgggacaggtgtctgtgctggccaccgcctcgagttccgcatccggcgggtctaaaatcccaaacacctctttattcgttccgctcaccgtcaaacctcagggcccttccgcagacggtgatgtaggtgcagagcttaccaggccactcgacaagaatgaagtgaaaaaagtcctcgacaagttttataaacgtaaggagattcagaagcttggggccgactacgggctggacgcacgactgttccaccaggcttttatcagtttcaggaactatattatgcaatcccattctctggatgttgacatccacatcgtattgaatgatatctgtttcggggctgcacacgcagatgacctgtttcctttcttcctcaggcatgccaaacagatctttcctgtgttagattgcaaggatgatctacgcaaaatatctgacctgcgcattcctccaaactggtacccagatgcccgagccatgcagcgtaagattatttttcactcaggccccactaattctggaaaaacataccatgcaattcagaagtatttcagtgccaagtctggcgtttactgtggccctctgaagttgctagcccatgaaatcttcgagaaaagtaacgcggcaggtgtcccttgtgacctcgtcacaggagaagagcgcgtcaccgtgcagccgaacggaaaacaagcgtcgcatgtctcttgcaccgtcgaaatgtgttccgtcacaacaccttacgaagtggctgttatagatgaaatccagatgatccgtgacccggccagaggatgggcgtggacgagagccctgttaggactgtgcgctgaagaggtgcacttgtgcggagagcctgcagctatcgatctggtaatggagcttatgtatacaactggcgaggaagttgaagtgagagattataagcgattgacacccataagcgtgctcgaccatgctttggaatctctcgataatctgagaccaggggactgtatagtatgcttctctaaaaacgatatctacagtgtatctcggcaaatcgagatccgcggactcgagtccgcagtgatctatgggagcctgccacctgggaccaaactggctcaggctaaaaagttcaacgatcccaacgacccttgcaaaattctggttgccaccgatgcaataggcatgggacttaatcttagtatcaggaggatcatcttttacagcctgatcaaaccctcaataaatgagaagggggagcgtgaactggagcctatcactaccagccaggcccttcagatcgcggggcgggcaggccggttcagttcacggttcaaggagggagaagtgactactatgaatcacgaagatctgagtttgcttaaagaaatactaaagaggcctgttgacccgatcagagccgccggactccaccccactgctgaacagatcgaaatgtttgcctatcacctgccagacgccaccctatcgaacttaatagatatcttcgtggactttagtcaggtcgacggacaatatttcgtatgtaacatggatgacttcaaattctcagcagagttgatccagcacatacctttatccttgcgggtcagatatgtcttttgcacagcacctattaacaagaaacaacccttcgtttgctctagtctgctccagttcgccaggcagtactcccgcaacgagcctttgacctttgcctggttgaggagatatatcaaatggcccctgctaccacctaaaaatatcaaggacctcatggacttggaggcagttcacgatgtgttagatctctatttgtggctatcataccgcttcatggacatgtttccggacgcctccctgatacgagatctgcagaaagagctcgatggcatcatccaagacggagtgcataacatcacaaaacttatcaaaatgagcgaaacccacaaactactgaacctggaagggtttccaagcgggagccaatcccgtctgagtggtactctgaagtctcaggcaagaaggaccaggggcaccaaggcccttggctcgaaggccactgaacccccctcgccggacgctggagaattgagcttggcgtccaggttggtccagcaaggcttgcttacccccgatatgcttaaacagctagaaaaagaatggatgacacagcaaaccgaacacaacaaggagaaaaccgaaagtgggacacatcccaaaggtactcgccggaagaagaaagagccagacagtgattag

SEQ ID NO: 136677 - DNA, 792 bp, Artificial Sequence
  Description of Artificial Sequence: Synthetic coding sequence
atgagcttcagcagagcactcctttgggctaggcttcctgcaggccggcaggcaggccatcgagctgcgatttgctcggcattacggccccattttggcccattccctggagtgctggggcaagtgtcagtgttggctacagcatcctcaagcgcaagcggcggctctaagatccccaacacatccctctttgtacctctgacagttaagccacaagggccatccgctgacggagacgtcggcgcggaattaactagacccctcgataaaaatgaggtcgccgtgattgatgagatacaaatgattagggatcccgcacggggatgggcctggacaagggcccttctgggattgtgtgcagaagaagtgcatctctgcggcgaacctgccgccatcgacctggtgatggagcttatgtacacgacaggcgaagaggtggaagttcgagactacaagaggcttaccccaatttcagtgctggaccacgccttagagtcccttgataacttgaggccaggagactgcatcgtgtgtttctccaagaacgacatatactcagtgagtagacagattgaaattagaggacttgagtccgccgtgatttacggaagcctgccccccggaaccaaacttgcccaggccaagaaatttaatgacccgaacgatccctgcaagattctggtggccactgacgccatcggaatgggcctgaacctaagtataaggcggataatcttttatagtctgatcaagccctctattaacgagaagggcgagcgggagctcgagtag

SEQ ID NO: 136678 - DNA, 1233 bp, Artificial Sequence
  Description of Artificial Sequence: Synthetic coding sequence
atggcagccgtaggagcagaagccagaggagcttggtgcgtgccctgcctggtatccctggacactttacaggagctgtgcaggaaagaaaaactgacttgcaagtcaatcggcattaccaagagaaacctcaacaattatgaggtcgaatacctgtgtgactacaaggtggtcaaagatatggaatactacctcgttaagtggaaggggtggccggacagtacaaacacatgggaacccttgcagaatctgaagtgccccctcctgctacagcagttctcgaatgataaacacaactacttatcgcaggtgaagaaagggaaggctatcactccgaaggacaacaataagacactcaaacctgcaatagccgaatatattgtaaaaaaggcaaagcagcgaattgccttacagcgctggcaggatgagctgaataggcggaagaaccacaaagggatgatttttgtggaaaacaccgtggatctggaggggcccccgtctgacttttactacatcaatgaatataaaccagccccaggtatttccctggtcaacgaggcaactttcggatgcagctgtacagattgcttcttccagaagtgctgccctgccgaagctggagtgcttttggcatacaacaaaaaccagcagatcaagatcccccccggaactcctatctatgagtgcaactcaagatgccagtgtggacccgattgccccaaccgcatcgtccagaagggaactcagtacagtctgtgcattttccgaaccagcaatggtagaggatggggagtgaaaacccttgtcaaaataaagaggatgtcctttgtcatggagtatgttggcgaagtcatcacgtcggaagaagcagagagacgaggccagttttacgataataagggtataacctatttgtttgatctggattacgagtcagatgagttcacggtggatgcagcccgttacggcaacgtgtcacactttgtgaaccatagctgcgaccctaaccttcaagtgtttaacgtgtttatagacaatttggatacccgccttccccgaatcgccctgttctctacgagaaccatcaacgcaggagaagagctgacattcgactatcagatgaaaggctcaggcgacatttcctccgactctatcgatcacagccccgccaagaagcgggtgagaaccgtttgcaagtgtggggcggtgacctgtaggggctatttgaactag

SEQ ID NO: 136679 - DNA, 693 bp, Artificial Sequence
  Description of Artificial Sequence: Synthetic coding sequence
atggccgccgtcggggctgaagcccgaggcgcctggtgcgtgccttgcctcgtcagcctcgacaccctccaggagctctgtcgaaaagaaaagcttacctgcaaaagtatcggcatcaccaagcgcaacttgaataattatgaggtcgagtacctgtgtgactacaaggtcgtgaaggacatggaatactacttggttaagtggaaaggctggccggactcaaccaatacctgggaaccactacagaatttgaagtgccccctgttacttcagcagtttagcaacgacaaacacaattacctgtctcaggtgattacatccgaggaggctgagcgccggggacagttttatgataataagggtataacgtaccttttcgacctagactacgaaagcgacgaatttacggttgacgctgcccgatacgggaacgtgagtcattttgtcaatcatagctgtgaccccaacctgcaggtgttcaacgtgttcatcgataatcttgatacacgactaccaaggattgcactgttcagtacacggaccatcaacgcgggcgaagagctcacttttgattaccaaatgaaaggatctggagacatcagtagcgacagtatagaccacagtccggcaaaaaagcgcgtccgaaccgtatgcaaatgtggagccgtcacttgtcgcggatacttaaattag

SEQ ID NO: 136680 - DNA, 459 bp, Artificial Sequence
  Description of Artificial Sequence: Synthetic coding sequence
atggagtattatttggtgaaatggaaaggctggcccgacagtactaatacatgggagcctttgcagaatctaaaatgccctctgctgctccagcagttttctaacgacaagcacaattaccttagccaggtgatcacgagtgaagaggccgagaggagaggccagttctacgataataagggcattacctatctgtttgacctggactacgaaagcgacgaatttactgttgatgcagcgcgctatgggaatgtgtctcacttcgtcaaccactcttgcgatccaaacttgcaggtgttcaacgtgttcattgacaacctggacacccgactgccacggatagccttattcagcactagaacaattaacgctggcgaggagcttacctttgattaccaaatgaagggatctggagacattagctccgattcgatcgaccattcacccgcgaagaaatag

SEQ ID NO: 136681 - DNA, 1053 bp, Artificial Sequence
  Description of Artificial Sequence: Synthetic coding sequence
atggaatactacctggtcaagtggaagggctggcctgattctacgaacacatgggaacctctgcagaacctgaaatgcccattactgcttcagcagttctcaaacgataagcataactacctgtcccaggtgaagaagggtaaagcgatcactccaaaggataacaataagactcttaagcccgcgattgccgagtatattgtaaagaaagctaagcagcgcatcgccctgcagaggtggcaggatgaactgaacaggaggaagaaccataaagggatgatctttgtagagaacaccgtggacctggaaggccctccttccgacttctattatataaacgagtacaagcctgctcctggaattagtctcgtgaatgaggcaacattcggatgctcctgcactgactgcttcttccagaaatgttgcccagccgaagccggggtgcttctcgcatacaataaaaaccagcaaatcaaaattccccccggtacaccaatttacgaatgtaactcccgatgccagtgtggccctgattgtccaaaccgtattgtccagaaaggaactcaatactcgctgtgtatcttccgcacgagtaatggacgcggctggggcgtaaagactctggtgaagataaaaaggatgtcctttgtgatggagtacgttggcgaagtgatcacatctgaagaggcagagagacggggtcagttttatgataacaaggggattacctatctctttgaccttgattacgaaagcgatgaattcaccgttgatgccgcaaggtatggcaacgtttcgcatttcgtaaatcactcttgcgaccctaatttgcaagtcttcaatgtgtttattgacaatctggatacaagacttccacggattgccctattcagcaccagaaccatcaacgccggtgaggagcttacattcgactaccagatgaaagggtctggcgatatttcctcagatagcatcgaccactctcctgctaagaagagagtgcggacagtgtgtaagtgcggcgcagtcacatgccgcggatatcttaattag

SEQ ID NO: 136682 - DNA, 2658 bp, Artificial Sequence
  Description of Artificial Sequence: Synthetic coding sequence
atgaaatggctgggcgagtctaaaataatggtagtcaatggcagaaggaacgggggcaagctctcgaacgatcaccagcagaaccagagtaagctacagcacactggcaaagatacactaaaggcaggcaaaaacgcggtggagaggcgaagtaaccgatgcaatggaaatagcggattcgaagggcagagtcgttatgtgcctagctcagggatgagtgccaaggagctttgtgagaacgacgacctggccactagcctggtattagatccttatctaggcttccagacacataagatgaatacatccgctttcccatccaggtcttcaagacattttagcaagtcagatagtttcagccacaataaccctgtccgatttagacccatcaaagggcggcaggaagagttgaaggaagtgatcgagcgtttcaaaaaagacgaacacctggagaaagcgtttaagtgcctgacatctggcgagtgggctagacattatttcttaaacaaaaacaagatgcaggagaagctgttcaaggagcatgtgttcatttacctcaggatgttcgctacagacagtggctttgaaatcctaccgtgcaatcgctactcctccgaacagaacggggcaaaaatcgtggcaactaaggaatggaagaggaacgataagattgaactgcttgtggggtgtatagctgaactctctgagatagaggaaaatatgttgctcaggcacggtgagaacgattttagcgtgatgtacagcacccggaagaactgtgcacaactgtggctgggccctgcagcatttattaaccacgactgtcgtccaaattgtaaattcgtgtccactggcagagatacagcatgtgtaaaggccctccgcgatatagagccaggagaggaaatcagttgctattatggggatggctttttcggcgagaacaacgagttctgcgagtgctacacttgcgaacgcagaggaacaggagcctttaagtcacgggtcggcctccctgcaccagcccctgttatcaactcaaaatacgggctgagagaaaccgacaaaaggctcaaccggttgaaaaagctgggagacagtagcaagaacagtgactcccagtccgtgagctctaacactgacgcggataccacacaggagaagaataacgctacttccaataggaagtctagcgtcggagtgaaaaaaaacagtaagtccagaacactgactaggcagtccatgtccaggatacctgcttcctccaactcgacaagctcgaaacttactcacattaataacagcagagtgccaaagaaactgaaaaaaccggcaaagcctctgctgtccaagatcaagctgcgtaatcattgcaaaagattagagcaaaagaatgctagccgaaaactggaaatggggaatttagtgctcaaagagcctaaggtggttttgtacaagaatttaccaatcaaaaaagataaagagcccgaaggtcccgcacaagccgccgtcgctagtgggtgtctcacacggcatgccgcccgagaacataggcagaatcctgtgagaggagcccatagccagggagagtcatcaccctgtacatacatcaccaggaggtccgttcggacgaggaccaacttaaaagaggcttccgacataaaattagaacccaacactttaaacggttataagtcctccgtcactgaaccctgtcctgactccggagaacagctgcaacctgcacccgtgctccaggaagaggaactcgcccacgaaactgcacagaagggagaggccaagtgccacaaatccgacacaggtatgtcaaagaagaagtctagacaggggaagctggtgaagcagttcgcaaaaatcgaagaatcgactccagttcacgactccccaggcaaagacgacgcagtcccggatctgatggggcctcatagtgaccagggagagcactcaggaaccgtcggcgtgccagtatcttatacagattgcgcaccctcccctgtgggctgctcagttgtcacctctgacagctttaaaactaaagactctttccgcaccgcaaagagcaagaaaaaaaggaggattactcgatacgacgcacaattgatcctcgagaataattctggaattcccaagctcactctccgccgaaggcacgacagcagctctaagacgaatgatcaagagaacgacggaatgaattcctcaaagatcagcataaagctgtcaaaggatcacgacaacgataacaatttgtatgtagccaaacttaacaacggcttcaactcgggctccgggtcatcgtccactaagctgaaaatccagttaaaacgcgatgaagaaaacagagggtcctatactgaaggcctgcatgaaaacggggtgtgctgcagcgatcctctcagtctcttggagtccaggatggaagtcgacgattactcacaatacgaggaggagagcaccgatgactcctcatctagcgagggcgatgaagaggaggatgactacgatgatgacttcgaagacgattttatccccctgcctcccgcaaagcgccttaggttgatagtggggaaggattctattgatattgacatcagcagccgcaggcgggaggaccagtctctccgccttaacgcttag

SEQ ID NO: 136683 - DNA, 1182 bp, Artificial Sequence
  Description of Artificial Sequence: Synthetic coding sequence
atgaagtggttgggtgagtccaaaatcatggtggtcaacggacggcgaaatggcgggaagcttagcaatgaccatcagcagaaccagtctaagctgcagcacactggtaaggacactctgaaggctggaaaaaatgccgttgaacggcgaagcaatagatgcaatgggaactctggcttcgaggggcagtctaggtacgtcccttcatctggaatgtccgctaaggagctgtgtgagaatgatgacttggccacttcactggtcctcgacccctatctgggattccagacccataagatgaacacgagtgcatttcctagcagaagctcacggcacttttctaagtctgactcgttctctcataataaccccgttcgttttcggcccatcaagggacgtcaggaggaactgaaagaggtgatcgagcgcttcaagaaggacgagcacctggagaaggcctttaaatgccttacctccggagagtgggcccgccattacttccttaataaaaacaagatgcaggagaaactgttcaaggaacacgttttcatttatctgcggatgtttgcaactgatagtggcttcgagattcttccatgtaatcggtacagttcagagcagaatggagccaaaattgtggcaacaaaggaatggaagaggaatgataagatcgaactgcttgtggggtgtatcgcagagctgagcgaaatcgaagagaatatgctgcttcgccacggtgaaaacgatttttcagttatgtacagtacgcgaaagaactgtgctcagctgtggctggggccagcggcttttattaatcatgactgtaggccaaactgtaagttcgtgagtacaggcagggacacggcctgtgtgaaagcactgcgggacatcgagcccggtgaggaaatttcctgttattacggtgatggcttctttggtgagaacaatgagttctgtgagtgctacacgtgcgagcggcgtgggacgggcgctttcaaaagtagggtgggtctgcctgctcccgccccagtgattaattctaagtatggattacgcgagactgacaaaaggctgaatcggctcaaaaaactcggggattcatctaaaaattctgacagccagagcgtgagtagcaacaccgatgcagatacaacccaagagaaaaataacgcctcaaaatag

SEQ ID NO: 136684 - DNA, 1182 bp, Artificial Sequence
  Description of Artificial Sequence: Synthetic coding sequence
atgaagtggctgggagaatccaaaattatggtcgttaacggcaggcggaatgggggcaaactgtccaacgaccaccaacagaaccaatctaagctccagcatacaggcaaggacacacttaaggccggcaagaacgccgtggaacggcgttctaatcggtgcaacgggaattcaggctttgaaggtcagtcgcgctacgtgccgagcagcgggatgtccgccaaggagctgtgcgagaatgatgatctggctacgagtctcgtcctagatccctacctcggatttcagactcataagatgaacaccagcgctttcccttcgcgctcaagcaggcacttttctaaatctgacagtttctctcataacaacccagtgcggtttcggcctatcaagggaaggcaggaggagctgaaggaggtaatcgaacgatttaagaaggacgaacatcttgaaaaggcctttaaatgccttactagcggcgaatgggctcggcattatttcctgaataagaacaaaatgcaggaaaagctgttcaaggagcacgtatttatttatcttagaatgtttgccactgactccggtttcgagatactcccttgtaatcggtattccagcgagcagaacggtgccaaaatcgtagcaacaaaagagtggaagcgcaatgacaagattgaactcctcgtcggctgtatcgcggagttgagcgagatagaggaaaatatgctcttgcggcatggagagaatgacttttcagtgatgtattccacaagaaagaattgtgcccagctttggctaggcccagccgcttttatcaatcacgactgtcggcctaactgtaaattcgtttctacagggcgggataccgcatgcgtgaaagctctgagagacatcgaacctggagaggaaatctcttgctattatggcgatggcttttttggggagaacaacgaattctgcgaatgctacacttgtgagcgtaggggaacaggcgcattcaaatcccgcgtgggcttgccagccccagcaccagtgatcaattccaaatatggacttcgggagactgacaaacgactaaatcggttgaaaaaattgggggattcctcaaagaattcagactcccaatcagtctcctctaatacggacgccgacaccactcaagaaaaaaacaatgccagcaaatag

SEQ ID NO: 136685 - DNA, 357 bp, Artificial Sequence
  Description of Artificial Sequence: Synthetic coding sequence
atgaagtggcttggagaaagtaagatcatggttgtgaacggccgcaggaacgggggcaaactgagtaacgaccaccagcagaatcaatctaaattgcagcacaccggaaaggacaccctgaaagctgggaaaaacgccgttgaaaggaggtcaaatagatgcaatggcaattctgggttcgaaggtcagtccagatacgtaccatctagtggcatgtccgccaaggagctgtgcgaaaatgacgaccttgctactagcttagtactggacccatacctcggctttcagactcataaaatgaacacaagcgccttcccttctcgatcctctagacacttcagcaagtccgatagctag

SEQ ID NO: 136686 - DNA, 1389 bp, Artificial Sequence
  Description of Artificial Sequence: Synthetic coding sequence
atgggacctgatagggttacagcccgagagctgtgtgagaacgatgacctggctacctcattagtgctcgatccttatctagggttccgcacccataaaatgaatgtgtcacccgttcctcccctgaggcgacagcagcacctgcggtctgcacttgagacgttcctcaggcagcgggatctggaggctgcatatagagctctgaccctcggcggctggacagcccgttactttcagagcagaggccctagacaggaagcagcccttaaaacccacgtatacagatatctacgcgccttcctccctgaatcaggctttaccattctcccgtgcactcggtattctatggaaactaatggtgcaaagattgttagtaccagagcgtggaagaagaacgaaaaactcgagcttttggttggttgtatcgcagagctgagggaagctgatgaaggcctcttgcgagccggtgaaaacgatttttcgatcatgtactctaccagaaagagatcggcgcagctgtggttgggacccgcggcatttataaatcacgactgtaagccaaattgtaagtttgttccagcagacggcaatgcagcctgtgtcaaagtgctccgggacatagagcctggagacgaggttacctgcttctacggcgaaggtttctttggggaaaagaacgagcattgcgaatgccacacatgtgaacgcaaaggggagggagcattccgcacccgtccccgagaaccagccctgcctccacggccactggacaagtaccagctgcgggagaccaagagacggctgcagcagggacttgacagcggttccagacaggggctgttaggcccccgagcgtgtgttcacccctctccacttcgcagagatccattctgcgctgcttgccagcctttgcgcctgcccgcatgctccgcacgcccagatacctcccctctgtggctgcagtggttgcctcagccacagccaagggtgcgtccaagaaagcggcgccgacctcgcccacgtcgggcccctgtgctcagcacccaccacgccgcccgcgtttcattgcaccggtgggggggttgtgggccacattgccggctgcggggggaggcgctggtggccctgggccagccacctcacgctcggtgggctcctcagcaggactggcattgggctcggagatacgggctgccatatgtcgttcgggtcgaccttaggcggctcgccccagcccctccagcgacacccgctccagcaggaacaccaggacccatcctaatcccgaagcaagcgctcgccttcgctcccttctctccacctaaaagattgcgacttgtagtgtcacacggtagtatcgacttggatgtcggtggggaggagctctag

SEQ ID NO: 136687 - DNA, 390 bp, Artificial Sequence
  Description of Artificial Sequence: Synthetic coding sequence
atgcccagacggggccggtggctgtcctgcagcccagaagcggagggtataagaagagtaggtagccgtgccgccttgagagtacatccattagagcaccgcccccgatggggtactccaggaggcatgacaaaaggatcccgtttcctcgcaccggagtccgagctgtcttgggggcccggcgacgcaacccccggcctttggtttttcattagtgacggggtcggcgaggacctgtggaattccgctggctggagttcggtgccagagggatttggacaacgcatgagaggtccaggcctgacgccccacacagatgcagggggcgatggcaacaaaaggaggcactctgaacggctgtgcagagcatctgtcctccaacccccatag

SEQ ID NO: 136688 - DNA, 744 bp, Artificial Sequence
  Description of Artificial Sequence: Synthetic coding sequence
atgcacctggcgcgactcgtgggatcatgttccctgttgctccttctgggcgccctgtccgggtgggccgcatccgacgaccccattgaaaaagtgattgaaggtatcaatagggggctgtcaaatgcagaacgcgaagtgggaaaggctttggacggcatcaatagcggcatcactcacgccggacgagaggtggaaaaagtgtttaacggactctcaaatatgggttcccataccgggaaagaactggataagggggttcagggactgaatcatggaatggataaagtggcccatgagattaatcatggtattgggcaggcaggcaaagaagccgagaaactcggacacggagtgaacaacgccgctggtcaagcagggaaagaagctgacaaggccgtgcagggctttcacaccggtgtccatcaggcgggcaaagaggccgaaaagctgggacaaggcgtcaatcacgcagctgaccaggccggcaaggaggtggagaagcttggtcaaggtgcccatcatgctgcgggacaggccggcaaagagctgcaaaacgcccataacggcgttaaccaagcctcaaaggaagctaatcaactccttaatggcaatcaccagagtggatctagttcccatcaggggggggcgacaaccacgcccctggctagcggggcttcagtgaataccccattcattaacctgcctgcactgtggagatccgtggccaacatcatgccttag

SEQ ID NO: 136689 - DNA, 1773 bp, Artificial Sequence
  Description of Artificial Sequence: Synthetic coding sequence
atgcatctcgccaggctggtggggagctgcagcctcctgctcctacttggagccctgtcgggctgggcagcctccgatgatcctatcgaaaaagttattgaagggatcaaccggggtctcagcaacgctgagagagaagtgggcaaggccctggacggaatcaattccgggattacacacgccggtagggaagtggaaaaggtctttaacggtctttcaaatatgggctctcacactggtaaggagttggataaaggggtgcaggggctgaaccatggaatggataaggtcgcccatgagattaatcatggaataggccaagcaggcaaagaagctgagaagctgggccacggtgtgaataatgcggccgggcaagtggggaaggaagccgacaagctgatccaccacggggtgcatcacggagcaaaccaggcggggtccgaggcaggcaaattcggacaaggggtggacaacgctgcaggtcaggctggtaacgaagcgggccgtttcgggcagggagtacatcatgccgcagggcaagccgggaatgaggcagggcgatttggccagggcgtacatcacgcggctggtcaggccgggaacgaagcaggccggttcggacagggcgcacatcacgggctgagcgaaggctggaaggagaccgaaaagtttggccaggggatccaccacgccgccggacaggttggcaaagaggccgaaaaattcggtcagggtgcccaccatgcggcaggtcaagcaggaaacgaggcaggtcgtttcggacagggtgtacaccatggcctgagcgagggctggaaggaaacagaaaagttcgggcaaggagtccaccacacagcaggccaggtaggtaaggaggcagagaaatttggccaaggggcccatcatgccgccgggcaggctggcaatgaggccggtcgatttggccaaggcgcacaccacgctgctggacaagcaggaaacgaggccggtaggttcggacaaggggtccatcatggtttgtcggaaggctggaaagagacagaaaaattcggccagggggtacatcatgccgcttcacagttcggaaaagagaccgagaagttagggcatggcgtgcaccacggagtgaatgaggcctggaaggaggcagagaaatttggtcaaggcgttcaccacgcagcaagccaggtggggaaggaggaggaccgggttgtacaaggcctccatcatggcgtcagccaagccggaagagaggcaggccagtttggtcacgacattcatcataccgcgggacaggccggcaaggagggggatatcgcggtgcatggagtccaaccaggcgtgcacgaggccgggaaagaggccggccagttcggtcagggagtgcatcatacccttgagcaggccggaaaagaagccgacaaggccgtgcagggatttcatactggagtgcatcaggccggaaaggaggctgagaagttgggccagggtgtcaatcacgctgccgatcaggccgggaaagaagtggaaaaactcggccagggagctcaccatgccgctggacaggccgggaaggagcttcagaatgcgcataatggggtgaatcaggcttctaaggaggcgaaccagctcctgaacggcaatcatcagtcaggaagctcttctcatcaggggggcgccacgaccactcccctggcaagtggggcctctgttaatacacccttcattaatctgccagccctgtggaggagcgtggccaatataatgccctag

SEQ ID NO: 136690 - DNA, 288 bp, Artificial Sequence
  Description of Artificial Sequence: Synthetic coding sequence
atgggctcccacaccgggaaggagctcgacaaaggggtccagggactgaaccacggcatggataaggtcgcgcacgaaataaatcatggcattgggcaggctggtaaagaagccgaaaagttgggccatggagtgaataacgccgccggacagggcaatcaccagagtggctccagttcacaccagggtggcgcgaccaccactcccctggctagcggcgcctccgtgaacacacctttcatcaacttacctgccttatggcggagcgttgctaacatcatgccttag

SEQ ID NO: 136691 - DNA, 738 bp, Artificial Sequence
  Description of Artificial Sequence: Synthetic coding sequence
atgtggttatgtcccctggccctgaatttaatattgatggcagccagtggagcagtctgtgaagtgaaagatgtttgcgtcgggtcccctgggatccctgggaccccaggtagccacgggctgcccggtagagacggaagagatggcttaaagggggatcctggccccccgggcccgatgggaccaccaggcgagatgccttgtccgccggggaatgacggcctgcccggcgcaccgggaatacccggtgagtgcggagagaaaggagagcctggcgagcggggaccacctggcttgcctgcccatctggacgaggaactccaggcaactctgcatgattttcgccaccaaatactgcaaacgcgtggggctctgagccttcaggggagcattatgactgtcggagaaaaagtcttttcaagcaatggacagagcatcacgttcgacgccatccaagaagcatgcgcacgcgcaggcggtaggatcgcggtacctcgcaaccccgaggagaacgaggctatcgcctctttcgtaaaaaagtacaacacttacgcctatgtggggctcacagagggaccgtctccaggggactttagatattcagatggcacccctgtgaactacaccaactggtatagaggcgagcccgcaggccgcgggaaagaacaatgcgtggagatgtacactgatggacagtggaatgaccgcaactgcctatactcccgactgaccatctag

SEQ ID NO: 136692 - DNA, 570 bp, Artificial Sequence
  Description of Artificial Sequence: Synthetic coding sequence
atggggcctccaggtgaaatgccatgcccccccggcaatgatggactgcccggagcccctggcattcccggcgagtgcggcgagaaaggagaacctggcgagaggggaccgccgggacttcctgcacacttggacgaagagttgcaggcaaccctgcacgactttcggcaccaaatattacaaacgagaggcgcgcttagcttacaaggtagcatcatgacagtcggggaaaaagttttctcaagtaatgggcagtcgattacctttgacgcaatccaagaagcatgtgctagagctggggggcggatcgcagtgcctagaaatcccgaagagaatgaagctatcgcaagcttcgtaaaaaagtacaatacctatgcgtatgtcggactgaccgagggtccaagtccaggggacttcagatatagcgacggcacacccgtgaactacacaaactggtatcgaggggagcccgctggcaggggaaaagagcaatgtgtagaaatgtacactgatggccagtggaatgaccggaattgcctgtacagccgactgaccatctgcgaattttag

SEQ ID NO: 136693 - DNA, 747 bp, Artificial Sequence
  Description of Artificial Sequence: Synthetic coding sequence
atgtggctttgccccctggccctgaacctaatcctgatggctgcttccggcgccgtgtgcgaggtgaaggatgtttgtgtgggctccccaggcattcctggcacgccaggttcacatggactcccgggacgggatgggcgcgatggcttaaaaggtgatcctggaccgcctggaccaatgggacccccaggcgagatgccatgcccaccaggaaatgacggcttgcccggggcccccgggatacccggcgaatgcggggagaagggtgagcctggagaacgtggtcctccgggactcccagctcaccttgacgaggagttgcaggccactcttcacgatttccggcaccagattctacagacaagaggcgccctcagtcttcagggaagtattatgaccgtcggcgagaaggtgttctcctccaatggacagagcataaccttcgatgctattcaggaagcctgtgcacgggcaggcggcagaatcgctgtacccagaaatccagaggaaaacgaggccatcgcatcgtttgtgaagaagtacaacacatatgcatatgtggggttgacagagggacctagtcctggtgattttaggtactctgatggtaccccagtcaattacacaaattggtaccgaggcgaacccgcgggtaggggtaaagagcaatgcgttgagatgtacaccgatggacaatggaatgaccgcaactgtctctatagcaggttgactatctgcgagttctag

SEQ ID NO: 136694 - DNA, 747 bp, Artificial Sequence
  Description of Artificial Sequence: Synthetic coding sequence
atgtggttatgccctttagctttgaatctgatcctgatggccgccagcggcgctgtttgcgaggtaaaagatgtgtgtgtcgggtcacctggaatccccggtacccctgggtctcacggattaccaggcagggatggccgagacgggttgaaaggagatcctgggcccccagggcctatggggcctcccggggaaatgccttgtccacccggtaacgacgggttacctggagctcccgggatccctggagagtgcggggagaagggcgaacccggtgaaagaggacccccagggttgccagcgcatctggatgaggagctccaagcgacactacatgacttcaggcaccagattttgcagacacggggggctctaagccttcaaggctctatcatgactgtcggcgagaaggtgttctcctctaatgggcagagtattacatttgacgccatccaggaggcctgtgccagggcgggcggacggatcgccgttcctagaaaccctgaggaaaatgaggcgatcgcgtcttttgtgaagaagtataatacctacgcatacgtgggactgactgaaggcccatctcctggagatttccgttatagtgacggcaccccagtcaattacacaaactggtatagaggcgaacccgctgggcggggcaaggagcagtgtgtggagatgtataccgacgggcagtggaatgatcgtaactgcctctactcacggttgaccatttgcgaattttag

SEQ ID NO: 136695 - DNA, 792 bp, Artificial Sequence
  Description of Artificial Sequence: Synthetic coding sequence
atgagaccatgtcaggtgcccggtgccgctaccggccctagggccatgtggctttgtccactggctctcaatctgattttaatggcagcgagtggcgccgtttgtgaggtgaaggacgtctgcgtcggcagccccgggatccccgggacccctggaagtcatggcttacctggccgagacggccgagacggattgaagggagacccagggccgcctggccctatgggcccaccaggagaaatgccatgccctcctggcaacgatggcctccctggtgcccctgggataccaggagaatgtggtgagaaaggcgagcctggggaaagaggaccgccggggctccctgcccatctcgatgaggagcttcaagcaaccttgcacgattttcgtcaccagatcctccagacacgcggcgcactgagcctgcagggctcgattatgactgtgggcgaaaaagtcttttcctcgaacgggcaatccattactttcgacgccattcaggaggcgtgtgctcgtgctggcgggagaatagccgttccacgcaaccccgaggaaaacgaagcaatagcatcttttgtcaagaaatacaatacttacgcttatgtgggcctaaccgaggggccctcccctggagattttagatacagcgatgggacccccgtgaattacactaactggtaccggggcgagccagctggccgggggaaagagcagtgcgtcgagatgtacacagacggccagtggaacgaccgaaattgcctgtactcccgcctgacgatctgtgagttttag

SEQ ID NO: 136696 - DNA, 747 bp, Artificial Sequence
  Description of Artificial Sequence: Synthetic coding sequence
atgtggctttgccccctggccttgaacctgattcttatggccgctagtggcgctgtttgtgaagtgaaagacgtgtgcgtaggctctcccggaatacctggcactcccggatcacacgggctgccaggtagggacggtcgcgacggcctgaaaggcgaccccggaccacctggacccatggggcctccaggtgaaatgccctgtccgcctggtaacgacggcctacccggcgcgcctggaatacctggcgagtgtggggagaagggagagcctggagaaagaggcccccccgggctcccagcccacctggacgaagagcttcaggccactctgcacgatttcagacatcagatcttgcagacacggggcgcactgagtctgcaggggagtataatgactgtgggagagaaagttttctctagtaacggtcaaagcatcacgttcgatgcaatacaggaggcatgcgccagagccggtgggcgcatcgccgtccctagaaacccagaagaaaatgaggcaatcgcttccttcgtcaagaagtataacacgtatgcctatgttgggctgacagaggggcctagcccaggggacttcaggtactctgacggaacaccggttaattatactaactggtatcggggagagcccgccggccgaggcaaggagcagtgcgttgagatgtatactgatggacagtggaatgaccggaattgtttatactcccgtctgaccatttgtgaattctag

SEQ ID NO: 136697 - DNA, 477 bp, Artificial Sequence
  Description of Artificial Sequence: Synthetic coding sequence
atgtggttatgtccccttgccctgaacctgatcctgatggcagcatctggcgccgtctgtgaagttaaagacgtgtgcgtcggctctcccggcatccccgggacaccaggttcacatgggctccctgggagagatggccgcgacggactcaagggcgaccccggtccaccaggacctatgggtccaccaggagagatgccatgtccccctggtaatgacggcctgccaggggcacctggaatacccggcgagtgtggcgagaagggggaacccggagagagaggtccacccgggctaccagcccacctcgatgaagagctgcaggccaccctgcatgattttcgccaccagattttgcagactcgcggagctctgtccttacagggaagtattatgaccgtcggggagaaagtcttctccagcaacggccaatctattacctttgacgccatacaggaagcctgcgccagggcttag

SEQ ID NO: 136698 - DNA, 477 bp, Artificial Sequence
  Description of Artificial Sequence: Synthetic coding sequence
atgtggctgtgtcctctggccctgaaccttattctgatggcagcctctggcgctgtttgtgaggttaaagatgtgtgcgttgggtcaccaggaatccccggtacacccgggtcacacggtttgccaggaagggatggtcgggacgggttaaaaggcgacccaggcccccctggcccaatgggtcctcccggggagatgccttgcccgccaggcaacgacggactcccaggagctcccggcatccctggcgaatgtggcgaaaagggcgagccaggagaaaggggcccccccggtttacctgcccatcttgacgaagagctccaagccacattgcacgattttaggcaccagattctgcaaaccagaggcgctttgtctctgcaggggtccataatgactgtcggtgaaaaggtcttttcaagcaacggacagtcaattaccttcgatgctatccaagaggcatgtgccagagcttag

SEQ ID NO: 136699 - DNA, 747 bp, Artificial Sequence
  Description of Artificial Sequence: Synthetic coding sequence
atgtggctgtgtccacttgccctaaccctgatcttaatggccgcatccggtgcagcatgtgaagtgaaggatgtgtgtgtaggcagtcccggcatcccggggacaccaggatcacatggccttcctgggcgtgacggccgagacggggtcaaaggcgaccccggccctccaggccccatgggaccacccggcgaaacgccgtgcccgcctggcaacaatgggttgcctggagctccgggtgtgccaggcgaacggggtgagaagggcgaggccggggaacggggccccccgggattgcccgcccatcttgatgaagaactgcaggccacactgcatgacttcaggcaccagatcctacagactagaggtgccctgtcccttcagggtagcatcatgacagtgggagaaaaggtgtttagttcaaatggacaaagcattaccttcgatgcaatccaggaagcctgcgcaagggctggaggaagaatagccgtcccccgtaaccccgaagagaatgaggcaatagccagcttcgtgaagaagtataatacctatgcctacgttggcctgacagaagggcctagccctggcgactttaggtattcggacggcaccccggtcaactacactaactggtatcgcggggagcctgccggcagagggaaagagcaatgtgtggaaatgtatactgatggccagtggaacgatcgcaattgtctttacagtcgcctgactatatgcgaattttag

SEQ ID NO: 136700 - DNA, 747 bp, Artificial Sequence
  Description of Artificial Sequence: Synthetic coding sequence
atgtggctgtgtcccctcgctctgaccctcatcctcatggcggctagtggtgccgcctgtgaagtaaaggatgtgtgcgttggtagcccaggaattcccggcactcctggaagccatggcctgcccggcagagacgggagggacggtgtcaaaggggatcctggacctcccggccctatggggccaccaggggaaacgccttgccccccaggtaataatggtttgcctggcgcccccggcgtgcccggagaacggggcgaaaaaggagaggcgggggagaggggacctcctgggcttcctgcccaccttgatgaggagttgcaggcaaccctgcatgattttagacatcagattcttcagacacgaggggccttgtctctccagggatccattatgactgtgggcgaaaaggtcttctccagtaacgggcaatccattacgtttgacgccatccaggaagcctgtgctcgggcagggggccgcatcgcagtgccccgaaatccagaggagaacgaagcgattgcaagctttgtcaagaagtataacacctacgcatacgtcggtctgaccgaggggccctcccccggggacttcaggtatagcgatgggacccctgttaactacaccaactggtataggggggagccagccggccgtggcaaggagcagtgcgtcgagatgtatacagacggccaatggaacgatcggaattgtctctattcaagactaactatctgcgagttttag

SEQ ID NO: 136701 - DNA, 477 bp, Artificial Sequence
  Description of Artificial Sequence: Synthetic coding sequence
atgtggctgtgtccattggcactaaccctgattcttatggccgcctctggggccgcctgcgaggtgaaggatgtgtgcgtcggatcacccggtattccaggaacaccaggctcccatgggttgccgggccgggatgggcgagatggcgtaaagggagatcccggaccccctggacctatggggccgccaggcgagactccttgccccccaggcaacaatggcttgccgggggcaccaggcgtgccaggggaaagaggggagaagggggaagctggcgagaggggccctcccggtttaccagctcatctcgatgaagaactgcaggcaacgctgcacgactttcgccaccagatcctgcagacacgcggcgccctttcgctccaaggctctattatgacagttggagagaaggtttttagcagcaacggccagtctatcacctttgatgccatccaggaggcttgtgcaagggcttag

SEQ ID NO: 136702 - DNA, 645 bp, Artificial Sequence
  Description of Artificial Sequence: Synthetic coding sequence
atgaggccctgtcaggttcccggcgctgccacaggacctagggctatgtggctgtgccctttagctttgacacttatccttatggccgcttctggagccgcatgtgaggttaaagatgtgtgcgtgggctcccccggcattccaggaaaacggggagagaaaggcgaagccggcgagaggggcccccccgggctgcccgcccacttggacgaggaattgcaggccacgctacacgattttaggcaccagatcctgcagactcgtggagctttgagcctccaaggcagcattatgaccgtgggcgagaaggtcttctcctctaatggccagtctataacttttgatgccatacaagaagcttgcgcaagagccgggggccgcatcgctgtcccacgtaatccggaagaaaacgaggcaattgcctcctttgttaagaagtacaatacttacgcatatgtggggctgactgaaggaccatcccccggtgacttccgttactccgatggaacccccgtcaattataccaattggtataggggggaaccagctgggaggggtaaggaacagtgcgtcgagatgtacactgatggacagtggaacgataggaattgcctgtatagtcgcttgaccatttgcgagttttag

SEQ ID NO: 136703 - DNA, 1146 bp, Artificial Sequence
  Description of Artificial Sequence: Synthetic coding sequence
atggctgaatctcacctgctgcagtggctgctgcttctcctacccactctctgcggacctggtactgccgcctggaccacttcgtcactggcttgcgcgcaaggtcctgaattttggtgtcagtccttggagcaagccttgcagtgtcgggccctcgggcactgtctccaggaggtgtggggtcacgtgggagcagacgatctctgccaggaatgcgaggacattgtgcatatactcaataagatggcgaaggaagccatctttcaggatacgatgagaaaattcttggaacaggagtgcaacgtgctgccattaaagctgcttatgcctcagtgtaaccaggtgctagatgattatttcccactggtgattgattattttcagaatcagacagatagcaatgggatttgcatgcatctgggcctgtgtaagtcccggcagcccgagcccgaacaagagcccggtatgtccgatcctttgccgaagccactccgagatccactgccggaccccttgctcgataagttggtgttgcccgttttgccgggagccctgcaagccagacccggtccccatactcaggatctaagcgagcagcagttcccgatcccgctgccctattgctggttgtgccgggccctgatcaaaaggatacaggcaatgatccccaaaggggcactggccgtggcagttgcccaagtttgccgcgtggtgcccctcgtggccggcggcatctgtcagtgtcttgcagagaggtatagcgtgatattgctggacactttattgggtagaatgctgccacagctcgtatgcaggctcgttctgagatgcagcatggatgattcagccggcccccgaagccccaccggtgaatggctgccccgggattccgagtgccacctgtgtatgtcagtcaccacccaggcaggaaactctagcgaacaagccatccctcaggccatgctgcaggcatgtgtaggctcatggttggaccgcgaaaagtgcaagcagttcgtggagcagcacacaccccaattgctgaccctggtgccgagggggtgggacgctcacacgacatgccaggcgttgggcgtgtgtggtaccatgagctctcccctgcaatgcattcattcacctgatctgtag

SEQ ID NO: 136704 - DNA, 1128 bp, Artificial Sequence
  Description of Artificial Sequence: Synthetic coding sequence
atgttactgtttcttctgtccgccctggtgctgctcactcaacccctcggatacttggaagctgagatgaaaacatatagccatagaaccatgccgtctgcgtgcaccctggtgatgtgctcttccgtcgagtctggcctgcctgggcgcgacgggcgcgacgggcgcgaaggacccagaggggagaaaggggaccccggtctgcccggcgccgccggccaagccgggatgccagggcaggctggccccgtgggcccaaaaggcgacaatggatccgtgggtgagcccgggccgaagggggacactgggccatctggcccgccgggtccgccaggagtccctggccccgcaggtcgcgaaggcccactaggaaaacagggcaatatcggtccccaaggtaagcccggtcctaaaggcgaggcaggaccgaaaggagaagtgggcgcccccggaatgcagggcagcgccggagcccgcggcctggccggacctaagggcgaaaggggggttcccggtgagcgaggagtgcctggtaatactggggcagccggtagcgcgggcgcaatggggcctcagggctctcccggcgccagaggccccccgggcctcaagggcgataagggcatccccggagataagggcgccaagggcgagagcgggctgcctgatgtggcaagtctgcgccagcaggtcgaggctctccagggtcaggtccaacacctgcaggcagcctttagccagtacaaaaaggtggagttgttccccaacgggcagagcgtgggggagaagatcttcaagacggcagggtttgtaaagcctttcactgaagcccagctgctctgcacacaggccggaggacagcttgcgtcgcctagaagcgccgcagaaaacgcggccctgcaacagctagttgtggcaaagaatgaggccgcctttttatcaatgacggacagcaagacagagggtaagtttacctaccccaccggcgaaagcctagtatactccaattgggcccccggggagccaaacgatgacggtgggtcggaagactgtgtggagatcttcaccaacggcaagtggaatgatagagcctgtggcgagaagaggcttgtagtatgcgagttttag

SEQ ID NO: 136705 - DNA, 657 bp, Artificial Sequence
  Description of Artificial Sequence: Synthetic coding sequence
atgttcttgtccactagcaagcacggacgtcaagaagcgatgttattattcctcctgagcgctttggtcctgctgactcagccactcggctacctggaagctgaaatgaagacctatagccaccgcactatgccctccgcctgtactctcgtgatgtgctcttccgtagaaagcggactacccgggcgggacggaagagatgggcgggagggcccccgcggggagaagggcgacccagggctacccggggctgctggacaggccggcatgccggggcaggcaggccctgttggtcccaaaggcgataatgggagcgtcggcgaacccggccccaagggggatactggaccaagcggccctccaggcccacccggcgtgccgggccccgctggacgggaaggacctctcgggaagcaggggaacatcggaccacaaggtaaacccggcccgaagggagaggctggtcccaagggtgaagtgggcgcacccggtatgcagggtagtgcaggggcacggggtcttgccggtcctaagggggagcgtggagtaccaggtgagcggggtgttccgggaaatacaggggcagcgggtagtgccggagctatgggacctcaaggctcccccggggcgcgtggtccgcccgggctgaaaggctag

SEQ ID NO: 136706 - DNA, 903 bp, Artificial Sequence
  Description of Artificial Sequence: Synthetic coding sequence
atggcagcagtcgctgcccttcagctcggattgcgagctgcagggctgggccgggcccctgcaagcgccgcttggagatcagtactacgagtttcgccccgacccggcgtggcttggaggccttcacggtgtggctcttccgcggctgaggcctctgccacaaaagcagaagatgatagtttcctccaatgggtgctgttactgatccccgtcaccgcattcggactcggaacctggcaggttcagcgccgaaagtggaaacttaaccttattgccgagcttgagagccgagtattggccgagcctgtgccccttccggccgaccctatggaactcaagaatctggaataccgccccgttaaagtaaggggttgcttcgatcacagcaaagagctgtacatgatgcctcgtactatggttgatccggtgcgggaggccagggaaggcggcctgattagcagctcgacacagtccggcgcttatgtggtgacaccattccactgcacagatctcggcgtcaccattctcgttaacaggggatttgttccccgtaagaaggtgaatccagagactagacagaaaggtcagatcgaaggcgaggtagacctcatagggatggtccgtctaacagaaaccagacagccgttcgttcccgaaaataatcctgagcgcaaccattggcactatcgggatctggaagccatggcccgcattactggggctgagccaatctttatcgacgcgaattttcagagcaccgtgcctggaggacctattggcgggcagacgagggtaacactcagaaatgaacacctgcaatatatcgtgacctggtatggtctcagcgcagctacatcatatctgtggttcaagaaattcctaagggggacaccaggagtgtag

SEQ ID NO: 136707 - DNA, 813 bp, Artificial Sequence
  Description of Artificial Sequence: Synthetic coding sequence
gcaccagccagcgcagcttggcggtcggtgttaagggtgtcccctaggcccggcgtggcttggagaccttcacgatgcgggagctctgcggccgaagctagtgcgactaaggcagaggatgattcattcctgcaatgggtgttactgttgatacctgtgacagcttttggcctcggcacttggcaggtgcaaaggcgcaagtggaaactcaatctcattgctgagctggaatctcgagtgctggcagaaccagtcccgctgcctgctgaccctatggagctgaaaaacctcgaatatcggccagtgaaagtgcgtgggtgtttcgatcactccaaagaactctacatgatgccacgtacaatggtggacccagtccgcgaggcacgagagggtgggctcatttcatcgtcaacacaaagcggcgcctacgtcgtgacccctttccactgcacagatcttgggaaaaaagttaacccagagacacgtcagaaagggcagattgagggagaggtggacctgatcggcatggtccggctgactgagacgcgtcagccatttgtgcctgaaaacaatcccgaacggaatcactggcattatagggacctcgaagccatggcaagaatcaccggggccgagccaattttcatagatgcaaacttccagagtacggtgcccggtggtcccattggagggcagactagggtcaccttgaggaacgagcatctgcagtatatcgtgacttggtacggactgtccgccgccacaagttatctctggtttaaaaaattcctgcgaggtacccctggagtatag

SEQ ID NO: 136708 - DNA, 771 bp, Artificial Sequence
  Description of Artificial Sequence: Synthetic coding sequence
atgtcagagcttcccggcgacgttagagcttttctccgcgagcacccttctctgaggctgcagacagatgcccgcaaggtaagatgcatcttgacaggacatgagctgccttgtaggctccccgagctgcaggtgtacacaagaggcaagaagtatcagcgactggtacgggcatctcctgccttcgattatgccgagtttgagccccatatcgtcccatccacaaagaatcctcatcagctcttttgcaagctaacacttagacacataaacaagtgtccagaacatgtgctccgccatacacaagggcggcggtatcagcgtgcgctatgtaagtacgaggaatgtcagaaacagggcgtggagtatgtgccggcttgtcttgtgcatagacggagacgaagagaagatcagatggacggagatgggccccggccacgcgaggctttttgggagccgacatcctccgatgagggtggagccgcttcagacgattccatgaccgatctgtaccccccagagttgttcacccggaaggacctgggctcaacagaggatggcgacgggaccgacgactttctcacagataaagaggacgagaaagccaagccccctcgtgaaaaggccacggacgagtcacggcgagagaccactgtctatagaggcctcgtgcagaaacgcggcaagaaacagttgggcagtcttaagaagaagtttaagagccaccatcgaaaacctaaatctttctcttcatgcaaacaaccaggatag

SEQ ID NO: 136709 - DNA, 810 bp, Artificial Sequence
  Description of Artificial Sequence: Synthetic coding sequence
atgggacagaatgacctcatggggactgccgaggatttcgccgaccaattcctgcgggtgacaaagcagtatttacctcacgttgcaaggctgtgcctaattagtacattcctggaggatggtattaggatgtggttccagtggtctgaacagagggactacatcgacacgacatggaactgcggttatctgctggcgagttcctttgtgtttctgaatctccttgggcaactcacggggtgcgtattagttttgagccgcaacttcgtccagtatgcatgctttggactattcgggatcatcgcgcttcagacaatagcttactccatactgtgggatctgaagtttctcatgcggaacctggcactggggggaggtctcctcctgctactcgcggaatcccgctcggagggcaaaagcatgtttgcaggagtgcccacaatgcgagagtcgagtcctaagcagtatatgcagctcggcggaagggtactgctggtgttaatgttcatgaccctcttacacttcgacgcgtcctttttctccatcgtgcagaacatagtaggtaccgccctgatgatccttgtcgcgattggctttaaaacgaaactggctgctctcacgcttgtggtgtggctgtttgccatcaatgtttactttaacgctttttggactatcccagtttacaagccaatgcacgattttctcaaatacgacttcttccagacaatgtccgtgatcggcgggctgttacttgtcgtggctcttggccccggaggagtctctatggacgaaaaaaaaaaggagtggtag

SEQ ID NO: 136710 - DNA, 561 bp, Artificial Sequence
  Description of Artificial Sequence: Synthetic coding sequence
atgggccagaacgatctcatgggcacagctgaagacttcgccgatcagtttcttagagtcactaaacagtaccttcctcacgttgctagactttgtttgatcagcaccttcctggaggatgggattagaatgtggtttcaatggtccgagcagcgagattatattgacactacttggaactgtggatatctgctggcctcctcatttgtgtttctaaacttactcgggcaactgactggctgcgttctagtccttagtcggaactttgtgcagtacgcatgcttcggattgttcggaatcattgctctccaaacaatcgcatactccatcctttgggatctcaagttcttaatgaggaacctggcactggggggcggtctgctgcttcttcttgccgagagccgttctgaaggcaagtccatgttcgccggcgtgcccaccatgcgggagtcaagccctaagcagtacatgcagctgggcggccgggtcctcctcgtgctgatgtttatgaccctgctgcactttgacgctagcttttttagccagccatctcaacaatag

SEQ ID NO: 136711 - DNA, 567 bp, Artificial Sequence
  Description of Artificial Sequence: Synthetic coding sequence
atggggcagaacgacctgatgggtacagctgaggactttgctgaccaattcctgagggtgactaagcagtatctgcctcacgttgcgcggttatgcctcatctccaccttcctagaagatggaatccgtatgtggttccagtggtctgagcaacgggattacattgacaccacttggaattgtggctacttgctcgcttcttcttttgttttccttaaccttctggggcagttaactggatgtgttctggtgctttcccgcaacttcgtgcagtatgcatgtttcggactattcggcatcatcgcactgcagaccatcgcttactccatactttgggatctcaagttccttatgaggaatttggccctgggcggaggcctgttattgctgctagccgaaagccggtcagaggggaaaagtatgtttgcaggcgtaccaaccatgcgagagtcatcccctaaacatacctgtctcgccaagacaagagggaggcagggccttgtgcggggcggcttcaataaaacagcaagtttttatgtttcaagctctcttccccttccatggtag

SEQ ID NO: 136712 - DNA, 783 bp, Artificial Sequence
  Description of Artificial Sequence: Synthetic coding sequence
atgcgctcattagcaacagagtttttgcgcgtcacgaagcagtacctcccccacgtggctagattgtgcctgatttctaccttcttggaggatgggatccgcatgtggttccagtggtctgaacagagggactacatcgataccacatggaactgcggctatctgctggcttcttctttcgtctttttgaaccttctcggccaactcactgggtgcgtgcttgtcctgagtcgcaactttgtgcaatatgcctgcttcggcctgttcggtatcatcgcgttacagaccatagcatatagtatcctttgggatcttaaatttctcatgcggaaccttgccctgggcggaggtcttctgcttttattggcagaatcccggagcgagggaaagtcaatgtttgccggtgtccctaccatgcgagagagttcccccaaacagtacatgcagcttggcgggcgcgtgctgcttgtcctcatgtttatgactctgctgcatttcgacgcgagttttttttcaatcgtacagaatatagtcggcacagccctgatgatcctggtggccataggcttcaaaaccaagctggcagccctgactctcgtggtttggttgttcgcaattaatgtgtattttaacgcattctggaccatccccgtgtataagccaatgcatgattttctaaagtatgacttcttccagacaatgtccgtcataggcggccttctcctggtggtcgctctaggccctggcggcgtgagtatggatgaaaaaaagaaagaatggtag

SEQ ID NO: 136713 - DNA, 387 bp, Artificial Sequence
  Description of Artificial Sequence: Synthetic coding sequence
atgggtcagaatgatctcatggggaccgcagaggacttcgcagatcagttcctcagggtgaccaaacagtacttgcctcacgtggcaagactctgccttatctcaacatttttggaggatggaatccgcatgtggttccagtggtcggagcagcgcgactatattgacaccacctggaactgcgggtatttgctggctagttcattcgtttttctgaatcttctcggccagctgactgggtgtgtgctcgttctcagtagaaacttcgtacagtacgcctgtttcgggctctttggaatcattgcacttcagactatcgcctattctatactctgggacctgaaattcctgatgcgactgagtcgcaccagctgggcgcagctctag

SEQ ID NO: 136714 - DNA, 1086 bp, Artificial Sequence
  Description of Artificial Sequence: Synthetic coding sequence
atggcgtctctgctcgcgaaagatgcctacctccagagtctggccaagaagatctgttcacattccgctcccgagcaacaggcacgaacacgagcagggaagacccaagggagcgagacagcaggcccgcctaagaaaaagcgaaaaaaaacacaaaaaaaattcagaaaaagggaggaaaaagccgctgagcacaaagccaagtcactgggcgagaagtctcccgcagcatctggtgcccgcaggcccgaggccgccaaggaagaggctgcctgggcaagctcatcagctggaaatccagcggacggactggcaacggagccagaaagcgtgtttgccttggatgtcctgcggcaacgcctacacgagaagatccaggaagcaagaggccaaggcagcgctaaggaattaagcccagccgctcttgaaaagagaagacgcaggaagcaggagagggataggaaaaagcggaaaagaaaagaattgagagccaaggagaaggccagaaaagctgaagaagctacagaggcccaggaggtggtggaagcaacgcccgaaggagcatgcaccgagccccgcgagcctcctggacttatctttaataaggtggaggtgtccgaagacgagccagcatcgaaggcacagcgaagaaaggaaaagaggcagcgagtgaaagggaacctgacacccctgaccggtcggaactatcgtcaactgctcgaacgtttgcaggctcggcagtcccgactggacgagcttcgcggacaggacgagggtaaggcacaggaactagaggcaaaaatgaagtggactaacttgctctacaaggctgagggggttaaaataagagatgacgagaggctcctacaggaagctctaaaacgcaaggaaaagcgtagggcacaacgtcagagaagatgggaaaagcgaactgccggggtagtggagaagatgcaacagagacaagacagacgacgccaaaacctgagacgaaagaaggcagcacgagctgaaaggcggttactccgcgcgcgcaaaaaaggaaggattctgccgcaagacctggaacgcgcagggctggtctag

SEQ ID NO: 136715 - DNA, 789 bp, Artificial Sequence
  Description of Artificial Sequence: Synthetic coding sequence
atggccatgtcctcgggcggctccgggggtggtgtgcccgagcaggaggatagcgtactgttcagacgcggcactggccagagtgacgacagtgacatctgggatgataccgcgctgatcaaagcatacgataaggcagtggcctccttcaaacatgctctgaaaaatggcgacatatgcgagacaagtgggaaaccgaaaaccacaccaaaaagaaaacccgcgaagaagaataaaagccaaaaaaagaataccgcagcctcactccagcaatggaaggtcggagataaatgctccgcaatttggagtgaggatggatgtatctatcctgctaccattgcctcaatagattttaaacgggagacctgtgtcgtagtctacactgggtacgggaaccgcgaggaacagaacctctccgacctgctgtcccccatttgtgaggtggctaataacatcgaacagaatgctcaggagaacgagaatgagtcccaggtctcaacggacgaatccgaaaattcacggtcccccggtaataaatccgacaatatcaagcccaagagcgctccctggaactccttcctgccgcccccgccgcctatgccagggcctaggctcgggcccgggaagataatacctccaccccccccaatatgccccgatagccttgacgacgctgatgcactgggaagtatgctcatatcttggtatatgtccggttaccataccggatactacatgggcttccggcagaatcaaaaagagggccggtgctcccattccctcaactag

SEQ ID NO: 136716 - DNA, 885 bp, Artificial Sequence
  Description of Artificial Sequence: Synthetic coding sequence
atggctatgagttcaggagggagtggcggtggagtacctgagcaggaggactcggtgctgtttcggcggggcaccggtcagtcggacgattccgacatctgggacgatacagctctgataaaggcatacgataaagccgtggcttccttcaagcatgctctgaagaacggagacatttgtgagactagtggtaaacctaaaacaactcctaagcggaagcccgccaagaaaaataagtcacaaaagaagaataccgcagcctctctacagcaatggaaggtaggggataagtgttctgccatatggtcggaggatgggtgtatttaccccgcaaccattgcaagcatcgacttcaaaagggagacatgtgttgtggtgtatactgggtacggcaatagggaagagcagaacctgagcgacttgctatcgccaatctgtgaggttgcaaacaatattgagcagaatgcccaggaaaacgagaatgagagccaagtgagcaccgacgagtctgaaaacagtagatccccaggcaacaagtccgataacatcaaacctaagtcagcgccgtggaattcttttctgcctcctcctcctcccatgcccggcccccgattgggtcccggcaaacccggtctgaaatttaatgggcccccacccccccctcccccaccacccccgcatctgctatcttgctggttgcccccattcccgtcagggcctccgattattcctccccctccccctatctgccctgactccctggacgatgcagacgcattaggaagcatgttgatttcatggtacatgagcggctatcataccggctactacatgggattcagacagaaccagaaggagggtcggtgttcccattccctgaactag

SEQ ID NO: 136717 - DNA, 789 bp, Artificial Sequence
  Description of Artificial Sequence: Synthetic coding sequence
atggccatgtcctcaggtggatcaggagggggcgtccctgaacaggaggatagcgtcctgttcagacggggtactgggcagtctgacgactcagatatatgggatgacacagctctcatcaaagcctacgataaggcggtggcttccttcaaacatgctttaaaaaacggtgacatctgtgaaacctcaggaaaacctaagaccaccccgaagcgtaaaccagccaagaagaacaaatcccagaaaaaaaataccgcagccagccttcagcagtggaaggtaggtgataagtgttccgccatttggtctgaagacggatgtatttatcctgcaaccatcgcttctatcgatttcaaaagggaaacgtgcgtcgtcgtgtataccggctacgggaatcgcgaagaacaaaacctgagtgatctgctgtcaccaatctgcgaagtggcaaataacatcgaacagaacgctcaggagaatgagaatgagtcccaggttagtaccgacgagtcagagaactcccggtcacccggcaacaagtcggacaatatcaaaccaaagagtgccccctggaatagttttttgcctccaccacctcccatgcccgggccacggctgggccctggtaagataattcctccacctcctcccatctgtcccgactctctggatgacgcagatgccctggggtccatgctcatttcctggtatatgagcggataccacactggatactatatgggctttaggcaaaaccagaaggaggggcggtgcagtcactcactcaactag

SEQ ID NO: 136718 - DNA, 849 bp, Artificial Sequence
  Description of Artificial Sequence: Synthetic coding sequence
atggcaatgagctcagggggttctggggggggggtaccggaacaggaggattccgtattgttcagacgaggaacaggccagtctgatgattctgatatctgggatgatactgctttgattaaagcctatgataaggctgtcgcttctttcaaacacgccctgaagaatggggatatttgcgaaacttccggaaagccaaagactactccaaagcggaagcctgcaaaaaagaataaatctcagaaaaaaaacacagctgcttccctgcagcagtggaaggtgggggataaatgcagcgcaatctggagcgaagacggctgtatctaccccgctacaatagcctccatcgacttcaaaagggagacctgcgtggtggtgtataccggctacggtaaccgagaagaacagaacctatctgacctgttgtcacctatctgcgaggtcgctaacaatatcgagcaaaacgcccaagagaatgagaatgagtcgcaggtatctaccgacgaatcagaaaacagcaggagccccggcaacaaaagcgataatatcaagccaaaaagcgcaccttggaatagcttcttgcctcccccacctccaatgcctggacccagactggggcctggaaaacccggactgaaattcaacggcccaccgccacctccaccgccacccccccctcatcttctcagttgttggctcccaccttttcctagtgggccccccatcatacccccacctcctcccatttgtcccgattctctcgacgacgccgacgctcttggatccatgctcattagctggtatatgagcgggtatcatacaggctactatatggaaatgttagcatag

SEQ ID NO: 136719 - DNA, 885 bp, Artificial Sequence
  Description of Artificial Sequence: Synthetic coding sequence
atggctatgtccagcggcgggtccggcggcggggttccggagcaagaagacagcgtgctctttagacgtggaaccggacagtctgacgattccgacatatgggatgatactgccctgataaaagcttatgacaaggcagtggcctcatttaagcacgctcttaaaaatggggacatctgcgaaacgtcagggaagccaaagactacacccaagaggaaacccgcaaaaaagaacaaatcacagaagaagaatactgccgcctccctgcagcagtggaaggttggcgataaatgtagcgctatctggtctgaggacggttgtatttaccccgcgaccatcgcctccatagatttcaagcgcgagacttgcgttgtcgtgtataccgggtatggcaatcgcgaagagcagaacctcagcgacttactctcgcctatttgcgaggtagctaataacatcgaacagaacgcccaggaaaacgagaatgaatcacaggtttcaaccgatgagtccgaaaactctcggagtccaggtaataagagcgataatatcaaacctaaaagtgccccatggaattcttttctgccgcccccgcctccgatgcctggcccgagacttggtcctggcaagccaggactgaaatttaatggccctccgccaccacctcccccaccccccccacacttgttgtcctgctggcttccaccattcccttccggccctccaatcattccaccaccacctcctatctgtcccgactcactggatgacgccgatgcactaggctctatgcttatctcctggtacatgagcggctaccacaccggctactacatgacaggattccattgcgtttcccaggacggactgaacttactcacaccctag

SEQ ID NO: 136720 - DNA, 684 bp, Artificial Sequence
  Description of Artificial Sequence: Synthetic coding sequence
atggccatgtcatcaggcggtagtggaggtggggtgcccgagcaggaggactcagttctctttaggcgtggaaccggccagagtgacgatagcgatatttgggatgacactgcccttattaaagcctatgacaaagccgtcgcctcattcaagcacgcccttaagaacggggacatttgcgagacttctgggaaaccgaaaaccaccccaaaaaggaaaccagctaaaaagaacaaaagccagaaaaagaatacagctgcatccctgcagcaaaatgagaatgagtcacaggtgagcaccgatgagtccgagaactcccgctctccagggaacaagagtgataacattaaaccaaaaagcgcaccttggaacagtttcctgccaccgcctccccccatgcctgggccccggctgggccctggtaagcctgggctgaagtttaacggcccacctccacctccgccacctccgccacctcacttgctctcatgctggctcccacctttccctagcggcccaccaataattccgcctcctcctcccatttgcccagatagtcttgacgacgcagatgcgctgggatccatgctgatctcttggtacatgtctggttaccatacaggttactatatggggttcaggcagaatcaaaaagagggaaggtgtagtcatagtctgaattag

SEQ ID NO: 136721 - DNA, 849 bp, Artificial Sequence
  Description of Artificial Sequence: Synthetic coding sequence
atggcgatgagttcaggaggatccggggggggcgtacccgagcaagaagacagcgtgctgtttaggcggggaacaggtcagagtgacgattccgacatttgggatgacacggctttaatcaaagcatacgacaaggctgtggcgagtttcaaacacgcactgaagaatggtgatatctgtgaaacatccggcaagcccaagactactcccaaacgcaagcccgcgaagaaaaacaagtcccagaagaaaaacactgccgccagcctgcaacagtggaaggtgggggataagtgctccgcaatatggtcagaggacggttgcatctaccctgccactatcgcctctatcgacttcaaacgcgagacatgcgtggttgtgtacaccggctacggaaacagggaggaacagaacctaagcgatctgctctcccccatttgcgaggttgcaaataatatcgaacagaatgcccaggagaatgagaatgagtctcaagtatctaccgacgagtccgagaacagtaggagtcccggaaataagagcgataacatcaaacctaagtcagcgccctggaatagctttctccctccacctcccccaatgccaggacccagactgggacctgggaaaccagggctcaagttcaacggccctccaccaccacctccacctccacccccacacctgttaagctgctggctgcccccatttccatctggcccccctataatccctccacctccccctatctgtcccgattccctggacgatgccgatgccctcggatcaatgctgatctcttggtatatgagtggctatcataccggctactacatggaaatgctggcttag

SEQ ID NO: 136722 - DNA, 789 bp, Artificial Sequence
  Description of Artificial Sequence: Synthetic coding sequence
atggcaatgagctccggcggatcaggtgggggtgttccagagcaggaggactccgtactgttcaggcgcggaacaggacagagcgatgattcagatatatgggacgacacagccttgataaaggcatatgataaggccgtagccagtttcaagcatgctcttaagaacggcgacatctgcgagacaagtgggaaaccaaagacgaccccgaagagaaagcccgctaagaagaataaaagtcagaaaaagaacaccgccgctagccttcagcagtggaaggtgggtgataaatgctccgctatttggtctgaagacggatgcatatatcccgctactattgcctcaattgacttcaagcgggagacctgtgtggtggtgtatacaggctatggaaatagagaggagcagaatctaagcgacctgctgtctccaatttgcgaggtggcaaataacatcgaacagaatgcccaggagaatgaaaatgaaagccaggtaagcacggatgagagcgagaatagccgaagccccggcaataagtcggacaacattaaacctaagagcgccccttggaatagctttctgccccctcctccaccaatgcctggtccacgtctgggccccgggaaaattattcccccgcctccacccatttgccctgacagccttgatgatgctgacgcactcggctccatgctgatctcatggtacatgtcaggctaccacactgggtactacatggggttccgtcaaaatcaaaaggaggggcgatgttcacattccttgaattag

SEQ ID NO: 136723 - DNA, 885 bp, Artificial Sequence
  Description of Artificial Sequence: Synthetic coding sequence
atggccatgtcttccggaggatccggaggtggcgtacccgagcaggaggactccgttctcttccgcagggggacgggacagagtgatgactcggatatatgggatgacaccgcactgattaaggcttacgacaaagcggtcgcatcatttaaacacgccctgaaaaacggcgacatatgtgaaacatcagggaagccgaaaacgacacctaaaagaaagccggccaaaaagaataaatctcagaagaagaacactgctgcatccctgcaacagtggaaggtgggcgataagtgttccgcaatctggagcgaggacggttgcatctacccggcgacgatcgccagtatcgattttaaacgtgagacctgcgtggtcgtgtacactggctacggcaatagagaagaacaaaatctgtccgacttactttcacccatatgtgaggtggctaacaatattgaacagaacgctcaggagaacgaaaacgaatcacaggtttctactgatgaatcagaaaactcccggtcccccggcaacaagagtgataacattaagccgaaaagtgctccatggaactcctttctgcctccaccaccccctatgcctgggccccggctcggcccagggaagcctggactaaagttcaacgggcctccccctcctcctcctccccctccaccacatctcttatcctgctggctcccaccattcccgagtggaccgcctataatccctcctccacctcctatctgtccagattcacttgacgacgccgacgctttggggagtatgttaataagttggtacatgtctggctatcatacaggctattacatgggtttccggcagaaccagaaagagggtcgatgtagccacagcctgaattag

SEQ ID NO: 136724 - DNA, 885 bp, Artificial Sequence
  Description of Artificial Sequence: Synthetic coding sequence
atggctatgtcctctggagggtccggtggaggagtccctgagcaggaagactccgttctattccgccgaggtaccgggcaaagcgatgattctgacatctgggatgacacggctctcatcaaggcctacgataaagcggtcgcatcctttaagcacgctttaaagaatggcgatatatgcgagacttcaggcaaaccaaagactacgccaaaacggaaaccagctaagaaaaacaaatcacagaaaaaaaatacggctgcctccctccagcaatggaaagtgggcgacaaatgcagcgcaatctggtcagaggacggctgcatctaccccgcgacgatcgcgtccatcgactttaaacgcgagacatgtgttgtggtctacacagggtacggaaatcgggaggagcagaatctgagtgatttgctgagcccaatctgcgaggtcgccaataacattgaacaaaacgcccaggagaacgaaaacgagtcacaggtttcaactgatgagtccgagaacagtcgcagccccggaaacaagtctgacaatataaaaccaaaatccgccccttggaattccttcctgccacctccgccccctatgcccgggccacggctcggacctgggaaacctggccttaaatttaatggccccccgcctccccccccacctccgcctccccatctcctgtcatgttggctcccccctttcccaagtggcccacccataattcccccgcccccccctatctgtccggactccttagacgatgccgacgctctgggctccatgcttatttcgtggtacatgtctggataccacactggatactatatgaccggttttcattgtgtgtcacaagacggactgaatcttctaaccccttag

SEQ ID NO: 136725 - DNA, 684 bp, Artificial Sequence
  Description of Artificial Sequence: Synthetic coding sequence
atggctatgagcagcggaggcagcggcggaggtgtgccggagcaggaggattccgtgctgttccggcgaggaaccggacagtctgacgacagtgatatttgggatgacacggccctaatcaaagcatacgacaaggctgtcgccagttttaaacatgctctcaagaatggtgatatttgtgaaacgtccggaaagccaaaaacaacacctaagcgcaagccagccaaaaaaaacaagtcccaaaaaaagaacaccgcagcctctcttcaacaaaacgaaaacgaatctcaggtgagtacagatgaatcagaaaactctagatcccctggcaacaagtcagacaacattaagcccaaatcggcaccctggaatagctttctcccaccacccccacccatgcctggaccacgtttaggaccagggaaacccgggctgaagttcaacggaccgccacctcctccaccacctccgcctccccacttgctatcgtgttggctgcctccattcccttcaggccctcccattattccaccaccacctcccatctgccccgattcgctcgacgacgctgatgcactcggtagcatgctcatatcctggtatatgagtggttatcatacgggctactacatggggtttcgtcagaaccagaaagaaggtagatgttcccactcactgaactag

SEQ ID NO: 136726 - DNA, 4494 bp, Artificial Sequence
  Description of Artificial Sequence: Synthetic coding sequence
atgccccgatgcatcgcgcacttttgtgaaaagccccccagcgtgtcgtacagtatcttagagtccgtgagtaaggcaaagtttgccgcggggtctgtcgtttcgttcaaatgcatggaaggtttcgttctgaacaccagcgccaagatcgaatgtatgagaggaggtcagtggaatccgtccccaatgtccattcaatgcatcccagtgcggtgtggagagcctcctagcatcatgaatggttatgcatctggctccaactatagcttcggcgccatggtcgcttatagttgtaacaaaggattttatatcaaaggagaaaaaaaaagcacttgtgaggcaaccggccagtggtcaagtccgatccctacatgtcatcccgtcagctgcggggaaccacccaaggtggagaacggatttttagagcacaccactggcagaatattcgaaagtgaggtgcgctatcaatgcaatcccggctataagagcgttggatctcctgtctttgtatgccaggcaaatagacattggcacagcgaatcacccttaatgtgtgtgcccttggattgcggcaaacctcctcccattcagaatggcttcatgaaaggggaaaacttcgaggttgggtctaaagtgcaattcttctgtaatgaaggctatgagctggtcggagatagttcttggacatgtcagaaatctggcaagtggaacaaaaaatctaaccctaagtgcatgcctgcgaagtgccccgaaccgcccctgctcgaaaatcagcttgtactcaaggagctcacaacggaggtcggcgttgttactttcagttgcaaagaaggacacgtgttacaggggccctctgtgttgaaatgtctgccgtcacagcagtggaacgactcattccccgtctgcaagatcgttctgtgcactcctccccctcttatctcgttcggggtccctattccttcctctgcgcttcatttcggtagtaccgtcaagtactcctgcgtgggcgggttctttctgcgtgggaactctaccacactctgccagccagacggtacatggagcagtccactgcccgagtgtgtccccgtcgagtgtccacaaccagaggagattcctaatggcattatcgacgtgcagggcctggcctatttgtcgaccgccttgtacacttgcaagccgggatttgaattggtggggaacacaactaccttgtgcggggaaaacgggcactggcttggcggaaaacctacctgcaaggctatcgagtgtctaaagccaaaggagatcctaaatggtaaattctcttatactgatctccactacggccagacggtcacctactcatgtaatcgggggttcaggttggagggcccctcggcgctgacttgcctcgagaccggtgattgggacgtggacgcaccaagttgtaacgctatacactgcgactctccccagcctattgagaatggctttgtggagggtgcggactatagctacggagctattatcatctactcttgcttccccggcttccaagtagccggccatgcaatgcagacatgcgaggagtccggatggtccagctcaattccgacctgcatgccaatcgattgcgggctgccgccccatattgatttcggcgattgcacgaagcttaaggacgaccagggttacttcgagcaagaggatgatatgatggaggtgccgtacgttacccctcatccgccctatcacctgggggccgtggctaagacgtgggaaaatacaaaggagtctcctgcaacgcattcaagtaactttctgtacggtaccatggtgtcttacacttgtaatccgggctacgagctgctgggaaatcccgtgctgatctgtcaggaagacggtacttggaacggatctgccccaagctgcattagcattgagtgcgacctgcccaccgccccagagaacggatttcttaggttcacggagaccagcatgggatctgccgtgcagtactcctgtaagcccggacatatcctggccggctccgatctgagactgtgcttagagaacaggaaatggagcggagcctctccccgatgcgaagcaatctcatgtaagaagccgaacccggtcatgaacggcagtatcaagggcagcaattacacctaccttagcactctatactacgaatgcgacccaggttacgttctgaatggcacagaacggcgcacctgccaggacgataagaattgggacgaggacgagcccatctgtattcctgtcgactgctcttcgccgccagtgagtgcaaatggacaggtacgcggtgatgaatacacattccagaaagagatcgaatatacatgtaatgagggattccttctggagggcgctcggtctagagtctgcctggctaacggctcatggtcaggtgcgacgcctgattgcgtgcctgtgagatgcgctacacccccccagttggcaaatggggtgactgagggtctggattacggattcatgaaggaagtgacattccactgtcacgaggggtatattctgcacggcgcacccaaactaacctgccagagtgatgggaactgggacgctgagatcccactgtgcaaaccggttaactgtgggccacctgaggaccttgcccatgggttccccaacggctttagcttcatccacggaggacatatacaataccaatgttttcctggatacaaactgcacggcaacagttcacggagatgcctgagcaacggatcctggagcggttcatcaccttcctgtttgccttgtaggtgcagcactccagtgatcgagtatggcaccgtaaatggtacagacttcgactgcggcaaggcagccagaatccagtgctttaagggtttcaagttgttggggctgagcgagattacatgtgaagccgatggacagtggtcgtctggcttcccccattgtgagcacacatcatgtggctcattacctatgatacctaatgcatttattagtgagacaagctcctggaaggagaatgtgatcacgtattcgtgtcgcagcggatacgttatccagggcagttccgaccttatctgcaccgagaagggcgtctggtctcagccatacccagtgtgtgagcccctgagctgtgggtcacccccttctgttgccaatgcggtggccacgggcgaagcccacacatatgagagcgaggtgaagctgcggtgtctcgagggctacactatggacaccgacactgacaccttcacttgtcagaaagacggcaggtggttccccgagagaatctcctgctcacccaaaaagtgcccgttgccagagaacataacccacatactcgtccatggggacgacttctcagttaatcgccaggtgtccgtctcttgcgctgaaggctacaccttcgaaggggtgaacatcagcgtgtgccagttggacggcacttgggaacctccattttccgacgagtcctgcagcccggtgtcctgtggaaagcccgaatccccagaacacggcttcgtggtaggctctaagtatacctttgagtccaccattatttatcagtgcgaacccgggtacgagctggaggggaatcgggagagggtgtgtcaggagaatcggcagtggtcaggcggggtggccatctgcaaggagacacgctgcgagacgcctctcgaattcctgaacggaaaagccgatattgaaaacagaaccactgggcctaacgttgtgtattcgtgcaatcggggctattccctagaggggccctctgaagcccattgcacagagaatggcacgtggtcacacccagtgcctttgtgcaagcccaacccttgcccggttccattcgtgatccctgagaatgccttattatccgaaaaggaattctatgtggatcagaatgtcagcattaaatgccgcgaaggatttctcttgcagggccacgggattatcacttgtaatcccgacgagacatggacgcagacttccgcaaagtgcgagaagatatcgtgcggcccacctgctcacgtggagaatgccatagcgaggggcgtgcattatcagtacggggacatgatcacctacagctgttacagcgggtatatgctggagggatttcttcgtagcgtgtgtttagaaaacggcacctggacttccccccccatctgcagagctgtctgtagatttccctgtcaaaacgggggcatttgtcagcgtcctaacgcctgctcatgtccagagggctggatgggccgcctgtgtgaagagcctatctgtatcctgccctgcctcaacggtggaagatgtgtagcgccttatcagtgcgactgtccccctgggtggactgggtcgcgttgccacacagccgtctgccagtccccatgcctcaacggtggaaaatgtgtccgcccaaataggtgtcactgcctgagttcgtggaccggccataactgttctagaaagagaaggaccggtttttag

SEQ ID NO: 136727 - DNA, 4650 bp, Artificial Sequence
  Description of Artificial Sequence: Synthetic coding sequence
atgtggcctcgcttggctttttgctgttggggactggccctagtgagcggatgggcgacgttccagcagatgagtccaagtcggaacttctctttcagacttttcccagaaaccgctcctggagccccaggaagtatccctgccccccctgctcctggggacgaagccgccggtagtcgggtggagcggctggggcaggcttttagacgtagagtcaggcttctgagagagctgtctgaaaggctggagctggtgtttctggtagatgatagtagtagcgttggggaggtgaatttccgcagcgagctcatgttcgtccgcaagctgttaagcgacttccccgtggtacctacagcaacccgagtggctatcgtgacattttcctcaaagaactatgtggtgccaagggttgattacatttcaactcgccgcgcacgccagcataagtgcgcactcctgctgcaggaaataccggctatctcttaccgaggcgggggaacatacaccaaaggtgctttccagcaggcagcacagattttgctgcacgcccgggagaacagcactaaggtcgtgtttctcataactgatggatacagtaacgggggggacccccgccccatagccgcatctctcagggattcaggagtcgaaatcttcacgtttgggatttggcaggggaatatccgggaactgaatgacatggcatcaacccccaaagaggaacactgttacttgttacattctttcgaggaattcgaggcactggcccgccgggctctccacgaagacttgccctctggatcctttattcaggacgatatggtgcactgttcatatttatgcgacgagggcaaagactgttgtgatcgcatgggcagttgcaaatgcggcactcacacaggtcatttcgaatgtatctgtgaaaagggctattacggaaaaggactgcagtatgaatgcactgcctgtcctagtggtacttataaaccagagggcagtccaggcggcatcagctcttgcataccgtgccctgatgagaaccacacatctccacccggaagcactagccccgaagattgcgtctgtagagaaggataccgggcctctgggcaaacgtgcgagctggtccactgtccagcacttaaaccacctgagaatggctacttcattcagaacacctgtaacaaccattttaatgccgcctgcggagttaggtgccaccccggattcgacctggtggggagctccataattttgtgcctgcccaacggtttgtggtctggctctgagagttattgtcgggtaagaacgtgtccccaccttagacaacccaagcacgggcacatcagctgtagcaccagggaaatgctatataaaactacctgccttgtggcctgcgacgaggggtatagactcgaagggagtgataagctgacatgccaagggaactcccagtgggatggaccagaacctcgttgtgtcgagcgacactgctccacgttccagatgcccaaggatgtgattatatccccacataactgtggaaagcagcccgccaaattcgggaccatctgctacgtttcctgtcgacagggcttcattttatccggcgtaaaagagatgttgcgctgtactactagtggcaagtggaacgtcggcgttcaggccgccgtctgcaaggatgtagaagccccccaaatcaattgtcctaaggatatagaggccaagaccttggaacagcaagactccgccaatgtcacctggcagattcccaccgcaaaggataacagtggcgaaaaagtctctgtccacgttcacccagcttttactccaccctacctcttccccatcggcgacgtggccatcgtgtatactgctactgatctgtctggtaaccaggcctcatgcattttccacatcaaggtaattgatgcagagcctccggtcatagattggtgcaggtcccccccaccagttcaggtgagcgaaaaagtgcatgctgctagctgggacgagccacagttttcagataactcaggcgccgaactcgtcattacacggtctcatacccagggagacctgtttccgcaaggagaaacaatcgtacagtatactgcaaccgacccaagtggcaacaaccgtacttgcgatatccatattgtgatcaaaggctctccatgtgagattccattcaccccagtgaacggcgatttcatctgtacccctgacaacaccggtgtcaactgtactctgacctgtctggaaggttacgattttactgaggggtccaccgacaagtactattgcgcttatgaggacggcgtatggaaaccgacttatacaacagaatggccagactgtgccaaaaagcgatttgcgaatcacggattcaaaagcttcgaaatgttctataaggcagccaggtgcgacgatacagatcttatgaagaagtttagcgaggccttcgaaacaaccctcggaaagatggtcccttcgttttgcagtgatgcagaagacattgactgtcgtctggaagaaaatctgactaagaagtactgtctggagtacaactacgattatgaaaatggtttcgctatcggtccgggcggttggggagcagccaatcgcctcgactatagctatgacgatttcctggacacagttcaggagaccgcaacaagcattgggaacgcaaagtccagcagaattaaaagatctgccccactcagcgattataagattaagcttatcttcaacattacagcttcagtcccactgcctgatgaacgtaacgatactctagagtgggaaaaccagcagaggctgctgcagactctagagactattaccaataagctcaaaagaaccttgaacaaggatcccatgtacagtttccaactggcctccgagattctcatcgcggatagtaattcgctagaaaccaagaaggcttctcctttctgccgccccgggagcgtactgcgcggtcgcatgtgtgttaattgtccattgggaacctactataacctggagcactttacatgcgaatcttgcaggataggaagctaccaggatgaagaaggccagcttgagtgtaagctgtgtcctagcgggatgtacacagagtacattcactctagaaacatatccgattgcaaggcgcaatgtaagcagggcacgtactcctactccggtctcgagacctgcgaaagttgcccactgggaacctaccagcccaaatttggatctcgaagctgcctaagttgccccgaaaataccagcaccgtgaaacgcggcgctgtgaacattagtgcatgtggagtgccctgtcctgaggggaagttctcccggtcaggcctgatgccgtgtcatccttgtccccgtgactactaccaacctaatgctggaaaggcattctgtctggcttgcccattttacggaactaccccctttgccggttccagatctatcaccgaatgctccagcttctcctcaactttttcggctgcagaggagagtgtagtgcctccagccagtttggggcacatcaaaaagagacacgaaatctcttcgcgcgtgttccacgaatgtttttttaatccatgccacaattcagggacttgtcagcagttaggtcgcggctatgtctgtctgtgccctttgggatacaccggcctgaaatgcgagaccgacatagacgagtgttccccgttaccatgtctgaacaatggtgtctgtaaagatctcgtgggagagttcatctgcgaatgccctagcggttatactggccagcgctgtgaagagaacattaatgagtgctcatcctcaccctgtttaaacaaaggaatctgtgtcgacggcgtcgcaggttaccgatgtacatgcgttaaaggttttgtgggactgcactgtgagaccgaagtcaatgaatgccagagcaatccatgcttgaataacgccgtttgcgaggatcaggtcggaggatttctgtgcaagtgtcctccaggcttcttaggcacccggtgtgggaaaaacgtcgacgagtgtctgtcccaaccatgcaaaaacggggcaacatgtaaagatggggctaacagctttcggtgtttgtgcgctgctggcttcaccggtagtcactgtgagctgaacataaacgagtgccagtccaacccatgcaggaaccaggcgacttgtgtcgacgagcttaattcctactcatgtaagtgccagcctggatttagtggaaaaaggtgcgagaccgaacaaagcaccggatttaacctcgacttcgaagtgtctggtatctacgggtatgttatgctggatgggatgctaccctccctgcatgctcttacttgtactttctggatgaagagcagcgacgatatgaattacggcacacctatctcttatgcagtcgataacggctccgataatacactactcctgaccgactataacggatgggtactgtacgtgaacgggagggaaaagatcaccaactgtccgtctgtcaacgacggccgctggcatcatatcgccattacatggacttctgctaacggcatttggaaagtatacatcgacgggaagctcagcgatggaggcgcagggttatccgtaggactacccatccccggcatgttttag

SEQ ID NO: 136728 - DNA, 2538 bp, Artificial Sequence
  Description of Artificial Sequence: Synthetic coding sequence
atgagcccctcgcgcaatttttccttccgcctgttccccgagacagccccaggggcccctggctcaataccagcgcctccagcacccggcgatgaagccgccgggagccgggtggagcggctagggcaagcatttcgacgccgcgttcggctgctgcgtgaactgagcgaaaggcttgaactggtcttccttgtagacgattcatcaagtgttggagaggtcaacttccgctccgagctgatgtttgtgagaaaactgttgagtgattttcctgtggtgccaacggctactcgcgtcgctatagtgactttttcctctaaaaactatgtggtgcccagagtggattatattagtaccaggagggccagacaacataaatgcgcgctgctccttcaggagatcccagctatttcttacaggggggggggcacctacacaaaaggcgcattccaacaggccgcgcaaatcctgctccacgctcgggaaaacagtacaaaagtggttttcctcatcactgacggatactcaaatggtggagacccccgccccatcgccgcatccctgagagacagtggagtggagatcttcacattcggcatttggcaaggaaatattagggaactgaatgatatggctagtaccccaaaagaagagcattgttacttgctgcactccttcgaagaattcgaagccctcgcccgaagagctttgcatgaggatcttccctcagggtccttcatccaggacgacatggtccattgttcttacctgtgtgacgaaggcaaagattgttgcgatcggatgggtagctgcaagtgcggaacacacacaggccacttcgagtgtatttgcgagaaagggtattacgggaaggggctgcagtacgagtgtacagcatgtcccagcgggacctacaagccggaaggcagcccgggcggaatttcttcttgcattccttgcccggatgaaaaccacacctctcccccaggctcgacaagccccgaggactgcgtttgcagagagggttatagagcctccgggcagacgtgcgagctcgttcactgcccggccctgaagccccctgagaatggttatttcattcaaaacacctgcaataatcacttcaacgcagcctgcggggtgaggtgtcacccgggatttgaccttgtcggcagcagcatcatcctgtgcctgcctaatgggctgtggtcaggcagcgagagttattgccgggtgcgcacctgccctcacctgagacagcccaagcacgggcacatctcctgtagtactcgagagatgctgtataagacaacctgcctggtagcttgtgacgaaggctatcgacttgaaggctcagacaagctgacctgtcaaggaaatagccagtgggacggcccggagcccagatgtgtggagcgtcattgttctaccttccaaatgcccaaagacgtgatcatcagtcctcacaactgcgggaagcagccagctaaattcgggacaatttgctacgtgagctgcaggcaaggttttatcctctccggagtgaaggagatgctgcgttgcactacgagtggtaagtggaatgtgggagtgcaggccgcggtctgcaaagatgtagaggcccctcagattaattgccctaaagatatcgaggccaaaacactggagcagcaggattcagccaacgtcacctggcagatccccacagccaaggacaactccggcgaaaaagtgtcagtgcatgtgcatccggcatttacacccccctacctgttccctatcggtgatgtagccatcgtgtataccgctactgatctcagcgggaaccaggcgagttgtatcttccacattaaggtgatagatgccgagccacccgtgatcgattggtgccggtctccccctcccgtccaggtcagtgaaaaggtccatgccgccagctgggacgagcctcaattttccgacaattccggagccgaacttgttataactagaagccacacccagggtgatctatttccgcagggcgagactatagtccagtacaccgctaccgatcccagtggcaacaatagaacttgtgacatccatattgtgatcaaggggagcccttgtgagatcccattcactccagtaaacggcgattttatctgcaccccggataatactggcgtgaactgtaccctcacctgcttagaggggtacgatttcactgaaggaagtacggataaatactactgcgcgtatgaagacggggtgtggaagcccacctacactacggagtggcccgactgtgctaagaagaggtttgcaaaccacgggtttaagagcttcgaaatgttttacaaagcagcccgatgcgatgacactgacctgatgaaaaagttctctgaagcttttgaaactaccctcggaaaaatggttccctccttctgcagtgacgcagaggatatcgactgtcggctggaagaaaacctgaccaaaaagtactgcctggagtacaactatgattacgagaatggtttcgcaatcggtaactag

SEQ ID NO: 136729 - DNA, 1548 bp, Artificial Sequence
  Description of Artificial Sequence: Synthetic coding sequence
ctggagaaccagctggtccttaaagaactcactactgaagtaggtgtggtgacattttcatgtaaagagggacatgtgctacagggcccaagcgttcttaagtgcttacccagtcagcagtggaacgactcatttccagtgtgtaagatcgtactgtgcacacctccacctctgatctctttcggagtgccgatccctagctccgctctgcacttcgggtcaacagttaagtattcgtgtgtgggcggtttctttttgaggggaaactccaccaccctgtgtcagccagatggcacatggagtagcccactccccgagtgcgtgccagttgaatgcccccagcctgaggaaatccccaatggcattattgatgtgcagggtctcgcctacttgtctacagctctatatacctgcaagcctggcttcgaactggttgggaacacaacaacattgtgtggagaaaacggccattggctcggaggcaaaccaacatgtaaagccattgaatgtctgaagcccaaggaaattttgaacggcaagttttcctatacggacttgcactacggacagacagtcacatactcctgtaatagaggcttccgactggaaggacccagtgcgttaacctgtctcgagactggggattgggacgtggatgccccttcatgcaacgcaattcattgtgatagtccacagccaatcgagaacggctttgttgagggcgctgattacagttatggggcgattattatttatagctgcttccccgggttccaggttgccggacatgccatgcagacatgcgaggagtcagggtggagcagcagcatacctacttgcatgccaatcgattgcgggctcccaccacacatcgattttggcgactgcacaaagctaaaagacgatcaaggttattttgagcaagaagacgacatgatggaggttccctatgtgactcctcatcctccttaccacctgggtgccgtcgcaaagacatgggaaaacacaaaagaatcccccgcaactcacagttcaaatttcctgtacggcacaatggtttcctacacgtgcaacccaggctatgaacttctggggaatcccgtgctcatttgccaagaggatggtacctggaacggtagcgcgccttcatgtataagtattgaatgtgatctaccaactgctcccgagaacggcttccttcgcttcaccgagacctcaatgggttccgcagtgcagtattcttgcaaacccggacacatccttgcaggctcggatctgcgtctctgcctcgaaaacaggaagtggagtggcgccagtccccggtgcgaagccatttcttgcaagaagccaaaccccgtgatgaatggatcaatcaagggctcgaattacacgtatctttccacattatactacgaatgcgatcctggctacgtgctgaacggcactgaaaggcggacatgccaggacgataagacagggatgcgcatgagtccctttgcatttctgtggacagctgttcatcctcagtcccagcccatggctagatag

SEQ ID NO: 136730 - DNA, 10647 bp, Artificial Sequence
  Description of Artificial Sequence: Synthetic coding sequence
atgtctccctccaggaacttctcatttcgtctattcccagagacagctcctggtgctccagggtccattcctgcgcctcccgcgcctggagatgaagctgccgggtcacgggtcgagagacttggccaagcctttagacgccgggtgcgtttactgcgggagctttccgaaagactggaactggtcttcctcgtggacgattctagttccgtgggggaagtaaactttcggagcgagttaatgtttgtgcgcaaacttcttagtgactttccagtggtgccgacagcaacacgggtagcaattgtgacattcagctcgaaaaactacgtagttccccgcgtggactacattagcactaggcgagctagacagcacaaatgcgctctcctcctacaggagatcccagccatcagttaccgcggtggtggaacctatacaaagggtgcctttcagcaggcggcccagatcctactgcacgcccgtgagaactccaccaaggtcgtgtttcttatcacggacggttattctaatgggggcgatcccagacctattgcagcttctctgagggattcaggagtcgagatcttcacttttggtatttggcagggaaatataagggaactcaacgatatggccagcacaccgaaagaagaacactgctatttactccacagcttcgaagaatttgaagccctggctaggagagctctccacgaagatctaccatccggatccttcatccaggacgatatggtacattgctcctacctgtgcgatgaaggcaaggattgttgcgatagaatgggctcttgcaaatgcggcacacacaccgggcacttcgaatgtatctgtgaaaagggatactatggcaaaggcctccaatacgagtgcactgcgtgcccaagcggcacgtataaacctgagggtagtcccggcggaatttcctcttgcattccctgtcctgacgagaatcacacatcacccccaggttccacaagtccagaggactgcgtgtgccgggagggatatagagcctcgggacagacctgtgaactcgtgcactgcccagctctcaagccacctgaaaacgggtactttatccagaacacatgtaataatcactttaatgctgcgtgcggcgtaaggtgccacccggggttcgatctggtcgggtcctctattatactgtgcctgccgaacggattatggtcagggtcggagtcctactgtcgcgtgaggacatgcccacacctgagacaacctaaacacggccatatctcctgcagcacccgagagatgctctataagactacatgtctcgtggcctgtgacgaaggatacaggttggagggatcggataagttgacctgtcaggggaatagccaatgggatggcccagaaccccggtgtgtcgagcgccattgttcaactttccagatgccaaaagatgtcataatctcaccccacaactgcggaaagcaacccgctaaatttggtactatctgttatgttagctgtcggcaaggtttcatcttgtccggcgttaaagaaatgcttcggtgcaccacctctgggaagtggaatgtgggggtgcaggccgctgtctgcaaagacgtcgaagccccacagatcaactgtccaaaggacatcgaggctaagacactggaacagcaagattccgccaatgtgacatggcaaatcccaacggccaaggataatagtggcgagaaggtctccgtgcatgtacaccccgcattcactcctccttacctgtttccaattggtgacgtggcaattgtgtatacggctaccgacttgagtggtaaccaagcttcctgtatttttcacatcaaagtgatcgatgccgagccaccagtgattgactggtgtagatcgccccctcccgtacaagtgtcagaaaaagtccatgctgcttcttgggacgaaccccagttctctgacaacagcggggcagagctggtgatcacgagatctcatactcagggcgatctctttcctcagggggaaactatcgtacagtacacggctaccgatcctagcggaaacaacagaacatgcgacatccacattgtgatcaagggctccccatgcgaaatcccgtttacaccagtgaatggggacttcatttgcactccagacaacacaggcgtcaactgtacgctgacctgcttggagggctacgatttcacagagggctccacagataagtattactgtgcttatgaggacggcgtttggaaacccacctataccactgaatggccggactgcgccaaaaagaggttcgcaaaccatgggttcaaatcttttgagatgttctacaaggctgcccgttgcgacgataccgatctgatgaagaaattttctgaggcttttgagactaccctgggcaaaatggtgccttctttttgttctgatgccgaggatatcgactgtagactggaggagaacctaaccaaaaaatactgcctggaatacaattatgattacgaaaacgggttcgctatcgggcccggcggctggggagctgctaacagactcgactattcctatgacgatttcctcgatactgtccaagagacagcaactagtatcggcaatgcaaaaagcagccgcattaagaggagtgcccccttgtctgattacaaaattaaactcatttttaatatcacagctagcgtccccctcccggacgagcgcaatgacaccctggagtgggagaatcagcagaggctgctgcagactttggagaccatcaccaacaagctcaaaaggaccttgaataaagatccaatgtatagtttccagttggcctcagagatccttatcgcggatagtaactctctcgaaaccaagaaggccagcccattttgtaggccaggatctgttctgcgcggccgaatgtgcgtcaactgcccactgggaacctactacaatcttgagcatttcacttgtgagagctgccgaataggaagttatcaagatgaagaaggacagctggaatgcaagctgtgtccatcgggaatgtatactgaatacattcattcaaggaacatcagcgactgtaaagcccagtgtaaacagggtacctactcttactccggtctggagacatgcgagtcatgccccctcggcacttaccagccaaagttcgggtccaggtcgtgccttagctgtcctgagaacacctctacggtgaagagaggcgctgttaacatatctgcgtgcggggtgccttgccccgagggcaagttttctaggagtggtttgatgccttgccatccttgccccagggattactaccagcctaacgccggcaaggcattttgcctggcatgtcccttctatgggaccacgccatttgcaggatcccggagtatcaccgaatgttctagttttagctccacattttctgcagctgaagaaagtgtggtgccacctgcaagcttgggacacatcaagaagaggcacgagatctcctcacaggtgttccatgaatgcttcttcaatccatgccacaatagcggtacgtgccagcagctgggacgtggctacgtgtgcctgtgtccattaggctatacgggccttaagtgcgaaactgacattgatgaatgtagcccgctaccctgcctcaacaatggggtgtgcaaagacctagttggtgaattcatttgtgagtgcccaagcggctatacaggtcagagatgtgaggagaacattaacgagtgctcatcgtccccctgcttgaataaaggcatatgtgtggacggcgtggcaggctaccggtgcacttgtgtcaagggctttgtgggcctgcattgtgaaaccgaagtgaatgagtgtcagtccaacccttgtttgaacaatgccgtctgtgaggatcaggtgggtggatttctgtgtaagtgcccacctgggttcctggggaccaggtgcggaaagaatgtggacgaatgcctttcccagccttgcaaaaatggcgctacctgtaaagatggcgccaattcttttcgctgcctctgtgcagccgggttcaccggctcccattgtgaactcaatattaatgaatgccaaagcaatccatgccgcaatcaagcgacctgcgtcgacgaacttaatagctattcctgcaaatgtcaacctggattctcaggcaagaggtgtgagactgaacagagtactgggttcaacttggacttcgaggtgagtggaatttatggctacgttatgctggatgggatgctgcccagtctgcatgctctgacgtgcacattttggatgaagtccagtgacgatatgaattacggaactcctatctcctacgccgtggacaacggctctgataataccctgcttcttacagactataatgggtgggtgctttacgtgaatgggagagagaaaatcaccaattgcccttcagtgaacgatggcagatggcaccacatcgccattacctggacaagcgccaatggcatttggaaggtatacatagatggaaagctgagcgatggtggagccggactgagtgtgggattgcccatcccaggcggcggggccctcgtgcttggtcaagagcaggacaagaagggcgagggtttttcccccgcagagtcctttgtgggatccatatcacagttgaacttgtgggattacgtgcttagtccccagcaggtgaagagccttgctacaagttgtcccgaagagttatctaaggggaatgttctggcatggcccgactttcttagcggaattgttggcaaagtaaaaatcgactcaaagtcgatcttttgcagtgattgtccccgcctggggggctctgtgccgcacctgcggaccgcatcagaagacctgaagccgggttccaaagtaaacctgttctgcgatcccggattccagctggtgggaaatcccgtgcagtattgtctcaaccagggacagtggacccaaccactgccccattgtgagcgcatctcctgcggcgtgcctccacccctggagaatgggttccactctgcggacgatttctacgcggggtccactgtcacgtaccagtgtaacaacggatattacctgctgggtgattctagaatgttctgcaccgacaatggcagctggaacggagtcagcccttcatgcttggacgtagatgagtgcgccgtaggcagcgactgcagcgagcacgcaagttgtctcaacgtggatggttcatacatctgttcctgtgtgcctccttacacaggtgacggcaaaaactgcgctgagcccattaaatgcaaagctcccggcaacccagaaaatgggcattcatccggcgaaatttacactgtcggcgcggaggtcacctttagctgtcaggaaggatatcaactgatgggcgtgacaaaaatcacttgtcttgagagcggtgaatggaatcaccttatcccgtattgtaaagcagtctcatgcgggaaaccagctatacctgagaatggatgcatagaagagttagccttcactttcgggtcaaaggtgacatatcggtgcaataaaggctacacgctggctggagacaaggaatcttcctgtctggcgaactctagctggtctcattcaccccctgtgtgtgagccggtgaagtgtagtagtcccgaaaatatcaataatggaaagtatatcctgagcggacttacctacttgtccacagcaagttacagttgcgatacgggctattccctgcaagggcccagcatcatcgaatgcactgccagcggcatatgggaccgggcaccaccagcctgtcatttggttttctgtggagaacccccagcaatcaaggacgccgtcattaccggcaacaatttcacgttccgtaatacagtcacttacacgtgtaaagaggggtatacactagctggcctagataccatagaatgcctggctgacgggaagtggagtaggagcgatcagcagtgcctggctgtttcttgcgatgagccacctattgtggatcatgcaagccctgaaaccgctcaccgtctgttcggggatattgcattttactactgctcagatggctacagcctggccgataattcccagctgctgtgtaacgcccagggcaaatgggtccccccagaaggacaggatatgcccaggtgcattgcgcacttctgcgaaaaacctccctctgtgtcctattcaattctggaatctgtcagcaaggctaagttcgccgcaggaagcgtggtgtctttcaaatgcatggaggggttcgtgcttaacacttcagctaagattgagtgcatgaggggtggccaatggaacccgagcccgatgagcatccagtgcatccctgtacggtgtggagagcctccaagtatcatgaatggatacgcatcagggagtaattattcctttggagccatggtggcttattcctgcaataaggggttctacatcaaaggcgagaaaaagtctacgtgcgaggccacggggcagtggtcttcacctattcccacatgtcatccagtttcatgcggagaaccacccaaagtggaaaacggcttccttgaacacaccacaggcaggattttcgagagtgaggtccggtatcagtgcaacccaggctacaagtccgtgggatctcccgtattcgtgtgtcaggctaatcgacattggcatagcgagagtcccctgatgtgtgtccccttggattgtggcaaaccccctcccatccagaatggttttatgaaaggtgagaatttcgaggtgggatctaaggtgcagtttttttgcaatgagggctacgaactggtaggcgacagctcatggacctgtcagaagagtggaaagtggaataaaaagtctaaccccaagtgcatgcccgccaagtgccctgagccgcctctattggagaaccaactagtgctaaaggaattgactaccgaggtgggcgtggtaacgttttcatgcaaagagggacacgtgctgcagggcccctccgtgcttaagtgtctacccagccaacagtggaacgactcattccccgtctgtaagattgtcctgtgtacccccccaccccttatcagcttcggagtgcccatcccaagctctgccctgcattttggctcaacggttaagtattcatgcgtgggagggtttttcctgcgtggcaactccaccactctctgccagcccgacggcacatggagctcccccttgccggagtgtgttcccgtcgaatgtcctcagcccgaggaaataccgaatgggataatagatgttcagggactcgcgtatttgtctaccgcgctctatacctgtaaacccgggtttgaactcgtcggaaataccactaccttgtgtggcgagaatggccactggcttggcggcaagcctacgtgcaaggccattgaatgcctgaaacctaaggagattttgaatggaaaatttagctacacagatttgcactatggccagaccgtgacatactcttgcaataggggctttaggctagagggaccctccgccctcacttgtctcgagacaggagattgggacgttgatgccccatcctgcaacgccattcactgcgacagtccacagccgatcgagaatgggtttgtggaaggcgctgactattcctatggagccataattatttatagttgctttcccggctttcaggtggctggacacgctatgcaaacatgcgaggagtccggctggagcagctctattccgacttgcatgccaatcgattgcggtcttcctcctcatatagacttcggcgactgtactaaactgaaagacgaccagggctactttgaacaggaggacgacatgatggaggtcccgtacgttaccccacatcctccttaccacctcggcgccgtagctaaaacatgggagaataccaaagagtcccccgctactcattctagcaatttcttgtacggtaccatggttagctatacatgtaaccccggatatgaactactcggcaaccctgtactgatttgccaggaggatggtacctggaacggctcagcccctagctgcatctctatagagtgcgacctgcccactgcccctgagaacgggttcctcagattcaccgagacgagcatggggagtgcggtgcagtactcttgtaaacccgggcacatactggcaggctcagatctgagactgtgccttgaaaatcggaaatggtcaggtgctagtccccgttgcgaggccatttcctgcaagaaaccgaatcctgtgatgaacggcagcattaaaggttctaactatacctatctttcaaccctgtattacgagtgtgacccgggttacgtactcaacggcaccgagcggagaacgtgccaggacgacaaaaattgggatgaggatgagccaatttgtattcccgtcgactgtagcagccctcccgtaagtgcaaatgggcaggtgcgcggagacgaatacactttccagaaggaaatcgaatacacctgtaacgagggtttcctgctcgagggtgccagatcaagggtgtgtcttgctaatggctcatggagcggagctaccccggattgcgtgccagtgaggtgtgcaacacccccgcagcttgcaaacggagtgactgagggactcgactacggattcatgaaggaggtgaccttccactgtcatgagggctatattctgcacggtgcaccgaagctgacgtgccaaagcgacggcaactgggacgcagaaattccattgtgcaagcctgtgaactgcggcccccctgaagacttggctcatgggttcccgaacggttttagtttcatacatggcgggcacatccagtaccagtgtttccccgggtacaagctgcatggcaactccagcaggcgctgtttatctaatggctcctggtccggctcctctccctcctgcctgccgtgccgctgtagcactccagttatcgagtacggaacagttaacggcaccgactttgactgtggaaaagctgccagaattcaatgtttcaaaggctttaagctgttagggctctcagaaataacgtgtgaagcagacgggcagtggagcagcgggttcccacactgtgaacacacatcttgtggctcgctccccatgatcccgaacgcctttattagcgagactagctcctggaaggagaacgtgattacttacagttgtaggagtggctacgtgatccagggatcctccgatttgatctgcacagagaaaggggtctggagtcagccatacccagtgtgcgagcccctctcatgcgggagcccaccctcagttgccaacgccgtggccaccggggaggcacacacctacgagtcggaggtgaaactgcgctgcctggaggggtacaccatggatactgatactgacacctttacctgtcagaaagacgggaggtggtttcccgagaggattagctgttcccctaaaaaatgtccactcccggagaatattacacacatcttggtccatggggatgatttttcagtaaatcggcaggtttcagtgtcctgtgccgaaggatatacctttgagggggtgaacatctcagtgtgccagctagacggcacctgggagcctcctttttcagatgaatcatgctctccggtgtcttgcgggaaacccgaatctccagaacacggttttgtggtagggtcaaagtacacattcgagtcaactattatttaccagtgcgaaccgggatatgaactggagggtaatagggagagggtatgtcaggagaaccgccagtggagtggtggcgtggcaatctgtaaagagacaaggtgcgagacgcccctcgaattcctgaatggtaaggccgacatagaaaatcgaaccactggccctaatgtggtttattcatgtaatcgaggctactccctcgaagggccaagcgaagcacattgcacagaaaatggaacttggagccaccctgttcccttgtgtaaacccaacccctgccccgtccccttcgtgattcccgaaaatgcccttttaagcgaaaaggagttttacgttgaccaaaatgtctcgatcaagtgtcgtgaggggtttcttttacagggacacggcattataacctgcaaccctgacgagacatggacacaaacctccgccaaatgcgaaaaaatttcctgtggcccccccgctcatgtcgagaatgccatcgccaggggggtacactaccagtacggtgatatgatcacctattcatgctactccggctacatgttggaaggttttttaaggtccgtgtgtctcgagaatggcacttggacatccccaccaatctgtcgggctgtgtgcaggtttccctgccaaaatggtggaatctgtcaacggcctaacgcttgcagctgtccggaaggttggatgggacggttatgcgaagagcccatctgcattttgccgtgcctgaacggtggaaggtgcgtggctccataccagtgtgattgtccacccgggtggaccggcagccgctgccacacagcagtgtgccaatccccatgtttaaacggtggcaaatgcgtgcggccaaatcggtgtcattgtcttagtagctggaccggccataattgtagtcgtaagaggcgaacaggattttag

SEQ ID NO: 136731 - DNA, 10716 bp, Artificial Sequence
  Description of Artificial Sequence: Synthetic coding sequence
atgtggcccaggctggccttctgttgctggggccttgcccttgtgtcaggatgggccacttttcagcagatgagtcccagcaggaactttagtttccgtctgtttcccgaaacagcccccggagccccggggtcaatccccgctcctcccgcccccggggatgaggcagcaggatctagagtggagcgcctgggtcaagcctttaggaggcgggtacgactgctccgggagctctccgaacggctagaactagtatttctagtggacgactcctccagtgtgggagaagtaaactttaggtccgaactaatgtttgtccgaaagcttctctcagattttcccgtcgtgcctaccgccactcgagttgccattgtgaccttcagttccaagaactacgtggtgccaagagtcgattatatcagcacccgcagggcccgtcagcataaatgcgctctgcttctgcaggagattcctgctataagctaccgggggggaggaacttacactaaaggcgctttccagcaagccgcacagatcctgctccacgccagggagaacagcaccaaagtggttttcctgatcacagatggttattctaacggaggcgatcctcggccaatagccgcttccctgcgggatagcggagtggaaatcttcacgtttgggatctggcagggcaacattagggagcttaacgacatggcttccacaccaaaagaggagcactgctatctccttcactcattcgaagagtttgaggctctggcacgcagggctcttcatgaagacctaccatctggcagctttatccaggatgacatggtccactgctcatatctctgcgacgaaggcaaagactgctgtgatcggatgggcagctgcaaatgcgggacacacacggggcattttgagtgcatatgcgagaaagggtactacggaaaaggcctccagtacgaatgcaccgcatgcccatctgggacatacaagccagaaggatcgccaggcgggataagctcttgtatcccctgtcccgatgaaaatcatacctctcctcccggatccacttcaccagaagactgtgtgtgccgcgagggctacagagcatccgggcagacatgtgagctggtccattgtcctgccctgaagccacccgagaacggatatttcatccagaacacgtgtaataatcatttcaatgcggcgtgcggcgtcagatgccatcctggattcgatctggtaggctctagtattatcctttgtctgcccaacggtctgtggagtgggtctgaaagctattgccgcgtccgcacatgtccacaccttcgccagccgaagcatggccatatcagttgttccacacgcgaaatgctctacaaaacgacttgtctcgtcgcttgcgatgaaggataccgcctcgaagggagcgacaagctgacctgccaggggaatagccagtgggatggcccagagcctcggtgcgtggaaaggcactgtagcacctttcagatgccgaaagatgtaattattagtcctcacaactgcggaaaacaacctgctaagttcggcacaatttgctatgtctcatgcagacagggatttatcctgtcaggcgtcaaggagatgctaaggtgtactactagtggtaaatggaatgtgggtgtacaggccgctgtgtgcaaggacgtggaagctcctcagatcaattgtcccaaggatatcgaggccaagactctggagcagcaggattctgctaatgtaacctggcagatccctacggccaaagataatagcggggagaaggtctctgtgcatgtgcacccggcctttacgcctccatacttgttcccaataggcgatgttgcaattgtgtacacagccactgacctgtctggtaaccaggcgagttgtatctttcatattaaggtcattgacgctgagccaccagtgatagactggtgtcgaagtccccccccagttcaggtgagtgagaaggtacatgcagcctcttgggatgaaccccaattctccgataattccggggcggagctagtgattacccggagccatacacagggcgacctgtttcctcagggtgaaactattgtgcagtatactgcaaccgatccttcaggcaacaatagaacatgtgatatccacatcgtgatcaagggttccccctgtgagatcccatttactcccgttaacggtgacttcatctgtacccccgataatacgggcgtgaattgtaccctgacatgtctggaagggtatgattttactgaagggtcaaccgacaagtattactgtgcctacgaagacggagtgtggaaaccgacatatacgacagaatggcccgactgtgctaagaagcgcttcgcaaatcacggcttcaagtctttcgaaatgttttataaggccgccaggtgtgacgatactgaccttatgaagaagttttctgaggcctttgaaactactttagggaagatggtgccatcattttgcagtgacgctgaagatatcgactgccgactcgaggagaatttaacaaaaaagtactgtcttgagtacaattatgattatgagaatgggtttgcaatcggacccggggggtggggagccgcaaaccggctcgactacagctacgacgacttcttggatactgtgcaagaaacagctacttctatcggtaacgccaagtcatcccgtataaaacgctctgcacctctatccgactataagatcaagctgatcttcaatattacagctagtgtccccctgcccgacgaacgtaatgatacacttgagtgggagaaccaacagcggttgttgcagaccctggaaaccattacaaataagctgaagagaacactcaataaggaccctatgtattcattccagctggcctccgaaatcttgatcgccgattctaactctctggaaaccaagaaggcctctcccttctgtagacccggatctgttctgagggggagaatgtgcgtaaattgtccactgggcacgtactacaacctcgaacacttcacatgcgagtcctgccgaatcggctcatatcaggatgaagaggggcagttagagtgcaaactgtgtccctcaggcatgtacacggaatacattcacagccggaacatcagcgattgcaaggctcaatgtaagcagggaacttactcctattccggtctcgagacctgcgaaagctgtcccctgggaacctaccaacctaagtttggatcccgaagttgtctgtcatgccccgagaataccagtaccgtgaagcgaggagccgttaacattagcgcttgcggcgtgccctgccccgagggcaaatttagtaggagcggcttgatgccttgccacccctgcccaagggactactatcagcctaacgcaggcaaggcattctgcttagcctgccctttttatgggacaacgccttttgccgggagcaggtcgatcactgaatgcagtagcttcagtagtacgttctcagccgctgaggagagtgtcgtgccccctgcatccttggggcacattaagaaacggcacgagatctcttcacaggtgttccacgaatgtttctttaatccatgccacaacagtggcacatgccaacagttggggaggggatacgtgtgcctctgccctcttggctacaccggtctgaagtgcgagaccgacatagatgagtgcagtcccctaccttgcttgaacaacggagtttgtaaagacctggtcggcgaattcatctgtgaatgtccgtccgggtacactggacagcgatgtgaggagaatatcaacgagtgtagcagctctccgtgccttaacaagggcatctgcgtggatggagtggccggctataggtgcacgtgcgttaaaggattcgtgggcttacattgcgagactgaagtcaatgagtgtcaatctaacccatgccttaacaacgccgtctgcgaagatcaggtcggggggttcctttgtaagtgcccccccggctttctggggacaaggtgcgggaagaacgtcgacgaatgcctttcccaaccatgcaagaatggcgccacgtgcaaggacggagccaactctttccggtgtctgtgcgcagccgggttcacaggatctcattgcgaactgaatatcaatgaatgccagagcaatccctgccgtaaccaggccacttgcgtggacgaattgaatagttactcgtgtaaatgccaacccggattcagcggaaagcgatgtgagaccgaacagtccactggctttaacctggactttgaagtttctgggatttatgggtacgttatgctggatggtatgcttccgagccttcacgcactaacttgcacattttggatgaaaagctcggacgatatgaactatggaaccccgatttcatacgctgtcgataacggaagcgataatacgttgttgctaacagattacaacggatgggtcctatacgttaacggacgcgagaagatcaccaactgcccgtcagtcaacgacggacgctggcatcatatcgccatcacctggaccagcgccaatgggatttggaaggtgtatatcgacggcaaactgtccgatggcggtgccggactgtcagtaggattacctatccccggtggaggcgcgctcgtacttggacaagagcaggataaaaagggggaaggctttagtcccgcggagtcatttgtgggatccatcagccagctgaacctgtgggactacgtactgtctccacagcaggttaagtctctggcaacatcatgtcctgaggaattgtccaaggggaacgtcctcgcttggccagattttctgtcaggaatcgtaggtaaagtgaaaattgattcaaagtccattttttgttcagactgtccaagacttggcggatccgtgccccatctccgcaccgcctccgaagacctgaaacctggcagcaaggttaacctgttttgcgaccccggctttcagctggttgggaatcccgtgcagtattgtttgaaccagggacagtggactcaaccactacctcactgcgagagaataagctgtggggtacctcccccattagaaaatggcttccattccgctgatgacttttacgccggctcaaccgttacctaccagtgcaacaacggatactatttactgggtgactcaagaatgttttgcacagataatggaagttggaatggagtctccccttcctgccttgacgtcgatgagtgtgctgttgggagcgactgttctgagcacgcttcgtgtctgaatgtcgacggatcatatatctgctcatgtgtaccaccatacactggcgacgggaagaattgcgcagaacccatcaagtgtaaggcaccgggcaatccagaaaatggccatagttctggggaaatatacacagtaggtgccgaggtgacattttcatgtcaagaagggtatcagctgatgggcgtgaccaagataacttgtctagaatctggtgagtggaaccacttgataccatattgcaaagcagtgtcatgtggcaagccagctatccctgaaaacggatgtattgaagagctcgctttcaccttcggcagtaaagtgacataccgctgcaataaaggatacactttggcaggggataaagagtcgtcgtgcctcgccaactcatcctggtctcattccccacctgtctgtgaacctgtgaagtgttcaagccccgaaaacattaacaatggcaagtacatcctatccggccttacatacctttcaaccgccagttatagttgtgataccggatacagcttacaaggcccctctattatcgagtgcaccgcctccggaatctgggacagagctccacctgcctgtcatctggtgttctgtggggagccgccggccatcaaggatgccgtgatcacagggaacaattttaccttcagaaacacggtgacatatacctgcaaagaagggtacacactggccggtctggacactatcgaatgcctggctgacggcaaatggtcccgttccgatcagcagtgcttagctgtcagctgtgacgagccacctattgtggaccacgctagcccagagacagcacaccgtctgttcggtgatatcgcgttctactactgttccgacgggtattctctggccgataattcccagcttctgtgcaacgctcagggcaaatgggtgcctcctgagggacaggatatgcctcgttgtatagctcacttctgcgaaaagccaccttcagtgagctatagtatcctggagtccgtatccaaagctaagttcgccgctggcagcgtcgtctcattcaagtgtatggagggttttgtcttaaatacctccgccaagattgaatgtatgcgaggcggccaatggaacccatcacccatgtcaattcagtgcatccccgtcaggtgcggcgaacctccatccatcatgaatggttatgctagcggatcgaactatagctttggcgccatggtggcttactcctgcaataaaggattttatattaaaggcgagaagaaatctacttgtgaagcgacagggcagtggagcagtccaattcccacttgccacccagtttcttgtggcgaacctccaaaggtggaaaatggatttttagagcatactaccggtaggatatttgaaagcgaggtgcgctaccagtgcaatccgggttacaagagtgtagggagtcccgtcttcgtgtgccaggccaatcggcattggcactctgaatcccccctgatgtgtgtccccctggattgtggcaagcccccccccatccagaacggattcatgaagggcgaaaattttgaagtgggttcaaaggtacaattcttctgtaatgaggggtatgaacttgtaggcgactcctcctggacctgtcaaaaatccgggaaatggaataagaagagcaacccaaagtgcatgcccgctaagtgcccagagccacccctgttggagaaccaattagtccttaaagagcttactacagaggtgggggtggtgactttttcatgcaaggagggacacgttctgcagggcccgagtgtgctgaaatgcctgcctagccagcagtggaacgactccttcccggtatgcaaaattgtgctatgtacaccgccacctttaatttcattcggtgtgcctatcccctcctcagctcttcacttcggctcaacagtcaagtatagttgtgtgggcggatttttccttagaggcaacagcaccactttatgtcagccagatgggacttggtcttctcctctgcctgagtgcgtgccggtggaatgcccccagccggaagagatccccaatggcatcatcgacgtacagggattagcctatttgtccactgctttgtacacttgtaaacctgggtttgagctggttgggaatacgactaccctttgtggcgagaacggccattggttaggcggcaagccgacctgcaaagcaatcgaatgtctgaagcccaaggagattttgaatggcaagttctcatatacagacctgcactacggtcagacagtgacttatagctgcaaccggggtttccgtctggaggggccctctgcactcacatgtttggagaccggcgactgggacgtagacgcgccaagttgtaatgcaatacactgcgatagccctcagcctatcgagaatggcttcgtggagggggctgattatagctatggggcgatcattatctactcttgttttccaggctttcaggttgccggccacgcaatgcagacatgcgaagagtcaggttggagttcctctatccccacctgcatgcctattgactgcggactgccccctcacatcgacttcggcgattgtacaaagctcaaggacgatcagggttatttcgagcaggaggacgacatgatggaggtgccttacgttacaccacatccaccgtaccatctcggcgcagttgcaaagacatgggagaacacaaaggagtctcccgctactcattcttctaatttcctttatggcacaatggtatcttacacatgcaacccaggctatgagctattgggtaatcctgtgctgatttgtcaagaggacggcacgtggaatggatctgccccaagctgtatctcaattgagtgtgatctacctaccgctcccgaaaatggatttctgcgctttacagagaccagcatgggttctgctgtgcaatatagttgcaagcctggacacatcctggctggttctgatcttaggttgtgtttggagaaccggaagtggtccggagcttcccctcgctgcgaggccatcagctgtaaaaaaccgaaccctgtgatgaatggttccattaagggatcaaactatacttacttgtccacgctgtattatgaatgcgatcccgggtatgtattgaatggcacagaaaggcgcacctgccaggacgacaagaattgggacgaggatgagcccatatgcatcccagttgactgctccagtccccctgtgtccgccaacggacaggtccggggagacgagtatacctttcaaaaggaaattgagtacacttgcaatgaaggctttctcctggagggggccagatctagggtgtgcctggcgaatggaagttggtccggcgctacacctgattgcgtccctgtgcgctgcgcaacaccccctcagctggcaaatggcgtgactgaaggcctcgattatggatttatgaaagaggtcacattccactgccacgaggggtatattttacacggtgctccaaagctgacgtgtcagagcgacggaaattgggatgccgagatacccttgtgtaaaccagtcaactgtgggccgcctgaagatcttgcccacggatttccaaacggcttcagctttatccacggtggacatattcagtatcaatgcttccccggatataagctccacggaaatagctctcgtcgctgccttagtaacggatcatggtcgggaagctctccatcttgcctgccttgtcgatgttcaacacccgtgattgagtatgggaccgtgaacggtactgattttgattgcggtaaggcggcacgcatccagtgctttaagggcttcaagctgctgggtctctctgaaattacctgtgaagccgacggccagtggtctagtgggttcccacattgcgagcatacatcttgtggcagcctccctatgattcctaacgcgttcatttccgagacttcctcttggaaggaaaatgtgattacatatagttgcagatctgggtacgtcatccagggtagctccgatctgatctgtacggagaagggggtgtggagccagccgtacccagtatgcgagccactgtcttgcgggtctcccccttccgtcgccaatgccgtagcaactggagaggcacacacgtatgagagcgaggtcaagcttcgctgtcttgagggatacactatggacacagacacggatacattcacatgtcaaaaggatggcaggtggtttcctgagagaataagctgttcccctaagaaatgtcctctgccagaaaatattacgcatattcttgttcacggagacgactttagcgtaaaccgtcaggtgtctgtctcttgcgccgaaggttacactttcgagggcgtgaacataagcgtctgccaactggacgggacctgggagccccctttctccgacgagtcgtgttcacccgtgtcctgcggaaagcccgaaagtcccgaacacggattcgttgtaggcagtaagtatacattcgagtcaactatcatctaccagtgtgaacctggatatgagctcgaaggaaatagagagcgagtgtgccaggaaaataggcagtggtctggtggcgtagcgatttgtaaggagacccggtgcgaaactcctcttgaattcctcaacggaaaggcggatatcgaaaataggaccaccgggcccaatgtggtctatagttgcaaccgtggctacagcttggaggggccgtccgaagctcattgcaccgaaaacggaacttggtcacatccagtgcccctatgtaaacctaatccctgccctgtgccgtttgtaattccagaaaacgcactcctctccgaaaaagagttctatgtagaccagaatgtatcgattaagtgtcgcgagggattccttctgcagggtcatggcattatcacatgtaatcctgacgaaacttggacccagacctctgccaaatgcgagaaaatcagctgtgggccccctgcacatgtagaaaacgcaatcgccagaggcgtacattaccaatatggagacatgattacatattcctgctatagcggttacatgttagaagggtttctgcgcagcgtatgccttgagaatggaacgtggacgtctccaccaatttgtagggccgtctgtcgcttcccctgccaaaacggaggaatctgccaacgacctaacgcctgtagctgtccggaaggttggatgggaaggttatgtgaggagccaatttgtatcctgccatgtctcaatgggggtcgctgcgtcgcaccataccaatgcgactgtcctcctggctggaccggttccagatgccatactgctgtgtgccaaagtccatgcctaaacggaggtaagtgtgttcggcccaaccgctgccactgcttgagttcatggaccggtcacaattgcagtcggaagaggcgaaccgggttttag

SEQ ID NO: 136732 - DNA, 1356 bp, Artificial Sequence
  Description of Artificial Sequence: Synthetic coding sequence
atggattttgatgtgggccgcaccactcatctttcctcttccccctgtagtgcttcgaatggcggtgagagtggacaggttagcaaaagaaggtgcctaatcggcgagagcggccacgacaccccttggtgttctcctataaaggttaaatatggtgatgtgtattgcagagcccctcagggaggatactacaagaccgccctcggcactcgttgcgatattcgctgccagaaaggatatgagctacatggatcatccttattaatttgccaatccaacaaaaggtggagcgacaaagttatttgtaagcagaagaggtgccctactttagcaatgcccgcgaacggagggttcaagtgtgttgatggcgcatacttcaatagcaggtgtgagtattactgctcccctggatacactctcaagggagagaggacagtgacttgtatggacaataaggcttggagcggccgcccagcgagctgcgtcgatatggagccacctaggattaaatgcccctctgttaaggagcgtattgcggaaccaaacaagctgactgtgagggtgtcttgggaaacgccggagggacgagatactgcagacggaattctgaccgatgtaattctcaagggactgcctccagggagcaatttccctgaaggagaccataagattcagtacactgtgtacgatcgggccgaaaataagggcacgtgtaaatttagagtaaaagttagagtgaagcgctgtggaaaactgaacgcccctgaaaacggctatatgaaatgctcttcggacggtgacaactacggagcaacctgtgaattttcttgcattggcggctatgagttacagggttcccccgcgcgggtgtgtcagtctaatctcgcctggtccgggaccgaacctacatgcgccgctatgaatgtgaacgtgggagtgcggactgccgcagccctgctggatcagttctatgaaaaacggagacttctgattgtctcaacacccactgcacggaacctgctgtacaggttgcaactcggaatgttgcagcaggcgcagtgcggtctagatcttcgccatatcacagttgttgagctcgtaggggtgttccccactctcatcggccgtatcggtgcaaaaattatgcctccagcactcgcactccaactgaggctgctgctgagaatacccctgtactccttcagcatggtgctcgtagataaacatgggatggataaagaacgctatgtctcactcgtgatgcccgtggccctcttcaatctcatcgatacttttcctcttcgaaaagaggaaatggtcctccaggcagagatgtcacaaacttgtaacacatag

SEQ ID NO: 136733 - DNA, 1395 bp, Artificial Sequence
  Description of Artificial Sequence: Synthetic coding sequence
atggggtcacccgcccacagacccgccctgctgcttctgctacctccccttctgttactgcttctgctccgggtgcccccatccaggagctttccaggttcaggagactcccctctagaggatgatgaagtcggctactcacatccgcgatataaagacacaccttggtgtagccccattaaagtgaagtatggcgacgtatactgtcgcgcgccccagggggggtattataagacagcgttggggactaggtgcgacatcaggtgtcagaagggctatgagttgcatggttcttctctcctgatctgtcaatctaataaaaggtggagcgacaaggttatctgtaagcagaagaggtgtccaaccctagccatgcctgcaaacggtgggttcaagtgcgtggatggagcatatttcaatagcagatgtgagtattactgctcacctggatataccctaaaaggcgaaagaacagtcacctgcatggataacaaggcttggtctggtcgcccggcgtcctgcgtggacatggagccaccacgcataaagtgcccatccgttaaggagcgcatcgcagagccgaataagctgacagtgcgcgtttcttgggaaactccagaaggcagggataccgcggacggcattcttaccgacgttatcctgaaaggcctgcctcctgggagcaacttcccagaaggagatcataaaatccaatacaccgtgtatgacagagccgagaataagggcacatgtaagtttcgggtgaaggtgcgagtcaagagatgcggtaaattgaatgcaccggagaatgggtatatgaagtgcagttccgatggggataactacggagccacttgtgaattttcttgcattggtggatatgaactccaagggtccccagccagggtgtgtcagtccaacctggcttggagtgggacagaacccacctgcgccgctatgaacgtgaatgtcggagttcgcaccgccgccgccctgctcgaccagttttacgagaagagacgccttctcattgtaagtacccctacggctcggaacctcctttacagactgcagctggggatgctgcagcaagcccagtgcggtcttgacctgcggcatatcactgtagttgagctcgtgggtgtcttcccgaccctgattggacgaataggtgccaagattatgccccccgccttggcgctccagctgaggctgctcctgcgcatccctctgtattccttctcaatggtcctagtggataagcacggtatggataaagagcgctacgtgagcctggtgatgcccgtagccctgttcaatctcatcgacacctttccactcaggaaggaggaaatggtcttacaggctgaaatgagtcagacctgcaatacctag

SEQ ID NO: 136734 - DNA, 1218 bp, Artificial Sequence
  Description of Artificial Sequence: Synthetic coding sequence
atggggtccccagcccacagacccgccctcctcctccttcttcccccacttctgctgcttttattgttgagggtgccgccatctcgcagctttcctgggtccggggattcaccactggaagacgatgaagtgggctactcccatcctcgatacaaagataccccctggtgttcaccaataaaggtgaaatatggtgacgtatactgccgggctccccaaggaggctactacaagaccgccctgggaaccaggtgtgatattagatgtcagaagggttacgagctacatggaagctccctgctaatctgtcagagcaacaaaagatggagcgataaagtgatttgcaagcatatggaacctccacgcattaaatgcccgagcgttaaagaaaggatcgccgaaccaaacaagctcactgtgcgtgtaagctgggagacgcccgaaggtcgcgatactgctgacgggattctaacggacgtgatcctgaaaggacttcccccgggctcaaacttcccagagggagatcataagatacaatacaccgtctacgacagggcagagaacaagggaacctgcaagtttagggttaaggtaagggtgaagcggtgcgggaagctcaacgcaccagaaaacgggtacatgaaatgctcctctgatggcgacaattacggcgccacctgcgagttcagttgcataggaggttacgagctacagggctctccagcccgcgtgtgtcagagcaacttggcgtggagcggcaccgagcctacatgtgcagctatgaatgtaaacgtgggagtccgcactgccgcagcactcctggaccagttctatgagaaacgcaggttgctgatcgtgtctacgcctaccgctagaaatttgctgtaccgactccagcttggcatgttgcaacaggcccaatgcggacttgacctgcgacacatcacggttgtcgaactcgtaggggtcttccccactctgattggccggatcggagcaaaaattatgccacccgcactggcattgcagctgaggctgctactccgaattccactttatagcttcagcatggtcctggtcgataaacatggaatggataaggagcgctatgtcagcctcgtgatgcccgtggctctttttaacctgatcgacacgtttcccctgcggaaagaagaaatggtcctccaggccgaaatgagccaaacatgtaatacctag

SEQ ID NO: 136735 - DNA, 1140 bp, Artificial Sequence
  Description of Artificial Sequence: Synthetic coding sequence
atgggttcacctgctcacaggcctgcgctgttactgctcttaccaccgctcctgttgcttctattactgcgcgtcccaccaagccggagcttccccggcagcggggattccccccttgaagatgacgaggtggggtactcccacccaaggtacaaggacaccccgtggtgctctccaatcaaagtgaagtacggtgacgtctactgtagagctccccagggcggatactataaaactgctctgggcacgagatgtgacataaggtgtcagaaggggtacgagctgcacgggagcagcctgctaatctgccagtctaacaaacggtggtcagacaaagttatttgcaagcaaaagaggtgccccacacttgcaatgccagcaaatggcggctttaagtgtgtagacggggcatacttcaacagccgctgtgagtattattgtagtccgggatacacccttaagggagaaaggaccgtcacatgtatggacaacaaagcctggagtggaaggcctgcgtcatgcgtcgatatggagcctccgcggatcaagtgtcctagtgtgaaggagagaatcgctgaacctaacaagctgactgtgagggttagctgggagactccagaaggccgggataccgcggatggtattctaactgatgtcattctgaaaggccttccgccgggatcgaacttcccggaaggagatcataagatccagtacaccgtctatgaccgggccgaaaacaagggtacctgcaagtttcgcgtgaaggtgcgcgtgaaacgctgcggcaagctcaacgcgcccgagaatggctacatgaagtgcagctccgatggagataattatggcgccacttgcgagtttagttgtatcggcggttatgaactgcaagggagccctgcccgcgtgtgccagtcgaatcttgcgtggagcgggactgagcctacgtgtgcagccatgaatgtgaacgtcggcgtgcgcaccgcagccgcattgctcgatcaattctatgagaagcgtcgactattgatcgtgtcaacgcccaccgcacgaaacctgctgtaccgcctgcagctgggtatgttgcaagctgtagcagccaaccccacactcctgctgcagtatggcgctagtggctag

SEQ ID NO: 136736 - DNA, 1335 bp, Artificial Sequence
  Description of Artificial Sequence: Synthetic coding sequence
atgggttctcctgctcaccgaccagctttgttgcttctgttgccccctctcctgctcctcttattgctcagggtaccgccctcccgatccttccccgacaccccatggtgttcacccattaaagtcaaatacggcgacgtgtattgccgggcaccccaaggtgggtactataagactgccctagggacccgatgcgacattcgatgtcaaaaaggatacgaattgcacggctcttcattgttaatctgtcagagcaacaagaggtggtccgacaaggtgatatgcaagcagaagcggtgcccgaccctagctatgcctgcaaacggcggtttcaagtgtgtagatggcgcttacttcaacagtcgatgtgaatattattgttcaccagggtatactttaaaaggcgaacgtaccgtgacatgcatggataataaggcctggtccggtaggcccgcatcttgcgtcgacatggagccccctcgcataaagtgtcccagcgtcaaagagagaatcgctgaaccaaataagctgactgtacgtgtgtcctgggagacacccgaaggtagggatactgccgatggtattcttactgacgtgatcctgaaggggttaccaccggggtctaatttccccgagggcgaccataagatccagtataccgtgtatgacagagctgaaaataagggcacttgcaaattcagagtaaaggtgcgcgtgaagagatgtgggaagctgaacgctccagagaacgggtatatgaagtgttcctctgatggcgacaactacggcgctacctgcgaattttcctgcattggtggctacgagctgcaggggtccccagctagggtgtgccagtcaaatctggcgtggagtgggacggaacccacgtgtgccgcaatgaatgttaacgtcggcgtacgaacagccgctgcccttcttgatcagttctatgaaaaacggagattgcttatagtttccactccaacagcccgcaatttactgtatcgactacagcttggtatgctccaacaggcccagtgtggactcgatctgcgacatattaccgtagtggaacttgtgggtgtgtttcctacactgatcggcaggataggcgcgaagattatgccaccagcattagccctgcagctgcggctgctgttacgcatccccctttattctttcagtatggttcttgtcgacaagcacggcatggataaggaacgttatgtgagcttggtgatgcccgtagcgctgttcaacctgatagatacgttccccctgagaaaggaagagatggtcctgcaggcggaaatgtcacagacatgtaatacatag

SEQ ID NO: 136737 - DNA, 1398 bp, Artificial Sequence
  Description of Artificial Sequence: Synthetic coding sequence
atggcttctcaactgacacaaagaggggctctttttttactcttttttctcaccccagctgtcacccccacttggtatgccggtagtggctactatcccgacgagtcgtacaacgaggtgtacgctgaagaagtgccgcaagcaccagctctcgactatcgagtccctagatggtgctacaccctcaacatccaggatggcgaggcaacctgttactcgcccaagggaggtaattatcattcaagcctggggacacgttgcgagcttagttgtgaccgcgggtttaggcttatcgggaggcgatctgttcagtgcctacctagtcggcgatggtccggaactgcttattgcagacaaatgcggtgccatgctctcccgttcatcacctcggggacttatacgtgtaccaatggagtgctactggattcgcggtgcgattactcttgcagttctggatatcatctcgagggggatcggtctcggatatgtatggaggacgggcggtggtccggcggcgaacccgtttgcgttgacattgacccccccaagattagatgccctcattccagggagaagatggccgaacccgaaaaactgaccgccagggtatattgggacccccccttggtcaaggatagcgccgatggcacgataaccagggtcaccctacggggcccggagccggggagtcattttccagaaggcgagcatgttatccggtataccgcttacgacagagcttataatcgggcatcatgtaaatttattgttaaggtgcaggtgaggcgctgccctacgcttaagccccctcagcacggatacctgacctgcactagcgctggcgacaactacggggctacctgcgagtatcattgtgacggcggatatgaccgccaggggactccgagtagggtttgccagtcatcccgacaatggtctggcagtccgcccatctgtgcccctatgaaaattaatgtgaacgtgaatagcgcagcgggtctgctggatcagttctacgaaaaacagcgacttctcattatctctgcccccgatccctcaaaccggtactacaagatgcagatctcgatgctccaacaatctacttgcggactggatctgcggcacgtgacgatcatcgaactagtggggcaacctcctcaggaggtcggaaggattagggaacagcagctcagcgcaaatatcatcgaggagctcagacagttccagcgtttgacaaggtcctacttcaatatggtccttatcgataaacagggaatcgaccgtgacaggtacatggagcccgttacccctgaggagatctttacctttatcgacgattatctattgagcaaccaggagttgacacagagaagagagcaacgcgacatctgcgagtag

SEQ ID NO: 136738 - DNA, 1452 bp, Artificial Sequence
  Description of Artificial Sequence: Synthetic coding sequence
tgaacgtttatggttgaagatgccgttgaggccattggattcggtaaatttcaatggaagcttagtgtgttgacaggcctagcatggatggctgacgcaatggagatgatgatcttgtcaattctagccccacaactgcactgtgaatggcgcctgccctcctggcaggtggcgctgctgaccagcgttgttttcgtcggcatgatgtcctcaagcactctttgggggaacatttctgatcagtatggccgcaaaaccgggctgaaaatatctgtgctgtggacgctttattatggtatcttgtccgccttcgcccctgtctattcctggatcttggtgttgagggggctggtcggattcggtattgggggcgtgccccagagtgtgacactctacgccgagttcctccccatgaaggcccgcgccaagtgtattctgttgatcgaagtgttctgggcgataggaacagtattcgaggtggtgctcgccgtgttcgttatgccttccctaggctggcgctggttgcttattctctccgcagttccattacttctctttgcggtcctttgtttctggctgcccgagtccgccaggtacgatgtgctgagcggcaaccaagagaaggcaatcgccacattaaagagaatagctactgagaatggcgctcctatgcccttaggaaagctcattatctctaggcaagaagacagaggcaagatgcgggaccttttcaccccccacttccgctggaccaccctgcttctctggtttatctggttcagtaatgcgtttagctattacggtctggtcctgctgactactgagctgtttcaagcaggagacgtgtgtggcattagctcacgtaagaaagcagtcgaagcaaaatgtagcctggcctgcgagtacctatccgaagaggattacatggacttactttggacaactctcagtgaatttcccggcgtgcttgtgactttgtggatcatcgaccgactggggagaaaaaaaacaatggctctgtgctttgtcatctttagcttttgcagtctgctgttattcatatgcgtggggaggaatgtgctcactctgttactgtttatcgcacgagccttcatctcagggggttttcaggccgcgtatgtgtatactcccgaagtgtaccccactgcaacaagggcattgggactcggaacatgttctggcatggcaagggtaggtgcattgataaccccgtttatcgcccaggtgatgctggagtcctctgtctatctgactctggctgtctactcaggctgctgcttgctggcagcccttgccagttgctttttaccaatcgaaactaaaggaagggggctgcaggaatcttcgcatagggaatggggccaagagatggtaggccgtgggatgcacggagcgggagtgacccgttcaaactccgggtcgcaagaatag

SEQ ID NO: 136739 - DNA, 39 bp, Artificial Sequence
  Description of Artificial Sequence: Synthetic coding sequence
atggaggaggacctgttccagctgagacaattgccatag

SEQ ID NO: 136740 - DNA, 1023 bp, Artificial Sequence
  Description of Artificial Sequence: Synthetic coding sequence
atggccgcgggccgacttatcattaaaactgaatttctcccaactaagtaccgaggctacatgttgcccttatctcaggtgttctggttagctggatcacttctcattatagggctcgccagtgtgattattcctactatcggctggcgctggctaattagagttgctagcatcccaggcattattcttatcgtcgccttcaaattcattccagagtccgcccgttttaatgtctctacgggaaatactagggctgctctggccaccttggaacgggtggccaaaatgaatagatcagtgatgccagaggggaaactggtggaacctgttctggagaaaagaggccgattcgctgatctcctggacgccaagtacctcaggacgactctgcagatatgggtgatctggctcggaattagcttcgcctattatggagtgattctggcgagcgcagaattgttggagcgggacctggtgtgcggtagtaagtctgactccgccgtggtggtgaccgggggtgacagcggggagtcgcagtccccatgctattgccacatgttcgcaccctctgactaccggaccatgattatttccacaatcggggagatcgccctgaatcctctgaatattttgggaatcaatttcttggggagacgactctctttgagcattacaatgggatgcaccgccctcttcttcttgctgctgaatatctgtacctcttctgccggcctgatcgggtttctgttcatgctccgcgccttggtggccgcaaacttcaataccgtgtacatatacacagccgaagtgtatccgaccaccatgcgtgctctgggcatgggcacatctggttctctatgccgcatcggcgcaatggttgcacctttcatctctcaggtcctgatgtccgcaagcatcctcggagcactatgcctgtttagcagcgtttgtgttgtgtgcgccatctccgctttcacactgcctattgagacaaaagggcgggcccttcagcaaatcaaatag

SEQ ID NO: 136741 - DNA, 1479 bp, Artificial Sequence
  Description of Artificial Sequence: Synthetic coding sequence
atggccacaaaaccaactgagccagtaaccattttgagtctccggaaattatcgctcggcacagcagagccccaagtgaaggagccaaaaaccttcacagtggaggacgctgtcgaaacaataggattcggccgcttccacatcgccctatttctgatcatggggagtaccggggtggttgaggccatggagataatgctgatcgccgtggtctcacctgtgatccgttgcgaatggcagcttgaaaactggcaggtggccctggtcactacgatggtgttcttcggctacatggtgttctcaatcctgtttggtcttctcgccgatcgttacggtagatggaaaatcctacttattagcttcttatggggcgcctacttcagtctgctgacctcctttgcaccatcctacatctggtttgtctttcttcgcacaatggttggatgtggtgttagcggacatagccagggcttgatcatcaaaaccgagttcctccctacaaaatatagaggatacatgctgcccctgagccaagttttctggttggcagggtccttgctcattatcgggctggcttccgtgatcatcccgacaatcggctggagatggttgataagagtcgctagcatccccggaataatcttgatcgtcgctttcaagtttattccagaatccgcccggttcaatgtgtcgaccggcaacacaagagccgccctggccactctcgaacgtgtggcgaaaatgaaccggtctgttatgccagaaggtaagctggttgaaccagtgctggaaaaaaggggtcggtttgccgatctgctggacgcgaagtacctccggacaactttacagatatgggtgatttggctagggatcagtttcgcctactacggcgtgattcttgccagcgccgagctgttggagagggaccttgtatgcgggtctaaatcggacagcgctgtcgtggtgacagggggcgactcaggcgagagtcagtcgccttgttactgtcatatgttcgccccgtctgattacaggaccatgatcatctctacaattggtgaaatcgcccttaacccactgaatatccttggcataaattttctgggacgcaggctctcactaagtattacgatgggatgcaccgcacttttctttctgctgctgaacatttgcaccagttcagcggggctgatcgggtttctcttcatgctccgcgctctggtggccgctaacttcaacactgtctacatttacaccgccgaagtttatcctactacaatgagagctctgggcatgggaaccagcggtagcctctgtcggattggcgcaatggtagcccctttcatctctcaagttctgatgtccgccagcatcttaggtgccctatgcctgttttccagcgtgtgtgtggtgtgcgctatttcagcattcactctccctattgagaccaaggggcgggctctgcaacagattaagtag

SEQ ID NO: 136742 - DNA, 1023 bp, Artificial Sequence
  Description of Artificial Sequence: Synthetic coding sequence
atggccgccggtagactcattatcaaaacggaattcctgccgactaaatatcgtggctacatgctgccattatctcaggtgttctggctggccggttcccttctcatcattggcttggcgagcgtaatcatccccactataggctggagatggctgattagagttgccagcattccgggaattatcctgattgttgcttttaagtttatcccagagagtgctagatttaacgtctccactgggaatacacgggcagctttagcaacactggaacgtgttgcgaagatgaataggagtgtgatgcccgagggcaagcttgtggaacccgtgcttgaaaagaggggccggtttgccgatctcctagacgccaaatacctccgtactactctgcagatttgggtgatttggctcggcatcagtttcgcctactatggcgtaatactggcatctgctgagctcctcgaaagagatctggtatgcgggtcaaagtctgactccgctgtagtcgttacagggggggacagtggagagtcccagtcaccctgctactgccacatgtttgcgccgagcgactatcgaactatgatcatatcgactataggcgaaattgccctgaaccctctgaatattttgggcatcaacttcctgggacggaggctttcactgagtattaccatggggtgcaccgccctgtttttcctgctgttaaatatttgcaccagttctgccggactcatcggattcctcttcatgctccgggctctcgtcgcagctaacttcaatactgtgtatatctacaccgcagaggtgtatcctaccacaatgcgcgccctgggtatgggcacctctggatccctctgcagaataggagccatggtagcccccttcatcagccaagtgctcatgagtgcttctatactaggggctctgtgcctattctcctctgtttgtgtggtgtgcgctatttccgcttttacactgcccattgaaactaaagggcgcgcgctccagcaaatcaagtag

SEQ ID NO: 136743 - DNA, 1758 bp, Artificial Sequence
  Description of Artificial Sequence: Synthetic coding sequence
atgggtagtctcaaggaggaactgctgaaagcaatctggcacgcattcactgctctggaccaggaccacagcggaaaggtgagcaaaagtcagctgaaagtgttgtcccacaacctgtgcacagttcttaaagtaccccacgaccccgtcgcactggaagagcacttccgagacgatgacgagggacctgtgagcaatcagggatacatgccctacctgaacagatttattcttgagaaggtgcaggataatttcgacaaaatagagttcaataggatgtgctggacactctgtgtcaagaagaacctgacaaaaaatcctcttctcatcaccgaggaggatgcctttaaaatctgggtcatatttaacttcctatcagaggataagtaccctttaattatcgtttccgaggaaatcgagtatctcctaaagaagttaactgaagcaatgggtggcggctggcagcaggaacaattcgaacactataagataaacttcgatgattctaagaacgggctctccgcctgggagctgatcgaactcatcggcaatggccagttctccaaggggatggatcgccagacagtcagcatggctatcaatgaggtatttaatgagttgatactcgatgtgctgaaacaaggatatatgatgaagaagggtcatcgcaggaagaactggacagagcggtggtttgtgttaaagccgaacatcatctcttactacgtgtcagaggatctcaaggataagaaaggagacatcctgctagacgagaattgctgtgtcgagagtcttccagacaaggacggaaaaaaatgtctgtttctggtgaaatgttttgacaagacctttgagatatccgcctccgacaagaagaaaaaacaagagtggattcaagccatccatagtacaatacatctccttaaactaggttctcctccgccccataaagaggcacgccagcggcggaaagagctgcgcaaaaagcagttggctgagcaagaggaactggaacgccaaatgaaggagttacaagccgcgaatgaatctaagcaacaggagctcgaggctgtgcgtaagaaacttgaggaggccgcttcccgggcagccgaggaggagaagaaaaggctgcaaactcaggtcgaactgcaggcccgttttagcacagaactggaacgcgaaaagctgataagacagcagatggaagaacaggtcgctcaaaagtctagtgagctggagcagtatctgcagcgagtaagagagcttgaggatatgtacttgaagcttcaggaggcattggaggacgagaggcaggcaagacaggacgaggaaactgtgcgaaaactgcaggcgcgcctacttgaggaggagtcctccaagagagccgaattagaaaaatggcacttggagcaacagcaggctatccagacaaccgaggccgaaaaacaagagctcgagaaccagagagtgctaaaggaacaggctctgcaggaagccatggagcagctggaacagctcgagctcgaaagaaaacaagcactcgagcagtatgaagaagtgaagaaaaaattggagatggcgacaaataaaacaaagagctggaaggataaggtggcacatcacgaaggtctgattcgcttgatcgaaccaggaagcaagaatccacatttaattaccaattggggccccgccgcctttacggaggctgaactcgaggagcgggaaaaaaactggaaagaaaaaaaaacaacagaatag

SEQ ID NO: 136744 - DNA, 3129 bp, Artificial Sequence
  Description of Artificial Sequence: Synthetic coding sequence
atggagcaggacactgcggctgtagctgcaactgtcgccgccgccgacgccacagccaccatcgtcgtaatcgaagacgaacaacccggaccaagcacttcacaggaggaaggcgccgccgctgccgcgaccgaagccacggctgccacagagaaaggcgaaaaaaaaaaggagaagaatgtaagcagcttccaacttaagctggccgccaaggcgccaaaaagtgagaaggagatggaccccgagtatgaggagaaaatgaaggcagatcgcgcgaaacggttcgagtttctccttaagcaaacggagctgtttgctcacttcatacagccatccgctcaaaaaagtccgacctcgcctctaaacatgaagctcgggaggcctaggattaagaaggacgaaaaacagagtcttatctctgctggggactaccgacaccgcaggactgaacaggaggaagatgaagagctgcttagcgaatcaaggaaaacaagcaacgtatgcatccggtttgaggtgtcaccctcctatgtcaagggcgggccccttcgcgattatcaaataagaggattaaattggctcatcagtctatatgagaacggcgtgaacggaatcctggctgacgagatggggttaggcaaaaccctacagactatagccctgttgggatacctcaagcactatagaaacattcctggccctcacatggtgctggtgccaaagagcacccttcataattggatgaacgagttcaaacggtgggtcccatccctcagggttatctgctttgttggggacaaggacgcccgcgccgccttcatcagggacgaaatgatgccaggagaatgggacgtctgtgtaacctcttatgagatggttattaaggagaagtcagtctttaagaagtttcactggcgatatttggttatcgacgaggctcataggattaagaacgagaaaagtaagctcagtgaaattgttcgagagttcaagtcaacaaatagactgcttctgaccggtactcctctccagaacaatctacacgagttgtgggccttgctcaatttccttctccctgatgtgttcaattccgccgatgactttgacagttggtttgacacgaagaactgtcttggggatcagaagttggtggaacggcttcatgctgtgttgaagccttttttacttagaaggataaaaacggacgtcgagaaatctttgcctcccaaaaaggagatcaagatctacctaggactcagcaagatgcaacgcgagtggtatacaaaaattcttatgaaagacattgatgtgctgaactcatccggaaagatggataagatgaggctactgaacatcttgatgcagctgcgcaagtgctgtaaccatccctatctttttgatggcgctgagccaggcccaccgtatacaacagatgagcatatagtctctaattcaggcaagatggtggttttggataagctccttgccaagttgaaggagcaaggttcccgggtgctcatcttttcccagatgacccggctcctcgacatcctggaggattactgtatgtggcggggttatgagtattgcagacttgacggtcagactcctcatgaggaaagggaagaagcgatcgaagcatttaacgcaccaaattcgagtaaatttatttttatgctgtctactcgagccggcggccttggcatcaacctggcctccgcggatgtagtgattctgtacgacagtgattggaatcctcaggtggacctgcaggccatggaccgggctcacaggatcggccagaagaaacctgtacgcgtgttcaggctgatcactgacaatactgtggaggagcggattgtggaacgggcggaaatcaaattgaggctggattccattgtgatccaacagggcaggttgatcgaccagcagtccaacaaactggctaaggaggaaatgctgcaaatgatccggcacggggctacccatgtgtttgccagtaaggagagcgagctcactgacgaggatattacaacaatactggaaaggggcgagaagaagactgctgaaatgaatgaacgtctgcagaagatgggggagtcatccctaagaaacttcagaatggatatcgaacagtccctgtataagtttgaaggagaggactacagagagaagcagaaacttggcatggttgaatggattgagcctccaaaacgcgaaaggaaggcaaattatgctgtggacgcctatttccgggaggctttacgagtgtcggagcccaaaatccccaaagctccacgcccgcctaagcagcctaatgtccaggattttcagtttttcccaccgagactttttgagctgctcgagaaggagatcctgtactatcgtaagacaattggatataaagtgccacggaatccagacatcccgaatccggcccttgcacagcgtgaggagcagaaaaagatagacggcgccgagcctctcaccccagaggaaacagaggagaaggagaaactactgactcaaggtttcacaaactggacaaaaagagacttcaatcagtttattaaggctaacgagaaatacggcagagacgatatagataacatcgctagagaagttgagggtaagagtcctgaggaggtgatggagtattccgccgttttctgggaaaggtgtaatgaactccaggacatcgaaaaaattatggctcagatcgagcgaggtgaagctagaatccagcgacggatatccattaaaaaagcgcttgacgcaaaaattgctagatataaggctcctttccaccagctgagaattcagtacgggaccagtaaaggaaagaactacaccgaagaagaggacaggttcctgatctgcatgttacataaaatgggctttgaccgggaaaatgtttacgaagagctaagacaatgtgtgcgcaatgcacctcagttccggttcgattggtttatcaagagccgcaccgcgatggagtttcagcgtcgctgcaacacacttattagcctgatagaaaaggagaacatggagatagaggagcgcgaacgtgctgagaagaaaaagcgcgcaaccaaaactcccatggtcaagttctcagccttctcctag

SEQ ID NO: 136745 - DNA, 3165 bp, Artificial Sequence
  Description of Artificial Sequence: Synthetic coding sequence
atggaacaggacacagccgccgtggccgcaaccgtcgctgctgctgatgccactgcgaccatagtggttatcgaggatgagcagcctggcccgagtacatcccaggaagaaggtgcggctgctgcggccacagaagccacagctgctacagaaaagggggagaaaaagaaagagaaaaatgtctccagttttcagttgaagcttgccgccaaggctccaaaatctgaaaaggagatggatcccgagtatgaggagaaaatgaaggcagaccgagctaaacgcttcgagtttttgctgaaacagacagaattgttcgcacactttattcaaccaagcgcacaaaagtctcccacaagcccactcaacatgaaacttggccgtcctaggattaagaaggatgagaagcagtcactgataagcgctggcgattataggcatcgtaggaccgagcaggaggaggacgaagaactgctctcagaatccagaaagaccagcaacgtatgtatccgtttcgaggtgtcccctagctacgtgaaagggggacccctccgcgattaccagatccgtggccttaactggctaatcagcctttacgaaaatggggtgaacggcatcctggccgatgagatgggacttggaaaaaccctgcagacaattgccctgctgggctacctaaagcattaccgaaacattccaggacctcatatggtgcttgtgcctaaatccacgcttcacaattggatgaacgaattcaagcggtgggtgccaagtcttagggtgatctgtttcgtgggtgataaggacgcacgcgcggcttttatccgggacgagatgatgccaggagaatgggatgtctgcgtaactagctacgaaatggtgatcaaggagaagagtgttttcaagaaattccattggcggtaccttgtcatcgacgaggcccaccggatcaaaaatgaaaagagcaagctcagcgagatagtgagagagttcaagagcacaaatcggctgctgctgacaggcacgcccttgcagaataacctgcatgagctgtgggccctgcttaattttctcctccctgatgtcttcaattcagccgacgattttgattcctggtttgatactaagaactgtctgggggaccagaaactagtggagagactgcatgccgtgctgaagccttttttactacgccggatcaagacggatgtggagaaaagtcttcccccgaagaaagaaataaagatctaccttggcttgagtaaaatgcaaagggagtggtataccaaaatcttgatgaaagacattgatgtgttgaatagcagcggcaagatggataaaatgcgtctgttgaatattctgatgcagctgcgcaagtgctgtaaccacccatatcttttcgatggggctgaacctggaccaccctatacgacagatgaacacatcgtgagcaactccggcaaaatggtggttcttgacaaactgttggccaagctgaaagaacaagggtcccgggtgttgattttttcgcagatgacccgcttgcttgatatactggaggactactgtatgtggcggggttacgaatattgtcgactggatggacagacccctcacgaggagcgtgaagacaagtttctcgaggtggagtttctcggtcagcgcgaggcaatcgaggcattcaatgctccaaactcatctaagttcatcttcatgctctcaacacgtgccggggggctaggcatcaatctagcgtctgccgacgtagtgatcttgtatgacagtgattggaacccccaagttgatttgcaggcgatggatcgtgcacaccgcatcggccagaaaaagccagttcgggtcttccgcctgattaccgacaatactgtggaggagagaatcgtagaacgtgcagaaatcaagttaagacttgactccattgtgatacagcagggtcgcctcatcgatcagcagagtaacaaattggcgaaggaggagatgctgcagatgattcgacacggagctacacatgtattcgcctccaaggaaagcgagctaaccgacgaggatattaccaccatcttggagaggggcgaaaaaaagacagctgagatgaacgaacgtcttcagaagatgggcgaaagctctctgcgtaactttaggatggatatcgagcagtctttgtataaattcgagggagaagattatcgagagaaacagaagctgggcatggtggagtggatcgagcctccaaagagagagcgcaaggctaactatgccgtggacgcctattttagagaagcgctgcgagtcagcgagccaaagatccctaaggctccccgccctccaaagcagccgaatgtgcaggacttccagttcttcccccccagattgtttgaactgcttgagaaggagatcttatattacaggaagactattggatacaaggtgccaagaaacccagacattcccaatcccgcactggctcagcgtgaggaacagaaaaaaattgatggcgcagagcctctgacccccgaagagactgaggagaaagagaaattactgacgcagggctttacaaattggaccaaaagggacttcaatcagtttatcaaagccaacgagaaatatggcagggacgacatcgacaacatcgcccgagaggttgagggcaagtcccccgaggaagtgatggagtacagcgctgtgttctgggagagatgcaacgagttgcaggatatcgaaaagatcatggcccagattgagcggggcgaggcaagaatccaacgacgcatttctatcaagaaggctctcgacgcgaaaatcgccaggtacaaagctccctttcaccagcttagaattcagtacggcacctcaaagggaaaaaactatacggaggaagaagacaggttcttgatctgtatgctgcataagatgggcttcgaccgggagaatgtgtacgaggaactgcgtcagtgtgtacgtaatgcgcctcagtttcggtttgactggtttatcaaaagcaggaccgccatggagttccagaggaggtgtaatactctgatttctctcatcgagaaggaaaacatggagatcgaggagagagaaagagcggagaagaagaagcgggccactaagactcccatggtgaagttcagtgcattctcctag

SEQ ID NO: 136746 - DNA, 3129 bp, Artificial Sequence
  Description of Artificial Sequence: Synthetic coding sequence
atggagcaggacactgctgctgtggccgctacagtggctgctgcagacgcgaccgcaaccatcgtcgtcatcgaggatgaacaacccgggccatccaccagtcaggaggagggcgctgcagctgctgctactgaagctaccgccgccacagaaaaaggtgaaaaaaagaaagagaagaatgtctcctcttttcagttgaagctggccgctaaggcccctaagtcagagaaagagatggaccccgaatacgaagaaaagatgaaagccgatagagcaaagcgattcgaatttctgttgaagcagacggagctgtttgcccattttatccaaccatctgcccagaagagccccacctcccccctaaacatgaagctcgggaggcccaggatcaagaaggatgaaaagcagtccctaattagcgctggggactatcgccataggcgaacggagcaggaagaggatgaggagttgctgtccgagagtagaaaaactagcaacgtatgtattagattcgaggtaagccccagttacgtaaaaggggggcctctacgcgactaccagatccgcgggctgaactggctaattagcctgtatgagaatggtgtgaacggaatcctggccgatgagatggggctgggaaaaacgctccagacaattgctctgctgggctacttaaaacattacaggaacattccgggaccccatatggtgttagtcccgaaatcaacgctacataattggatgaacgagttcaaaagatgggtcccctcactgcgggtcatatgtttcgttggggataaggatgcacgggcagcgttcattcgtgatgaaatgatgcccggagaatgggatgtgtgtgtgacctcatatgaaatggtgataaaggagaagtctgtttttaagaaattccattggcgttatttagtaattgatgaagcccacaggatcaaaaatgaaaagtccaaactctcagagatcgtccgcgagtttaagtcaactaacaggctcctgctgacgggtacacctctgcaaaataatctacacgaactgtgggctttattgaattttttgctccctgacgtcttcaactccgctgatgacttcgacagctggttcgacacaaaaaactgtcttggggatcaaaaactggtggagcgtctgcacgctgtcttaaaacccttccttcttcgccgaattaaaacagacgtcgagaagagcctacccccgaagaaagagattaagatttacctgggtctgagtaaaatgcagcgcgagtggtacactaagattctgatgaaggacatagatgtactgaacagctctggcaaaatggacaagatgagattacttaatatcctgatgcagctgagaaaatgctgcaatcacccgtacttgtttgatggtgccgagcccggaccaccttacacgacagatgagcacatcgtgtctaactcgggcaagatggtagtgctcgataagcttctggccaagttgaaggagcagggctctagagtgttaatattttcccaaatgacccgcctactcgatattttggaggattactgtatgtggaggggttacgagtactgtcgattagacggccaaacgccgcatgaggagcgcgaagaggctattgaagctttcaacgcacccaacagctcaaagttcattttcatgttgtccacgcgtgctggtgggttggggatcaacctcgccagtgctgacgtggtgatcttatatgactctgattggaacccgcaggtcgatctacaagccatggatagggcccacagaatcggacagaagaagcctgtgcgggtgttccgacttatcactgacaacaccgtcgaggaaaggatcgtggagagagccgagatcaaactccgactggatagtattgttatacagcagggtcgactcatcgaccagcaaagcaataaactcgcaaaagaggagatgctgcagatgatccgtcacggagcaactcatgtattcgctagcaaagagagtgagctgacagacgaggatattaccaccattctcgagagaggtgagaagaagacagctgaaatgaacgagagactgcaaaagatgggcgaaagtagcctgcggaattttcgaatggacatcgaacaatctctatataagttcgagggcgaggattaccgtgagaaacaaaagttaggaatggtggagtggatcgagccccctaagcgggagcgaaaagccaattacgctgtagatgcctattttcgcgaagctttgagggtctctgagcccaagatcccaaaggcgccacggccaccaaagcaaccgaatgtccaggactttcagttctttccacctcgtcttttcgaacttctggagaaggagatcctgtattatcggaagaccatcggctacaaagtaccgagaaaccctgacatcccgaatccggctctcgctcaacgcgaggaacagaaaaagattgatggggccgaaccgctcacgccagaggaaactgaggagaaggagaagctcttaacccagggtttcactaactggacaaagcgcgattttaatcagtttatcaaagctaacgagaaatatggcagagatgacatcgataatatcgcacgtgaggtcgagggaaaatcccctgaggaggtcatggaatattccgctgttttttgggaaaggtgcaacgagctgcaggacatcgagaagattatggctcagatcgagcgtggtgaggctcgtattcagcgccgcatctcgataaagaaggcgttggacgctaaaattgctcggtataaggcgcctttccaccagctgcgaatccagtacgggacttccaagggtaagaattatacagaggaagaggataggttcctaatttgtatgttacacaaaatggggttcgaccgcgagaacgtctacgaggagttaaggcagtgtgtccgtaacgcgccacagtttagatttgattggttcattaagtcccgtaccgccatggagttccagcgacgttgcaacacactaatatcacttattgagaaagaaaatatggagatcgaagaaagggaacgagccgagaagaaaaaacgcgctactaagacacccatggtgaagtttagcgcattcagttag

SEQ ID NO: 136747 - DNA, 3018 bp, Artificial Sequence
  Description of Artificial Sequence: Synthetic coding sequence
atggagcaggacacagctgccgttgcagcaacagtggctgccgctgacgccacggccaccattgtagttatcgaggacgagcagcccggcccctcaacatcgcaagaagagaagaatgtgtcaagctttcagttgaagctcgcggctaaagctccaaagagcgaaaaagagatggaccctgagtatgaggaaaagatgaaagcggacagggccaaacgcttcgagttcctgttaaaacaaaccgagttatttgcacactttatccagccctcagcccagaagagcccgacatctccattaaacatgaaattagggcgtcccaggatcaaaaaggacgaaaaacagagcctcatttccgcaggtgattaccgtcatcgacgcactgagcaggaggaggatgaagaactgctcagcgagagcagaaaaacctccaatgtgtgcatcagatttgaggtatcaccaagttacgtgaaggggggaccgctaagggattatcagattcgggggttaaactggctgattagtctctatgagaatggcgtcaacgggatcctcgctgatgagatgggcctgggtaagactctgcagactatagcactacttggataccttaaacactataggaatattcccggacctcatatggtgctcgtgcctaagtccacacttcataactggatgaacgaatttaagcgttgggtcccgagcttgcgcgtcatttgctttgtgggcgacaaggacgcaagagctgcatttattagggacgagatgatgccaggtgaatgggacgtatgtgttacatcatacgagatggtcatcaaggagaagagcgtatttaaaaagtttcactggagatacctggtgatcgatgaggctcaccgtatcaagaatgaaaaatccaagctctccgagatcgttcgggaattcaagtccaccaataggctgctattaacaggcacacccctgcagaataacctgcacgaattatgggccttgctaaattttcttttacccgatgtctttaattctgcagacgacttcgactcctggtttgacaccaaaaattgtttgggagatcaaaaactggtggaaagattacatgcagtcttaaagcccttcctactcaggcgcattaagaccgatgtcgaaaaatcgttgccccccaagaaggagattaaaatttatttgggcttatcgaaaatgcagcgtgaatggtacactaagatcttaatgaaagacatcgacgtgctgaactcttcgggtaagatggacaagatgcgactgcttaatattctaatgcaattgagaaaatgttgtaatcacccatacctattcgatggggccgaacccggaccaccatatacaaccgacgaacacattgtgagcaacagtggcaagatggtggtgttagataaattactggctaagctgaaagagcagggctcgcgcgtgctgatcttcagccagatgacccggttactggatatcctggaagactactgcatgtggaggggatatgagtattgtagactcgacggccagactcctcatgaagagagggaggataagttccttgaggttgagttcttaggacaacgcgaagccattgaggctttcaacgccccaaattcttcaaaattcatattcatgctcagcactcgcgcagggggcctgggcattaacctagctagcgctgacgtggttatcttgtatgactccgattggaatcctcaagtagatctccaagccatggaccgcgctcaccggatcgggcagaagaaacctgtgagggtgttccgactgatcacagacaacaccgtcgaggagcgcattgttgaacgcgcagagatcaagctacgactcgatagtatagtgatccagcaggggcggcttattgatcagcagtctaacaaactagctaaagaagaaatgttgcaaatgatacgccacggcgccacccacgtcttcgccagcaaggaaagcgaactgacggatgaggacatcacaaccatactggagcggggggaaaaaaagaccgccgagatgaacgaacgcttgcagaaaatgggagaatcttcactgcgtaactttcgaatggacatagaacaatcgttatataagtttgaaggtgaggactatcgggagaaacaaaaattggggatggttgagtggatagaaccacccaagagggagcggaaagcaaattacgccgttgacgcatacttcagagaagcacttcgagtttcagagccaaaaatacctaaggcaccccggcctcctaaacagcctaatgtgcaggacttccagttctttccccctagactgtttgagctcctggagaaggaaatactttactaccgcaaaactatcgggtataaggtaccacggaatcctgacattccaaacccagctctggcacagcgagaggaacagaagaaaattgatggggcagagccattgacacctgaagagacagaggaaaaggaaaagctcctgactcaagggttcacaaactggaccaaaagggattttaatcaattcatcaaggctaatgagaagtacgggcgtgacgatatcgacaatatcgctcgagaggtggagggaaaatcacccgaagaagtcatggaatactcagcagttttttgggagcggtgtaacgaactacaggatatcgaaaaaatcatggcgcaaatcgagcgcggcgaggcccggattcagcggcggattagcattaaaaaggccctcgacgccaagatagcacgttacaaagcccccttccaccagctcagaatccagtacgggacttccaaagggaaaaactacaccgaagaagaggacaggtttctgatatgcatgctgcacaagatgggatttgatagggagaacgtgtacgaggaactgcgtcagtgcgtcaggaacgctcctcagttcaggtttgattggttcatcaaatccaggaccgccatggaatttcagcgtcggtgcaataccttaatcagcctcatcgaaaaggagtag

SEQ ID NO: 136748 - DNA, 837 bp, Artificial Sequence
  Description of Artificial Sequence: Synthetic coding sequence
atgttgatgaaacgcctggctgccaggtgttttgctggactgctgattttgagtcctctgactgtaatttcagacagcagaccagccgactccggaaaggctatcgaggacggcaacttggaagagatggaggaagaggtccggttaaagaagcggaagcgacggcgcaatgtcgataaagatcctgccaaggaggacgtagagaaggccaagaagcgacgagggcgcccccctgccgaaaagttgtcacctaacccgcccaagttgacaaagcaaatgaatgccatcatagataccgtaataaattacaaagatagttctggtagacagttgagcgaggtttttattcaactccccagcagaaaggaactgccagagtactacgaactgattcggaaacctgttgattttaagaaaattaaggagcggatccgaaatcataaatacagatccttgggtgacttggaaaaggacgtcatgctcttgtgtcacaacgctcagacattcaatttggagggctcccagatatatgaggacagtatcgttcttcagagcgtcttcaagtcagccaggcagaagatcgccaaagaggaggagagtgaggatgaatcaaacgaggaggaggaggaagaagacgaggaggagtctgaatctgaagcaaagagcgtcaaagtaaaaattaaacttaataaaaaggacgataaggggcgcgataagggtaaggggaagaagcgacccaacaggggtaaggctaagcccgttgtttccgacttcgactcagatgaagagcaggacgagagggagcagtccgaaggcagcgggaccgacgatgagtag

SEQ ID NO: 136749 - DNA, 711 bp, Artificial Sequence
  Description of Artificial Sequence: Synthetic coding sequence
atggaagaggaagtgcgtctcaaaaagagaaaaagacggcgaaatgttgacaaagatccagccaaggaggacgtggaaaaagctaaaaagagacggggcaggccacctgccgagaagctctctccaaaccctcccaaactgaccaagcagatgaatgccatcattgatacagttattaactataaggacagcagcggacgtcagcttagtgaggtcttcattcaactgccttctcggaaagaactgcccgagtattatgagcttatccgaaaaccggtggactttaaaaaaattaaagagcgtataaggaatcataaatatcgcagtctgggcgacctcgaaaaggatgtcatgttactttgtcacaatgcacagacctttaacctcgaggggagtcaaatatatgaggacagtattgtgctgcagtccgtgttcaaaagcgcacggcagaaaatcgcgaaagaggaggaatcggaggacgaatctaatgaggaagaggaggaggaagatgaggaagagtcagaatcagaagccaagagcgtgaaagtgaaaattaagctcaacaagaaagacgacaaggggagagataagggtaagggaaagaagaggcccaaccgcggaaaagccaaacccgtggtaagcgattttgacagcgatgaggaacaagacgaacgcgagcagagcgaagggtctggaacagatgacgagtag

SEQ ID NO: 136750 - DNA, 4773 bp, Artificial Sequence
  Description of Artificial Sequence: Synthetic coding sequence
atgagcacacccacagaccctggagctatgccacatccaggaccctctcccggtccagggccgtcccccgggcccatcttgggaccctccccaggccccggcccctcccctggcagcgtgcattctatgatgggaccttcccccggccccccctccgtatctcaccccatgcctactatgggatctacagatttcccacaagaaggcatgcaccagatgcacaaacctattgatggcatccacgacaagggcatcgttgaggacatacattgcggttcaatgaagggcaccggcatgaggccacctcatcccgggatgggaccaccccagtccccaatggaccagcacagccagggctacatgtcgccccatccgtcccccttgggcgctcctgagcacgtgagttcaccgatgagcggcggaggaccaactcccccccagatgcccccaagccagcctggggctctgattccaggggacccacaggcgatgtctcaacccaatagaggtccgtccccattttctcccgtgcagctgcaccagctgagagcacaaatactcgcttacaagatgttagcccgtggacagcccctcccggagacacttcaactcgcggtgcaggggaagaggacactccccggacttcagcaacagcagcagcagcagcagcagcagcagcagcagcagcagcaacagcagcagcagcaacaacaaccccaacagcaaccaccccagccccagacacaacagcagcagcagcctgccctggtaaactacaatcgcccctctggccctgggcctgagctcagcggtcccagcaccccacagaaactgccagtgcccgcacccggcgggcggccctcccccgcccccccagctgcagcccagcctcctgctgcagctgtgcccggcccctctgtgccacagccggctcctggacagccaagtccggtgctgcagctgcaacagaagcagtcacggatttctccgatccagaagcctcagggtcttgaccccgtggaaatcctccaagaacgcgaatataggctgcaagccaggatagctcacaggatccaggagctcgagaaccttcccggatcacttcctccagatctcagaaccaaggctaccgtagagctgaaagctttgagacttttgaatttccagagacagctccgtcaggaggtggtcgcctgcatgagaagagacactacactcgagacggccctaaacagcaaggcttacaagcgatccaaacgccagaccctcagagaagcacgaatgaccgagaaattggagaaacagcaaaagattgagcaggagcgaaaaagacgacagaaacaccaggagtatctgaacagtatacttcagcatgcgaaagattttaaggaataccataggagtgtagccgggaagattcagaagctgagcaaggcggtggcgacttggcatgctaatacggaacgtgagcaaaagaaggagaccgaaaggatcgagaaggagagaatgaggaggttgatggccgaagacgaggaggggtataggaagcttatcgaccagaagaaagacaggcgactcgcctatttactgcaacagacagacgaatacgtggccaatctgactaacctcgtgtgggagcacaagcaggcgcaggctgcgaaggaaaagaaaaagaggagacgtcgaaaaaaaaaagcagaggagaacgccgagggtggcgagtctgctctggggccggatggcgagcccattgatgaaagcagccagatgtcagacctgcccgttaaggtgactcatacagagaccggtaaggtgctgttcggtcccgaagcccccaaggcctcacagttggacgcttggctggagatgaaccccggctacgaggtggctcccagaagcgactcagaagagtccgatagcgactacgaggaagaagatgaagaggaggagtctagccgtcaagagacagaggaaaagatcctgcttgaccccaattccgaggaggtgtcagagaaggacgctaagcaaataatagaaacagcaaagcaagacgtagacgatgagtatagtatgcagtactctgccagaggatcccagtcctactataccgtggcccatgccatttctgaacgtgtggagaaacagtccgctcttctgatcaacggaacactgaaacattatcagctccagggcctggaatggatggtgagcctatataataacaatctgaacggaattctcgctgatgagatggggttaggcaagactattcagacaattgcactgattacctatctcatggagcacaagaggctcaatggaccctatttgattatcgtcccgctctcaacgctgtctaactggacttatgagttcgataagtgggctcccagtgttgtcaagatcagctacaagggcaccccagccatgcgaagaagccttgtgcctcagctgagaagtgggaagttcaacgtgttgcttacaacttatgagtatattattaaggacaagcatatcttggccaaaatacggtggaaatacatgattgtagacgaagggcacaggatgaaaaatcatcattgtaaactgactcaggtcctcaacacccactacgtcgctccccggagaattctgcttactggtacgcccctgcagaataaactccctgaactttgggccctgctgaacttcctccttcccactatctttaagagctgctcaacatttgagcagtggttcaacgcacctttcgcgatgaccggcgagcgggttgacctgaacgaggaagaaaccattttgataatccgccggctacacaaggtgctacggccgttcctcctcaggaggctcaagaaggaggtggaaagtcagctgccagaaaaggtggaatacgtgattaagtgtgatatgtcagcactgcagaagattctgtatcggcacatgcaggcaaagggaatccttctcacagatggctccgaaaaagataagaaagggaaggggggagctaagacactgatgaataccatcatgcaattaagaaaaatctgtaaccacccctacatgttccagcacatagaggagagcttcgcggagcatctcgggtattcaaatggagttatcaatggggccgaattatatagagccagcggaaagtttgaattgttagaccgcatcctgccaaaactcagggctacaaaccaccgcgttctattgttctgtcagatgactagcctgatgactatcatggaagattatttcgcattccgaaatttcttgtacctcagactggacggcaccacgaaatctgaggatagggcagctctgctcaagaaatttaatgagccagggtctcagtacttcattttcctcctaagcactcgcgcagggggtctgggcctgaacctacaggccgctgacactgtagtaatatttgattccgattggaacccgcaccaagacctccaggcgcaggaccgcgcccaccggatcggccagcagaacgaagtacgagtgctgcgtctgtgcacagtgaatagtgtggaagagaaaattctcgccgctgccaagtataagttgaacgtcgaccaaaaggtgatccaggcggggatgttcgaccagaaaagcagctcacacgagcgtagagctttcctccaggccattcttgagcatgaggaagagaatgaagaggaagatgaagtgcccgatgatgaaacgcttaatcagatgatagcccgtagggaagaagagttcgatctgttcatgaggatggatatggatcgaaggcgggaggacgctaggaatcccaagcgaaaaccacgactgatggaggaggacgagttaccatcatggattataaaggatgatgccgaggtcgagcgcctgacctgcgaagaagaggaggagaaaatctttgggcgggggtcccgacagcgtcgagatgtagactacagcgacgcactgacagagaagcagtggctccgggcaattgaagatgggaacctggaagagatggaggaggaagtgaggttaaagaagagaaaacgcaggagaaatgtcgataaggatcctgcgaaagaggatgtggagaaggctaagaaacgccgtggtcgaccgcctgccgaaaagctttcccccaatccacccaagcttacaaagcagatgaacgccattattgacaccgtgataaattacaaagaccggtgcaatgtggagaaggttcccagtaattcgcagctggagatagagggaaacagtagtgggagacagctcagtgaagtgttcatccaacttcctagcagaaaggaactgccggaatattatgaactcatccgcaagccggtagatttcaagaagatcaaggagcggatcagaaatcataagtacaggtccctcggcgatctcgagaaagacgtgatgcttctgtgccataatgcacagacatttaatctagaagggagccagatttacgaagattccatcgttctgcagtctgttttcaaaagtgcccgtcagaagatcgctaaggaggaagaaagcgaagacgaatccaacgaagaggaagaggaggaggacgaagaagaatctgagtcggaggccaagagcgttaaggtgaaaatcaagctgaataagaaagatgacaaaggacgcgataaaggcaagggcaagaagcgccccaatcgcggcaaagccaaaccggtggtctcagactttgacagcgacgaagagcaagatgagagggagcaatctgaaggttctggaactgatgacgaatag

SEQ ID NO: 136751 - DNA, 4719 bp, Artificial Sequence
  Description of Artificial Sequence: Synthetic coding sequence
atgtccacccccaccgaccctggagccatgcctcatcccgggcccagccctggtccagggcccagtccaggcccgattttggggccatcacccggaccaggccccagtcccggcagtgtccactctatgatgggaccatcgcccggacccccatcagtgtcccaccccatgcctacaatgggcagtaccgatttcccacaggaggggatgcaccaaatgcacaagcccatagacgggattcacgacaaggggatagttgaagatatccactgtggctcgatgaaaggcaccggcatgcggcctccacacccaggtatgggccctccacagagccccatggaccaacacagccagggttatatgagcccccatccctctcctctgggagctcccgagcacgtctctagccctatgagcggcggtgggcctacccctccacagatgcctcccagtcaacccggcgccctgatcccaggggacccccaggcaatgtcccaacctaaccgggggccatctcccttctctcccgtgcagctgcatcaactccgcgctcagatcctggcctacaaaatgcttgctcgggggcagccgctcccggagacccttcagctcgctgtgcagggcaagcgcacgctgccgggcctgcagcagcagcagcagcaacagcagcaacagcagcagcagcagcaacaacagcaacagcagcagcagcaaccacaacaacagccacctcagccgcagacccagcagcagcagcaacctgccctggttaactataacagacccagtggcccggggccagagctgtcagggcccagcacgcctcaaaagctcccagtccctgctcccggcggtcgtcccagccctgcccctccggctgctgcccagccaccagcggctgccgtacctggcccatcagtgccccaacctgcaccagggcaacctagccctgttctgcagctgcagcaaaagcaatcccggatcagcccaattcagaaacctcaagggctggaccccgtggagatcttacaggagagagagtataggctccaggcccggatcgcccatcggattcaggagctcgagaatcttcccgggagtctgcctccggatttgaggaccaaagcaacggttgagctgaaggccctgaggctgttaaactttcaacgacaattgcggcaggaggttgttgcgtgtatgagaagagacacaactctagaaacggccctgaacagtaaggcgtataagcggtccaaacgacaaacgttaagggaagcaaggatgaccgaaaagctggagaagcaacagaaaatcgaacaggaacgcaagcgaaggcaaaaacatcaagaatatctgaacagtattttacagcatgcaaaagacttcaaggaataccatcggtccgttgctggcaaaatccaaaagctgtctaaggccgttgccacctggcacgccaataccgaaagggaacagaagaaagagaccgaacggatcgagaaagagcgcatgaggcgattgatggcagaagacgaggaggggtaccgcaagctgattgatcagaagaaagaccggaggctggcctatctgctgcagcagactgatgaatatgtagcgaacttaacgaacctcgtgtgggaacacaagcaggcccaggctgccaaagagaagaagaagcggcgccgcagaaagaaaaaagctgaagagaacgctgagggcggcgagtccgccctcgggcccgacggggaacctattgacgaaagtagtcagatgtcagacctccccgttaaagttacacacacagaaacaggcaaggtgctgttcggccccgaagcccctaaagcgtcacagctggacgcatggctggaaatgaaccccggctatgaggtcgccccgagaagcgactctgaagagagcgacagcgattatgaggaggaggatgaagaagaggagtcttccaggcaggaaaccgaggagaagattcttctcgatcctaattctgaggaggtcagcgagaaggacgcaaagcagataattgagacagcgaaacaggatgtagatgacgagtacagtatgcaatatagtgcacggggatcccagtcatactacaccgtagctcatgccatcagcgaacgggtggaaaagcagagtgccctcctgattaacggcactctcaagcactatcagcttcagggccttgagtggatggtgagcttgtacaataacaatcttaatggaatcctggcggacgaaatggggctggggaagacaatacagactatcgccctgatcacctatttgatggagcacaagcgccttaatgggccctatctcatcatcgtcccactgtctaccctgtctaattggacatacgagttcgacaagtgggccccaagcgtggtgaagatctcttataaaggcacgccagctatgcgccgttctctggttcctcaacttaggagcggtaaattcaacgtgctgttgaccacctacgaatatattatcaaagataaacacatcctcgcaaaaatccggtggaagtacatgatagttgacgaggggcacaggatgaagaatcaccactgcaagttaacacaggtcttgaacacacactacgtcgcccccagacgaatcttgctgaccggtacaccacttcagaataagcttcctgaactgtgggccctgctgaatttcctgctgccaacaatttttaagtcttgttctactttcgaacaatggttcaatgcccctttcgctatgaccggggagcgagttgacctgaacgaagaagagactatcttaatcataagacggcttcacaaggtattgcgacccttcctgctgaggaggctaaaaaaagaagtcgagtctcagctaccagaaaaagttgagtatgttatcaagtgtgacatgtcagctctgcaaaagattctgtaccgacacatgcaagccaaaggaatcttgcttacagacggcagcgaaaaggacaaaaaagggaaaggcggcgcaaaaaccttgatgaacacaattatgcagctgaggaagatatgtaaccatccatacatgttccaacatattgaggagagctttgccgagcatcttggctactccaatggcgtgattaacggcgccgagctgtaccgcgctagtggaaaattcgagctgcttgatcgcattctgcccaagctgcgcgctaccaaccatcgcgttctcttgttctgccagatgacttctcttatgactatcatggaggattatttcgcgttccggaactttctgtacctgagactggatgggaccaccaagagcgaagatagggccgctctgctgaagaaattcaatgaacccggctcacagtatttcatatttcttttatcaaccagagcgggtggtttgggtctcaatctgcaggccgctgataccgttgttatattcgactcagactggaacccgcaccaggatctccaagcccaagatcgtgcccaccggattggtcagcagaatgaagtccgggtattgaggctgtgtacggtgaattctgttgaagaaaagatcttagctgctgccaagtataaacttaacgtggaccagaaagtgattcaagccgggatgttcgatcaaaagtctagtagccatgagcggcgggccttcctgcaagcaatcttagagcacgaggaagagaatgaggaagaagacgaggtgcctgacgacgaaacactcaatcaaatgatagcccgtcgagaggaggaatttgatttgttcatgcgtatggacatggaccgcagacgagaggatgctcggaatccaaaacgcaagccccgtctgatggaagaagatgagttgccatcctggattattaaggatgacgcagaagtggaaaggttgacttgtgaggaagaggaggagaagatctttgggaggggttcgcggcagagacgggacgttgactattccgatgctctgaccgaaaagcaatggctgcgcgctatcgaagatggtaacctggaagaaatggaggaagaagtgcgactgaagaagcggaaacgccggcggaatgtcgacaaggacccggccaaagaggacgtcgaaaaggccaagaaacggcgggggcggcctccagccgagaaactgagcccaaaccctccaaagctgaccaaacagatgaacgctatcatagatactgtgatcaattacaaggatagctcgggtcggcagctttctgaggtctttatccaacttccatccagaaaggaactccctgaatactacgaattgattcgcaaacctgtggacttcaaaaaaatcaaggagagaatacggaatcataagtatagaagccttggagacttggagaaagacgttatgctgctgtgccacaacgcacaaacttttaacctggaggggagtcagatttacgaagattctatcgtcttgcagtcggttttcaaatccgcgagacagaaaatcgccaaggaggaagaatccgaagacgagtccaacgaggaagaggaagaagaagatgaagaggaatcagaatcagaggctaagtcggtcaaggttaagattaaactgaacaaaaaggacgacaagggaagagataagggcaaggggaaaaaaagacctaacagagggaaggcaaagcctgtagtgtccgatttcgactcggacgaggagcaagatgaacgcgagcagtccgaggggtcggggacagacgacgagtag

SEQ ID NO: 136752 - DNA, 360 bp, Artificial Sequence
  Description of Artificial Sequence: Synthetic coding sequence
atgctcttgtgccataatgctcaaacgtttaatctggagggctctcagatttatgaagactccatagtgcttcagtccgtctttaagtctgcacgccaaaagattgccaaggaggaggaatctgaggatgagagtaacgaagaggaggaagaggaagacgaggaggagagtgaaagcgaggccaagtccgtgaaagtgaagatcaagctgaacaaaaaagatgataaaggcagggataaaggcaaggggaagaaacgaccgaaccgggggaaggccaaacccgtggtaagcgacttcgatagcgatgaggaacaagatgagcgcgagcagagcgaaggttctgggacagatgacgaatag

SEQ ID NO: 136753 - DNA, 711 bp, Artificial Sequence
  Description of Artificial Sequence: Synthetic coding sequence
atggaggaggaggtgcgccttaagaaacgtaagaggcgacgaaacgtcgataaggatcctgccaaagaagatgtggaaaaagccaagaaacgcagaggtcgccctccggcagagaagctgtcccccaacccacccaagctgaccaagcagatgaacgccatcatcgacaccgtgatcaactataaagacagcagcggccgtcagctcagtgaggtctttattcagctgccaagtcgcaaagaactccccgagtactatgagctgattcggaagccagtggatttcaaaaaaatcaaggagaggatcaggaaccacaaatataggtccctgggggacctggagaaagatgtgatgctgctctgccataacgcacaaaccttcaacctggagggttcccagatctatgaggactctatagtgctccagtccgtgttcaagagtgctcgtcagaaaattgcaaaggaagaagaatcagaagatgaatcaaatgaagaagaggaggaggaagatgaagaggagtccgagtccgaggccaagtccgtgaaagtgaaaataaagttgaacaaaaaagatgataagggccgcgacaagggaaaaggcaagaaaagacctaatcggggcaaggcaaagcctgtcgtatcggatttcgactcagacgaggagcaagatgaaagagagcaatcagaggggagtggtacagatgacgagtag

SEQ ID NO: 136754 - DNA, 711 bp, Artificial Sequence
  Description of Artificial Sequence: Synthetic coding sequence
atggaggaggaagtgcggctgaaaaagagaaaacggcggcgaaatgtcgacaaggaccctgccaaggaagacgtcgaaaaagccaagaagcgccgtggtcgaccacccgcagagaaactttcccctaacccgccgaaactcactaagcagatgaatgccatcattgatacggtaataaactacaaggactcttcggggaggcagctgagtgaagtatttatccaactgccctctaggaaagagctgcccgaatactatgagctaatccgtaagccagtcgatttcaaaaaaattaaagaacgcattcggaaccataagtatcggtcccttggggaccttgagaaagatgttatgctgctctgccataacgcccagactttcaacctggaggggtctcagatctatgaggattctattgtcctgcagagcgtgtttaagtccgcacggcagaagatcgccaaagaagaggagagcgaggatgagtctaatgaggaggaagaggaagaggacgaggaggagtcagagagtgaggcaaagagcgttaaagtgaagatcaaactgaataaaaaggacgacaaaggtagggataagggcaaaggcaagaaaaggcctaataggggcaaggccaaacccgttgtgagcgactttgattctgacgaggaacaggatgaaagagagcagagcgagggcagcggcaccgacgatgagtag

SEQ ID NO: 136755 - DNA, 765 bp, Artificial Sequence
  Description of Artificial Sequence: Synthetic coding sequence
atggaggaagaagtcaggctgaagaagagaaagcgcagacgtaacgtggacaaggacccggctaaagaggacgtggaaaaagccaaaaagcggcgcggacggccacctgctgagaagctcagccccaaccctcccaagctgacaaagcagatgaacgcgatcattgacactgtgataaactacaaagaccgatgtaatgtggagaaggtaccgtccaatagtcagctggagattgagggtaactcatccgggcgacaactgagcgaggtttttatccaattaccttccagaaaggagctgcccgagtactacgaactgatcagaaagccggtcgacttcaagaagatcaaggaaaggatccgaaaccataagtaccgctccttgggcgaccttgaaaaggacgtaatgctcttgtgtcataatgcacagaccttcaacctcgaaggatcacaaatttacgaggattcgatagttctacagagtgtcttcaaatctgcacgccagaaaattgctaaagaggaagagagtgaagatgaatccaatgaagaagaagaagaggaggacgaggaggagagtgagtccgaggcaaagagtgttaaggtgaagatcaaactgaataaaaaggatgacaaagggcgagataagggaaagggaaagaaaaggccaaacaggggcaaagcaaagccagtcgtgagtgactttgattccgatgaagagcaggatgagagagagcaaagtgaaggctccgggaccgacgatgaatag

SEQ ID NO: 136756 - DNA, 4719 bp, Artificial Sequence
  Description of Artificial Sequence: Synthetic coding sequence
atgagtactcccacagaccccggggcgatgccccacccggggccttcccccgggcccggtccttctcctggcccaattcttggaccctccccaggccccggcccgtcccctggttccgtccattccatgatgggcccttcacccggtccaccgtccgtttctcaccccatgcctacaatggggtccactgattttccacaggaaggcatgcaccagatgcataagccaattgatggcatccacgataaaggcattgtggaggatatccactgcggctccatgaagggcaccggcatgaggcccccccatcctgggatggggccaccacagagtccaatggatcagcactctcaaggctatatgagtccccatccatctccattgggggccccagagcacgtatctagtccaatgtccggggggggacctacacctcctcaaatgccaccatctcaaccaggcgctctaattcctggggacccccaagccatgtctcaacccaaccggggaccctcacccttctccccggttcagctgcaccaattgagggctcaaatcctggcttataaaatgctggctcgtggccaaccactgccagagacactccagctggctgttcaagggaaaaggaccttgccaggcctgcagcagcaacagcagcaacagcagcaacaacaacagcaacagcagcagcagcagcagcaacagcagcagccccagcagcagcctcctcagccacaaacccagcagcagcaacagccagccttggtgaattataatagaccctccggccccgggcccgaactgagtggcccatcaactcctcagaagctccctgtcccagctccaggaggaagaccttcccctgcgccccccgctgccgcgcagccccctgcagccgccgtccccggcccaagtgtcccacagcccgcccctgggcagccctctcctgtgctgcaactgcagcaaaagcagtcacgaatctccccgattcaaaaaccacaggggctcgatcctgtggagatactgcaagaacgagagtatcggctgcaggctagaatcgcccatcgtatacaggaactcgagaacttgcccggctcactcccaccggatcttcgaacaaaagccacagtggaactgaaagccctcagactgcttaattttcaacgccagttacggcaagaggtcgttgcatgcatgaggagagacacgacactagaaaccgcccttaattctaaggcctataagagaagcaagcgacaaacactgagggaggcacgaatgacagagaaactcgagaaacaacagaaaattgagcaagaaagaaagcggagacagaagcaccaagagtacttgaactcgatactgcagcacgcaaaagactttaaggaataccaccggtctgtggccggaaaaatccagaaactgagcaaggcggtcgcgacttggcacgccaacactgaaagagagcagaaaaaggaaacggaacggatagagaaagaacgtatgagacgcttaatggccgaagatgaagaggggtaccgcaagttgattgaccagaagaaggatcgtcggctagcttacctgttgcagcaaacagatgaatatgttgctaacctgactaacttagtctgggagcacaaacaagcgcaggcagcaaaagagaaaaagaagcggcggcggagaaagaagaaggccgaagaaaacgccgaagggggtgaatcagccctggggccagatggagagccaatcgacgaatcttcacagatgagtgacttaccagtcaaggtgacgcacaccgaaactggcaaagtcctcttcgggcccgaagcgcctaaggcaagccagctggatgcttggctggagatgaaccccggatacgaagtggccccaaggagtgactccgaggagtctgactccgactacgaggaagaggacgaggaggaggaatcatctaggcaagagacagaagagaaaatcttattggacccaaattctgaggaggtctcggagaaagacgcaaagcaaatcatagaaaccgctaagcaagatgtggatgatgagtatagcatgcaatactcggcgcgcggtagccaatcgtattacaccgtcgctcatgctatcagcgaacgtgtcgagaagcagtccgcgctcctgataaacgggacgctcaaacattatcagttacaaggactggaatggatggtctcactctataacaataatctcaacggaatcctagcagacgagatgggactgggaaaaacgattcaaacgatcgcacttatcacatacctcatggagcacaagcgattaaacggaccgtatttgatcatcgttcccctgagtaccctgtccaactggacatatgaatttgacaagtgggccccatcggtagtgaaaatctcatacaaggggacaccagcaatgaggcgctccttagttccacaactgagaagtggaaaatttaacgtcctgctgaccacttatgaatatattattaaagacaagcacatcttggccaaaattagatggaagtatatgatagtggacgagggccatcggatgaaaaatcatcattgtaaactgacccaggtgctcaatactcactatgtcgctccacggcgcatcttgctgacaggcaccccactacaaaacaagctgcccgagctttgggcactcctcaacttcctattaccgacgatttttaagtcttgttctacatttgaacagtggtttaacgccccattcgcaatgacaggcgaaagggtggatttgaacgaggaggaaactattctgataattaggcggctgcataaggtcctaagaccgtttctactccgaaggctaaaaaaggaggtcgaatcccagctacctgagaaggtcgaatatgtcataaaatgtgacatgtccgcactgcaaaagatcttataccgccacatgcaggcaaaaggcattctactcaccgacggctctgagaaagacaagaaggggaagggcggtgccaaaaccttgatgaacaccatcatgcagttgagaaagatctgtaaccacccctatatgtttcagcacattgaggagagcttcgccgaacacttggggtattctaacggtgtgatcaacggcgccgagctttatcgcgctagcggaaagttcgaactgctagaccggatcctgcccaaactgcgggcaaccaatcaccgtgtgcttctcttctgtcaaatgacctctctcatgactatcatggaagactattttgccttccgaaactttctgtatttgcggctggatggaaccaccaaaagcgaagaccgggctgcactgctgaaaaaattcaatgagcccggctcccagtatttcatcttcctcttgtctactcgagcgggcggactaggcttgaacttgcaggccgcagacacagtggtcatcttcgactccgactggaatccacaccaggatctccaggcgcaggatagagcgcacagaattggccagcaaaatgaggtccgggtcctgcgtctgtgcacagtgaatagtgttgaggaaaaaatcctcgctgctgcgaagtataaactgaatgtggaccagaaagtgatccaggcaggtatgttcgaccagaagagctcctcccacgaacgtcgcgcctttttacaggcaattctggaacatgaagaagagaacgaggaagaggatgaagtccccgacgatgaaaccctgaatcagatgattgcccggagggaggaggagttcgacctgttcatgcgcatggatatggacagacgaagagaggacgcgcgtaatccaaagcggaaacctagacttatggaggaggatgagctcccttcttggatcattaaggatgatgctgaggttgagagactgacctgtgaagaggaagaggaaaagatcttcggtcgcggcagccgccagagacgagatgtagactactccgatgccctgaccgagaagcagtggctgcgggccatcgaggacggcaatctggaggagatggaagaagaagtcagactgaaaaagcggaagcggcggcgcaacgttgacaaggaccctgcgaaggaggatgtcgaaaaagccaagaagaggcgaggcagaccccctgctgaaaaacttagccccaatcctcctaaactcacgaagcagatgaatgcaatcatagataccgttataaattataaagattctagtgggaggcagctgagcgaggtgtttatccagctgccaagccgcaaggagctgcccgaatattacgagttaattaggaagccagtggacttcaagaaaattaaagaaagaatccgaaaccataagtatcggagccttggagatcttgaaaaagatgtgatgcttctttgccataacgcacaaacgttcaatcttgaaggcagccagatatatgaagacagcattgtcttacagtctgtgtttaagagtgcccgccagaagattgcaaaagaagaggagtcagaggacgagagtaatgaagaagaggaggaggaagacgaagaagagtccgaatctgaggctaagtcagtgaaagttaaaataaaattaaataaaaaggacgataaggggcgggacaaaggaaaggggaagaagagacctaatcgaggaaaagctaagcctgtcgtgtctgactttgactcagatgaggaacaggatgaacgcgagcaatccgagggatcagggaccgatgatgagtag

SEQ ID NO: 136757 - DNA, 4773 bp, Artificial Sequence
  Description of Artificial Sequence: Synthetic coding sequence
atgagtacccccactgacccgggcgcgatgcctcaccctggaccttccccaggccccggcccgtcacccgggccaattctgggcccttcaccaggacctggaccgagcccaggctcagtacactccatgatgggaccatccccaggtccaccttctgtcagtcatccgatgcctacaatgggtagcacggactttccccaggaagggatgcatcaaatgcacaagccgatagatggtattcatgacaagggaatagtggaagatattcactgtggctccatgaaaggcactgggatgcgcccccctcacccgggtatgggcccccctcagtcacccatggatcaacacagtcaaggttacatgtccccccacccttcaccactgggcgcccccgagcacgtgtcgtctccaatgtctggtggaggccctacaccccctcaaatgccgccctcacaacctggcgcactgatccctggcgaccctcaggccatgagccaaccgaaccgcgggccatctcctttcagtcccgttcagctccaccaactgagagcccaaatcctggcttataaaatgcttgctcgtggccagccactccctgaaactttacaactggccgttcagggcaagagaaccttgcccggacttcaacagcaacagcaacagcaacagcagcagcagcagcagcagcaacagcaacagcaacagcagcagcaaccccagcagcaaccgccccaacctcagacccagcagcagcagcaacccgctctggtgaactacaatcgaccatcaggtcctggtcctgagctctccggaccatctactcctcagaagttaccggttccagcccccgggggaaggcctagccctgccccccccgccgctgcgcaaccccccgcagctgccgttccaggaccctcagtaccacagcccgccccgggtcagcccagcccggtgctccagctgcaacagaaacagtcaaggataagtcccattcaaaaaccccagggcttagatcccgttgagattctccaagaaagagaatatagactgcaagcccgaatcgcccaccggattcaagagcttgagaacttgcccggcagtctccccccggacctgcggacaaaagcgacagtggaactgaaggcacttcggctgctcaactttcagaggcagctcaggcaggaggtggtggcttgcatgagaagagatacaaccctagagaccgctcttaacagcaaagcatacaaacgctctaagcggcagacactgagggaggcaagaatgactgagaaactggaaaaacagcagaagattgaacaagaaaggaaaagaagacagaagcaccaggagtacttaaacagcattctgcagcatgccaaggatttcaaagaatatcataggtctgtggcgggaaagattcagaagcttagcaaagcagtcgctacatggcacgctaacactgagcgagagcagaaaaaggaaacagagcgaatcgagaaagaacgaatgcgacggttgatggctgaagacgaagaggggtaccgcaaactgatagaccaaaaaaaggatagacgcttagcatatctcctgcagcagaccgatgagtacgtggcaaatctcacaaatttggtgtgggaacacaagcaagcgcaggccgccaaggaaaagaagaagagacggcggcggaaaaaaaaagctgaggaaaacgccgagggaggagagtctgccctgggacctgatggcgagcccattgatgaaagtagccagatgtctgatctcccagtcaaagtcacacataccgagacggggaaggtgctgttcgggccagaagccccaaaggcctcacagctggacgcttggttagagatgaaccccggttatgaggtggcacctagatcggattcggaagaaagtgattccgattacgaggaggaggatgaggaggaggagtcatccagacaagaaactgaagagaaaattctgctggatcctaatagcgaggaagtgtccgaaaaggacgccaaacagatcattgagaccgctaaacaggacgtcgacgacgaatacagcatgcaatacagcgcccggggttctcaatcttactacaccgttgcccacgctatctctgaaagagtggagaaacagagtgctctgctcattaacggcaccctgaagcactaccaactccaaggactggaatggatggtttcactctacaacaacaatctgaacgggatcctggctgacgaaatggggctcggaaaaaccattcaaactattgccttgattacctacctgatggaacataagaggctcaatggcccatatctgatcatcgttccattgtctaccctgagcaactggacgtatgagttcgacaagtgggccccatctgtcgtgaagatttcatacaagggcacccctgccatgcggcggagtcttgtaccgcagctgagatccggcaagttcaatgtcctgctgaccacctacgagtatatcatcaaagacaaacacatattagctaaaataagatggaagtacatgatcgttgatgaaggacatcgcatgaagaaccaccattgtaagctcacgcaggtcctcaatacacactacgtagccccgagacggattttactcacgggcacccccctgcagaacaaactgccagaactgtgggctctgctgaatttcctgttgcccaccatctttaagtcatgcagtacattcgagcagtggttcaatgctccattcgctatgaccggggaacgggttgacttaaatgaggaagaaacaattcttattattcgaaggctccacaaggtgctccggccttttctgcttagacgactcaagaaagaggtggagtcgcagctgcctgagaaagtggagtatgtaatcaaatgcgatatgtctgcgctgcagaagatcctttatcgtcatatgcaggctaaggggatcctgttaacagatggtagcgagaaggacaagaaaggcaaaggaggggcaaagactcttatgaacactatcatgcagctgcgtaaaatctgcaaccacccgtatatgttccagcacatagaagagtcattcgccgaacacctgggctactctaacggggtaattaacggcgcagagctatatcgcgcatcaggtaaattcgaattgctggaccggattttgccaaaattgagggccaccaatcacagggtactgctcttttgtcagatgacctccctgatgaccatcatggaggattactttgcgttccgaaattttctttatctccggctcgatggtacaacaaagtccgaagatagagcagccttgctcaagaagtttaatgaaccaggctcccagtatttcatattccttctgtctaccagggcaggcggactaggattaaatctgcaggctgcggataccgtcgttatattcgactctgactggaaccctcatcaggatctgcaggcacaagatagagcccatcgcattggacagcagaacgaggtgagggtgcttcgattgtgtacagtgaattccgtagaggagaagatccttgctgccgcaaaatacaagttgaacgtagaccaaaaagtgatacaggccggcatgtttgatcagaagtctagctcccacgaaagaagagcgttcctgcaggctatcttggagcatgaagaagagaacgaggaggaggatgaggtaccagacgacgaaacactgaatcaaatgatcgcccgcagagaggaggagtttgatctgttcatgcggatggacatggaccgccgcagagaagacgctcgcaaccccaaacggaagccccgactgatggaggaagatgaattaccttcctggattattaaggacgatgcagaggtggaacgcctgacatgcgaggaagaggaagaaaaaatctttggccgagggtccagacagaggcgagatgtggactattccgatgcccttacggaaaaacagtggcttcgggcgattgaagacggaaacctggaagagatggaagaggaagttcgccttaaaaagcgtaaacgcaggagaaacgtcgataaagatccagccaaggaagatgttgagaaggctaagaagaggcggggacgccctcccgccgagaaactgtcacctaacccccctaaattgacaaaacagatgaatgcgattatcgacacagttatcaattacaaggaccgatgcaatgttgagaaggtgcctagtaatagtcagctggaaatagaaggaaattctagcgggaggcagctgagtgaggtgtttatccagttgccgtccagaaaggagctgcccgaatactacgagctcatcagaaagccagttgattttaagaagatcaaggaacgtatcaggaaccacaagtaccgttctctcggagaccttgaaaaagatgtcatgctgctgtgccataatgctcagacctttaaccttgaggggagccagatatacgaagacagtatcgtgctgcagagcgtattcaagagcgccagacaaaagatcgccaaggaggaggaatccgaggacgaatcgaatgaagaagaagaggaagaagacgaagaagagagcgagtctgaagctaaatccgtgaaggttaagattaagctgaacaaaaaggatgacaagggacgcgataaaggaaaggggaagaagcgcccaaatagggggaaggcaaagcctgtggtgtccgattttgacagtgatgaggagcaggacgaacgggagcagtcggaggggagcggtaccgatgacgaatag

SEQ ID NO: 136758 - DNA, 534 bp, Artificial Sequence
  Description of Artificial Sequence: Synthetic coding sequence
atggaggaggaggtgcggctgaagaagagaaagcgccgcagaaacgtcgataaggatcccgctaaagaggacgtcgagaaagctaaaaagcggcgaggacgcccccctgccgaaaaactctcgccaaatcctcctaaactgaccaagcaaatgaatgccattatcgatacagtcatcaactacaaagactcttctggccgccagttaagcgaggtatttatccagctgcccagtagaaaagaactgcccgagtactacgaacttatcagaaaaccagtcgatttcaagaaaattaaggaacggatccgtaaccataagtacaggtcgttgggagacctggaaaaggatgtgatgctgctttgtcacaacgcccagacattcaatcttgagggttctcagatttacgaagattccatcgtgctccagagcgtgttcaagtcagcgcgccaaaaaattgcgaaagaagaagagtccgaagacgagagtaacgaagaagaagaggaggaggatgaggaggagagcgaatccgaatag

SEQ ID NO: 136759 - DNA, 816 bp, Artificial Sequence
  Description of Artificial Sequence: Synthetic coding sequence
atgaaacgactggcagcacggtgcttcgcgggactgctcatcttgtctccccttaccgtgatctccgactcgagacccgccgattctggcaaagccattgaggatggaaacttggaggagatggaggaagaagtgcggctgaagaagcggaaaagacgccggaacgttgataaggatccagccaaggaagacgtagaaaaggcaaagaaacgcaggggtaggccgcccgcggaaaagctcagccccaaccctccgaagctgacgaaacagatgaatgccataatcgatacagttataaattataaggacagttctggacgacagcttagcgaagtattcatccagttacccagccgaaaggagctccccgagtattatgagctaatcagaaaacccgttgacttcaaaaagatcaaagagagaatacgtaaccataagtacagaagcctcggggatttggagaaggatgttatgctgctgtgtcataacgcgcagacatttaacctggagggcagccagatctacgaagatagtatcgtcctccagagcgtgtttaagagtgctcgacaaaaaattgcaaaggaagaggagtcagaagacgaatcgaatgaggaggaggaggaagaggacgaggaggagtccgagtccgaagctaagtcagtgaaagtgaaaatcaagcttaacaaaaaagacgacaagggtcgggacaaaggcaagggaaagaagagaccaaatcgcggcaaagcgaagccggtcgtcagcgattttgactcggacgaagaacaggacgaaagggtgtctgtcgctgattggtag

SEQ ID NO: 136760 - DNA, 462 bp, Artificial Sequence
  Description of Artificial Sequence: Synthetic coding sequence
atgaaacggctcgccgcacggtgctttgctggcctgcttatcctgtcccctctgacagtcatcagtgactccaggcctgcagattctgggaaagcaattgaggatgggaatttggaggagatggaggaggaggttcgcttgaaaaagcgtaagcgaaggcgtaacgtcgacaaagatcccgccaaggaagatgtggagaaggccaagaaacgaagagggaggccaccagcagagaagctctcaccaaacccacccaaactaactaaacagatgaatgctatcattgataccgtcattaattacaaggactctagcggaagacagttgtcagaggtgttcatccagttaccctcacgcaaagagcttccagaatactatgaattgattcgcaagccagtggacttcaaaaaaattaaggagcgcatacgtaatcataagtatcgctccctgggcgacctctag

SEQ ID NO: 136761 - DNA, 468 bp, Artificial Sequence
  Description of Artificial Sequence: Synthetic coding sequence
atgtctaccccaaccgacccaggggcgatgccacaccccggaccttctcccggcccaggtccctccccagggccgatcctgggccctagcccgggacccggcccatctccaggaagcgtgcattcaatgatgggcccgtcacctgggcctccgtcagtgtctcaccctatgcccacaatgggatccaccgactttccacaagaaggtatgcaccagatgcataaacccatcgatggcatccacgataagggaatagttgaagacatccattgcggttcgatgaaggggactggcatgaggcccccccaccccggtatggggcctcctcaatcccccatggatcaacacagccaggggtacatgtcgccgcatccttctcccctgggtgcccccgagcatgtttctagtccaatgagtggaggtggaccgacccctccgcagatgccaccatcgcaacccggtgcttag

SEQ ID NO: 136762 - DNA, 1680 bp, Artificial Sequence
  Description of Artificial Sequence: Synthetic coding sequence
atgagcacccccaccgacccaggcgccatgccgcacccgggcccatccccagggcctggcccgtcccccggccccatcctgggaccgagtcccggaccggggccatctcctggctcagtgcattcaatgatggggcccagcccgggacctcctagcgtttctcaccccatgccaaccatggggagcaccgactttccccaggagggcatgcaccagatgcacaagccgatcgacggaatccacgataagggaattgtggaggacattcattgtggttctatgaaaggcaccggaatgaggccgcctcaccctggcatgggaccaccccagtccccaatggaccagcatagtcagggctacatgagccctcatccatcccctctcggagcccccgagcacgtgtccagccccatgtccgggggcggacccacaccaccacagatgcctccttcacaacctggcgcccttattcccggagatccgcaggctatgagtcagccaaacagaggtccgagcccttttagcccggtgcaattgcatcagctccgggctcaaatcctagcctacaaaatgctcgcgcgcgggcagccactgccagagactctgcagctcgcggtccagggaaaaaggactctgcctggactgcagcagcagcagcagcaacagcagcaacagcagcaacagcagcagcagcagcagcagcagcagcaacagccccaacaacagccccctcagccccagacccagcagcagcaacaacccgcactagtcaactacaatcgaccttccggccccggacccgaactctccggcccctccacacctcaaaaacttccagttccagctcctggcggccgccccagtcctgcaccacctgcagccgctcaaccacccgctgccgcagttcctggaccatctgtgcctcagcctgcgcctggacaaccctctcctgtgctgcaactccaacagaagcaatccaggatttcacctatccagaaaccgcaagggctggaccccgtggagatcctgcaggagcgggagtatcgtcttcaggcccggatcgcacacagaatacaggaactggaaaatctcccaggttctctcccaccagacctgaggaccaaggctactgtggagctcaaggccctgcggctcttgaactttcaacgccagctgcggcaggaggtagtggcttgtatgcggagggacactaccctggagaccgccctgaacagtaaggcatacaagcgtagcaagagacaaacactgagggaggcaaggatgaccgagaaacttgagaagcagcagaagattgagcaagagcggaaacgccggcagaaacaccaggagtatctcaattcaatcctgcagcatgccaaagattttaaagagtaccacaggtctgttgcgggtaagatccagaaactgtctaaagctgtggcaacctggcacgctaacactgaaagagagcaaaaaaaagagacagagaggatcgaaaaggagcggatgagacgattgatggcagaagatgaggagggttatcggaaattgatcgaccaaaagaaggaccggcgcctggcctatctactgcagcagaccgacgagtacgtggcgaatctgactaacctggtctgggagcataagcaggcccaagccgctaaggaaaaaaagaaaaggtag

SEQ ID NO: 136763 - DNA, 516 bp, Artificial Sequence
  Description of Artificial Sequence: Synthetic coding sequence
atggaggaagaagttcgacttaagaaaaggaaaagaaggagaaacgtcgataaagaccctgctaaagaagacgtggaaaaagccaaaaagcggcggggccgcccaccagctgagaaactcagcccaaatccacctaagctcactaaacagatgaacgccatcatagatacagtaataaactacaaggatcggtgtaatgtcgagaaagtcccttctaactctcaactcgaaattgaggggaactcgagcgggagacagttgagcgaggtgttcatacagcttccaagtcgaaaggagcttcctgagtactatgaacttattagaaagcccgtggatttcaagaaaatcaaggaacggattagaaatcataaatatcggtccttgggcgacctggagaaggacgtcatgctgctgtgtcataacgctcagactttcaatctggaaggcagccaaatctacgaggacagcattgtgctgcagtccgtctttaagtccgcccggcaaaaaattgcatag

SEQ ID NO: 136764 - DNA, 201 bp, Artificial Sequence
  Description of Artificial Sequence: Synthetic coding sequence
atgtcgacgccaacagaccccggcgccatgcctcatcccgggcctagccccggtcctggcccctccccagggcctatactagggccatcaccagggcctgggccaagccccgggagtgtgcattctatgatggggccgtctcctggccccccaagtgtgagccacccaatgcccactatgggctcaaccgatttcccatag

SEQ ID NO: 136765 - DNA, 4944 bp, Artificial Sequence
  Description of Artificial Sequence: Synthetic coding sequence
atgagtacacctgatcccccactgggagggacccccaggccaggtccatctccggggccgggcccctctcccggcgctatgctgggacctagccccggcccatctcctggaagcgcccatagcatgatggggcccagcccggggcctccaagcgctggtcaccctatccctactcaggggcccgggggctacccacaggataacatgcatcaaatgcataaacccatggaaagtatgcatgaaaagggtatgagcgacgatcctcgctacaatcagatgaagggcatgggcatgcggagcggtggccacgcaggaatggggccccctcccagcccaatggatcaacattcccaagggtacccatcccccctgggcggtagcgagcacgctagcagtccagttcccgctagtggacctagctccggacctcagatgagttccggcccggggggagcccctctggatggagcggacccccaggccttgggacagcagaaccgcggcccaacaccatttaatcagaatcagcttcaccagctgagggcccagataatggcctataaaatgctggcacgggggcaaccgctccccgatcatctgcagatggccgtccagggcaaacgccccatgccaggaatgcagcagcagatgccaactcttccacccccgagtgtctccgctaccggcccaggtcccggaccggggccgggacctggacccggacctggccccgcaccccccaactattcaagaccacacggcatgggggggcctaatatgccccccccggggccttctggggtgccccccgggatgccggggcaaccaccaggtggcccgccaaagccgtggccagaggggcccatggctaatgcagcagcccccaccagcacaccccagaagcttatccctccccagccaacaggcaggccctcaccagccccgccagctgtccctccagcggcctccccagtcatgccaccccaaacccagtccccagggcagccagctcagccagcgcctatggtccccctgcaccagaagcagagtagaattacgcccatccagaagccacggggattggaccccgttgagatcctgcaggagcgcgaatacagacttcaagccagaatcgcacaccgtatccaggaactggaaaacctcccaggatcattggcaggtgacttaagaactaaggccacaatagagttgaaagccctgagactcctgaactttcaaaggcagttgcgacaggaagtggtcgtctgcatgcggcgagatactgccctcgaaacagctctgaacgccaaagcatataaaagatcgaaaaggcagagtctgagagaggctcgcataaccgagaagctggaaaagcagcagaaaattgagcaggaacggaaacgtagacagaagcatcaggaatatctgaatagcatcctgcaacatgctaaagactttaaggagtatcacaggagtgtcacgggaaaaatacagaaacttacaaaggcagttgccacctatcatgcaaacaccgagagggagcagaaaaaggagaatgagagaatcgagaaagaacgcatgagacgactgatggcggaagatgaggaagggtaccggaagctgatagaccagaaaaaggacaagaggcttgcctacctgttgcagcaaacagacgagtacgtcgccaacctgacagaactcgtgcgccagcataaggcagcccaggtagctaaggaaaagaagaaaaagaagaaaaagaagaaagcagaaaatgccgaagggcagaccccagccatcggtcccgatggggaacccctggacgagacaagccaaatgtctgacctgcccgtgaaagttattcacgttgagtccggcaaaattctcaccgggaccgatgctcctaaggccggacagttggaggcatggctcgagatgaacccgggttatgaggttgccccaaggtctgactccgaggagtcagggtccgaggaggaggaggaggaagaagaggaggagcagccccaagccgcccagccccccacattgcctgtggaagagaagaagaagataccggatcctgactcagatgatgtgtctgaggtggatgcccgtcacataatagagaatgcgaagcaggatgtggacgacgagtatggcgtttcccaggccctcgccaggggactacagagttattacgccgtggcacacgcagtgacagagcgagttgataaacaatccgctctgatggttaacggagtattgaaacagtatcagatcaaggggctagagtggctagtgtcattgtataacaataacctgaatggcatactggccgatgaaatgggactgggcaaaaccatccagactattgccttgatcacctacttgatggagcacaagaggatcaacggaccatttctcattattgtgcctctcagcactctgagtaattgggcatatgaattcgataaatgggccccatcagtggttaaagtaagctacaaaggttctcccgccgccaggagagcctttgtcccacagcttaggagtggaaagttcaacgtgctgctcactacatacgagtatatcattaaagacaaacacattctggctaagataagatggaagtacatgatcgttgacgaagggcaccggatgaagaatcaccactgcaagctgacccaggtcctgaacacccactacgtcgctcccagacgtctactactcaccggcactccccttcagaataagctgcctgagctgtgggccctacttaactttctccttccgaccatcttcaagtcttgctcgaccttcgagcagtggtttaacgcgcctttcgcaatgaccggagagaaggtggatctcaacgaggaggaaactattctgataattaggcgactgcacaaagtgctgcggccatttttattacgacgactgaaaaaggaagtcgaggcccagcttccggaaaaggtggaatatgtaataaagtgtgatatgtctgcactgcagcgggtactttaccgtcacatgcaggcgaagggggttctacttacagatggatctgaaaaagacaagaagggcaaaggggggacgaaaactttgatgaacaccatcatgcagctcagaaagatctgtaaccatccttacatgttccagcacattgaggaatcattttccgagcaccttgggttcaccgggggcatagtacaggggctggacctctacagagcctcagggaagttcgaattgttggatcgcatcctgcccaagctgcgcgctaccaatcataaagttctgctgttctgtcaaatgacctccctgatgaccatcatggaagattacttcgcatatcggggcttcaagtacttgcggttggacggcaccactaaggccgaggataggggaatgctgctcaagacctttaatgagcctgggtccgagtacttcatcttcttgctctccacacgcgcgggaggccttggactgaacttgcaatcagccgatacagtcatcatttttgacagtgattggaacccccatcaggacctgcaggcacaagacagggcacaccggatcggccagcagaatgaagtgcgtgtgctcagactttgtacagtgaattctgtggaagagaaaattctggcagccgctaagtataagctgaacgtggatcagaaggtgatccaggcaggcatgtttgaccagaaaagtagtagtcatgagcggagagccttcttacaggccatactcgagcacgaggagcaagacgagtcacgccattgcagtactggctccggctcagcgagttttgcccacacagctcccccacctgccggcgttaatcccgacctcgaagagccccccctgaaggaggaggatgaggtgcccgacgatgaaactgtgaaccagatgatagcgaggcatgaggaagaatttgatttatttatgagaatggacctggaccgacggagagaagaagcgagaaaccccaaacggaaacccagactcatggaggaagacgagctgccatcctggatcatcaaggatgatgccgaggtggagcgcctaacatgcgaggaggaagaagaaaagatgttcggtcgaggctcacgacataggaaggaagttgactactctgattcactcactgagaaacagtggctgaaggccatcgaagaaggtactctggaagagattgaggaggaagttaggcagaagaaatcatctcggaagaggaaaagagactcagacgcaggaagctcaacaccgaccactagcacacgctccagagacaaggatgacgagagcaagaagcagaagaagcgggggcgacctccagcagagaagctctccccgaatcccccgaatttgactaaaaagatgaaaaaaatagttgacgcagtgatcaaatacaaggactcctctagcggcagacagttgagtgaggtatttatccaactgccaagtcgcaaggagttgcccgaatactatgagctgatccggaagccagtcgatttcaaaaagatcaaggagcgcattaggaatcataaataccgatcattgaatgatctggagaaggatgtaatgcttctgtgtcagaatgcccagacatttaacctggaaggatctctaatatatgaggacagcattgtcctccaaagcgtattcacgtccgtaagacagaagatcgaaaaggaagacgactccgaaggagaagaatccgaagaagaggaagagggggaggaggagggcagcgagtccgagtccaggtcagtcaaggttaagatcaagctcgggcgtaaagaaaaagcccaggatcgccttaagggtggcagaagaaggccttctcgcgggagtagggcaaagcctgtcgtttccgacgatgatagcgaagaagaacaggaggaggacagatccggatcaggctccgaggaagactag

SEQ ID NO: 136766 - DNA, 5040 bp, Artificial Sequence
  Description of Artificial Sequence: Synthetic coding sequence
atgtccacccccgaccctcccctggggggtacgcctcgccctggtcctagccccggccccggacctagtcccggggcgatgctgggccctagccctggcccctcacccggatccgcccatagtatgatgggaccatcccctggaccccctagcgctgggcaccctatccctacgcagggccccggcgggtacccgcaggataatatgcaccagatgcacaagcccatggagtctatgcacgaaaaggggatgtccgatgatccccgttacaatcaaatgaagggcatgggcatgcgatccggcggccacgctgggatgggccctcctcctagtccgatggatcaacactctcagggataccccagtccgctgggaggatctgagcatgccagttctcctgttccagccagcggaccatcctccggccctcagatgtcttcaggaccaggaggtgcccctctggacggggccgatccacaggcacttgggcaacaaaatagggggcctacgccctttaatcaaaatcagctgcaccaactgcgggctcagatcatggcttataagatgttggcacgcggtcaaccgctgcctgatcatctgcagatggccgtgcagggtaagcgccccatgcccggaatgcagcagcagatgcccaccctcccgccgccttcggtgtcggcaactgggccaggaccgggacctggtccgggccccgggcccggcccgggaccggcacctccgaactatagcagaccccatgggatgggaggtcccaatatgcctccccctggccctagcggcgtgccacctggcatgcccggtcagccccccggcgggcctccgaagccttggcctgaggggccaatggctaacgccgcagcacctacatctacgcctcaaaagctgatccctccccagcctacaggaagaccatcacccgctccacccgcagtgcccccagcagccagccctgtgatgccccctcaaacgcagagtcccggccagcctgcacagccagctcctatggttccgcttcatcagaagcagagccgtattacacccatccagaagcctaggggcctagaccccgtagaaatcctgcaggaaagagagtataggttacaggctcggatcgcacatcggatccaggaactcgaaaatttgcccggctccctcgcgggtgacctccggacaaaggccaccattgaattgaaggccctgcgcctgctgaactttcagcgccagttgcggcaggaggtggtggtttgcatgagacgagacaccgcactggagactgctctcaacgccaaggcatataagcggtccaaaagacagtcattgagggaagcccgcattaccgagaaactggagaaacagcagaaaattgagcaggagaggaagcgtcgccagaagcatcaggagtatttgaatagcatcctgcagcacgctaaggactttaaggagtaccaccgtagcgttaccgggaaaatacagaaattaacaaaggctgtggcgacttatcacgccaataccgagagagaacaaaaaaaagagaacgagcggatagagaaggaaagaatgcggcgcctgatggctgaagatgaggagggatacagaaaactgatagatcagaagaaggacaagaggctggcttacctattgcagcagaccgatgaatacgtagctaatttaacggagttagtgaggcaacacaaggccgcgcaagtcgcaaaagaaaagaaaaaaaagaaaaagaagaagaaggccgagaatgccgagggacagacaccagccataggtccagacggtgagccccttgatgagacctcccagatgtccgatttgcctgtgaaggtaattcatgtcgaatccggtaagatattaacgggtactgatgcaccaaaggccggccagctcgaggcatggttggagatgaaccctggatacgaggttgcccccaggtcggactcagaggagtcgggatccgaagaggaggaagaagaggaagaggaggaacagccccaggccgcccagccaccgaccctccctgtggaggagaagaagaagatacctgacccggactcagacgacgtcagtgaggtggatgctagacacattattgagaacgcgaagcaggatgtggatgacgaatatggtgtctctcaggccctcgcgagagggctccagagctactatgcagtggctcatgctgttacagagagggtggacaagcagtcagccctcatggttaatggcgtgctgaagcagtaccagatcaaagggctcgaatggctagttagtctgtataataacaatctaaacggaatactggccgacgaaatgggtctgggaaaaaccatccagaccatagccctcataacctacctcatggaacataagaggatcaatggtcctttcctgataatcgttcctctgagtaccctctctaactgggcttacgaattcgacaagtgggctccttcggtggtgaaggtctcttacaaaggctcccctgcagctagacgggcatttgtgcctcagctgcgtagcggaaaatttaatgtgctcctcacgacctatgaatatattatcaaggataagcatatcctggctaaaattaggtggaagtatatgattgtggatgagggtcataggatgaaaaatcatcattgcaaactgacccaggtcttgaatacacactacgtggccccccgacgcctcctcctaacgggaacccctctgcagaacaagttgcctgaattatgggccctgttaaacttcctattacccacaatctttaagtcttgctcaacctttgagcagtggtttaatgcaccttttgccatgacaggagagaaggttgacctcaatgaagaagagaccatcctcataatcaggagattgcacaaggtccttcggccattcctgcttcgccgcctgaaaaaggaggtggaggcccagctgccagagaaagtggagtacgtcatcaagtgcgatatgtcggctctgcaacgcgtgttgtaccgccatatgcaagccaaaggtgtccttctgaccgatggctccgagaaagataagaaaggtaaagggggcacaaaaaccctgatgaatacaataatgcagcttcgtaaaatttgtaatcatccctatatgttccaacacattgaagagtccttcagcgaacacttggggtttactggtgggattgttcagggcctggatctctatcgcgcctctggcaagttcgagctcctcgatcggattctgcccaaactccgggccacgaaccataaggtcctgctgttttgtcagatgacaagcttgatgacaattatggaagactatttcgcttatcgtggcttcaagtaccttaggctggacggcaccactaaagcggaagatagaggaatgctactgaagacctttaacgaaccaggatctgagtatttcatctttctgctatccacacgagccggcggattggggcttaacttgcagagcgccgataccgtgatcatattcgactccgactggaatccgcaccaagaccttcaggcccaagatagggcccaccgcataggacagcagaacgaggtgcgcgttctaaggttgtgcactgtgaattctgtagaagagaagattcttgccgcagcgaaatacaagctcaatgtagaccagaaggtgattcaggctggtatgtttgatcaaaagtctagcagtcatgaacgcagagcatttctacaggctatacttgagcacgaggaacaggacgagagtagacactgttccactggctccgggtcagcttcattcgcccatacagctcctccccccgccggcgttaaccccgacctagaagagccacccctgaaggaggaggatgaggtgcccgacgatgagacggtcaaccaaatgatcgctaggcatgaagaagagttcgacttgttcatgcggatggacctcgatcggcggagagaggaggccaggaatccgaagaggaagcctcgccttatggaggaggacgaactcccttcctggatcatcaaagatgacgcagaggtcgagcgcttgacgtgcgaagaagaggaggagaaaatgtttggaagaggttccaggcaccgaaaagaagttgactactctgacagcctgactgaaaaacagtggctgaaaaagatcaccggcaaagatattcatgacacagccagcagcgtagcacgagggctgcagttccagaggggcctgcagttttgtacaagagcgagcaaagcaatcgaagagggtacgctggaggagatagaggaggaggtgaggcaaaaaaagtcatccagaaagcgcaaaagggactccgatgcaggatcttccactccaaccacctcgacgaggtcaagagacaaggacgacgaaagcaagaagcagaaaaagaggggaaggccgcctgcagaaaaactctctcctaatccccccaacctgaccaaaaaaatgaaaaaaatagtggacgccgtaattaaatacaaagactcctcttctgggcgtcagcttagcgaagtattcatccaactgccatcccggaaggagttgcccgagtattacgagttgatccgcaagcctgtcgatttcaaaaaaattaaggaacggatacgtaatcataaatacagaagtttaaatgacttagaaaaggacgttatgcttctgtgtcaaaacgcccaaacctttaacctcgagggtagtctcatttatgaggatagcattgtgctgcagtctgtgttcacatccgtgcgacaaaagatagagaaggaggacgacagcgagggggaagagtccgaggaggaagaggagggggaagaagaagggtctgagagcgaaagccgcagcgtcaaagtaaagattaaactcggccgtaaggaaaaggcccaggacagactcaagggtgggcggaggcgcccttcacggggtagccgggcaaagccagtcgtttcggacgacgactccgaggaggagcaagaggaagaccgcagcggctcaggatctgaagaggattag

SEQ ID NO: 136767 - DNA, 4854 bp, Artificial Sequence
  Description of Artificial Sequence: Synthetic coding sequence
atgagtacccctgatccaccactgggtggtaccccccggcctggtcctagccccggcccgggcccaagccccggggccatgctgggtccctctcccgggcctagtcctgggtccgcacatagcatgatgggaccttctcctggaccaccatcagcaggccacccaattcctacccagggtcccggaggctatccccaggacaacatgcaccagatgcataagcctatggagagcatgcatgagaagggaatgagtgacgacccccgctataaccagatgaaggggatgggaatgaggagcggtgggcatgctggtatgggcccccctcccagtcccatggatcagcattcccagggatatcctagtcctctgggggggagcgagcacgcctcttctcctgtccctgcgagcggtccaagctctgggccccagatgagcagtggcccgggtggggccccgctggacggagcagacccccaggcactgggacagcagaatcgaggtccgacaccatttaatcaaaatcagctccaccagctcagggcccagatcatggcatacaaaatgcttgcccgtggccagccattgccggatcatctgcaaatggcagtgcaggggaagagacccatgcccggcatgcagcagcagatgccaacgcttcctccaccaagcgtaagtgccacaggccccgggcccgggcctgggccaggccccggtcctgggcctggtccggctcctcctaactactccagacctcatgggatgggggggccaaatatgccgcctcccggtcctagcggggttcctccaggtatgccaggacagcccccgggaggccccccgaaaccttggcccgaaggtccaatggcaaatgcagcggcccctactagcacccctcagaagcttatccctccacagccgacagggcgaccaagcccggccccccccgcagttcctccagctgcctccccggtgatgccaccacagacacagtcaccagggcagccggctcagcctgcacccatggtcccgcttcaccagaagcagagtagaataactccaatccaaaagccacggggccttgatcccgttgagatcctgcaggagagggagtaccgactccaggcgcggatcgcacatcggatccaggagctggagaatctaccaggtagtctcgcaggagacctgagaaccaaggccacaatagagcttaaggcccttagacttctgaacttccagcgtcaactgagacaagaggttgtggtgtgtatgagaagagacacggctcttgagaccgctttaaatgctaaggcctataaacggagtaagcgacaaagcttaagagaggctaggattaccgagaaactggaaaaacagcagaagatagagcaggaacggaagagacggcagaaacaccaggagtatcttaactctatattgcagcatgctaaggactttaaggagtaccaccggtctgtgaccggcaagatacagaaattaaccaaggccgttgccacttaccacgccaacaccgagcgtgaacagaagaaagagaatgaaagaatcgaaaaggagaggatgagacgacttatggctgaggatgaggaggggtacaggaagcttatagaccaaaaaaaggataagcgcctggcttacctgctccagcagactgacgagtacgtggcaaatctgaccgaattggttcggcagcacaaagctgcgcaggttgctaaagagaaaaaaaagaagaagaagaagaaaaaagctgaaaacgccgagggtcagacaccggcgatcggccctgatggcgaaccgctcgacgagacttcccaaatgtcagatctgcccgtgaaggttatacacgtagagagcggcaagatcctgacagggaccgatgcacccaaggcaggacagttagaggcctggctcgaaatgaatcctgggtacgaggtggccccccgcagcgacagcgaagagagcgggtcggaggaggaagaggaggaagaggaggaagaacagccgcaggctgctcagcctcctactctccccgtggaggagaagaagaagattcctgatccggactccgatgacgtgagtgaggtggatgcaagacacatcatcgagaatgccaagcaggacgtcgacgacgaatatggcgtttctcaggcactagcaaggggccttcagagctactacgctgtggctcacgcagtgaccgaacgggtggacaaacagagtgcactcatggtcaatggcgtactgaaacagtaccaaataaagggcctggagtggctggtgagtctctacaacaataacctcaacgggatactcgcagatgagatgggcctcggcaaaactattcaaaccatcgcattgatcacgtatcttatggaacataagaggatcaacggacctttcctaattatagtaccattatccactttgtctaactgggcatacgaatttgacaaatgggctccgagcgttgttaaggtgtcatataagggaagccccgcggcccggcgtgcgtttgtcccacagctccggtctggtaagtttaacgtgctgttgacaacttacgaatacatcatcaaagacaaacacatcctcgccaagatacggtggaaatatatgatcgtcgacgaggggcaccgcatgaagaaccaccattgcaaactgacacaagtgctgaacacacattacgtggcacccagacgtctgctcttaacaggaacccccttgcagaataaactcccggagctgtgggctcttctgaacttcctactgcccacgatatttaagtcctgctctacattcgagcagtggttcaatgcacctttcgccatgaccggagaaaaagtggatttgaacgaggaggaaacaatcctgattattaggagactgcacaaggtgttgcgtccattccttttaaggagactcaagaaggaggttgaggcccaactccctgagaaagtcgagtatgtcattaagtgcgatatgtccgctttgcagagggtactgtacaggcatatgcaggcaaaaggtgtgctgctcacagatgggagcgagaaagataaaaaaggcaaaggaggtacaaagaccctgatgaacacaatcatgcaactccgcaagatctgcaaccatccatatatgttccagcatatcgaggaatccttctccgagcacctcggcttcaccggggggattgtgcagggtctcgacctgtatagagctagtgggaagttcgaacttttggataggattttaccaaaacttagggcaaccaatcataaagtactgttattctgccagatgacctctttgatgaccatcatggaagattatttcgcttaccggggttttaagtacttgagactcgatgggaccacaaaagctgaggatcggggcatgctcctgaagactttcaacgagccaggatctgagtattttattttcctgctatcaacaagggcaggaggactgggactgaatctgcagtcagctgataccgtgataatctttgacagcgactggaatccccatcaagacctgcaagcgcaggatcgcgcccataggatcgggcagcaaaatgaagtccgcgtgctgagactgtgcacagtgaacagcgtcgaagagaaaatcctcgctgccgccaagtataaactgaacgttgaccagaaggtgattcaggctggcatgttcgaccagaaatcaagctctcatgagaggagggccttcctgcaggctattctcgagcatgaagagcaagatgaggaggaagatgaagtccctgatgatgagaccgtgaaccaaatgattgctaggcacgaagaagaattcgacctattcatgcgaatggatttggaccggcgtcgcgaagaagctcgaaatcccaaaaggaaaccacgcctcatggaggaggatgagcttccgtcctggatcatcaaggatgatgccgaagttgagagactcacctgcgaggaggaagaggagaaaatgttcgggcggggaagtaggcacagaaaagaagtggactacagtgactccctgaccgaaaaacagtggcttaagaccctcaaagcaattgaagaaggaaccctcgaggagattgaagaagaggtgcgccaaaagaagagctctcgcaaaaggaagcgggacagcgatgctgggtcgtctaccccaaccacaagcacacgctcacgcgataaagacgacgaatcaaagaagcagaagaaacggggacgcccccccgccgaaaaattgtctcccaaccctcctaacttgaccaagaaaatgaagaagattgtcgacgccgtgatcaaatacaaagacagttcctcaggcaggcagctgagtgaggtcttcatccagctgccctcccgcaaggaattgccagagtattacgagctgattcgcaaacctgtcgacttcaagaagatcaaagaacgcatccgtaaccacaaataccggagcctaaacgaccttgagaaggacgtgatgcttctgtgtcagaatgcacagaccttcaacttggaaggatcactgatttatgaagacagtattgtgctccagtccgttttcacatccgttagacaaaagattgagaaggaagacgactctgaaggagaggaatccgaggaggaggaagagggagaggaagaaggctcagaatctgagtcccgaagtgtcaaagttaagattaagttaggacgcaaagaaaaggcccaggataggttaaaagggggacgccggcgtccctcccgagggagtcgcgcgaaacccgtcgtgagtgacgatgatagtgaagaagagcaagaagaggatcgaagcggctctggctcagaagaagactag

SEQ ID NO: 136768 - DNA, 5046 bp, Artificial Sequence
  Description of Artificial Sequence: Synthetic coding sequence
atgagcacccctgatcctccactgggagggacaccccggcccggaccctccccaggcccaggcccttcaccaggggcgatgttgggccccagccccgggccctccccagggagtgcccatagcatgatgggcccttcacctggtccaccttctgcgggccaccccatcccaacacagggcccaggcggatacccacaggacaacatgcatcagatgcataaaccaatggagtccatgcatgaaaaaggaatgtccgatgatcctcgctacaatcagatgaagggcatgggcatgcgtagcggcggacacgcagggatgggtccaccaccaagccccatggaccagcatagccagggctacccgtccccgctgggaggcagcgaacacgcatcctcccctgtgcccgcctcgggcccaagttctggtcctcagatgtcctccggccctggaggtgcaccgctcgatggggctgatcctcaagctcttgggcagcagaacagaggcccaactccatttaaccaaaatcagctacatcagttgcgggcacagataatggcgtataagatgctggcgcgagggcaacctctccccgatcacctccaaatggctgtgcaagggaaacgacccatgccgggaatgcaacagcagatgcccaccctaccacccccttctgtatctgctacaggtcccggacccggacctggccccggaccagggcccggacccggacccgctccccccaattattcgagaccccacggtatgggaggaccaaatatgccaccaccaggcccctcaggagtgccacccggcatgcccggccagccccctggcgggcccccaaaaccctggcctgagggacccatggcaaacgccgccgcccccactagtactccccagaagttgatccccccacaacctacgggcagacccagcccagctccacctgctgttcctccagcagccagtcccgtcatgcctcctcagactcagagtcccggccagcccgcccagcccgctccaatggtgcccctccatcagaagcagtctcgtattacccccatccagaaaccccggggcctcgatccagtagagatactccaagagcgagagtacagactgcaggctcggatcgctcatagaatccaggagttggagaatttgccaggcagtctcgcgggggacctgagaacaaaagctactatcgagttaaaggccttgaggctgctgaattttcaaagacagctgcggcaggaagttgtcgtgtgcatgcgccgggacaccgcactggagacagcactcaacgcgaaagcctataaacggtccaaacgccagtccctccgagaggcgcggattactgagaagctcgaaaagcagcagaaaatcgagcaggagcggaaacgaaggcaaaagcatcaggaatacctgaactcaattctccaacacgctaaagactttaaggaataccatcggtctgttacaggaaagatccagaagctgacaaaagcagtggcgacttaccatgccaatactgagagagaacaaaaaaaagagaatgagcggatagagaaggaaagaatgaggagacttatgggccagcgagaaaagtcacgccggggactggggtctcagtcatgggccaggatattcgccgacctttcagaccatcagaatgattgcgtcacttcagtcacggagtcccttgttgggcagatcctggccgcttgttctggagaggagggtgaggtggagtggaaaggtcgggatcgcgtccgcagattgcgggctgaggatgaagagggataccgaaagctcatcgatcagaaaaaagacaagcgtctggcatacttactccaacagaccgacgagtatgtcgcaaacttgacggaactggtgcgacagcataaagctgcccaggtcgctaaagaaaagaaaaagaagaagaaaaaaaagaaagcagagaacgcagagggccaaacaccagccatcggccctgacggagaaccgttggacgaaacctcccagatgtctgacctacccgttaaggttattcacgtggagtcaggcaaaatcctcactggaactgacgcacctaaggcaggacagctggaggcatggttagagatgaacccgggttatgaagttgcacccagatccgactcggaggagagcggtagcgaggaggaagaggaagaagaggaggaggaacaaccacaggcggcccagcccccaaccctgccagtggaggagaagaaaaagattcccgaccccgacagtgacgacgtgtccgaggtggatgcccgccacattattgaaaacgctaaacaggacgtggacgacgaatacggcgtttcgcaggccctggcaagaggacttcaatcctattatgccgttgcccatgccgtgactgagagggttgacaagcagtccgctctgatggtgaatggcgtgcttaagcagtatcagatcaaagggctcgaatggctagtcagcttatataataacaatctgaatggcatcctggccgatgagatgggcctcggcaagaccattcagaccatcgccctgattacgtatcttatggagcataaacgtatcaacggccctttcctgataattgtaccattatccaccctgagcaattgggcatacgaattcgataaatgggcgccaagtgttgtaaaagtttcttacaaaggcagcccagctgccaggcgagccttcgttccacagctcaggtctggtaaatttaacgtgctcctgacaacctatgaatatatcattaaggacaaacatatccttgcaaagattaggtggaaatacatgatcgtggacgagggacacaggatgaagaaccatcattgcaagctgacgcaagttttgaacactcactacgtggccccgcgtcggctgctgcttaccggaactcctctgcagaataagttgccagaactgtgggctttactcaatttcctcctgccaactatcttcaagtcatgctcgacttttgaacagtggttcaacgcacccttcgccatgacaggtgaaaaggtcgacctgaatgaggaggagacaattctaatcatccgacgcctgcacaaggtcctgcggccattcctgctgagaagactcaaaaaagaagtggaagcccaattgcctgagaaggtcgagtatgtcataaagtgtgacatgagcgctttgcagagggtgctgtatcggcatatgcaggctaagggcgtgttgctgacagacgggtcagagaaggataaaaaaggtaagggtggtactaaaaccctaatgaacacaatcatgcagctccggaaaatatgcaatcatccatacatgtttcaacacatcgaggaatccttttccgaacacttgggctttactggagggatcgtccaggggcttgacctctacagagccagcggtaagttcgagttgttagaccggattctccccaagttacgcgccacaaatcacaaagtccttctattttgccagatgaccagtctgatgactataatggaagactactttgcctatagaggcttcaagtacctgaggctggacggtaccaccaaggcagaggatcgcggaatgctattaaaaacatttaacgaacccggcagcgaatactttatctttcttttatccacacgggcaggagggctcggtctcaacttacaatccgctgataccgtgatcatcttcgatagcgactggaacccgcatcaggacctgcaggcgcaggatagggctcaccgtattggccagcagaatgaagtgcgcgttctgaggctttgtacagtgaatagcgtagaggagaagatcctggccgctgccaagtacaagttgaatgtggaccagaaagtgattcaggccggaatgttcgaccagaagtcgtcaagccatgaaaggcgagctttccttcaggccatccttgagcacgaggagcaggatgaggaagaggacgaggttccagacgatgagaccgtgaaccaaatgatcgcacgtcacgaggaggaatttgacttgttcatgcgcatggatctcgataggcggcgagaggaggcccgtaatcccaaaaggaagcctaggctgatggaagaggacgaactgcctagttggatcatcaaggatgacgccgaggtcgagagactcacatgtgaggaagaggaagaaaaaatgttcgggcggggatcacggcatcgcaaagaagtagattacagcgactccctgactgaaaagcagtggcttaaaactttaaaagcaattgaagaaggaaccctcgaagagatagaggaagaggttaggcaaaagaaatcaagccgtaaaaggaaacgcgacagcgatgcaggctccagtactccaaccacttcgacccgaagcagggataaggacgacgagagcaagaagcagaaaaagagaggcagacctcccgctgaaaagctgagcccaaaccctcccaacctgacaaaaaagatgaaaaaaatcgtcgacgcggtaataaaatacaaagatagtagttccggacggcagttatcagaagtgttcattcagttgccaagtcgaaaggagctgcccgaatactatgagctgattcggaagcctgtagactttaagaaaattaaagaaagaatacggaatcataagtatcggtcactgaacgatttagagaaggatgtgatgttactctgtcaaaacgcccagactttcaatctggaaggctctctcatttacgaagattcaatcgtgctccaaagcgtattcacttctgtaagacagaagatagaaaaggaggatgactccgagggagaggaaagcgaagaggaagaggagggcgaggaagaaggatcagagtccgaatcccgctccgtgaaagttaagattaaattagggagaaaagaaaaagcccaggatcgccttaaaggaggtagacggagaccaagcagagggagccgggctaaacccgtggtttctgatgatgactcagaggaagaacaagaagaggaccgcagcgggtctggctccgaagaggattag

SEQ ID NO: 136769 - DNA, 4944 bp, Artificial Sequence
  Description of Artificial Sequence: Synthetic coding sequence
atgtcgacccccgatccccccttgggcgggactcctcggccaggtccgtctcctggccccggtccttcccctggagcaatgttggggccgtcacctggaccctcccctggaagcgcgcattcaatgatggggcccagtcccgggccacctagtgctggccaccctatccccactcagggtccaggcggatatccgcaagacaatatgcaccaaatgcataagccaatggaatccatgcatgagaaagggatgtctgacgatccccgttacaatcagatgaaggggatgggtatgaggtcgggcgggcacgcaggcatggggccacctccgtctcccatggaccagcactctcagggttacccatcccccctaggaggatctgaacatgcctccagtcctgtgccagcttctggacccagcagtgggccacaaatgtctagtggccccggaggagcaccgttggatggtgctgacccacaggctctcgggcagcagaataggggccctacaccttttaatcagaaccagctccaccagctacgcgctcagataatggcctataaaatgctggcaagaggacagcccttgccggatcacctacagatggccgtgcagggcaagagaccaatgcccggcatgcagcagcagatgccaaccctaccaccaccgtctgtctcggcaactggacctggtcccggccccgggccagggcccgggcctggtccaggccccgccccccctaactattctcggccccacggcatgggaggacctaacatgcctccccccggacccagcggcgtgccgccaggtatgcctggacagccaccaggcggcccacccaagccttggcccgagggccctatggctaacgccgccgccccaacgtcaaccccccaaaagttaatccccccacagccaactggaaggccgtctccagcaccacctgctgtcccaccggcagcctctcccgtcatgcctccccagactcaaagccctggtcaacccgctcagccggccccaatggtgcctcttcaccagaaacagagcaggatcacgcctatacagaagcccaggggtttagaccctgttgagatcctgcaggagcgggaatatcgcctgcaggccagaatcgctcacaggattcaggagcttgagaaccttccagggagtttggcgggcgatcttcggacaaaggcgaccatcgaactaaaagctctgagactcttaaatttccagagacagctgcggcaggaagtagtggtttgcatgcgcagggacactgcactggagacggccctgaatgccaaggcctataagcgctctaagagacagagcctccgggaggcccgtattactgagaaattggaaaagcaacagaaaatcgaacaggagcggaaacgtaggcagaaacaccaggagtatctgaacagcattttgcaacatgcaaaagacttcaaggaataccatcgatcggttactggcaaaatccaaaagctgaccaaggccgtggccacctaccatgcgaacactgagcgagagcaaaagaaagagaacgaacgcattgagaaggaacgtatgaggcgtctgatggctgaggacgaagaggggtacaggaagctaatagaccagaaaaaagacaagcgcttggcatacctgcttcagcaaacagacgagtacgttgccaacttaaccgaacttgtccgacagcataaagctgcacaggtcgcgaaagagaaaaaaaagaaaaaaaagaagaagaaggcagagaacgccgagggtcaaacaccagccatcggacctgacggagaaccgctggatgaaacatcacagatgtccgatctgccagtgaaggtcatccacgtcgagtccggtaagatcctgacggggacggatgcccccaaggcaggtcagctcgaggcctggctcgagatgaacccaggttacgaggtcgctccccgcagtgactctgaagaatcaggatccgaggaggaggaagaagaggaagaagaggaacagccacaggcagctcagccgcctacactgcctgtagaagagaaaaagaaaatcccagaccccgacagcgatgatgtgtcggaggtcgatgccaggcacatcattgagaatgctaagcaggacgtggatgatgagtatggcgtgagccaagccctcgcccgaggcctccagagttattacgccgttgcacacgccgtaacagagagggtggataagcaaagcgctctaatggtgaacggggtgctaaagcaataccagattaaaggattggagtggctggtatccctttataacaacaaccttaatggaattttagcggatgagatgggcctagggaagactatacagacaatcgctcttataacttacttaatggagcataaaaggattaatggccctttcctgattatcgttccacttagtacattgagtaattgggcttatgagttcgataagtgggcacccagcgtggtgaaagtcagctacaaagggtcacctgcggcccgacgagccttcgttccccaactgaggtccggcaaatttaatgtgctgctgaccacttacgagtacatcatcaaagataagcacattcttgctaaaatccgatggaagtatatgatcgtggacgagggtcaccgaatgaaaaatcatcactgcaaactcacccaggtgttaaatacacattatgtcgcgcctcggcgattgttgttgaccgggaccccactgcagaacaaacttccagaactgtgggcattactgaactttcttcttcctaccatctttaagtcgtgttctacgttcgaacagtggttcaatgcccctttcgctatgacaggggagaaagtggatctaaacgaggaagagactatcctgatcattagacgcttgcacaaggtgctcagaccgtttcttctccgaaggctgaagaaagaggttgaagcacagctccccgagaaagtagagtacgtgataaagtgcgacatgagtgcactgcaaagggttttgtatagacacatgcaggctaagggcgtgctgctgacggacggtagtgaaaaagacaagaaaggcaaagggggcaccaaaactttgatgaatacaattatgcagctgcgaaaaatctgtaatcacccgtacatgttccagcacattgaagaatctttctctgagcacctcggtttcacaggtggaatagtccagggccttgacctctaccgtgcttcgggcaagttcgagttactggacaggatattgcctaaattgagggccaccaaccacaaagtgctcctcttttgccagatgacgagcctcatgactataatggaagactattttgcatatcgagggtttaagtaccttagattggacggcacgacaaaggcagaagaccggggcatgctcctcaaaacctttaacgagcccgggtctgaatactttatctttttgctgagcacacgcgcaggcgggcttggcttgaaccttcagagcgccgacacagtgattatctttgacagtgactggaacccacatcaagatctccaagctcaggatcgcgcccaccgaatcggacaacagaacgaggtgagagttctgcggttgtgcaccgtaaattccgtcgaagagaaaattctagcagccgctaaatataaactcaacgtcgatcagaaggttatacaggcagggatgttcgaccaaaagtctagtagtcacgagcgacgcgcctttctgcaagcgatattggaacatgaagaacaagatgaaagccgtcactgtagcaccggctcagggagcgctagctttgcccatactgcccctccacctgctggtgtaaatccagatctcgaagaacccccactcaaggaagaggacgaagtgcctgacgatgagactgttaaccaaatgattgcccgtcacgaggaagagtttgacttatttatgcgcatggacctggataggagacgcgaagaggcccgtaaccctaaacggaagccccgcttaatggaagaagacgagctgccttcatggatcattaaagacgacgccgaagtcgaaaggctgacctgcgaggaggaagaggaaaaaatgtttggtagggggagtcggcatcggaaggaagtcgactattccgactcactcacggagaaacaatggctaaaagctatcgaagaagggacactagaggaaatcgaagaggaagtccggcagaagaaatccagccggaagaggaagcgagattccgatgcgggtagctcaacccccaccacaagcacgaggagccgtgacaaggacgacgaatccaagaagcagaaaaagaggggtagacctccagccgagaagctgtccccgaaccccccaaacttaactaaaaaaatgaagaaaatcgttgacgccgttataaaatataaggattcatccagcggtagacagctgagcgaggtttttattcagctgccctcgcgcaaggaattgcctgagtactacgaattgatacggaaacctgtggatttcaagaagataaaggagcgcataagaaaccataaatatcgctctctcaacgacctggaaaaagatgtgatgttgctttgccagaatgcgcaaacttttaacctcgagggctctctcatttacgaagacagcatcgttctccagtccgttttcactagcgtgcggcaaaagattgaaaaagaggatgactccgaaggagaggagtcagaggaggaagaagagggggaggaggaaggtagcgaatctgagtccagatcggtaaaagtaaaaatcaaattgggaaggaaagaaaaggcccaggaccggctcaagggcgggaggcgccgacctagccgcggctctagagcaaagccagtagtctcagacgatgattcagaagaagagcaggaagaggatagaagcgggtccggtagcgaagaagactag

SEQ ID NO: 136770 - DNA, 4842 bp, Artificial Sequence
  Description of Artificial Sequence: Synthetic coding sequence
atgtcgacccctgatcccccactgggagggaccccgaggcccggaccctctccaggccccggaccttcgcccggcgctatgctgggaccgtcccccggaccatcgcctggatctgcgcactctatgatggggccaagccccggacctccgagtgccggtcaccctatccccactcaagggcctggcggctacccccaggataatatgcaccagatgcacaagcctatggaatctatgcacgagaaaggtatgagtgatgaccctcgatacaaccagatgaaggggatgggcatgaggagcggtggacatgcaggtatgggtcctccgccctctcccatggaccagcacagtcaagggtatccctcacccctcggtgggagtgagcatgcgagctcccctgtgccagcctcaggccccagcagcggcccacagatgtctagcggtccaggaggcgccccgcttgatggagctgatccccaggcactaggccaacagaaccgaggacccacccctttcaatcagaaccaactgcaccagctccgagcacagattatggcctataagatgctggcgaggggacagccactgccggatcatctacagatggccgtgcagggcaagcggcccatgcctggcatgcagcagcagatgcccaccttgccgcctccaagcgtgtccgcgaccggacccggtcctggcccaggacccgggcctggaccgggacccggtccagccccgccgaattactctagaccccatgggatgggtggccctaacatgccgccgcctggcccatccggagtgcctccagggatgcctggccagccccccggcggaccccctaagccctggccagagggaccaatggcaaatgcagcagcccccacatcgaccccacaaaagctcatcccaccccagccgacgggaaggccctcacccgccccgccagcagttccacccgccgcatcccccgtcatgcctcctcagacacagtccccgggacaaccagcacaacccgctcctatggtccctctccatcagaaacagtcaagaattacacccattcagaagccaagagggctcgatcctgtggagatcttacaagaacgagaataccgccttcaggccagaatcgcccacaggatccaagaattagagaacttgcctggctcactggcaggcgatctccgaacaaaggcaacaatcgaacttaaggccctgcgacttctgaatttccagcgacaactgcgacaggaggttgtcgtttgcatgcgcagagacaccgccctcgagacagcattaaacgccaaagcctataagcggtccaaacggcagtctctccgtgaggcgagaattacagagaaactagagaagcagcagaaaatagagcaagagagaaaaaggcgccagaagcaccaggaataccttaattcaatcctccagcatgcaaaggacttcaaggaatatcataggtccgtgactggaaagattcagaagctgactaaagcagttgcaacctaccatgccaataccgagagggagcagaagaaagagaatgaacggattgagaaggagcgaatgcggcgcctcatggccgaggacgaagaaggatatcgtaagcttatcgatcagaagaaggacaagagactggcttacttactacagcagacagatgagtacgtggccaatctgacagagcttgtgcgccagcataaagccgcgcaggttgcaaaggagaaaaagaaaaaaaagaagaaaaaaaaggctgagaacgctgagggtcagacgcctgctatcgggccagatggggagcctctcgatgagacatcgcagatgtcagacctccccgttaaagtgatccacgttgagagcgggaagatcctcacagggactgatgcgcccaaggcgggccaactggaagcctggctggagatgaacccagggtatgaagtagctcccaggtccgactccgaagagagcggatcagaggaagaggaggaggaagaggaagaagaacagcctcaagcggcccagcctccgacactgcctgtcgaggagaaaaaaaagattcccgatcctgactcagatgatgtgagcgaagtagatgcccgccatattatcgagaacgcgaagcaggacgtggatgacgaatacggagtgtcacaggcgctcgcccgaggcctgcagtcctattatgccgtggctcacgcagtgacagagcgagtagataaacagtcggcactgatggtgaatggagtgctgaaacagtaccagattaagggcctcgagtggctggtaagcttatacaataacaatctgaacggcatcctggcggacgagatgggattggggaagacaatccagacaatcgccctgataacatatttaatggagcacaagaggatcaatggcccctttctcatcatcgtgcccttaagcacactatctaactgggcatacgagttcgataagtgggcaccctccgtggtaaaggtgtcatataagggatcacctgcagcacgacgtgctttcgtccctcaactgcggtccggtaagttcaacgtgcttcttactacctatgaatacatcataaaggacaagcacatcctcgcaaagattcgttggaagtacatgatcgtggatgaaggacatcgaatgaaaaatcatcattgtaagctgacccaggtgctcaatacccactacgtagcaccacgccggctgttgctgaccgggactcctctgcagaataagctccccgaattgtgggccttgctgaatttcttactacctacaatcttcaaatcctgtagtaccttcgaacagtggtttaatgctccgtttgctatgacaggggaaaaggtagacctgaacgaagaggagacaatcctaatcattagaagactccataaggtgctgcgcccctttctgcttcggcggcttaagaaagaggttgaggcccaattgcccgaaaaagtcgagtatgtcatcaaatgcgacatgtccgcactgcaacgagtgctttatcggcacatgcaagctaagggcgtactgttaaccgacggctcggaaaaggataaaaaggggaagggcggcacaaagactctcatgaacacaattatgcagctaagaaagatatgtaaccatccctacatgtttcagcatattgaggaatccttcagtgagcatttaggttttaccggcggcatagtgcagggcctcgatttgtatcgggcgtcaggtaaatttgaactcctggatagaatcctccctaagttgcgggctacaaatcacaaagtcttgttattctgtcaaatgacctcccttatgactatcatggaggattattttgcctaccgaggcttcaagtatttacggctcgatgggaccaccaaagctgaagacaggggcatgctcctaaagactttcaacgagcccgggtccgagtattttattttcctactttcgacacgagcaggcgggctgggcctcaatcttcagtctgccgacacagtgatcatattcgactctgactggaacccacaccaggacctgcaggcacaagatcgcgcacacagaatcgggcagcagaacgaagtgcgcgtcttgaggctttgtacagttaactctgtggaggaaaagattctggcagcggctaaatataaattgaatgttgatcagaaggtgattcaagcaggtatgtttgaccagaaatccagctcccacgagcgacgcgctttcctgcaagcaattctggaacacgaggagcaagacgaggaagaggacgaggtaccagacgatgagacggtcaatcagatgattgctagacacgaggaagaatttgacttgttcatgagaatggatctggatcgaaggcgcgaagaggcaagaaaccccaagagaaagccccgcttaatggaagaggacgaacttcctagttggattatcaaggacgacgccgaagtggagcggttaacctgtgaggaggaggaggagaagatgttcggcagaggctcaaggcacagaaaagaagtagactattctgactctctgacagagaaacagtggctcaaagctatcgaggagggaacgctcgaagaaatagaagaggaagtgcgccagaagaaatcatcccgcaaacgtaagagagactccgatgctggatcctcaacgcccacaacttccacgagatccagggataaggacgacgaaagcaagaagcagaagaagcgcggtaggccccccgcagagaaactcagccctaaccctccgaacctcaccaaaaaaatgaaaaagattgttgatgcagtgatcaagtacaaagatagttctggccgtcagctgtctgaggtgtttatacagctcccgtcccggaaggagctgccagaatattacgagttgatccggaagccagtagacttcaagaaaattaaggagcgcatccgaaatcacaaataccgtagcctcaatgatctagagaaagatgtgatgttactgtgtcagaacgctcagacctttaacctggaaggctcattgatctatgaagattcaatcgtgctccagtccgtttttaccagcgtccgacaaaaaatcgagaaagaggatgatagcgaaggcgaggaatccgaagaagaggaagaaggcgaggaggaaggctccgagtcagagtcccgttctgttaaagtcaaaatcaagctaggcagaaaggaaaaggcccaggaccgacttaaagggggccgcaggcgtcccagccgcgggtcacgggcaaagcccgtagtatccgacgacgatagtgaggaggagcaggaggaggacaggtcgggaagcggttcggaggaggactag

SEQ ID NO: 136771 - DNA, 4851 bp, Artificial Sequence
  Description of Artificial Sequence: Synthetic coding sequence
atgagtactcctgacccaccgctgggagggacgcctagacctggcccaagcccaggacccgggccctctcccggagctatgcttgggcccagcccgggtccctcccccggttccgcccatagtatgatgggaccatcccccggcccacccagcgcaggccacccgatccctacacaaggacccgggggctatccccaggacaacatgcaccaaatgcataaacccatggaatcgatgcatgaaaagggcatgtccgatgaccctagatacaatcagatgaaaggtatggggatgcggtccggtggtcatgctggtatgggcccccctccctctcccatggatcaacactcacaaggctatccctcccccctgggcggtagcgaacacgcgagttccccggtgccagcgagtggaccttcctctggcccacaaatgtctagcggcccagggggagccccactagatggagccgatccacaggcgctcggacagcagaatagggggccaaccccgttcaaccagaaccaactacatcagctgagagcccaaataatggcatacaagatgctggcacgcggtcagccattacctgaccacttacagatggccgtccagggtaaacggcctatgcccggaatgcagcagcaaatgccgacgttacccccacctagtgtcagcgctacaggcccgggtcctggaccaggtccagggccgggccctggcccgggacctgcgccacccaactacagtcgcccccacggaatgggaggccctaatatgccaccgcccggcccaagtggggttccacccggcatgccaggacagccgcccggcggcccccccaaaccttggcccgagggacctatggccaacgctgcagcaccaactagcacaccacagaaactgatcccccctcagccaactggacgtcccagtcctgctccacctgccgtccctccagctgcttctcccgtaatgcctcctcagactcagagcccaggccagccagcacagcctgccccaatggtaccacttcatcagaagcaatccagaatcactcccatacaaaagccaagaggcctggatccggtcgagatccttcaggaaagggagtacaggctgcaggcaagaatcgcacatcggatacaggagctcgagaatctccccggatctctcgccggcgatctcagaaccaaagccacgattgagctgaaagccctacggctcttgaattttcaacggcagctcagacaagaagtggtggtatgcatgcgcagggacaccgcgctcgaaacagcccttaatgcaaaagcttataagagatccaagagacagtctctgcgggaggcacgcatcacagagaaactggagaagcagcagaaaatagagcaagagcggaaaaggagacagaaacaccaggaatatctgaactcaatattgcagcacgcaaaggacttcaaggagtatcaccgatccgtgacaggcaagattcagaagctgacgaaggccgttgccacatatcatgccaacacggaacgggaacagaagaaggagaatgaacggattgaaaaagagagaatgaggcggctcatggccgaggacgaagagggctaccggaaactcattgaccagaaaaaggataaaagactggcctatcttctgcagcagacagacgaatacgttgcaaacctcaccgaactggtcaggcagcacaaagccgcccaagttgctaaggaaaagaaaaagaagaagaagaagaagaaagcagagaacgcagaggggcaaacaccggccataggcccggatggggaacccttggatgagaccagccagatgagcgatctccctgttaaggttatacacgtggagtcggggaaaattctgaccggaacagacgccccaaaagccggacagttggaagcttggcttgagatgaatccaggctatgaggtcgcccctcgcagcgactctgaggagagcggatccgaagaagaggaagaggaagaggaagaggagcagccacaggctgcacagccacccaccctacctgtcgaagagaaaaaaaagatccccgaccctgattctgacgatgtgagcgaggtcgacgctagacatatcatagaaaatgctaaacaggatgtggacgacgagtacggagtgtcgcaagctctggctcgcggcctgcagtcatattatgcggtggcacatgctgtcactgagcgggtagataagcagagtgccctgatggtgaacggagtcctgaaacagtaccagattaagggcctggagtggctggtgagcctctacaataacaacttgaatggcattttggctgacgagatgggcctaggaaaaacaatccagaccatcgcactgatcacctatcttatggagcataagcgaataaacgggccctttttgatcattgtccccctgtccactctatccaattgggcctatgagttcgataaatgggccccttctgttgtgaaagtgtcttacaaagggagtccggccgctaggcgcgcttttgtgccacagctgcggagcgggaaatttaatgtgcttttgacaacctatgagtatatcatcaaagataaacacattctcgcaaagatccgctggaagtatatgattgtggatgagggccatcgaatgaagaatcatcattgtaagctgacacaggtgttgaatacccattacgtcgcgcctagacgcctgctcctcacaggcacaccacttcagaacaaattgccagaactttgggccctcctcaattttctgctgcccaccattttcaaatcttgctccactttcgagcagtggtttaacgctcctttcgctatgactggcgagaaagtagaccttaatgaggaagagactattctcatcatccggaggctccataaggtactccgaccgttcctgttgcgtaggctcaagaaagaggtggaagcacagctcccagagaaggtggagtatgtgattaagtgtgatatgtctgccctacagagagtcctgtaccgtcatatgcaagccaaaggtgtcctgctgacagacggctctgaaaaggacaaaaagggcaaaggcggaacaaaaaccttaatgaacactattatgcagctgcgcaagatctgcaaccacccctacatgttccaacatatagaggagagtttcagcgagcatttagggtttaccggtggcattgtgcagggcctcgacttgtatagggccagtgggaagttcgaactgctggatcgcattctgcccaagcttcgcgcgaccaaccataaggtgcttttgttctgccaaatgaccagcctaatgacgattatggaagactactttgcttaccgcggatttaagtatttaaggctggacgggacaaccaaggcggaggataggggcatgctgctaaaaacattcaacgagccggggagcgaatactttatctttttgctgagcaccagagctggaggtctgggtctgaatttgcagtcagctgataccgtaatcatatttgactctgactggaacccacaccaggatttgcaggctcaggacagagcccaccgtattggccagcagaacgaagtccgggttttgcgactgtgcactgtcaatagcgtggaagaaaagatcctcgccgctgcgaaatataagctgaacgtggaccaaaaagttatccaggccggcatgttcgaccagaagagttcgagccatgagagacgtgcctttctgcaggccattctcgaacatgaagagcaggatgaggaggaagacgaagtgcctgatgatgagacagtcaaccagatgattgcacgccatgaggaggaatttgatctgttcatgaggatggatctggaccgcagaagagaagaagcccgcaatccaaagagaaaacccagactgatggaagaggatgaacttccatcttggattatcaaagacgacgctgaagtggagcgcctcacttgtgaggaggaagaggagaaaatgttcgggagagggagccgacaccgcaaggaagtggactacagcgacagtttgaccgagaagcagtggctcaagacactaaaagcaatagaggagggcacacttgaagaaatcgaggaggaggtgaggcagaaaaaaagttcacgtaagcgtaagcgggacagtgatgctggcagtagcacgccaaccacctccacaaggagtagggataaagatgatgaaagtaaaaagcaaaagaagcgcgggcggcccccagcggaaaaactgtctccgaatccgccgaacctgaccaagaaaatgaaaaagattgtggatgccgtcatcaaatacaaggacagcagtggccgccaactcagcgaagtgttcatccagctcccaagtcgaaaggagctgcctgaatattacgaactcatcaggaaacctgtcgattttaagaaaatcaaggagcggattaggaaccataagtataggagccttaatgaccttgaaaaggacgtcatgctgttatgccagaacgcacaaacctttaacctcgaagggagcctgatctacgaagactccattgtgcttcagtctgtgttcacgagtgtcaggcagaagatcgaaaaagaggacgacagtgaaggcgaggaaagcgaggaggaggaggaaggggaagaagagggcagcgagagtgaatctcggtccgtgaaagtgaagataaaactgggtaggaaggaaaaggcccaggacagactcaagggaggacgtcgccgacctagcaggggctctagagcaaaacctgtggttagcgacgatgactccgaggaggaacaggaagaggatcggtcaggatccggttctgaagaggattag

SEQ ID NO: 136772 - DNA, 4845 bp, Artificial Sequence
  Description of Artificial Sequence: Synthetic coding sequence
atgagtacacctgaccctcccctcggaggaacaccgcggccgggcccttcccctggccctggaccaagcccgggggctatgctcgggccatcacccggaccatcccctgggtctgcacactctatgatgggtccttcgcctggacccccttcggctggacacccaatcccaacacaggggcctgggggctaccctcaggacaacatgcatcaaatgcacaagccaatggagagcatgcacgagaagggcatgtcagatgatccccgctacaatcagatgaagggaatgggcatgcgaagcggtggccacgccgggatgggacctcctccatctcccatggatcagcatagccagggatatccttctccattgggggggtctgagcatgcaagctcgcccgtacccgcttcaggcccatcctcaggcccacagatgtctagtggtcccgggggcgccccccttgatggtgcggatccccaggcactgggacaacagaataggggccccaccccttttaaccagaaccagctacatcagcttcgggctcagatcatggcgtataagatgcttgcaaggggacagccccttcccgatcacctacagatggcagttcagggcaaacgtccaatgcccggaatgcaacaacagatgcccacactccctcctccaagcgtctctgccacaggccccggacctggaccaggccctggaccaggccctggccctggtccagccccccccaattattcccgcccccacggcatgggcggccccaacatgcccccacctggtcctagcggggtgcctcccggtatgcccgggcaaccaccaggcgggccccccaaaccatggcctgaaggacctatggccaatgcagctgcacccaccagcaccccccaaaaacttattccaccacagcccaccgggcggccgagtcctgctccccctgccgttccacctgctgcctctcctgtcatgcctccccagacccagtctcctggccagccagcgcagcccgcaccaatggtgccattgcatcaaaaacagagcaggattaccccaatacagaaaccccgaggcctcgacccagttgagatcctgcaagaaagggaatacagacttcaggcaaggattgctcaccgaattcaggaactggagaacctccccggaagcctagccggcgacttacgaaccaaagcaacaatagagctgaaagcattgagactgctcaatttccagaggcaactgcggcaggaggttgtggtctgcatgcggagggatacagctctcgaaactgccttgaacgcaaaggcatataaaagaagcaagcggcagagcctcagagaagccaggatcaccgagaagttagagaaacagcagaaaattgagcaggagcgcaagagacggcagaaacatcaggaatatttaaattccattctgcagcacgccaaggactttaaagaataccatagaagcgtcacagggaagattcaaaaattgacgaaagccgtggccacctaccacgccaatacagaacgggagcaaaagaaggaaaacgaaaggatcgagaaagagaggatgcggcgcctgatggccgaagacgaggaagggtacaggaagctcattgaccaaaagaaggataagagattagcctacttgctgcagcagaccgatgaatacgtcgccaacctgaccgaactagtgagacagcacaaagctgcccaagtggctaaggagaaaaaaaagaaaaaaaagaagaagaaggccgaaaacgcggagggccagactccagcaatcggaccagacggcgagcctctcgatgaaacgtctcaaatgtcggatttgcctgtgaaagtcatacatgtggagtccggaaagatattgaccggaaccgatgccccaaaagcgggccaactagaggcctggttggagatgaaccccggctatgaagtcgcgccacggtcagattctgaagagtcaggttcagaggaggaggaggaggaagaggaggaagaacaacctcaggccgcccaaccccccacactgcccgtagaggaaaaaaagaaaattccagaccctgacagcgacgatgtttccgaagtcgacgcccgacatatcattgaaaacgcgaaacaagacgtcgacgatgaatacggggtctctcaggccctcgctagagggctacagtcttattatgccgttgcccacgccgtcaccgagcgcgtcgataagcagagtgctttaatggtgaacggggttttgaagcagtaccagataaaaggtctcgagtggttagtgtcactctacaataacaatcttaacggcatcctggcggatgaaatgggcctcggtaagactattcagaccatcgccctgatcacctatctgatggagcataaaaggatcaatggcccctttctgataattgtcccactttcaacactgtccaactgggcatatgagttcgacaaatgggccccaagcgtggttaaggtgagctacaaaggctctccagccgcccgaagggccttcgtcccccagttacggtctggcaaattcaacgtccttttgaccacctatgagtacattatcaaagataaacacattcttgccaaaattcggtggaagtacatgatcgtggacgagggacaccgcatgaagaatcatcattgcaaactgacacaggtccttaatacccactacgtcgcccctcgcagattgctgcttacaggcactcctcttcaaaacaaattgcccgaactctgggccctcctcaattttctgctgcccactatcttcaagtcttgctcaaccttcgagcagtggtttaacgcccccttcgcaatgaccggtgagaaggtcgacctgaatgaagaagaaaccattctgataataaggagactgcacaaagtgttgagaccttttttactgaggagattaaagaaagaagtggaagcccagcttcccgagaaagtcgagtacgttatcaagtgtgatatgtccgccttacaaagggtcctctaccgacacatgcaggccaagggagttctgctgaccgacggttcagaaaaagacaagaagggcaagggtggaaccaagaccctgatgaatactataatgcagctgcggaagatttgcaaccatccatatatgtttcagcatatagaggaatcctttagtgaacacttagggttcactggtggtatcgttcagggcctggatctttatcgtgcttccgggaaattcgagctcctagatcggatcctccccaaacttcgtgccaccaaccataaagtgctgctgttctgtcaaatgacttctttgatgactattatggaggattatttcgcctacagggggtttaaatacctacgcctggatggaacaaccaaagccgaggatcggggtatgctgttgaaaacatttaacgagcccgggtctgaatacttcatattcttgttaagcaccagggccggaggactgggtctgaaccttcagagcgccgatacagtcatcatcttcgattcagactggaatccacatcaggacctccaagcccaagaccgagcccataggattggtcaacagaatgaagttcgagttctcaggctgtgcactgtgaacagcgtagaggagaagatcctggccgccgcgaagtacaagttaaatgtggaccagaaagtgatacaggcaggaatgttcgatcagaagtcttcttcccacgagcgccgcgcatttctccaggccatactcgaacacgaagagcaggatgaagaggaagatgaagtacctgacgacgagaccgttaatcaaatgatcgcaagacacgaagaagaattcgatctcttcatgcggatggatctggaccggaggagggaagaggcacggaatccaaagcggaagcccagattaatggaggaggacgagctcccttcttggatcattaaggatgacgccgaggtggaaaggctgacctgtgaagaagaggaagagaagatgtttgggagaggtagtcggcaccgcaaagaggttgactactccgacagcttgacggaaaagcagtggcttaaggccattgaggagggaacactcgaggaaatcgaggaggaggtgcggcagaaaaaatcttccaggaaaagaaagagagacagtgacgccgggtccagcacccctactacaagcacacgctccagagataaagatgatgagtccaagaagcagaaaaaacgtggccgtcctcccgccgagaaactctcacctaatccgcctaaccttaccaagaagatgaagaagattgttgacgcagtgatcaagtataaggattcatcctccgggaggcagctgtcagaagtattcatccagctgcccagtaggaaggagctgccagaatattatgagctaattcggaagcctgtcgacttcaagaaaattaaagagcgaatacgcaaccataaatatagatctttgaatgatctggaaaaggatgtgatgctgctatgccaaaatgcacagacattcaacctcgaaggctctcttatatatgaagactcaatagtgcttcagtcggtcttcactagcgttcggcagaaaatcgaaaaagaggacgatagtgaaggggaggagtcagaggaggaggaggagggcgaggaagagggctctgagtcagaatccaggtcggtgaaagtcaaaattaaattgggacgaaaagagaaagctcaggaccggctgaagggcgggaggaggcgacctagcagaggtagccgcgctaagcccgtggtgtccgatgatgattctgaggaggagcaggaagaggaccggagtggctccggcagtgaggaagactag

SEQ ID NO: 136773 - DNA, 3159 bp, Artificial Sequence
  Description of Artificial Sequence: Synthetic coding sequence
atgagctccgccgctgaacctcccccgccacctccccctgagagtgccccctccaaaccagcagcctcaatcgcctctggagggagcaattcatctaacaaggggggaccggaaggcgtggctgcccaagctgtagccagtgcagcaagtgctgggcccgcggatgccgagatggaggaaatcttcgatgacgctagtcctggaaagcagaaggaaatccaagaacctgaccccacatacgaggaaaagatgcagacggatcgcgctaatcggttcgagtatcttcttaagcaaaccgagctgtttgcgcacttcatccaacccgccgcccaaaagacccccacgtccccactcaaaatgaagcccggaagaccacgaatcaaaaaggatgaaaagcagaatcttctttcagttggagattaccgccaccgacggaccgaacaagaagaggatgaagagcttctcacggaatccagcaaagcaacaaacgtatgcaccaggttcgaggatagtcccagttacgtaaagtggggcaagctgcgtgactaccaggtgaggggactgaactggctgatttccctgtacgaaaacggtataaacgggattctagcggatgaaatgggcctggggaaaaccctacagactatttccctgttgggatacatgaaacactataggaacatcccaggtccacatatggttctggttcccaagagcactcttcacaactggatgtccgagttcaaaagatgggttcctactctcaggtctgtttgtctgatcggtgacaaggaacagagagctgccttcgtgcgggacgtgctgttgcctggggagtgggatgtttgcgtgaccagctacgagatgctgattaaagaaaagtccgtgtttaaaaagttcaattggaggtaccttgtaatcgacgaagctcaccggattaagaatgagaagtctaaacttagtgagattgttagagaattcaagaccactaataggctcctcctcaccgggacacccttacagaataatttacatgaattgtggagtctgctgaacttcctcttacccgatgtttttaactctgcggacgacttcgacagctggttcgacaccaacaattgtctcggggatcagaagttagtagagaggctgcatatggtgctcaggccattcttactcagacgaattaaggccgatgtagagaagtccctgccaccaaagaaggaagttaagatctatgtcggcctttctaagatgcagagagagtggtatacacgaattctaatgaaagacattgacatcttgaatagcgccggcaagatggataaaatgcgacttctgaatattctgatgcaattgagaaagtgttgcaatcatccttacttatttgacggagctgagccaggaccaccttacaccacagatatgcacctggtgaccaatagtgggaaaatggtcgttttagacaaactgttgcccaagctaaaggaacagggcagtcgagtgctaattttctcacaaatgactcgggtcctcgacattctcgaagactactgtatgtggaggaactacgaatattgcaggcttgacggacaaactccgcacgacgaacggcaggattcaattaatgcatacaatgaacctaatagtactaaattcgtcttcatgctgtccactagagccgggggacttggcattaacctggctacagcagacgtcgtcatcttatatgatagcgactggaatccgcaggtggatctgcaagctatggatagagcgcaccggattggccagacaaagactgtccgggtctttaggtttattaccgataacaccgtggaagaacgcatcgtcgaacgcgccgagatgaaactccgcctggactctatagtgatccagcagggccgactggtggatcaaaacctgaacaaaataggaaaagacgagatgctccaaatgatacgccacggagctacccatgtgttcgctagcaaggagtcagagatcacagacgaagacattgacggtatcttagaacgaggggcaaaaaagacagctgagatgaacgagaaattgagcaaaatgggagaatcatcactgagaaacttcaccatggacacagaatctagtgtatacaactttgaaggcgaagactaccgagaaaaacagaagatagcgttcaccgagtggatagaacctccaaagagagagagaaaagctaattacgccgtcgacgcatatttcagggaggcactccgggtttcggaaccgaaagcccctaaggctccacgcccccccaaacagcctaacgtgcaggattttcagttttttcctccccggctctttgagttacttgagaaagaaattctgttctacagaaagaccatcggctataaggtgcccaggaaccccgagctccccaacgccgcacaggcccagaaagaagaacaacttaaaattgatgaggcggagtccttgaacgatgaggagttagaggagaaggaaaagctgctgacacaagggttcaccaactggaataagcgggatttcaatcagttcatcaaagcaaacgaaaaatggggccgcgacgatattgagaacatcgctcgcgaagtggaaggcaaaacccccgaggaagtgatcgaatacagtgctgtgttctgggaacggtgcaatgaactccaggacatagaaaagatcatggcccagatcgagagaggtgaggctaggatccaacgccgaatttccatcaagaaggcactggacaccaagattggtcgatacaaggcgccatttcaccagctgagaatatcatacgggactaacaaaggcaaaaactatacggaagaagaagaccgcttcctgatctgcatgctgcacaaactcggtttcgataaggagaatgtgtatgatgaactgagacagtgcatacggaactctccgcagttccggttcgactggtttctcaagagtcggacagctatggagctgcaaaggcggtgcaacacattaataaccctgatcgagagggagaatatggagctggaagagaaggagaaagccgagaagaagaaacgcggtcctaaaccaagcactcagaaacgaaagatggatggggctccggacggtaggggccggaaaaaaaagttaaaactttag

SEQ ID NO: 136774 - DNA, 2988 bp, Artificial Sequence
  Description of Artificial Sequence: Synthetic coding sequence
atggaggaaattttcgatgacgcatctccgggtaaacagaaggaaattcaagaaccggaccccacatatgaggagaaaatgcagaccgaccgggccaacaggtttgaatatttgctaaagcagacggaactcttcgcccactttatccaacccgccgcacagaaaacccccacatctccattgaagatgaagccaggccgtcctagaatcaaaaaggacgaaaaacaaaatctacttagtgtgggagattatagacatcgacgaaccgagcaggaagaggacgaggaactgcttacagagtccagtaaggcaaccaatgtctgcactcgctttgaggattctcccagctatgtgaagtgggggaagctacgtgactaccaagtccgggggctgaattggctaataagtctttacgagaatggtataaacgggatcctggccgatgaaatgggcttgggaaaaactcttcagacaatctcgctcctgggctatatgaagcactaccgcaatatccccggcccgcacatggtcttggtgcctaaatcgaccctgcataactggatgagcgagtttaaacgttgggttccaactctcaggagcgtatgtcttatcggggacaaagagcagcgggcagcttttgtaagggatgttctcctgcccggcgaatgggacgtttgtgtgacatcatacgaaatgctgatcaaggagaaatccgtctttaagaagtttaattggagatacctggtgatcgatgaagcccaccggattaagaatgagaagagcaagctgtccgagatcgtacgggagttcaagacgaccaaccggctgctcctgaccggcaccccactgcagaacaacctgcacgaactttggtccttgctgaactttctcctgcccgacgtctttaattcagcagatgactttgattcatggttcgacacaaacaattgcctgggagatcagaagctcgtcgagcggctgcatatggtgttgagaccgttcctcctgaggagaatcaaagccgatgtggagaagtcactaccaccaaaaaaggaggtaaagatctacgttggtctgtctaaaatgcagagggaatggtacactcggattctcatgaaagacatcgatatcctcaacagcgccgggaaaatggacaagatgcgcctcctgaacatcttgatgcagttgaggaagtgttgcaaccatccctatctgtttgacggcgcagagccaggccctccctacacaactgacatgcacctcgttaccaattctggcaaaatggtggtgctggataaactgttacccaagttgaaggagcagggatcacgtgtcttaatttttagccagatgactagagtgctggacatcctggaagactactgtatgtggagaaattacgagtactgccgacttgacggtcaaacgccccacgatgagcgccaggactccattaatgcctacaacgaaccaaattctacgaaatttgtgtttatgttgagcactcgggccggcggcctgggcatcaacctggctacagctgacgtcgtcattctgtacgattccgactggaacccccaagtggacctacaagcaatggaccgcgcgcatcggattgggcagactaaaaccgttcgggtgtttaggtttatcactgacaataccgttgaggagcgaatagttgagagagcagagatgaaacttcggctggactcaatagtgatccaacaaggtaggctggtggatcagaatttaaataagattggcaaagatgagatgttgcagatgattagacacggggctactcatgtgtttgcaagcaaggagtccgagataactgatgaggatattgatggcattttggagaggggagctaaaaaaacagcagagatgaacgagaaactgagcaagatgggcgagagctcccttaggaatttcaccatggataccgagtccagtgtttataacttcgagggtgaagattacagggagaagcagaaaattgcttttaccgagtggatcgagccccccaaaagagagagaaaggcaaactacgcagttgacgcctactttagagaggcattaagggtctcggaaccaaaagcgccaaaagcgccccggcctccaaaacaacctaatgtccaggacttccagttcttccctccccgattgtttgaactcctggagaaagagatacttttttaccggaagaccatagggtataaggtacctcgcaatcccgaactgccaaatgctgcccaggcccagaaggaagaacagctcaagatcgatgaagctgaatccttgaatgatgaggagctcgaggagaaagaaaaattgcttacgcaaggttttactaattggaataagagggatttcaatcagttcattaaggccaacgagaaatggggcagagacgatattgagaatatcgctcgggaagtcgagggcaaaacacccgaggaggtgattgagtactccgccgtcttctgggaaagatgtaacgagttacaagacatcgaaaagattatggctcagatcgagcgcggagaggctcggatccagcggcgaatctctataaaaaaggcgttggacactaaaattggaaggtataaagctccttttcaccaattgcggatcagttatggcacaaacaaaggtaagaattacaccgaagaggaggatagattcctgatatgcatgctgcacaaattgggctttgataaagagaatgtttatgatgagctcagacagtgtatcagaaacagccctcaatttagattcgactggttcctcaaatcacggaccgccatggagctccagagacgctgcaatacattgataacactaatagagcgcgagaacatggaactggaggaaaaggagaaggcagagaagaagaaaagaggtccaaagccgtcaactcagaaaaggaagatggacggtgcccccgacgggcgtggacggaaaaagaaacttaagctgtag

SEQ ID NO: 136775 - DNA, 2988 bp, Artificial Sequence
  Description of Artificial Sequence: Synthetic coding sequence
atggaagagattttcgacgatgcaagccccgggaagcagaaagagattcaggaaccggacccaacttatgaggagaagatgcagactgacagagccaaccgcttcgagtatctgctgaaacagacagagttattcgcccacttcattcagcctgcagctcagaagactcctacctcgcccctcaagatgaagcctgggagacctcgtatcaaaaaagatgagaagcaaaacctgcttagtgtcggggactataggcaccggcgaactgagcaggaagaagatgaggaactgcttaccgaatcctctaaggccaccaacgtgtgcacaaggttcgaggactctccctcatacgttaagtgggggaagctacgagactatcaggtacgtggcctcaattggctgatctcactctatgagaacggcatcaatggcatcctggctgatgaaatgggattaggcaaaacgttgcagaccatctcattactgggatacatgaagcactaccgcaacattcccgggccccacatggtcttggtccctaagtcaactctgcacaactggatgtctgaatttaagcgctgggtgccgaccctgaggtcggtctgtctcatcggggacaaggagcaacgcgccgcttttgttagagacgtgctgctcccaggcgaatgggacgtgtgcgttactagttacgagatgctcataaaggagaagtctgtctttaaaaaattcaactggagatatcttgtcatcgacgaggcacaccggattaagaatgagaaatctaagttgtcggaaatcgttcgtgagttcaagacaacaaatcggctgctgctgacaggaacccccctgcagaacaatcttcatgaactgtggtcgctactcaatttcctcctccctgatgtattcaactcggccgatgatttcgactcctggtttgacaccaacaactgtctcggcgaccagaaactggtcgagcgcctgcacatggttctgcgtcctttcctgcttcgacggattaaagccgatgtcgagaaatccctccctcctaaaaaagaggttaagatttatgtaggcctatctaaaatgcagcgtgagtggtacacccggatcctaatgaaggatatcgatattctcaactcggccggcaaaatggacaagatgcgactcctcaatatcctcatgcaactcagaaagtgttgcaatcacccttatttgtttgacggggctgaacccggaccaccttacactacagatatgcacctggttacgaactccgggaagatggtggttctggacaagctgctccctaagttaaaggagcagggctcaagggtcctaatctttagccaaatgaccagggttctggacatcctggaagactattgtatgtggcgaaactatgaatactgccggcttgatggacagacaccacacgacgaaaggcaggatagcattaacgcatacaatgagccgaactcaactaagttcgtgtttatgctgagcacccgggcggggggacttggcatcaatctggctacagctgatgtcgtgattctctatgactctgattggaaccctcaagtggacctgcaggccatggatagggcacatcgtattgggcagacaaagacagtccgggtttttcgatttataactgacaataccgtggaagagagaattgtggagcgcgcagaaatgaaactgagattggactccattgtaatccaacagggcagactggttgatcagaatcttaataaaataggaaaggacgagatgctccagatgattcgtcacggtgctacccatgtgttcgcctctaaagagtccgagattactgacgaggacattgacggtattcttgagcgaggggcaaagaagaccgcggagatgaatgagaagctgagtaaaatgggcgaaagctctctgcgcaactttacaatggacactgagtctagcgtgtataactttgagggggaggactaccgggagaagcagaagatagctttcactgagtggattgagcccccaaaacgggaacgaaaggccaactacgcagtcgacgcctattttagagaggccctgagggtaagcgagccaaaggcgcccaaggctccacgaccccccaagcaaccaaatgtccaagactttcagttcttcccaccaagactgttcgaactactggagaaggagatattgttctaccggaaaaccatcggatacaaagtgccgcgaaacccagagctgcctaacgccgctcaggcacaaaaggaggagcagcttaaaatcgatgaggctgaaagcctgaacgacgaagagctggaggaaaaggagaagttgttgacccaaggctttacaaattggaataaaagggacttcaaccaatttatcaaagccaatgaaaagtggggtcgtgacgatatcgagaacatagcacgggaggtggaagggaaaactcccgaagaggtgatagagtactcagcggtgttctgggaacgatgcaacgagttacaggatatagaaaagataatggcccaaatagaacggggtgaagctcgaatacagcgtcgaatatctatcaagaaggcgttggacacgaagatcggacggtataaggccccttttcaccagctacgaatctcctacggcactaataaggggaaaaactatacagaagaggaggatcggttcctcatatgcatgctgcataaactcggcttcgacaaggagaacgtgtacgacgaactccgccagtgtattcgcaatagtccgcagttcagatttgattggtttctgaaaagccggactgccatggagcttcagaggagatgtaataccctgattacactaattgagcgggagaacatggagttagaggagaaagaaaaggcggaaaaaaaaaagcgtgggccgaagccttccacgcagaagcggaagatggacggcgccccagatgggcgcggacggaagaagaagctgaagctatag

SEQ ID NO: 136776 - DNA, 2865 bp, Artificial Sequence
  Description of Artificial Sequence: Synthetic coding sequence
atgagcctccccttgaccgaggagcagcgcaaaaagatcgaagaaaatcggcagaaggccttagcgagacgcgcagagaagcttcttgctgagcagcatcagcgcacgagctctgggactagcatcgcaggtaatccttttcaagctaaacagggccctagccaaaattttcccagggagagttgcaagcctgtgagccatggcgtgatctttaaacagcagaatttatctagttcatctaatgcagatcagcggcctcacgatagccacagtttccaggctaaaggcatctggaaaaagcccgaggaaatgccaaccgcttgccccggccacagtcccaggagccagatggctttaaccggtatctcaccccccctggcacaatcaccgcccgaagtcccaaaacaacagctgctgagttatgagctgggacagggccatgctcaggccagccccgagatccgcttcactcccttcgcaaaccctacccataaacccctcgcgaagccgaaatctagccaggaaactccggctcactcctctgggcaaccaccccgcgacgccaagctggaggctaaaacagccaaggcctctccttccggccagaatatatcatacatacatagtagctcggaatcagtgaccccgaggactgaaggacgattgcagcaaaagagtgggagttcagttcagaagggagttaacagccagaagggcaagtgtgtccggaatggggacagattccaggtgctcatcggttataacgccgaactaatcgcggtgttcaagactctgcctagtaagaattacgatcccgacaccaaaacttggaacttttcaatgaatgattactctgccctcatgaaagccgctcagtccctacctacggtgaacctgcaaccactcgagtgggcatacgggtcatccgaatctccttcaacaagttccgaggggcaagcaggcctgcctagtgctcccagcctcagcttcgttaaggggcgctgcatgctgatcagtagggcctatttcgaagccgacatcagctattcgcaggacctcatcgccctgtttaaacaaatggactctagacgatacgatgtcaaaacaagaaagtggtcctttctcctggaggagcactcaaagttgattgccaaggtgaggtgtctcccccaggtccaattagaccctctgcccaccacattgacactggcctttgcatcacagctgaaaaagacaagcctctccctgactcccgatgtccccgaggctgatctaagcgaagtggaccctaaactggtctctaatctgatgccgttccagagagcaggcgtgaatttcgctatcgccaaaggcggacggctcttgctggccgatgacatggggttaggtaaaaccattcaggcaatttgtatcgcagcgttctaccgcaaagaatggccactcctggttgtggtcccttcctcagtaagattcacatgggaacaggcatttctccgctggttaccatcattgtcccccgactgcattaatgtcgtggtcacgggaaaagaccggttaacagcaggcctgattaacatcgtatcttttgatttgttgagcaagctggaaaaacagctgaaaactccttttaaagtcgtcatcatcgacgagagccactttcttaaaaatagcaggacagctaggtgtcgcgcggcaatgcctgttctcaaggtcgcgaaacgcgtgatcttgctctcgggcacacccgctatgagccgccctgcagaattgtatacacagatcattgccgtgaagccgacgttcttcccccaatttcatgcctttggtctgagatattgcgacgccaagcgcatgccctggggctgggattactcgggctcatctaacctgggcgagctcaaactcctccttgaggaagccgtgatgttgaggagacttaagagtgacgtgctatctcaactgccagccaaacagaggaaaattgtagtgatcgcgcctgggcgtattaacgctagaaccagggcagccctcgatgccgcggcgaaggagatgaccaccaaggataagaccaagcaacagcagaaggacgctctgattttgttttttaaccggaccgccgaggccaagattcctagcgtgattgagtacatccttgatctgctggagtctgggagagaaaaattcttagtatttgcccatcacaaggttgtgctcgacgcgatcacccaagagctcgaaaggaagcatgtgcagcacatacgcattgatggctccacaagttccgccgagcgtgaagatctttgccagcagttccaactctccgaaaggcatgctgtggccgtattatccataaccgcagccaatatggggttaacctttagcagtgccgacctggtagtcttcgcagagttattttggaatcctggtgtgttgatccaggctgaggatcgcgtccatcgcattggtcagacgtcctcggtggggatccattatctggtggctaaaggaactgcagacgattacttgtggccgctaatccaggaaaagattaaggtgctggctgaagccgggctctctgagactaacttctcagaaatgaccgaatccaccgactacctgtacaaggaccccaaacaacagaaaatatacgatctgtttcagaaaagctttgagaaggaaggatccgacatggagttgctcgaagccgctgagagctttgatccaggctcagccagcggcaccagtggtagcagctctcagaatatgggcgacactttggacgaatcttccttgactgcaagcccccagaagaaacgcaggttcgagttctttgacaactgggattccttcacgtcacctctttag

SEQ ID NO: 136777 - DNA, 2865 bp, Artificial Sequence
  Description of Artificial Sequence: Synthetic coding sequence
atgtcccttcccctcactgaagaacaacggaaaaagatagaggagaataggcaaaaggctctcgcccggagggcagagaaattgctggcggagcagcaccaaagaactagttccggcacctccatcgctggcaacccctttcaggctaaacaaggcccttcacaaaattttccaagagaatcctgtaagcccgtctcccatggcgtgattttcaagcagcagaacctgagcagctcaagcaatgcggaccaacgcccacacgattcgcactcctttcaggctaaagggatctggaaaaagcctgaagagatgcctactgcgtgccctggtcacagtccacgctcgcagatggccctaaccggaatatcccctccactggctcagagtccacccgaggtgcccaaacagcagctcctatcttacgagttagggcagggccatgctcaggcctcccctgagatcagatttacgccctttgcaaatccgacacacaaaccactcgctaaaccaaagagttcccaagagacgcctgcacacagttcgggccagcccccaagggacgcaaaattggaggctaaaacagccaaggcctccccttctggtcagaatatatcatacatccacagttccagtgaaagtgtgactcccaggactgaggggcggttgcagcaaaagtccggaagcagcgtacagaagggagttaactcacagaaggggaagtgcgtgcggaacggcgataggtttcaggttttgattggatacaatgccgagctcatcgcggtgttcaaaaccctcccttcgaaaaattatgatccggatactaagacctggaatttctctatgaatgattattctgccttgatgaaagcagcccagagtcttcccaccgtgaacctccaacccctggaatgggcgtatggctctagcgagtctccatcaacctcgagcgaaggacaggccggactgccaagcgcaccatcattatctttcgtcaagggccgctgtatgctcatctctcgcgcgtactttgaggccgacatctcatactcacaggaccttatcgccctcttcaagcagatggattcccgcagatatgacgttaagacaagaaaatggtctttcctgctggaagagcactccaagcttatcgccaaggttcggtgtctcccccaggttcagttggatcccctgcctacgacactgaccctcgctttcgcctctcagctgaaaaagacttccctaagcctcactccggacgtgccagaagcagatctgagtgaagtggatccgaagcttgtctctaatttgatgccgttccagagagctggcgtaaattttgctatcgctaaagggggacgtcttctgttagcagacgatatgggcctcggcaaaacaattcaggctatctgcatagctgcattttatagaaaagagtggccactgcttgtggttgtgccatcgtctgtccgatttacttgggaacaggcgtttctccgatggctgccctcactgtcccccgattgtatcaacgtggtggtcaccggaaaggatcggctgacggcaggcttgataaacatcgtgtctttcgatctgttgtccaagctggagaagcagctaaaaacgccctttaaagtagttatcatagacgaaagtcactttctgaaaaattcacgaaccgccagatgcagggccgccatgccagtccttaaggtagctaaacgagtaatattgctctccgggacgccggccatgagcaggcccgcagaactttacacacagattatagccgtgaagcctaccttcttcccccagttccatgcattcggtctccgctactgcgatgccaaaagaatgccttggggatgggactattcaggatcgtctaatctcggcgaactaaaattactcctagaagaggctgttatgcttcgtcgactcaaatcagacgtgctgtcacagctcccagccaaacaaagaaagatcgtagtaatcgcccctggaagaatcaacgcccggaccagagccgctctggacgccgcagcaaaagaaatgactacgaaggataagaccaagcagcaacagaaggatgcgctaattctattttttaaccgaaccgcggaagctaaaatacctagtgtcatcgaatacatcctggacttattggagagcggacgcgagaagtttctggtgtttgcccaccacaaggtcgtgttggacgccattactcaggaattggagaggaagcatgtgcagcacatccggatcgatgggtccacttctagcgcggagcgggaggatctgtgccagcagttccagctgtcagaacgccacgctgtcgcggtactgtcaattacggcagccaacatgggactcacgttttcttccgccgacttggtggtctttgcggagctgttttggaatcctggagtgttgattcaggctgaagatcgggttcatagaattggacagactagctcagtgggcatacactacctggtcgctaagggaacggcagacgattacctatggccactgatacaagagaaaatcaaggtgcttgctgaggctggactgagtgaaaccaatttctcagaaatgacggaatccacggattatctctacaaagatcccaaacaacaaaagatttatgatctgtttcagaagagttttgagaaggaaggttccgacatggagctgctagaggcagcggagagctttgatcctggatcagccagcggaacctccgggtcctcttcccagaatatgggagatacgttggatgaatcctccctgacggcatcgccccagaaaaaaagacgcttcgagttttttgacaattgggattcatttacatcccccctctag

SEQ ID NO: 136778 - DNA, 60 bp, Artificial Sequence
  Description of Artificial Sequence: Synthetic coding sequence
atgtcactacctttgactgaggagcagcgcaaaaagatcgaggagaataggcagaaatag

SEQ ID NO: 136779 - DNA, 441 bp, Artificial Sequence
  Description of Artificial Sequence: Synthetic coding sequence
atgtcattgcccttgaccgaggaacaacggaaaaaaattgaagagaacaggcaaaaggccctggcgaggcgcgccgaaaagttgctggcggaacagcaccagaggacttcttctgggacgtctatagcgggtaatcccttccaagctaagcaggggccaagtcagaatttccccagagagagttgcaagcccgtctcccatggagttattttcaaacaacaaaatctatcgagctcatccaacgcggatcagcgtccgcatgacagtcacagcttccaagcgaaaggaatctggaagaagcccgaagagatgcccacagcttgcccaggacactcccctcgctcacagatggccctgacgggaatttcacctcccttagcccagtctcccccggaagtacccaagcagcagttgctttcctatgagctgggccagggctag

SEQ ID NO: 136780 - DNA, 279 bp, Artificial Sequence
  Description of Artificial Sequence: Synthetic coding sequence
atgtcactccctctgaccgaagagcaaagaaagaagatcgaggagaatcgccagaaggccctggcccggagagcggagaagttgctggcagagcagcaccagcgcacgagttcaggtactagcatagccgggaatccattccaggccaagcaggggccttcacaaaacttccctagagagtcctgcaagcctgtgtcccatggagtgattttcaagcagcaaaatctttcttcatcatctaacgctgaccagcgcccgcacgactctcactctttctag

SEQ ID NO: 136781 - DNA, 393 bp, Artificial Sequence
  Description of Artificial Sequence: Synthetic coding sequence
atgtcgcttccgttgactgaggaacagagaaagaagattgaggaaaataggcagaaagccctggcccgcagagccgagaagctattagccgaacagcaccagagaactagcagtggtacaagtattgctgggaacccctttcaagccaaacagggcccttcacagaattttccccgtgagtcctgtaagccggtcagtcatggtgtcatattcaagcaacagaacctgagttcctcctccaatgccgaccagcgacctcatgactcacactcattccaggcaaagggcatctggaagaagcccgaagagatgccaaccgcttgtcctggccactcgccaagaagtcagatggctttgacaggaattagtcctcctctcgcacagagcccgtag

SEQ ID NO: 136782 - DNA, 3318 bp, Artificial Sequence
  Description of Artificial Sequence: Synthetic coding sequence
atggctgccgccgccggtggtgggggcccggggaccgccgtgggcgcaacagggtccgggatcgcagccgccgccgctggcctcgccgtttacagacggaaggacggaggccctgctactaagttttgggagagcccagagactgtgagccagctcgattctgtccgggtatggctcggtaagcactataagaagtatgttcacgctgacgctccaactaacaaaacactcgcggggctggtcgtgcagttgctgcaatttcaggaggatgccttcgggaaacacgtgactaatcctgcctttaccaagttgcctgcgaaatgcttcatggactttaaagccggtggtgccctgtgccacattttgggggcagcctacaagtataagaacgagcagggttggcgcaggttcgacctgcagaatccctcaaggatggatcgcaatgtcgagatgttcatgaatatagaaaagacacttgtccagaacaactgtctcacacgccctaacatctaccttattccagatatcgatctgaagctcgccaataaattgaaggacattataaaaagacaccaaggtacattcaccgatgaaaagagtaaagcctcacaccacatatacccatactctagttcccaagacgatgaggaatggctccgccccgtgatgaggaaggaaaagcaggtgctggtgcattggggcttttaccccgacagttatgatacctgggtgcatagcaacgacgttgatgctgaaatcgaggatccccctattccagagaaaccctggaaggtgcacgttaaatggatcctggatactgacattttcaacgaatggatgaacgaagaggattatgaggtggacgagaatagaaagccggttagttttcggcagagaatctccaccaaaaacgaggagcccgtcagaagtccagaaaggcgtgaccggaaagccagcgccaacgcccggaagcgaaaacattcgccttctccccccccgcccactccaaccgagtcacgtaagaaaagtggaaaaaaaggtcaggccagcctgtatggcaaaagaaggtcccagaaagaagaggacgagcaagaagacctgacgaaagatatggaggacccaacacccgtgcctaatatagaagaggtggtgctaccaaagaacgtgaacttgaaaaaagattccgaaaacaccccggtgaaaggaggcacggtcgctgatctggacgagcaagatgaggaaacagtgaccgccggcggtaaggaagatgaggatcccgccaagggtgaccaatctcggagtgtggatctgggcgaggataacgttacagagcagacaaatcatatcatcattccatcttacgcaagttggttcgattataactgtatccatgtaattgaacggagggcactgcccgaattcttcaacgggaaaaacaagtccaagaccccagaaatctacctagcatataggaactttatgatagacacatacaggttaaatccccaggaatatctcacctcgaccgcgtgcaggcggaacttgactggcgacgtatgcgcagtcatgcgcgtgcatgccttcttggagcagtgggggttggttaactatcaggtggaccccgagagtcgccccatggctatggggcctccgcccactccacatttcaacgtcctagcagacactccaagtgggcttgtgcccctccaccttaggtctccccaggtgccagcagcgcagcagatgctgaacttcccagagaagaacaaagagaagcctgtggatctgcagaactttggacttagaactgacatttacagtaaaaaaactctcgccaagtctaagggcgctagtgccggccgtgaatggactgaacaggagactctcttattattagaagctctggaaatgtataaagatgattggaataaggtgagtgaacacgttgggtcacggactcaagatgagtgcatcttgcactttctgcggctaccaatcgaggacccatacctcgagaacagcgacgcctcattgggaccattggcatatcagcctgtcccctttagtcagagcggtaatcctgtaatgtctacggtggcctttctggcctctgttgtggacccaagggtggcttctgccgcagcgaaagctgcgctggaagagttctcacgcgtgagagaagaagtgcctctggagcttgtagaggcccacgtgaagaaggtccaagaagcggctcgagctagtgggaaggtggaccctacttatggcctggagtctagctgtatcgccggcactgggcccgatgagcctgaaaagctggagggcgccgaagaggagaaaatggaagctgacccagacggccaacagccagagaaggccgaaaacaaggtagaaaatgagacagatgaaggcgataaggcacaggacggagagaacgagaaaaactctgagaaagagcaggatagcgaggtctcagaggatacgaaaagcgaagagaaggagacagaggaaaataaggagttgacagacacgtgcaaagaaagggagtctgacaccgggaagaagaaagttgagcatgaaatttccgaagggaacgtggcaaccgccgctgctgccgctctcgcttcagctgccacaaaggctaagcacctcgccgctgtcgaagagcgtaaaattaaaagcttagtggccctcctggtcgagacccaaatgaaaaaactggagatcaagctgcggcacttcgaagagctggaaactatcatggatagagagaaggaggccttagaacaacaacgccaacagctgctcactgaaagacagaacttccacatggagcaattaaagtacgctgagttgcgggccagacagcagatggagcagcagcaacacggccagaacccacaacaagcccaccagcattcaggcggtcctggattggcccctcttggtgccgccggacatccgggcatgatgcctcaccagcaaccccccccctacccactgatgcatcatcagatgccaccaccccaccccccacagccaggccagatccctggtcctggctcgatgatgcccggccagcacatgcccggacgaatgatccctacagttgcagctaacatccatccatctggctccgggcctaccccgccagggatgcctcctatgccaggaaacatcctggggcctagagttcctctgacggccccaaacggaatgtacccaccacccccacaacaacagcccccacctccacctccggccgatggggttcctccgccgcctgctcccggaccccctgcctcagcagctccatag

SEQ ID NO: 136783 - DNA, 3645 bp, Artificial Sequence
  Description of Artificial Sequence: Synthetic coding sequence
atggccgttcgcaaaaaagacggcgggccgaacgtaaaatattatgaagccgccgacaccgtgacacagttcgataatgtcaggctgtggttagggaagaactataagaaatatatccaagcagagccccccacaaacaagtctttgtcctccctagttgtacagctgctccaattccaggaggaggtattcggtaagcatgtgtccaacgcacctctgacaaagctccccatcaagtgcttcctggattttaaggcaggcggatctctgtgccacatcctggccgccgcttacaagtttaagtctgatcagggatggcgcaggtatgatttccagaacccatcacggatggaccggaacgtcgaaatgttcatgaccatagagaaatcgttggttcagaataattgcctctcacgccccaatatttttctctgccccgagatcgaaccaaagctgctcggaaagctcaaggacatcatcaagaggcaccagggcacagtcacagaagataagaacaatgcgtcacatgttgtctaccccgttccaggcaatctggaagaagaggaatgggtgcgccccgtaatgaagcgagacaaacaggtgctcctgcactggggttactatccagacagctacgacacttggatacccgcaagcgaaatcgaagccagtgtggaagatgcacctaccccggagaagccccggaaggtccatgccaaatggattctcgacacagatacctttaacgagtggatgaacgaggaggactacgaagtgaacgacgataaaaatcccgtctcccgccgtaaaaagatttcagctaagactctcacagatgaagtcaactccccagacagtgacagaagagataagaagggagggaactacaagaagcgaaagcggtcccccagcccgagtcccacaccggaagccaagaagaaaaacgctaaaaaagggccaagcactccgtacacaaagtccaagaggggccacagagaagaagaacaggaagacctcacaaaggatatggatgaaccttcacccgtgcctaacgttgaagaggtaactctgccgaaaaccgtgaatactaaaaaggattctgagtccgcacccgtgaaaggaggcactatgaccgaccttgacgaacaggaggacgagtctatggaaactacaggcaaagacgaagatgagaatagcacggggaacaaaggcgagcagaccaagaaccctgaccttcacgaggataacgtgaccgagcagacccaccacatcatcattccttcttacgctgcctggttcgactataattctgtgcacgccatcgagaggagggctctccctgagtttttcaacgggaagaataaatccaagacccccgagatctatctagcctacagaaacttcatgattgatacttaccggcttaatcctcaggagtatctcacatcgacagcttgccgcagaaatctcgcaggggatgtgtgtgccattatgcgcgtacatgccttcctcgagcagtggggccttataaattatcaggtcgatgctgaatcccgccctactccaatgggtcccccaccgaccagccacttccacgtcctcgccgacaccccgagtggcctggttcccctgcagccgaagacgccccagcagactagcgctagccagcaaatgctgaactttcctgataaagggaaagagaaaccaactgatatgcagaattttggcctccggacagacatgtatactaagaaaaacgttccctccaagtccaaggccgcagcatccgccacaagggagtggactgaacaggaaaccttgctcctgttggaagcactggagatgtataaggacgactggaacaaggtgagcgaacacgtgggatctcgcacacaggacgagtgcatcctccatttcctcagattgcctatcgaggacccatacctggaggactcagaagccagcttaggacctttggcataccagcccatccccttctcacaatctggtaacccggtcatgagcacagtcgccttcctcgccagtgttgtggatccccgggtggcgtccgcagccgcgaagtcagcgctggaagaatttagcaagatgaaggaagaagtccccaccgccctggtcgaggcgcatgtaaggaaagtcgaagaggccgccaaggtaactggcaaagccgacccagctttcggactcgagtcctccggaatcgcgggcactacgtctgatgaacccgagcgaatagaggagagcggaaacgatgaagcacgggtagagggacaggctaccgacgaaaaaaaggaacctaaagaaccgcgggagggcggcggcgccatcgaggaagaagccaaggagaagacctctgaggctccgaagaaggatgaagaaaagggtaaggaaggggattctgagaaggagtctgagaagtctgacggcgaccccatagtggaccccgagaaggagaaagagcccaaagaggggcaggaggaggttttgaaagaggtagtcgagtctgagggcgagcgtaaaactaaagtggagagggatatcggcgaaggcaatctctcaaccgcagccgcagccgctctagccgccgctgctgtcaaggctaagcatcttgcggctgtcgaggagaggaagattaaatccctcgtagccctcctagttgagactcagatgaagaagctcgagattaagcttcggcattttgaagaactcgaaacaattatggatcgcgaacgggaagccttagaatatcagagacaacaactcctggctgataggcaggcgttccatatggagcagctcaagtacgctgaaatgcgagctcgccagcaacactttcagcagatgcaccagcaacagcaacagcccccccccgccctgccaccgggctctcaacccatccccccgacaggagccgcgggcccgccagctgtgcacggcctcgccgtggccccggcctccgtggtgcccgcccctgctggaagtggcgccccgccagggagcctggggccctccgaacagataggtcaggccggatcaactgctggcccccaacagcagcagcccgcgggggcaccccagcccggcgccgtgccacctggggtacctccgcccgggccacatggaccctccccatttcccaatcaacagactcccccaagcatgatgcctggcgctgtacccgggagcggacaccctggagtggcggggaatgctcccctgggactgccgttcggaatgccaccaccacctccgcccccggcaccttctataatcccctttgggagcctcgctgattcaatcagcataaacctgccagcacctccgaacctccacggccaccatcatcacctgccatttgcaccaggtaccctgccgccccctaacctcccagttagtatggccaatcccttacacccgaacctgcctgccacaacaacgatgccctcctcattaccgctcgggcctggattgggcagcgctgcagcccagtctccagctattgtagcagctgtacagggcaacctgctgccgtcagcatcacccctccccgacccgggaactcccttgccccctgaccccaccgccccttctcccgggaccgttacgcccgtgcccccgccccagtag

SEQ ID NO: 136784 - DNA, 3393 bp, Artificial Sequence
  Description of Artificial Sequence: Synthetic coding sequence
atggctgtgcggaaaaaggatggcggcccaaatgtgaagtactacgaggcagcggacacggttacacaatttgacaacgtaagattatggctgggcaagaattacaagaaatacatacaggcagagcccccaaccaataaatctctgtcaagtttggtcgtacaactgctgcaatttcaggaggaagtgttcggcaagcatgttagcaatgccccactgactaagctccccattaagtgtttcctggacttcaaagccgggggctccttgtgccatattcttgccgctgcgtacaagtttaagagtgaccaaggctggcgcaggtacgattttcagaacccttcacgcatggaccgaaacgtagaaatgtttatgaccattgagaagtcgctggtccaaaataactgtctatctaggccgaacatttttctttgcccagagattgagccaaagttgctcggcaagctcaaggacattatcaagcggcatcagggcacggtaacggaggataagaacaatgcaagtcacgttgtgtacccagtgccaggcaatttggaagaagaagagtgggtacggccagtcatgaaaagggataagcaggtgctcctgcattggggctactatccagatagttacgacacttggatccctgcatccgagatcgaagcgtcggtcgaggatgcgcccacccccgaaaaacctaggaaggtgcacgctaagtggattctggacactgacacgttcaacgagtggatgaatgaggaggactatgaggtgaacgacgataagaaccccgtgtctcggcgcaaaaaaatatctgccaagactctgactgatgaagtgaactcaccggattctgacagaagagacaaaaaaggaggcaattacaagaagcgaaaacggtccccttctcctagcccaacccccgaggccaagaagaagaatgccaagaagggaccgtcgacaccttataccaagagcaagcgcggccacagagaggaagaacaggaggatctgacaaaggacatggacgagcctagcccagtgccaaacgtggaggaggtcaccctccctaagacagttaatactaagaaagacagcgaatctgctcccgtcaaggggggcacaatgaccgacctggacgagcaggaggatgaatctatggaaactactggtaaggacgaagacgagaattctacagggaataagggagaacagactaaaaacccggatctacacgaagataacgtcacagagcagactcaccatatcatcatccccagctacgccgcctggtttgattataactcggtccatgcaatcgagaggcgtgcccttcccgagttcttcaatgggaagaataaatcaaaaacccctgagatttatttagcatatcggaactttatgattgacacataccggctaaatcctcaggagtacctcaccagcaccgcctgtcgaaggaaccttgctggggacgtttgcgcaataatgagggttcatgccttccttgaacagtggggcctaattaactaccaggttgatgcagaatctcgccccacacctatgggaccaccccccacgtcccacttccatgtgttggcagatacaccttctggcctcgttccacttcagcctaaaacaccccagggacggcaggtagacgccgataccaaggctggccgcaaaggtaaagagttagacgacttggttccagaaactgctaaagggaagccggagctgcagaccagcgcatctcaacagatgctgaacttccctgacaaaggcaaggaaaaaccgaccgatatgcaaaattttgggttaaggacagacatgtacacaaagaagaacgtgccctcaaaatctaaggcagcagcatctgctacaagagagtggactgagcaggagaccctccttctgttggaggccctagaaatgtacaaggacgactggaacaaggtttccgagcatgttggaagtcggacgcaggacgagtgcattctgcatttcctgcgcctccctatcgaggacccatatctggaggatagcgaggctagcctcggccccttagcataccaacctatcccattctctcagagcggcaatccagtgatgtcgactgtggcattcctggcctctgtggtggatccaagagttgcctcagctgcagccaaatcagctcttgaagagttttccaaaatgaaggaagaggtacccaccgcattagtggaggcccatgtcaggaaagtcgaggaggcagcaaaggtgactggcaaagccgatccagcattcggcctggagtcttccggaattgctggcactacctccgacgaacccgagcgaattgaagagtctgggaatgacgaggcccgcgttgagggccaagcgacagatgaaaagaaagagcctaaagagccccgcgagggtggcggggctattgaagaagaggccaaggaaaagaccagtgaggcgcccaaaaaggacgaggagaagggaaaagaaggcgattcagaaaaggagagcgaaaagagtgacggtgaccccattgtggatccagagaaggagaaggagcctaaagaaggccaggaagaagtacttaaagaggtggtcgagagcgagggcgaacgcaagactaaggttgaaagagacataggggagggcaatttgagcactgcagccgcagccgcccttgctgcagccgctgtcaaagccaaacaccttgcggcagtggaggagcgaaagataaaatcactggtggctttgctcgtggagacccagatgaagaagttggagataaagctcagacatttcgaggaacttgagactataatggacagagaacgggaggctttggaataccaaaggcaacagctgctggccgatcgccaggcctttcacatggagcagctgaaatacgccgagatgcgagcaagacaacagcactttcaacagatgcaccagcaacagcagcaacctcctcctgcactgcccccaggaagccagcccatcccacctactggggcagctggtcctcctgccgttcatggactagcagtagctccagctagtgtcgtaccagctcctgcaggctctggtgcccctcccggatcactgggcccctctgaacagattgggcaggccgggagcaccgccggaccacagcagcagcagccagctggagccccgcagcctggggcagtccctccaggcgtgccgccaccagggcctcatgggcccagcccatttcctaaccagcagacacccccaagtatgatgcctggagctgtccccggctctggccatccaggagttgcagatcctgggacccctttaccaccagacccaaccgctccctcacccgggacagtaaccccggtgccacctccccagtag

SEQ ID NO: 136785 - DNA, 3459 bp, Artificial Sequence
  Description of Artificial Sequence: Synthetic coding sequence
atggctgtgagaaagaaggatggaggtccaaatgtcaaatactacgaagccgcagacactgtgacgcagtttgataatgtgcgtttgtggcttgggaagaactataagaaatatatccaggccgagcccccaaccaacaagtcactgtcctctcttgtggtgcaacttctgcagtttcaagaggaggtctttggaaagcacgtatcaaatgctccactcaccaaactgccgatcaaatgtttcctggattttaaagctgggggaagtctatgtcatatactggctgccgcctataaattcaagtcagatcagggctggagaaggtacgatttccagaatccttctcggatggaccgtaacgtcgaaatgtttatgacgatcgagaagagtcttgtccaaaataactgtctcagccgaccaaacatatttctgtgccccgagattgaacctaaattattaggcaaattaaaagacatcataaaacggcatcaggggacagtgacagaggacaagaacaacgcgtcccatgttgtttaccctgtccctgggaacctggaagaggaggaatgggtgagacctgttatgaagcgagacaaacaagtgcttcttcattgggggtactatcctgactcatacgatacttggatccccgcttcagagatcgaagccagcgtcgaggatgcccccacccccgaaaagcctcgcaaggtccatgctaaatggattctcgacacagatacctttaacgaatggatgaacgaggaggattacgaagtgaatgacgataagaacccagtgtccagacggaaaaagatctcagccaagacactcacagacgaggtgaatagcccagactcagatcgacgagataaaaagggcgggaattataagaaacggaaacgatccccctccccttcccccacacctgaggccaaaaagaagaacgctaaaaagggcccttctacaccctatactaaatccaaacgagggcaccgggaagaagagcaagaagatctcaccaaggacatggacgagcctagccctgtgcccaacgtggaagaagtgacacttcccaaaacagtgaatacaaagaaagatagtgagtccgcaccagtgaaagggggaaccatgacagatttggacgagcaagaggatgaatccatggagaccaccggtaaagatgaggatgagaactcaacagggaataagggagagcagacgaagaaccccgatttacatgaggataacgtgacggaacaaacccatcacatcattattccttcctacgccgcctggtttgactacaatagtgtgcatgcaatcgaacgcagagcactccctgaattttttaatggcaagaataaatctaaaacacctgagatctacctggcttatcgaaactttatgattgatacctatcgactgaacccgcaggaatacctcacgtccactgcctgtaggcggaaccttgccggtgacgtctgtgctataatgagagtccacgcctttctagagcagtggggcttgatcaattaccaggtggatgcagagagtaggccaacccctatggggcctccgcccacaagccatttccatgtcctggcggatactccttctggcctcgtccccctgcagcccaagaccccccaggggcgccaggtggatgcagacaccaaagctggaagaaaagggaaagaactagatgacctagtacccgaaactgccaagggtaagcctgagctacaaacaagtgccagccaacagatgttaaatttccctgacaaaggtaaggaaaaaccaaccgatatgcagaatttcggcctgagaacggatatgtacaccaagaagaatgtcccgtcaaagagcaaggccgccgcatccgcaactcgggagtggacggaacaggagacacttcttctgctggaagcgcttgaaatgtataaagacgattggaacaaggtgtcagagcacgttggcagcaggacccaagacgagtgcatccttcactttctacgactacccatcgaagatccctatcttgaagatagcgaagcctctttaggcccattggcgtatcaaccaattcccttctcccaatcaggcaatccagtgatgagtacggtggccttccttgcaagcgtggtggacccgagggtggcatctgcggccgcgaaatccgctctggaggagttctcaaaaatgaaggaagaggttccaacagctcttgtggaagctcatgttaggaaggtggaggaggcagccaaagttacggggaaagccgatcctgcatttggtttggagtcgagtgggatagccggtactaccagcgatgagcccgagagaattgaagaatcaggaaatgacgaggcacgggtggaagggcaggcaacggatgagaaaaaggaacctaaagagccgcgcgagggcggtggggccattgaagaggaagcaaaggagaagacaagcgaggcacccaagaaagacgaggaaaagggcaaagagggagacagcgagaaggagagtgaaaaatccgatggagatcccatcgtagaccccgagaaggaaaaagaacctaaggaaggacaggaggaggtgctcaaggaggtcgttgagtcagagggagagcgcaagactaaggttgaaagggatatcggggaggggaacttatccacagccgctgcggcagctctcgctgcagctgccgtgaaagcaaaacatctggcagccgtggaggaacggaaaattaaatcgttagtggccctgttggtagagacacagatgaaaaagcttgagataaaacttcggcactttgaggagttagagacgattatggatagagaaagagaggctctagaataccagcgtcagcagctgctagccgatcgccaggctttccacatggagcagcttaaatacgccgagatgagggcccgccaacagcactttcagcaaatgcatcagcagcaacagcagcctcctcccgcgctcccaccaggctcccaaccaattccacctactggcgctgccgggcctcctgctgtgcatggcctggcagtagctcccgcaagcgtcgtacctgctccggccggtagcggagcacctcctgggtccctgggcccttccgaacagatcggacaggccggtagcaccgcaggaccacaacaacagcagcccgccggcgcaccacagcccggggctgtgcctcccggggtgcccccccctgggccacatggccccagcccctttcctaaccagcagaccccaccaagcatgatgcccggcgcagtgcctggtagcggtcacccaggagtggccgcacagtcccccgcaattgtcgccgctgtgcaaggaaatcttttgccctctgcttccccactgcccgacccgggtacacctcttccccccgaccccacagcgccatcccctggcaccgtgacccctgtcccacccccccagtag

SEQ ID NO: 136786 - DNA, 1425 bp, Artificial Sequence
  Description of Artificial Sequence: Synthetic coding sequence
atggcagccagagccggctttcagtcggtcgcacccagtggcggcgctggtgcgagcgggggtgccggcgcagctgcagcccttggaccaggtggaacaccagggccccctgttaggatggggcctgcacccggccagggcctgtacaggtccccaatgccaggtgccgcttatcctcgtcccggcatgctgcctggcagccgcatgacgccccaaggcccatctatgggcccccccggatatggtggaaaccccagtgtgaggcccggcctggctcagagcggcatggatcaatctaggaagcgcccagctccccagcagattcaacaagttcagcagcaggctgtgcagaaccgcaatcacaacgccaagaaaaagaagatggccgacaaaatcctacctcagcgcatacgcgagctggtgccggagtcacaggcctatatggacctgctggcttttgagagaaagttagaccaaactatcatgaggaagcggctcgatattcaagaggcattgaagagacctatcaaacaaaagagaaagctgcgaattttcatctcaaatactttcaatcccgccaagtctgatgctgaggacggggagggcactgtggccagctgggagctgcgcgtggagggccggctgcttgaagatagtgccctgtctaagtatgatgcaacaaaacagaaacgcaaattctcttcattcttcaaatcactggtgatagagctggataaggatctgtacgggcccgataatcacctggtcgagtggcaccgcaccgcaacgacccaggaaaccgacggattccaggtgaagcgccctggggatgtcaatgttcggtgcaccgtcctgctgatgctggattatcagccaccccagttcaaacttgacccgcgcttagctagactgcttggcattcacacccagacccgtcccgtcattatacaggctctgtggcaatacattaagacacacaagctacaagacccccacgagagggaattcgtgatttgcgataagtacctacagcagatattcgagagccaaagaatgaagttcagtgaaatccctcaacgtctgcacgccctgttgatgccccctgaacctatcataatcaaccacgttattagtgtagacccgaatgatcagaagaaaacagcctgctacgatattgacgtagaggtggacgataccctcaaaacccaaatgaacagctttctgcttagtacagctagtcagcaggagatagctaccctggataataagacaatgacagacgtcgtcggaaatccggaggaggagcgccgagcggaattttacttccagccctgggcccaggaggccgtatgccgttacttctactcgaaagtgcaacagagacgtcaggagctagaacaggcactcggaatcagaaacacgtag

SEQ ID NO: 136787 - DNA, 1548 bp, Artificial Sequence
  Description of Artificial Sequence: Synthetic coding sequence
atggctgccagagctggatttcaatctgttgccccttcaggcggcgccggagcttccggtggagctggagctgcggctgccctcggccccggcggtacaccaggaccgcccgtgcgcatgggccccgcgccggggcaaggcttataccggagcccaatgcccggggcagcatatccccgcccaggcatgctgccgggaagccgaatgacaccacagggtccatcaatgggcccccctggatatggagggaacccctccgttagaccaggcctcgctcagtccggaatggaccagtcccgcaaacgccctgcgccccagcagatccagcaggtgcagcagcaggctgtgcaaaaccgcaaccacaacgctaagaagaagaagatggcggacaagattttacctcagcggattagggaactcgtgcctgaaagccaagcttacatggacctcctggcgtttgaacgtaagctggaccaaaccattatgagaaagagattggatatacaggaggctctcaagagaccaatcaaacagaagagaaaactccgtatctttatctccaacacatttaacccggccaaaagcgatgctgaggatggagagggtacagtggcttcttgggaacttcgcgtagagggcaggctcctggaggacagtgcattgtctaaatacgatgccacaaagcagaagagaaagttttcgtcgttctttaaaagcttggttatagaattagataaggacctctacggacccgacaatcatctggtcgaatggcaccggaccgcaaccacacaggagacggatggcttccaggtcaagagacccggcgatgtgaatgtccgctgcacagtactactcatgctggactaccagccaccacaattcaaactcgatcctcgtctggcccggttgctggggattcatacacaaaccaggcctgtgataattcaggcgctgtggcaatatatcaagacacataagttgcaagatccccacgaaagagaatttgtgatttgtgacaagtacctgcaacagatctttgagtcccagaggatgaagttcagcgaaatcccccagagacttcatgcgctcttaatgcctcctgaacctataattattaatcacgtgatatcagtagaccccaacgatcagaaaaaaactgcctgttacgacattgatgtcgaggtggacgatacactcaaaacgcagatgaacagcttcttactctctaccgcctcacagcaggaaatcgctacgctcgataataagattcatgaaacaatcgagaccatcaatcagctgaagactcaaagggaatttatgctcagctttgctagggatcctcaaggcttcatcaatgattggctgcaaagtcaatgcagggatctgaagacaatgactgacgtggtcggcaatccagaagaagagcggcgagccgaattttactttcagccatgggcacaagaagccgtgtgtcggtacttttactctaaggtccagcaaagacggcaggagctcgagcaggccttgggcatacggaacacttag

SEQ ID NO: 136788 - DNA, 876 bp, Artificial Sequence
  Description of Artificial Sequence: Synthetic coding sequence
atgatgcccctgaacaaacggggctccagcctgccattcaaatcactggtgatagaactcgacaaggatctatacggtcccgataatcacctggtcgagtggcaccggactgccactacacaagagactgacgggttccaggtaaagcgccccggagacgttaatgtgagatgtaccgtgctgctgatgctcgattaccaacccccacaattcaagcttgatcctcgtctcgcccggctgttggggattcatacacaaaccagaccggtgattattcaggctctgtggcagtatatcaagactcataagcttcaggatccgcacgagagagaattcgtcatttgcgacaagtacctgcagcagattttcgaatctcagcggatgaagttttctgaaataccacagcgcctccacgccttacttatgccgcctgaaccaatcattatcaaccacgtcatcagtgtggaccccaacgaccagaagaaaactgcctgctatgatatcgatgtggaggtcgatgatactctaaagacccagatgaatagtttcctgctgtcaactgcgagtcagcaggaaattgcaacgctggataataaaattcatgagaccattgagacaattaatcagctgaaaactcagcgcgagtttatgctatctttcgcccgtgatccacaagggtttattaacgattggttacagagtcagtgccgggatctaaaaacgatgaccgatgtggtgggcaatccagaggaagagcgccgtgcagaattctactttcagccttgggcccaagaagctgtgtgcagatatttttactccaaggtgcagcagagaaggcaggagctggagcaggctctgggtataagaaacacctag

SEQ ID NO: 136789 - DNA, 1362 bp, Artificial Sequence
  Description of Artificial Sequence: Synthetic coding sequence
atgtccaaaattagcgaagctgtgaaacgtgcgcgcgcagcatttagctcaggcaggacccgccccctccaatttcggattcagcagttagaagctctccagcgactaatccaggaacaggaacaggaactggtgggcgccttggcggcagaccttcacaaaaacgaatggaacgcctactatgaagaggtggtgtatgttctggaagaaatcgagtatatgatccaaaaattgcccgaatgggccgccgatgaaccggttgagaagactcctcaaacacagcaggatgaattatatattcattccgaaccactgggtgtggtcctggttatcgggacctggaactaccccttcaacctcacgatccagccaatggttggggcgattgcagcagggaattccgtagttctgaagccctcagagctttcagagaacatggcctccttgctcgccacaattatccctcagtacttggacaaagatctgtaccccgtaattaatgggggcgtaccagagactacagagctgttgaaggagcggttcgatcatatcctgtataccggcagcacgggcgtgggaaaaattatcatgacggctgccgccaagcacttgacacctgtaacactggagcttggcggcaaatctccttgctatgtcgacaagaactgtgacctcgacgtcgcctgccgcagaattgcctgggggaaattcatgaattccggacaaacatgtgtggctcccgattatatcctgtgcgaccccagtattcagaaccagattgtggagaagctgaaaaaatccctcaaggagttctacggcgaggatgccaagaagtcccgcgactacgggcgaatcatatcagctaggcatttccagagggtgatggggttgattgaagggcagaaagttgcatatggtggcacaggggatgcggcgacccgatatatcgccccaacaattctgacagatgtcgacccgcaatccccagtaatgcaggaggaaatattcggccctgttctcccaatcgtttgcgtcagatcactggaggaagcaatccagtttataaatcaacgcgaaaagccactcgcactgtatatgttttcgtccaacgacaaggtcatcaagaagatgattgctgagacctctagcgggggagtcgccgcaaatgatgtaatagttcatatcactctgcattcactcccctttgggggtgtgggcaactcaggaatgggatcttaccacggcaaaaaatcttttgagacattctctcatcggcggagctgtctggtgcggcctttgatgaacgacgagggactcaaagttcggtatccacccagtcctgctaaaatgacccaacactag

SEQ ID NO: 136790 - DNA, 1452 bp, Artificial Sequence
  Description of Artificial Sequence: Synthetic coding sequence
atgggacggagggtcggcgtggaggttacaccccgatgggccccccagaagtgccaaggagccaggccccagcgcccaggaatgtcgccaggcaaccggatgcctatggccggactgcaggtaggtccgcctgcaggatccccgttcggcgctgcagcgccactcaggccaggtatgcctcctacgatgatggatccctttcgcaaacggctgctggtcccccaggcccagccgcccatgcccgctcagcgcagaggactgaaaaggcgcaagatggccgacaaggtcctgccacagaggattagggaattggtgcccgaatctcaagcatatatggatctgttagctttcgagcggaaacttgaccagaccatcgcacgtaagagaatggagatacaggaggccataaagaagcctctgacccagaagcgcaaactgcggatttacatcagcaatacatttagcccttcgaaggctgagggggacagtgctggcaccgctggtacccctggcggcacccctgccggggacaaagtggctagctgggaactccgtgtcgaaggtaaactccttgacgaccctagcaagcagaagcgcaaatttagctcatttttcaagtctcttgtcatagaactcgataaggaactatatgggcccgacaaccatctggtggagtggcatcgtatgcctacaacccaggaaacagacggcttccaggtgaaaagaccgggggatctgaatgtgaaatgcacactgcttttaatgctagaccaccagccgcctcagtataagctggacccccgcctcgcacgactgctcggcgttcacacacagactcgggctgctatcatgcaggcactgtggctgtacatcaagcacaatcaactgcaggacgggcatgagcgcgagtatattaattgcaatcgatacttccggcaaatcttttcatgtggcagattgcggtttagcgaaatccctatgaaactggccggtctcctgcagcatcctgaccctattgtgatcaatcacgtgatcagtgtcgatcccaacgatcagaaaaagacagcctgctacgatatagatgtggaggttgatgatcctcttaaggcccagatgagtaattttctcgcctccaccaccaaccagcaggagatcgcctccctggacgtcaaaatccacgaaacaattgagtccatcaatcaactgaaaacccagagggattttatgttaagcttttcaacagacccacaggacttcattcaggagtggcttcgatcacagcgaagggatctcaagatcatcacagacgtcataggaaatcccgaggaggaaaggcgagctgctttctatcatcagccctgggcccaggaggcagtggggaggcatatttttgcgaaggttcagcaacggagacaagagttggaacaggtacttgggatccgcttgacctag

SEQ ID NO: 136791 - DNA, 1596 bp, Artificial Sequence
  Description of Artificial Sequence: Synthetic coding sequence
atgtcgggtagaggcgccggtgggtttccattacctccactgtccccaggcggcggcgccgttgcagcagctctcggagcccctccacctccagctggccccgggatgcttcccgggcccgcattgcgcggacccggaccagctgggggcgtcggcggacccggggccgccgcattccggccaatgggccctgccggccctgctgctcagtatcagaggcccggaatgtctcccggtaatcgcatgccgatggctggtctgcaggttgggccaccagccgggtcaccattcggcgcagccgctccattaagacctggaatgccaccaacaatgatggaccccttcagaaagcgccttctggttccacaggcacagccgcccatgcctgcacagcgacggggcttaaaaagacgaaaaatggccgacaaggtgctgccccagagaatcagggaactggttcccgagagtcaggcgtacatggatctgctggcatttgaaagaaagctcgaccaaactatagcccgaaagcgcatggagatacaggaggccattaagaaaccgttaacccagaagagaaagttacgcatctacatctcaaacacatttagtccctcgaaggctgaaggtgacagcgccggtactgcaggaaccccaggcggcaccccagctggggataaggttgcctcctgggaactgagggtggaaggaaagctcctggatgatccctctaaacagaaaagaaagttcagctcattcttcaagagcctggttatcgaattagataaagaattgtatgggcctgataatcatctggtggagtggcatagaatgccaacaacgcaggagacggacgggtttcaggtcaaaaggcccggggacctgaatgtgaagtgcacccttcttcttatgctcgaccaccagccacctcagtataagctggatcccagattggccagacttctcggtgtgcatacgcagacacgcgccgccatcatgcaggccttgtggctgtacatcaaacataaccagcttcaggatggccatgagagggagtatattaactgtaaccgctattttagacaaattttttcttgtggccgactacggttttccgagattccaatgaaacttgctggcctgctccagcaccccgatcccatcgtgatcaaccatgtaatcagcgttgatcccaatgatcagaagaaaacggcttgctacgatatagatgtagaggtcgacgatccacttaaggcccaaatgtcaaacttcttagcctctacaactaaccagcaagaaatcgccagcctcgacgtgaaaatccacgaaacaatcgagtcgataaaccagctaaagacgcaaagagattttatgctctccttctccaccgacccccaggacttcattcaggagtggctgaggtcacagagaagagacctcaagatcatcaccgacgtcattggcaatcctgaagaagaacgtcgggcagccttttaccatcagccctgggcacaagaagccgtcggccggcacatctttgcgaaagtgcagcagcgcagacaagaactggagcaagttctcggcatcagactgacctag

SEQ ID NO: 136792 - DNA, 1485 bp, Artificial Sequence
  Description of Artificial Sequence: Synthetic coding sequence
atgtccggtaggggcgctgggggcttccccctgcccccgctgagtcccggtgggggggccgctttcagaccgatgggacccgccgggccagccgctcagtaccagcggcctgggatgtccccaggcaatcgaatgcccatggccgggctgcaggtcggtccgccggcaggttctccgttcggcgctgccgcccctcttcgccccggtatgcctcctaccatgatggaccccttccgcaagagactgctcgtcccccaggcccaaccgccgatgcccgctcagaggaggggcctgaagagacggaaaatggccgacaaggtcctgccgcagcgtatacgggagctggtgcccgaaagccaagcttatatggatctgctggcattcgaacgcaaattagatcagactattgccagaaaaaggatggagatacaagaggccatcaagaagccgctgactcagaaaagaaagttacgaatttatatcagtaacaccttttcccctagcaaagcagaaggcgatagcgcggggactgctggaacacctggaggaactccagctggtgacaaggtagcttcatgggagctgcgagtggaaggaaagctacttgacgacccttcaaagcaaaagcgcaaatttagtagcttcttcaaatctctggttattgaacttgacaaggaactctacgggcctgacaatcatctggttgagtggcatcgaatgcctacgacacaggagaccgacgggttccaagtgaaacgccccggcgatttaaatgtcaagtgtactctgttattgatgctggatcatcaaccacctcagtacaaactggatccaaggctggcgaggctgttgggcgtccacactcaaaccagagccgcaatcatgcaggccctctggttgtacatcaagcataatcagcttcaggacggacacgagcgcgagtatatcaattgcaacaggtatttccgtcagatcttctcttgtgggagactccggttttccgagatccctatgaagttagccggcctgctgcaacatccggacccaattgtaattaaccacgtgattagtgttgatcccaatgatcaaaagaagacagcatgttatgacattgatgttgaggttgacgaccctcttaaggcgcagatgtccaacttcctggcgtccacaacaaatcaacaagagattgcatcgttagatgtcaagatccatgagactattgagtcaatcaaccaacttaagactcagcgggatttcatgctgtcatttagcactgaccctcaggattttattcaggaatggctccgctcccaaagaagagacctgaaaatcattacagacgttataggaaaccctgaagaagagcgcagggctgcgttttatcatcagccctgggcacaagaagccgtggggcgacatatctttgctaaagtgcagcaacgccggcaggagctggaacaggtgttgggtattagactgacttag

SEQ ID NO: 136793 - DNA, 1452 bp, Artificial Sequence
  Description of Artificial Sequence: Synthetic coding sequence
atggctgccgacgaagtggccggaggagcccgcaaagctaccaagtctaagctatttgagtttcttgttcacggagtgcgccccggaatgccaagcggggcccgaatgcctcaccagggagcccctatgggacccccaggctctccttatatgggctcgccagccgtgaggcccggacttgcgcctgccggtatggagccagctagaaagcgagcagcccctcccccaggccagtcccaagctcaatcccaggggcaacccgtgcctacagcacccgcaaggtctaggtctgcgaagcgaaggaaaatggcagacaagatcctgcctcagcgaatccgcgaactagtgccagaaagccaggcatacatggatctcttagccttcgagaggaaactggaccagacgataatgcgtaagcgggttgatatccaggaggctctgaaaaggccaatgaagcagaagcggaaactgagattgtatattagtaacactttcaatcccgcaaagccagacgcggaagatagcgacggctccattgccagctgggaactccgggttgaagggaagttgctcgacgacccaagtaaacagaaacgtaaatttagcagctttttcaaatctctcgtgatcgaactggacaaagacctgtatggtcccgacaaccacctggtggagtggcatcggacgcccacaacccaggagacagacggctttcaggtaaaaaggccaggcgatctttcggtccgatgcactctgttgctgatgctcgactatcaacccccacagttcaaactcgatcctcgcctcgcgagactcttgggactgcacactcagtcccgtagtgccattgtacaagcactgtggcaatatgtgaagacaaacagactgcaggatagccatgacaaagagtatatcaacggcgataaatactttcagcaaattttcgattgtccccgccttaaattctctgaaatcccccagcgcttaactgctctactgttgcctccagatcccatcgtgatcaaccatgttatcagcgtggatccaagtgaccagaaaaagacagcttgctacgatattgacgtggaggttgaggaacccctaaagggtcagatgtcttcattcctcttatcaactgctaaccagcaggaaatcagtgcgctcgactctaaaattcatgagactatagagtctatcaaccagctgaagattcaacgggatttcatgctgagtttttcacgcgacccaaagggatatgtgcaggatttgctgcgctcccaatccagggacttgaaggttatgacagacgtcgctggcaatcccgaagaagaacgtagggccgaattctatcatcagccttggagtcaagaagcagtgtctcggtatttctactgcaagatccaacaaaggcgtcaggagctagaacagtccctcgtggttaggaacacatag

SEQ ID NO: 136794 - DNA, 1308 bp, Artificial Sequence
  Description of Artificial Sequence: Synthetic coding sequence
atgactcccggcctccaacacccaccaacagtcgtccagcggccggggatgcctagtggagccaggatgcctcatcagggcgcccctatgggaccccccgggtcgccgtatatggggtcccccgcagccccagctcggagccggagtgccaaaagaaggaagatggccgataaaatcctgcctcaaaggattagagaactggtgcctgaatcccaggcttacatggacctgttggcctttgaacggaaactggaccagacgattatgcgaaagcgggtggacatccaggaagcactgaagcgccctatgaagcaaaaacgaaaactccggctctatataagcaatacatttaatcctgccaagccagacgccgaagatagtgatgggtccattgcctcctgggaactcagagtggagggaaaactgctggacgatccctcaaaacaaaaaaggaaattcagttcatttttcaagagtcttgtgattgaattggataaggatttgtatggaccagataatcacctagtggaatggcacaggactcccactacacaggaaaccgacggtttccaagtgaaaagacccggagacttgagtgtgcggtgtaccctgctgttaatgctggactaccagccccctcagtttaaactggatcccaggcttgccaggctgttgggacttcatacacagtctcgaagcgcaattgttcaggcactatggcagtatgtgaaaacaaatcggctacaggattctcatgacaaagagtacataaacggtgataaatactttcagcagatatttgactgtcctcggcttaaattcagcgagatcccccagcggctcaccgcattgctcctgcccccagatcccattgttattaaccatgttataagcgttgacccttccgaccagaaaaagactgcgtgctacgacatcgatgttgaagtggaagaacctctaaagggccagatgtcttctttcctgctttctacagcgaaccaacaggaaatcagcgcccttgatagtaaaatccacgaaactattgagagtattaatcagctgaaaatacagagggacttcatgctgagtttttctcgcgaccctaagggttacgtgcaagacttactccgatctcagtcacgggatcttaaagttatgactgatgtcgccggcaatcctgaggaagaacgccgggctgagttttaccaccagccatggtcccaagaagctgtgtcaaggtacttttactgtaaaatccaacaaagacgccaggagctcgaacagagcctcgttgtgagaaacacttag

SEQ ID NO: 136795 - DNA, 1413 bp, Artificial Sequence
  Description of Artificial Sequence: Synthetic coding sequence
atgacaccaggcctgcagcacccccccacggtggttcagcgtccgggcatgcctagtggggcacggatgccacaccagggagccccaatgggtcccccaggcagcccttatatgggatcccctgcagtgaggccaggactggcgccagccgggatggaaccagcaagaaaacgcgcagctccacctcccggtcagtcccaggctcagtcgcagggtcagccagtgcccactgccccagccagatctaggagtgcaaagcgccgcaagatggctgataagatccttccacagagaattagggaattggtgccagagtctcaagcatatatggatctgctcgccttcgaacgcaagctggatcagacaatcatgcgcaagcgcgttgatatccaggaagccctgaaacgtcctatgaaacaaaaacgtaagctgagactttatattagcaatacattcaatccagccaagcctgatgccgaggatagcgacggcagcatcgcatcttgggaactgagggtggaagggaagctccttgacgacccaagcaagcagaaaagaaagttttccagcttctttaaaagtttggttattgaactggacaaagacctttatgggcctgacaatcatctcgtcgaatggcaccgaacaccgaccacccaggaaacggatggatttcaggtcaaacgacccggagaccttagcgtgaggtgcaccctgcttttgatgctagactatcagcccccacagtttaaactggacccacgtctcgcaagattactgggactgcatactcaaagtcggagtgccatagtgcaggcactgtggcagtacgtaaaaactaaccgcctccaggacagtcatgacaaggagtacatcaatggtgacaaatatttccagcaaatctttgattgcccccggttaaagttcagcgaaatcccacagcgtctgaccgccctgctcctccctcccgaccccatcgtgatcaaccacgtgattagtgtcgatccgtccgatcagaagaaaaccgcctgctacgacatcgatgtcgaggtggaagagcctctgaaaggccagatgtcctcttttctgcttagcaccgccaatcagcaggagatttccgccttggattcgaagatacacgagacaattgagagcattaatcagctgaagatccagcgcgattttatgttgtcatttagcagggacccgaaaggctatgtacaagatctcttgagatcacagagtcgtgacttgaaagtcatgaccgatgtcgctggaaatcctgaggaggaacggcgggctgaattctaccaccagccctggtcacaggaggctgtgtctagatacttttattgtaagatccagcagagaaggcaagaattggaacaatcgcttgtcgttcgcaacacttag

SEQ ID NO: 136796 - DNA, 1413 bp, Artificial Sequence
  Description of Artificial Sequence: Synthetic coding sequence
atgacccctggactgcaacacccgccaactgtcgtacagaggcccgggatgccatccggtgccaggatgccccaccagggagcccccatggggccacctgggtccccttacatgggatctccagccgtcagacctggccttgcacctgccggtatggagccggcccgaaagcgggccgcacctcccccaggccagagccaggcgcagtcgcaaggacagccagtcccaaccgctcccgccagaagtcggtcagctaagagacgcaagatggcagataaaattttacctcagcgcatacgcgagctagtccctgagagccaggcctacatggatctgctggcctttgagagaaagctggatcaaaccattatgaggaaaagggtggatatccaggaggcactgaagcgtcctatgaaacagaagaggaagttgagactctacatctctaatacatttaacccagcgaagcccgatgccgaggatagtgatggctcaattgcctcctgggaactcagagtggaaggcaagttgctcgacgaccctagcaaacagaagagaaaattttcgtcattttttaagtcactagtgatcgaactggacaaggacttatacggacctgacaaccatttagtggagtggcaccgaaccccaacaacacaggagacagatggatttcaagtgaaacgcccaggtgacctgagtgtgaggtgtacgctgttgctaatgctcgactaccagcctccccagttcaagctagatccgcggctcgcgcggctcctgggtctccatacccagtctaggagtgccattgtccaggctttatggcagtatgtgaaaacaaacagactccaggactctcacgataaggagtacatcaatggggacaagtacttccaacagatttttgattgtccacgtctgaagttttcagagattccccagagattgaccgcccttttattaccccccgaccccatagtcattaaccacgtcatcagcgtcgacccctctgatcagaagaaaaccgcttgctatgacatcgatgtagaggtagaggagcccctcaagggccaaatgagctctttcctgttatcaacggcaaatcagcaggagatcagtgctctggattcaaaaatacacgagaccattgagagcatcaaccagttgaaaatccagcgtgattttatgctgtcctttagtagggaccccaagggatatgtacaggatttgctgcggtcccagtcaagggacttgaaagtaatgaccgacgtggcagggaaccctgaggaagaaaggcgcgccgagttttatcaccagccatggagtcaagaggcagtgtcccgctacttctattgcaaaatccagcagaggagacaggaactcgaacagtccctggtggtgagaaacacctag

SEQ ID NO: 136797 - DNA, 420 bp, Artificial Sequence
  Description of Artificial Sequence: Synthetic coding sequence
atgactccagggcttcagcacccaccaacagtggtgcaacggccaggtatgccatccggcgcacggatgcctcatcagggggcccctatgggaccacccggttctccatatatgggcagccctgctgtcagaccggggctggctccggccggcatggaaccggcccgcaagcgcgccgcacctccaccgggacagtcgcaggctcagtctcagggacagccagtccccactgcaccggccaggtcccggagtgccaaacgcagaaagatggctgacaagatcctgccacaacgaatcagggagctagtcccagagagtcaagcttatatggacttactagcattcgaacgaaaattggatcagactattatgaggaagagggtagatatacaggaagccctgaagagaccgatgaaatag

SEQ ID NO: 136798 - DNA, 3081 bp, Artificial Sequence
  Description of Artificial Sequence: Synthetic coding sequence
atgaacctgttcaaccttgatagatttcggttcgaaaaacgcaataagattgaagaggcccctgaggccacgcctcagcctagccaaccaggcccttcttcccctatttccctgtccgccgaggaggagaatgccgaaggcgaggtctctcgtgctaatactccagacagcgatataaccgagaagaccgaagacagctcggtgcccgaaactcccgataacgagaggaaagcatctatcagctactttaagaaccaaagagggatacagtatatcgatctgagtagcgatagtgaggacgtggtgagtcccaattgctcaaatacagtgcaagaaaagacttttaataaagacactgtgatcatagtatccgaaccctcagaggatgaagagtcgcagggcctccccactatggctcgtcggaatgatgacataagcgagctcgaggacctttcggagctcgaggaccttaaggatgcaaaactccagactcttaaagagttgtttccccagcgttctgacaacgacctgctgaaactcattgagagcacatcaacaatggacggagccatagccgcagccctgctgatgttcggggatgccggggggggccctaggaagcgcaagctttcttcttctagtgagccatacgaggaagatgagttcaacgatgaccagagcatcaagaagacaagactggatcatggggaggagtcaaatgagtccgccgaaagcagcagtaattgggaaaagcaggagtccattgtcctgaagcttcaaaaggagtttccaaactttgataagcaggaactcagggaggtgctcaaggaacatgaatggatgtataccgaggccctcgagtcccttaaggtttttgctgaggatcaggacatgcagtacgtgtcccaaagcgaggtgccgaatggcaaagaagtaagctcaagatcgcagaactatcccaaaaacgccactaaaactaaactcaaacagaaatttagtatgaaggctcagaacggctttaacaaaaaacggaaaaagaacgttttcaacccaaaaagggtggtcgaagattccgagtatgactccggttctgacgtgggatcaagtctggacgaagactactctagcggagaggaggtcatggaggatggttataaagggaagatactgcatttccttcaggatgccagtatcggagaactgacgttgataccgcagtgttctcagaagaaggcccagaaaataaccgagctccgccccttcaactcctgggaggcgctgttcactaagatgtccaagacaaatgggctgtctgaggatctaatctggcattgtaaaacactcatacaggaaagagacgtcgtaatacggctgatgaacaaatgcgaggatataagcaacaaactcacgaaacaggtcactatgctcacagggaacggcggcggatggaatatagagcagccttcgatactaaaccagagcctctcacttaagccctatcagaaggtagggctaaactggctggccctcgtccataaacacggcctaaatgggattctggctgacgagatgggtcttggcaaaacaatccaagccatcgccttcttggcttatttgtatcaggaaggcaataatggaccccatttgatcgttgtgcctgcaagcactattgacaattggctgcgggaagtgaacctgtggtgtccaacacttaaggtgctctgttattacggatctcaggaggagaggaagcaaatccgcttcaatatccatagccggtatgaagattacaatgtgattgtcacgacttataattgcgccataagcagtagcgatgaccgcagcctgtttcgcaggctaaagcttaattacgccatatttgacgaagggcacatgctgaagaatatggggagcatacggtaccagcatctgatgacaatcaacgcgaataaccggctacttctaacgggaaccccagtccagaacaatcttttagaactgatgtccttacttaacttcgttatgccacacatgtttagctccagtacatctgaaattcgaagaatgttcagttctaagaccaaatccgccgatgagcaaagcatttacgaaaaagagcggattgcccacgctaagcagataatcaagccatttatcttacgacgagttaaggaggaagtgttaaaacagctgccgcccaagaaggataggatcgagttatgcgctatgagcgagaaacaggaacagttgtatttaggcctgttcaatcgactgaagaagtcaatcaacaatcttgagaagaacacggagatgtgtaacgtgatgatgcaattgagaaagatggcgaatcacccactgcttcaccggcagtactacactgctgagaaactcaaggagatgtcccaactgatgctgaaggagcctacccattgcgaggctaatccggacctcatcttcgaagatatggaggtcatgacagattttgagctccacgttttatgcaaacagtacaggcacataaacaacttccagcttgatatggacctgatattagacagcggcaagtttcgggtgttgggatgtatcctgtctgaactcaagcagaagggcgacagggtggtgctgttctctcagtttactatgatgcttgatattctggaggtgctgctgaagcaccaccaacaccgatacttacgtcttgacggtaagacgcagattagtgaacgaatccatctgatagatgaatttaacacggacatggatatttttgtgttcctcctttccaccaaagctggcggactgggcattaacctgacctctgctaacgtggtcatattgcacgacattgactgcaacccatacaatgacaagcaggccgaagaccgttgccatcgggtgggccagacaaaggaagtgctggtgattaagctcataagtcaggggacaattgaggagagtatgctgaagattaaccaacagaagctgaagcttgagcaggacatgaccaccgtagacgaaggggatgaaggctctatgcccgccgacatcgctactttgctcaagacatcgatgggcctctag

SEQ ID NO: 136799 - DNA, 3087 bp, Artificial Sequence
  Description of Artificial Sequence: Synthetic coding sequence
atgaacctgtttaacttagataggttcagatttgaaaagagaaacaagatcgaggaggcaccagaggccacaccacagccctctcagcccggcccttcctctcccatcagtttgtcagccgaggaagagaacgcagaaggggaggtgagcagggctaatacacccgactctgatatcactgagaagaccgaggattcaagtgtaccagagacccccgacaacgaacggaaagcgtcaatctcatacttcaagaaccagcgggggattcagtatattgacttaagcagcgatagcgaggatgttgtgagtcccaactgctccaacactgtgcaggagaagacgttcaacaaagacacagtgatcatcgtatctgaaccgtcagaggatgaggaatctcagggtttgcccacaatggctcgccgtaacgacgacatctccgagttagaggatttatctgaactcgaagacttaaaggatgcaaaactccaaaccctcaaggaactgttcccccagaggtctgacaacgacctcttaaagctgattgagtcgacctctacgatggacggggctattgctgccgccttactaatgttcggagatgctggcggaggacctagaaaacggaagctgtccagcagttcagaaccgtatgaggaggacgagttcaacgatgaccagtctattaagaagacccggctggatcacggagaggagtcaaacgaatccgctgagagcagcagcaattgggagaagcaggaatcaatcgtacttaaactccaaaaggaattcccaaatttcgataaacaggagctaagagaggttcttaaagaacatgaatggatgtacacagaggccctggaaagtctcaaggtctttgccgaggaccaagatatgcagtacgtgtcccaaagcgaggtccccaacgggaaggaggtaagttcccggtcccagaactaccccaaaaacgcaacaaaaaccaagctgaaacaaaaatttagcatgaaagcccagaacggttttaacaaaaagcgcaagaaaaacgtttttaaccctaaaagagtcgttgaggattccgagtacgattctgggtcagacgtgggctcaagtctggatgaggactactctagcggtgaagaagtcatggaagacggttacaagggcaagattctgcacttcctgcaggatgcctccattggagagttgactttgatcccccaatgttcccagaagaaggctcagaagatcaccgagcttcgacctttcaattcctgggaggctctgtttacgaagatgagtaaaaccaacggcttaagtgaggatttgatctggcattgtaaaacactgatacaggagagggatgttgttatcagactcatgaataagtgcgaagatatctctaataaactgacaaagcaggttaccatgcttaccggtaacggcggcgggtggaatatagaacaaccaagcatcttgaaccagtccttgtccctgaagccctaccagaaagtcgggcttaactggttggccctcgtacacaagcacggcttgaatgggatccttgctgatgagatgggactgggtaaaactattcaggccatcgcctttctggcctacttgtaccaggagggcaacaatggcccacatctgattgtcgtccctgctagtacgattgacaactggctcagggaagtcaatctgtggtgccctaccctgaaggttctgtgttattacggcagccaggaagagcgcaagcaaatcaggttcaatatccactctcgttatgaggattataatgttatcgtaactacatacaactgtgccatctcgtcttccgacgatcgaagcctctttaggcgtctgaagctaaactacgccattttcgatgagggtcatatgctgaagaacatgggctcaatcagatatcagcatctgatgacaatcaatgctaataatcggctgctgctaacaggaactcccgtgcaaaacaacctgttagagctgatgtctttactgaacttcgtcatgcctcacatgtttagttcttccaccagcgagattaggagaatgttctcttcgaaaacaaagtctgccgacgagcaatcgatctatgagaaagaaaggattgctcacgcgaaacagattattaagccattcatccttcgtcgtgttaaagaggaagtgctcaagcagctacccccaaaaaaggatcgtattgaactgtgcgcgatgtccgaaaaacaggaacaactgtacctgggactcttcaaccgactgaagaagtccattaataatcttgttactgaaaagaataccgagatgtgtaacgttatgatgcagctacggaaaatggcaaatcaccccctgctccaccggcagtactacacagctgaaaagctgaaagagatgtcccaactgatgcttaaggagcccacccattgcgaggccaaccccgacctgatcttcgaggacatggaagttatgaccgactttgaactgcacgtgctttgtaagcagtatagacacattaacaatttccagctcgatatggatcttatactcgactcgggcaaattccgggtactcggttgtatccttagtgagctgaaacaaaaaggagaccgcgtggtgttgttcagtcagttcacaatgatgttggatatcctggaggtgctacttaaacatcaccagcatcgatatctcaggctggatggtaagactcagatttccgagcgcattcacctgatcgacgagttcaacaccgacatggacatatttgtgtttcttctctctaccaaagcaggaggcctcggtatcaatctcacaagcgccaacgtggtgatcctccacgatatcgactgtaacccgtataacgataaacaggctgaagatagatgccacagggtcggtcaaacaaaggaagtcctggtcataaaactaattagccagggcaccatagaggaatctatgctgaaaatcaatcaacagaagctcaagctggagcaggatatgaccaccgtcgatgaaggggacgaaggaagcatgccagctgacatcgctaccctacttaaaacctccatgggcttgtag

SEQ ID NO: 136800 - DNA, 3087 bp, Artificial Sequence
  Description of Artificial Sequence: Synthetic coding sequence
atgaatctcttcaacctggatcggtttaggttcgagaaaaggaacaaaattgaggaagctcctgaggccacaccgcagccctcacaaccagggccatccagtcccatttctctgtctgccgaggaagaaaatgcggagggcgaagtcagccgcgccaacacgcccgatagtgatattactgagaagactgaagattccagcgtgccagagaccccggacaatgagcgtaaggcaagcatttcgtacttcaagaatcagcgcggcattcagtacattgatctgagtagtgatagcgaagacgtggtatcccccaattgctccaataccgtgcaagagaagaccttcaataaggacaccgtaattatcgtctccgaaccctctgaagacgaagagtctcaggggctgcctaccatggcacgccgaaatgatgatattagcgaactggaggacttatccgaactggaggatctcaaagatgccaagctgcagacactcaaagagctgtttccgcaaagaagtgacaacgacttgcttaagcttatcgaaagtaccagtactatggatggtgccatcgctgccgcactactgatgtttggggacgcaggcggcggccctagaaagcggaagctctcctcaagctccgaaccatacgaagaggatgagttcaacgatgaccagtccatcaagaagactcggctggatcatggggaggaaagcaacgaatccgcagagtcctcatccaactgggagaagcaggaatccattgtgttgaaactgcaaaaagaatttcccaatttcgataagcaggaacttcgcgaagtccttaaggagcatgagtggatgtatacagaagccctcgaaagtctgaaggtgtttgctgaagaccaggatatgcagtacgtcagtcaatcagaagtccccaatggcaaggaagtctcttcccgcagccagaattatcctaaaaacgccaccaaaacaaagttgaagcagaaattttccatgaaagcccagaacggatttaataagaagaggaagaagaatgtcttcaaccctaagcgtgttgtcgaagactctgagtatgatagcggtagcgatgtcggatctagtttagacgaggactactcctccggcgaagaagtgatggaggacgggtataagggaaagatcctgcatttcctacaggacgccagtattggagaacttaccctgattcctcagtgcagccaaaaaaaggctcaaaagataaccgagctgcgacccttcaactcctgggaagccctcttcacgaagatgagcaagaccaacggcctgtccgaggatctgatttggcattgcaaaactctcatccaggaaagggatgtggttatcagactcatgaacaaatgcgaggacatctccaataaactcaccaaacaggtcactatgctgacaggaaacggcggcggctggaacatcgaacagccctctatcctgaaccaatccctgagtctgaaaccatatcagaaagtgggcctcaactggctggcactggtccacaagcacggacttaacggcattctcgccgacgagatgggtctcggtaaaaccatccaggccatcgcattcttggcttacctttaccaggagggcaacaatggcccacatctaatagttgtgcccgcaagtaccattgacaactggctccgggaagtcaatttatggtgccctactctgaaggtgctgtgttactatgggtcccaagaagagaggaagcagattaggttcaatattcactctagatatgaagattacaacgtgattgttactacatacaactgcgctatctcatcaagcgatgacagaagtctgtttcggcgtctgaagctgaattatgcaatcttcgatgaaggacatatgctcaaaaatatgggaagcattagataccagcaccttatgaccattaacgccaataataggttactgctgacgggcaccccggtccagaataatctgctggagctcatgagcctcttgaattttgtcatgccacacatgttttccagcagcactagtgagatccgccgaatgttttccagtaagacaaaaagtgcagacgaacagtctatatatgaaaaagagcgtatcgcgcatgcgaagcagatcattaagcccttcattttgcgtagggtgaaggaggaggtactcaagcagctccctcctaagaaagacaggatcgagctatgcgctatgtctgagaaacaggagcagctgtatctgggactcttcaacagattgaaaaagtctatcaacaacctggtgacggagaagaataccgagatgtgtaacgtgatgatgcagctgaggaaaatggcaaatcatcctttgctgcatcggcagtactacacagcagagaaactgaaggagatgagccagctgatgttgaaagagcctacccattgcgaggccaaccccgatctgatatttgaagacatggaagtcatgactgatttcgagcttcatgtactgtgtaagcagtaccggcatattaacaatttccagctggatatggatctgatcttggactctggaaagttcagggtgctagggtgcatcctttccgaactcaagcagaagggggacagagtagtactattctctcagtttaccatgatgctggacatcctggaggtgctactcaagcatcaccagcaccgttatttacgtttagacggtaaaacccagatctcggaaaggatacaccttatagatgagtttaacaccgacatggacattttcgtctttttgctgtccacaaaagcggggggtctgggcatcaatctgacttccgccaatgtggtaattctgcacgatatagattgtaatccctacaacgacaagcaggccgaagatcgatgtcatcgggtagggcagaccaaagaggtgctcgtcattaaactgattagtcagggaactatagaggaaagtatgctgaagattaaccagcaaaaattgaagttggaacaagatatgaccactgtggatgagggcgacgaagggtccatgccagctgatatcgccacactgcttaaaacatccatggggctgtag

SEQ ID NO: 136801 - DNA, 957 bp, Artificial Sequence
  Description of Artificial Sequence: Synthetic coding sequence
atgaatctgttcaacctagatagattccgctttgagaagcggaacaagatcgaggaggcgccggaggctacaccgcagccgagccaacccgggccgtccagtcccatctcactgagcgccgaagaagagaacgcggaaggggaagtctcacgggccaacactcctgacagcgacattacagaaaaaactgaggactctagtgtgcctgaaacccctgataatgagaggaaagcctcaatctcgtactttaagaaccagcggggcatccagtatatcgatttaagttctgacagcgaagatgtggttagtcccaactgctcgaacactgtgcaagagaaaacgtttaacaaggacactgttattattgtgagcgagcctagcgaagatgaggagtctcaaggactccccaccatggctagacgaaacgatgacatctccgaactggaggatctctccgaactggaggacctcaaagacgcaaagttgcagacactgaaggaactgttcccacagcggtccgacaatgacctcttaaaactgatcgagtccacttcaaccatggatggagcaatcgctgctgccctgctgatgtttggcgacgccggaggcgggcctcggaagagaaaactgtccagtagctcagagccctatgaggaggacgagttcaacgacgaccaatccattaagaagacacgactggatcacggggaggaaagtaacgagagtgccgagtcctccagcaactgggaaaaacaggagtccatagtcctaaaacttcagaaggagtttcctaacttcgataagcaggagttgcgggaagtcctgaaagagcacgagtggatgtacaccgaggccctggaatccctgaaagttttcgccgaagaccaggacatgcagtacgtttctcaatccgaagtgccaaatgggaaaaagaaagcccagaagaaaaagaagtag

SEQ ID NO: 136802 - DNA, 732 bp, Artificial Sequence
  Description of Artificial Sequence: Synthetic coding sequence
atggctgccattgcggccagcgaagtgctggtggattctgccgaagagggaagtctggctgccgccgccgagctggctgctcaaaagcgggaacagaggctccgaaagttccgggagctacacctaatgaggaatgaagctcggaaactgaaccaccaggaagtggtggaagaagacaagcgtctcaagctgcccgcgaattgggaggcaaaaaaggcccgcctcgagtgggaactcaaggaggaggagaaaaaaaaagaatgtgcagcaagaggcgaagactacgaaaaggtgaaactgctggaaatatctgctgaggatgccgagcgttgggagcgcaagaagaagcggaagaaccccgatctgggtttttccgattacgcagccgcgcagcttaggcagtatcacaggctgaccaaacagatcaaaccggatatggagacatatgaaaggctccgcgagaagcacggcgaagagttttttcccacatccaatagcctgttgcatggtacgcacgtcccatctactgaggagatcgataggatggtgatagacctggaaaagcaaatcgaaaagcgggacaagtatagccgaaggagaccttataatgacgacgcggacattgactatattaatgagcgtaacgcaaaatttaataagaaagccgaacggttctacggaaagtacacggcggaaattaaacagaacctcgagaggggaactgcagtgtag

SEQ ID NO: 136803 - DNA, 606 bp, Artificial Sequence
  Description of Artificial Sequence: Synthetic coding sequence
atggcagctatcgccgccagtgaggtgctcgtggactctgcagaagagggaagtctggctgccgcggccgagctggctgcccagaagagagagcagagattacgaaagtttcgggaattgcatctaatgagagaatgtgccgcccgcggagaagattacgagaaggtgaagctgttagagatctccgcagaagatgccgagcgatgggagcggaagaagaaaaggaaaaatcctgacttaggcttttctgactatgccgcagcccagcttagacagtaccacagactgacaaagcagattaagccagacatggaaacctacgagaggctgagggaaaaacacggagaagagttcttccctacaagtaactccctcttgcacggaacccatgtacccagcacagaagaaattgatagaatggtgatcgacctggagaaacagattgagaagagggataagtactcacgacgtaggccatataacgatgatgccgatattgactacataaacgagaggaatgcgaaattcaacaaaaaagcggagcggttctacggcaaatatacagccgaaattaaacagaatctggaacgcggcactgccgtgtag

SEQ ID NO: 136804 - DNA, 777 bp, Artificial Sequence
  Description of Artificial Sequence: Synthetic coding sequence
atggatggcattatagaacaaaagtcaatgctggtgcatagcaaaatcagtgatgcaggtaagcgaaatggccttataaatacacgcaatctgatggccgaatctagggatggccttgtcagtgtgtatcccgcgcctcagtaccaatcgcacagagtcggcgcatccactgtaccagcctctctggacagctcacgttctgaacccatgcagcagcttctggatcccaacactttgcaacagagcgtagaatctaggtatcggccaaatattatcctatactcggagggcgtcttaagaagttggggggatggagttgccgcagactgttgcgaaaccactttcatcgaggaccgctctccaactaaagactctctagaatatcctgatgggaagttcattgacctgagtgcggatgacattaagatacataccctgagctatgacgtcgaggaagaggaggagttccaggaacttgaatcagactattcctctgatacagaaagtgaagataacttccttatgatgccccctcgggaccatcttgggcttagtgtgttttccatgctatgctgcttctggccactgggtattgcagctttctacttatctcatgagaccaacaaggccgttgctaagggtgaccttcaccaggccagcacatcatcccgtcgggctttgttcttagctgtgctctcgatcactatcggcaccggcgtgtacgtgggtgtcgccgttgccctgatagcttatcttagtaagaataatcatctttag

SEQ ID NO: 136805 - DNA, 717 bp, Artificial Sequence
  Description of Artificial Sequence: Synthetic coding sequence
atggaaagcctgtcggagctgcaaaatcctttgcttccaaggtctcctgcgcaccttcacggaccgtatccgtaccctgaaaccccgccttcatggtcatgccaagaaaagctgtatagctatttgctggggggcgctgggcccgcaggcgcacatcagttattggacccaggaagtctccaactcgcagtcgaagcctggtacaggccctcctgcctgttgggccgcgacaaggtgaaagaacccagagccgggtcttgcgaaactagctttacagaggaccgagaaccccaggagggtccaccagagcagccgactgggccaggacaggccgcggaaaacgtcaccatccaaacagtgagttacggagtgcaggaagaactgcgcgatcaggaagatgaccaagaagaggaggagtcagacgccacatccactgaatcggaaagcgaggataacttcctcacacttcctccacgcgatcatcttggcctgaccttattctcaatgctctgctgcttttggcctcttggaatcgccgctttctatttctcccagggcacctctaaggctatttctaagggggactttaggcttgccagtacaaccagtagacgcgccctgtttctggccaccctagcaatcgccgtgggcgcgggactctatgtcgccgttgttgtggccctcgctgcctatatgtcccagaatggtcacggatag

SEQ ID NO: 136806 - DNA, 717 bp, Artificial Sequence
  Description of Artificial Sequence: Synthetic coding sequence
atggaaagtctgagcgaactgcagaacccactccttcctcgttctccagcccacttacacggtccttatccctaccccgaaacccccccttcatggtcctgtcaagagaaactttatagctatctcttgggaggcgctggaccggccggggcccaccaactgctcgaccccggctcattgcaactggctgtcgaggcatggtaccgccctagttgtctgctgggacgggataaagttaaagagccccgggcaggatcttgcgaaaccagctttacggaagaccgcgaaccacaggaggggccacctgagcagccaacgggaccagggcaggccgccgagaatgtgacaatccagacggtatcctacggggttcaagaggagctacgtgatcaggaagatgaccaggaggaggaggaatcagatgcaaccagtaccgagtctgagtctgaggacaattttcttaccttaccccctcgggaccacttgggcctcactttgttcagcatgttgtgttgtttctggccgttggggattgcagcgttctactttagtcaaggaacgtcaaaggccatcagtaagggcgactttcggctcgctagcactactagcagaagagctctgttcttggccacactggccattgcagttggcgccggcctgtatgtggccgtcgtggtagctttagcggcatacatgtctcagaatggtcatggttag

SEQ ID NO: 136807 - DNA, 243 bp, Artificial Sequence
  Description of Artificial Sequence: Synthetic coding sequence
atggagagcctgagtgaactgcagaaccccctattaccccgctcaccagcacatctgcacggaccctatccttaccccgagacccctccgagttggagttgtcaggagaagctatacagctatctcctcgggggcgccgggcccgccggtgcacatcaactcctagaccccggatctctgcaactagcggtggaggcttggtaccgtccatcctgtctcctcgggcgggacaaggtgaaatag

SEQ ID NO: 136808 - DNA, 2118 bp, Artificial Sequence
  Description of Artificial Sequence: Synthetic coding sequence
atgaattatctgagaagacggttatccgatagtaactttatggccaatctgcccaatggctatatgaccgaccttcagcggccccagcccccaccacctcccccaggcgctcactctccaggcgccacacctggtcctgggacagctaccgctgaacgatccagcggcgtcgctccagcagctagccctgccgcaccatcacctggcagctccggagggggaggttttttttctagtctcagtaacgccgtcaaacagactacggctgctgccgccgcgactttttccgagcaggttggtggaggctccggtggagccggccgaggaggcgcagcttcaagagtgcttctcgtgatagacgagccacataccgactgggctaagtattttaaaggaaagaaaattcacggagaaattgatatcaaggtggagcaagctgagttttctgacctcaatctggtggctcatgccaatggaggattttccgtagatatggaggtcttgagaaatggagtgaaggtcgtgaggtcactcaaacccgactttgtgctgataagacagcatgccttctcaatggcccgaaacggagattaccggtcccttgtaattggcctacagtatgccggcatccccagcgtgaacagcctgcattcagtatacaatttctgcgacaagccttgggtatttgctcagatggtgagactccacaagaagctaggaacagaggaattcccgctcatcgatcagaccttctatccaaatcataaggaaatgctcagcagcacgacctatcctgtggttgtcaaaatggggcacgctcattccgggatgggcaaggtgaaagtggataatcaacatgacttccaggacatcgcgtccgtggtggcgctgaccaagacatatgcaactgctgagcctttcatcgatgccaagtatgatgtcagagtacagaagattggacagaattacaaggcctatatgagaacctctgtttccggaaattggaagactaacactggctctgccatgctggaacagatagctatgtctgatcgatacaaactgtgggtcgatacctgtagtgaaatctttggcgggctggatatctgcgccgtggaagcattacatggaaaggacggccgcgatcatatcattgaggtggtgggttcgtccatgccgcttatcggtgaccaccaggatgaagataagcagcttattgtcgaactcgtagtgaacaagatggcccaggccttaccacgccagcggcagagagatgcctccccagggaggggctcccatggccagacaccatcacctggtgccctgcccctaggccgacaaacttcccagcagccagcaggccccccagcacaacagaggccgccccctcagggcggcccaccccagcccgggcctggccctcagaggcagggacctcctctgcaacagaggccgccacctcagggacagcagcatctctcagggcttgggccccccgccggctcacctctgccccagaggttaccgtcgcctacaagtgcaccccagcagccagctagtcaggcagcacctcctactcaagggcagggtcggcagagccgtcccgtcgccggcgggcctggcgcaccgcctgctgcccgacccccagccagcccctcgccccagcggcaagctggaccaccacaggctacccgccagacctccgtgagcggccctgccccccctaaggcctcaggcgcacctcctggcggccagcagcggcaggggcctccacagaagcctcccggacctgctggtcccactcgtcaggcatcacaagccgggccagttccgcgtacggggccaccaaccacgcagcagcccaggcctagcggccccggacccgccggacggccaaagccgcagctcgcacaaaaaccctctcaggatgtacctccccctgcaaccgccgcggcggggggaccccctcatcctcagttgaacaaaagtcaatccctgaccaatgcctttaatttgcccgagcctgccccccccaggccttccctgagccaggacgaagtgaaggcagaaaccatacgctccctaagaaagagtttcgcaagcctcttctcagattag

SEQ ID NO: 136809 - DNA, 2010 bp, Artificial Sequence
  Description of Artificial Sequence: Synthetic coding sequence
atgaattatctgaggaggcggttgagcgactcaaattttatggccaatttgccgaacggatatatgaccgacctgcagagacctcagcctcccccacccccgcctggagcccatagccctggcgcaacacccggccctgggacagctacggctgaaagatctagcggggtcgcccctgctgcttccccagctgccccgagcccgggatcttccggcgggggaggcttcttcagctccctgagcaacgcagtcaagcagacaactgccgccgccgccgccacctttagcgaacaggtagggggaggatctggaggggccggccgaggaggcgccgcgtctcgggtgctgctggtgatcgacgagccccacacagactgggctaagtacttcaaaggtaaaaagattcatggcgaaatcgatatcaaggttgaacaagcagagttcagcgacttgaacctcgtggctcacgccaacggtgggttttctgttgatatggaggtactcaggaacggtgtaaaggtggtccggagcttgaaacctgattttgtcctcattcgacagcatgctttctccatggccagaaacggagactaccggtctttagtgatagggctccagtatgccgggattccttcggttaactctctgcatagcgtatacaacttttgcgataagccttgggtgtttgctcagatggtgcggttacataaaaagctggggacggaggaatttccgttaattgaccagaccttttatccaaatcataaagagatgctctccagtaccacctaccccgtggtcgtaaagatggggcacgcacatagcgggatggggaaggttaaagtcgataatcaacacgatttccaggacatcgcttctgtggtcgccctaacaaaaacctacgcaactgctgagcctttcatcgacgccaaatatgacgtgagggtgcagaaaatcggacagaattacaaagcttatatgcggactagcgtcagcggcaactggaagacgaacacgggatctgctatgctggaacaaattgcaatgagcgaccggtataaactgtgggtcgacacatgttctgagatttttggtggcttggacatttgtgccgttgaagccttgcatgggaaagatggcagagatcatatcatcgaagtagtgggtagttctatgccattgatcggcgatcaccaggacgaggataagcagctgatagtggagttagtggtgaataagatggcccaggcccttccccgccagcgccagagagacgcctcgccaggtagggggtcacacggtcaaaccccctctcccggggctcttccccttggccggcagacttctcagcagcccgcgggcccacctgcccaacagcggccaccgcctcagggtggacctccccagccagggcccggtcctcaacggcagggacccccgctccaacaacgaccccccccacaaggtcagcagcacctgtccgggctcggcccgcctgcgggttcgccattgcctcaacggctcccgagccccacttcggccccccaacagccagcttcccaggcagcacccccaacccaaggacaggggagacaatctcggcccgttgccggcggccctggcgcgcccccggctgcccgcccaccagcatccccttcgccccagcgccaggccgggcctccgcaggccacccggcagacttccgtttcaggcccagcccctccaaaagcatctggagctccacctggcggccagcagcgccagggaccccctcagaagccccccggtcctgccggacctaccaggcaggcatcacaggccggccctgtgccgcgcaccggccctccaacaactcagcagccacgcccctccgggccaggacccgctggccgcccaaaaccccagctggcccagaaaccaagccaagacgtgcccccacccgccacagctgctgccggaggtcccccacacccacagctgaaggcttcacctgcacaggcccagccctag

SEQ ID NO: 136810 - DNA, 1743 bp, Artificial Sequence
  Description of Artificial Sequence: Synthetic coding sequence
atgaacttccttaggcgtagattgtccgattcctcgtttatggcaaatctgcctaacggctacatgacagatctccaacggccagatagttccacgtccagtccggctagtcctgccatggaacggaggcatccgcaacctctggcggccagttttagtagccccgggagtagcctgttttcatccctgtctagcgccatgaaacaggccccgcaggcgacatccggtctgatggagccgcccgggccaagcactcctattgtccaaagaccaaggattctgttagtgatcgacgatgcgcatacagactggagtaagtattttcacggcaagaaagtgaatggtgagatagagattcgtgtggagcaggctgaatttagcgaactaaatttagctgcatacgtgactgggggatgcatggtggatatgcaggtggtccggaatggtaccaaagtggtgagcaggagtttcaagccagatttcatattagtgcggcagcacgcctactcaatggccctgggcgaggattatagaagcctggtgatcggcttgcagtacgggggcttgcccgcagtaaactcactctatagtgtgtacaacttctgtagtaaaccatgggtgttttcccaattaattaaaatcttccacagcctagggccagagaaattccccctcgtcgagcagacctttttcccgaatcataagcccatggttaccgccccccacttccccgtcgtggtaaaactgggacacgctcatgccgggatgggtaagatcaaggtcgagaaccagctcgattttcaggacatcacatctgtggtcgcaatggctaaaacatatgcaactactgaagccttcatcgactcaaagtatgatattcgcatccaaaaaatcgggagcaattataaagcgtacatgaggacaagcatctctggaaattggaaggcaaataccggttctgccatgctggaacaagtagccatgacagaacgctatcgcctgtgggttgattcctgtagtgagatgttcggggggctggacatctgcgctgttaaggccgtgcacagtaaagatggtagggattacatcatcgaggttatggattcatcgatgccactgattggtgagcacgtggaagaggacaggcagctaatggccgacctggtggtgtctaagatgagccagctgccaatgcccggcggcactgcaccatcgcctcttcgaccctgggcaccccagataaagagcgctaaaagccccggacaagcccagctggggccccagctgggccaacctcaaccaagaccccctccacagggaggccctaggcaggcccagtctccgcagccacagaggagcgggtcaccaagccagcagagactgtccccccaggggcagcagcctctcagccctcagtctggctcgccacagcagcaacggagtcccggttccccacaacttagcagagcatcgagtggatctagtcccaatcaagcctccaaacccggtgcaaccctggcaagtcaacctaggccccccgtccaaggaagaagcacaagccagcagggagaggagagcaagaaacccgccccccctcatccccatctaaataagagccagagtctgacaaactctttgtctacgagtgacacctctcagcgagggacaccttctgaggacgaggcaaaggcagagacgattcggaatttgcgtaagagctttgcatcactattcagtgattag

SEQ ID NO: 136811 - DNA, 1743 bp, Artificial Sequence
  Description of Artificial Sequence: Synthetic coding sequence
atgaatttccttcgcagacgtctgagtgactcaagcttcatggctaatctgccaaacgggtacatgacagatctgcagcgccctgattccagcacgagctcgcccgcttcacccgccatggagaggaggcacccccagccacttgccgctagtttcagcagtcctggcagttctctgttctctagtctttcctctgccatgaagcaggcaccccaggccacctcaggtctgatggagcccccagggcccagtactcccatcgtgcagagaccacgcattctgctggtcatagatgacgctcataccgactggagtaaatattttcatggcaaaaaagtgaatggcgaaatagagattcgggtcgagcaggcagagttcagtgagctgaatttggcggcttatgtgacaggaggatgtatggtcgatatgcaggtggtgagaaacggaacaaaagtggtgtctcgctcttttaagccagattttatccttgtcaggcagcacgcctactccatggcattaggggaggattatcggtctctggtcatcggactacaatacggtggactccctgccgtgaattctttgtacagtgtatataacttttgtagcaagccgtgggtcttcagccagttgataaagatcttccattctctgggaccggaaaaattccccctggtcgagcagactttctttcccaaccacaaaccaatggtcactgcgccccatttccctgtcgtcgtgaagctcggtcacgctcatgctggcatgggaaagattaaggtcgaaaatcaattggatttccaagatattaccagcgtagtcgctatggcaaagacatatgccacaacggaagcctttattgactctaaatatgatattaggattcagaagattgggtctaactataaggcttacatgcggaccagtatctccggcaactggaaggcaaacaccgggtcggcaatgttggagcaggttgcaatgacagaacggtataggctctgggtagacagctgtagtgagatgtttggaggactagatatttgcgccgtgaaggccgtacactccaaggacgggcgggactacattattgaagtcatggactcctcaatgcccctcatcggcgagcacgtggaggaggaccgccagctgatggcggatctggtagtaagcaaaatgtcccaacttcccatgcccggcggaaccgccccctcaccattacgaccctgggcgcctcagattaagtctgcgaagtcccccggccaggcacagctcggaccacagctggggcaacctcagccacggcccccacctcagggaggacctaggcaggcccaaagcccacagccccaacgctcgggaagcccgtcccaacagcggctaagtccccaggggcagcagcctctttccccacaatccggaagtccccagcaacagcgcagccccggatctccccagctcagccgagcttctagcggaagctcccccaaccaggcctctaagcccggagctacattggccagtcaaccgaggccccccgtgcaggggagatccacctctcaacagggggaggaatctaaaaagcccgctccaccacatccacatttgaacaagagtcaaagtctgacaaactccctcagtactagcgacacctcgcagcggggcacaccctccgaggacgaggcaaaggccgagacaatacggaatctcagaaaatcattcgcgtcactcttcagcgactag

SEQ ID NO: 136812 - DNA, 1335 bp, Artificial Sequence
  Description of Artificial Sequence: Synthetic coding sequence
atgaattttcttcgaagacgcctctccgatagttctttcatggctaatctccctaatgggtacatgactgacctgcagcggccagattctagtacttcgagcccagcaagcccagccatggagaggaggcatccacaacccctcgcagccagcttcagctcccccgggagctcactgttttcgtccctgagctccgccatgaagcaggcaccccaagccacatccggactaatggagcctccgggcccatccacccccattgttcaaagaccccgcatcctgctcgtgatcgatgatgcacacacagactggagcaagtattttcatggaaagaaggtgaacggggagattgagattagagtggagcaggctgaattttccgaactcaatctggccgcatatgtgacagggggctgcatggttgatatgcaggtcgttagaaacggcacaaaagtggtctcccgttccttcaaaccagattttatcctagtgcgccaacatgcttactctatggccctgggtgaggactatagatccctcgttattggactgcagtatggaggactccccgcagtgaacagcttatattccgtctataacttttgttctaagccatgggtgttttctcagctgattaagattttccacagtctgggccccgaaaaatttcccctcgttgaacaaacctttttccccaatcacaaaccaatggtcacggcacctcacttccctgtggttgtcaaattaggacacgcccacgctggcatgggcaagataaaagtggaaaaccaacttgacttccaggacatcacaagtgttgttgccatggctaaaacttacgcgaccactgaagccttcattgattctaaatatgacattaggattcagaagattggctccaactacaaggcttacatgcgtaccagtatttccgggaattggaaggccaataccggcagcgctatgttagagcaggtggcaatgactgagcggtatagattgtgggtcgattcgtgtagtgaaatgttcggcggactggacatttgcgccgtgaaagctgttcactctaaggacgggagagactatattattgaggtgatggatagctccatgcccctgatcggtgagcacgtagaagaagatcgccagctgatggcggaccttgtggtgtctaaaatgagccagttgccaatgccagggggcacagccccgtcccccctacggccgtgggcaccccaaatcaagtcggccaagtcacccgggcaggcacagctcgggccccagttggggcagcctcagcctcggcctcccccccaagtttcattcagcccttag

SEQ ID NO: 136813 - DNA, 342 bp, Artificial Sequence
  Description of Artificial Sequence: Synthetic coding sequence
atgaactttctgagacggcgactatccgactcttcttttatggcaaatctgcccaacggctatatgaccgatttacagcggcctgatagtagtacctcatcaccggcctctccggcgatggaaaggagacaccctcagcctctggcggcctccttctcttccccagggtccagtttgttctcaagcctgtcttccgcgatgaaacaggccccacaggctactagtggcctgatggaaccccctggacctagcacccctatagtgcaacgccctcggatcctgctggtgattgatgatgcacacaccgactggagtaaatattttcacggaaagaaggtgtag

SEQ ID NO: 136814 - DNA, 372 bp, Artificial Sequence
  Description of Artificial Sequence: Synthetic coding sequence
atgaacttcctccggaggcggctgtccgacagttcattcatggcaaacctacctaacgggtatatgactgacctgcagcgaccggactcctctacttcttcacccgcttcgcccgcaatggagaggagacacccccagcccctggcggcttccttttccagcccaggatccagcctcttcagctcactcagctccgcgatgaaacaggctccccaagccacctcgggcctgatggagccacctggccccagcacaccaatcgtacagcggccaagaatcctactcgtgattgacgacgcccacaccgactggtccaagtacttccatgggaaaaaggtcaatggggaaatcgaaattagagtggaacagtag

SEQ ID NO: 136815 - DNA, 561 bp, Artificial Sequence
  Description of Artificial Sequence: Synthetic coding sequence
atggattcgagcatgccactgatcggggagcatgtggaagaggacaggcaattaatggctgacctggtggtgagcaagatgagccagctgcccatgccgggtggcacggcccctagtccactgcgcccatgggccccacaaatcaaaagcgccaaatcccccggccaagcccagctgggcccacagctggggcaaccccaacctcgccccccaccccaaggcgggcccagacaggcacagtctccccagcaacagaggtcccctggatctcctcagttaagccgggcctccagcgggtcgtcgccaaaccaggcctctaagccaggcgcaacactggccagccaaccccgcccacccgtacaggggcgctcaacctcgcagcagggcgaggaatcgaagaagccagcacctccccacccccacctgaataagtcccagagtctaaccaactccctcagtacctctgacacaagccagcgcgggactccaagcgaagatgaggccaaagccgagacaatccgtaacctccggaaaagtttcgctagtttattttctgattag

SEQ ID NO: 136816 - DNA, 1212 bp, Artificial Sequence
  Description of Artificial Sequence: Synthetic coding sequence
atgagtcacagaaagttttccgctccacgacatgggagtcttggtttcttgcctcggaaaagaagttcacggcaccgaggaaaagtaaagtctttccctaaggacgacccttctaaacccgtgcatctaactgcgttcctcggatacaaggccggcatgacccacattgttagggaagttgaccggcccggcagcaaggttaataaaaaagaagtcgtcgaagccgttactatcgtggagactccacctatggtggttgtgggaattgtcggatatgtggagacccctcgtggcttgcggacgttcaagacagtctttgctgagcacatcagcgacgagtgcaaaaggcggttctataagaattggcacaagtctaaaaaaaaagccttcacaaagtactgcaaaaaatggcaggatgaggacggtaagaaacagctcgagaaggatttcagttcaatgaaaaagtattgtcaagtcatcagagttatcgcccatactcagatgcgcttacttcctctgaggcagaagaaggctcacttaatggagattcaggttaacggcggcacagttgccgaaaaactggattgggctcgcgagagattggaacagcaggtgccagtgaaccaggtgttcgggcaagatgagatgatcgatgtcatcggagtgactaagggcaaagggtataaaggggtcacgtcccggtggcatacaaagaaactcccccgaaagacgcatcgggggcttcggaaggtcgcttgcatcggggcttggcaccctgctagagtagccttttctgtagcgagggcaggccagaaagggtatcaccaccggaccgagataaataaaaagatctacaagataggccaggggtacttaatcaaggacggtaagctgatcaagaacaatgcctctactgactatgatcttagcgataagagcattaaccccctaggcgggtttgttcactatggggaagttactaacgacttcgtcatgctcaagggctgtgtggttggtaccaagaaacgtgtgcttactctgcgcaagagtctcctagttcagactaagcggagggctctagagaagatcgacctaaaatttatcgacacaactagcaaatttggtcatggccgcttccaaaccatggaagagaaaaaagcgttcatgggcccactgaagaaagaccgtatagcaaaggaagagggcgcatag

SEQ ID NO: 136817 - DNA, 576 bp, Artificial Sequence
  Description of Artificial Sequence: Synthetic coding sequence
atggagggcggtgcctacggtgctggaaaggccggtggagctttcgatccttacactctcgtgcggcagccgcacaccattctaagggtggtaagctggctgttctctatagtggtcttcgggtcaattgtgaacgaagggtacctgaactctgcaagcgaaggagaggaattttgtatttataaccgtaatccaaatgcttgctcctacggagttgcagtcggagtgctggcattcttgacatgtctgttatacctggcgctcgacgtctattttcctcagatcagcagcgtgaaagatcgcaaaaaggctgtgctgagtgatattggagtttctgccttctgggcgttcctgtggtttgtggggttctgttaccttgcaaaccaatggcaggtctcaaagccgaaggacaatcccctcaacgaagggaccgatgcagcccgggcagcgatcgctttctcttttttctcaatctttacctggtcccttaccgcggctttggctgtacggcggtttaaggatctctcattccaggaagaatactccactctcttccccgcttccgcacaaccatag

SEQ ID NO: 136818 - DNA, 702 bp, Artificial Sequence
  Description of Artificial Sequence: Synthetic coding sequence
atggagggaggggcttatggagctggcaaggccgggggcgccttcgatccctacacgctcgttcgtcagccccacactatcctaagggtcgtgtcttggttgttttccatagtggtctttgggtcaatagtgaatgaaggctatctgaattcagcttcagaaggtgaggagttttgtatatataaccggaacccaaacgcctgcagttacggcgtggccgtcggagtcctcgccttcttgacctgtctactttatctcgccctggatgtgtacttcccacagatttcttctgtgaaggaccgcaagaaagcagtgctgtctgacatcggtgttagtgcgttctgggccttcctgtggtttgtggggttctgctacctcgctaaccagtggcaggttagcaagccaaaagataatccgcttaacgagggtaccgacgccgctagggcagcaattgccttttcttttttcagcatcttcacttgggctgggcaagcggtgctcgcctttcagcgataccaaataggggcagattctgccttgttcagtcaggactatatggacccttcccaggacagttcgatgccatatgccccatatgtggagccaactgggcctgacccggccggcatggggggaacctaccagcaacccgctaacacctttgacactgagccgcagggttatcagagccaaggatattag

SEQ ID NO: 136819 - DNA, 579 bp, Artificial Sequence
  Description of Artificial Sequence: Synthetic coding sequence
atgctcactctcgagtttgggatcctggagttcgatcctagttggataggttcatggactcagcggtcctgggtgagttggaggtcacgccctggttgcgaactgttttccatcgtggtgttcggatcaattgtgaacgaggggtaccttaattctgcctcggagggcgaggagttctgcatctataaccgcaaccctaacgcttgtagctacggtgtggctgtaggagttctggcctttcttacatgtctgctgtatctcgcactcgacgtatactttccacaaattagcagcgtgaaagataggaaaaaggctgtcctttcagacatcggagtgagtgctttctgggctttcctttggtttgtgggcttttgctacctggccaatcaatggcaggtctctaaacccaaggacaacccccttaacgaaggaacggacgccgctagggcagccatcgctttctcattcttttctatcttcacttggagcttgactgcagccctggctgtgaggagatttaaagacctcagttttcaggaggagtattccacactcttcccagcttccgcccagccctag

SEQ ID NO: 136820 - DNA, 510 bp, Artificial Sequence
  Description of Artificial Sequence: Synthetic coding sequence
atggaagggggtgcctacggcgcgggaaaagccgggggagcattcgacccatatacgctcgtccgacagccacacactattctccgggttgtgagttggctgttttcaatcgtggtgtttgggtctattgttaacgagggatacctcaactccgcaagtgagggcgaggaattttgtatatacaatcgcaacccgaacgcttgcagctatggagtagcggtgggcgtgttagcattcctgacgtgccttctatatctggctcttgacgtgtactttcctcagatctcatccgtgaaagacagaaagaaagctgttcttagcgacattggggtgtccgcattttgggcgtttctctggttcgttggcttttgctatcttgcgaaccagtggcaggtgtctaagcctaaagacaaccctcttaacgagggaacagatgcagccagagcagcaatcgcattcagcttcttcagcatttttacttggcggagcggggccacgtcacccccttag

SEQ ID NO: 136821 - DNA, 297 bp, Artificial Sequence
  Description of Artificial Sequence: Synthetic coding sequence
atggcttccggagcaggtgggtcttggggccggagcccaccccagagtgctgtgcccaccccatgggttacttttcttcagcctttgagttgggccgtgccaccagctccaccccaacctgggagagtcaaggaggatctcctggaattgatgatgctccagaatgcccaaatgcaccagttgctgctgtcgcgtctagtggccggcgctctgcagcctagacccgccagcccttgccctcaggagtcttgcgctccaacgccaacccctcagtgccatagggattgcggatgttag

SEQ ID NO: 136822 - DNA, 690 bp, Artificial Sequence
  Description of Artificial Sequence: Synthetic coding sequence
atggaaggcgcgagttttggggctggtagggcaggcgcggcgctagatcccgtgtccttcgccaggagaccccaaacactacttagggtagcatcatgggttttctcaatcgcggtgttcgggcccatcgtcaatgaaggttacgtgaacacagacagcggacccgaactccggtgtgttttcaacgggaacgccggcgcatgtcgcttcggcgtggccctgggccttggcgccttcctggcctgcgctgctttcctgcttctcgatgtccgctttcaacagatctcaagcgtgcgcgacagacgccgggccgtgcttttagaccttggcttctcaggactgtggagctttctctggtttgtgggcttttgtttcctgacaaatcaatggcagcgcactgctcccggacctgccactactcaagcgggtgacgccgctcgggccgccatagcttttagtttcttcagtattctgagctgggtggccctgacagtaaaagccttacagaggtttcgccttggaaccgatatgtccctgtttgcaaccgaacagttatcaaccggtgccagccaggcttacccaggatatcccgtcggaagtggtgtagaaggcacagaaacctatcagagccctcccttcacagaaactctggacactagccccaagggctaccaagtgcctgcctattag

SEQ ID NO: 136823 - DNA, 438 bp, Artificial Sequence
  Description of Artificial Sequence: Synthetic coding sequence
atggagggcgcttccttcggcgctggtcgcgcaggcgcggcactggacccagtgagtttcgcacgacggcctcaaacgctccttcgggttgcaagttgggtattctccattgccgtattcggcccaattgtcaatgagggatacgtgaacacagatagcggcccagaactccgatgcgtgttcaatggcaacgccggagcgtgtcgctttggggtagctctcggcctcggcgccttccttgcctgcgcagcgtttctgctcctcgatgtcagattccagcaatccggcggccgagggaaaaccccaccaagccctcaggattggggttcctggccactgtttccttcccacgttccagtggggtccgattgtctcgtgtcggtgatggtcgtcagaccagttagatcacatagccctctaagcttaacaggatgctag

SEQ ID NO: 136824 - DNA, 705 bp, Artificial Sequence
  Description of Artificial Sequence: Synthetic coding sequence
atgcatattccaaagagccttcaggaactggcaaattctgaagctgtacaattcctacgaagacccaagaccatcacaagggtcttcgaaggtgtgttcagcctcatagtgttctcaagtttactcaccgacgggtatcaaaacaaaatggagtcccctcaactgcactgcattctgaactcaaattctgttgcgtgctcttttgcggtgggggccggttttcttgcctttctctcctgcttggcatttttagttctagatactcaggaaactcggatcgctggaacccgattcaaaaccgcctttcagctgttggatttcatcctggccgtgctgtgggctgtggtctggtttatgggcttttgcttcctggcaaaccagtggcagcacagcccacctaaggaatttctccttggatcaagtagcgcccaggctgcaatagctttcacctttttctctattctagtttggatctttcaagcatacttggcgttccaagacctgcggaacgacgcacccgtaccatacaagcgctttctggatgaggggggaatggtgctgaccacactccccttgccatctgctaactcccctgttaacatgcccactaccgggcccaactccctgagctatgctagctccgccctctcgccatgtcttactgcgcccaaatccccaagactcgccatgatgccagataactag

SEQ ID NO: 136825 - DNA, 4722 bp, Artificial Sequence
  Description of Artificial Sequence: Synthetic coding sequence
atggcattttcaaaaggcttcagaatctatcataaactggatcctccaccctttagcctcatcgtggaaactcggcataaagaggaatgtctgatgtttgaaagcggcgcagtcgctgttctgagttctgcagaaaaggaggccattaagggcacctactccaaggtcctggatgcttacggactacttggggttttaagacttaacctcggagacacaatgctccactatctggtcctggtgaccgggtgcatgtcagtgggaaagattcaggagtcagaggtatttagagtgacctccaccgagtttatttcgctccgcatcgattcttccgatgaagacaggatctccgaggtacgcaaggttttgaattctgggaacttttactttgcctggtctgcaagtggcatctcactggaccttagccttaacgcacacaggagtatgcaggagcaaaccaccgacaatcgcttcttctggaaccaaagcctgcacctccacctgaaacactatggagtaaactgcgatgattggctcctaaggctcatgtgcggcggtgtggagataagaaccatatacgctgctcacaaacaagctaaagcatgcttgatctctaggctatcttgcgaacgtgccggcactcgcttcaatgtaagaggcaccaacgacgatggtcacgtggctaacttcgttgagacagaacaggtcgtctacttggatgatagcgtgtcttctttcattcagattcgcggcagcgtcccactgttttgggagcagcccggccttcaggtgggctcccatagggttagaatgtcgaggggattcgaggcgaatgctcccgccttcgatcggcatttcagaacccttaaaaacctgtacggcaaacaaatcatcgtcaacctcttaggcagtaaagagggcgagcacatgttaagcaaagccttccagagccatctgaaagcaagcgaacatgcagcagacattcaaatggtgaacttcgactaccatcagatggtaaagggtggaaaggctgagaagttacatagcgttctgaagccccaggtccagaaatttctggattatggatttttctatttcaacggatctgaagttcagagatgtcagagcggaaccgtgagaacaaactgcctcgattgcctggaccgcacaaattcggtgcaagccttcttgggccttgaaatgctcgccaagcagctggaggctctcggactggccgaaaaaccacaactggttactcgatttcaggaggtgttcaggtccatgtggtccgttaacggagactcgattagtaaaatatacgccggcacaggagcactagaggggaaagccaagctgaaggatggggcccgtagtgtgactcgaactattcaaaacaatttcttcgatagcagcaaacaagaggctatcgacgtcctgctgctgggcaacaccttgaacagtgacctggctgataaggcacgagcgctgctcaccacaggttccctgagagtgtccgaacagacactccaatccgcatccagtaaggtccttaagtctatgtgcgagaacttctacaagtattcaaagcccaagaagatccgtgtttgcgtcgggacatggaacgtgaacgggggcaaacagtttagatctattgcgttcaaaaatcaaactctcactgattggcttctggacgcacctaaactcgcaggcattcaggaatttcaagataaacggtccaaaccaactgatatctttgccatcggtttcgaagagatggtggagctcaacgcaggtaatatcgtctcagcctccacaaccaatcagaaactctgggctgtcgaactgcagaagacgatcagccgagataataagtacgtgctactagcaagcgaacaactggtaggcgtatgcctgtttgtgttcatcagaccccaacacgccccatttattagggacgttgccgtcgacacagtgaaaaccggaatgggcggtgccaccggaaataagggagctgtggcgatcaggatgctcttccacacgacctcactttgttttgtgtgtagtcactttgccgcgggccagagtcaggtaaaggagcggaatgaagatttcatcgagatcgcgcgcaagctctcctttccaatgggacgcatgttgttcagccacgattacgtgttttggtgcggagatttcaattaccgtattgatctgcccaacgaggaggtgaaagagcttattcgtcaacagaattgggactccctcatcgcgggcgatcagctgatcaatcagaaaaatgctggacaggtgtttaggggctttctcgaaggtaaggtgacatttgctcccacatacaagtatgatctgtttagcgacgactacgacacctccgagaagtgccgaacccccgcctggaccgatcgcgtgctgtggagacgccggaaatggccctttgatcggtcagctgaagacctcgacttgctaaacgcctccttccaagacgagagcaaaattctgtatacttggacacccgggactctccttcattatggtagagccgagctgaagacatccgaccatcggccagtcgtcgccttaatcgacatagacatcttcgaggttgaagctgaggagcgtcagaatatttacaaagaggtgattgctgttcagggcccaccagatggtactgttctcgtgtccatcaagagttccctcccagagaataatttctttgacgacgccttgatcgacgaactgctgcaacagttcgcctccttcggagaagtgatcttgatcaggttcgtcgaagataagatgtgggtgaccttcctggagggttctagcgccctcaacgttttgtctctgaatggcaaggagctgttgaaccgaacgattacgatcgccctcaagagccccgactggatcaagaaccttgaggaagagatgagcttggaaaaaatcagcattgcactgccctcttcaacatcatcaaccctcctaggagaggatgcggaagtggctgccgattttgacatggaaggggatgttgacgactacagtgctgaggtggaagagttgctccctcagcacctgcagccctccagttctagtgggctggggactagtcctagtagttccccacgcacttctccctgccagtctcccaccatcagcgagggacccgtgccatcacttccaatcaggccttccagggccccctcgcgcacccccgggccacctagtgcccaaagctcccctattgacgctcagccagccacacctttgccgcaaaaagacccagctcagcctctggaacctaagaggcctcctcccccgcggcccgtcgcccctcccacaaggccagcaccgccgcaacgtccaccaccaccttctggcgccagaagtcctgcccccacacgcaaagaatttggtggaatcggcgcccctcctagtcccggggtcgcacgccgcgaaatggaagcacctaagagtcccggcacaactcgaaaggataatataggcaggagtcagccgtcaccccaggccggcctggccggccccggcccggccggatactccactgcaagaccaaccattccacctcgcgctggagtgataagcgcaccacaatcacacgcccgagcctccgctggtcggcttactcctgagtcacagagcaagacctctgaaacctctaaaggaagtacattcctgccagagcctcttaaaccccaagccgcctttcctccacagtccagtttgccgcctccggctcagaggctccaagagcctcttgtacctgtggctgccccaatgccccagagcggcccacagcctaacctagagacgccaccacagcctccgcctcgctcccgctctagccattctcttccaagcgaggcttctagccagccacaggtgaaaaccaacggaatctctgacggcaaacgcgaaagcccgctgaagattgaccctttcgaagacctctcattcaacttactggcagtttccaaagctcagttgtctgtgcagacttctccagtgccaactcccgaccctaagaggctaatccaactaccgagtgcaactcaaagcaatgtcctctcttctgtgagctgtatgccaactatgcctcccatcccggccagaagtcagtctcaggaaaatatgcgttcaagtccaaacccttttatcactggcctgacgcgcactaatccattttccgaccggacggcagccccaggaaacccgtttagggcaaaatcggaagaaagtgaagctacttcttggttcagcaaagaggagcccgtgacgatcagtcctttcccctccctccaaccattaggccataataaatcaagagccagctcctccctggacggtttcaaggatagttttgatcttcagggacagtcaacccttaaaatttctaaccctaaggggtgggtgacctttgaagaggaggaggacttcggagtgaaggggaagtctaaaagcgcctgcagtgatcttctggggaaccagccaagctccttcagcgggagcaacttaaccctgaatgacgattggaacaaagggaccaatgttagcttttgcgtcctgccatccagaagaccacccccccctcccgtgcccctgcttcctccgggcacatctcctccagtcgatcctttcaccactctggcttcaaaggccagcccgacgttagatttcacagagcgatag

SEQ ID NO: 136826 - DNA, 3888 bp, Artificial Sequence
  Description of Artificial Sequence: Synthetic coding sequence
atggcatttagcaagggatttcggatctaccataagcttgaccctcctccattttcactgatcgtagagacccgccacaaagaagaatgtctcatgttcgagtccggagctgtggctgtgctgagcagcgctgagaaagaagcgattaagggaacctactcaaaagttctagacgcctatggcctgcttggtgtgctgcggctgaatctgggagacactatgttgcattatttggtgctggtgaccggatgcatgtccgttggaaagatccaagagagcgaagttttccgagttacatctaccgagtttatttcccttagaatagactcctcggacgaagaccgtattagtgaggtgcgcaaggtcttaaattccggcaacttctattttgcatggtccgcgtccggtatatctctggacttatccctgaatgcacacagatcaatgcaggaacagaccactgataatcgctttttctggaaccagtccctccacctccatctgaagcattatggagttaattgtgacgactggctgctcagactgatgtgcggcggtgtggagatcagaacaatatacgccgcacataaacaggcaaaggcctgcctcatttctagactgagttgcgagagagctggcacacgctttaacgtccgcggcaccaacgatgacggccatgtagccaattttgtggaaaccgaacaggtggtgtatttggatgacagcgtctctagctttatccagatccgtggcagtgtgcccttgttctgggagcagcccggtctgcaagtgggatcccaccgggtaagaatgagccgcggcttcgaagctaacgcccccgcattcgatcgacatttccgtactttgaagaacctctacggtaaacagatcatcgtaaatctactgggctccaaggagggagagcacatgctcagtaaagcattccagagtcacctcaaggcttccgaacatgcggccgatattcaaatggtcaatttcgactaccaccagatggtgaaaggcggcaaagccgaaaagctgcactcggtcctgaagccccaggttcaaaaatttctcgactacggatttttctactttaacggatccgaggtgcagaggtgtcaatctggtaccgtgagaactaattgtcttgactgcttggaccggactaattctgtccaggccttcttgggtctagaaatgctcgcgaagcagctggaggccttaggactggccgagaaacctcaactggtgacacggtttcaggaggtgtttcggtccatgtggtccgtaaatggggattccatctctaagatctatgctggcacgggagccttggagggtaaagctaaactgaaagatggggcccgatccgtaacaaggaccatccaaaataactttttcgacagtagcaaacaagaagctatcgacgtgctgcttctggggaacacgctgaattccgatctggccgacaaagcccgggcgctgctgaccactggctccttgcgggtatctgaacaaaccctgcagtctgccagctccaaggtgctgaagagtatgtgtgagaacttttacaagtattctaagcctaaaaagatcagggtgtgcgttgggacgtggaacgtgaatggcggaaaacagtttcggagtattgcattcaagaatcagactctaaccgattggctcctagatgcccccaagctggctggaatccaagagtttcaagataaaagatccaaacccactgatatcttcgccattgggtttgaggagatggtggagctgaatgccggaaacattgtgtcagcttcaactacaaatcaaaagctgtgggctgtggaactgcagaagaccatcagtcgcgataacaaatatgtgctcctggcgtcggagcagctcgttggagtgtgcctttttgtgttcattagacctcagcatgctcccttcattcgggatgtggccgtggacacagttaaaaccggaatgggaggagccacaggaaataaaggagccgtcgccatcaggatgttattccatactacaagtctgtgctttgtctgctctcattttgcggcgggccaaagccaggtgaaggaaaggaacgaggattttatcgaaatcgcccgcaaactgagtttccctatgggaaggatgctgtttagccatgactacgtcttttggtgtggcgattttaactacaggattgatctaccaaatgaggaggtcaaggagctcatcagacagcagaactgggatagtctgattgcgggtgaccaacttatcaatcagaagaacgccggccaggtgtttcgcggctttctcgaaggcaaagtgactttcgcccccacctataagtacgacctgttctccgatgattatgacaccagtgagaaatgccggacacctgcctggaccgatcgagtgctgtggcgccggcggaaatggccctttgatcgtagcgcagaggacttagacctgctgaatgctagcttccaggatgagagtaagatcctgtatacctggacgcctggtaccctcctgcattacggcagagcagagctgaagacgagtgaccaccggcccgttgttgcgctaattgatatcgacatctttgaagtcgaggccgaagagaggcagaacatctataaagaggtaatcgctgtccagggccccccagacgggacggtactggtttcaattaagtcatcccttcccgagaataatttctttgatgacgcgctcatcgatgagctgctccagcagtttgcatcctttggggaggtgatccttattcggttcgtcgaggacaaaatgtgggtgacgttcctggaagggagttctgctctgaatgtactgagtctgaatgggaaagagctcctcaaccgtaccatcacaattgccttgaagtcccctgactggatcaaaaacctggaggaggagatgagcctagagaaaatttccatagctttgcccagcagcacctcatctaccctcctgggagaggacgccgaggtcgccgctgattttgacatggagggcgatgttgatgactactcagccgaggtggaggagctacttccgcagcacctccagccctccagttcttcaggtttgggcaccagtccgagcagctccccccgtactagtccttgccagtctcctaccatctctgaaggacccgtaccatccttgccaatcaggccaagccgtgcaccgtccaggactcctggcccaccatccgcacagtcatcaccaatcgacgcccagccagcaacacccctgcctcagaaagacccagcccagcccctggagccaaaacgcccacctccgccacggcccgtggcccctcctactcgtccggctccaccacagagaccgcctcctccaagcggtgcgcgaagcccagcaccgaccagaaaggaatttggagccccgaagagccccggtacgactaggaaagataatatcgggcggtcccaacctagcccacaggccggcttagccggccctggacccgctgggtactccacagcgcgtcccacaatccctccacgcgctggcgtgatttccgcgccacagagccatgcccgcgctagcgccggacggctgacacctgagtctcaatcaaaaacaagtgaaacatccaagggttctactttcctgccggagcctctgaagcctcaggctgccttcccaccgcagtcgagtctccccccacccgcgcagagacttcaggaaccattggtgccagtcgctgctcccatgccccagtctggaccacaaccaaaccttgagacccccccacagcctcccccacgtagtagaagctctcactccttgccatctgaagcctccagccagccacaacaggaacagccaagtggctag

SEQ ID NO: 136827 - DNA, 4581 bp, Artificial Sequence
  Description of Artificial Sequence: Synthetic coding sequence
atggcttttagcaaaggatttaggatttaccacaagctcgatccccccccttttagtttgatcgtggaaacaaggcataaggaagagtgcctgatgttcgaatcaggcgccgttgcagttttgtccagcgccgaaaaagaggctataaaaggaacttacagcaaggtgctagatgcttacggtctgctgggcgtactgaggctcaatctgggagataccatgctacattacctcgtcctggtcacagggtgcatgagcgttgggaaaattcaggagtcagaggtcttcagagttacctcgacagaattcatctccttgcgaatcgactcctcagatgaagacagaatctccgaggttagaaaggtgctgaactctggcaacttttatttcgcttggtccgctagcgggatatcacttgacctctccctgaatgcgcaccgaagtatgcaggaacagacaacagataaccgcttcttctggaatcaatctctacacttgcatctgaagcactacggggtgaattgcgacgactggcttctgcggctgatgtgcggtggcgtggagatccgaaccatatacgcggcccacaagcaggccaaggcatgccttatcagccggttgtcatgcgagagagccggtacacgcttcaatgtcagaggaacaaatgacgacggccacgtggcgaactttgtggaaacagagcaggttgtgtaccttgacgattcagtttccagcttcatacaaataaggggaagtgtgcctctgttctgggaacagcctggacttcaggtcggatcacacagagtccgcatgtctaggggattcgaggctaacgccccagctttcgataggcacttccgtaccctgaagaacttgtatggcaagcagatcatcgtgaacctgttgggtagcaaggaaggagagcatatgctgtccaaggcattccaatcccacctgaaggcttctgaacatgcagccgacatacagatggtaaattttgattatcaccagatggtaaaggggggcaaggccgagaagctgcactctgtcttaaagccacaggttcagaagttccttgactacgggttcttctattttaacggatccgaagtacagcggtgtcagtctggcacagtgagaactaactgtctcgattgcctggaccgcaccaatagcgtgcaggccttccttggcctagagatgctcgccaaacagctcgaagccctgggactagccgagaagccgcagttggtgaccaggtttcaagaagtgttccgatccatgtggtctgtgaatggagacagcatctccaaaatttacgcgggaaccggggccctcgaggggaaggcaaaagccggaaaactgaaagatggtgccaggagcgtgactcgaacaattcaaaacaatttcttcgactcttccaagcaggaagcaattgacgtactgctcctgggaaatactttaaacagtgaccttgcagacaaagcccgcgcgttacttaccaccggttcactcagagcttcaagcaaggtgctcaagtccatgtgcgagaatttctacaagtatagcaagcctaagaaaatccgggtgtgtgtcggcacatggaacgtgaacggcggtaagcaattccgcagtattgctttcaagaatcagactctgactgattggttactcgatgccccaaaactcgccgggatacaagagttccaagacaagaggagtaaacctacagatattttcgccatcggctttgaagaaatggttgaattgaacgctggcaacatcgtctccgcttcgactacgaaccaaaaactttgggcagttgaactccagaagacaatatctcgggataataagtacgtgctgctagcgtctgagcaattggtaggagtatgtctctttgttttcattagacctcagcatgcaccattcattcgtgacgtcgcagtggacacagtgaagacgggcatgggaggagcgaccggaaataagggcgctgtggccatcagaatgctgtttcatacaacttctctgtgttttgtgtgctcacacttcgcagctggccagagccaagtaaaggaacggaacgaagactttatcgaaatcgcccgcaaactgtcctttcctatgggtaggatgctgttttcccacgactacgttttctggtgtggcgacttcaattatcgaatcgacctgcccaacgaggaggtcaaagagttgatcaggcaacagaactgggactcgctgattgctggcgaccaactgattaaccagaagaatgcaggccaggtatttagagggtttcttgaaggaaaggtcacgttcgccccaacttataagtatgacctgttcagcgacgactatgacacctctgaaaagtgccgaacaccagcatggaccgatagagtcttgtggcgccgtcgcaaatggccatttgatcgatctgcagaggacttggacttattgaacgcatcattccaagacgagtcaaaaattctgtacacttggacacctgggacacttctacattacggtagggccgaactgaagacctcagaccaccgtcccgtggttgccctgatcgatatcgatattttcgaagtagaggcagaagagcgtcagaacatatacaaagaagtgatcgccgtgcagggcccccccgatggaacagttttggtcagcatcaaatcatctctcccggaaaacaacttcttcgatgatgcactgatcgatgagttgctgcagcagtttgctagttttggcgaggtgattctgatccgatttgttgaggacaaaatgtgggtgacctttctggagggcagttcagctttaaacgtgcttagtctgaatgggaaggagcttctgaatcgcacaattacgatcgctcttaagtcccccgattggataaaaaacctcgaagaggagatgagcttagaaaagatctctattgccctgccaagttcaacctcctcaaccttactgggcgaagacgctgaggtcgccgctgatttcgatatggagggcgatgtggatgactacagcgccgaggtggaagagttgcttcctcagcaccttcagcccagtagcagctcgggacttggaactagtccctcttcctcaccgcgcacaagcccatgccagtcccctacaattagtgaggggccggtaccctctctgccaatccggccttccagggcccctagtaggacgccaggccccccttctgctcagagtagtcccatcgatgctcaacccgcaacccccctgcctcagaaggatcccgctcagccactggaaccaaagcgtccccccccgcctcgcccagttgctccacctacgaggcccgcacccccccagcggccccctccgccgagtgggaggagtcaaccatccccacaggctggactggccgggccagggcccgccggctactcaaccgcgagacctactattccgcccagggcaggggtgatctccgctcctcagagccacgcacgagccagtgcaggacggcttacacctgaaagccagagcaagacctcagaaacatccaaaggctccacgtttttgcccgagccactgaagccgcaggctgcattcccccctcaaagctcattgccacctccagcccagcgtctgcaggaacctctggtccccgtggccgcccccatgcctcagagcggccctcagcctaatctcgagacccccccgcagcctccgccaagatcacgatcgtcccactccctgccatctgaagcctcctcacagccacaagtcaagacgaatggcatctccgacgggaagcgggagagtcccctaaagattgaccctttcgaggatttatcttttaatttactggccgtgagcaaagcacaactttctgtgcagacttcgccagtaccaaccccggacccaaagaggttaatccaacttcccagcgctactcagtccaacgtgcttagcagcgtttcatgtatgccaactatgccacccatccctgccagaagccagtctcaagaaaatatgagatctagccctaatccttttataacaggtcttactcggactaacccttttagcgaccggactgccgcacccggcaatccgttcagggcaaagtcagaggagagtgaagcgacaagctggttttcaaaagaagagcctgttacaatcagtccctttccatcactgcagccccttggccataataagagtcgtgcatcctcttctctggacgggtttaaagactcattcgatttacaaggccagtccacactgaaaatctccaatcctaagggttgggtcacattcgaggaggaagaagactttggggtgaaaggcaagtctaagtcggcctgcagcgatctcctgggaaatcaacccagcagtttctcaggctccaatctaacactgaacgatgactggaacaaggggaccaacgtctccttctgcgttctgccctcgcgacgaccccctccaccacctgtgcctttgctgccacccggcacctctccccctgtggaccctttcaccacattggctagcaaggcgagccctacactggatttcactgagaggtag

SEQ ID NO: 136828 - DNA, 4053 bp, Artificial Sequence
  Description of Artificial Sequence: Synthetic coding sequence
atgcgcaagcgatgggcgtgctggtctggaagtgatgctcccggaggctgcggaggcggatgtggccggcgccgtcgaagaagccgccgcaagcgggcagcttccgaagagagacggatggcatttagcaaaggctttcggatatatcacaaactcgaccctcctccgttctccctgattgtggagacaaggcacaaagaagagtgtttgatgtttgagtctggcgccgtggcggttctgagttcagcagagaaggaagcaatcaaaggaacctatagtaaggtgttggacgcttacggtctgctcggggtcttaaggctgaatctgggggatacaatgctccactacctggtattagtgaccgggtgcatgagtgtgggaaaaattcaggagtccgaggtgtttagagttacaagtactgagttcatatctctgcggatagatagctcagatgaagacagaatttccgaggtacggaaagtgttgaattccggcaatttttacttcgcctggtctgcaagcggtatttcactggacctaagtctgaatgcccaccgtagtatgcaagagcaaaccaccgataatagatttttttggaatcagtctctgcacctgcacctgaaacactatggggtgaattgtgacgactggctcttgcgcctcatgtgtggcggtgtggaaataaggaccatttatgcagcccacaagcaggcaaaagcctgcctgatttcaagattgagctgtgagcgcgccgggacccggttcaatgtgcggggaacaaacgacgatgggcacgtcgctaactttgtggagactgagcaagtggtgtaccttgatgatagcgtctcttctttcatccaaattcgcggctctgtcccactcttctgggaacagcccggacttcaagtaggctctcacagagtacgtatgtcccggggattcgaagcaaatgcccctgcttttgataggcattttagaactctgaaaaacttatacggcaaacagatcattgtcaacctgctcggatcgaaggagggcgagcatatgttatcaaaagcgttccaaagccacctaaaagcatcggagcatgccgcagacatccagatggttaactttgactatcatcaaatggtcaagggtgggaaagctgaaaaactccacagtgtgttaaagccccaggtccagaagttcctagactacgggtttttttacttcaacggctcagaagtccaacgctgccagtctgggaccgtgcgcaccaactgcctcgattgcttagaccgcaccaattctgtgcaggcatttctgggactcgaaatgctcgcaaagcagctcgaggctttgggacttgccgagaagccccagctggtaacccggtttcaggaggtgttcagatcaatgtggtctgtgaatggtgattccatctctaagatttacgcaggtacaggcgccctagaggggaaagccaagcttaaggatggagcccgctcagtaacccgaaccatccaaaacaatttctttgactcctcgaagcaggaagcaatcgacgtgctgctgctggggaatacgctgaattccgatttagccgacaaggctagagccctgctcacgaccggtagcctgcgcgtgtcagagcagaccctccagtcggcctcttccaaggtcctgaaatcaatgtgtgaaaacttctataagtacagcaaacccaagaaaattcgggtctgcgtgggcacgtggaacgtgaatggcggtaagcagtttcgtagcattgccttcaaaaatcagaccctgactgactggctgctagacgcccccaagctcgcaggcattcaggagtttcaggacaagcgcagcaagcctacagacattttcgcaataggctttgaggagatggtggaactgaacgcggggaatatcgtgagtgcaagtaccactaaccaaaagctttgggcggtcgaactacaaaaaaccatcagccgcgataataagtacgtgcttttggcatccgagcagctggttggcgtgtgcttgttcgtgtttattcgacctcagcacgccccattcattagggacgtcgcagttgatacagtgaaaacaggaatggggggagctaccgggaacaagggcgccgtggctattcggatgctgttccatacaactagcctttgtttcgtctgctctcactttgccgccgggcagtctcaggtgaaggagcgcaacgaggactttatcgagatcgcccgaaagctgtcctttccgatgggccgcatgttattcagccacgattatgtattctggtgtggggattttaactataggatcgacctgcctaatgaagaggtgaaagagctgatcagacagcagaattgggatagcctcattgccggcgatcagctgatcaaccagaagaatgccggacaagtgttcaggggcttcctggaaggcaaagtaactttcgcccctacctataaatatgatttattctctgatgattacgatacttccgagaagtgcagaactccagcttggactgaccgagtgctgtggcgccgccgcaaatggccgtttgataggtcagcagaggacctggacctgctcaacgcctcttttcaggacgagagtaagattctttatacctggactccagggactctcctgcattacggtcgagcggagctgaaaacaagtgatcacagacccgtggtcgcactcatagatatcgacatttttgaggtggaggcggaggagcgccagaacatttacaaagaagtcatagccgtccagggccctcctgacggcacggtattggtttcaattaaaagctccttgcctgagaacaactttttcgacgacgcactgatcgatgagttgctacaacagtttgcgtccttcggggaagtgatcctgatccgcttcgtcgaggacaaaatgtgggtaacattcttggagggttccagcgccctcaatgtgctgagtctgaatggcaaagaactcctgaacaggactatcacaattgcactcaagtctcccgattggatcaagaatctggaagaggagatgagcctggaaaagatctctatcgccctgcccagcagcacctcttccacgctgctgggcgaggatgcggaggttgctgcggatttcgacatggaaggcgacgtggacgattatagcgcagaggtggaggagctgctgcctcagcatctgcaaccttcgagcagctctgggctgggcacgagtccttcttctagtccaagaacatctccctgtcagtctcctacaatttccgaggggcccgtgcctagtctgcccattagaccttccagagcaccctcacgcactcctggcccgccatcggcccagtcaagccctatcgacgcgcagccagccacaccactgccacagaaagatcctgctcagcccctggaaccaaaaaggccaccccctcccaggcccgtagctcctcctactagacctgcccctccacaacgacctccgcctccatctggtgccagaagccctgccccaacccggaaggagttcggggggattggggcaccaccatctcccggcgtggcccgccgggaaatggaggctccaaagagcccaggcacgacccgcaaagacaacattgggcgtagccagccatcaccccaggcggggcttgcaggcccagggccggctggttattccaccgcccgccctacgattcctccacgcgccggggtgatttctgccccccagtcgcacgctagggcaagtgccgggaggctgactcccgaatcccagtcgaagacttcagaaacatcaaagggctctacattccttccagaaccgttaaagccccaggccgcctttcctcctcagtctagcctgccgcctcccgctcagcgactgcaagaaccattggtgcctgtggcagcaccaatgccccagtcggggccacaaccaaatcttgagacgccaccacaacctccccctaggagtaggtcaagtcacagtttaccatcggaggcctcaagccagccccaacaggagcagccttcaggctag

SEQ ID NO: 136829 - DNA, 4839 bp, Artificial Sequence
  Description of Artificial Sequence: Synthetic coding sequence
atgcgcaaacggtgggcctgttggtcaggttcagatgctcctggtgggtgtggaggtggctgcggaaggcgccgcagaagatcaagaagaaaaagagctgcaagcgaggaacggagaatggccttttcaaaaggctttcggatttatcataaattggacccaccccctttctctctgatagtagaaacacgccataaggaggagtgtttgatgtttgaatctggtgctgtggcggtgcttagctctgccgagaaggaggccattaaaggcacttactccaaggtgttggatgcatacggtctcctcggggtccttcgactgaatttaggggatacaatgcttcactatttggtgcttgtcactggttgcatgtcagtcggcaagatacaggaatcggaagtctttcgcgtgacaagcactgagttcatctccttgcgcattgattcctcagacgaagacaggatctcagaggttcggaaagttttgaactccggtaatttttactttgcatggagcgcatctggcataagcctggacctaagtctgaatgcgcatcggtctatgcaagagcagaccacagacaatcgcttcttctggaaccagagccttcacctgcacttgaaacattacggcgtgaactgtgacgactggctcctcaggctgatgtgcggtggggtggagatcaggacaatctatgctgcccataagcaagccaaagcgtgtctaatctcaaggttatcctgtgaaagagctggaacccgatttaacgtgagaggcaccaacgacgacggccatgtcgccaacttcgtcgagacggaacaggtcgtctatcttgatgattctgtgtcctcctttatccaaattcgcggcagcgtgcccctgttttgggaacaacctggactgcaggtcgggagccatcgggtacgaatgtctaggggatttgaggctaacgctcctgcctttgataggcactttaggactctgaagaacctgtatgggaaacagatcatcgttaatctgttaggaagtaaggaaggcgaacacatgctttccaaggctttccagagccatctgaaggctagcgaacatgccgcagacatccaaatggtgaattttgactaccatcaaatggtgaaggggggcaaagccgaaaagctgcattctgtactgaaaccgcaggttcaaaagtttttggattacgggttcttttattttaatggcagcgaggtacagcgttgccagagcggaacagttaggacaaattgtcttgactgcttggacaggacaaactcagtccaagccttcctgggccttgaaatgcttgctaaacagttggaggctctgggcttagcagagaagccccagctagtcaccaggttccaagaagtctttcggtctatgtggtccgtgaacggagactctatcagtaagatctacgccggcaccggggctctcgaaggcaaggccaagctgaaggatggcgctcgctccgttactaggacaattcagaacaatttctttgactccagcaaacaggaggccattgatgtgctgctcttgggtaacactcttaattcagacctggccgacaaagcgcgcgcattgctcactaccgggtccctgagggtgtctgagcaaacgttgcagagtgctagttccaaggtgttaaagtctatgtgtgagaacttctataaatacagtaagccaaaaaagatcagggtctgcgtgggcacctggaatgtgaacgggggaaagcaattccggagtatcgctttcaaaaatcagacgttgactgattggctgctggacgcccctaagttggccgggatccaagagtttcaggacaagagatccaaaccaaccgacatattcgcaataggctttgaagagatggtggagctgaacgctgggaatatcgtgagtgccagcacaaccaaccaaaagctttgggctgttgagctccagaaaactatcagccgggacaacaagtacgttctgctggctagcgagcagctggtgggcgtgtgtttgttcgtttttattcgaccgcagcacgccccttttattagagacgtggcagtcgacactgtgaaaacggggatgggcggtgctacaggaaacaaaggggcagtcgccattagaatgctgtttcacacaacatcgctgtgctttgtgtgctcgcatttcgcggccggacagtcccaggttaaggaacggaacgaagatttcatagagatcgccagaaaactctcattccctatgggcaggatgctgttctcccatgactacgtgttctggtgtggagatttcaattaccgcatagacttaccaaacgaggaggtgaaggagttgatccgtcagcaaaactgggattctttgatagccggagaccaacttatcaaccagaaaaacgcaggtcaggtgtttcggggctttctcgaagggaaagtcacgtttgcacctacatacaagtacgatctgttctccgatgattacgacacatctgaaaagtgtcgcacacccgcttggacggacagggtcctttggcgccgacgcaaatggccttttgacagatcagcagaggacctggacttattaaacgcctcgtttcaggacgagtcaaaaatattatacacatggacacctgggaccctccttcattatggacgcgctgaactcaagacttctgaccaccgtccagtggtggcgctaatcgacatcgatatattcgaggtagaagctgaggagcggcagaacatttataaagaggtgatagctgttcaaggaccaccagacggcaccgtgctggtatccattaagtcctccctcccagagaataacttctttgacgatgctctgattgacgagctgcttcagcaatttgcctcattcggtgaggtgatactgatccgtttcgtcgaagacaaaatgtgggtgacctttctcgaaggctcctctgcccttaacgttctgtctctcaacgggaaggaactgctaaacaggacaattacaattgcgctaaagtcccctgactggattaaaaatctggaggaggaaatgtccctggagaagatctcgattgccttaccatctagtacttcctctacgcttctcggggaagacgcagaggtcgcggccgattttgatatggagggagatgtggatgactattccgctgaggttgaggagctcctgccccaacacttgcaaccgtcctcctcctcagggttaggaactagcccgagctctagccctcggacatcaccgtgccagtcacctacaatctctgaaggccccgtgccttccctgcccattcggccatcaagggcaccctcgagaacaccagggcccccatctgcccagagcagccccatcgacgcccagccggccacacctttaccccagaaggatcccgcccaaccgctcgaacctaaaaggccccccccacctaggcctgtcgcccctcctacacgtccagccccaccccagcggcctccccctccttccggtgcgcggagcccggctcccacccggaaggagtttggaggcattggtgccccaccatctcctggggttgctcgccgggagatggaagccccaaagtcacctgggaccactaggaaagacaatatcgggcggagtcagccaagcccccaggctggattggcggggcccgggcctgctggctattctactgccagacccaccatccccccacgggctggggtcatcagtgcaccacagtctcatgcccgtgccagcgctggcaggctaacacctgagtcccaatcaaaaacctccgaaacaagcaaagggtcaaccttcctgcctgagccactcaaaccgcaggccgcttttcctcctcaaagcagtttaccacctcccgcccaacgtttgcaggagccactggtcccagtcgctgcccccatgcctcagtccgggccacagccaaacctagaaacacctcctcagccaccccccagaagcaggtcttcacattctctgccttccgaggcctcctcacagcctcaagtcaagaccaacggcatctccgatggaaaaagggaatctccactgaaaatagacccattcgaggacctgagcttcaatcttcttgcggtcagcaaggcacaactgtccgtccaaacctccccagtgccgacccctgatccaaagcgcctaatccaactgcccagtgctacgcaaagtaatgtgctatccagcgtgtcatgtatgcccacaatgccaccgattcccgcaagatcccaaagtcaagagaatatgcgctctagccctaacccattcatcaccggtctcactaggactaacccattcagtgatcgtaccgctgctccagggaatccttttagggctaagagcgaggagagcgaagctacctcgtggtttagtaaggaggaacccgtgacaatttccccgtttcctagtttgcagcctctcgggcacaataagagccgagccagtagctcactggatggcttcaaggatagtttcgatctgcaagggcaaagtacgctcaaaataagtaatccgaaaggatgggtgacattcgaggaagaggaagacttcggcgtcaaaggcaaatccaaaagcgcttgttcggatctgctcggtaaccagccgtcctcgttcagcggaagcaacttgacccttaacgatgattggaataagggcactaacgtttctttctgcgtgctgccatcacgtcgtcccccccccccccctgtcccactacttccccctgggacctccccgcctgtggacccctttacaaccctggccagcaaagccagtcctacccttgactttaccgagcgatag

SEQ ID NO: 136830 - DNA, 4491 bp, Artificial Sequence
  Description of Artificial Sequence: Synthetic coding sequence
atggccctgagcaagggactgcgcttgctgggcaggctcggtgctgagggcgactgtagcgtactcctggaagcccggggaagagatgactgcctcctgtttgaagccggtactgttgccactctggcgcccgaagagaaggaggtgatcaaggggcagtacggtaagctcaccgatgcctacggctgtctgggcgaactgcggctgaaatccggtggaaccagcctctcgtttctagttctcgtgacaggctgcacatctgtcggccggatcccggacgctgagatatataagatcaccgccactgacttctatccgttacaggaggaggctaaagaagaggaaaggttaatcgccttgaaaaagatcctgagcagcggcgtcttctattttagttggcctaatgatgggtcacgtttcgacctcaccgttcgaacccaaaagcagggagatgactcaagcgagtggggaaactccttcttctggaaccagctccttcacgtccctttgcggcagcatcaagtgtcctgctgtgattggctgctcaagattatttgcggcgtcgtaaccattcgtaccgtgtacgcctcccataaacaggcaaaagcctgtctcgttagcagggtgagttgcgaacggacaggtacgcgctttcacacccgtggagtgaatgatgacggccacgtgagcaactttgtcgaaacggagcaaatgatctatatggacgacggagtatcctctttcgtgcaaatccgaggctctgtgcccttattttgggaacagcccggcctgcaggtgggcagtcaccacttacggttgcaccgcggactagaggcaaacgcccccgcgtttgacaggcacatggttttattaaaagaacaatacggtcagcaagtggtggttaatctcctcggctcgagaggcggggaagaagtcctcaatagagccttcaaaaagctcttgtgggcctcctgccacgccggagacacacccatgatcaattttgatttccaccagtttgccaaggggggaaagcttgaaaaactggaaacgctgctgcgcccccagctgaaacttcactgggaagattttgatgtttttactaagggtgaaaacgtctcacccagatttcagaaggggaccctgagaatgaattgtttggactgtctagacagaaccaatactgtgcaaagttttatcgctctcgaggttttgcatctgcaactgaagacgctaggtctgagcagtaaacccatagtcgaccgattcgtggagagcttcaaggctatgtggtccctaaatggacattctctatcaaaggtgttcacggggagcagggcgctggaagggaaagcgaaggtgggtaagctgaaagatggggcaagatccatgtccaggacaattcagagcaacttcttcgacggcgttaagcaagaggctattaagctcctcctggtgggggacgtgtatggcgaggaggtcgctgacaaaggcggaatgttgttagattccacggccctgctcgttactccgaggatcctgaaagcaatgactgagaggcaaagtgaatttacaaactttaagcggatcagaatcgcaatgggaacttggaatgtgaatggcggaaaacaatttcggagtaatgtgctgcgcacagcggagttgaccgattggctgttagactcacctcagctgtctggggcgaccgattcccaagacgactcatctcccgccgatatttttgctgttggatttgaagaaatggtagagctttcggccggcaacattgtcaacgcatcaacgactaacaagaagatgtggggagagcagctgcaaaaggccatctcccgttcccaccgttacattctgctgacctccgctcagctggttggggtttgtttgtatatctttgtacggccatatcatgtgccctttattcgcgacgtggccattgacacggtgaagacagggatgggggggaaggctgggaataaaggagccgtgggaatccggtttcagtttcactctacgtctttctgcttcatttgttcgcacctgactgctggacagagtcaggtcaaggaacggaatgaagattacaaggagatcacccagaagctttgtttccctatgggacggaatgttttctcacacgactacgtgttctggtgcggtgattttaactaccggattgacctcacctacgaagaagtgttctatttcgttaagcgccaagattggaagaagctgctggagttcgaccagctgcaacttcagaagagttctgggaaaatcttcaaagacttccacgagggagcgattaatttcggacctacgtacaagtacgacgtcggctccgccgcatacgacactagcgataagtgcaggacgcccgcttggactgatcgagtgctgtggtggcggaagaaacaccctttcgacaagactgctggagagctcaatctgctcgactctgatctggacgtggacaccaaggtcagacatacatggtcacctggggcacttcaatactacggaagggctgaactgcaggcttcagaccatcgcccagttttggcaatcgtggaggttgaagtgcaggaagtcgatgtgggggcccgtgagcgcgtgtttcaggaggtgtctagttttcagggaccgctcgacgcaaccgtagttgtgaacttacaaagcccaacactggaagagaaaaacgagttcccagaggaccttcggaccgagttaatgcagactctgggttcatacggcacaatcgtacttgtccgcataaaccaaggccagatgctggtgacctttgccgactcgcactcggctctctctgtgctggacgtggacggcatgaaggttaaagggagagccgtgaaaattcgcccaaaaacaaaggactggcttaaaggtttgagggaagagatcatccgcaaaagagacagtatggcgccagtgagtccgacagcaaactcatgcctgttggaggaaaattttgactttacaagtctggactacgaatccgagggagatattctagaggacgatgaagattacttggttgacgaattcaatcaacccggggtctcagattcagaactcggcggtgacgatctgagcgacgtgccaggtcctaccgccctggcccctccctccaaatcccctgccctgacgaagaagaagcaacatccaacttataaggatgatgccgacctggtcgagctcaagcgcgagctggaggctgtgggggagtttcggcaccgctccccttcaaggagcctcagtgtgcccaatagaccaagaccaccacagcccccacagagacccccaccaccaactggacttatggtaaagaagagcgcttcggacgcatccatcagctccggaacacacggccaatactccattctgcagactgcacggctgttgcccggggcaccccagcagccaccgaaggccaggaccggaattagcaagccgtacaatgttaagcaaatcaagaccaccaacgctcaggaggcagaagccgctattaggtgtctcctggaagcccgcggtggcgccagtgaagaagctctgtcagctgtcgcccctcgagatctagaggccagcagcgagcctgaacctacgccgggagctgcaaagcctgagactcctcaagctcctcctctactcccacggcgtcctcctccccgcgtgccagctatcaagaagcctacgctgagaaggactggcaaacccctgagtccggaagagcaatttgaacagcagacggtccatttcacgattggtccacccgagacgagcgtggaagcccccccagtagtaaccgcaccacgggtccccccagtgcctaagccacgtacattccagcctggcaaggccgccgagcgcccaagccacagaaaacccgccagcgacgaagcgccccccggcgctggggccagcgtccccccgcccctggaggcccccccccttgtccctaaggttccaccaagacggaaaaagtctgctccagccgcgtttcacttgcaggttctgcagtcaaatagccagctgctacagggccttacttacaactctagcgactctcctagcggacaccctccagccgccgggactgtgtttccgcagggggatttcctgagcactagcagtgctacttcaccggacagtgatggcactaaagctatgaaaccggaagcggccccattactcggcgactatcaggatccattctggaacttgcttcatcaccctaaactcctgaacaacacttggctttccaagtctagcgacccactggacagcgggacccggtctccaaaacgcgatcctatcgaccctgttagtgctggggcctccgcagctaaagcggagctcccaccagaccatgagcataagaccttagggcactgggtgaccatttctgatcaggaaaaacggacagcattacaagtctttgaccctctggcgaagacctag

SEQ ID NO: 136831 - DNA, 1746 bp, Artificial Sequence
  Description of Artificial Sequence: Synthetic coding sequence
atgcagacactggggagttacgggacaatcgtgttggtgcgcattaaccaaggccagatgctcgttacatttgccgatagccactccgctctgtcggtcctggatgtggacggcatgaaagtgaagggcagggcagtcaaaatccgacccaagacgaaagactggcttaaaggcttacgagaagaaatcattcgcaagcgggacagcatggcccctgtctccccaaccgcaaattcgtgtctcctcgaggagaactttgatttcacatcattggattatgaatctgagggagatattctggaagacgatgaggactatctggtcgatgaattcaatcagccaggtgtgtccgatagcgaactcggcggggacgatttatctgacgtgcctgggcccaccgccttggcccctcccagcaagagtcccgctctcacaaaaaagaagcagcacccaacttacaaggatgacgccgacctagtcgagctcaagcgcgagcttgaggcagtcggagaatttaggcaccggtcgcccagcagaagcttatccgtcccaaatcgcccgagacctccgcaaccgccccagagacccccaccccctacaggcctgatggtaaaaaaatcggctagcgatgcatccatcagtagtggcacccatgggcagtatagtattctccagaccgcaaggctgttgcccggcgccccccagcagccccctaaggcacgaaccggtatctctaagccatacaacgttaaacagattaagacaactaacgctcaggaagccgaggccgcaataagatgtctcctggaggcacgcggcggtgcctctgaggaagcattgtccgcagtggctcctcgcgatctcgaagccagctctgagccagaacccacgcccggagccgctaaaccggagacccctcaagccccccctctgctgccaaggaggccaccaccgcgcgtgccagccattaaaaagccgaccctgcgtcgaaccgggaagcctctttctcctgaagaacaattcgaacaacagaccgtgcacttcaccattggaccaccagaaactagtgttgaggcgcccccagtggttaccgccccgagggtcccccctgtgcccaaacccaggacttttcaacctgggaaggcagcagagcggcctagtcatcggaagccagcttctgacgaggcaccaccaggagccggggcctcagttccacctccgctggaggcaccccccctcgtcccgaaagtgcctcctcggagaaaaaaaagcgcacctgcggccttccacctccaagtcctgcagtctaattcccaactcctgcaggggctgacttataattcatcggatagtccctcgggccaccctccagctgctggtactgtgtttccccagggggactttttgagcactagcagtgccacatcccccgattctgacggcacaaaggccatgaagcccgaggccgccccactgttaggcgactatcaggatccgttctggaatctgctgcaccacccaaaactgctgaataacacttggctttccaaatctagtgatccactagactcagggaccaggagcccgaagcgggaccctatagaccctgtttccgccggcgcatctgctgccaaggccgaactgcctcccgaccacgagcacaaaactcttggtcattgggtgacgatcagtgaccaggagaaacgaacggctcttcaggtcttcgaccctcttgccaaaacatag

SEQ ID NO: 136832 - DNA, 411 bp, Artificial Sequence
  Description of Artificial Sequence: Synthetic coding sequence
taaggacgggatgactgcctgcttttcgaagccggaactgtagctactttagccccggaagaaaaagaggtgatcaagggacagtatgggaaactgaccgatgcttatggctgtttgggagagctcaggctcaaatccggtggaacttctctgtctttccttgttttggtgaccggatgtacctcagtcgggcgaatccccgacgccgagatttataagattactgcaaccgacttctaccccctccaagaagaagccaaggaggaggaaaggctcattgccttgaaaaagatcctgagctctggggtgttctacttttcctggccaaacgacggctctcggttcgaccttaccgtacgcacacagaaacagggggatgatagtagtgagtggggaaactcatttttctag

SEQ ID NO: 136833 - DNA, 3867 bp, Artificial Sequence
  Description of Artificial Sequence: Synthetic coding sequence
atggctctatccaaagggctgaggttgctcggcaggcttggggctgaaggggactgcagcgtcctgctggaagcacggggaagagacgattgtctcctgtttgaagccggaacagtggcaactctcgcccccgaggaaaaggaggttattaaaggtcagtacgggaaattaaccgacgcttacgggtgtttgggcgaacttaggctgaagtccggaggcaccagtctgagttttctggtcttagtaaccggatgtactagcgttgggcgtatcccagacgcagagatctataaaattaccgcaacagacttttatccactccaggaggaggccaaagaggaggagcggttgatcgctctgaaaaagattctgagcagcggcgtgttttactttagctggcctaacgatggatcccggtttgacctgactgttcggacccaaaaacagggcgatgattcatccgaatggggcaattcattcttctggaaccagctcctgcacgtgcccttaagacagcaccaggtgtcttgttgcgattggttgctgaagatcatttgtggagtcgtcaccatccgtactgtgtatgcatcgcataaacaggccaaggcatgcttggtgagtcgggtttcttgtgagcggacgggaactagattccatacacgaggtgtgaacgatgatggccacgtgtctaactttgttgagacagaacaaatgatctacatggacgatggagtctcgtccttcgtgcagatccgaggtagtgtaccgctgttttgggagcagcccgggttgcaggtcggatcccaccacctgagactgcaccgcggcctggaagccaacgccccagcatttgataggcacatggtcctccttaaggaacagtacggccaacaggtcgtcgtgaacttactcggtagcaggggaggggaggaggtgttaaaccgtgctttcaaaaagttactctgggcctcgtgccatgctggagacacaccaatgatcaactttgatttccatcagttcgcgaaaggcggcaaactggagaagctcgagacactcctccggccccaactgaagcttcactgggaggacttcgacgtcttcactaagggcgagaatgtcagtcccagattccagaagggtacgctccggatgaactgcctggattgcttggatcgaactaacacggtccagagtttcatcgcactcgaggtgttgcatttgcaacttaagactctaggactcagctctaaaccaattgtggaccggttcgttgagagttttaaggcaatgtggagtcttaatggccactccctgagcaaagtatttacaggatcacgggctttagaaggcaaagccaaggtcggcaagctgaaggacggagcaagatctatgtcccggacaatccagtcaaatttctttgatggtgtcaaacaggaagcaataaaattgctcctggtgggagatgtgtatggggaagaggtcgcggacaagggggggatgctgttagatagcacagctctcttggtgacccccagaatccttaaagccatgaccgagaggcagagtgaattcaccaattttaaacggattcgaatcgccatggggacatggaacgtcaacggcggaaaacagtttcgctcaaatgtccttagaaccgccgagctcaccgactggctgttggacagcccccagctgtccggagctactgactcacaggacgattctagtcccgccgacattttcgcagtggggtttgaggagatggttgagctttctgccggtaatattgtgaacgcctctacaacaaataagaaaatgtggggagaacagcttcagaaggccatctcccggtcacatcggtatatcttactgacttccgcccagttggtcggtgtctgcttgtatatttttgttcggccatatcacgttccttttatacgcgacgtggccatcgacactgtgaagacaggaatgggcgggaaagcggggaacaagggtgctgtcggaatcagattccaatttcacagcacatcattttgttttatctgtagtcatctgacagcagggcagagtcaagtcaaggaacgcaacgaagattataaggaaataactcagaaactgtgtttcccaatgggccggaacgtttttagccacgactacgtgttctggtgtggtgacttcaactaccggatcgacctgacttatgaggaagttttctactttgtcaagcgtcaggactggaaaaaactattggaattcgatcagctgcagctgcagaagtcctcaggtaagatcttcaaagactttcacgaaggggcaattaattttggcccaacttataaatacgacgtaggtagtgccgcatacgataccagtgataagtgtaggactccggcctggactgatagagtgctatggtggaggaaaaagcacccgttcgacaaaacagccggggaactgaacctgctggattcagaccttgacgtagacaccaaggtcagacatacctggtcaccgggcgcattgcaatactacggaagagccgagttacaagcctctgatcatagacccgtgctggctatcgtggaggtggaggtgcaggaggtcgacgttggcgcccgggagcgcgtgtttcaggaagtgtcatcattccagggcccccttgacgcaactgttgtggtgaaccttcaatctcctactttagaggagaaaaacgaattccccgaggaccttaggactgagctcatgcagacactgggatcttatggcacaattgtgttagttaggattaatcagggccagatgctggtgacgtttgcagattctcatagcgctctcagtgtacttgatgttgatggcatgaaagtcaagggcagagcagtgaagattcgacccaaaacgaaggactggctgaaaggcctaagggaggaaatcatccggaaaagagattccatggcgccagtgagcccaacagcgaacagctgcctgctggaagagaactttgactttacttccctagattacgagagcgagggggatatcttggaggacgatgaagattatttggtggacgagtttaaccagcccggagttagtgatagcgagctgggtggggacgacctttcagacgtccccgggcccaccgcactggcacctccaagcaagtccccagccttgaccaagaaaaagcagcaccccacctacaaagacgacgcggacttagtcgaattaaagcgcgaactggaagccgtgggcgagttccgacatcgcagtcccagtaggtccctgtccgtgcctaataggccccgcccaccacagccgccccaaaggccacccccccctacaggacttatggttaagaaaagtgcaagtgatgcctctataagttccggcactcatgggcagtattcaattctccaaacagcacgtctgcttcctggtgccccccaacagccccctaaagcccgcacgggaatcagtaaaccctacaatgtgaaacaaatcaagactacaaacgcccaggaggccgaagccgcaatccgatgcctgctcgaggctaggggcggggcttctgaagaagccctgagtgccgtagccccgcgcgacttggaggcctcctcagaaccagaaccaactcccggagctgccaaaccagaaaccccacaggcccctcccctgctcccaagacgaccaccaccccgcgttcctgcgattaagaaacccactcttcggcggaccggcaagattgtcttttgttccaggtctcaagcttcccagccctgtttactgcttcagcggcatgaattcgtgaggacagtggcagcccaacggttggctagtgtggatacgtctgggtcctccgtctag

SEQ ID NO: 136834 - DNA, 4356 bp, Artificial Sequence
  Description of Artificial Sequence: Synthetic coding sequence
atggcactttccaagggactgagactcttaggccgacttggggctgagggcgattgttccgtattattagaggctagggggcgcgatgactgtctgctgtttgaggcgggcaccgtggcaactctggccccagaggagaaggaggtgatcaagggccagtacggaaaactcactgatgcttacggttgtctgggcgagctaagactgaaatctggaggcacatctctttccttcttagttcttgtgactgggtgtaccagcgttgggaggatccctgatgccgaaatttataaaatcaccgccacggatttctatcctttgcaggaagaggcaaaagaggaggaaaggttgatagcgctgaagaaaatcctgagcagtggagtgttttacttttcctggcctaatgacggatcgagattcgacctgacagtacgaacccagaagcagggtgatgactcatccgagtggggaaatagtttcttctggaatcagctcctccatgtgcctctaagacagcaccaagtcagctgctgcgactggctgctgaagatcatctgcggggtggtcaccattcgaacagtgtatgcctcccacaagcaggctaaggcctgccttgtgtctcgggtgtcctgcgagaggactggcacacgcttccataccaggggtgtcaatgatgacgggcatgtcagtaacttcgtcgaaactgagcagatgatctacatggatgacggcgtaagtagctttgtgcagatcagagggtctgtcccacttttttgggagcagcccggcctccaagttggatctcatcacctgagactccacagagggctggaggctaacgccccagcttttgaccggcacatggtacttctgaaggagcagtacggccagcaggtggtggtgaacctactggggtccaggggtggggaagaggttctcaacagggcattcaaaaaacttctgtgggcctcttgccatgcaggcgatacccccatgataaacttcgacttccatcagtttgcaaaaggggggaagctggaaaagctcgaaaccctccttaggccccaactgaagctccattgggaggattttgacgtttttactaagggggaaaacgtcagcccgagatttcagaagggcaccttaaggatgaactgtttggactgcctggatagaacgaacaccgtgcagagctttattgccctcgaggtattgcacctccagctgaaaactctgggactatcaagcaagccgattgtcgataggtttgtagagtcgtttaaagccatgtggtctttaaatgggcactctctctccaaagtcttcacggggtctcgcgccctagaggggaaggcgaaggttggaaagctgaaggacggggcacgcagtatgagccggactatccagagtaatttcttcgacggtgtgaaacaggaggcaattaagcttctgctagtgggagacgtgtacggcgaggaggtggcggacaagggaggaatgcttctggattctaccgccctccttgttactcccaggattctgaaagctatgaccgagcgccagagcgagttcacgaactttaaacggatacgaattgctatgggaacgtggaacgttaacggcggaaagcagttcagatcgaatgtcctgaggacagctgaattaaccgattggttactggactccccacagctctccggggccaccgactcacaggacgattcctctccagccgacattttcgctgtgggatttgaagagatggtggagctttcagcagggaacattgtcaacgcaagcaccacaaacaagaaaatgtggggcgagcaattgcagaaagccatctcgagatctcataggtacatcttactcacctctgctcagctggttggggtttgtttgtatatattcgtgcgaccctaccatgtgccttttatccgcgacgtggctatcgacacagtgaaaaccggaatggggggcaaggcaggtaacaaaggcgccgtggggattagatttcagttccattccacatccttctgttttatttgtagccacctgacggccggacaatcccaggtgaaagaaaggaacgaagattataaggagatcacccagaagctctgttttcctatgggccgaaatgttttttcacacgactatgtcttctggtgcggcgatttcaactatcgcatagacctgacgtacgaggaggtgttctacttcgtgaagcgccaagactggaagaagttgctagaatttgatcaattgcagttgcagaaatcgtcagggaagatcttcaaggactttcatgaaggcgccatcaactttggtccgacctacaaatatgacgtagggtccgcagcctacgacacaagtgacaaatgtcgaactccggcatggaccgatcgcgtcctctggtggcggaagaaacatccattcgataaaactgctggggagcttaacctgctggatagcgacctggatgtggatacaaaggtaagacatacatggtcacctggggccctgcagtactacgggcgagccgaactccaggcgtccgatcacaggcccgtcctagccatcgttgaggtggaagtccaggaagtggacgtgggtgctcgcgaaagagttttccaggaagtatcgagttttcagggtccactcgacgctacagtcgtggtgaacttgcagtctcctaccctggaagagaagaatgagtttccagaagatttgcggaccgaactaatgcaaacgctgggctcctacggcacgatagttttggtaaggattaaccaaggacaaatgcttgttacatttgcggactctcacagcgccctgtctgtgctggatgtggacggcatgaaggttaagggtcgggccgtcaagattcggccaaagactaaagactggctgaagggactccgtgaagagatcattaggaaaagagattcgatggccccagtcagtccaactgctaatagttgcctcttagaggaaaactttgacttcacctccctagactacgaatccgaaggagatattctggaggacgacgaagattacttagtggatgagttcaaccagcccggcgtgtctgattccgaacttggtggggatgatctgtccgatgttcctgggcctacagcacttgctccaccaagcaagagtccagctcttactaaaaagaagcagcatcccacatataaggcaggtctgatggtgaagaagtccgcttcagatgcttccataagttctggtacccacggacagtattcgatcttacagactgctcggctcctcccaggggccccacagcaaccccctaaggcccgcacaggcatctccaagccatacaacgtcaagcaaatcaagacaacaaacgcgcaggaggccgaagccgccatccgatgtcttcttgaggcccgggggggcgcttctgaagaggctctgtctgcagtggcaccccgggatctcgaagctagctctgaaccagagcccacacccggcgctgccaaacctgaaaccccacaggcaccacctctcttgcctcgtcggccaccacccagggtgcctgcgatcaagaaacccaccctaagaagaaccgggaagccactctcgcctgaggagcagttcgagcagcagacagtgcatttcacaattgggccacccgagacgtcagtggaggccccaccagtggtgactgcaccaagagtaccacccgttcccaagcctagaaccttccagccgggtaaggccgccgagcggccttctcatcgtaagcctgcctctgacgaagccccacctggggcaggcgcctcagttccaccaccccttgaggcgccccccctagtgcccaaagtgccaccaagacgaaaaaaatccgccccagctgccttccacttgcaggtgcttcaaagcaactctcaattgctccagggattaacctacaactcctccgatagtcctagcggacacccccccgccgcaggtacggtatttccacagggagatttcttgtcaacatccagcgccaccagccctgattctgacgggacaaaagccatgaagcccgaagcagcccctttactaggggactaccaggatccattttggaaccttctgcatcacccaaaacttttaaacaacacctggctgtccaagagctctgaccctttggactcaggaacgcgatccccaaagagagaccccattgaccccgtgagcgcgggtgcgagtgccgccaaggctgaactgccccccgaccacgagcacaagaccctgggtcactgggttacaatctcagaccaggaaaagcggacggctctgcaggtgttcgatccactcgctaaaacgtag

SEQ ID NO: 136835 - DNA, 279 bp, Artificial Sequence
  Description of Artificial Sequence: Synthetic coding sequence
atgttcctctatgcatccggccccgcaccacctgccggcacctgcagatggggcggtcaggggggtacgtccctctccttcctggtcctggtgacaggctgtacttctgtggggcgcataccggatgccgagatctacaaaatcaccgcgaccgacttttatccgctgcaagaagaagccaaagaagaggagaggctcatagcacttaaaaagatcctatcttcaggggtgttctacttctcctggccaaacgacgggtcccgatttgaccttacgtag

SEQ ID NO: 136836 - DNA, 1551 bp, Artificial Sequence
  Description of Artificial Sequence: Synthetic coding sequence
atgtttctatatgcctccggacctgcgccgccggcaggcacttgcaggtggggaggacaggggggtacctcactttcctttctggtgctggtcactggatgtacctctgttggacggatacctgatgctgaaatctacaagattaccgcaaccgatttctaccccctccaggaagaagcaaaagaagaagagcggctgattgccttgaaaaaaattctgtcctccggcgtcttctacttttcttggcctaacgatggatcacgatttgatcttacagtgcgcacgcaaaaacaaggagatgactcttcagaatggggcaattccttcttctggaatcagctgctgcacgtgcctttgcgccagcatcaggtgagttgttgcgattggttgctgaagatcatctgcggcgtggttactatccgcactgtctacgctagccataaacaagctaaagcttgcctggtgagccgtgtcagttgcgaacgcaccggaacgaggtttcacacgcggggtgtaaacgatgatgggcacgtttcgaattttgtggaaacagaacaaatgatatacatggacgatggtgtatcctcattcgtgcagattaggggcagcgtgccgctgttttgggagcagccgggacttcaggtgggctctcatcatctgaggctgcacagagggctagaggccaacgcccccgcatttgatagacacatggtcctgctcaaggagcagtacggccagcaagtggtggtcaacctactcggtagcaggggaggagaagaggtgctgaaccgggctttcaagttcgcaaaaggcgggaagttagagaaacttgagacattattgaggcctcagctgaaactccattgggaggactttgacgtctttactaagggggagaatgtctccccgagatttcagaaaggaacgcttcgcatgaactgtctagattgtctagacaggaccaacacagtgcaaagtttcatcgcgttagaggtcctgcatctgcagctgaaaactctgggcctatcttctaaaccaatcgtggaccgatttgtggagagctttaaagccatgtggtcactcaatggacactcgctgtccaaggtgtttaccgggtctagagccctggagggcaaagcgaaagtgggcaagttgaaagacggcgcccggtctatgagccggaccatccaatctaattttttcgatggcgtcaaacaggaggcaattaagttgctacttgtaggcgatgtatacggggaggaggtggctgacaaagggggcatgttattagactccacggctctcctggtaaccccacgtatcctgaaggccatgacagaacgccagtccgagtttaccaattttaaaaggataagaatcgccatgggcacttggaatgttaatggcggcaagcagtttcgctcaaatgtactgcgcacagctgaactcactgactggctgctggatagccctcagctctccggcgccacagactcacagggcgaaggaagtgatttcgggggtgataaaattcaactgcatcttacatag

SEQ ID NO: 136837 - DNA, 438 bp, Artificial Sequence
  Description of Artificial Sequence: Synthetic coding sequence
atgaatggcagggtggactacctcgtgacagaagaagaaattaatcttacccgtggccccagcgggttaggtttcaacatcgttggaggcacagatcagcagtacgtgtccaacgactccgggatctatgtcagtaggataaaggaaaacggggcagctgccttggatggcagactgcaggagggcgacaaaatcttaagcgtcaatgggcaggatctgaagaacttactgcaccaggatgctgtggacttattccgcaatgccggatatgccgtaagcctccgcgtgcagcatcgcctgcaggttcaaaacggacctattggccataggggagaaggggacccttcaggcattcccatcttcatggttctggtcccagtttttgccttaaccatggtggccgcatgggccttcatgcgataccgccagcagttgtag

SEQ ID NO: 136838 - DNA, 957 bp, Artificial Sequence
  Description of Artificial Sequence: Synthetic coding sequence
atggccggcaggtctctgactagcaaagccgagcctaccgctggtgcagtggacagagcagagaaggcaggcggccaagatacatcctcccagaagatagaagatctgatggaaatggtgcagaagctgcagaaagtgggaagtctggaaccacgggtggaagtgctgatcaaccggattaacgaggtgcaacaagctaaaaaaaaagcaaataaggacctgggagaagctcgaactatctgcgaggccctgcaaaaggagctggacagtttgcatggcgaaaaggttcacttgaaggaaattttatctaaaaagcaggagactctgcgcattctgaggctgcactgccaggagaaagagtcagaggctcaccgcaaacatacgatgttgcaggagtgcaaggagaggatttctgcgttaaacttgcaaattgaagaagaaaaaaacaaacagcgacagttacgtttggctttcgaagaacagctcgaggacctcatgggtcagcataaggacctgtgggactttcatatgccggaaaggctagcaaaggaaatttgtgccctggattcctcaaaggaacaacttcttaaggaagagaagctggtcaaggctacattggaagacgtcaagcatcagctctgctctctctgcggggcagaaggcccttccactctggatgaaggcctgttcttgcggtctcaggaggctgcggccacggtacagctgtttcaggaggagcataggaaggccgaggagttgctcgcggcggcggcccagcgccaccagcagctccagcaaaagtgtcagcagcagcagcagaaaagacagcgactgaaagaggagctggaaaagcacggaatgcaagtgccagcccaggctcagagtacacaggaagaagaggcgggacccggtgacgtggccccacgacccgggcgaccagtgacatggtggagctag

SEQ ID NO: 136839 - DNA, 1056 bp, Artificial Sequence
  Description of Artificial Sequence: Synthetic coding sequence
atggcgggtcggagtctgacttctaaagccgaaccaaccgctggagccgtggaccgagctgaaaaggctggcggccaggatacgtcgtctcagaagatcgaggatctgatggagatggtccagaagctgcaaaaagtgggatctctggagccacgggttgaggttctaatcaaccggatcaacgaggtccagcaggccaagaagaaagcaaataaagatctcggtgaagcaaggaccatctgtgaggctctgcagaaagagctggatagcttacacggagaaaaggtgcacttgaaggagatcttaagcaagaagcaggagacactgcgaatcttgcgcctccactgccaggagaaggagtcagaagcacacagaaagcacacaatgctacaagagtgcaaagagcgcatctcagccctcaacctccagattgaagaagaaaaaaataaacagaggcagttgcgactcgcgttcgaggagcagctggaggatcttatgggtcagcacaaggatttgtgggactttcacatgcctgagcgactggctaaggagatttgtgccttggattcatccaaggagcaactgctgaaggaggaaaaactggtgaaggccacattggaggatgtaaagcatcagttgtgcagtctgtgtggtgcggagggcccatctacgttggatgaaggtcttttcctgcgtagccaggaggccgccgcaacagttcaattgtttcaagaggagcatcgcaaggcagaggagctgcttgccgccgctgcacaacggcaccagcaactgcagcagaaatgccaacaacagcagcaaaagcggcagcggcttaaagaggagctagagaaacacggaatgcaggttcccgctcaggcccagagcacccaggaggaggaagcaggtcccggggacgtcgcctcaccaaagcccctgaaaggagagaggcctggcgctgctcaccaagctggccctgacgtcctgatcggtcaggaggataccctccaccccgatctgtctccaagaggcttccaggaaatcaaagaactgttttag

SEQ ID NO: 136840 - DNA, 849 bp, Artificial Sequence
  Description of Artificial Sequence: Synthetic coding sequence
atggagatggtgcagaagctccaaaaggttgggtctctagagccccgggtggaggtgctgattaaccgaatcaatgaggtgcagcaagccaaaaaaaaagcgaacaaggatctcggcgaggcccggacgatttgtgaagccctccagaaggaattagactcactccacggcgagaaggttcaccttaaagagattctgtcgaaaaagcaagagacacttagaatcctgcggttacactgtcaggagaaggagtcggaagcccacagaaagcatacgatgttgcaggagtgcaaagagcgcattagtgcattgaaccttcaaatcgaggaagaaaagaataagcagagacagttgagacttgcatttgaagaacagttggaagatctgatgggtcagcataaggatctctgggatttccatatgcctgagaggctcgcaaaagagatctgtgccttagactctagcaaggagcaattactaaaagaggagaagctggtgaaagcgactctagaagacgtgaagcatcagctctgctcactgtgcggggccgaagggcccagcacgctggatgagggccttttcctgaggtcacaggaggcagctgccactgttcagctttttcaggaagaacatcgcaaagctgaagagcttctggccgccgctgcccagcgccaccaacagctccagcaaaaatgccaacagcagcagcagaagcggcagagacttaaggaagagctagagaaacatggaatgcaagtgccagcgcaagcccaatccacacaggaggaggaggctggtccgggagatgtcgctccaagacccggaaggcccgtaacatggtggagttag

SEQ ID NO: 136841 - DNA, 849 bp, Artificial Sequence
  Description of Artificial Sequence: Synthetic coding sequence
atggagatggtacaaaagcttcagaaggtgggcagtctggagccacgagtggaagtcctgatcaatagaatcaatgaggtgcagcaagccaagaagaaagccaataaggacttaggggaggcgcggaccatttgcgaggccctgcaaaaagaactcgatagcctccacggcgagaaagtacatttgaaagaaattctgagcaagaagcaggagacccttcgcattctgcgcctgcattgccaagagaaggaatcagaggcccatcgcaagcacactatgttgcaagagtgtaaggagaggatcagcgcccttaacctccagatagaggaggaaaaaaacaagcaacggcagctcagactcgcctttgaggaacagctggaggatcttatgggtcaacataaagatctgtgggactttcacatgccggaaagactggccaaggagatctgtgccttggattctagtaaagaacaactactgaaggaagagaagctggttaaggccaccctggaggacgtgaagcatcagctttgttccctctgtggcgccgagggtccttcaactcttgacgagggtcttttcttgcgttctcaggaggctgcagctaccgttcagctgtttcaagaggaacaccgaaaagcggaggagttgctggctgctgccgcacaacgccatcagcaattacagcaaaaatgtcagcagcagcagcagaaacggcaaaggttaaaagaggaattagagaagcacggcatgcaggttcccgctcaggctcaatcgacccaggaagaggaggctgggcctggagacgtggctcctaggcccggaagaccagtgacctggtggagctag

SEQ ID NO: 136842 - DNA, 657 bp, Artificial Sequence
  Description of Artificial Sequence: Synthetic coding sequence
atggagagacaaggtgtggatgtgcctcatgttaagtgcaaagatcaggaaccgcaaccactcggagagagcaaagagcatcccagatgggaagagaattgcgaggaggaggcaggagggggtcctgcgagcgcgtcatgtcaacttacagtgttggaaggcaagagcgggctttacttttcgagccttgatagctcgattgatatactgcagaaacgggcgcaggagcttatagaaaatatcaacaagagtagacaaaaggatcacgcactcatgacgaattttcggaacagtttgaaaacaaaggtgagcgatttgacagagaaattggaggagcgtatctaccagatctataatgaccacaataaaattatccaagagaagctgcaggaattcacccagaaaatggcaaaaatttcacacctggagacagagctgaagcaggtctgccacagcgttgagaccgtgtataaggatctatgtttgcagccagagcagtctcttcgccttcgctggggccccgaccactcgcgcggtaaatcccctccccgcccgggtaatagtcaaccccccgatgtcttcgtgagttctgtcgcagaaaccacatcgcaagcaaccgcttccgaggtccagacaaacagagacggcgaatgctag

SEQ ID NO: 136843 - DNA, 2931 bp, Artificial Sequence
  Description of Artificial Sequence: Synthetic coding sequence
atggagaagcagaaaccgttcgcactctttgtgccgccaagatccagttcatcccaggtgtccgcggtgaagccacagactctagggggtgactccacattttttaaaagcttcaataagtgcacagaagacgatttcgaatttccgttcgctaaaactaacctgtccaaaaatggtgagaacattgactctgaccctgcacttcaaaaggtcaactttctgcccgtgctggaacaggtcgggaattccgactgccactaccaggagggcctgaaggatagcgaccttgagaatagcgaagggctgagccgtgtgtatagcaagctatacaaggaggcagaaaaaattaaaaaatggaaggtgagcaccgaagctgaactacggcagaaggaaagcaaacttcaggaaaaccgcaagatcatcgaagcacagaggaaagccatccaagagctgcagtttgggaatgagaaggtgtctcttaagttagaggaggggatccaggaaaacaaggacctgattaaggagaacaatgctacaaggcacttatgtaacttgctcaaggagacatgcgcaaggtccgcagagaaaacaaaaaagtatgagtatgagagagaggaaacacgccaggtttacatggacctcaacaataacattgagaagatgattacagccttcgaggagctgagggtgcaggccgagaatagcaggctggagatgcactttaaactgaaagaagattatgagaagattcagcatttggaacaagaatacaaaaaggaaatcaatgataaggagaaacaggtgtctctgctcctcatccagattaccgaaaaggagaataaaatgaaggacttgaccttcttgctggaagagagtcgcgacaaggtgaaccagctggaggaaaagacaaaactccagagcgagaatctcaagcagtccattgagaaacagcatcatctgaccaaggaactcgaagacataaaagtatccctccagcgatctgtgtcaacgcagaaagccctggaggaggatctgcagattgcaacgaagacaatctgtcaactcacagaagagaaggagacgcagatggaggaatctaataaagcgagagcagcccatagctttgtggtaaccgagtttgagaccaccgtctgctccctggaagagctgctgagaaccgaacaacaaagactggagaagaatgaggatcaacttaagatcctgactatggagctccagaaaaagtccagcgaactcgaggagatgactaaactgacaaacaataaagaagtggagctggaagagctgaagaaagttctcggggaaaaggagactttgctatatgagaataaacagttcgagaagattgccgaggagctcaagggcaccgagcaggaattgataggcctactgcaggcccgtgagaaggaggtacacgacctggaaattcagctcaccgcaataactactagtgagcagtattactccaaagaggtcaaggaccttaaaacagagctcgaaaacgagaaactgaagaacaccgagcttaccagccattgtaataagcttagtctagaaaacaaagagctgacgcaggaaacctccgatatgacattggaactcaaaaatcagcaagaagacatcaataataataagaaacaggaggagaggatgctgaagcagattgaaaatcttcaggagaccgagacacaactcaggaacgaactcgagtacgtcagggaggaactcaagcagaagcgggacgaagtgaagtgcaagttggacaagagcgaagagaactgcaacaatctgcgcaagcaagttgagaataaaaacaagtacatcgaggagctccagcaggagaataaggcacttaagaagaaaggaacggccgagagtaaacagctgaacgtctacgaaatcaaggtgaacaaactggagctggagttagaatccgccaagcaaaaattcggtgagattaccgatacttaccaaaaggaaattgaggataagaagatttctgaagaaaatttgctcgaggaagttgagaaggccaaggtcattgcggatgaggctgtaaaactgcaaaaagaaatcgataagcggtgccagcacaaaatcgccgagatggttgctctcatggagaagcacaaacatcagtacgacaagatcattgaagaacgggattccgaactgggcctgtataaatcaaaagagcaggaacagtcatccctacgcgcatctctggagatcgaactgtccaacctgaaggccgaacttctgagtgtgaagaagcagctcgaaatcgagcgcgaagaaaaggaaaagttgaaacgcgaagcgaaggagaacaccgccacactgaaggagaaaaaggacaaaaagacgcagacctttctgctggagacacccgaaatatattggaaactggattccaaagcggtacccagtcagactgtctctcgaaacttcacgtctgttgaccatggaatctcaaaggacaagcgtgactacctctggactagtgccaaaaacaccctgtccacccctctgcccaaggcttacactgtaaaaactcccactaaacccaaacttcagcagcgagagaacttgaatatccccattgaggagagtaaaaaaaagcgcaagatggctttcgaattcgacataaactctgattcgtctgagacaactgatttgctgtctatggtctcagaggaagagactttaaagaccctatacagaaacaataatccacctgcatcccatttgtgtgtgaaaaccccaaaaaaggccccatcctcactgacaactccgggttccacgctgaagttcggggccattagaaagatgcgagaggatcgttgggcagtgatcgccaaaatggataggaaaaaaaagctgaaagaggccgaaaagcttttcgtgtag

SEQ ID NO: 136844 - DNA, 2931 bp, Artificial Sequence
  Description of Artificial Sequence: Synthetic coding sequence
atggagaaacagaagcccttcgccctttttgtgcccccaagaagctcatcaagccaggtgtcagcagtgaaaccccagacactgggaggggactcaacctttttcaagtcatttaacaaatgcaccgaagacgactttgaattcccgtttgcaaaaaccaatttgagcaaaaatggcgagaacattgacagcgacccggccctgcagaaagtcaacttcctccccgtgctggaacaggtcgggaacagcgactgtcattaccaggaggggctgaaagacagcgatcttgagaactctgaaggtttgagtcgcgtatactctaaactgtacaaggaagccgaaaaaattaaaaaatggaaggtgagtaccgaagccgagctacgccagaaagagtctaagctgcaggaaaatcgtaaaatcatcgaagcacagaggaaggccattcaggaattgcagttcggtaatgaaaaggtgtcgttaaaacttgaagagggtatacaggagaacaaggacctgataaaagaaaacaacgctacgcgccacctgtgcaatctcttgaaggaaacatgcgcgaggagtgctgagaaaactaagaaatacgaatacgagcgcgaagaaactaggcaggtgtacatggatctcaacaataatatcgaaaaaatgataactgcctttgaagagctgcgggtgcaagcagaaaattctagactggagatgcatttcaaactgaaggaggactatgagaaaatccaacacctggaacaggaatacaaaaaagaaattaatgacaaggagaagcaggtgtccttacttcttatccagattaccgagaaggaaaataagatgaaggacctgactttcctattagaagaatccagagacaaggtgaaccagctggaggaaaagacgaaactgcagtccgagaacctgaagcagtctatcgagaagcaacaccacttgactaaggagctagaagacattaaggtgtccctgcagcgcagtgtgtccacccagaaggccctggaggaggatctgcagattgctactaagactatttgccagctgacggaggagaaggagacgcagatggaggaaagcaataaggcgcgtgccgcccatagcttcgtggtgacagagttcgagacaaccgtgtgtagccttgaagaactccttcggacggagcagcagagactggaaaagaacgaagatcagctgaaaatcctgaccatggaactgcagaaaaagtcctcagagctcgaggagatgaccaaactcactaataataaagaggttgagctggaggaactgaagaaagtgctgggggagaaggaaactctgctgtacgagaacaagcagttcgaaaagatcgctgaggagctcaaggggaccgaacaggagttgatcggcctcctacaggcacgagagaaagaagtgcacgacttagagatccagctcactgcgatcacaaccagcgagcagtactactctaaggaggtcaaggacctgaagacagaactggaaaacgaaaagctaaaaaataccgaactgacaagtcactgtaacaaactgagcttggaaaacaaggagctgacacaagagaccagcgatatgaccctggagctcaagaatcagcaggaggatatcaataacaataagaagcaggaggaaaggatgcttaaacagatagagaaccttcaagaaacagagactcagctgcgcaacgagctggaatacgtgcgagaggagttgaagcagaaacgagacgaggtcaaatgcaagctggataaatccgaggaaaattgcaacaacctacgcaagcaggtggagaataaaaacaaatacattgaagagctccagcaagagaacaaagccctgaagaagaaaggcacagccgagtccaaacagctgaacgtgtacgagattaaagttaataaacttgagcttgaactcgagagcgctaaacagaagttcggagagattacagatacttatcagaaagagatcgaggacaagaagatctctgaggaaaacctgcttgaagaggtggagaaagccaaggtgatcgctgatgaagccgtcaagttgcagaaggaaattgacaaaagatgccagcacaagatcgccgaaatggttgctttaatggagaaacacaagcatcagtacgataagattattgaggaaagggactcagagttgggcctgtacaaatcaaaggagcaagaacagtcgtcacttcgtgcatccctggagattgaactttcgaacctgaaggctgaactattgagcgtgaaaaagcagctggaaatcgagcgggaagaaaaggaaaagctcaaacgggaagcaaaagagaacacggctacgctcaaggagaagaaggataaaaaaacccagacatttcttcttgaaactcccgagatttattggaaactggacagcaaggctgtcccatctcagaccgttagccggaactttacctccgttgatcacggcataagcaaggataaacgtgattacttatggacgtccgccaaaaacaccctctctacccccttgccgaaagcctataccgtgaagactcccaccaagccaaaacttcaacagcgcgagaaccttaacattcccatcgaggagtccaagaagaagaggaagatggccttcgagtttgacattaactctgattcttctgagacgacagacttgctgagtatggtgtcagaagaagaaacactaaaaacactgtatagaaataacaacccccctgcgtcccacctgtgtgtcaagacaccaaagaaagcacctagcagcctgaccacacccgggagcaccttgaaatttggggcgatccgcaaaatgcgagaagatcggtgggctgtgatcgcaaagatggatcgcaaaaagaaattgaaggaggctgagaagttgtttgtgtag

SEQ ID NO: 136845 - DNA, 2379 bp, Artificial Sequence
  Description of Artificial Sequence: Synthetic coding sequence
atggaaaagcagaagccattcgcccttttcgtgccccccagaagttcatcctcccaggtgagtgcagttaaaccgcagactctgggaggtgatagtaccttctttaagtcctttaacaagtgcacggaggacgatttcgagttcccattcgccaagaccaacctttctaagaatggtgagaacattgactccgaccccgctcttcagaaggttaactttctccccgttctcgagcaagtagggaattcggattgccattaccaagaaggcttaaaggatagtgacctggaaaactctgagggactctctcgggtctacagtaagctctataaagaggctgaaaaaataaaaaaatggaaagtgagtacggaagccgaactccgccagaaggaatctaaacttcaggagaaccggaagattatagaggctcagagaaaggcaattcaagaattacagttcggcaacgagaaggtgagcctgaaactggaagaaggcatacaagagaacaaagacctcattaaagagaacaatgcaacgcgtcacctgtgtaatttgcttaaagagacttgtgcaagatctgcagaaaaaacgaagaaatacgaatacgaacgggaagaaacccgacaagtctacatggacttaaataataacatcgagaaaatgatcactgctttcgaagagctgagagtgcaggccgagaacagtaggctcgagatgcattttaagttgaaagaggactatgaaaagatccaacacttagagcaagagtacaaaaaggaaatcaatgataaggaaaaacaagtaagcctgctgctgatccagattaccgagaaagaaaataaaatgaaggacctgactttcctgcttgaagaatctagagacaaggttaatcagctggaagaaaagacaaagctgcaatctgaaaaccttaaacagagcattgagaaacagcatcacctcaccaaagaacttgaggatatcaaggtgagtctccagcgatcagtttctactcagaaagccctcgaagaagacctccaaattgcaacgaagaccatctgccagctcactgaggagaaagaaacccaaatggaggaaagcaataaagcccgggctgcccatagttttgtggtcacagaatttgaaacaacggtgtgttcactcgaagaactcctgaggactgagcagcagcggctcgagaaaaacgaagaccagttaaaaatcctcaccatggaactgcaaaagaagtcctctgaactggaagagatgactaagctgacaaataacaaggaagtcgagctagaggaactaaaaaaagtcctcggagagaaagagacccttctgtatgaaaacaagcagttcgaaaagatagcggaggaactgaagggtacggagcaggagctgattggtctgctgcaggcacgagagaaagaggtgcatgatctagaaattcagctgacggccattacaacaagcgagcagtactactctaaagaggttaaggatctgaaaaccgagctcgagaatgaaaagttaaaaaacactgagctgacttcccattgcaataagctgtccctcgagaacaaggagctcacccaggaaacatctgacatgacactggaattaaaaaatcaacaagaggacatcaacaataacaaaaaacaggaagaacggatgttaaagcagatcgaaaacctgcaggaaacagaaacgcagctgaggaatgaacttgagtatgtccgcgaagaacttaaacaaaagcgcgatgaggtcaaatgcaagctcgataagagtgaagagaattgtaataacctgcggaaacaagttgagaacaaaaataaatacatagaggaactgcagcaggaaaataaggcactcaagaagaagggaaccgctgaaagcaagcagttgaatgtgtacgaaattaaagttaacaagctcgaacttgagctggaatcggccaagcagaaatttggcgagattactgacacttaccagaaagaaatcgaggacaaaaaaatctccgaagagaatctccttgaggaagtagagaaagcgaaggtcattgcggacgaggcagtgaagctacaaaaagaaatcgataaacgctgccaacataagatcgccgaaatggtcgcccttatggaaaaacataagcaccagtacgataaaataatagaggagcgggactccgaacttggcctgtacaagtccaaggaacaagaacagagcagcctgcgagcctctctcgagatcgagctgtctaacttgaaagccgagctgttatcggtcaagaagcagctggaaatcgagagggaggaaaaagaaaaactaaaacgtgaggcaaaggaaaacaccgcgacactgaaggagaaaaaatag

SEQ ID NO: 136846 - DNA, 2388 bp, Artificial Sequence
  Description of Artificial Sequence: Synthetic coding sequence
atggagaaacagaagcctttcgcactctttgtgccccctaggagctcaagtagccaggtgtccgcagtgaaacctcagacactgggaggtgactctacattctttaaaagctttaataaatgcactgaggatgatttcgaatttccattcgccaagacaaatctaagcaagaatggcgaaaacatcgactctgaccctgctttacagaaggttaactttttgcccgtgttagaacaggtcgggaacagcgattgtcactaccaagagggtttgaaggactctgaccttgaaaattccgaagggctgtctcgggtgtactccaaactgtacaaggaggcggagaaaattaagaagtggaaggtttctacggaggccgagctgcgccaaaaggagagtaaattacaggagaatagaaagatcattgaggcccagcgcaaagctattcaggagctccagtttggcaatgagaaggtctccctcaagttggaagaaggtatccaggagaataaggacttaatcaaggaaaataacgcaacacgccacctgtgtaacctgctcaaggagacttgtgccaggtccgcagagaagacaaagaaatatgagtacgagcgcgaggaaacaagacaggtatacatggacctgaataataacatcgagaaaatgatcacagcgttcgaggaactgcgcgtccaggcagaaaatagtagactggagatgcactttaagctgaaggaggattacgaaaaaatacagcacctggagcaggaatacaagaaagaaattaatgacaaagagaaacaggtgtccctcctgctgatccagatcactgagaaggagaataagatgaaggacctgacgttcttgctggaggagagcagggataaggtaaaccagttggaggagaagacaaaactccaatcagagaatctgaaacaatctatcgagaaacaacaccacctgacgaaggagcttgaggacatcaaagtgtctttgcagaggagcgtgtctacacagaaggcgttggaggaagacctgcaaatcgcaacgaaaacaatctgtcagctgaccgaagaaaaggaaacacaaatggaagaaagtaacaaggccagggcagcccattctttcgtcgtgacagagttcgagacaactgtgtgcagcttagaggagctgctgcgcacagagcaacagaggttggaaaaaaatgaggaccagctcaagatcctgaccatggagttgcagaagaagtcttcagaactggaggagatgactaagctgaccaataacaaagaggtcgagcttgaggaactgaaaaaggtcctgggggaaaaagagaccttgctttacgaaaacaagcaatttgaaaagattgcagaggagctgaaaggcactgagcaggaactcattgggttgctgcaggctagagagaaagaagtccatgacctcgagatccagctgacggcgattactacgagtgaacagtactatagcaaagaagtcaaagatctgaagaccgaactcgagaatgaaaaattgaaaaacactgaattaacttcccactgtaacaaattgagcctggagaataaggagctcactcaagagacttccgatatgaccttggagctcaagaatcagcaagaggacatcaataacaacaagaagcaggaagagcggatgctcaagcagatcgaaaatctgcaagaaacagaaacccagctgcgaaatgaactggagtatgtccgtgaagaacttaaacagaaaagagacgaagtgaagtgcaagctcgacaagagcgaggaaaattgtaacaatttgagaaaacaggtggagaacaaaaacaagtacatagaggagctccagcaagaaaataaggccctcaaaaagaaaggcaccgcggagtcaaagcaacttaacgtctatgagatcaaagtgaacaagttagaactggaattggagagcgccaaacaaaaattcggtgaaatcaccgatacttaccagaaggagatcgaggacaaaaaaatatcggaggaaaaccttctggaggaagttgagaaggcgaaggtgatagcagacgaggcagtcaaactgcaaaaggaaatcgacaagagatgccagcataagattgctgaaatggtggccctgatggaaaagcataagcaccagtacgataagatcattgaagaacgcgactctgagctgggcctgtacaaatctaaggagcaggagcaaagttctctcagggcaagtcttgagattgaactgtcaaatcttaaggctgagctcctcagcgtgaagaaacaactagagatcgaacgggaggaaaaggaaaagctcaagagagaagccaaggaaaacactgctacactcaaggaaaagaaagataaaaaatag

SEQ ID NO: 136847 - DNA, 4593 bp, Artificial Sequence
  Description of Artificial Sequence: Synthetic coding sequence
atgccaatcagacctgacctgcagcagctggagaaatgcatcgatgacgcccttcgcaaaaatgacttcaagcccctcaaaactctgctccagattgacatctgtgaagatgtgaaaatcaaatgcagcaaacagttcttccacaaagtcgataacttgatttgccgcgagctgaataaagaggacattcacaatgtatctgccattctcgtgtccgtgggtcgatgcgggaaaaatatctcagttctgggccaggcaggcctgctgactatgatcaaacaggggctgatacagaagatggtggcctggttcgaaaaaagtaaagacataatacagtcgcaggggaattccaaggatgaagccgttctgaatatgatcgaggatcttgtagatttgttgctcgtgattcacgacgtttcagacgaagggaagaaacaagtggttgagagttttgtccctaggatatgttcactggtgatcgattccagggtcaatatttgtatccagcaggaaatcattaagaaaatgaacgccatgctcgataagatgccccaagatgctagaaagatcctgtccaaccaagagatgttaatcttgatgagcagcatgggggagcgcattcttgatgcaggtgattacgacttgcaggttggcatcgtggaagcactgtgcagaatgactaccgaaaaacaacgccaggaactcgcccaccagtggttttctatggatttcatagcgaaagcctttaagaggatcaaggactccgagttcgagactgactgtaggattttcctgaacttagtgaatgggatgttaggagataaacggcgagttttcacatttccttgtctcagcgcctttctggacaagtatgagctgcagatccctagcgatgagaagctcgaggagttctggatcgatttcaatctcggaagccagactctgtcgttttatattgcaggagacaacgacgaccatcagtgggaggccgtcacagtgcctgaggagaaggtccagatctactccatcgaggttagagagagcaagaagctactcaccatcatcctgaaaaataccgtgaagatcagcaagcgagagggaaaagagctgctgctgtacttcgacgcctccctggagatcacaaacgtgacacagaagatcttcggcgccaccaaacaccgcgagagcattcggaagcagggtatctccgtggcgaaaacatccctgcatatactttttgatgcttccggttcccagatccttgtgcccgagagccaaatatcacccgtgggggaggagttagtcagcctcaaagaaaaatcaaagtctccgaaagaattcgcaaaacctagtaaatacattaaaaacagtgacaagggaaacaggaataatagccagttggagaagactacccccagcaaaaggaagatgtctgaggccagtatgatcgtgtccggcgccgatcgctacacaatgaggtctccagtccttttctccaataccagtatcccgcctagacgcagacgcatcaagccacccttgcaaatgacatcttccgcagaaaagccttccgtgtctcagacctcggagaatcgcgtggataacgccgctagcctgaagtctagaagctctgagggaagacacagacgagacaatattgataagcatatcaaaacagccaagtgtgtggagaacactgagaacaagaatgtcgaattcccaaatcagaacttctctgagctgcaggatgtgattcctgattcccaggctgctgagaagagggatcatacgatcctgcctggtgtgctggataatatctgtggcaacaagatacattccaaatgggcctgctggacaccagtgacaaacatcgagctttgcaataatcagagggcttcaacaagctccggtgacaccttaaaccaagacatcgtgattaataagaaactaacaaagcagaagtccagctcttccatctcggaccacaattccgaggggaccgggaaggtcaagtataaaaaggagcagacagatcacattaaaatcgacaaagcagaggtcgaggtttgtaaaaaacataatcagcagcagaaccaccccaaatactctgggcagaagaacactgaaaacgccaaacagtcagattggccagtagagtcggagacaacgttcaaatctgtccttttgaataagaccatcgaagaatcattgatctacaggaaaaagtacatcctgtccaaggatgtgaacacagctacttgcgacaagaacccctctgcttcgaagaacgtacagtcccataggaaagcggagaaagaacttacctcagagctgaactcctgggatagtaagcagaagaaaatgagagagaaaagtaaagggaaagagtttacaaacgtggcagaaagccttatttctcaaatcaataagagatataaaacaaaggacgacattaagagcaccaggaaactcaaggagagcttgattaattccggcttttccaacaagcctgtggtgcagctgtctaaggagaaagttcagaaaaaaagctacagaaaacttaagaccaccttcgtgaatgttaccagcgaatgcccggtgaatgacgtctacaactttaacctgaatggagctgacgaccctatcatcaagttggggattcaggagttccaggctaccgccaaagaagcctgtgccgacagatccattaggctggtggggccaagaaatcatgatgagcttaagtcgagcgttaagacaaaggacaaaaaaatcatcaccaaccatcagaagaaaaacttgttctccgacacggaaacggagtaccgctgtgatgatagtaaaaccgacatatcctggctcagagagcctaagagcaagcctcagctgattgactatagtagaaataaaaacgtcaaaaaccataaatcaggtaagtctcggtcctctctggagaagggccagccatcttctaagatgacgccctcgaagaatattaccaagaagatggataagactataccggagggtaggatccgcctgcccagaaaagctaccaaaaccaagaaaaactacaaggatctctccaactcggagagcgagtgtgaacaagagtttagtcattccttcaaggagaacataccagtgaaagaagagaacatccacagtcgaatgaaaacagtcaagctgccaaaaaagcagcagaaggtgttttgcgccgagacagagaaggagctaagtaagcagtggaagaatagtagcttactgaaagatgctattcgtgataactgccttgatttaagtcccagatctctcagcggtagcccctcaagcatcgaagtcaccagatgtattgagaagatcaccgaaaaggactttacgcaggactacgactgtataacaaaaagcattagcccctaccccaagacatcttctctggagagtctcaattccaacagcggtgtcggaggcacaatcaaatcccctaagaataatgagaagaactttctctgcgcatctgagagttgtagcccaatcccccgacccctgtttttgccacgtcacacgcccactaagtccaacactatagtgaatcgcaagaaaatcagtagcttggttctgactcaggagactcagaatagtaattcctacagcgatgtgagcagctactcctccgaggaaagattcatggagatcgaatcacctcacatcaacgaaaattacatacagagcaaaagagaggaatctcatttggccagctcattaagtaagtccagcgagggccgagagaaaacctggtttgacatgccttgcgacgcaacccatgtaagcgggcctacacagcacctcagccgaaagagaatttatatcgaagacaacctctccaacagcaatgaagttgagatggaagaaaaaggagaaaggcgggccaacttgttgcccaagaagctctgcaagattgaagacgccgatcatcacattcacaagatgtcagagtctgtgtccagcttatctactaatgatttcagcatcccatgggaaacgtggcaaaacgaattcgcggggatagagatgacctacgagacctatgaacgacttaactcagagtttaaacgtagaaataacattagacacaagatgttatcatactttactacacaatcgtggaaaactgcccagcagcacctgcgcacaatgaaccaccagtctcaggatagtagaattaagaagctcgataaattccagtttataatcatcgaggagttagaaaactttgagaaagatagccagtcattgaaagatcttgagaaggagtttgtggatttctgggaaaaaattttccagaagttctccgcctaccaaaaaagcgaacaacagagactccatctactcaaaacttctttggcaaagtccgttttctgcaacaccgattcagaggaaaccgttttcacttctgaaatgtgcctgatgaaggaagacatgaaggtcctgcaggacagactcttaaaggacatgctagaggaggaactgcttaacgttcggcgggagctgatgtctgtgttcatgagccacgagagaaatgctaatgtttag

SEQ ID NO: 136848 - DNA, 4593 bp, Artificial Sequence
  Description of Artificial Sequence: Synthetic coding sequence
atgcctatacggccagatctgcagcagcttgagaaatgcatagatgacgctttgaggaaaaacgactttaagcccctcaagactctgctgcagatcgacatctgtgaggatgtgaagattaaatgctctaaacagttttttcataaggtcgataacctgatatgtcgggagctgaacaaggaggatatccacaatgtcagcgcgatcttggtgtctgtcggcaggtgtgggaaaaacatctctgtcctgggacaggccggtctcctgaccatgattaaacaaggcttaatccagaaaatggtcgcgtggttcgaaaagagtaaagacattatccagagtcaaggcaatagcaaggacgaagccgtcctcaacatgatcgaggatctggtggaccttctgctcgtaattcacgacgtctccgatgagggtaaaaagcaggttgtcgagagttttgtccctcggatatgctcactcgtgatcgactctcgagtgaatatttgtatacaacaggaaattatcaaaaagatgaatgctatgttagacaaaatgccacaggatgctcgcaagattctgagtaaccaagaaatgctgatcctgatgtccagcatgggggagagaatactggacgcaggagactatgatctccaagtcgggatagtagaagcactttgccggatgactactgagaaacagaggcaggaactggcccaccagtggttctccatggattttatcgcaaaggcatttaagaggattaaggactcagagtttgagactgactgcagaatctttctaaatctggttaacggcatgctcggcgacaagagaagagtgttcacattcccgtgcctctccgccttccttgataagtacgagctgcagattccatccgacgaaaaattggaagagttctggatagacttcaatcttggatcgcagacgctgagcttctatatcgcgggtgataacgacgatcatcagtgggaggccgtcaccgtgcccgaagagaaagtgcagatttattccatcgaagtcagggagtcaaaaaaactattaacaattattttgaagaacacagttaagatctctaagcgggaggggaaggaacttctcttgtatttcgatgcttcattggagatcactaacgtgacgcaaaaaatcttcggcgcaactaagcacagggaatccatcagaaagcagggcatatcagtagccaagacctctctgcatattctcttcgacgcttcgggctcgcagatcctagtgccggaatcccagatatctccggtaggcgaagagctagtgtctctgaaggagaagtccaagtccccaaaggagtttgccaagcccagtaagtacataaagaactcagataaagggaatcggaataactctcagctagagaagaccactccaagtaagagaaaaatgagcgaggcctcaatgatagtaagcggggcagatcgatataccatgaggtccccggtgctgtttagtaatacctcaattcctcctcgaagaaggcgcattaagccccccctgcagatgacctccagcgcggagaagccctctgtaagtcagacaagtgaaaatcgagtcgacaatgccgcatctcttaagtccagatcatcggaaggaaggcataggagggacaacattgacaaacatattaagacagccaagtgcgtagagaacactgagaataagaacgtggagttcccgaatcagaatttcagtgagcttcaggatgtgatacctgacagccaggcagccgaaaaaagggaccacacgattcttcctggggtgctggataatatttgcggaaacaagatccattctaagtgggcctgttggactcctgtcaccaacattgagctatgcaacaaccagcgggcttctacaagctcaggcgacacactcaaccaggatatagtcattaacaagaaactcaccaaacagaagtccagttcctcaatcagcgatcataattccgaaggcacgggaaaggtgaaatacaaaaaggaacagaccgaccacattaagattgataaggccgaagtggaagtctgcaaaaaacacaatcagcagcagaaccacccaaaatatagcggccaaaagaacaccgagaacgctaagcagtcagattggccagtcgagtcagaaactacttttaaatccgtgcttctgaacaaaaccatagaggagagtcttatttatagaaagaaatacattcttagtaaggacgtgaataccgctacatgcgacaaaaaccctagcgcatcgaagaacgttcagtcccaccgtaaggctgagaaggagcttacctcagagctaaattcctgggactctaaacaaaaaaagatgagggaaaagtccaaaggtaaagaatttactaacgtggcagaatcccttatctctcagattaataaacggtacaagacaaaagacgacataaaaagtacgcgaaagctaaaagagtccctcatcaactccgggttcagtaacaagcctgtggtccagttgagtaaagagaaggtgcagaagaagagctaccggaaactcaagacaaccttcgttaacgtcacatccgagtgcccggttaacgatgtctataatttcaacttaaatggcgccgacgatccgatcatcaaactgggtattcaggaattccaggcaactgcgaaggaagcctgcgcagatcgtagcattagactggtgggccctcggaatcacgacgaactaaagagcagcgtgaagactaaagacaagaaaataattactaaccaccaaaaaaagaatctgttctcggatacagagacagagtacaggtgtgatgatagtaagaccgacatctcctggctccgggagcccaaaagcaagccccagctgatcgattacagccgcaacaaaaatgtaaagaaccacaagagcgggaagtcccgaagctccctggagaaaggacaaccttctagcaaaatgactcccagtaaaaatataacaaagaaaatggacaagacaataccagagggtaggatccgacttcctcgtaaggccactaagactaaaaagaactacaaagatctcagcaattctgagagtgaatgcgagcaggagttcagccactccttcaaggaaaatatccccgtaaaggaggaaaacattcactcccggatgaagacagtgaaacttcccaaaaagcagcaaaaagtattctgcgctgaaaccgaaaaggagttgagtaaacagtggaaaaattcatcgctgctcaaagacgctattagggataactgtctggatttatctcctagatccctgagcgggtctccctcttccatcgaagttacccggtgcattgaaaaaatcacagagaaggatttcacacaggattatgactgtattacgaagtcgatatcaccatacccaaaaacctcctctctcgagtctctcaactccaactctggtgtgggcgggacaatcaaaagtccgaaaaacaatgagaagaattttttgtgtgcttctgagagctgctctccaatcccccgtccattattcctgccccgccacacaccaaccaagtctaatacaatagtgaaccgcaagaagatcagctctctcgtgctcactcaggagacacagaactccaattcctattccgatgtttcctcatactcatctgaagagagatttatggagatagagagtcctcatattaacgaaaactacatccagtcaaagagagaggagtcccaccttgcctctagcctcagcaagagctcagaagggagagaaaagacctggttcgacatgccatgtgacgccacccatgtgagcggtccgacccagcatttaagtcgaaaaaggatttacatagaagataatctgtctaacagcaacgaggtagagatggaggagaaaggcgagcgtcgggccaatctgctgcctaagaaactctgcaagatcgaggatgccgatcaccatatacacaagatgagtgagtccgtgagttccctgagcactaacgattttagcattccatgggaaacttggcagaacgagtttgctggaatcgagatgacctatgagacatacgagcgactgaactctgaatttaagcgcaggaacaatattagacataagatgctttcatacttcacaactcagagttggaagaccgcacagcagcatctgaggaccatgaaccaccagtcccaagatagccggattaaaaaactggacaagttccagtttataattatagaggaattggagaattttgaaaaggacagccagagcctgaaagacctcgaaaaagagttcgtggatttctgggaaaaaatatttcagaaattctcagcgtatcagaagtccgaacagcagaggcttcacctgctgaaaacaagcttggcgaagtcagtgttttgcaacactgatagcgaggagacggtgtttactagtgaaatgtgccttatgaaggaggatatgaaggtccttcaggacaggctgctgaaagacatgctcgaggaggagctcctgaatgtgaggcgagagctaatgtctgtcttcatgtctcacgagcggaatgccaacgtctag

SEQ ID NO: 136849 - DNA, 3072 bp, Artificial Sequence
  Description of Artificial Sequence: Synthetic coding sequence
atgcccatccgtcccgacctgcaacagctggaaaagtgtatagacgatgccctccgtaaaaatgatttcaagcccttgaagaccctccttcagatcgacatatgcgaggatgttaaaatcaagtgttccaagcagttttttcacaaggttgacaatctgatttgtagagagctcaataaagaagatattcataacgtaagcgctatattggtttccgtaggaagatgcggtaaaaacatctctgtgctcggacaggctgggctgctgacaatgattaaacagggtcttattcaaaagatggttgcttggttcgaaaagagcaaggacatcattcagtcacaaggaaacagtaaggacgaagcagttctcaatatgatcgaagacctcgtggatcttctgcttgtcattcacgatgtttcagatgaggggaagaaacaggttgtggaatctttcgtcccccgcatatgcagtttggttattgactctagagtcaatatttgtatccagcaggaaatcattaagaaaatgaatgcaatgttggacaaaatgccccaagacgcccgaaaaatcctgtccaaccaggagatgctaattctgatgagcagcatgggggagaggatcctcgacgctggggactatgatctgcaagttgggatagtggaggcgctgtgccgcatgaccactgagaagcagaggcaggaacttgctcaccagtggttttctatggacttcattgccaaagcgttcaaaaggattaaggactctgagttcgagactgactgccgtatctttctgaacctcgtgaatggcatgctcggtgataaacgacgtgtattcacttttccttgcctgagtgcttttctcgacaagtacgagcttcaaatcccctctgatgagaaactagaggagttttggatcgactttaacctgggcagccagacactttccttttacatcgccggcgataacgatgatcatcaatgggaggctgtcaccgtccctgaggaaaaggtgcagatttacagtattgaagtgcgcgaatccaagaaactcctgacaatcattctgaaaaataccgtgaagatctccaaacgggaggggaaagaattgctcctttatttcgacgcatccctcgagatcaccaacgtgacacagaagatctttggagcgaccaagcacagggagagcatccgtaaacaggggatctctgtggcaaagaccagcttgcacatccttttcgatgccagcggaagtcagatcctggtccccgagagtcagatttcacccgtcggggaagaactcgtgtctctgaaggagaagtccaaaagccccaaggagttcgccaaaccttctaaatacatcaagaattcggataagggaaatcggaacaatagtcagctcgagaagaccaccccttcgaaacgcaagatgagcgaggctagcatgatcgtttctggagccgaccgttacacaatgagatctccggttctctttagcaatacatcaattcctccccggaggcgccgtattaagcctccccttcagatgaccagcagcgccgaaaaaccatccgtgtcgcagacttccgagaaccgggtggacaatgctgcatcactcaagtctcgctcatccgaagggcgacatcgacgcgacaacatcgataagcacatcaaaacagctaagtgtgtcgagaataccgagaacaaaaacgtggagtttccgaaccaaaacttctctgagctgcaggatgttatccccgactcccaggctgctgagaaacgcgaccacaccatactgcccggggttctagacaatatttgtggcaacaaaatccactctaaatgggcttgttggacccccgtgacaaatatcgagctttgtaataatcagagagccagtacttcttcaggggataccttgaaccaagatattgtcatcaacaaaaagctgacgaagcagaagtcgagcagttctatcagtgaccataatagcgagggaacgggcaaagtgaaatataaaaaagagcagacagatcacattaagatagataaggccgaggttgaagtgtgcaagaagcacaatcagcagcagaatcaccctaagtactctggtcagaaaaatacagagaacgctaaacagtctgactggcccgtggagtctgagactaccttcaagtccgtgttgctcaacaagacaattgaagagtctctgatctaccgcaagaagtatattctgagcaaagacgtcaacactgccacctgcgacaagaacccatcagcgagcaagaacgtccagagtcaccggaaggcggagaaggaactcacgtcagagctgaactcatgggacagcaagcagaaaaagatgcgtgagaaatcaaagggcaaggaatttacgaatgtggcagaaagtctgatcagccagattaacaagcgatataagaccaaggatgatataaaaagcacacgcaaactcaaggagagcctgattaactctgggttctctaataagcctgtcgtccagttgtcaaaagaaaaagtccaaaagaaatcatataggaaattaaagacgacattcgtgaacgtgacgtctgaatgccctgtgaacgatgtttacaattttaacctgaacggagccgacgatcctatcatcaaactcggcattcaagagttccaggcaacggccaaggaggcctgtgctgataggtccattaggctcgtgggacctcgtaaccacgacgagttaaagtcctccgttaaaacgaaagacaagaagatcattacaaatcatcaaaagaagaatttattctcagatactgagaccgagtaccgctgtgatgactccaagacggatatctcgtggctgcgcgagcctaagtccaagccccagctgattgactattcaaggaacaagaacgtaaaaaatcacaagtcaggaaagagtaggtcttccctcgaaaaggggcaacctagcagcaaaatgacaccttctaaaaatataactaagaagatggacaaaaccatccctgagggacggatacgtctgcccaggaaggccaccaagacaaagaagtag

SEQ ID NO: 136850 - DNA, 711 bp, Artificial Sequence
  Description of Artificial Sequence: Synthetic coding sequence
atggtcagctccggcaaaaagtactcccggaagtctggcaaaccttctgtggaggatcaattcactcgtgcttacgactttgagacagaggataagaaggatctgtctggctccgaggaggacgtgatcgaagggaagacggccgttatcgagaaaagacgcaagaaacggtccagtgcaggggttgtcgaggacatggggggcgaagttcagaatatgctagagggcgtcggagtagacatcaataaggccctactggctaagagaaaacgactggagatgtatactaaagcctcccttaagactagtaaccagaagatcgagcatgtttggaagacacagcaagatcagcggcagaaacttaatcaggagtattcccaacagttcctgacactgtttcagcagtgggacctggatatgcagaaggccgaggaacaagaagaaaagattttgaatatgttcagacagcagcaaaagatcttgcaacaaagcaggatcgttcagtcccagaggttgaagacaattaaacaactgtatgagcaatttataaaaagcatggaagagctggagaaaaatcacgataatctcctaacaggcgcccagaatgaattcaaaaaggagatggccatgctgcagaaaaaaattatgatggagacacagcagcaagaaatcgcgagcgttcgtaaatctctgcagtctatgttattttag

SEQ ID NO: 136851 - DNA, 711 bp, Artificial Sequence
  Description of Artificial Sequence: Synthetic coding sequence
atggttagttctgggaaaaagtacagtcgaaagagcggcaagccttcagttgaagatcaatttactcgtgcttatgatttcgagaccgaggataaaaaagacttatctggctctgaagaggacgtaatcgaaggcaaaaccgcggtaatagaaaagcggcgtaaaaaaagatcatcagcaggtgtcgtcgaggacatggggggagaggtgcagaacatgttggagggagtcggggtcgatatcaacaaggcgctgctggctaagcgcaagcggctggaaatgtacaccaaggccagcttgaagactagtaaccaaaaaatcgaacatgtgtggaaaacccagcaagaccagcgccagaaacttaaccaggaatactcccagcagttcctgaccctctttcagcagtgggatttggatatgcagaaggcagaagagcaggaggagaagattcttaacatgtttaggcagcagcagaagatcttgcagcaaagcaggattgtccagtctcagaggctcaaaacgattaagcagctttacgaacaattcattaagtctatggaggagttggagaaaaatcatgacaatctgctcacaggagcccagaacgagttcaaaaaggaaatggcaatgctgcagaaaaagattatgatggaaacccaacaacaagagatagcctccgtacggaagagcttgcagtccatgctgttttag

SEQ ID NO: 136852 - DNA, 711 bp, Artificial Sequence
  Description of Artificial Sequence: Synthetic coding sequence
atggtaagtagtggaaaaaaatactcaaggaagagcggcaagccctccgtggaagatcagttcaccagagcctatgactttgagacagaagacaagaaagacctttcaggcagtgaggaagacgtcatcgaaggtaagaccgcggtgatagaaaagagaaggaaaaagaggtcatccgctggggttgtcgaggacatggggggtgaggtccagaatatgctggagggcgtcggggtggacatcaacaaagccttgttggccaagcgcaagcggctggagatgtacaccaaagcgtctttgaagacatctaatcaaaagatagagcatgtttggaaaacacagcaggatcagcgacagaagctcaaccaggagtacagccagcaattcctgacattgtttcaacagtgggacctcgacatgcaaaaggcagaagaacaagaggagaagatcctcaatatgtttaggcagcagcaaaaaatcctccagcagtctcgcatcgtccagagccagcggcttaaaactatcaagcagctgtatgagcaatttattaaaagtatggaagagctggagaaaaaccatgataacctgctcaccggcgctcagaacgagttcaagaaggagatggccatgctccagaaaaagattatgatggaaacccagcagcaagaaatcgcgtcagttaggaagtctcttcagtctatgcttttttag

SEQ ID NO: 136853 - DNA, 942 bp, Artificial Sequence
  Description of Artificial Sequence: Synthetic coding sequence
atgcttctgctcgcagatatggatgtggtgaatcagctggttgccggcggacagtttcgggtggtgaaggagcctctcggatttgtgaaggtgctacagtgggtcttcgctatctttgccttcgccacctgcggttcctactcaggagaattacagttaagcgtggattgcgccaacaagactgaatctgacctgtctatagaggttgagttcgagtatcccttccgactgcaccaggtgtactttgatgcacccacctgccggggcgggactaccaaagttttccttgtcggtgattatagctcttcagctgaattctttgtcactgtcgctgttttcgcctttttgtactctatgggagccctggccacatatattttcctacagaacaaataccgcgagaataacaagggccccatgctggactttctcgcaacagctgtgttcgccttcatgtggctggtctccagctctgcatgggctaagggattgagcgatgtaaaaatggcgaccgatcctgaaaatattattaaagaaatgcctgtgtgcaggcagacaggaaatacgtgcaaagagttgcgtgatcctgtgacatctgggctgaacaccagcgtagtgttcggctttctcaacctggtactctgggtcgggaacttgtggttcgtcttcaaggaaaccggctgggcggctccctttctgagagcccccccaggtgcgcccgaaaagcagcctgcgccgggagacgcttacggcgacgctggttatggccagggacctggaggatacggcccccaggatagctatggccctcagggaggctaccaaccggactatggccagcctgcggggtcaggcggcagtggatatggaccacaaggggattacggccaacagggatacggaccgcaaggggcacccacctcgttttccaaccagatgtag

SEQ ID NO: 136854 - DNA, 942 bp, Artificial Sequence
  Description of Artificial Sequence: Synthetic coding sequence
atgctcctactggccgacatggatgtcgtaaaccagctcgtggcagggggtcagtttagggttgtcaaagaacctttaggttttgtgaaagttctccagtgggtcttcgcgatattcgcctttgcaacctgcggcagttattccggcgagctgcagctgagtgttgattgcgcaaataaaaccgaatctgaccttagcatcgaggtcgaatttgagtacccatttagactgcatcaggtgtactttgatgcacctacttgccgtgggggaaccacgaaggttttcctggtgggcgactactctagctcggcggaatttttcgtaaccgtggccgtgttcgccttcctttattctatgggggcactggccacatatatattcctccagaacaaatatagggaaaacaataagggacccatgctcgacttcttggcaactgccgtgtttgccttcatgtggttagtctcgagcagtgcttgggcgaaaggactgtccgatgtgaagatggcaaccgaccccgagaatattatcaaggaaatgcctgtgtgccggcagactgggaacacatgtaaggaacttagggaccctgtcacgagcggcctaaatacatcagttgtgttcgggtttctgaacctggtgctgtgggtgggaaacctctggttcgtgttcaaggagactggttgggccgcaccctttctccgtgctccaccaggagcccctgagaaacagcccgcgcctggcgatgcctatggcgacgccggttacggccagggaccaggaggttacggaccacaggactcttatggtcctcagggaggctatcagcctgattatggtcagccagctggcagtggggggagcgggtacggccctcagggggattatggccagcaggggtacggtccgcagggcgcgcctacctctttcagcaaccagatgtag

SEQ ID NO: 136855 - DNA, 588 bp, Artificial Sequence
  Description of Artificial Sequence: Synthetic coding sequence
atgggggcccttgccacctacatctttctccagaacaaatatcgcgaaaataacaagggacctatgctcgacttcttggctactgctgtgtttgccttcatgtggctggtctcatcctcagcgtgggctaagggcttatctgatgttaagatggccaccgatcctgagaacatcatcaaggagatgcccgtgtgcagacagacaggcaacacctgtaaagagctgcgtgatcccgtgacatccggcctgaatacaagcgtcgttttcgggttcctaaacctggtgttatgggtcggcaacctgtggtttgtttttaaagagactggctgggccgcaccgtttctcagagccccacctggtgctcctgagaaacagcccgcgcccggcgacgcttatggcgatgctggctatgggcaggggcccggcggatacggaccccaggatagctatggaccccagggcggctaccagccagattacgggcagcctgcaggctcaggggggtctgggtatggtcctcagggcgactatggccaacaggggtacggaccccaaggagcccctacctccttctccaatcaaatgtag

SEQ ID NO: 136856 - DNA, 2712 bp, Artificial Sequence
  Description of Artificial Sequence: Synthetic coding sequence
atggaaggctattcagaggaggcgtccctcctccgccacctggagaaggtcgcttctgaggaagaggaggtccccttggtggtctacctcaaagagaatgcggctctgctgacagccaatggcctgcatctctcccaaaaccgagaagcccagcagagttctcctgcgccccctcccgccgaggtccactctcccgcagccgacgtaaaccagaacctggctagccccagtgcgacgctcactacccctacctccaattcttcgcataatccccctgccaccgatgtgaaccagaatccacctgccaccgtggtgccccagagcctgccactatcatcaattcagcaaaattcttcagaggctcaactgcctagcaacgggacggggcccgcctctaaaccaagtacattatgtgctgacgggcaaccccaggcaccggccgaagaagtcaggtgtagtaccctgttgatcgataaggtgtcgacccctgccaccaccacctctacgttcagtagagaggctaccttaataccaagtagtaggccacccgccagtgacttcatgagctctagcctgctaatcgatattcagcctaacactcttgtggtctcagcggatcaggaaatgtccggtagggccgccgcaactactcccactaaggtttattctgaagtgcattttacgctggcgaaaccacccagcgtggttaaccggacggctagaccctttggtatccaggcacccggaggtacaagccagatggaacgctcgccgatgctggagcggcgccacttcggggaaaaggcaccagctccccagcctcccagcctgcccgaccgcagcccgaggccacagcgccacattatgtcccgctctcccatggtggaacgacgcatgatggggcagagatctccagcctcggagcgccgacccctcgggaacttcaccgccccccccacatatactgagacactctctaccgcaccactggcatcgtgggtgagatcacctccatcttattctgtcctttatcctagttccgacccaaagtcctcacacctgaaaggccaggccgtccccgcctcaaagacaggcattctggaggagagtatggccagacggggctcccgaaagagcatgtttacattcgtcgagaaaccaaaggtgacccccaaccccgacctgctcgacctggttcagaccgctgacgagaaaagacgtcagcgagatcaaggagaggtgggcgtggaggaagaaccctttgccctcggtgctgaggcatctaacttccagcaggaaccagctccaagggatcgagcgagtcccgctgcagctgaggaggtcgtgcccgaatgggcttcctgtttgaaatctccccgcattcaggccaagccaaaacctaagcccaaccagaatcttagcgaggcttctggtaagggagctgagctctacgcaaggagacagtcgcgcatggagaaatacgtgatcgagagcagttcccatactcccgaactggcccggtgcccaagccccactatgtccctcccctcttcatggaagtatcctaccaacgctcccggggcattccgggtggctagcaggtctcctgcccgcactccgccagcatcgttataccatggttacctccctgagaatggcgtcttgcgcccagagcctacgaagcagcccccctatcagctaagaccatctctgttcgtacttagccccattaaagagcctgccaaagtatcccctcgagccgcgagcccagccaaaccatcttctctggacctggtgccgaatttgcccaagggtgctttgcccccgagccccgccctgccgcggcccagtcggtcgtctcccggcttgtacacatcccctggtcaggattctcttcaacctaccgcggtgagccccccttatggcggtgacatcagcccggtctctcctagtcgagcgtggagcccgcgcgcgaagcaagcccctcggcctagtttttcgacccgtaatgctgggattgaggcgcaggatcggagggagtctctacctacgagtcctccatggaccccgggggccagtagacctccatcatctctcgatggatgggtaagcccaggcccctgggagcccggaaggggctcctccatgagttcaccccctcctctaccccccccaccacctatgagccccagttggtccgagcgctccgtgagccctctgagacctgaaacagaggctagaccgccatcgagacagctgcaggcattgctggctcgaaatattataaacgcagccagacggaagagtgcctcccccagatctgcaggcgctgagaatcctcggccgttttctccaccccgagcccccccgcccccacctccaccacctcccccccctcccaggatgcggagcccacaacctgccaggcctgggtcagcagccgtgcctggggcggctttcgcccctatcccaagatccccactcccggccggaccgtcctcttgcacgtcacctagatcccccctgcctgcaccgcccagaccattcctatacaggagaagccccacagattcagatgtgtcccttgactctgaagactcaggggccaagtctccaggcattctgggatacaatatctgtcctagaggctggaacgggtctctgcgcctgaagcgggggtctctgcccgcagaggcttcttgtaccacctag

SEQ ID NO: 136857 - DNA, 2790 bp, Artificial Sequence
  Description of Artificial Sequence: Synthetic coding sequence
atgttgggcccacatttacctcccccccccctggcaccttccgaaggtcggcctacaccatgtgctttccagatccctgatggttcctacaggtgtctagctcttgaggccgaggagtcatctggagaggaaggcctgcagggagaagttggcccgaccgacctggaggaagatgagggcgtgtcacgaagcggagacgacagcgcctgtagagtaactcagggaacgccacagcttcctaaagcgttgggcatccagccacctagctgttcacgggaggagcagggcgcatcacaacacgatgaccgcgcaagtcaggactgggacgtggtgaaagccgggcagatgatgacggctagcccaagtcctggtcctggacccagagtcgctcagaaacctgcgctggggcggtctaccagcctcaccgaaaaagacctgaaggaggccaaggccagatcccagcagatcgctgctcagctgactacccctccctcatcaaattctcgcggtgttcagcttttcaaccgtagaagacaaagggtgaacgaattcacactggaaagccacgggcagagaggacagaaacctagccaggagtcactgcgagtgctgccctcaagtctgccggggcacgcccccgggttaagtctatcttccactagcctgcctgagccaggacccccacgccatccaagtcctcagtcccctgataggggcgtgcccgggcacagtatggagggttacagcgaggaggccagtctgttgcgacatctggaaaaggtggctagcgaggaagaagaagttcctcttgtggtctacctgaaggaaaacgctgcgctcctgaccgccaatggtctacatctgtctcagaacagagaagctcagcagtcctctcctgctccgccacctgcggaagtacatagccccgccgctgatgtaaaccagaacctcgctagtcctagcgcaaccctcacaactcctacttccaactcttctcataaccctcccgcgaccgatgtcaaccagaatcctccggcgaccgtcgttccacagagtcttccactgtcatccatccagcagaattcaagcgaagcccaactaccaagcaacgggaccgggccagccagtaaaccgagtaccttatgtgctgatgggcaacctcaggccccagctgaagaagtaaggtgctccacattactgatagacaaggtctcaacgccagccactacaactagcaccttctcaagggaggctactctcataccctcctcccgacctccagctagcgatttcatgagcagttccctgctgatcgatattcagccaaacactttggtcgttagcgctgatcaggagatgtcaggacgtgcagccgctactacgccaacgaaggtatatagcgaagtgcacttcactctggctaagcccccgtccgtcgtaaacagaaccgctagacccttcggcatacaggcgcccggaggaacatcgcaaatggaacggtccccaatgctggaacggcggcacttcggcgaaaaggctccagccccccagcctccctctctaccagatagaagcccaagacctcaaagacatattatgagtcgatcacctatggttgagagaagaatgatggggcaaagatctcctgcatctgagagacggcctcttggcaactttacggcccctcccacctacactgagactctgtcgacagcaccactggcctcttgggtacgtagccctccttcttatagcgtattgtaccccagcagtgatccgaagagctcccaccttaaaggtcaagcggttcctgccagcaagacaggcattctcgaggaatcaatggcccgacgtggcagccgcaagtcaatgtttacattcgtagagaaacccaaagttacacctaatccagacctgcttgaccttgttcaaacagccgacgagaaacgacgacagcgggatcagggggaagtgggggttgaggaggaaccctttgccttgggggccgaggcatccaattttcaacaggagcctgctccgcgggatcgggcttccccggccgccgctgaggaggtggtgcctgagtgggcgtcttgcctgaagtccccgcgaattcaagccaaacctaaaccaaagccaaaccagaatctcagtgaggctagtggtaagggcgcagagctttatgccaggagacagagtcggatggagaaatatgtcatcgagagctcctcccatactcccgaactagcccgctgtcctagcccaactatgtcgctgccaagttcctggaaatacccgaccaatgctccaggagcatttcgggttgcctcaaggtcccctgcaagaactcccccagcgtctctctaccacggctatctaccggagaacggggtgcttcgacccgagcctacaaaacagccaccataccagcttagaccatctctcttcgtcctgtccccaatcaaggaaccagccaaggtcagtcccagagccgcaagtcccgcaaagccttctagtctggacctggtccccaacttacctaagggagcgctgcccccttcaccagcactcccaagaccaagcaggagcagccccggcctctatacttccccaggccaggacagtctccagcctacggccgtctcccccccttacggcggtgatatatcccccgtttctccaagtagagcttggagtccccgggccaagcaagccccaagaccatccttctcaacacgaaacgccggaattgaagctcaggtctggaaaccatctttttgtttcaagtag

SEQ ID NO: 136858 - DNA, 2058 bp, Artificial Sequence
  Description of Artificial Sequence: Synthetic coding sequence
atggagggttattctgaggaggcgagcctgctcagacacctggagaaagttgccagtgaagaggaggaggtgcccctggtggtttacttgaaagagaacgcagcactgttaactgctaacggtctgcatctgtcacagaaccgcgaggcacagcagagtagcccggccccacctccagcagaggtgcacagtcccgccgctgatgtgaatcagaacctagcgagcccttctgcaactctaacaaccccaactagcaattcatcgcacaaccctcctgcaacggacgtcaaccagaaccccccagccacagtagtccctcagagcctgcctttgtcctctattcagcagaattcttccgaggcccagctgccgagtaacgggaccggaccagcctccaagccttccaccctatgcgccgacggccagccacaagcccccgctgaagaagtgagatgcagcacactgctgatcgataaggtgtcgacccctgccaccacaacttctactttcagtcgtgaggcaacattgattccgagttccaggccaccagctagcgattttatgtcttccagtttacttattgacatccaaccaaatacactagtcgtctccgccgaccaggagatgtcaggccgggccgctgctactacccccactaaagtctacagtgaggttcatttcacacttgccaaacctccatcagtcgtgaaccgaaccgcaaggccctttggcatccaggcccccggcgggaccagccagatggaacgtagtcccatgctagaacgaagacattttggcgaaaaggccccggcaccacagccacctagcctgcctgaccggtctccgcgaccccagagacacattatgtcacgctcgccgatggtggagcggcgaatgatggggcagcggtctcctgcttctgagcgccgacccctggggaatttcaccgccccgcccacatacacagagaccctgagcactgcaccactcgctagttgggtaaggagtccccctagttactctgtcctatacccatcctcagaccctaagtcttctcacttaaagggacaagctgtgcccgcctccaaaactggtattctcgaagagtctatggcacgccgcgggtcacgtaagtctatgttcacattcgtggaaaagccaaaggtgaccccaaatccagaccttctggatcttgtccaaaccgccgatgaaaagaggagacaaagggatcagggcgaggtgggcgtcgaggaggaaccctttgcccttggtgccgaggctagtaattttcagcaggagcccgccccccgagacagagccagccccgctgctgccgaggaagtggtgccagaatgggcatcgtgcctgaaatccccacggattcaggccaaaccaaagccaaagccaaaccagaacctatctgaagcctcaggcaaaggggccgaactgtatgcccgccgccaaagtcgcatggagaagtatgttatcgagagtagctcacacacccctgaattagccagatgtccatccccaacaatgagtctgccatcatcttggaagtacccaaccaatgcccctggagcttttcgggtcgcttcccgaagccctgcacgtacgcccccagccagcctgtaccatgggtacctcccagagaacggtgtactacgtccagaaccaactaaacagcccccttatcagctgaggccctccctttttgtgctatccccaatcaaggagcccgccaaagtgtcccctcgagccgccagccctgcaaaacccagtagcctggacctggtgcccaatctgcctaaaggggcgttacctccaagccctgctttaccaagaccatccagaagtagtccaggactgtatacctcacctgggcaggatagcctccagcccacagcagtctccccaccttatggtggcgatatctcacccgtttcgccctcccgggcctggagcccgagagctaaacaagctcccaggccctccttttcgacccgcaacgccgggattgaggcccaggtgtggaagccctccttctgctttaaatag

SEQ ID NO: 136859 - DNA, 2790 bp, Artificial Sequence
  Description of Artificial Sequence: Synthetic coding sequence
atgttgggcccccatttgcccccaccaccgctggcgccctctgaggggaggccgaccccttgcgctttccaaatcccagatgggtcttaccggtgtctggcattagaagctgaagaaagctcgggcgaagaagggctgcagggtgaggtcggccctaccgatctcgaagaggatgagggagtgtctcgttcaggcgacgattccgcctgccgagtgacccaaggcactccacagctcccaaaggcactgggcatccagcctccatcctgttccagggaagagcagggggcatcacagcatgatgatagggcctctcaagactgggacgtggtcaaggccggacagatgatgaccgcctccccgtcgcccggaccaggaccaagggtggcacaaaaacctgccctcggacgatcaacaagtctgacagaaaaagatcttaaggaggccaaggcccgtagccaacagattgccgcccagttgaccacaccgccaagttctaatagccgcggagtacagctctttaaccgccgacgccagagagtaaacgaatttactctcgagagccatggccagagaggtcagaagcccagccaggaatccctcagagtactacccagtagcctgcctggccacgcccctggactatccttaagttccacctctttgcccgaacccggaccccctcgccacccttctccacagagccccgaccgaggcgtgcccggccatagcatggagggatactccgaggaggcgagtctcttgcggcatcttgagaaggtcgcaagcgaagaagaagaagtgcccctggttgtgtatctcaaggaaaacgccgctctcctgacagcgaacgggctgcacctgagccagaatcgggaggcacagcagagttctcccgcccctcctcccgccgaggtacactctccggccgcggacgtcaaccaaaatctggcatcaccatccgcgaccttgacaactcctacctccaattctagtcataatcctccagctacggacgtgaatcagaaccctcctgcaactgttgtgcctcaatcactccccctcagttccatccaacagaattcgtccgaagcccaactgccttctaatggcacaggaccagcatcaaaaccttctactctttgcgcagatgggcagccacaggcccccgccgaggaagtccggtgctcaacgctgcttatcgataaggtgagtacccccgccactacaacatcgactttttcacgcgaagccactttgatcccctcgagcaggcccccagcaagcgactttatgagcagttccctgctcatcgatatccaacctaataccctcgtcgtgtccgcagatcaggaaatgtcaggcagggctgccgccacaacaccgaccaaggtatatagtgaggtgcacttcactctggccaaacccccttcagttgtcaatcgtactgcaagaccatttggtatccaagcaccaggcggaacctctcagatggagcggtccccaatgctcgaacgacgccatttcggcgagaaagcacctgcgccacagcccccctcgctcccagaccgatcacctcgccctcagcgacacatcatgtccagatccccaatggtcgagcgccgcatgatggggcagcgttctcctgcatcagagaggaggcctctaggcaatttcacggcaccccccacctacacagagaccctctccacagcacccctggcaagctgggtacggtcaccgccctcttattctgtcctctacccttcttccgacccaaagagctctcatctcaaggggcaagctgttcctgcgagcaagacaggcatcctggaggaatccatggccaggaggggaagccgcaaatcgatgtttacttttgtggagaagcctaaagttactccaaacccagatctgctggatctagtacaaacagctgatgagaaaaggagacagcgcgatcagggggaggtgggggtggaggaagaaccattcgccctgggcgccgaggcctcgaactttcagcaggaacccgcgcctagggaccgggcgagcccggctgctgccgaagaggtggtgccagaatgggcttcatgcctgaaatcaccacgcattcaagcaaaaccaaagccgaagcctaaccaaaacttgagcgaagccagcggcaagggagccgagctttacgccagaaggcagagtaggatggagaaatatgtgatcgagtcatcaagtcacacccctgagttggctagatgcccaagtcctacaatgtccctgccaagttcctggaaatatcccactaacgcgccgggggcttttcgggtggcaagcagaagtcccgctcgaactccgcccgcctctctatatcatggatacctccccgaaaacggtgtgctgaggccagaaccaaccaaacaacccccctaccaactaagaccctccttgttcgtcctgtcacccataaaagagcctgcgaaagtttcccccagagccgcgtcaccagccaagccaagttcattagatttggtgcccaacctgcccaagggggccctgcccccctctcccgcactgcccaggcctagtaggagctccccgggattatacacaagccccggacaggactcgctgcaacctactgcagtctcccctccttacggcggtgatatatcccccgtgagcccgtcacgcgcgtggagtccaagggccaagcaggcaccccggccttccttctccacccggaacgcaggcatagaggctcaggtttggaagccctctttttgtttcaaatag

SEQ ID NO: 136860 - DNA, 636 bp, Artificial Sequence
  Description of Artificial Sequence: Synthetic coding sequence
atggacaatttgagttctgaggaaattcaacaaagagcacaccagattacagatgaatccctcgaatccacaagacgcatcctcgggctggcaatcgagagccaggatgccggcatcaaaacaataacgatgttagatgagcagaaagagcagcttaatagaatcgaggaagggttggatcagatcaacaaagatatgcgcgagacggagaagacactgaccgagctcaacaagtgttgcggcctttgtgtgtgtccttgcaataggactaaaaattttgagtcgggtaaggcgtacaagactacttggggggatgggggagaaaactctccttgtaatgtcgtatcaaagcagcccgggcctgtgacgaatggccagcttcagcaacccactacaggggccgctagtggaggctacatcaaacggattactaacgatgccagggaagacgagatggaggagaacctaacacaagttggaagcattctcggcaacctgaaggatatggccttgaatataggcaatgagatcgacgcacaaaaccctcagattaaacgcattaccgataaggctgataccaatcgggaccgtattgatatcgctaacgcacgggctaaaaaactcatagactcttag

SEQ ID NO: 136861 - DNA, 477 bp, Artificial Sequence
  Description of Artificial Sequence: Synthetic coding sequence
atggacaacctttcctccgaggaaattcagcagcgcgcccatcagataacggatgaaagtctggaatccactcgccgcattctcggcctggcgatcgaatcgcaggatgctggtataaagaccattactatgctcgacgagcagaaagagcagctgaacaggattgaggagggtctggaccagatcaataaggatatgcgggaaaccgaaaagacactgacagagctcaataaatgctgcggcctctgcgtctgtccctgcaatagtatcactaacgacgcaagggaggacgagatggaagaaaacttgacgcaggtgggttctattcttggcaacttaaaagatatggccctaaacattggcaacgaaattgatgcccagaacccacaaattaagcgaatcacagataaggcagatacgaaccgcgacaggatcgatatagctaatgctcgcgccaagaagttaatcgacagttag

SEQ ID NO: 136862 - DNA, 477 bp, Artificial Sequence
  Description of Artificial Sequence: Synthetic coding sequence
atggataacctgtctagcgaggagattcaacaacgggcccatcaaattactgatgagagtttagagtctacaaggcgaatcttgggcctggcaattgagtcacaggacgccggcattaagactatcaccatgctcgacgaacagaaagagcagttaaaccggatcgaagagggcctcgaccagattaacaaggatatgagggagactgaaaaaacattaacggagctgaacaagtgttgcgggctgtgcgtatgtccatgcaactcgattactaacgacgctcgcgaagatgaaatggaggaaaatctcactcaggtgggttcaattctgggaaacctgaaagatatggccctgaacatcggtaacgagattgacgctcaaaaccctcagatcaagaggataactgataaggcagacaccaacagggacaggatagatatcgcaaatgccagggcaaaaaagctcatcgatagttag

SEQ ID NO: 136863 - DNA, 621 bp, Artificial Sequence
  Description of Artificial Sequence: Synthetic coding sequence
atggctgaggacgcagacatgaggaacgagctcgaagagatgcaacgaagagcagatcagctcgcagatgaaagcctcgagtcaacaagaagaatgctgcagctggtcgaagagtcaaaagacgctggtatacgcacactggttatgctcgacgagcagggagagcagctcgagcgaatagaggagggaatggaccagatcaataaagacatgaaggaggccgaaaaaaatctcacagatctgggcaaattctgtggactgtgcgtgtgcccatgtaataaattgaagtcttcagatgcttataagaaggcctgggggaacaaccaggatggagtcgtggcctctcagcccgcaagggtggttgacgagagggaacaaatggctatttccggcggatttatcaggagagttacaaacgatgcacgcgagaatgagatggacgagaaccttgagcaggtatcaggcattatcggcaacctgcgacacatggcattggatatgggcaatgagattgatactcagaaccgacagatagaccggatcatggagaaggccgattccaacaagaccaggatagatgaagcaaaccagagagccaccaagatgttgggcagcgggtag

SEQ ID NO: 136864 - DNA, 621 bp, Artificial Sequence
  Description of Artificial Sequence: Synthetic coding sequence
atggcggaggatgccgatatgagaaacgagctggaagaaatgcagcgtcgggccgaccagctggcagatgaatccctggagtcaacaagacggatgctgcagctggttgaagaaagtaaggacgccggaataagaaccctcgttatgctcgacgagcagggcgaacagctcgaccgggtggaagaaggcatgaaccacattaatcaggacatgaaggaagccgaaaaaaacctgaaagatctgggcaagtgttgtgggctgttcatctgcccttgtaacaagctaaagagctcggacgcctacaaaaaagcctggggaaataatcaggacggggtcgtcgcatcccagcccgctagagttgtggacgagcgggagcaaatggcaatctcgggtgggttcatccgaagggtgactaacgacgccagggagaatgagatggatgagaacttagagcaggttagcggaattattggcaaccttaggcacatggcactggacatgggcaatgaaatcgatacacagaatcggcaaatcgatcgaattatggagaaggctgattctaacaagactcgaatagacgaagccaaccagagggccaccaaaatgctcggtagcggttag

SEQ ID NO: 136865 - DNA, 282 bp, Artificial Sequence
  Description of Artificial Sequence: Synthetic coding sequence
atggcagaggatgctgacatgcgtaacgagttggaagaaatgcagcgacgggccgatcagttggctgatgagtcactggaaagtacacgccgtatgttacaactcgtggaggaatcgaaagacgcgggtatccggaccctggtgatgctggacgagcagggcgagcagctggagcgcatcgaagagggcatggaccagatcaacaaggacatgaaggaggccgagaaaaacttgaccgacttgggcaagttttgcggcctgtgtgtttgtccttgtaactag

SEQ ID NO: 136866 - DNA, 1500 bp, Artificial Sequence
  Description of Artificial Sequence: Synthetic coding sequence
atgaagcactctctcaacgctttgctgatcttcctgataattacttctgcatggggaggttcaaagggaccacttgatcagcttgaaaaagggggcgagactgctcagtcagctgatccacagtgggagcagttaaacaataaaaatctttctatgccgctattacccgccgatttccacaaggaaaacacagtaaccaatgattggattccagaaggggaggaggatgatgactatctggacctcgaaaaaatcttctccgaagacgatgactacatagatattgtggacagcctgagtgtgtctccaacagacagcgacgtgagcgccggcaatatactgcaactgttccacggaaaaagtaggatacagagattgaacattttgaatgctaagttcgctttcaacctttacagggtgttgaaggaccaggtaaatactttcgacaatatctttattgcgcctgtagggatctccaccgcgatggggatgatcagtctgggactgaaaggcgaaacccatgaacaggtgcattctatccttcacttcaaggattttgttaacgcatcttctaaatatgagatcaccactatccacaacctgtttaggaaattgacacatagattgtttcgccggaatttcggttacaccctccgtagcgtgaacgacctttacattcagaagcagttccccatactcctggactttaaaaccaaagtccgcgagtattacttcgctgaggcccagatagccgactttagcgatcccgccttcattagcaagactaacaaccatatcatgaagctcaccaaaggccttatcaaagatgcattggaaaacattgatcccgctacccagatgatgatactgaactgcatctatttcaaaggttcatgggtaaataagtttcccgttgagatgacacataaccataacttccgcttaaacgaacgcgaagtggtgaaggtttcaatgatgcagactaagggtaatttccttgcggccaatgaccaggaacttgactgcgacattctgcagttagagtacgtcggcggcatttccatgcttatcgtcgtgcctcacaagatgtctggaatgaagaccctggaggctcagctaacccctagggtagtcgaaagatggcagaaaagcatgacaaatcgcacaagggaagtcctgctacctaagttcaagctggaaaagaactataacctggtagagtccctcaagctgatgggaatccggatgcttttcgacaagaacggcaatatggccggaatatccgaccagagaatagccatagacttgtttaagcaccaaggaactataacagtgaatgaggaaggtacacaggctaccaccgtcactacagtgggcttcatgccactcagcactcaggtgcgattcacggttgaccgccctttcctctttctgatttatgagcaccggacatcctgtctgctgtttatgggcagagtggcaaatcccagccgaagttag

SEQ ID NO: 136867 - DNA, 1269 bp, Artificial Sequence
  Description of Artificial Sequence: Synthetic coding sequence
atggtctcggagtcccatcacgaggctcttgccgccccccctgtaactacagtggccacggtcctgcccagcaacgcgacggaacccgcttccccaggcgaggggaaggaagacgcgttttcgaagctgaaagaaaagttcatgaacgaacttcacaagattcccctgccaccctgggccctgattgctatagctatagtagcagtgctgttggtcctgacttgctgcttctgcatctgtaagaagtgtctattcaagaaaaagaataagaaaaagggcaaagaaaaaggcggtaaaaacgcaattaatatgaaagacgtgaaggatttaggcaaaactatgaaggatcaggccctgaaagacgacgacgcggagacaggcctgacagacggcgaagagaaggaagagccaaaagaggaggagaaattgggcaagctgcagtatagcttagattatgactttcagaacaatcagctgctggtgggtatcattcaggctgccgagctgccagctttggatatggggggcacgagcgatccatacgtcaaagtgttcctactgccagacaagaagaagaaatttgagaccaaggtacatcgtaaaacccttaatcctgttttcaatgagcagttcacattcaaagtcccctatagtgaactgggcggtaagactctggtcatggcagtctacgattttgaccgtttctccaaacatgatataattggggagtttaaggtgccgatgaatacagtcgactttgggcacgtgactgaagaatggcgagacctgcagtcagccgagaaagaagagcaggagaaactgggtgacatttgttttagtcttcggtacgtgcctacagccggcaagctcaccgtcgttatcctcgaggccaaaaacctgaagaagatggatgttggtgggctctctgacccatatgtaaaaatccatctaatgcagaatggcaaacgtttaaagaaaaagaaaaccacaatcaaaaagaataccctgaacccctattataacgaatcctttagctttgaggtccctttcgagcagatacagaaagttcaggtggtggtaacagttctggactacgacaagattggcaaaaacgacgcaataggaaaggtatttgttgggtacaacagtactggcgccgaactgagacattggtctgatatgctggccaacccgcgtaggcccattgcccagtggcacaccctgcaggtcgaggaggaggttgacgcaatgctggccgttaaaaaatag

SEQ ID NO: 136868 - DNA, 1269 bp, Artificial Sequence
  Description of Artificial Sequence: Synthetic coding sequence
atggtgtcggagtcacatcacgaggcactcgcagccccaccagtcacaactgtcgccactgttctgccaagcaacgctaccgagccagctagcccaggagaaggcaaggaggacgcattctcaaaactgaaagaaaaatttatgaacgaactccacaaaataccactgcctccatgggcactgattgccatagccattgttgccgtgctgctcgtactcacatgctgtttttgtatttgcaagaagtgcttgtttaagaagaagaataaaaagaagggcaaagagaaaggggggaagaatgcaattaacatgaaggacgtcaaggatttgggcaaaaccatgaaggatcaagccttgaaggacgatgatgctgaaactggcctaacggatggagaagaaaaagaggaaccaaaggaagaagagaaactgggcaagctccagtattcacttgactacgactttcaaaacaatcaacttttggtgggaatcatccaagcggccgaactgcccgccctggacatgggtggcacctcagatccgtatgtgaaggttttcctgctgcctgacaagaaaaagaaattcgagactaaggtgcataggaaaaccctgaatcctgttttcaatgagcagttcacttttaaggtcccgtactccgaattaggcgggaaaaccttggtgatggccgtttatgatttcgatcgtttcagtaaacacgatatcatcggtgagttcaaagtacctatgaataccgtggactttggacatgtgacagaggaatggagggatctgcagtccgcagaaaaagaggaacaggagaagcttggggacatatgtttctcgctcagatatgttccaaccgccggaaagctcaccgtcgtaatcctggaggccaagaatcttaagaagatggatgtgggaggtctctcggatccttacgtcaagatccatctcatgcaaaatggcaagcgattaaaaaagaagaagaccactatcaagaagaacacccttaatccgtattataacgagagcttcagcttcgaggtgccatttgagcagattcaaaaagttcaagtggtggttaccgttctggattacgataagattggtaagaatgatgctataggaaaagtcttcgtgggctacaactctacgggtgctgaactgcgccactggtccgacatgttggccaacccacgtcgaccaattgcccagtggcatacgcttcaggtggaagaggaagtggatgccatgcttgctgtgaagaaatag

SEQ ID NO: 136869 - DNA, 549 bp, Artificial Sequence
  Description of Artificial Sequence: Synthetic coding sequence
atggtgtctgaaagccatcatgaagccttagccgctccaccagtgactaccgtggccaccgtgctgcctagcaatgccaccgaaccggctagtcctggggaaggcaaagaggacgcattctccaaactgaaggagaagttcatgaacgagctgcacaagatccccttgcctccctgggctctgatcgccatagctatcgtagcagtacttctggtactgacttgttgcttttgtatttgcaagaagtgtctatttaaaaaaaaaaataagaagaaaggaaaggaaaaaggagggaaaaacgctataaacatgaaggacgttaaagatcttggtaagacgatgaaggatcaggcactgaaggatgacgacgcggagaccggtctgaccgatggcgaggaaaaggaggagcctaaggaagaagaaaagcttggtaaattgcagtactcactggattatgacttccaaaacaaccagctacttgtgggcattatccaggccgctgagctgcccgccctggatatgggcggtacatctgacccctacgtgtag

SEQ ID NO: 136870 - DNA, 177 bp, Artificial Sequence
  Description of Artificial Sequence: Synthetic coding sequence
atggtgagtgaaagccaccatgaggcccttgccgctccaccagtcacaacagtcgcaaccgtattgccatcaaacgccactgagcctgcgtcgccaggagagggtaaggaagatgcttttagtaagctgaaggagaagttcatgaatgagctgcacaagatcccactccctccgtag

SEQ ID NO: 136871 - DNA, 219 bp, Artificial Sequence
  Description of Artificial Sequence: Synthetic coding sequence
atggtcagcgaatcacaccacgaagctctcgccgctccaccagttacaaccgtcgctacagtccttccatccaacgccactgagccggccagtccgggagaaggaaaagaggacgctttctcaaagctgaaggaaaagttcatgaacgaactacacaagattccccttccaccgtgggcattaatcgctatcgccatcgtggccgtgctgctggtctag

SEQ ID NO: 136872 - DNA, 222 bp, Artificial Sequence
  Description of Artificial Sequence: Synthetic coding sequence
atggtgtctgaatcacatcatgaggcgctcgctgctccacctgtgaccaccgtggccactgtgctcccttctaacgctaccgagccggccagcccgggggaaggcaaggaagatgcattcagcaaactcaaagaaaaatttatgaacgagctgcacaagatacctttgcctccctgggctctgatcgcaattgccatagtggctgtcctgctagttctgtag

SEQ ID NO: 136873 - DNA, 285 bp, Artificial Sequence
  Description of Artificial Sequence: Synthetic coding sequence
atggtgtcagagtcccatcacgaggctctggcggcccctcctgtcacaactgtcgctactgtgttaccgagcaacgccacagaacccgcaagtcccggcgaaggcaaggaagatgctttctccaagctcaaggaaaaatttatgaatgagctgcataagatcccccttcctccgtgggcactgattgccattgccatcgtggctgtactgctcgtgctgacctgctgcttctgtatttgtaaaaagtgcctctttaaaaaaaaaaataagaagaaaggcaagtag

SEQ ID NO: 136874 - DNA, 1269 bp, Artificial Sequence
  Description of Artificial Sequence: Synthetic coding sequence
atggtgtctgagagtcaccacgaggccttggccgcaccaccggtgaccaccgttgccacagttctgccaagtaacgctaccgaaccagcatctcccggtgaaggaaaagaggatgctttctcgaagctgaaagaaaagttcatgaacgaactgcacaaaatcccactgccaccgtgggcacttattgcaatcgccatagttgcggtgctgctggtgctcacctgctgcttctgtatttgcaaaaaatgtctctttaagaagaagaataaaaagaaaggtaaggagaagggcggcaaaaatgcaatcaacatgaaagatgttaaggatctgggcaaaacaatgaaggatcaggctctcaaggatgatgacgctgaaacaggcttgaccgacggagaggaaaaagaagagcccaaagaagaggaaaagctcggaaaactgcagtacagcctggactatgattttcagaataatcagttgctcgtggggattattcaggccgctgagttgccggcgttggatatgggaggaacgagtgatccctacgttaaggtgttcctcttacccgacaaaaagaaaaaatttgagaccaaagtccacaggaagaccctcaatccggtgtttaacgagcaattcaccttcaaggtaccctacagtgaactcggagggaagaccttggtgatggctgtgtatgactttgacagattttccaaacatgacataatcggggagttcaaagttccaatgaacacggtcgacttcggccacgttacggaggagtggcgggatttacagtcggctgagaaagaagagcaggagaaactcggcgacatctgcttttcactccgctatgtgcccactgccggcaagttaaccgtggttatcctcgaggcaaaaaatctcaagaagatggacgtgggagggctctcggatccatacgttaaaatccatctgatgcaaaacggtaaacgtctgaagaaaaagaaaaccacaattaagaagaatactctgaatccgtactataacgagagcttttcctttgaggtgccatttgaacagatacagaaggtgcaggtggtggtgactgtcttagattacgacaaaatcggcaagaacgatgccattgggaaagtgtttgtggggtacaatagcacaggtgctgagctaagacactggtccgatatgcttgctaatccccgcaggcctatcgctcagtggcacacccttcaagtcgaagaagaagtggatgcaatgctggcagtaaagaagtag

SEQ ID NO: 136875 - DNA, 1773 bp, Artificial Sequence
  Description of Artificial Sequence: Synthetic coding sequence
atgagcggggattatgaggatgatttatgccggcgcgcgttgatactcgtgagcgacctgtgcgccagagtgagagatgcggataccaacgaccgctgtcaggaatttaacgatagaattcggggctaccccagggggccagatgccgatatctctgtcagcctgttgtcagtgatcgtcacattttgcggtatcgtgctgttgggggtcagtctgttcgtgtcgtggaagttgtgttgggtcccttggcgagacaagggaggtagcgctgtgggcggaggcccactaaggaaggacctcggtcccggcgtcggcttagccggtctggttgggggaggcgggcatcatttggccgctggtctgggaggccatccgctgctgggcggaccgcatcatcacgctcacgccgcgcatcatccaccattcgccgaactgctggaacccggatccttgggaggttctgacacgccagaaccgtcttatctggatatggacagttatcccgaagccgctgccgccgcagtggccgccggagtgaagccctcccaaacctcccccgagctgccatctgaaggaggcgccggctccgggctgttgcttttgccgccctctggaggcgggctgccatccgcgcagtctcaccagcaggtaacatctctcgcccccacgacaagataccctgcactccctcggcccctgacccaacagactctaacaagccagccggaccccagcagcgaagaacgcccccccgcactgcccctcccactgcctggaggagaggagaaggcaaaactcatcggccagattaagccagaactgtatcagggcaccggtccagggggcaggcgtagtggaggggggccgggaagcggggaggcaggaaccggcgccccctgcggacgcattagtttcgcgctgaggtatttatacggctctgaccagctggtcgtgcggatcctccaggcactggacttacctgccaaagatagcaatggcttttcggatccctatgtaaagatatatctcctaccagacagaaagaaaaagttccagacaaaggtccaccggaagacactcaatcctgttttcaatgagaccttccagttttctgtgcccctggctgagcttgcccaacgcaagctccacttcagcgtttatgacttcgacagatttagtcgccacgacctgatcggacaagtggttttggataacttattggagcttgcagagcaaccacccgatagacccctttggcgcgacatagtggagggtggaagtgagaaggcggatctcggggaactaaacttttcattatgctacttgcctacggctggccgactcacggtgactattatcaaagccagtaatcttaaggccatggatctcacaggattctcagacccctatgttaaggcctcattgattagtgaaggcagacggctgaagaagagaaagacgagcatcaagaagaatacgcttaaccctacttacaacgaggcactagtgttcgacgttgccccagaaagcgttgaaaatgtaggacttagcatcgcagttgttgattatgactgtattgggcacaacgaggtgatcggggtgtgtcgagtgggccccgacgcagccgatccccacggccgggaacattgggctgagatgttggcgaacccccggaagcccgtcgaacattggcatcagttggtagaggagaagacagtgacgagtttcaccaagggctcgaaaggcttgagcgagaaagagaactccgaatag

SEQ ID NO: 136876 - DNA, 1773 bp, Artificial Sequence
  Description of Artificial Sequence: Synthetic coding sequence
atgagcggggattatgaagacgacctttgtcggcgagctctcatcctggtctccgatctttgcgctagagtgcgagacgcagacaccaatgatagatgtcaagagtttaatgatcgcatccgagggtacccgaggggcccagatgccgatatttctgtgagcctgctgagcgttatagtgaccttttgtggtatagtgctcttaggcgtgtctctcttcgtatcatggaagctgtgttgggtaccatggcgcgataaaggggggtccgcggtcggcggcggacccctgcgcaaggatctgggcccgggcgtcggactcgccgggttagtagggggaggtggccaccacctggccgccggactggggggccacccattgctgggggggccacaccaccatgcccatgctgctcatcaccccccttttgccgaactcttggagccagggtcactaggagggtccgacacgcccgagccgagttaccttgatatggactcctacccggaagccgctgccgccgctgtcgccgcaggcgttaaacccagtcagaccagcccagagctgccgtcagaaggaggcgccggttccggactcctgctgctgcctcctagcgggggaggattaccctccgcccagtctcatcagcaggtgacatcactcgccccgactacccgctatccagcactgccaaggcctctgacacaacagaccctgactagccagcccgatccctcaagcgaagaaaggcctccagctttgcctctgccccttcctggaggcgaggaaaaggccaaattaatagggcagatcaagcctgaactttatcagggaactgggcccggcgggcgcagatctggagggggacctggttcaggagaggccgggaccggtgccccgtgtggaaggatctctttcgcccttagatacctgtacggttccgaccaactggtggtcaggatattgcaggccctagacctccccgcaaaagactcaaatggatttagcgatccgtacgtgaagatttatttgctgcctgaccgcaagaaaaaatttcagaccaaagtgcacaggaagactcttaaccctgtatttaatgagaccttccaattttccgtccccctggctgagctggcacagcgaaagctccatttctccgtgtacgacttcgatcggtttagtcgccacgacctgataggccaggtggtgctcgacaatttgttggaacttgcagagcagccgccggacagaccgctttggcgcgacatcgtagaaggcgggtccgagaaggcagatctgggagaactgaatttctccctgtgctacttgccaaccgccgggcggctgacagttacaatcattaaagccagcaatctgaaagcgatggaccttacggggttctcagacccctatgttaaagcctcccttatctccgaggggcgcaggttaaagaaacggaagacttctatcaagaaaaacaccctcaacccaacatacaatgaagcccttgtgtttgatgtggctcccgagagtgttgagaacgtgggactgtccattgcagtcgtagactacgattgcattggtcacaatgaggtgatcggggtctgtcgggtgggccctgatgcagcggacccccacggcagggagcactgggcagaaatgctggccaatccacggaaacctgtcgagcattggcaccagcttgtggaggagaagactgtgacctctttcactaagggatcaaaaggcctcagcgagaaagaaaactcagagtag

SEQ ID NO: 136877 - DNA, 1773 bp, Artificial Sequence
  Description of Artificial Sequence: Synthetic coding sequence
atgagcggcgactacgaggacgacttgtgccgacgagccttaatcttagtgagcgatctgtgtgctagggttagggatgcagacacaaatgatcgctgtcaggaattcaatgacagaatccgcggatacccgcgcggccctgatgcagacatatccgttagtctgctttccgtgatcgtgaccttttgtggaatcgtgctgctgggggtgtctctgtttgtatcatggaagctctgctgggttccttggcgtgacaaaggaggttctgcagtggggggagggcccctacgcaaagacctcggcccaggcgtcgggctggcaggcctcgtgggcggagggggtcaccacctcgccgcgggcctcgggggacaccccttgttaggcgggccccatcaccatgcgcatgccgcccaccatcccccctttgcggaacttttagaacctggctccttaggtggcagcgatacgcctgaaccctcttacctcgatatggactcctatccagaggctgccgccgctgctgtggcagctggtgtaaaaccatcccagacgagccccgagctgccttccgagggaggggctgggagtgggcttcttttgctgcctccgagcggcggagggctccctagcgcgcagagccaccaacaggtcacctcgttagccccaacgacccgctaccctgcccttccccgacctctaactcaacagacactcacctcacagcccgacccaagtagcgaagaacgaccaccagccctccctctccccctaccaggaggggaggagaaggctaagcttataggacaaattaagcctgagctgtatcaggggaccgggcctggggggcggcgctccgggggaggacctggctctggcgaagccgggaccggcgccccttgcggacgaattagctttgccctgcgctacctctacggttccgatcagcttgttgtgcggattctgcaggcactcgacctcccagccaaggactccaatggcttctccgacccgtatgttaaaatttacctgctgcctgataggaaaaaaaaatttcagaccaaggtacatcggaaaactctaaaccctgtcttcaatgaaacctttcaattttctgtgcccctggctgagctggcccagcgcaaactgcacttttcggtgtatgatttcgatagattcagccgccacgatttaattgggcaagtagtgctagataatcttctggagctggcagaacaaccaccagatcgaccactctggagggacatcgtcgagggaggctcagaaaaagccgatctcggggaactgaacttttccctgtgctacctgccgacggctggtagactgacagtgaccatcataaaggcaagtaacctcaaggcgatggatctgaccggtttcagtgacccgtatgtcaaggcctcccttatctccgagggtaggagacttaagaaacgaaaaactagtataaagaaaaacacccttaatccaacctacaacgaggcacttgtctttgacgtggctcctgaatccgtagagaatgttggtctgagtattgcggttgtggattacgactgcattggtcacaacgaggtgatcggggtttgtagggtgggtcccgacgctgccgacccccacggacgtgaacattgggcagagatgttagccaatccacgcaaaccagtagagcactggcaccagctggttgaggaaaaaacagttacctcatttaccaagggttctaaaggtctgagcgaaaaagagaatagcgagtag

SEQ ID NO: 136878 - DNA, 1773 bp, Artificial Sequence
  Description of Artificial Sequence: Synthetic coding sequence
atgagtggagattatgaagatgacctatgtaggagagcactgattctcgtctccgacttgtgtgccagagttcgcgacgccgataccaacgaccgctgccaggagttcaacgacagaataagaggttatcctcgaggcccggacgctgatatcagtgtgtcactgctgagtgtcatcgtgaccttttgcgggattgttttactgggggtgtctttattcgtgtcctggaagctttgttgggtgccctggcgcgataaaggtggctcggccgtgggcgggggaccactgcggaaagacctgggcccaggtgtgggtctagctggtctggtcggggggggcggtcaccacctggccgccggattgggcggacacccactgctgggcggccctcatcatcatgcccatgcggcgcaccacccgccctttgccgaactgctggagccaggaagcttgggaggaagcgacacgccggagccaagctacctcgatatggattcttaccctgaggccgctgccgcagccgtcgcagcgggagtgaagccatcccagacctcccctgagctccctagcgagggcggcgccggctctggacttctgctgcttccaccaagcggcgggggcttgccctcagcccagtctcaccagcaggtgaccagcctggccccaacaacccgataccctgctttgccccgacctttgacacagcagacactgactagtcagcccgacccttcctctgaggaacggccgcccgcgctgccacttcctttaccgggcggtgaagaaaaagcaaaactgattggtcaaatcaaaccggagctctatcaggggaccggacccggggggcgtaggagcggcggtggccctggatccggagaggcagggaccggagcgccatgtggccggatttccttcgcgctgagatatctgtacggatccgaccagctggttgtgcgcattcttcaggctcttgacctgcctgctaaggatagtaacgggttttcagacccgtatgtgaagatatacctgctgcccgacagaaagaaaaaatttcagaccaaggtccaccgaaagacgctaaacccagtgtttaatgagacatttcagttctcagttcccctcgccgagctcgcccagaggaagttgcacttcagcgtatacgatttcgaccgcttcagccggcatgaccttattggtcaggtagtcttggacaatcttctcgaacttgccgaacagccccctgaccggccactgtggagggacatcgtcgaaggagggtcagaaaaggccgatcttggggaactcaatttcagcctgtgctacttgcccactgcaggaagactgactgtgacgatcattaaggccagcaacctaaaagcgatggacctgactggcttcagtgatccatatgtgaaagcatccttgatcagtgagggtcggcggctgaagaagcggaaaacatcaatcaaaaagaatactctcaatccaacgtacaatgaggccctggtgtttgatgtcgctccagaatccgtagagaacgtggggctgtctatagcggtggtggactacgactgcatcggacacaatgaagtcataggagtctgcagagtggggcccgacgcagcagacccacacggaagagagcattgggccgagatgctggccaatccacgaaagcccgtggagcactggcatcaactggtcgaggagaaaactgtaaccagcttcactaagggcagcaagggcttgtcagaaaaagaaaattcagaatag

SEQ ID NO: 136879 - DNA, 1278 bp, Artificial Sequence
  Description of Artificial Sequence: Synthetic coding sequence
atggctccaataaccacaagccgcgaagaatttgatgagattcccacagtggtgggtattttctcagccttcggacttgtctttactgtatccctgttcgcctggatttgctgccagagaaaatcgagtaagtccaacaagactccgccatataaattcgttcacgtattaaaaggagtcgatatctacccagaaaatttaaactcaaaaaagaagtttggggccgacgacaagaacgaggtgaagaataaacctgccgttcccaagaatagcctgcacttagacctcgaaaagagagacctgaatgggaactttcccaagacaaatctgaagccagggtccccttctgacctagagaatgcaacgcctaaactcttcctggagggagaaaaagaatcagtgtcacctgaaagcctaaagagtagtaccagcctgactagtgaagagaagcaggagaagttgggcactctctttttcagtctggagtacaattttgaacgcaaagcttttgtggtcaacatcaaagaggccagggggcttcctgctatggacgagcaaagtatgacatctgacccatatattaagatgacaattctgcctgaaaaaaaacataaggtcaagactagagtgctccgcaaaaccctcgatccagcttttgacgaaactttcacattctacggtattccgtacactcaaatccaggaactggcgcttcacttcactattctcagctttgatagattcagcagggacgatataatcggagaggtgcttattcctctatccgggatagaacttagtgagggcaagatgctgatgaatagagagattattaagcgaaacgtacgcaagtcctcaggaaggggtgagctgctcatatcactgtgctaccaatctaccacaaatacattgaccgtggtagtgttgaaagccaggcacctgcccaaatctgacgtaagcggtctatcagacccctacgtgaaagtcaacctgtaccatgccaaaaagcgaataagtaaaaagaaaacccatgtcaaaaaatgtacacctaacgcagtcttcaacgaactctttgtttttgacattccctgcgaggggttagaggatatatctgtggaattcttggtgctcgactctgagaggggcagtagaaatgaggttataggccaactcgtgttgggcgccgcagctgagggaacgggcggcgagcattggaaggaaatctgcgactaccctaggcggcagatagcaaaatggcacgtactgtgcgacggctag

SEQ ID NO: 136880 - DNA, 693 bp, Artificial Sequence
  Description of Artificial Sequence: Synthetic coding sequence
atggatctgctgagcgagaagaagcataaggtgaagacgcgggtgctgcgaaaaacgctggacccagcctttgacgagaccttcacattttatggcatcccatacactcagatccaagaactagccctgcactttaccatactctcgtttgatcggttcagtcgggacgacatcattggcgaagttttgatccccctgtctgggattgagctgagtgaaggcaaaatgctgatgaacagggagattattaagcgtaatgtcaggaaatctagcggcagaggtgagctcctgattagcctgtgttatcagtccaccactaatacactcaccgtggtggtgctgaaagctcgccaccttcccaagtccgacgtgtctgggttgtctgatccctacgttaaagtcaatttgtaccatgccaaaaagagaatttccaagaaaaaaacacacgtgaaaaagtgcacccccaacgcagtgttcaatgaactgtttgtctttgatatcccgtgcgagggtttagaagacatcagtgtcgagttcctggtcctggatagtgagagaggatccaggaacgaagtgatcggacagctcgtgctcggcgcggcagcagaaggtaccggaggggaacactggaaggaaatctgtgattaccctcgacggcagattgccaagtggcacgtcctctgcgacggttag

SEQ ID NO: 136881 - DNA, 1476 bp, Artificial Sequence
  Description of Artificial Sequence: Synthetic coding sequence
atgccaggtgccagggacgctttgtgtcaccaggctctccagttgctggctgagttatgcgcccggggagcactggaacacgatagctgccaagatttcatctaccacctgcgagaccgggcccggcctcggttgcgagaccccgatattagtgtgtctttgctgaccttggtggtcactgcttgcgggctagcactcttcggggtctctctgttcgttagctggaagctttgttgggtgccctggcgggagagaggactgccctccgggagtaaggataacaaccaagagccactgaactacatggacactgagacaaacgaacaggaaaacagcgaagactttctggatcccccgacgccctgtccagacagctcaatgaagattagtcacacttctcccgacattccactgtccacacagactggtatccaggagaactgtgctcatggcgtacgggtccagaggcaggttacggaacccacatcatccgcccggcataatagcataaggcgtcagctcaacttgtccaatccagacttcaatatccaacagctccagaaacaggaacaactcactggtatcggcaggatcaagcctgagctgtacaaacagcggtccttggacaacgatgacggcaggcggtcaaactccaaggcttgtgggaaacttaatttcattttgaagtacgactgtgacctggaacaactcattgtgaagattcacaaagccgtgaacctccctgcaaaagactttagcggcacatcagatccgtacgtgaagatttacctgttgccagacaggaagactaagcaccagaccaaagttcaccgcaaaaccttgaatcctgtgtttgatgaagtttttctatttcctgtcccttataatgatcttgaagccaggaaattgcatttcagtgtttatgatttcgaccgattttccagacacgatttgattgggcaggtggttgtcgatcattttcttgatctggccgacttcccccgagaatgcatcctgtggaaagacattgagtacgtgaccaacgataacgtcgacctcggcgagctgatgttctccctgtgttacctgcccactgcaggccgcctaacaattactatcattaaggctcggaatctaaaggcgatggatatcactggagcatcggatccctacgtgaaagtatctttaatgtgcgacggaagacggcttaaaaagagaaagacctccaccaaaaggaacacgctgaaccccgtgtataacgaggccatagtctttgacgttcccccagaaaatatcgaccagatccacctgagcattgcagtgatggattacgacagggtgggccataatgaaattattggagtgtgccaggtgggaaatgaggccgagcgccttggacgggatcattggagcgaaatgctgagttacccaagaaagccaatcgcccactggcattccctggtggagaagagatag

SEQ ID NO: 136882 - DNA, 960 bp, Artificial Sequence
  Description of Artificial Sequence: Synthetic coding sequence
atgctggcgaaggttgtcgagggcgatttggctttcaagggcgggcgggacattagtgtctccctgcttaccttggtggtgaccgcgtgcgggctggcgctgttcggagtgtctctctttgtcagctggaaattgtgctgggtcccatggagggagcgcgggctaccctccggcagcaaggacaataatcaggaacccctcaattatatggacactgaaacgaacgaacaggaaaacagcgaggattttctggatcccccaaccccttgccctgactcgagcatgaagatatctcatacatctcccgatatccccctgagcacccagacaggtatacaggagaactgcgctcacggtgtgcgagttcaacgccaggttaccgagccaaccagttcagcacgtcacaattcgatccgtaggcaattaaacctcagtaaccctgatttcaatattcagcaactccaaaagcaggaacaactgaccggcatcggtcgcattaaaccggaactgtacaaacagcggtcgctggacaacgacgatggcagaaggagcaactcaaaagcctgtgggaaactgaattttatcctcaagtatgattgtgatctggagcaactcatagttaaaattcataaagcagtcaacctacctgcgaaagactttagtggcacgtcagacccatacgtaaaaatctatctcctccctgatcggaagacgaagcaccagacaaaggtccataggaagactctgaatcccgtcttcgatgaggttttcctttttccagtgccctacaatgatctagaggcaagaaaactgcatttcagtgtctatgactttgaccgctttagccgccatgacctgatcggccaggtcgttgtggatcatttcttggacctggcagactttcccagagaatgtatcttgtggaaggacatagagtatgtgaccaatatcttatcgtag

SEQ ID NO: 136883 - DNA, 1161 bp, Artificial Sequence
  Description of Artificial Sequence: Synthetic coding sequence
atgttccctgagcctccgactcctggacctcccagcccagacacaccccctgactcatctcgaatctcacacggaccggtacccccatgggccctggcaacgatcgttctcgtcagcggccttcttatcttttcctgttgtttctgtttgtaccgaaagtcatgtaggaggagaacaggcaagaaaagtcaagcgcaggcccaagtccatctgcaggaagtcaagggtctgggacagtcatacatcgacaaagttcagccggaggtagaagaattggaacctgccccctcagggcctggccagcaagtcgccgataagcatgagctaggaaggctgcagtactcactggattacgactttcagagcgggcagttgctcgtgggcatattgcaagcaatggggctggccgccctggacctgggcggtagttccgatccgtacgtcagggtgtacctgctgccggacaaaagaaggcgctacgagacgaaagttcaccgtcagacgcttaatccccactttggcgaaaccttcgccttcaaggtgccatatgtggaactaggagggagggtcctggtcatggcagtctacgactttgatcgcttctcaagaaacgacgcaatcggggaggtccgggtaccaatgagttccgttgacctgggcaggcccgttcaggcttggcgcgagctgcaagccgctccgagagaagagcaggaaaagctgggcgatatctgcttctcactgagatacgtaccaacggccggcaagctgacagtgatagtgctcgaagccaaaaatttgaaaaagatggatgtgggtgggctgagtgatccttacgtgaaagtgcatctgctgcaggggggcaagaaggtgaggaaaaaaaaaactaccatcaagaaaaatacccttaatccttattacaatgaggctttttcctttgaagtcccatgcgatcaggtgcaaaaggtgcaggtcgaactgacggtgctcgattatgacaaactgggaaagaacgaggcgattggcagggtggcggtgggcgccgccgctgggggagctgggcttaggcactgggcggacatgcttgccaatccccgccgccctatcgctcagtggcattccctgcggccaccagaccgagtgcgactgcttcccgccccgtag

SEQ ID NO: 136884 - DNA, 1161 bp, Artificial Sequence
  Description of Artificial Sequence: Synthetic coding sequence
atgtttcctgaaccgcccaccccgggccccccttctcctgatacaccccccgacagctcccggatctcacacggtccagtcccaccctgggccctcgcgacaatcgtactggtctccggcttgcttatcttctcgtgctgtttttgtctgtacagaaagtcctgtagacgtcgcacgggcaagaagtctcaggcacaggctcaggtgcacctacaagaagtgaagggactgggccagtcctacatagacaaggtgcagcccgaggtggaggaactcgagcccgcaccttcagggcctggccagcaggtcgcagataagcacgagcttgggcgattgcagtatagcctggactatgatttccagtccgggcagttattggtcggcatcctacaggctatgggcttggcggccctggacctgggcgggtcttccgatccctatgtaagagtgtatctcctgccagataagcgtcggcgttacgagaccaaagttcaccgccagaccctgaatcctcatttcggcgagaccttcgcattcaaagtgccctacgtcgagctaggaggacgggtgctggttatggccgtttacgacttcgaccgcttctcccggaatgatgccatcggagaggttagagtcccaatgtccagtgtggaccttgggcgccccgtgcaggcatggcgcgagcttcaggcagccccgagggaggagcaggagaaattgggcgatatttgcttctcactgaggtatgtgcctaccgcaggtaagttgacagtaatagtcttagaggccaaaaacctgaaaaagatggatgtcggcggcctgtccgacccatacgtcaaagtccatctcctgcagggcggcaaaaaagtacgcaagaagaagactacaattaagaaaaatactttgaacccttattataatgaagcattttcgtttgaagtaccttgtgatcaggtccagaaggtccaggtagagctgaccgtgttagattatgacaagcttggtaagaatgaagccatcgggagggtggccgtgggtgccgccgccggcggagccgggcttcgccactgggccgacatgctggctaatcctcgacggcccattgctcagtggcatagtctgagacctcccgacagagtgaggctgctgcctgcgccatag

SEQ ID NO: 136885 - DNA, 1149 bp, Artificial Sequence
  Description of Artificial Sequence: Synthetic coding sequence
atgaccaggggtggctgcccagtcagtgctcggctctttgctcagcgacctcatggttcatggagctcactgttatgcgtcggtctcaagggcaggctgggctgggagtgggggacccgagtactcgaatgtttgtgtaggaaggattctcgcacccctccgccatgttcgcggagtccccagccgcgcggtttacaccgaccaactaggctgcctacaccagtcgctagcgccaccgcgcaggttcagccagaggtggaggaactcgagccagcaccgagcggcccaggccagcaggtggcagacaaacacgaactggggcgcctgcaatactccctggactacgattttcagtcgggccaactgcttgtggggatactgcaggcgatgggacttgccgccttggatctgggcggcagctccgacccttacgtccgagtctacttactcccagacaagagacggagatatgaaaccaaggtgcacaggcaaactctcaacccacactttggagagacatttgcttttaaggtcccatatgtcgagctaggtggccgagtcctggtgatggctgtatacgatttcgatagattctcaagaaacgatgccattggagaggtaagggtaccgatgtccagcgtggatctgggtagaccggttcaagcctggcgtgaactacaggccgcaccacgcgaggaggagaagctcggagatatttgcttcagcctccggtatgtcccgaccgctggcaaactgacggttattgttctggaagccaaaaatctcaaaaaaatggacgtgggaggtctgtccgatccttacgttaaggtccatctcctgcaagggggcaagaaagtgcgcaaaaaaaagaccacaatcaagaaaaatacccttaacccgtactacaatgaagctttttctttcgaagtgccgtgtgatcaagtacagaaggttcaggtggaacttacagtcttggactacgataaattaggcaaaaacgaagccattggccgggtcgcagtgggggccgccgccggcggtgcaggactccgtcattgggctgacatgctcgctaacccccgcaggcccatcgcccaatggcactcccttagacctcccgaccgagttaggctactgcctgctccctag

SEQ ID NO: 136886 - DNA, 1533 bp, Artificial Sequence
  Description of Artificial Sequence: Synthetic coding sequence
atgtccggggtgtggggagctggtggcccacgatgtcaagaagctctggcggtactcgcttccctttgtcgggctcggcccccaccactgggtctagatgtagaaacttgcaggagtttcgagctccagccgccagaaaggagtccatcagcagccggggccggcacttcagtctcgctcttagcggtcgtggtgatcgtgtgcggggtggcactggtcgccgtattcctgttcctattttggaaactgtgttggatgccgtggagaaacaaggaggcttcctcaccatcaagtgccaaccccccgctagaggctttgcaatctcccagtttcagagggaacatggctgacaagcttaaagatcccagcaccctgggatttctggaggccgcagttaaaatcagccatacatcccctgacatccctgccgaagtgcagatgtctgtcaaggagcatatcatgcgccacacacgactccagcggcagacaactgagccggccagtagcacacgtcatacgagttttaagaggcatttgccaagacagatgcacgtttcctctgtcgactacggcaatgagctgccccctgccgccgagcagcccaccagcatcggacgcatcaagccagaactttacaaacaaaaaagcgtagacggtgaggacgcgaagtctgaggccactaaatcttgtggtaagatcaacttctcactgcggtacgattatgaaaccgagactctgatagtgaggatactgaaagccttcgatctgcctgccaaggatttctgtggaagcagtgacccttacgtaaagatatatctgcttcctgaccggaaatgtaagctgcaaacccgggtgcaccgaaaaactctgaatccgacttttgacgaaaatttccacttccctgttccatacgaagagctcgctgaccgtaagctgcacctctccgtcttcgattttgatagattcagccgccatgacatgattggcgaagtgatcctggacaatttgttcgaggcttccgacctgtccagagagacatccatctggaaggatatccagtatgctaccagcgagagtgtggacctgggggaaataatgttcagcctctgctatctgcctacagctgggaggcttacacttacagttatcaaatgtcgaaacctcaaagccatggacatcactgggtattccgacccgtatgttaaggtgtcgctcctatgcgatgggcggcgtcttaagaagaagaagacaaccattaagaagaacactttgaatcctgtctataatgaggccattatcttcgacatcccccccgagaatatggatcaggtaagcttattgatctcagtcatggactatgatagagtgggacacaatgaaatcatcggggtttgtcgcgtgggaatcacagcagaaggcttgggccgggaccactggaacgagatgcttgcttatcctcgaaagccgatagcccattggcacagcctggttgaggttaagaaatccttcaaggaaggcaatcctaggctgtag

SEQ ID NO: 136887 - DNA, 1278 bp, Artificial Sequence
  Description of Artificial Sequence: Synthetic coding sequence
atgccgtggcgtaacaaagaggcctcctctccctcaagtgctaacccccccctcgaagccttacagtcaccatcatttcggggaaatatggccgataagctcaaagaccccagcactcttgggtttttggaggctgcagtaaaaatttcacacacatcccccgatatccccgccgaggtacagatgagtgtgaaggagcatataatgcggcatactcggctccagcgacaaaccactgaaccagcgtcgagtacacggcatacctcattcaaacggcacttaccccggcagatgcatgtaagctctgtggactacgggaatgagcttccaccagccgcagaacagcctacctccatcgggagaattaagcccgaactctacaagcaaaagagtgttgatggagaggacgcaaagagcgaagctactaagtcttgcggcaaaatcaacttcagcctacggtacgactacgaaactgagactctgatcgtgaggatcctgaaggcgtttgatctgcccgccaaagatttttgcggttccagcgacccctacgtaaaaatatacctgctgcctgatagaaaatgtaaactgcagacacgcgtgcatcgaaagactttgaatccaacattcgacgaaaattttcactttccagtcccttacgaggagttggcagaccgcaagctccacctgtccgtgttcgatttcgaccgtttttcacggcacgacatgattggagaggtgattctggacaacttgttcgaggctagcgacctttcccgggagacatcaatctggaaggacatccaatacgccacttctgagagcgttgatcttggcgagatcatgttctcactttgttacttaccaaccgcgggacggcttactcttaccgtgattaagtgtcgcaacctgaaggccatggatattactggatattctgacccttatgtcaaagtttcactattgtgcgatggcagacgccttaagaaaaaaaagaccacgattaagaaaaacaccttgaatcctgtgtataatgaggccatcatctttgatattcctcccgagaatatggaccaggtgtcactgctgatctctgtgatggactacgatagagtgggtcataacgagatcattggggtgtgcagggtgggaatcacagcggaaggtcttggtcgagatcactggaacgagatgctggcatacccacggaaacctattgcccactggcacagccttgttgaagtgaagaagtcatttaaggaaggaaatcctaggctgtag

SEQ ID NO: 136888 - DNA, 1278 bp, Artificial Sequence
  Description of Artificial Sequence: Synthetic coding sequence
atgccctggagaaataaagaagcgagttccccttcctcagcaaacccacctcttgaagcccttcagagcccctctttcagagggaacatggcagacaaacttaaggatcctagcacacttgggttccttgaggcagcagtgaagatctcccatacttctccagatatccctgccgaggtccagatgagcgtgaaggagcacatcatgcggcacaccaggctccaaagacaaactaccgagcccgcatcgtcaaccagacacacctcattcaagcgccacctgccacggcagatgcacgtttcaagcgtggactacggcaacgagttgcctcccgccgccgagcaacccacgtctatcgggcggataaaaccagagttatacaaacagaaaagcgtggacggcgaagatgcgaagagcgaggccaccaaaagctgtggcaagatcaacttcagcctgagatacgactacgagacggagactttgatagtacggatcctgaaagccttcgacctaccggccaaggacttctgtggcagcagtgacccctacgtaaagatatacctgctgcctgatcgcaaatgcaagctccaaacccgtgtgcatagaaagacactgaatccaacattcgatgaaaattttcatttccccgttccttatgaagaactggctgaccgtaagctccatctctccgtctttgattttgacagattttctcggcatgacatgattggggaggtcatactggacaacctatttgaagcctccgacctgtcccgcgaaaccagtatttggaaagacattcagtatgctactagcgagagcgtagatctgggtgagataatgtttagtttatgttaccttccaacagccggccggttgaccttaactgtgatcaagtgtagaaatctaaaagccatggatattactggttattcagacccttacgtgaaggtttccctgttgtgtgacgggcgaagattaaagaaaaagaagacaaccattaaaaaaaatactttgaatcccgtttataatgaggctatcatctttgatattcctcccgaaaacatggatcaggtgagcttgctgatttccgtaatggactacgacagagtgggccacaacgagattattggtgtgtgtcgagttggcataacagccgagggactaggacgggaccattggaacgagatgctcgcttaccctcgaaaaccaattgcccactggcacagcttagttgaagttaagaagagctttaaggagggcaatcctcgattgtag

SEQ ID NO: 136889 - DNA, 1533 bp, Artificial Sequence
  Description of Artificial Sequence: Synthetic coding sequence
atgtcgggtgtgtggggagcgggagggccgaggtgccaagaagccctagccgtcttggcgagtctgtgtcgggctaggccaccaccattgggactcgatgtggagacctgcaggtcatttgaactgcaaccgccggagaggagtcccagcgcagccggggcagggacctccgtttcactccttgccgttgttgtgattgtgtgcggcgtagcgctcgttgccgtttttctctttctgttctggaaactgtgctggatgccctggcgcaataaggaagcttccagtccatcaagcgccaacccacctctggaagctctccagtccccgagttttcgcggcaacatggctgataagcttaaggatccctccacactgggatttctggaggctgccgtgaagatcagccacacatcccccgacattccggcggaggttcagatgagcgtcaaggaacatattatgcgtcacactcgactgcaaaggcagactaccgagcccgcgagctctacacggcacacatcctttaagcgacacctgccgagacagatgcatgtctcctccgtggactatgggaatgagcttccaccagcagcagaacaacccacgagtatcggaaggatcaagcctgagctatataagcagaaatcagtggacggcgaagatgccaagtccgaggccactaaatcctgtggcaaaatcaactttagtctgcgatatgattatgaaaccgaaactctcatagtccgtatcttgaaggcctttgacctgccagctaaggacttctgcggatcgagcgacccctatgtgaagatttacttattgcctgatcgtaagtgtaaattgcaaaccagggttcatagaaaaactttgaatccaacattcgatgagaacttccattttccagtgccatatgaggagttggccgaccgcaagctgcatctctctgtgttcgatttcgacagatttagccgacatgatatgattggcgaggtgatcctggataacctctttgaagccagtgacctgtcaagagagacttcaatttggaaggacatccagtacgccacatcggagtctgtcgacctgggcgagataatgtttagcctgtgttacttaccaactgctggccggctcactcttaccgtaatcaagtgtaggaacttaaaggccatggacattacgggatacagtgatccttacgtgaaagtttctttactgtgtgacggtaggcgcctaaaaaaaaaaaagaccacaatcaagaaaaacacgttgaatcctgtttacaatgaggctattattttcgacatacctccagaaaacatggatcaggtctcacttctgatatccgtcatggactacgacagagtggggcataacgaaatcatcggagtttgccgggtgggcattacggccgagggactgggccgagatcattggaatgaaatgctggcctatccacgtaaacctatagcacactggcattccttagttgaggtgaagaagtctttcaaagaagggaaccctaggctgtag

SEQ ID NO: 136890 - DNA, 288 bp, Artificial Sequence
  Description of Artificial Sequence: Synthetic coding sequence
atgccgtggaggaacaaggaggcttcatcaccctcttctgccaatcccccgctggaggcattacagtctccatctttccgcggaaatatggccgataagctgaaggatccttctacactgggcttcttagaggctgccgtgaaaataagccatacgtcccctgatatcccggcagaggtgcaaatgtccgttaaggagcacattatgcgtcacacgagactgcagaggcaaacaacagagcctgctagctccacacgccacacttccttcaagaggcatctcccgtag

SEQ ID NO: 136891 - DNA, 261 bp, Artificial Sequence
  Description of Artificial Sequence: Synthetic coding sequence
atgccttggcggaacaaagaagcatccagtccttcttcagccaacccaccactagaggccctgcaatcacctagctttcgggggaatatggccgacaagcttaaggatccttcaacattggggttcctggaagccgccgtgaagatctctcacacatctcctgacatccccgcagaggtgcagatgtcagtgaaggagcatattatgcgccacacacgcctgcaaaggcaaactacagagcctgccagctcgaccaggtag

SEQ ID NO: 136892 - DNA, 1212 bp, Artificial Sequence
  Description of Artificial Sequence: Synthetic coding sequence
atgtaccgcgatcccgaggccgcatcacccggtgcacccagcagggacgtactgctggtgagcgccatcattaccgtctctctgtctgtgacggttgtgctctgtggcctgtgtcattggtgtcagcgaaagttgggcaagcgctataaaaatagtttagagacagtaggcacgccagacagtgggaggggaaggagcgagaaaaaggctatcaaactccccgccggtggcaaggccgtcaacaccgcccctgtaccaggccaaacaccccatgacgagagcgacagacgtaccgaacctcgctcttccgtcagtgatttagtgaacagcctcacaagtgagatgttaatgctgtcgcccggatccgaggaagacgaggctcatgaaggatgttcccgagaaaacctcggccggattcagttttctgtcgggtataacttccaggaatcaaccctgacagtgaaaatcatgaaagcgcaggaattgcccgctaaggacttcagtggtaccagcgacccctttgtcaagatctatctgctgcctgataaaaagcacaagctggaaacaaaagtgaaacgtaaaaatctgaatcctcactggaacgagacttttctctttgagggatttccgtacgagaaagtcgttcagaggatcttgtatttgcaggtacttgactacgatagattctctcgaaacgatccaattggggaggtgtctattccactgaacaaagtcgacttgactcagatgcagacattctggaaggatttgaaaccctgtagtgatgggtctggctcgcggggcgagctgttgctctccctttgttacaatccatcagcaaatagcatcatcgtcaatatcataaaggctcggaatctgaaggctatggacattggaggtacctcggacccctacgtgaaggtttggctgatgtacaaggataaacgagttgagaagaaaaaaacagttacgatgaaacgtaatctgaatccaatattcaatgagtccttcgcctttgatatacccaccgagaaactccgggagactaccattataatcaccgtcatggacaaggacaagctgagtcgcaacgatgtgatcggcaaaatctatctcagttggaaaagcggtccaggggaagtcaagcactggaaagacatgatcgccaggcccaggcaaccagtcgcccagtggcaccagttgaaggcatag

SEQ ID NO: 136893 - DNA, 1266 bp, Artificial Sequence
  Description of Artificial Sequence: Synthetic coding sequence
atggcagtggatgtggctgaatatcacctgagtgttataaagagcccaccgggatgggaagtgggtgtgtacgccgccggcgctctcgcattgctgggcatagccgcagtgagcctctggaagctctggacctcaggtagcttcccaagcccttcgcctttccctaactacgactatcgctatctgcagcagaaatacggcgagtcctgcgcagaggcacgagagaaaagggtgcccgcctggaacgctcagcgggcctcgactcggggtcccccgtccagaaagggatcactgtccattgaagacacattcgagtccatatccgagcttggccccctagagctaatggggcgagaactggacctcgccccatacggcacgctgcgaaagagccagtctgcggactctctgaacagcatttcaagcgtgtctaatacttttggccaggactttaccctgggtcaagtagaagtgtccatggagtacgatacggccagccacaccctcaacgtggcagtgatgcaggggaaagatctcctggaaagagaggaagcttcgtttgaatcctgctttatgcgggtgtctctcctcccagacgagcagatcgtgggaattagtagaatccaaaggaatgcctattcgatctttttcgacgagaaatttagcattccgttggaccccacagccttggaagaaaaaagcctgaggttctcagtgtttggcatcgatgaagacgagaggaatgtcagtaccggcgtggtggaacttaagttgtcagtactcgatcttccactgcagcccttttccggctggctgtatttgcaggatcagaacaaggccgcagacgccgtgggggaaatacttctgtcgctaagctacctgcctacagctgaaagattgactgtcgtggtggtcaaggcgaagaaccttatctggacaaacgacaagacgacggctgatccattcgtgaaggtctatttgctgcaggatggccggaaaatgagcaagaaaaaaacagccgtcaaaagagacgatccaaatccggtgtttaacgaagcaatgatcttttcagttccggcgatcgtgctacaggatctctcacttagagtgaccgtggctgaatcatcctctgacggccggggtgacaacgtgggtcatgtgataattgggccctcagcctctggtatgggcacaacccattggaaccagatgctggctaccctgcggagacccgtgtctatgtggcacgctgtgcgcagaaattag

SEQ ID NO: 136894 - DNA, 1266 bp, Artificial Sequence
  Description of Artificial Sequence: Synthetic coding sequence
atggccgtggacgtcgcggagtaccatttgtctgtgattaagtcccctccagggtgggaagtgggtgtctatgccgccggggccttggctctgttaggcatcgccgctgtgtctctctggaaactttggacaagtggcagtttccctagcccatccccttttccgaattatgattatcggtatctgcagcagaagtacggcgagtcctgtgcagaggctcgagagaagcgagtccccgcttggaacgcccaacgggcctctacacgggggcctccatcacggaaggggtcgctgagcattgaggacacgttcgaaagcatcagcgaacttggccctctcgaactgatgggccgggagctggacctggccccttatggcacactgaggaagtcccagtccgctgatagcctaaacagtatttccagtgtgtcaaacaccttcggccaggattttacacttggccaagtagaagtgtcaatggaatatgatactgcttctcacacgctcaatgtggccgtgatgcaggggaaagacctgcttgagagagaggaagcgtctttcgagagctgtttcatgcgagtctctttgctgcctgacgagcagattgtgggcattagccgcattcagcgtaatgcttatagcatattcttcgatgaaaagtttagtattcctctggaccctaccgccttggaagagaagtctctccgcttctcggtttttggcatcgatgaggatgaaaggaacgtcagtacaggcgtggttgagctgaagctttccgtccttgacttacccctccaaccgttcagcggctggctctatctgcaggatcagaataaggccgctgacgcagtgggcgagattctgttgtcgcttagctatcttccgaccgccgaaaggctgacagtggtagtggtcaaagctaagaacctgatctggactaacgataagaccacagcagatcccttcgtaaaggtgtacctgctgcaggatgggaggaagatgagcaagaagaagactgctgtaaaacgtgatgatcccaacccagtgttcaatgaagcaatgatcttctccgtgcccgcaatagtactccaggacctctccctccgagtaaccgtcgcggaatctagcagcgatggccgcggagacaacgttggccacgttatcattggcccctccgcctctggcatgggaaccacccattggaaccaaatgctagctaccctgagacgacccgtgtccatgtggcacgctgttcgcaggaactag

SEQ ID NO: 136895 - DNA, 1266 bp, Artificial Sequence
  Description of Artificial Sequence: Synthetic coding sequence
atggcggtggatgtggctgaataccatctatctgtaatcaagagtccaccagggtgggaggtcggcgtctacgccgccggcgccttggctctcctgggcattgccgcagtttccctgtggaagctatggacttccggcagctttccaagcccctctcctttccccaattacgactatagatacctgcagcagaagtatggggagtcctgtgccgaggctcgcgagaagcgcgtcccagcctggaatgctcagcgcgccagtactcgtggcccaccttccagaaaaggcagtctttctattgaggatactttcgagagtatttctgagctaggacctctggagcttatgggaagggagttggacctggcgccttatggaacacttcgcaagagccaatcggccgacagcttaaatagcatttcctctgtcagcaacacctttggccaggatttcaccctgggacaggtggaagtgtccatggagtatgacacggcatcacacaccttaaatgttgctgtaatgcagggaaaagacctgctggaaagggaggaggcgagtttcgagtcctgttttatgcgtgtgagcctgcttccagacgaacagatcgttgggatctccagaatccagaggaacgcgtattcaattttcttcgacgagaagttttctattcccttggatcccactgctcttgaagagaaatcgctccgcttttccgtgttcggcattgacgaggatgagaggaatgtaagtacaggggtggtggagcttaaactgtctgttctggacctgccacttcagccgttttcggggtggctctacctccaggaccagaataaggctgccgacgcggttggggaaattctcctgtcactctcctatctaccaacagctgaacgtttgactgttgtagtcgtcaaggcgaagaatctgatttggacaaacgacaagacaacagccgatccatttgtcaaggtctacctgttgcaagatggccgaaagatgagcaaaaaaaaaacagcggtgaagagggatgatccaaacccagtcttcaatgaagccatgatcttctccgttccagccattgtcctgcaggacctatccctcagagtgacggtggccgagtccagcagtgacggacggggtgataatgtaggacatgtaattattggaccgtctgctagcggtatgggtaccacacattggaatcagatgttggcaactttaaggcggcctgtttccatgtggcatgctgtgcgcaggaattag

SEQ ID NO: 136896 - DNA, 1281 bp, Artificial Sequence
  Description of Artificial Sequence: Synthetic coding sequence
atggttcttagcgtgccagtaatagcgctcggcgccacactcggaactgccacaagcattctagcgctctgcggcgtgacttgtctttgcagacacatgcaccctaaaaaagggctgttgccccgggatcaagatccagacttggagaaggctaagcctagcctgttggggtccgctcagcaattcaatgtcaagaaaagtaccgaaccagtccagcccagggcactgttgaaatttcccgacatctacggtccgaggccagcagtcacagctcccgaggtcataaactatgccgactattctcttagaagtacagaagaacccacggccccagcgagtccccaacctcccaacgattcgcgcttgaagaggcaggtaactgaagaactcttcatcctgccccaaaatggcgtagtcgaggatgtgtgcgttatggagacatggaatcctgaaaaggccgcgtcttggaatcaagcccctaagctgcattattgcctcgattacgactgccagaaagcagagctgtttgtcacccgactggaggccgtcaccagtaaccatgatggcggatgtgactgctacgtacagggatcagtcgcaaaccggaccggctcggtggaggcgcagactgcactaaagaagagacaattacataccacctgggaagaggggttagtccttcccctggctgaagaagagctgcccaccgccaccctaacgctgacactgcgcacttgcgatcgcttctccagacatagtgtggctggcgagttaaggcttggcctggatgggacaagcgtgcctcttggagccgcccagtggggagaactcaaaacctccgccaaggaaccttccgctggcgcaggtgaggtgctcctgagcattagttaccttcccgccgccaaccgattactggtggtcctcataaaggccaagaatcttcacagcaatcagtctaaggagcttctcggtaaggatgttagtgtgaaagtgactctgaagcatcaggccaggaaactcaagaaaaagcagaccaagcgggcaaaacacaagatcaatcccgtgtggaatgagatgatcatgtttgaactccctgacgacctgctgcaagctagctctgtggaactagaggtgttggggcaggatgatagcggccaaagctgtgccctgggccactgtagcctgggtctgcacacctctggttctgaaaggagccactgggaggagatgctgaaaaacccaaggaggcagatcgctatgtggcaccaattacacttgtag

SEQ ID NO: 136897 - DNA, 1554 bp, Artificial Sequence
  Description of Artificial Sequence: Synthetic coding sequence
atgctgcttctatttctgtacataaataaaaaattttgctttgagaatgttgggggattccccgatctggggagcgagtactccactcgaaaaaacagccaagataaaatttacaacagctatatggacaaagacgagcacggtagcagcagtgagtcggaggatgaggccttgggaaaataccacgaggccctctcccggacacataactctaggctccccctagctgattcccgccagagaaactatgcctgggaaacccggcagaagtactcccccctgtctgcagagtacgacggctacagctcggaagcctccattgacgaaggaaactgtattcagcgaatgcgccggacccctccactggacgagctccagccaccgccctaccaagacgactctggatcgccccacctgtcatgtaccccaagcgaaatcggcgattcaaagtgtgagttttctcattgttcaaattctccccgttgtagctataacaagtgcccatccgagggttccaccggacatgagattgagtcctttcacaataagggctatgaggaagatgtgcccagcgatagcacagcagttttaagtcccgaagacatgtctgcgcagggttcatcatcccaactgccaaagccttttgaccctgagcccgaagcgaagtacggtactttggacgtaacatttgactacgactctcaggaacagaaactgctggtgaccgtcactgcagtgacagatatacccacatataataggactggaggaaacagctggcaagtgcatttggtgctgttgccaatcaaaaaacagagggcgaaaacaagtatccagcgggggccgtgtcccgtctttaccgagacattcaagtttaatcacgtggaatccgaaatgattgggaactatgccgttcgtttcagattgtatggcgttcacaggatgaagaaggagaagattgttggcgaaaaaattttttacttgaccaagctcaacctccagggcaagatgtccttgcccgtaatactcgagcctagctataatcacagcggctgtgactcccagatgagtgtcagcgaaatgtcttgcagtgaatcgacatcgtcatgccaatcactggagcacggcagcgtccctgagatcctgattggcctcttgtataatgccaccacagggcgtctaagcgctgaagtcattaagggctcccacttcaagaatctagccgccaatcgcccccccaacacatacgtgaagctcacgctcctaaactccatggggcaggagatgtctaaatgcaagaccagcatccggaggggacaacccaacccggtgtacaaagaaacgttcgtgttccaagtagccctgtttcagctgtcagacgttactcttatcctttctgtctacaacaagagaagtatgaaaaggaaagagatgatcggatggatctcactggggctcaattcaagcggcgaggaggaactgaaccactggacagaaatgaaagaatccaaagggcagcaggtatgtcgctggcatgccctgcttgagtcctag

SEQ ID NO: 136898 - DNA, 1725 bp, Artificial Sequence
  Description of Artificial Sequence: Synthetic coding sequence
atggctatcgaaggcggtgagcgcacatgtggggtccatgagctgatttgtattaggaaagtgagcccagaggccgtgggattcctgtcagccgtgggtgtgttcatcattttgatgctcctgctgttcttatacatcaacaagaagttctgctttgaaaatgttggtggatttcctgacctcggcagtgaatacagcacacgtaagaattctcaagacaagatttataacagttacatggacaaagatgagcatggtagttcatctgaatcagaggacgaggccctcggaaagtaccacgaagccctgagtcggacacacaatagtcggctgcctttggctgactccagacaacgcaattacgcctgggagacgaggcagaagtattctcctctctccgcagagtacgacggctattcatctgaagctagtattgacgaggggaactgtatacagaggatgcgcaggactccgcccctggatgaattgcagccccctccatatcaagacgatagtggcagcccccacttaagctgcactccgagcgaaataggggactcaaagtgcgaatttagccactgctcaaactctccaagatgctcctacaacaaatgcccctcggaggggtctacaggacatgagattgagtcttttcacaataaagggtacgaagaggacgtgccttccgattcaacagcggtgctaagcccagaggatatgtccgcccaggggagtagctcccagttaccaaagcccttcgatcctgagccagaagccaagtatgggacccttgacgtaaccttcgactacgattcccaggagcagaaacttctggtaaccgtgaccgcagtgacagatatccccacttataatcgcaccggcggaaattcttggcaggttcacttggtacttctacccattaagaagcaacgtgcgaagactagcatccagcgcggtccctgcccagtctttacagagacttttaagtttaatcatgtggaatcggagatgattggcaattacgccgtacggttcaggctgtacggagtccaccgcatgaaaaaggagaaaatagtgggcgagaaaatattttacttgaccaagctcaatctgcaaggaaaaatgagcttacctgtcatcctcgagccatcgtataatcacagtggttgcgactcacagatgagcgttagcgagatgagctgctccgaaagtacctcctcttgtcagtcattggaacacggcagcgtacccgaaatcctcattggcctattgtataacgccaccactgggcggctgagcgccgaggtgattaaaggctcccatttcaagaatctcgctgccaaccggccacctaatgggctgttttgctgcctcaagcatttgataggtgggcaggtgtacatcataagagacacttatgtgaagcttactcttcttaactctatgggccaggagatgtccaaatgtaaaacttctattagacggggtcagccgaaccctgtttacaaggagacgtttgtgttccaggtggcattgtttcagttgtcagacgtgactctgatactcagcgtgtacaacaagcgatcaatgaagagaaaagagatgattgggtggatctccttggggctcaatagctccggagaggaagaactgaaccattggacagaaatgaaagagagcaagggccaacaggtttgtcgatggcacgcccttctggaatcatag

SEQ ID NO: 136899 - DNA, 1377 bp, Artificial Sequence
  Description of Artificial Sequence: Synthetic coding sequence
atggccatcgaaggtggcgagcggacatgtggagtacatgaacttatttgcatccgtaaggtcagtcccgaagctgtgggattcctcagcgcagttggcgtttttattattcttatgttacttctgttcctctatattaacaaaaaattttgctttgagaacgtgggcggttttcccgatctgggctctgagtacagcacacggaaaaacagtcaagataaaatctataattcttacatggacaaagacgaacatggatccagctcggagtccgaagatgaagcccttggaaaataccacgaagcactctcccggacacataacagccgactgcctctggccgactcgcggcagcgaaattatgcgtgggagaccaggcagaagtattctccactgagtgctgagtacgatggttacagcagtgaagcgtccattgacgaaggtaattgtatccaaagaatgaggcgcacacctcctctggacgagcttcaacctcctccctaccaggacgattccggttcaccacacctgtcatgtacacctagcgagattggcgattccaagtgtgagtttagccactgttcgaactccccaagatgctcttataacaaatgtccgtctgaaggatccactgggcatgagattgagtcgtttcacaacaagggttacgaagaagacgtgccaagtgacagcactgctgtactgagcccagaagatatgtccgcacagggctcctccagtcagctgccgaaaccctttgaccctgagcccgaggccaaatacgggactctggatgttacatttgattacgacagccaggaacagaaactactcgtgacagttaccgccgtgaccgatatccccacctataacagaactggtgggaactcatggcaggtgcacttggtgctactacctatcaaaaagcagagagcgaagacatccattcagcgcgggccatgtccagtgtttacagagacgttcaagttcaaccacgttgaatcagagatgattggcaattacgccgtgcgcttccggctatatggcgtccatagaatgaagaaggagaagattgtgggggagaaaatcttctacctaacgaaactcaatctgcagggaaagatgagcctccccgttatcttggagccaagctataaccacagcggttgcgattcccaaatgtccgtttccgagatgagttgttctgagagcacatcttcttgccagagtctggaacacggaagcgtccctgagatactgatcggactcttgtataatgcgacgacgggccgcctgtccgctgaagtcattaaaggttcgcatttcaaaaacttagctgctaataggccccccaagatggactgtagcgttgtgtag

SEQ ID NO: 136900 - DNA, 1860 bp, Artificial Sequence
  Description of Artificial Sequence: Synthetic coding sequence
atggcaagcgcgtcctggaggctgaaggtggaacgcgaacctgtagaatacatgaacctatcggtgctggaaaagattgggtattttagtgtcgcgaggctcgagtactcaggcacaatcctggcccactgtaacttcagactcctcgggtcaaacgattccagcgcctccgcctcccaggtaacgggcacaactgtctcccccgaggccgtggggtttctgagtgccgtcggcgtgtttataattttgatgcttctgctgttcctgtacataaacaagaaattctgtttcgagaacgtgggaggatttcctgacctaggctccgaatactctacaaggaagaactcgcaggataagatatacaattcttacatggataaggacgagcacgggagctcaagcgagtccgaggatgaggcgttggggaaataccatgaggccttgagccggacccacaacagcagactcccgctggccgactctaggcagcggaattacgcctgggagacgcgccagaaatatagtcctctgagcgccgaatacgacggctattcctctgaagcttctatcgacgagggcaactgcatccagagaatgcgacgaacacccccgctggacgaactgcaacccccaccttaccaggacgacagtggatccccacatctctcctgcaccccctccgagataggcgattctaagtgtgaattcagccactgtagtaactcgcctaggtgttcgtacaataagtgtcctagcgaggggtctacaggccatgaaatcgagagcttccataacaaaggatatgaggaagacgtcccatctgactccaccgcagtcctttcgcccgaggacatgtcagcacagggatcgagcagccagttgccgaaaccattcgatcctgagcctgaggccaaatacgggaccttagatgtcacctttgattatgactcccaggaacagaagctgttagtcacagtcaccgccgtcacagatattcctacatataatcggacaggaggcaacagttggcaggtgcacttagtcctgctccccatcaagaaacagagggccaagacctctatacagcgggggccatgcccagtcttcaccgaaactttcaagtttaaccatgtggagtccgagatgatcgggaactacgccgttcgtttcagattatatggggttcatcggatgaaaaaagagaagatagtgggagagaagatcttctaccttacaaaactcaatcttcagggcaagatgtccttgccagtaatactggaaccctcttacaaccatagtggctgcgacagccaaatgagcgtctctgaaatgtcttgtagcgagtccaccagttcctgccaatcccttgagcacggatccgttcctgagatcctgattgggctgctgtacaacgcaaccaccgggagattgtcagcggaggtaatcaagggcagccattttaaaaacctagctgccaataggccccccaacggactgttttgctgcctgaagcatctgattgggggccaggtgtacatcatcagagacacctatgtaaagcttaccctgttgaattcaatgggacaggagatgagtaagtgtaaaacctctatcagacgaggacagcccaatcccgtgtataaggaaacttttgtgtttcaggttgctctttttcaactgtcagatgtgaccttgattctgtccgtgtataataaaagatctatgaagaggaaggagatgatcggctggatctcactgggtctaaactcttcaggcgaagaagagcttaaccattggactgagatgaaggagtccaaggggcagcaagtgtgcagatggcacgccttgctcgagagctag

SEQ ID NO: 136901 - DNA, 1668 bp, Artificial Sequence
  Description of Artificial Sequence: Synthetic coding sequence
atggctattgaaggcggagagcgaacatgtggtgtgcatgagctgatttgcatcagaaaggtgtctcccgaggccgtcggattcttgagcgcagtcggagtattcatcatcctgatgctgttgctatttctttacatcaataagaagttttgtttcgaaaatgttggaggctttcctgatcttggctctgagtactccacaagaaagaatagccaggacaaaatctataactcttacatggataaggacgagcacggcagtagcagtgagtctgaggacgaggcgttaggtaagtaccacgaggccctttcccgaactcacaactcgagactccctctcgccgattcacgccagcggaactacgcatgggagactcggcaaaagtactcccccttgtcggcggagtatgacgggtacagttcggaggcctcaattgatgaggggaactgcattcagcggatgcggagaacccctccactggatgagttacagcctcctccgtaccaagacgatagtggttcccctcacctttcatgtactccatccgaaattggagactcaaagtgcgaattttcccactgcagcaacagtccgcgttgttcttacaacaaatgccctagcgagggttctacagggcacgagatcgagagctttcataataaaggatacgaagaagatgtaccatccgactccacagctgtgctgtccccggaggatatgagcgctcagggaagttccagccagctccccaagccctttgatcccgaacccgaagcaaaatatggtaccctggacgtgacttttgattatgatagccaggagcagaaactcctcgttaccgtaaccgctgtcaccgacattccgacttacaacaggacaggggggaattcatggcaagtgcatctcgtccttctaccaatcaagaagcaaagagcaaaaactagcattcagcgtgggccgtgtcccgtttttactgagaccttcaagtttaatcatgtggaaagcgagatgatcggaaattacgcagtccgcttccgcctatatggggtgcatagaatgaagaaggagaaaatcgtcggggagaaaatcttttatttaaccaaattaaacctgcagggcaagatgtccctccctgtgattctggagcctagttataaccactcaggatgtgattctcagatgtcggttagcgaaatgagctgtagtgaaagcacatcctcttgtcagtccctggagcatggaagtgtgccagaaattctgatcggcctgttatacaacgcgaccaccggacgcctgtctgcagaagttataaagggctctcatttcaaaaacctggcagccaaccgcccccccaatacatatgtcaagctgacgctgctcaatagtatgggacaagagatgtcaaagtgcaaaacaagcattaggcgtggtcaaccgaaccccgtgtacaaggaaacttttgtattccaggtagcactcttccagttaagcgatgtgactttgattttaagcgtctacaacaaaaggtccatgaagaggaaagaaatgattggttggatatcccttggcctcaactcgtctggagaagaagaacttaaccattggaccgagatgaaggagtccaagggacaacaggtgtgccgttggcacgccctgctggagagctag

SEQ ID NO: 136902 - DNA, 1746 bp, Artificial Sequence
  Description of Artificial Sequence: Synthetic coding sequence
atggccattgaggggggggagcgaacctgcggcgtgcatgagctgatatgcatccgaaaagtctcccctgaggcggtcgggtttcttagtgccgtcggtgtatttattatcctcatgctgctccttttcctgtacatcaataagaagttctgttttgagaatgtgggcggatttcccgatttggggagcgagtactcaacacgcaagaacagccaggataaaatttataatagctatatggacaaagatgagcatggttctagctccgaaagtgaggatgaggcattggggaagtatcatgaggccctgtcacgcacacataacagtcgccttccccttgcagattccaggcagcgcaattatgcgtgggagacccggcagaagtacagtccgctgagtgcagaatacgatggctacagctctgaagccagtatcgatgaaggcaactgtatccagcgcatgcgccgtactccacccctggatgagctccaaccccctccttaccaagacgattcagggagccctcacctgtcatgtacaccgtcagaaatcggtgatagcaagtgtgaatttagccactgctctaatagcccccgctgtagctacaataagtgtccttcagaggggtccactggccacgaaattgaaagtttccataacaagggctatgaagaagacgtgccttctgattcgactgcagtgttgtcaccggaggacatgtctgcacagggctcatctagtcaattaccgaagcccttcgatccagagcctgaggccaagtacgggactctcgacgtaaccttcgactacgatagtcaggagcagaaactgttagttacagtaaccgcggtgacagacatacccacgtacaaccgaacaggcggcaattcttggcaggtgcacctcgtgctactgccgatcaaaaagcagcgggctaagactagcatccaacggggcccgtgccctgtcttcacagagaccttcaaattcaatcacgtcgaatctgaaatgatcggcaattatgcggtgcgattcaggctgtacggggtgcatagaatgaaaaaagaaaagattgtaggagagaagattttctaccttaccaagctcaacctgcaaggtaaaatgtcactccctgtgatactcgagccaagctacaaccactccggctgcgactcccagatgagcgtatcagaaatgtcatgcagtgaaagtacatcctcttgccaaagtctcgagcacgggagcgtccctgagatcctcataggtctcctttacaacgcgacgaccgggaggctgtcagccgaggtgatcaagggtagtcatttcaagaacttagcggccaatcgaccccccaccttccatcctctcctgagtgatgggctgttctgctgcttgaaacatctaattggtggccaggtctacatcatacgcgatacatacgtgaagctgaccctgctaaatagtatggggcaggagatgtctaaatgcaaaacctccattcgccgagggcagccgaatcccgtctacaaagaaacttttgtcttccaagtggctttgttccagttatccgacgtaaccctcattcttagtgtgtacaacaagcgaagtatgaagcggaaagagatgatcggatggatttcactcggactgaatagctctggtgaagaggaactcaaccattggaccgagatgaaagagtcaaagggccagcaggtctgcagatggcatgcactgctggagagttag

SEQ ID NO: 136903 - DNA, 1554 bp, Artificial Sequence
  Description of Artificial Sequence: Synthetic coding sequence
atgctgctgctgttcctctatatcaataagaaattctgtttcgaaaatgtcggcggctttcccgacttgggcagcgaatactccaccaggaagaacagccaagacaagatttacaacagctacatggataaagatgaacatggcagcagttccgaatccgaggacgaagcactgggaaaatatcacgaggcgctcagcaggacccacaattccaggctgccactggctgattctcgccagcgtaactatgcttgggagacgcgccagaaatactcccctctctccgccgagtatgacggatattcgagcgaagcaagtatcgatgagggtaactgtatacagcggatgcgccgcacccctcccctggacgagcttcagccaccaccttaccaggacgacagcgggtcaccgcacctgtcctgcactccctctgagatcggagactctaaatgcgaattcagccattgctctaactcaccgagatgttcctataacaagtgcccatctgagggctctaccggacatgagatcgaaagcttccacaacaaaggctacgaagaagatgtcccctccgactcaaccgcagtgctgtccccagaagacatgagcgcccaaggcagctccagccagttacccaagccttttgaccccgagcctgaggcgaaatacggcactctcgacgttaccttcgattatgacagccaagagcaaaaactgctggttaccgtgaccgctgtaaccgacatcccgacgtacaaccggaccgggggaaattcttggcaagtgcatttggtcctgctccctattaagaagcaacgtgccaagaccagcattcagcgggggccttgtccagtgtttactgaaacattcaagtttaatcacgttgagtccgagatgattggtaattatgcagtgcgattccgactctatggagttcatcggatgaagaaagagaagatcgtgggcgagaaaattttttatctcactaagttaaacctgcaggggaagatgtcactgcctgtgattctagagcccagttataatcatagtggatgcgatagccagatgagcgtctcagaaatgtcatgttcagagtccacaagctcatgtcagagcctggagcacggctctgtgccagagatactgattggcctcctctacaatgccacaactgggcgcctctcagccgaggtcattaagggatcccactttaagaatctagcagcaaaccgaccgccaaatacctacgtgaagttaacattactgaactccatgggccaggaaatgtcaaagtgcaaaaccagcatcaggcgcggtcaaccaaatcctgtgtataaagagaccttcgtgttccaggtagccctgtttcaactttcggatgtcacactgatcctgagcgtgtacaataagcgatccatgaagcgcaaagaaatgatcggatggatatctttaggactgaactcaagtggtgaggaggaactgaatcactggactgagatgaaagagagtaagggccagcaagtatgccggtggcacgccctcctggaaagttag

SEQ ID NO: 136904 - DNA, 1266 bp, Artificial Sequence
  Description of Artificial Sequence: Synthetic coding sequence
atggccgaacagcttgccctggtaatcggcgggactatcgggggcctgcttctcctcctcttgatcggcgcctcatgctgtctttggcggagattctgtgccaccttgacttacgaagagctccccggtacgccagcaatggccactaccgcagcctcatcgggtcagagggaccgcccctgccagcctcatgccagaactcagctatcgcggcctcctgccgtgccatttgtggtgccaccaaccctgcaagggcgagactgggtgcccctgcacagcggagagtgggccgacgcgccctgggatccatgtccagcaagtgaactccttccgcataccagttctggtggcctgggggacgcgtgtatggttggggccattaatccagagctctacaagtttcccgaagacaagagtgaaaccgatttccccgatggctgtttaggccgcctctggtttagcgtggagtacgaacaagaggccgagaggttgttggttggcctgataaaagctcaacaccttcaagccccttctgagacctgttccccgttagtcaagctgtacttgttgccagacgagcgcaggtttctccaatctaagacaaaaaggaagacttctaacccccagtttgacgagcactttatatttcaggtgtcttccaagacaataactcaacgcgttctgaaattttccgtgtaccacgtagaccggcaaagaaagcatcagctgctgggacaggtgctgtttcccctaaaaaacgaaaccctcgtaggcgactgccgcagggttatatggagagaccttgaggctgaatcattggaaccccctagtgaatttggtgatctgcagttttgcctgtcatataacgattacctcagcagactgacagtcgtcgtgcttagagccaagggtctccggcttcaagaggacaggggaattgtgtcggttttcgtcaaagtgtcactgatgaaccataataagttcgtgaaatgcaaaaaaacatccgcggttctgggttctatcaatccagtctacaatgagacatttagcttcaaggccgatgcgacagaactcgacaccgcgtctctctcactgaccgtggtgcagaacatggaaggagacaagtctcaacaactgggacgggtggttgtgggcccatatatgtacacacgcgggcgtgagttagagcactgggatgaaatgctgtctaaacccaaggaactggtaaaacgatggcacgcattatgccggacaaccgagccatag

SEQ ID NO: 136905 - DNA, 1425 bp, Artificial Sequence
  Description of Artificial Sequence: Synthetic coding sequence
atgggggtggtactgagtcctcaccccgcacccagccgccgcgaaccccttgccccgctcgcccctggcacccgcccaggctggtcaccagcagtgtctggaagttcacgaagcgctttgagacccagcactgccggcccaggaccgggacccggcactgggtgggggggaaccgctgcaagcggccgctgggtaccagcccccgcagtgcactgtgctgcacctagagccgctgctgggcaccaacagcatcacggtccccctctttgttctccagatggagcccctagacgcttcaagcgccggcctgggagcccagcccctgctgcacagaccggcgaaacatccctccgtgagcagcctcatgggggaccccccgccgtaccattcgttgtgcctcctactttgcagggccgggattgggtgccactgcactctggggagtgggctgacgctccatgggacccgtgtccggctagtgaactgttgccgcacaccagctcagggggactgggcgacgcctgcatggtgggggctattaatcccgagttatataagtttcccgaagataaaagcgaaacagattttcccgacggctgtctcggacgactgtggttttcagttgagtacgagcaggaggccgagcgcctcctggtaggactaatcaaggcccagcatctccaggccccatcagaaacatgcagcccactagtgaaactgtaccttctgcccgatgaacggcgctttttacaatctaagactaagcgcaagaccagcaatccacaattcgacgaacatttcatatttcaagtctcctctaagactatcacccagagagtactcaaattttccgtgtaccacgtggatcggcagcggaagcatcagcttctcggccaggtgctcttccctcttaagaacgagacgctggtgggtgattgtcggagagtaatctggagagacttagaagctgaaagcctcgaaccaccttcggagttcggagatctgcagttctgtctctcctacaacgattatctgagtcgcctaactgtggtggtgctaagagccaaggggctgaggctgcaagaggatcgggggattgtctccgtattcgtcaaggtcagcctcatgaatcacaataaattcgtgaaatgtaaaaagacgtcagccgtgctcggctcaataaaccctgtatataacgaaacattcagttttaaagccgacgctacggaacttgacactgccagcctgtccctgacggtagttcagaacatggagggtgataagagtcagcaattggggagggtcgttgtggggccctacatgtacacccggggaagagagctggagcactgggacgagatgctcagcaagcccaaagaattggtcaaacgctggcatgccctctgtcggacaaccgagccatag

SEQ ID NO: 136906 - DNA, 1173 bp, Artificial Sequence
  Description of Artificial Sequence: Synthetic coding sequence
atggctgagcaactggccctggtcataggcggtaccatcggcggactgctgctgctgctcctcattggcgcttcttgctgtctgtggagacgcttctgcgccaccttgacatacgaggaactgcctgggactccggcgatggccacaacggcggcctcatctgggcaaagggataggccctgccagccacatgcgagaacgcagctgtcccggccgcctgcagtgcctttcgtagtcccaccaacattgcagggcagggattgggtgccgcttcattctggggaatgggctgatgcgccatgggacccctgtcctgctagcgagctgctgccccatacgagcagcggaggtcttggggacgcgtgcatggtgggcgctataaatcctgagctgtataagttccctgaagacaaaagcgaaacggatttcccagatggatgtcttgggcgactgtggttctcagttgagtacgagcaagaagccgagcgtctgctggtgggactgatcaaggcccagcacttgcaagcaccatctgagacatgttcccctttggtgaaattatatcttctgccggacgagcgacggttccttcagtctaagacaaagcgaaagacaagcaatcctcagttcgacgaacattttatcttccaggttagttctaaaaccatcacccagcgcgtcctgaaattcagtgtctaccacgtggataggcaaaggaagcaccagttgctagggcaagtgctctttccactgaaaaacgagacgctggtgggggactgtcggcgcgtcatttggcgagatttagaggccgagtcactcgaaccgccctcagagttcggtgacctgcagttctgcctttcctataacgattacctgtccagactgactgtggtggttttgcgggccaaggggctgagactccaggaagacagagggatcgtaagtgtgttcgtgaaggtcagtcttatgaatcacaataaatttgttaaatgtaagaagacttctgccgtactcggatctattaatcccgtgtacaacgaaaccttttctttcaaggccgatgcaaccgaactggataccgcctcgctgtctctcacagttgtccaaaacatggaaggagataagcaggctacgactgtcgagctctttctctttcatctgaccagcggttag

SEQ ID NO: 136907 - DNA, 543 bp, Artificial Sequence
  Description of Artificial Sequence: Synthetic coding sequence
gatgagcattttatttttcaggttagctccaaaaccattactcaacgcgtactgaagtttagtgtctaccatgtggatcggcagagaaaacaccagcttttaggccaggtcctcttcccactgaagaacgagacactggttggggactgtcgacgcgtaatctggagagacctcgaggctgaaagtcttgagcctccatctgaatttggggacttacagttttgcctcagttacaatgactacctgtcacggctgaccgtggtggttctacgagcaaagggcctccgcctgcaagaggaccgggggatagtgagcgtgtttgtaaaagtgagtctcatgaatcacaataagttcgttaaatgcaaaaaaacttctgcagttctgggcagtatcaaccccgtgtataatgagacattctcattcaaggcagacgctacagaactcgatacggcctctctgtccttgacagttgtccaaaacatggagggcgataagcaagccacaacggtggagcttttcctgtttcacttgacttccggttag

SEQ ID NO: 136908 - DNA, 783 bp, Artificial Sequence
  Description of Artificial Sequence: Synthetic coding sequence
atggtaggggcaatcaaccctgaattgtacaagttcccagaggataagtctgagacgtgttcaccgctagtcaaactgtatctgctgcctgacgagcgccggtttctgcagtcaaagactaagcgaaaaactagcaacccccagtttgacgaacacttcatcttccaggtgtcttcaaagacaatcactcaaagggtactgaagttctctgtgtatcatgtggacaggcaaaggaaacaccagctcctggggcaggtactcttcccgctgaagaacgaaaccctggtgggggactgtcgccgcgtgatttggcgagacctggaggcagagagcctcgagcctccgagcgaattcggggacttgcagttctgcctgtcgtataacgactacttatctagactgactgtggtggtgctgagggcaaaaggacttcggttacaggaggaccgcggcatagtgtccgtttttgtgaaagtttccctcatgaaccataacaaatttgtgaaatgcaagaaaacaagcgctgtcctgggcagcattaaccctgtctataacgagaccttttcatttaaggctgacgccacggaactggacactgcctccttaagcctgaccgtcgtgcaaaacatggagggcgataagtcccagcagctgggccgggttgttgttggaccttacatgtatactcgcgggagagagctggagcattgggacgaaatgctgtccaagccgaaagagctcgtgaagagatggcatgccctgtgtcgtacaacagagccctag

SEQ ID NO: 136909 - DNA, 1047 bp, Artificial Sequence
  Description of Artificial Sequence: Synthetic coding sequence
atggcagaacagctcgcgctcgtgattggaggaaccataggcgggctgctcctattattactgataggggcctcttgctgcctatggaggcgattctgcgctactctgacttacgaggaactcccgggtacccctgccatggcgacaacggcagccagctccggacagcgggatagaccttgccagccacatgccagaactcagctgagccggcccccagctgtgccttttgtggtgccccccaccctgcagggccgtgattgggtgcctctgcattctggagaatgggctgacgcaccatgggacccgtgtcccgccagcgagctcctgccacacacaagctctggagggctgggagatgcttgcatggtaggggctataaaccccgagctttataaattcccagaagataaaagcgaaacagatttccccgacggctgtctgggccgcttatggttcagcgtcgagtacgagcaagaggcggagagattgctggtcggcctcattaaggctcaacacctgcaagcaccaagcgagacgtgttcgcccctggttaagctgtatcttctcccggacgagcgacggtttcttcagagcaagactaagcggaagaccagcaatccacagttcgacgagcacttcatctttcaggtatcaagcaagaccatcacccagcgtgtgctaaaatttagcgtgtatcatgttgaccgccaacggaaacaccaactgcttggtcaagtcttattcccgctcaaaaacgagactctggttggtgactgcagacgcgtcatttggcgggacctagaggcagagagtttggaaccaccttccgaatttggagatctgcagttctgcctcagttataacgattacttgtctcgcttaactgtcgtggttctccgtgccaagggactccgcctgcaggaagatagagggattgtgtccgtgtttgtgaaggtgtctctgatgaaccataacaagtttgctaaatgcaagcccgggcccgatcttggcgaggagtccagaggtagcctcaatctgaaatag

SEQ ID NO: 136910 - DNA, 1173 bp, Artificial Sequence
  Description of Artificial Sequence: Synthetic coding sequence
atggcagaacaactggccttagtaatcggtggcaccattggaggtcttctcctcctgctcctgatcggtgcaagctgctgcctatggcggaggttttgcgcaaccttaacctacgaagaattgcctggcacccccgcgatggccactactgcagcttccagcggacagcgagacaggccttgccagccacacgcacgaacacagttgagtcgccctccagccgtcccgttcgtagtgccacccacgttgcagggacgcgactgggtacctctccattctggggagtgggccgatgctccatgggacccttgtccggcttccgaactgcttcctcacacatcgagtggcggactcggcgacgcttgcatggtgggagccattaaccccgagctctacaagttccctgaggacaagtccgaaaccgattttccagacggctgcctgggccggctgtggttctcagtcgagtatgagcaggaggccgaaaggttgttggttggcctgattaaggcacagcacctgcaggcacctagtgagacatgctctcccttggtgaaactgtatctgctgcccgacgagaggcggtttctccagagcaagacaaagcggaagacttctaacccacaattcgacgaacacttcatctttcaggtctcctctaagactattacccagcgcgtacttaagttctctgtctatcacgtagatagacagagaaagcaccaattacttggtcaagtgctgttcccgctgaagaacgaaacactggtgggagattgcagaagggtaatctggcgtgatctggaggctgagagcctagaaccaccttcagagtttggcgatctgcagttctgcctatcgtacaatgactacctctcccgactaactgtggtcgtactgcgagctaaaggcctccgtctccaagaagataggggaattgtgtccgttttcgtcaaggtaagcctgatgaatcacaataaattcgtaaagtgcaaaaaaacatcggccgtgctgggaagcattaaccccgtgtacaatgagaccttcagttttaaggctgatgctacagagttggatacagccagccttagcctgaccgtggtgcaaaatatggagggggataagcaggcaaccaccgtggaattgttcctgttccatttgaccagtggatag

SEQ ID NO: 136911 - DNA, 1152 bp, Artificial Sequence
  Description of Artificial Sequence: Synthetic coding sequence
atggtcctcgccatggcctcccaagacgtacagaatttctttcagccattttcatcctggatctctcgggtttacgaagccctgcaacaggctggcgatatgctctctgccagtctagtgaacatttctaagcaagatagtaagctctccgacaaacttgatcaggacctggataatatccaaattcaagaaacgtactttgaggacgaagaacaggacaacgattggagccaggaggatgcgaattctctgttccttgaagtggaccacttttcctgttgcaactcagatcttcaggactcagcgcagaatagcagcccatctctctctcaacatgccaaggatagctgctcaaccatgtctcagtggccgaattgggcaagtgacgacaggaagttgccccatgtactcagcagcattgccgaagaagaacaccacctggaaaaacaacggtccggtctccaacacggtttcgatagtcaactccctggaactctcgagacagttaacggtaaaaagcaggtgaatagttttggtgatgatgaggaattgtctacctccagtgactccgatgaggaagttattaagcagtttgaaatctcagtgtcccgctctcagagttttcgctctgtcacgtcggagaaaggaaagcaaaccggtctggaacagaaaccaaaattctctagaagcctcctgacacacggcgaagacggcaccgaagtctccgcctgtgaggacttggacggggccagtcagagaaggtacagtgagaatctttcctatggggaagacgatcatatccctgcccactcccagtctccgtgcgagaggggagacgctaaacaccatggcacaagccaccaggaatccagcgtcgtgcagtccttgcgaagacagtccacagagggaagcctggagatggaaaccgctttcaactcaagaggctttgaggactcatatgcgactgatagttctagcatgtggtctccagaggccaatttaaatctgaagcggaagggctatctgctggatgtctactgcctttctagtcccctgctgtttaccacgagccttcatcggaggaataggactggccccatctgcaggtgtcaccccgggagtcagtcccctagtcaatccgttgttacatag

SEQ ID NO: 136912 - DNA, 1938 bp, Artificial Sequence
  Description of Artificial Sequence: Synthetic coding sequence
atggtgttagccatggctagtcaggatgtgcaaaacttttttcagccttttagtagttggatttctcgcgtttacgaggctctgcagcaggctggcgatatgttgtccgcgtctctggttaacatcagcaaacaggattccaagctttccgataagcttgaccaggaccttgacaatatacagatccaggagacttactttgaggacgaggagcaggacaacgattggagccaggaagacgcaaatagtcttttcttggaggtcgatcatttttcctgttgtaattcggatcttcaggattccgctcagaacagtagcccgtccctgagtcagcatgctaaggatagctgctccactatgtcacagtggccaaattgggcatctgatgaccgcaagctgccccacgtcctttcctccatcgctgaagaggaacatcatctggagaagcagcggtctggcttacagcatgggttcgactcccaacttcccgggactctggaaactgtcaatggcaaaaagcaggtcaatagctttggggacgacgaggagctatccacatcttccgacagtgatgaggaggtgataaaacagtttgagatctctgtatcacgctcccagtcgttccggagcgtgacctccgaaaagggtaagcagaccggactagagcagaaacccaaattctctcgaagcctgcttacccacggagaggacggcacagaggtctctgcgtgcgaagatctggacggtgcaagtcagagacgttattcggagaatttaagctacggggaagacgatcacatccccgctcatagccagagcccttgcgagcgaggagatgccaaacatcatgggacctcacatcaggagagctcggtcgtacagagtttacgcagacaatctaccgaaggcagtttagaaatggaaacagcttttaactcccggggcttcgaagattcctacgctacggattctagttcaatgtggagtcctgaggagcaggatcgcactaatctgcaggtgccgagtggcgtctctgagcccatctcaaaatgtggtgatttggatgttattttcgagtatagagccgcctctcagaagctaactgtcactattgtgagggcacagggactccccgacaaggatagaagtggggtcaactcctggcaggtgcatgtggtactgctgccaggcaagaagcatcggggccggaccaatattcagagggggccaaacccagtgtttcgcgagaaggtgaccttcgcgaaacttgagccacgtgatgtagctgcctgtgcagtccgcttccggctgtacgcagctcggaaaatgacacgggagcggatgatgggagaaaagctgttttacttgagtcatctccatcctgagggggagatgaaggtaacgctggtgctggagcctcgctctaacatcagctccggcggatcaccactgagcccctccgcagtgtcgcacagcgacagtaccagtagcactcagtccctatcacatggtggtgcgccagaattactggttggtttgtcatataacgctacaaccggccgcttgtctgtggaaatgattaaagggagccacttcagaaatctggctgtgaacagggcgccagacacctatggaaagctgtttctcctgaactcagtcggccaagagatgagccggtgtaagaccagtattaggcgcggccaacccaatcccgtctataaagagacgtttgtattccaggtcgccctgtttcaactctcggacgtcactttaatgatatcagtctataatagacgcacgatgaagagaaaggagatgattggctggattgctcttggacaaaacagctctggagaggaagagcaggaccactgggaagaaatgaaggaaacgaagggtcaacagatttgccggtggcacactctgctggagtcctag

SEQ ID NO: 136913 - DNA, 1653 bp, Artificial Sequence
  Description of Artificial Sequence: Synthetic coding sequence
atgcctcaacgggggcatccaagccaggagggcctgtgggctctgccatccctgccgatggcccacgggccgaaacctgagaccgagggcctccttgatctgtcattcttaactgaagaggaacaagaggcaattgccggcgtcttacagcgagatgcacgcctgagacagcttgaagagggccgagtgtccaaactgcgcgctagcgttgcagatcccggccagctgaaaattctgaccggcgattggtttcaggaagcccggtcccagcgacatcacaatgctcatttcggcagcgatctggtccgcgccagtatgcgccgaaaaaaatcgacccgaggcgatcaggctcctggccacgaccgcgaagcggaagccgcagttaaagagaaggaagaaggccccgagcctcgactcacaatcgatgaagctccacaagaacgcctcagagagactgaagcatcagaccctgaggaagctagccaagctcaggaagatcctgggcagggagaccagcaggtgtgcgccgaagaagcagaccctgagctggagcccgcctcaggcggcgaacaggagcctaggccgcagcaggctcagaccaaagccgctagccagatcctcgagaacggagaggaagcaccaggccccgatccgtccctggatcgtatgctctcaagcagcagttctgtgagttccctgaactcctcgacattgagtggcagtcagatgtcccttagcggtgacgctgaggccgtccaggttagggggtcggtgcactttgccctgcattacgaacccggagcggctgaactcagggtccatgttatccagtgccagggtctggcagctgcccggcggcgccgaagtgacccatacgtgaaaagttatctattgcctgacaagcagagcaaacgcaagactgcagtgaagaagcggaacctgaacccagtgtttaacgagaccctgcgctactcggtgccacaagctgagctgcaggggagagttctctcccttagcgtgtggcaccgagaatccctagggcgaaatatctttctgggagaagtggaggtacctttggatacttgggattggggctccgaacctacttggctcccactccagccacgtgtgccaccttcgccagatgacctaccctccagggggcttcttgcattgtcattgaagtacgtgcctgcgggcagcgaaggcgcaggactgcctccatcaggcgaactgcatttctgggtcaaggaggctcgcgacttactgccactgcgcgccgggtccctggatacctacgtgcagtgctttgttttacctgatgactctcaggcatcccgtcagagaactcgggtggtgcgacgtagtctgtccccagtgttcaatcataccatggtgtacgatgggtttggacccgcagatctccgccaggcctgtgctgagttaagtctgtgggaccatggcgcccttgccaatcggcaactgggcggcaccagactttcacttggcaccggttcatcctatggattgcaggtgccgtggatggattctaccccagaggagaaacaattgtggcaggccctgctggaacagccgtgtgagtgggtggatggtcttttgccactgagaaccaatctggcccccaggacatag

SEQ ID NO: 136914 - DNA, 231 bp, Artificial Sequence
  Description of Artificial Sequence: Synthetic coding sequence
atgccacagcgcgggcatccctctcaggaggggctgtgggcgcttccaagtttgccaatggctcacggaccaaagcctgagaccgaaggtctcctcgatctgagtttccttaccgaggaggagcaggaggccattgccggcgtgttgcaaagagacgcgcgactcaggcaattagaagaaggcagggtgtcaaaacttagggctagtgtggccgaccctggccagctttag

SEQ ID NO: 136915 - DNA, 1065 bp, Artificial Sequence
  Description of Artificial Sequence: Synthetic coding sequence
atgccacagaggggacaccccagccaggagggtctttgggccctccctagtcttcccatggcccacggtccgaaacccgaaactgaaggtttgctcgacctctccttccttaccgaagaggagcaggaggccattgccggggtgcttcagcgggacgccagattgcgccagctcgaagaaggacgtgtgagcaaattgagggcaagcgtggccgaccccgggcagttaaaaatacttactggagattggttccaggaagctaggagtcagcggcaccacaatgcccactttggatccgatctggttagagcttccatgcggcggaagaagtccactcgcggcgaccaggcaccaggacacgatcgagaggccgaagccgctgtgaaggagaaggaggaagggcctgagccaaggctcacaatagatgaagccccgcaggaaaggttgagggagactgaaggccctgatttcccctcaccttcggtacccctgaaagcatcagatcccgaagaggcaagtcaagctcaagaggatccaggccagggtgatcagcaggtgtgtgcagaagaagccgaccctgaattggaacctgcatctggaggggagcaagagcccaggccccaacaggcccaggtcgggggaagtggtccttggctgctatcaacatccggagccgactccgggcggggggctctacttccgagagcggcatcacggcctagaccaagggccctcggggcaggcgtaggcaaagagggggcacctagacatcttcccccactgcagaccaaagccgcttctcagatactggaaaatggagaagaagctccgggacctgatccaagcctcgacaggatgcttagctctagtagctctgtttcctctctgaactcatctacccttagcggtagtcagatgtctttatctggtgatgctgaagccgtgcaagtgagaggttccgtccactttgccctccattacgagccaggagctgctgagctgagggtccatgtgatccaatgccaggggcttgccgccgctaggagaagacggtcagacccatag

SEQ ID NO: 136916 - DNA, 606 bp, Artificial Sequence
  Description of Artificial Sequence: Synthetic coding sequence
atgggaaccacagcattgcttggaggggtgcggctctccgagaccatcccggtcaagcgacttgcaagaggcttggctagggtcagggacggcggctggggctcaccgcaggccggagagaaggcactcggagggccattgctgacctccggatcacatctgccttcctacgtgaagagctatttgttgcccgataaacagagcaaacggaaaacagctgttaaaaagagaaacctgaatcctgtctttaatgaaactctgaggtatagtgtgccccaagccgagctgcagggtagggtactgagtctgagtgtctggcatagggaaagcttgggccggaacattttccttggagaggtggaagtacctctcgacacttgggattggggcagcgaacccacctggctgcctttgcagcccagagtgccaccatcccccgacgacctgccttcaagaggtctgttagcattgtctcttaagtacgtgcccgctggatccgagggcgcgggcctccctccatctggagagctccatttttgggtcaaggaggcgcgtgaccttcttcccctacgtgcaggctctctcgatacatacgtacagtggtag

SEQ ID NO: 136917 - DNA, 1083 bp, Artificial Sequence
  Description of Artificial Sequence: Synthetic coding sequence
atgccccagcgcggccatccatctcaggaaggactctgggcactgccaagtttgcctatggcccatggccccaagccagaaacggaaggtctcctggatctaagctttttgacggaagaggagcaggaggctatagctggcgttcttcaaagagatgccagacttcgccagctggaggaggggagagtttccaagctcagagcgagcgtggcagacccgggccagttaaagatcctgacaggtgattggttccaggaagcacggagccagaggcatcacaacgctcatttcgggtccgatctcgtcagggcttccatgcgcaggaagaagagtacccggggcgaccaggcccccgggcatgatagggaggccgaggctgccgtcaaagagaaggaggagggaccagagccacggctgactatcgacgaggctccccaagagagactgcgggagaccgaggggcctgatttcccatccccctcagtcccccttaaagcgtctgatcccgaggaagcttctcaggcacaagaagatccgggccaaggtgatcagcaggtctgcgcggaggaggccgatcctgagctggagcctgccagcggaggggaacaggaacctagaccccaacaagcacaggtcggggggtccggcccgtggctgctttccacatccggggcagactcagggcggggagcactgctgcctcgagccgcgtcccgcccacggcctagggcgctcggggccggagtgggcaaagaaggcgcaccacggcatctccctccgctccagacgaaagccgcgagccagatcctggaaaatggcgaagaagcccccgggcccgacccctctctagacaggatgctcagtagttcaagcagtgtttctagcctcaattccagtacagtgagaagggaaggcggagatcccggaggccggggcgtggaccccttcaggtgcgtggcacccgcttgtcccagcctggccgccgggcccacggctgcggcacctcagccagcgacttatgatccaggcctgaagcccccccggtgtccaaggcccagacgcgagccttgtgaacggccttag

SEQ ID NO: 136918 - DNA, 879 bp, Artificial Sequence
  Description of Artificial Sequence: Synthetic coding sequence
taacctcgaccccaacaagcccaggtcggagggtcaggtccctggttgctttctacctcaggcgcagatagtggcaggggcgccctgctgccacgggccgcctcaagaccgaggcccagggcactgggagccggcgtgggtaaggagggagccccaaggcacctgccaccactgcagaccaaagctgcctctcagatcctggagaacggtgaagaggcacccgggcctgatccttctctggatcgaatgctgagcagcagcagcagtgtgagctctttaaacagtagcactctgtcaggctcccagatgagcctgtctggggatgccgaggccgtacaagtgcgcgggtcggtgcatttcgcactgcactacgagcctggcgcagctgaactcagggtgcatgtgattcagtgccagggcctggcggccgctagaagacgtcgcagcgacccctacgtcaaatcatatttgttgcccgataaacagtccaagaggaagacagcggttaagaaacggaatctgaaccctgtgtttaacgaaacactcagatattctgtgcctcaggcggaacttcaagggagggtgctgtctctgagcgtgtggcaccgagagagtctggggcgtaacatctttctgggagaggttgaggtgccattagatacatgggactgggggtcagagccaacttggctgccactgcagccccgagtgcctccaagcccagatgacctgcctagccgcggcctactggcactgtctttgaagtacgtgccagcgggctctgagggtgcaggtctgcccccctccggtgagctccacttttgggtcaaggaagcgcgggacctacttccactccgcgcaggcagtctcgatacttag

SEQ ID NO: 136919 - DNA, 1689 bp, Artificial Sequence
  Description of Artificial Sequence: Synthetic coding sequence
atgccccaacggggacatccctcgcaagagggactctgggccctgccttcacttcctatggcacacgggcccaagccagagactgaggggttactggatctgtcattccttacagaggaggaacaggaggccatcgcaggagtcctgcaacgggatgctcggctgcgccagctggaggaaggccgagtgtcaaagctgcgggcgagcgtcgccgacccaggtcagttgaagatcctaaccggagattggttccaggaggcgcggtcccagaggcaccacaatgcacattttggctctgacctggtgcgggcctccatgcgcagaaaaaagagcacacggggagaccaggctcccgggcacgacagagaagctgaggcagctgttaaggaaaaggaggaagggccagagccccgactgaccattgatgaagcccctcaggaacgactccgcgagactgaaggcccggacttccccagcccgagcgtcccgctcaaggccagcgatcccgaagaggccagccaggcacaagaggatccaggacagggtgatcaacaggtctgtgcggaagaagccgatcctgagctcgaacccgcctcaggaggagagcaggagcctcgcccacagcaggcacagacaaaagccgcctctcagatactggaaaatggggaggaagcaccagggcccgacccctccctagatcgcatgctctctagttcttcgagcgtctcctcactgaactcctcaactctctccggttcacagatgagcttatccggcgacgccgaggcagttcaggtgagaggtagcgtgcacttcgcccttcactatgaaccaggagccgctgagcttagagtgcacgtcatccagtgtcagggcctggcggccgcccgtcgaaggaggtcggatccctatgtgaagtcctatctgctgcccgacaagcagagtaagcggaaaacggcggtcaagaagaggaacctgaaccctgtgttcaacgaaactcttcgctattcagtcccccaggccgagcttcaaggcagggtacttagtctcagcgtatggcatcgggaatccctgggacgtaatatctttctgggagaggtggaagtccctctggacacatgggattggggcagcgagcccacttggctccccctccaaccgagagtgcccccttctccggatgacctgccatcaagaggcttgctcgcactgtcgctcaagtacgtgcccgccgggtccgagggggccggtctccctcccagcggagaactacacttctgggtgaaagaggcacgcgacctgttacctctgcgcgccggcagtttggatacatacgtacaatgtttcgtgctgccagatgacagtcaggcctcaagacagcgaacacgggtggtgcgtcgcagtttgtccccagtattcaaccacaccatggtctacgatgggtttggacccgctgaccttaggcaggcttgtgccgaactgagcttgtgggatcacggcgccctcgcaaaccgccaactgggcggtacccggctatccctcggaacaggctccagttacgggcttcaggtcccatggatggattctactcccgaggagaagcagctgtggcaggccctgttggagcaaccctgcgaatgggtagacgggctgttgcccctgagaaccaacctcgcaccaagaacgtag

SEQ ID NO: 136920 - DNA, 2808 bp, Artificial Sequence
  Description of Artificial Sequence: Synthetic coding sequence
atgattgatctgtcttttcttactgaggaagaacaggaagcaatcatgaaggtgcttcaaagagatgctgccttaaagagggcagaagaggagagagtccgtcacctgccagagaaaataaaggacgatcagcagctgaagaatatgtctggacagtggttctatgaggctaaagcaaaacgacacagggacaaaattcatggagcagacatcatccgcgcctccatgcgtaaaaagcgcccccagattgctgctgaacaatccaaggacagggaaaatggggctaaggaaagctgggttaacaatgtgaacaaagacgcatttctgccgcccgaacttgctggcgttgtcgaggaacccgaagaggacgcagcccccgcttccccttctagcagtgtggtcaaccccgcgtcaagcgtgatcgacatgtctcaggagaatactagaaagcccaatgtttcccctgagaagcaacgtaaaaatcctttcaacagctcaaagttgcccgagggacacagctctcaacaaacaaagaacgagcagagcaagaatggacgcaccggtctcttccagacatcaaaggaagacgagctcagtgaaagcaaagagaagagtacagtggctgatacatctatccagaagctcgaaaagagcaagcagactctgccggggctttccaacgggagccagataaaggcaccaatcccaaaggccaggaagatgatttataagtcaactgacctgaataaggatgataatcagagcttcccccggcagagaactgatagccttaaagcgcggggcgctcctaggggaattctaaaacgcaacagcagtagcagttccactgattcggagactttaaggtataaccataacttcgaacccaaaagtaaaatcgtctctcccgggctgaccatccatgaaaggatcagcgaaaaagaacactcactcgaagataactcctcccccaacagtctggagccgttgaaacatgtaagattctctgccgtgaaagacgaattacctcagagtcccggactcattcatggcagggaggttggggagttcagcgttctagagagtgatagactgaagaatggtatggaggatgctggggatactgaggagtttcagtctgaccctaaaccctcacaatacagaaaaccgtccctgttccaccagagtacctcctctccttacgtgtcaaagagcgaaacgcaccagcccatgacatccggaagtttccccatcaacgggttgcactcccactctgaggtcctaaccgcgcgtccgcagagcatggaaaactcacccactattaacgaaccaaaagacaagtcctctgagttaactcggttagaaagcgtgctgcctaggtcgcccgcggacgagctgtcccactgcgtagagcctgaaccttcccaggttcccgggggaagttcgcgtgatagacagcaaggctctgaagaggagccttcaccggtgctgaagaccctggagcgctccgccgctagaaagatgccgtctaaaagcctggaggacatctcatccgacagtagcaaccaagccaaagtcgataaccagccagaggagttggtgcgttctgctgaagacgttagtacggtccccacacagccagataatcccttctctcatcccgataagttgaagcgcatgtccaagtctgtgcctgcatttcttcaggatgaatccgatgatcgggagactgatactgccagtgagagcagctatcagttgtcccgtcacaagaagtcccctagttccctcaccaatctctcctcctcgagtggtatgacctccctgtcgagcgtcagtggctccgtcatgtcggtgtactctggagatttcggaaatcttgaggtaaaagggaacatccaatttgcaatcgagtacgtggaatccctgaaggagcttcacgtcttcgtggctcagtgcaaggatttagccgctgccgacgtgaagaaacagaggagtgatccctacgtcaaggcatatctgctgcccgacaaagggaagatgggaaaaaagaagactttagtggtcaagaaaacattaaaccccgtgtataacgaaattctgcggtacaaaattgagaagcagattcttaaaactcagaagttgaatctcagcatttggcatagggatacatttaaacgtaactcgttcctcggcgaggttgaactcgacctcgagacctgggactgggacaacaagcagaataagcaactgcgctggtaccccctcaaaaggaaaacagctccagtggcccttgaagccgaaaacaggggtgaaatgaagctggccctgcaatacgtgcccgaacctgtgcccggaaagaaacttcccaccacaggcgaagtgcacatctgggttaaggagtgtctggacctgcccctcctccgcgggagccatctgaacagcttcgtcaaatgcacgatactcccagatacatctcgcaagtctcgccagaaaaccagagccgtcggaaaaaccacaaaccctattttcaaccataccatggtgtacgatggcttcaggcctgaagacctgatggaggcctgcgtcgagttgactgtgtgggaccactataagctcacaaaccaatttctggggggccttaggatcgggttcgggacaggtaagtcttatggtaccgaggtcgattggatggactcaacaagcgaggaagtcgccttatgggaaaaaatggtcaacagtcctaatacttggatcgaggctactctaccgctcaggatgctcctcattgcaaaaatttctaagtag

SEQ ID NO: 136921 - DNA, 3819 bp, Artificial Sequence
  Description of Artificial Sequence: Synthetic coding sequence
atggacgagcccaacgctgaacaggtgtacaaccctagccagttcgagaatctcaggaagttttgggatcttgaggctaacagcaactctaaagataacgacaagaatatcacaactaccagccagaagaactctgcaccttttaacagacaaaaacacaaggagttctcggatatcaagctttcaggcaaaaatactcacgaggccgaagtgcttctttctccaaagaaggtaatggcacgagaggagatggaaaaactgaattccaaggggatccttcaggttctgcctgacgagatcacattccctctgagccccttgagaaagtatacttaccagctgcctggcaacgaatctagcaaagaaaacgtagagaagaataccgagggaatagttactcctgtctttaaggaggagaaagactatagcgagcaggagatccaggagagcattatcaaaacaaacgtgctttctaaagactgcaaagatacctttaatgactccctgcagaaactccttagcgagacctctaccccagcgattcagccctctggtggaaaagttcatggtaagcaggtattagagccctcggtcagcgaaaacaggacctggccgcaaaaaactgactttgccgacaccgaggaggaagtcaagggtcctgaaaaaatcattaacgagcacgtggataagaccgttgtgcatcctaaggtcaagagaaattccctcacggcctcactggacaagctgctaaaggaagcgaccgggacttctccttcgcctcttcaagctaaattggccccggtgatcactgggactaattcaaaattggaagaaggtcgattcttcggcaaagggattgaacagtctcacaatacctcagcagacaaaagggaaatactagcaccctttcctgtcagggatgagacatttggcaatacggccttattaaagaaggctgagagcggcgaatgccaattgtctacacaaaacttgattcagatggccgcagaggactcacaccctctggatccaacatcccagctaagcagaaagggttccttcggagatgtcgcttcccccccgcaggacatgttatttccacaggacgcacatcttgtcccacaggctagagtgcaccctagccagacggagattagcgagacagtggagaaagtgatcctgccccctcggccagtgctgaacgacgttagcgcagcactgcagaagctgtgtggggaggtgtggttaagctacccagccggtcgcgaggtgggcccaggcgaagtaaaccccgagtttccggaggcagtgcagcctgtctgctcgcccctgaaccctcccggggtgataagcccatgggctaccatggacaccatagtcccagacaggaaagacttttactcctccaatgttgtgcctgataagacacatgaggtcggttcttacttggctgcgcagatgtccccatcggatcagacattgagcagctttgcaagtatagtggcccagtatggaaagggcctgcctcaagaagttgaagagatcgtcagggagactatagtgcagcctaagtccgagtttttagagttctccgcaggactggaaaaactgctcaaggaagaaacggagacctttccatcaaagtacgagtctgacaccgggaatctcagcccttctaagctcatcggatcaactgaagaaccccggagggcaacttcagagtgccaccctgaagaattgaaggagaccgtggagaaagccgaggccccccttatcacagagtcagctttcgacgccggcttcgagaagctactgaaggagataacagaagcacctccataccagccccaggtgagtgtgcgggaggagacacacgaaaaagaatcttcccaatccgagcagactagattcctcggcaccgtcccccacttttacagagcggcatcgcaaaccagcgaaatgaaggacaaaagcaatgggcttgagtcccaggtgaatcagtgtgataagatgctgggcggtgacgctcttgttacggacctgctggtagacttctgcggatctcggagcggagttgagatcccccggacccctcagctgtatgtggctcatgagatcggcacaatcaaaactgtgacaccacctgaagaccgcgactcagaatctggggtcgctggaggccagggcaccctgcaagaacctggattcggcgaagcctccgaagccatcagtgttagccgaaacagacagccaatccctctgctgatgaataaggagaatagtacaaagacgtccaaagtggaactcactctcgcaagtccttatatgaagcaggagaaggaagaggaaaaggaaggcttcagcgaatccgatttttctgacggaaacacatcctcgaatgccgaaagctggcgaaaccccagttccagcgaggaggagccatctcctgtcttaaaaactctcgagcgcagcgccgccagaaagatgccatcaaagagcctggaggacatctccagtgacagtagcaatcaggcgaaagtggacaatcagccagaagagctcgtgaggtctgccgaggatgatgagaaacccgaccagaaacccgtaaccaacgaatgtgtccccaggatatcaactgttccaacacagcccgataatccattcagtcaccccgataagctcaaaaggatgagtaaaagtgtgcccgctttcttgcaagacgagtcagatgatagggagaccgacacagcaagcgagtcgtcttaccagttgtctcggcataaaaagtcacccagctccctgactaacctctctagctcttctggcatgacgtcccttagttctgtgagcggaagcgtgatgagcgtttactccggagacttcggaaatcttgaagtgaagggtaatattcagttcgccatcgagtatgtagagtcactaaaggaactacatgtctttgtggcacagtgcaaagacctcgctgctgccgacgttaagaagcaaagatctgacccatatgttaaagcttatcttctgccagataagggtaagatggggaaaaagaaaaccctcgtggttaaaaaaacattgaaccctgtgtataatgagatcctccgttacaaaattgagaaacagatccttaagacccagaagctgaacttatctatttggcatcgtgacacttttaaaagaaattcattcctaggagaagttgagctagatctagagacctgggattgggacaacaagcagaacaagcagttaagatggtatcctctgaaacgaaaaacagccccagtggcccttgaggcagaaaaccgaggggagatgaagttagccctgcagtatgtgccagagcccgtgccgggcaagaagttgccaacaaccggagaggttcatatatgggtcaaagaatgcctggatttgcctctcctcaggggttcccacctgaatagcttcgtgaaatgtacaattcttccagatacatctcgcaaaagtaggcagaaaacgcgggccgtggggaaaaccacaaaccccatctttaaccatacaatggtgtatgacggatttcggccagaggatcttatggaagcgtgcgtggagctcacagtatgggatcactacaagctcactaaccagtttttgggcggcttgcgcataggcttcgggactggcaaaagctatggcaccgaagtggattggatggattcaacaagtgaagaagtggctctttgggagaagatggtgaactctccgaacacgtggattgaggctactctcccgttgcggatgttgcttatcgcaaaaatctctaagtag

SEQ ID NO: 136922 - DNA, 5343 bp, Artificial Sequence
  Description of Artificial Sequence: Synthetic coding sequence
atgattaactcgagcctcagcatgctgttttcttatttagaaaaatacttctacgtagcagatgagctaagccactgtgtggagccagaaccatcacaggtcccagggggctccagtagagacagacagcaaggaaagccaccacctctgccagccttgaaggctaagacctcatccaggtctggaccgtacgctacagagattaaaaaatcgaccgatgatagtatattcaaagtcctcgactggttcaaccggagctcctattcggatgacaacaaatctttcctgcagcacccccgcggcatagagagcaaggagaagaccgattccaaaagtcaggtggccgtggacctcgtcactgatgatacgaccctgagagaaaacggctctaagaccctctccccaagtaagatcgaactgaagccagtaagatccgattctccctttcaagctgagggagatatgctcgtgtctgaaagctgtcaggataacaatgtgaacataaagtcgaaattcatgaacctttctcagaaaggcacccctaaggaggggcccggaatcttgcagccatttgagtcatatggcaccccttcccagggtagcaagaatatggactactctcaagactccaagtcgccaggcaaaggaaacggagctagcccttcaaactctaactacagctactccgtactgaaagaaagtgatgccgaaaaccaggttccatgtaacacaaataatattggtaacctcggcgaagaagagccaaagttccacgcccacgaagagaatagggggcactcagaggtaaacttcgactcctcaacagtggtgaaggagccaggactaaaggacaatatgaacgccgagagaaaatctaaagttgggaatacatatattctgaaggcgagtctcgagccagaaaatatcaagtccactccaggtgtggcaaataacggctctccctggaagaagccagaagtccaattccagcaggaggctggagaggtgcctaagaatcaggtgcaaagagaaaaatacaagagggtgtctgacaggatttccttctgggagggtgagaaggcgggagcgaagattacgcatgagaaaccaactagctcttgtagccaagaacagccatctgccaaagcgtaccaacccgtgaagaagtctcagggcgtgtcatctatggatagcctttccactgatcagtctgagtataaccaagctattccaaaacgagtggtgctggacgaggatgatcaggcttcccagttgtctaattcttatagctctaacaagtcaaaggagaccaagccacagattgccggcccctcaaggtactatctgagcgctgaacagagcgataaagtgtcccttttccagaataagaagaacgaacccatcaagcgctctcaggtggctgatagtttaccttcccggcgcaatatcacactgcccgcacttcagccacccagcaatgtagggtcggagaggcacgccccactggaaaaagatcgtcccctcgttagagagtcaaatgcgaattttaaggtaatgtccctgaaagaacgaatggacgaaccaaatgcagagcaggtctacaacccttcccaatttgagaatcttcgcaagttttgggacctggaagctaattctaactctaaggacaatgacaagaacatcactacaacaagtcagaaaaacagtgcgccattcaaccggcagaagcacaaggagttcagcgatattaagctgtctggtaagaacacccatgaggcggaagttctgctgtccccaaagaaggttatggctagggaggagatggagaagttaaatagcaaagggatactgcaggttcttcctgatgaaatcacttttcccctgtctccactgaggaagtacacctatcaactcccaggaaacgagtcatccaaagagaatgtagagaagaacacagagggaatcgtcacccccgtgtttaaagaagagaaggattactctgagcaggagatccaagagtccatcataaagaccaacgtcctctccaaggattgcaaagatacttttaacgacagcctgcagaagctgttgtccgagactagtaccccagccatacagcctagtggcggcaaagtgcatggcaaacaggtgttggagccatcagtgtctgagaaccggacctggccgcaaaaaacggatttcgcagatacagaggaagaggtgaaaggccctgaaaagattatcaacgaacacgtcgacaaaacagtggtgcacccaaaggtgaagagaaatagcctgaccgcatctctggacaaattactgaaggaggctaccggtacatcaccatctccactgcaggccaaattggcacccgttattactggcacaaactccaagctcgaggagggccggttcttcggtaaggggatcgaacaatcccataacaccagtgctgataaaagagaaatactggccccatttccggtacgcgatgagaccttcggcaatacagccctacttaagaaagccgagtcgggagagtgtcaattgagcacacaaaacttaatccaaatggcagcggaagactcacatccgctcgaccctaccagccaattgtctagaaaagggtcgttcggggacgtagctagcccaccacaggacatgctgttccctcaggatgcacacctggtgcctcaggctcgggtgcatccttcacagaccgaaatctccgaaacagtagaaaaggtgatcctgccacccagacccgtgttaaatgatgtgtcggctgcgctgcaaaagctttgcggagaggtgtggctctcttaccctgccggacgggaggtgggaccaggcgaagtcaatcctgaattcccagaggccgtgcaacccgtttgtagcccactaaatcccccaggggtgatctcgccctgggcgacaatggataccatcgttccggatcgcaaagatttttactccagcaacgttgtgcccgataaaacgcacgaggttgggtcctacctcgccgctcaaatgtccccctctgaccaaaccctgtcttcatttgccagcattgttgcccagtatggaaaagggctgccgcaagaagtggaggagatcgtccgggagacaattgtccaacccaaaagcgagtttctggagttttcggctggccttgaaaagctgcttaaagaggagactgagactttcccgagcaagtatgagtctgacaccgggaatttgtcacccagtaagctcattggtagtaccgaggagccacgacgagcaacatctgagtgtcacccagaggagctgaaggagaccgtcgagaaggccgaggcacctctgattacggaaagcgcttttgatgccgggtttgaaaaactcctgaaggaaattaccgaagctcccccctaccagccccaggtctctgttcgcgaggaaacccatgagaaagagtctagccagagcgaacagactcggtttcttggtacagttccccacttctaccgcgcggctagtcaaacctccgaaatgaaagataagtcaaacggcctggagtcccaggtgaatcaatgtgacaaaatgttggggggagatgccttggtgacagatctactggtcgatttctgcggcagtcggagtggagttgagatcccccgaaccccccaactgtacgtagcgcacgagattggaacgatcaaaaccgtgacacctccagaagaccgtgacagtgagtcgggcgtcgctggcggccagggcaccttgcaagaaccagggtttggcgaggcaagcgaggctattagcgtctccagaaaccgccagccaatccccctcctgatgaataaggaaaatagcaccaaaaccagcaaggtggagttgacccttgcctccccttatatgaagcaggaaaaagaggaggagaaagaggggttttcggagtcggactttagcgatggcaacacctccagtaacgcggagtcttggcggaacccgagctcgagcgaagaagagccttcgcccgttttgaaaaccctcgagaggagtgccgcacggaaaatgccatccaagagtctagaggatatctcctctgacagctccaatcaagctaaggtcgataaccagcctgaagagctggtccgatccgcagaggacgtgtctacagttcctacccaaccagacaaccctttctcgcacccggacaaattgaagagaatgtccaagagcgtacccgcatttctccaagatgagtctgacgacagagagactgacacagcatccgaaagttcctaccagctgtcaagacataaaaagtctccatcatccctgactaatctttcatcttcatccgggatgacctccctctcctctgtctcagggagcgttatgagtgtctatagcggagacttcgggaatctcgaagtaaagggcaatatacagtttgctattgagtatgtcgagagtttgaaagagctgcatgtctttgtagcacagtgcaaggatctggctgcagctgatgtgaaaaagcagcgcagcgacccatacgtgaaagcgtatcttctcccagacaagggaaaaatgggtaagaagaaaaccttggtcgtgaagaagacattgaacccagtctacaatgaaatcctgaggtataaaatagaaaagcagattctcaagacccagaagttgaacttgagtatctggcatagggacacttttaagcgcaatagcttcctaggggaggtggaactcgatcttgagacctgggattgggataacaagcaaaataagcaattacgctggtatcctttgaagaggaaaaccgccccagtggcactagaagccgaaaatcgcggagaaatgaagcttgccctccaatacgtccccgagcccgtccctggaaaaaaactccctaccaccggggaagtacatatctgggttaaggagtgcttggacctgccgttgctgagaggaagccacctaaactcgtttgtgaagtgtactattttgccagacacgagcagaaagtctaggcagaaaacccgggccgtcggcaagaccaccaatccaattttcaaccataccatggtttatgatggcttccgccccgaggacctgatggaggcctgtgtcgaacttaccgtctgggaccactacaagctcaccaaccagtttctggggggcttacgcataggctttggcaccggaaagtcttatgggacagaggtggattggatggatagtacttcagaggaggtcgctctgtgggagaaaatggttaactcgccaaatacgtggattgaggccacgctgccgcttagaatgctcctcatagccaagatatccaaatag

SEQ ID NO: 136923 - DNA, 1098 bp, Artificial Sequence
  Description of Artificial Sequence: Synthetic coding sequence
atgtctgacgatagggagaccgacacagccagcgagtctagctatcagctgagccgacataaaaaaagtccctccagcctgactaacctgtccagctccagtggaatgaccagcctgagcagtgtatctggctcagtgatgtctgtgtattctggagatttcggtaacctggaggtaaagggaaatattcaattcgcaatcgaatacgtggagagcctgaaggagctccatgtgtttgtagcccagtgtaaggatctggccgctgcagatgtgaagaaacagcgctcggatccttatgtcaaagcctatctgctccctgacaaaggaaagatgggaaaaaagaagactctcgtagtgaaaaaaacccttaaccccgtctataacgagatcctgaggtataagattgaaaaacagatacttaagacacagaagctgaatctgtccatatggcacagagatacattcaaacgtaatagttttctcggcgaggtagaactggacctggagacatgggactgggacaacaagcagaacaagcagctaaggtggtaccccctgaagagaaagacagcccccgtcgctttggaagctgagaaccgtggcgagatgaagctggcactgcagtatgtgccggagcccgtgcccgggaagaaacttccaacaacaggcgaggtgcatatctgggtgaaggaatgcctagacctgcctctccttaggggctcccacctgaattccttcgtgaagtgtacaattctccctgacacttccaggaagtcccggcaaaagactagggctgttggtaagaccaccaatcccatttttaatcacactatggtgtatgacggattccggcccgaagatttgatggaagcttgtgtggaattgaccgtgtgggatcactataagttaactaaccaattcctgggaggcttgcgcataggcttcggcactgggaagagttacggtacagaagtggactggatggacagcacaagcgaagaagtggccttatgggaaaagatggtcaactctcccaatacgtggattgaggcaacacttcccctgagaatgctgctgatcgccaaaatatcgaagtag

SEQ ID NO: 136924 - DNA, 2733 bp, Artificial Sequence
  Description of Artificial Sequence: Synthetic coding sequence
atgattgaccttagcttcttgaccgaggaagaacaggaggccataatgaaagtcctccaaagggacgcagcactgaagagagccgaggaggagagggtacggcatttaccagagaaaatcaaagacgaccagcagcttaaaaatatgagcggtcagtggttttacgaggcgaaagcaaagcggcaccgggataaaatccacggagccgatattatcagggcgtccatgaggaagaagcggccccagattgccgctgaacagtccaaggatcgtgagaacggcgccaaagagagctgggtgaataatgtgaacaaagatgcattcctgccacccgaattggccggagtcgtggaggagcctgaagaagacgctgctccagcttcaccgtcctcctccgtcgtgaatccagcttccagcgtgatagatatgtcccaggaaaacacacggaagcccaatgtgagcccggagaagcgcaagaaccctttcaattcaagcaaactccccgaaggccattcatcccaacagacgaaaaacgaacagtctaaaaatgggagaaccggcctgttccaaacaagcaaggaggacgagcttagcgagtccaaagagaagagcactgtcgctgacacgtctattcaaaagctcgagaagtcgaaacagaccctaccaggactgtccaacgggtctcagatcaaggcccccatcccgaaggcaaggaagatgatatacaagtctaccgacctgaacaaagatgataaccagtcttttccgcggcagcgcaccgacagccttaaggctagaggcgctcctagaggaatcctgaagcgcaactccagctcatcgagtaccgactcagagacccttagatacaaccacaatttcgagccaaagtccaaaatcgtgagtcctggtttaaccatccacgaacgcatcagcgagaaggaacattccctggaagataatagctccccaaattccctggaaccattgaagcacgttcgtttctctgccgttaaagacgaacttcctcagtccccggggctgatccacgggcgggaggtgggagaattctcggtactcgaatctgatcggttgaagaatggaatggaagatgccggcgatacggaggaatttcagtcagaccccaaaccttcgcaatataggaagccaagcttgtttcatcagagcacgagctcgccttatgtctctaaatctgagacccaccagcccatgacgtcagggagctttcccatcaatgggctgcactcacacagcgaagttctgaccgcaagaccacaatctatggagaacagtccgactattaacgaaccgaaggataagtccagcgaactgacccggcttgagtctgtcctgcccagaagtccggccgacgagctttctcattgcgttgaacctgaaccctctcaggtgcccggggggagtagtcgggaccgccagcaaggctctgaggaagagccatcccctgtacttaaaacactggaacgctccgctgctagaaaaatgccttccaagtcactggaggacatttccagcgattctagtaaccaggcgaaagtggacaaccagcctgaggagctagtccggagcgctgaagatgatgagaaaccagatcagaaaccagtgaccaacgagtgtgtacccaggatctccaccgtgcctacacagccagataatcctttctctcacccggacaaactgaagcgaatgtccaagtccgtccccgccttcttgcaggacgaggtcagtggcagcgtcatgtcagtttactctggtgattttgggaatctagaagtgaaggggaacatccaatttgccatcgaatatgtcgagtctctcaaggaactgcacgtattcgtggcacagtgcaaggatttggctgcggccgatgtcaagaaacagcgatccgacccttatgtgaaggcctacctgctgccagataagggaaagatgggcaaaaaaaaaaccttggtcgtcaaaaagaccctcaatcccgtgtacaacgaaatactacgctacaaaattgagaagcaaattctaaagacacaaaaactcaatctgtctatctggcatcgcgacaccttcaagcggaacagtttcctgggagaagttgaactggatctggagacttgggattgggataataaacaaaataagcaactgcgatggtaccccctgaagaggaagaccgccccagtggcgttggaggccgaaaacagaggggagatgaaattagccctccaatatgtccctgagccagtccctgggaagaagttacctactaccggcgaagtgcacatttgggtgaaagaatgtcttgatctccctctccttcgcgggagccacctgaattccttcgtcaaatgcacaatactcccagacacgagtcgtaaaagtcgccaaaagacccgggcggttggaaaaactaccaacccaatattcaatcacactatggtgtatgacggattcaggcccgaagatctcatggaagcttgcgtagaactgaccgtgtgggaccattataagctgaccaatcaattcctcggcggcctgaggatcggatttggcaccgggaaatcctacggcacagaagtggactggatggatagtacctcggaagaagtcgccctatgggagaagatggtgaattcccctaatacttggatcgaggctacactgccattaagaatgctactgattgcaaagattagtaaatag

SEQ ID NO: 136925 - DNA, 2733 bp, Artificial Sequence
  Description of Artificial Sequence: Synthetic coding sequence
atgatagatctctcctttctgacagaagaagaacaagaggcaattatgaaagtgctccagagggatgccgcgcttaagcgggccgaggaagagcgcgttaggcatttgccggaaaagatcaaagatgaccagcagctgaagaacatgagtgggcaatggttctatgaggcaaaagcgaaaagacacagagacaagatccacggcgcggacattattcgtgccagtatgcgcaagaagcgaccacagatcgccgccgagcagtccaaggatcgagagaacggcgcgaaggaatcttgggtgaataatgtgaacaaagacgcgttcctgccaccagagctcgccggtgttgtggaagaacctgaggaagacgcagccccggcaagccccagtagttcggtggtcaaccccgcttcatccgtgatcgatatgtcacaggagaacactcgcaaacctaatgtcagtcccgagaagcgcaaaaatcctttcaacagcagcaaactgccggaaggccactcgtctcaacagactaaaaacgagcagagcaagaacggtcgtaccggactatttcagacatccaaagaggacgagctcagtgagtctaaggagaagtcaacagtagctgacacatctatccaaaagctcgaaaaatccaagcagaccctgcccggattatcaaatgggtctcagatcaaggccccgattccaaaagcacggaaaatgatatataaaagcaccgacctcaataaagacgataatcagtcattcccacgacagagaacagatagcctgaaggcacgaggcgcacccagggggatcctgaagcggaactcaagctcgtcatccaccgattcggaaaccttgagatacaaccacaacttcgagcctaaatctaagatcgtgagccccgggctgaccattcatgagagaattagtgagaaggaacactcacttgaagataattctagcccaaactccctggagcctctaaaacacgtgcgctttagcgccgtgaaggatgagctgcctcagagtccgggtttgatccacggacgcgaggtgggagagttttcagtgctggagtctgatagactaaagaatgggatggaagatgccggagacacagaggaattccaatccgacccgaagccaagtcaatatcgtaagcccagcttatttcatcagagcacttcgagcccctatgtgtccaaaagcgagacgcaccagccgatgacgagtggctcattccctatcaacggactacatagccattccgaagtcctaactgctcgtccgcagtcaatggaaaactcgcccaccattaatgaacccaaggacaagagtagtgaactgactaggctggaaagcgtgctacctcggtccccagctgacgaactgagccattgtgtagagccggaaccgtcccaagtccctggaggtagctctcgagatcgtcagcagggctccgaggaagagcctagccctgtgttgaagacattggagcgctcagccgcccgcaagatgccaagcaagtcgttagaagacatcagcagtgacagctctaatcaggcaaaagtggacaatcagcctgaggaactcgtaaggtctgcagaagacgatgaaaaacctgatcagaagcccgtgaccaacgaatgtgtcccaaggatctctaccgtgcctacacagccagacaaccccttttcccaccctgacaaacttaaacggatgtcaaaatccgtgcccgcgtttctgcaggacgaggtgtctggatctgtaatgagcgtctattccggcgatttcgggaatctggaggtcaagggtaacattcagtttgccatcgaatacgtggagtccctaaaggaacttcacgtgttcgtagctcagtgcaaagacctggcagccgccgatgttaagaagcagcgctctgatccctatgtgaaggcctacctattaccagacaaagggaagatgggcaaaaaaaagaccctggtagtaaagaaaacattgaaccctgtgtataacgaaattctaaggtacaagatagaaaagcagatcctgaagacccagaagctcaacctgagtatttggcatcgggacacctttaagaggaactctttcctgggggaggtagagctggacctggaaacgtgggattgggacaataaacagaacaagcagctacgctggtaccccctgaagcgtaaaaccgcacccgtcgccctggaggcagagaaccgcggagaaatgaagcttgcccttcagtatgttcctgagccagttcccgggaaaaagctgcccacaaccggggaggtgcacatatgggtcaaagagtgcctggacctccctctcctgaggggctcccacctgaattcatttgtgaaatgtaccatccttccagatacctctcggaaatcgagacagaaaactagggccgtaggcaagaccactaacccaattttcaatcacaccatggtatatgacggatttcggccagaggacctgatggaagcctgtgtcgaactgacggtgtgggatcactacaagctcaccaaccagttcttggggggcctcaggattgggtttggcaccggcaaatcctatgggacagaggtggactggatggactccacgtctgaagaggtggctctgtgggaaaagatggtgaactccccgaacacgtggattgaggctaccttgccgctgcgcatgttgctcatcgccaagattagcaagtag

SEQ ID NO: 136926 - DNA, 192 bp, Artificial Sequence
  Description of Artificial Sequence: Synthetic coding sequence
atgtccaaatcagtgcctgccttcttgcaggacgaaagcgacgatagagagaccgacaccgcgagtgaaagtagctatcagctcagtaggcacaagaaatcgccgagttctctgaccaatctgtcttctagctcaggcatgacaagcctgtcaagcgtctccgggagcgtcatgtccgtttactccgggtag

SEQ ID NO: 136927 - DNA, 3771 bp, Artificial Sequence
  Description of Artificial Sequence: Synthetic coding sequence
atggatgaaccgaacgccgaacaggtctacaacccttcccagttcgagaatttgagaaagttttgggatttagaagccaattctaactcaaaagataatgataaaaacatcactaccacctcccaaaaaaattctgcgccttttaataggcagaaacataaggaattctccgatattaagttaagtggaaagaacacacatgaggccgaagtccttctgtcacctaaaaaggtgatggctagagaagagatggagaagttgaactccaaaggtatattacaagtcctgccagatgagatcacattcccgctttcgcccctgcggaagtacacttaccagctcccgggcaacgagagctccaaagaaaatgtggagaagaacactgagggcatcgtgaccccggtctttaaagaagaaaaggactattccgagcaggagatccaggagagcatcattaagactaatgttctctcgaaggactgcaaagacacgttcaatgattcgctgcagaagctactatccgagacctcaacccccgctattcagccaagtggtggcaaagtgcacggcaaacaagtcctcgaacccagtgtgagcgagaaccgcacctggccacagaaaaccgattttgccgatacagaggaagaggtgaaagggcctgagaagattatcaacgaacacgttgataaaactgtagtgcacccaaaggtgaagagaaactccctgacggcctctttagacaaactgctgaaggaggctacggggacatccccaagtcccctccaggctaaattggcaccagtaattaccggcacgaatagtaagctggaggagggacgcttcttcggcaaaggcattgagcagagtcataacacctcggccgacaagagggagattctagccccctttccggttcgcgatgagacattcggtaataccgccttattgaagaaggctgaatccggagaatgtcaactttccactcaaaatcttattcagatggccgcggaagatagccaccccctcgaccctacgtctcagctttcgcgcaaaggatcattcggagacgtggccagtcccccgcaggacatgctattcccacaggatgctcatctggtccctcaggcacgggtacacccttcccaaactgaaatctctgagaccgtggagaaggtaatactgccacctaggcctgtgctgaatgacgtgtcagccgcactccagaagctctgtggtgaagtttggctatcctatccggctggccgcgaagtaggccctggtgaggtcaatcctgagttcccagaagccgtacagcccgtgtgcagccctctgaatcctcccggcgtgatctcgccgtgggccaccatggacacaatagtgcccgatcgaaaagacttctactccagcaacgtcgtgcctgataagacacatgaggtcgggtcgtatcttgcagctcaaatgtctccctctgaccagaccttaagtagctttgcgagtatcgtggcacagtacgggaaaggactgcctcaagaagttgaggaaatcgtgcgtgagactatcgtacagcccaagtccgagtttcttgagttcagcgcaggactcgagaaactcctgaaggaagagaccgagactttcccatccaaatatgagagtgataccggaaacctcagccctagcaaattgatcggatctaccgaggagcctaggcgcgctacctctgaatgccatcctgaggagctcaaagaaactgtcgagaaggctgaagctcctctcatcacagaatcagcattcgacgctggctttgagaagctgcttaaggagatcactgaggcaccaccatatcaacctcaggtgagcgtacgggaagaaactcacgagaaagaatctagccagtccgagcaaaccaggttcctgggcaccgttcctcacttctatcgcgctgcaagccagacctcggaaatgaaagataagtctaacggtctggaaagtcaagtcaatcagtgcgacaaaatgttgggtggggacgcccttgtcacagacctcctcgtggatttttgtggcagtaggtccggcgtggaaatccctaggacaccccagctgtacgttgcgcacgaaattggtaccataaaaactgttacgccacctgaggacagggattcagagtctggcgttgctggaggccaggggacactacaggaacctggctttggcgaagcctccgaggccatcagcgtctcaagaaatcgtcagcccattcccctgctgatgaataaagaaaactccaccaaaacgtcaaaggtggagctgaccctggctagtccctacatgaaacaggagaaagaggaagaaaaggagggcttctcagagtccgacttctctgacggcaatacctcatccaatgcagagtcttggcgtaatccttcttcctccgaggaggaaccatcgcctgtgctcaaaaccctggaaaggtccgctgcgcgaaagatgccgtccaagagcctggaagatattagtagtgactcctccaaccaggccaaggtggataaccagcccgaggagttggtgaggtcagccgaggacgtctcaaccgttccaacccaaccagataatccatttagccaccctgataagcttaaacgaatgagtaagtctgtccccgcattcttgcaggatgagagcgatgatagggagacagatacagccagtgagagttcgtaccagctctcgcgacataagaaatctccttcaagtcttaccaatctgtctagcagctcaggcatgacctctctgtcttctgtatcgggcagcgttatgtcggtgtactctggagacttcgggaacctggaagtaaaaggtaatatacagttcgccatcgagtacgtcgaatctctgaaagagctgcacgtcttcgtggcccagtgcaaggacttagctgcagccgatgtgaaaaaacagcgcagtgatccgtatgtaaaggcctatctcctgccagacaaggggaagatggggaaaaagaaaaccttagtagttaaaaagaccctcaatccagtgtacaatgagatcctgagatataaaattgaaaaacagatactaaagacccaaaaacttaatctgtcaatttggcaccgagatactttcaagcgaaatagtttcctaggcgaggtggaactagacctggaaacttgggactgggacaacaaacagaacaagcagctcaggtggtatcctctgaagcggaagaccgctccagtagccctggaggctgaaaaccgaggagaaatgaagctcgccctccagtatgtcccagaacccgtccctgggaagaaactccctactaccggtgaggtgcacatatgggtcaaggaatgcttggatcttccacttcttagaggcagtcatctgaatagcttcgtcaagtgtaccattctgccagataccagccgcaagtcccgtcagaagacacgtgccgtcggcaagactactaaccctattttcaatcatacgatggtgtacgacggctttcggcccgaggatctcatggaagcctgtgttgaactgacagtgtgggatcactataaactaacgaaccagttcttagggggactgaggatcggctttggaactgggaaaagctatggcacagaagttgattggatggattccacatcggaggaagttgcgttgtgggagaagatggtaaactcacctaacacgtggatcgaggcgaccctaccactgcgcatgctgctcatcgcaaaaatctccaagtag

SEQ ID NO: 136928 - DNA, 1131 bp, Artificial Sequence
  Description of Artificial Sequence: Synthetic coding sequence
atgtccaagagtgtgccggcattcctgcaagatgagtcagacgaccgtgagacggataccgcctccgagagctcctatcagctgagtagacacaaaaagtcccccagtagcttgaccaatctctcctctagctcgggcatgaccagcctttcttccgtctcaggttctgtgatgagtgtgtacagcggggacttcggcaatctggaggtgaaagggaacatccagttcgcgatagaatatgtcgaatccctgaaagagctgcatgtgttcgtggcgcagtgcaaggacctcgccgcagctgatgtgaagaaacagcgctcagacccttacgtgaaagcgtacctcctgccggacaaaggaaagatggggaagaagaagaccctcgtcgttaaaaagactcttaatccagtgtacaacgagattcttagatataagatcgagaagcagattctaaagacccagaaactgaacttatctatatggcatcgtgataccttcaagcgcaactcatttctgggcgaggtggagctggacctggagacatgggactgggataacaagcagaacaagcagttgcgctggtatcccttgaaacgaaaaacggcacccgtggcactcgaagccgaaaaccggggtgagatgaagcttgctctgcagtatgtgcccgagcctgtaccaggcaaaaagttgcccactaccggagaagtgcatatctgggtgaaggagtgcctggacctgccgctccttagaggaagccaccttaactctttcgttaagtgcaccatcctgcctgacacaagtcgaaagagcaggcagaagacccgggcagtggggaaaaccaccaacccaatctttaaccatacaatggtctacgatggattccggcccgaagatctaatggaagcctgtgtggagttgaccgtttgggatcactacaaattgacaaaccagtttctcggcggcctacgcattgggttcggtacaggaaaaagctacggcacggaggtggactggatggattcaaccagtgaagaggttgccctttgggagaagatggtcaactcaccgaacacatggattgaggcaaccctccctttacgcatgttgctgatcgctaagattagcaagtag

SEQ ID NO: 136929 - DNA, 312 bp, Artificial Sequence
  Description of Artificial Sequence: Synthetic coding sequence
atgtcgaaatcagttccagccttcttgcaggacgaatcagatgaccgcgagaccgacaccgccagtgagagttcatatcagctcagtaggcataaaaagagtcctagtagcctgacaaacctttcttcttccagtggaatgacttcgctgtcctcggtgagcggaagcgttatgtcggtctattcaggagatttcggcaacttagaagtgaaaggcaatatccagttcgcgattgagtacgtcgagagcttaaaggaactgcacgtgttcgtggcccaatgtaaagatctggctgccgccgacgtgaagtag

SEQ ID NO: 136930 - DNA, 2709 bp, Artificial Sequence
  Description of Artificial Sequence: Synthetic coding sequence
atgagtggccagtggttctacgaagctaaagcaaagagacatcgtgacaagatccatggcgctgacatcatccgcgcttctatgcggaaaaaaagaccgcagatagccgcagaacaatcgaaggatcgagaaaatggagccaaggaatcatgggtgaacaatgtgaataaagacgcttttctaccaccagaactggccggggtggtggaagaacccgaagaggacgcagcacctgccagcccctcgagttccgtcgtgaaccccgcttcaagtgtcattgatatgtcgcaagagaacactagaaagcctaacgtctcccccgagaagagaaaaaatccctttaactcatcaaaactgccggagggccattcatctcagcagacaaagaacgagcagtcgaagaatggtagaactggcctgttccagactagtaaagaggacgagttaagtgagtccaaggaaaagtcaaccgtcgctgatactagtattcagaaactcgaaaaaagcaaacaaacactccctggcctgtccaatggcagccagatcaaagctccaattccgaaggctcgaaagatgatttacaagtcaacagatctaaataaagatgacaaccagtctttccctcgtcagagaacagatagcctcaaggctcgcggcgcaccccggggcattctgaaaagaaattccagtagctcttcaaccgacagcgaaactttgcggtacaaccataacttcgaacctaagtcgaaaatcgttagccctggcctgaccatccacgagagaatcagtgaaaaggagcatagcctagaagataattctagcccaaattccctggagcccctgaagcacgtgcgttttagcgctgtgaaggacgagctgcctcaaagtcccggcctaatccatggcagagaagtgggtgaattcagtgtgctggagtctgaccggctgaagaacgggatggaagatgcaggggacacagaggaattccagtccgaccctaagcccagtcagtaccgaaagccgtctctttttcaccagtccacatcaagcccctatgtttctaagagcgagacccaccagcctatgacatctggaagttttcccattaatggactccattcccactcggaagtgctgaccgccaggcctcagagtatggaaaactctcccaccatcaatgaaccaaaggataaatccagtgagctgacacgcctcgagagcgtgctcccccggtcaccagccgatgagctgtctcattgtgtggaaccggagcctagccaggtgccaggtggcagttctagggataggcaacaaggctctgaggaggaaccatcccccgtgctgaagacactggagaggagtgccgcccgcaaaatgcccagcaagtcattagaagatatttctagcgacagttcaaatcaggccaaggtggataaccaaccagaagagcttgtccgttccgccgaagatgacgaaaaacccgatcagaaaccagtaacaaatgaatgcgtgccgaggatttcaacagtacctactcaacctgataatccattctctcaccccgacaaacttaagaggatgtctaagtctgtgcctgcctttctgcaggacgagtcggatgaccgggagacggacactgccagcgagagcagctatcagctgagtagacacaaaaagtccccaagcagcctcaccaatctgagcagttcctctgggatgacttctctatccagcgtatctgggtcggtcatgtcagtttattctggcgatttcggcaacctggaggtgaaagggaacatacaattcgccatcgagtatgttgagtctcttaaagagctacatgtctttgtggcacaatgtaaagacctggccgcagccgatgtcaagaagcagaggtcggatccctacgtgaaagcctaccttctgccggacaaaggcaagatggggaagaagaaaactttggtcgttaagaaaactctgaaccccgtctacaatgaaattcttagatataagatagaaaagcagatcttgaaaacccagaaactgaatttaagtatttggcatagggacacctttaagaggaactccttcttgggtgaagtagaattagatttggaaacatgggattgggacaacaaacaaaataaacagctcaggtggtacccgttaaaacggaagaccgcaccagttgcactggaggctgaaaataggggagagatgaaactcgccctccagtatgtccccgagccagtgcctgggaaaaagctgcctaccaccggggaagtccatatctgggttaaagaatgcctggatctcccacttctacgaggcagtcacctgaattcctttgttaagtgcaccatcctgccagacacaagtcgcaagtcacgccagaagacccgggcagtggggaagaccaccaatccaatcttcaaccacacaatggtgtacgacggttttcgtccagaggacttaatggaggcttgcgttgaactgaccgtgtgggaccattacaagctgaccaaccaattcttggggggtctgaggattggctttggcacaggaaaatcctatggaacagaggttgattggatggatagtacatcagaggaagtagcgctgtgggaaaagatggttaacagtccaaacacatggatcgaagccacgctaccactcagaatgctgctgattgccaaaatctctaaatag

SEQ ID NO: 136931 - DNA, 483 bp, Artificial Sequence
  Description of Artificial Sequence: Synthetic coding sequence
atgagtaaaagcgtaccagcatttctgcaggatgaagtgagcggcagtgtgatgtccgtgtatagtggagactttggaaacctggaggtcaaaggcaacatccagtttgcaatcgaatatgtcgagtccctgaaagaattacatgtgtttgtggctcaatgtaaggacttagccgctgcagacgttaagaaacagcggagcgatccctatgtcaaagcctatctgctgcctgacaagggaaaaatgggcaagaagaagaccttagttgtaaagaagactctgaatcccgtatacaacgaaattctgcgttacaagatcgagaaacagatcctgaaaacgcagaagctcaacttgtcgatctggcatagggacaccttcaaaaggaattcattcctcggggaggtggagctagacttggagacgtgggactgggataataagcaaaacaagcagctgcgctggtatcccctcaagcgcaagtag

SEQ ID NO: 136932 - DNA, 2805 bp, Artificial Sequence
  Description of Artificial Sequence: Synthetic coding sequence
atgatcgatttgagcttccttaccgaagaagagcaggaggccatcatgaaagtgctccagcgcgacgccgcccttaaacgggcagaagaagagagggtaaggcatctccccgagaaaatcaaagacgaccagcaacttaagaacatgtccggccagtggttctacgaagctaaggccaagagacatcgagacaagatccatggcgctgatataatacgagcctctatgaggaagaagcggccacagattgccgctgaacagagtaaagatagggaaaacggcgcaaaagagtcttgggtcaacaacgtgaacaaggacgcctttctccccccagaactcgctggcgtcgtggaggagcccgaagaagacgctgcccctgcaagtcccagcagcagcgttgtgaatcctgctagcagcgtgatcgacatgtcacaagagaatactagaaaaccaaatgtctctccggaaaagcgcaagaacccattcaacagctcaaagctgcccgagggtcactcttcgcagcagacaaaaaatgagcagtctaaaaacgggcggactgggctgtttcaaacatcaaaggaggatgaattgagcgagagtaaggagaaaagtacagtcgcggacacctctatccaaaagctggagaaatccaagcagactctccccgggttgtctaacggaagtcagataaaggctcccatcccaaaggccaggaaaatgatctataaatccaccgaccttaataaagacgacaatcagtcatttccaaggcaacgcacagactccctgaaggccaggggtgctccaaggggcattctgaagcgcaactcaagctcgtcttccaccgactccgaaaccctccgttataaccacaactttgaaccaaaaagtaaaatcgtgagtcctggtctgactatacatgaacgcataagcgagaaagagcattctcttgaagacaatagttctccaaacagcctggaacccctaaaacatgtccggttttccgccgtgaaggatgagctgccgcagagccctgggctgatccacggtcgcgaggtgggagaattttcagttcttgaatctgacagactgaagaacggtatggaggacgctggagatacggaggaatttcagagcgaccctaagccctcacaatataggaagccctctctgtttcatcagtctacctcttctccatatgtgtcgaaaagtgagacgcatcagcctatgactagtggtagttttcccattaatggcctgcactcacactctgaggtgttgaccgctcgaccccagagcatggaaaatagcccaacaatcaacgaaccgaaggacaaatctagtgagttgacacgcctggagagtgtgctgccacgaagcccagctgatgagctctcccattgtgtagagccagaaccctcccaggtacctgggggaagctcacgcgaccgacagcagggatccgaggaagaaccatctccagtgctgaaaactctcgagcggtcagcagctcggaagatgccgtctaagtccttggaagacatctcctcagattcgagcaatcaggccaaggtggataaccagccagaggagctcgtgaggagcgctgaagatgtaagtacagtgcccacacagcctgacaacccattctctcatccagataagcttaaacgaatgtcaaagagcgtacctgcgtttctgcaggatgaaagtgacgaccgcgaaaccgacaccgcctctgagtccagttaccagctgagtcgccataagaagtcacctagtagcttgactaacctgtccagcagcagtgggatgacatcactcagttcagtctcaggctcagtgatgagtgtctattcaggagactttggtaacctggaagtgaaagggaacattcagtttgccatcgaatatgtcgagagcctcaaggaactgcacgtcttcgttgcccagtgcaaagacctggccgccgccgacgtgaaaaaacaaaggagtgacccctacgtgaaagcgtatttgctccccgacaagggcaaaatgggcaaaaagaaaaccttggttgtcaaaaagactcttaacccagtctacaatgaaatactgcggtacaagattgagaaacagattcttaaaacacagaagctcaacctcagcatatggcatagggatacatttaaacggaactcattcctgggcgaagtggaacttgacctggaaacatgggactgggacaacaagcagaataaacaactgcggtggtacccgctaaaaaggaaaaccgctcccgtcgcactggaggccgagaaccggggcgagatgaagctcgctctgcagtatgtgcccgagcccgttccaggcaaaaaattgccaactacgggcgaagtgcatatttgggtgaaggagtgtttggatctgccgttgttgcgaggcagtcatttaaattccttcgtcaagtgtaccatcctacctgatactagtagaaagagtaggcagaagacccgggcagtcgggaagacaacgaatccaatttttaatcacacaatggtgtatgatgggttccgcccagaggatctgatggaggcttgcgttgagctgacagtctgggatcattataagctgacgaaccagttcctaggcggcctcaggataggcttcggcaccgggaagtcctacgggacagaggtcgactggatggattccacatctgaagaggtggcactctgggaaaaaatggttaacagcccaaatacatggatcgaagccacactcccactcaggatgctcctaatagccaaaataagtaagtag

SEQ ID NO: 136933 - DNA, 468 bp, Artificial Sequence
  Description of Artificial Sequence: Synthetic coding sequence
atgagcaagagtgtccctgctttcctgcaggatgagtctgacgatcgcgagacagatactgctagtgaatcctcataccaactgagtaggcacaagaaaagtccatctagtctgacaaatctgagcagcagctcaggcatgacctcactgagcagtgtgtctggatccgtcatgtcggtgtacagcggtgatttcgggaacttggaagtgaagggaaacattcagtttgcgattgaatacgtggagagtttgaaagaactgcacgtgttcgttgcccagtgtaaggaccttgcggcagcagacgtgaaaaagcaaagaagcgatccctatgtaaaggcgtatctgttacctgacaaaggtaagatggggaaaaagaaaacactggtggtgaagaagacactcaaccctgtgtataacgagatcctccgctataaaattgagaagcagattcttaaaacacaaaagtag

SEQ ID NO: 136934 - DNA, 1131 bp, Artificial Sequence
  Description of Artificial Sequence: Synthetic coding sequence
atgtccaagagcgtgcctgcatttcttcaggacgaatctgatgacagagaaactgatactgcatcggaaagcagctaccagctgtcccgccataaaaaatctccttcttctctaaccaacctcagctcctcttctgggatgacctcgttatcttcggtgtcaggcagcgtaatgtctgtctattcaggcgattttggcaatttagaggtcaagggtaatatccagtttgccatagaatatgtcgagtcactgaaggaactccacgttttcgtcgcccagtgtaaagacctggccgcggccgacgtgaaaaaacaaagatccgatccctacgttaaggcttacctgcttccagacaagggcaaaatgggtaagaaaaaaacattggtcgttaaaaaaactctgaaccctgtgtataacgagattttgagatacaaaattgaaaaacaaatcctgaaaactcagaagctcaatctaagtatttggcatagggataccttcaaacggaactctttcttaggtgaagtcgagttggacctcgagacctgggactgggacaacaagcaaaataaacagctgcgctggtaccccctgaagcggaaaacagctccagttgcgctggaagccgaaaaccggggagagatgaaactggccttgcagtacgtgcctgagccagtccccgggaagaagctgccgacgaccggcgaggtgcacatctgggttaaggaatgccttgatctgccattactgcggggatcccatcttaacagtttcgttaagtgcacaattttgccagatacatcccgtaagagcagacaaaagactcgggccgtagggaagaccactaatccaatttttaaccatacgatggtttacgacggattcaggccggaggatcttatggaggcctgtgtggaactgactgtgtgggaccattataagctgacaaaccagtttttaggggggctacggatcggctttgggaccggcaaatcttatgggaccgaggttgactggatggactctacttcagaggaggttgcattgtgggagaaaatggtgaactctcctaacacatggatagaggcaaccctgcccttacgcatgctgttaatcgccaagatttcaaagtag

SEQ ID NO: 136935 - DNA, 1956 bp, Artificial Sequence
  Description of Artificial Sequence: Synthetic coding sequence
gagacagtggagaaagcggaggcgcccctcatcacagagtctgccttcgacgccggctttgagaaattgctgaaggagataacggaagcccccccttatcagccccaggtgagcgtgcgagaggaaacacacgagaaggagtcatcacagagtgaacagactcgcttcttaggtacagtgccacacttctacagggccgcatcccagacttcagaaatgaaggacaaatccaacggccttgaatctcaagtcaatcagtgcgataaaatgctaggaggggatgctctggttaccgacctgctcgttgacttctgcggaagtaggagtggagtcgagataccacgaactccacagttatacgtggcccatgaaattgggactattaaaactgtgactcccccagaggacagagactcagaatctggtgttgctgggggacagggcactctccaagagcccggcttcggagaggcaagcgaggcaatttcagtctctagaaatcgacagccaattcctctactcatgaacaaggagaatagcacaaaaacttcaaaggtggagcttaccttagcttctccttatatgaagcaagagaaagaggaggaaaaagagggtttctcagaaagcgatttctctgatggcaacacttcatccaatgccgagtcctggaggaatcccagttcaagcgaagaggaacctagcccagtcctgaagaccctcgagcgcagcgcagctcgaaaaatgccttcgaagtctctggaggatattagctcggatagctctaatcaggcaaaagtggacaaccagcctgaggagctggtaaggtcggccgaggatgacgagaagcctgaccagaagcctgtgacgaatgagtgcgtacctagaatttcaaccgtccccacccagcctgacaaccctttttcacacccggacaaactgaaacgaatgtctaaaagtgtcccagcattcctgcaagatgaggtgagtggatctgtgatgagtgtctattcgggagacttcggaaacctggaggtgaaaggtaacatccagttcgccatcgaatatgtcgagagtctcaaggaattacatgtgtttgtggcccagtgcaaggacttggccgccgcagacgtaaaaaaacaaagaagcgatccatacgtgaaagcttacctgcttccagacaagggcaaaatgggtaaaaagaaaacacttgtggtcaagaaaacgcttaaccctgtctataacgagattctgcgatataagatcgagaagcagatccttaagacccaaaagttgaacctgtctatttggcatcgcgataccttcaagagaaacagtttcctcggtgaagttgagcttgacctggaaacatgggattgggataataaacagaacaagcagctccggtggtaccctttgaagcgcaaaaccgctccagtggccctggaagctgagaatcgcggggaaatgaaactggccctccagtacgttcctgaacctgtcccaggtaaaaagttgcctaccactggggaagtccatatatgggttaaggagtgcctcgatctgcccctgcttcgtgggagccatcttaactcttttgtgaagtgtaccattttgcccgacacaagtcgaaaatcacgccaaaaaacaagagctgtcggtaaaaccaccaaccctatttttaatcacactatggtgtacgatggtttccgcccagaggatctcatggaggcctgtgttgagctcaccgtctgggatcactataagctcaccaaccagtttctgggaggactgagaatcggattcggcaccggcaaaagctacggaacagaagtcgattggatggactccacttccgaggaggtggctctgtgggagaagatggtcaattcacctaacacctggatagaggcgaccctccctctccgcatgctcctgattgctaaaatctcgaaatag

SEQ ID NO: 136936 - DNA, 213 bp, Artificial Sequence
  Description of Artificial Sequence: Synthetic coding sequence
atgagtaaatccgtccccgctttccttcaggatgagtccgacgacagagaaaccgataccgcctctgaaagctcgtatcagctcagccggcataagaagtccccatcaagtttgacaaatttgtcctcctcctccggaatgacctctcttagttccgtgagcggaagtgttatgtcagtgtattccggggatttcgggaacctggaggtctag

SEQ ID NO: 136937 - DNA, 1011 bp, Artificial Sequence
  Description of Artificial Sequence: Synthetic coding sequence
atgagcaagagcgtacccgcctttcttcaggacgaagtgtccggcagtgtgatgtcggtgtactctggggactttggcaacctggaagtgaagggcaacatacagttcgctatcgaatatgtggaaagcttaaaagagctgcacgtcttcgttgcacagtgcaaagatctggcagccgccgacgttaagaaacagcgctccgacccttacgtcaaagcttatcttctgccggacaagggcaaaatgggaaaaaaaaaaacgctcgtggtgaaaaaaacactgaatcctgtatataacgagatcttaaggtataagatagagaaacagattctcaaaacccagaaactgaacctctcgatttggcatcgcgatacattcaagcgaaactccttcctaggcgaagttgagctggatctcgagacttgggattgggataacaagcaaaacaaacagctcaggtggtaccctttgaaaaggaagactgcccccgttgctcttgaggccgagaacagaggcgaaatgaagttagctctacagtacgtgcccgagcccgtgcccggaaagaagctgccgactaccggagaagtgcacatctgggttaaagaatgtctggacctgcctctcttacgcggatcacatttgaattcatttgtaaaatgcacaatattgccagacacttcccgtaagagcagacagaagacacgcgccgtcggaaaaacaactaatccaatcttcaatcacacaatggtatatgatgggttccgccccgaggacttaatggaagcatgtgtggaactgaccgtctgggaccattataaactaactaatcagtttctgggaggactccggataggcttcggaaccggaaaatcatatggcactgaggtcgactggatggattcaactagtgaggaagttgccctgtgggaaaaaatggtgaactctccgaacacctggatcgaagccacactgcccttgcgcatgctcctcatcgccaagattagcaaatag

SEQ ID NO: 136938 - DNA, 2016 bp, Artificial Sequence
  Description of Artificial Sequence: Synthetic coding sequence
atgtctgagctcctcgacctatcgtttctttcagaggaggaaaaagatctcatcctatccgttctccaacgggacgaggaagtgaggaaggccgatgaaaagagaatcaggcgcctaaagaatgagcttctggagattaaacgtaagggtgcaaagcgggggagccagcactactctgatagaacttgcgcaagatgtcaagagagtctggggcggctgtctcccaaaacaaatacatgtcggggctgtaatcacttggtctgccgagactgcaggattcaagagtctaacggaacgtggcgctgtaaagtgtgtgcaaaggagattgaactgaagaaggcaactggggattggttttacgaccagaaagtgaaccgattcgcttacagaacagggagtgaaatcatacgaatgtctttgcggcacaaacccgctgtgtcgaagagagagactgtgggccaaagcctcctccaccagacacagatgggggacatatggcctggcagaaagattattcaggaaaggcaaaaggaaccttcagtgttgtttgaagttcccaagctgaaatcggggaagtccgccctagaggctgaaagcgaaagtctggattccttcaccgccgatagcgactctacttcccgcagagattcccttgacaaatctggcttgttcccagagtggaagaagatgtccgctccaaaaagccaggttgaaaaggaaacacaacccggcggacagaacgtggtcttcgttgacgaaggtgagatgatcttcaaaaaaaacacgcggaagatactgagaccgagcgagtataccaagagtgtgatcgatctaagacctgaagacgtggtacatgagtccggatctcttggtgatcggagcaaatcagtacctggcctcaacgtggatatggaagaggaggaagaggaagaggacatcgaccacctggttaagctgcacagacagaaactcgcgagaagctctatgcaatctggatcttccatgtccacgatcggcagcatgatgtccatctactccgaagccggagacttcggcaatatctttgttaccggtaggattgcattttctctaaagtacgaacagcaaacacagtccttagtcgtccacgtaaaagaatgccatcagttggcctacgcagatgaagccaagaagaggtcaaacccgtacgtgaagacatatctgctgcccgataagtcaagacagggaaagaggaagaccagtatcaagagagacacaattaaccctctttatgatgagactttgcggtatgaaattcccgagtccttactagcccagcggacactgcagttcagcgtgtggcatcatggaaggttcggccgaaacacttttcttggggaggcagagatccagatggattcttggaagcttgacaaaaaattagatcattgtctgccgctccacggaaaaatctctgctgaaagtcctactggtttgcccagccacaaaggggagttggtggtcagtctgaaatacatcccagcatctaagactcctgtgggcggagatcggaaaaaatccaagggaggcgagggcggagaactgcaagtctggattaaagaggccaagaacctcacagcagctaaggcgggcgggacctcagacagtttcgttaaggggtacctgctccctatgcggaacaaagctagcaagcggaagacccccgtgatgaagaagaccctgaatccacactacaatcacacgtttgtttataacggtgtgcggttagaggacctgcagcatatgtgtctggagttaaccgtctgggacagggaacctctggccagcaacgatttcttgggaggagtcaggctgggtgtcggcacgggaatctcaaatggcgaggtcgtggactggatggactccacgggggaggaggtgagcctctggcagaagatgagacaatacccgggatcctgggctgaaggtaccctgcagctgaggagcagcatggcgaaacagaagcttggcctttag

SEQ ID NO: 136939 - DNA, 2016 bp, Artificial Sequence
  Description of Artificial Sequence: Synthetic coding sequence
atgagcgaactgctcgatttgtcattcctgtccgaggaagagaaggatctgatcctgtcagtcctgcaacgggacgaggaagtgcgaaaagccgacgaaaagaggattagacgcctaaagaatgagcttctcgagatcaagcgtaagggagctaagaggggaagccagcactactccgatcgaacttgtgcaagatgtcaagagtcattgggacggctgtctccaaagaccaatacatgcaggggctgcaatcacctagtgtgccgcgattgtcggatacaggaatcaaacggaacctggaggtgtaaggtctgtgcaaaagaaattgagttgaaaaaagccacaggcgattggttttacgatcagaaggttaacagatttgcatacaggacggggtccgagattatcaggatgagcctccggcataagcccgcagtatccaagcgagaaaccgtgggccagagtctcctgcaccagactcaaatgggcgacatttggccaggcaggaaaataatccaggaacgccagaaagaaccctccgtacttttcgaggtgcccaagctcaagagcggcaagagtgccctagaggctgaatccgagtcgttggattctttcacagccgactcggattcaacctctcgtcgcgactcacttgacaagagcggccttttccccgagtggaaaaaaatgagtgccccaaagtctcaagtcgaaaaggagactcagccaggcggccaaaatgtggtatttgtggacgagggagaaatgatctttaaaaagaatacaaggaaaatactccgaccgagtgaatacactaaatctgtgattgacctgcgaccagaggatgtagtccacgagagcggcagcctgggcgatagatcaaagtctgttcctggcctgaacgttgatatggaggaggaggaagaggaggaagacatcgatcacctggtcaagctgcatcgtcagaaactagccagatcaagtatgcaatctgggagtagcatgtcaacaatcggaagcatgatgagcatatattctgaggcaggcgattttggcaacatcttcgtgactggtcgtatcgcattctctttaaagtacgaacaacagacacaaagcttagtggttcacgtgaaggagtgtcaccagttagcatacgccgatgaagcaaagaagaggagcaacccatatgtcaagacttatctgctgccagataagtcccgacagggaaaacgaaaaacttcaataaaacgggacaccattaatccactgtacgatgaaactctaaggtacgagatacctgagtctctgctcgcgcagcgaaccctccagttctccgtatggcaccacgggagattcggacgtaatactttcctgggggaggccgagatccaaatggatagttggaaattagacaaaaagctggaccactgccttcccctccacggaaagatcagcgccgagagccccaccggtctcccttctcataagggggaactcgtcgtgtcactgaaatatatcccagccagcaagacacctgtgggcggagataggaaaaaatccaaaggtggcgaaggaggcgagctacaggtctggatcaaagaggctaagaatctcaccgccgctaaggctgggggaactagcgattcgttcgtgaagggttatctgctgcccatgcggaataaggcaagcaaaaggaagaccccagtaatgaagaaaacactcaatcctcactataatcataccttcgtgtataatggtgtgcgattggaagacttacagcacatgtgcctggaattgaccgtctgggaccgggagcccctcgcatccaatgatttcctgggaggagtgaggctgggggtgggcaccggcattagcaacggagaagtggttgattggatggattctacaggggaagaagtgtctctatggcagaaaatgaggcagtatcctggctcctgggctgagggcactctgcaactccgcagctcaatggccaagcaaaaacttgggttgtag

SEQ ID NO: 136940 - DNA, 1050 bp, Artificial Sequence
  Description of Artificial Sequence: Synthetic coding sequence
atgagtgaactgctggatctgtccttcctttcagaagaagaaaaggatctgattctgtctgtgctgcagagagacgaagaggttaggaaagcagatgaaaagaggattcgccgacttaagaacgagcttctagaaattaaaaggaagggggccaaaagaggaagtcaacattactctgatcgaacatgtgctaggtgtcaggagagcctgggaagactctctccgaagacaaacacttgtagaggatgcaatcatctcgtgtgcagggactgccgtatccaagagagcaatggaacctggcgctgcaaggtctgcgcaaaggagatcgagctgaagaaggctactggcgactggttctatgatcagaaggtcaaccgattcgcttaccgtactggatccgaaattatacggatgtcactgcggcacaaaccagccgtgtcaaaaagagaaactgtcggtcagtcccttttacaccagacccagatgggagacatctggccaggtaggaaaatcattcaagaaagacaaaaagagccgagcgttctatttgaagttccaaaacttaaatcaggaaagtcagccctggaggcggagtccgaatctttggactcgtttacagcagatagcgactcgacaagtcgaagagactccctcgataaaagcggcttgttccctgagtggaaaaagatgtccgcacccaagtcacaggtcgaaaaggagacccagccaggcggccagaacgttgtgttcgtggacgagggtgaaatgatatttaagaagaacacaaggaaaattctaagaccctccgagtacacaaaatctgtcatcgatctgcggcctgaagatgtggtgcacgagagtggcagtctgggcgaccggtccaagagcgtccccgggctgaatgtagatatggaggaagaggaggaagaggaggacattgaccacctggtcaagctgcacagacagaaattggcccgctcttccatgcagtcaggctcaagtatggtgtcctcaattcggagcgtggtcacgggcatgctcggatactag

SEQ ID NO: 136941 - DNA, 2016 bp, Artificial Sequence
  Description of Artificial Sequence: Synthetic coding sequence
atgtccgagctgctggatctctcgtttctgtccgaagaggaaaaggacctgatccttagcgttctccagagagacgaagaagtgcggaaagccgacgaaaaaagaattcgaaggctgaagaacgagctcctggaaattaagcgcaaaggtgccaagcgaggcagccagcactactctgaccgcacttgtgcgcggtgtcaggaatcactcggacgattatcccctaagaccaatacctgccgtgggtgcaaccatctggtttgcagagattgtagaatccaggagagtaatggcacatggcggtgcaaggtgtgtgccaaggaaattgagttgaagaaggcgactggcgactggttctacgatcagaaggtcaaccgcttcgcttaccggacagggagtgaaatcataaggatgtctttacgccacaagcctgctgtttccaaaagggaaacagtggggcagtcactgcttcatcagactcagatgggtgacatctggccagggcgcaagatcatccaagagcggcagaaagagccatctgttctgtttgaggttcctaaactgaagagtggcaaatctgctttggaggccgagagtgagtccctcgattctttcactgctgactcagattctacaagtagacgcgattccctggacaaaagcggcctctttcctgagtggaaaaagatgagcgcacccaaaagccaggttgagaaggagacacaaccaggaggccagaatgtggtgtttgtggacgaaggggaaatgatctttaaaaaaaatactagaaagattctgagaccatctgagtacacgaaaagcgtgatcgaccttagacctgaggacgtggtacacgaaagcggttccctgggagaccggagcaagtcagtgccggggctgaacgttgatatggaggaagaagaagaagaggaggatattgatcacctcgtgaaactgcacaggcagaagctggcccgaagctccatgcagagcgggtcctcaatgtcaacaatcggtagcatgatgtcaatttattctgaagctggcgactttgggaacatatttgtgactgggcggattgccttttccttgaaatatgaacagcagactcagtccctggtggtacatgtgaaggaatgccaccagctcgcttacgctgatgaggcaaagaagcgctcaaacccctatgttaagacttatctgctgccagataaatcaaggcagggaaaaagaaagacctcgataaaacgagataccattaaccccctgtacgacgagacccttcggtatgagatacctgagtctctgcttgcccaacggacactgcagttttcagtgtggcaccacggtcggtttggtcgcaatacctttctcggcgaagcagagatccagatggacagttggaagctagataaaaagctggaccactgtctaccattacatggaaaaatttcagccgagtcacctacaggactgccctcacacaaaggggaactcgtggtgagcttgaagtacattcctgctagtaagactccagttggtggtgatcgcaaaaagtccaagggcggagaagggggggagcttcaggtgtggattaaggaggccaagaacttgactgcagccaaagctggggggacatcagattcctttgtcaaaggatatctgctgccgatgcgcaacaaggcctctaagagaaagacacctgttatgaagaaaacactcaatccacattacaatcatacatttgtgtacaacggagtacgtcttgaggacttgcagcacatgtgtcttgaactgaccgtctgggatcgcgagcccctggcctctaatgactttctcggcggggtgcgcctcggagtggggactgggatttctaacggggaggtggtggactggatggattccacaggcgaagaggtcagtctttggcagaagatgaggcagtacccaggatcgtgggccgaggggaccctccagctcagatctagcatggctaagcagaaactggggctgtag

SEQ ID NO: 136942 - DNA, 2022 bp, Artificial Sequence
  Description of Artificial Sequence: Synthetic coding sequence
atgagcgaactgcttgacctgtccttcttgagtgaggaagagaaggatcttatcctcagtgtactccagcgtgacgaggaggtccgaaaagccgacgagaagagaataagaagactaaagaatgaactcttggaaatcaagcggaaaggagctaaacgcggtagccagcactactctgataggacttgcgcaaggtgccaggaaagccttggacgactctctcctaaaaccaatacatgtcgaggctgcaaccacctggtatgtcgtgactgtcgcattcaagagagcaatgggacatggaggtgcaaggtctgcgccaaggaaattgagctgaaaaaagccactggtgactggttttacgaccagaaagttaatcgttttgcctatcgtaccggctcggagataatccggatgtctctgcgccacaagcccgccgtttcgaaacgggagacagtggggcagtcgttgctgcaccagacccagatgggtgacatttggccaggcagaaaaatcatccaggagcggcagaaggagccgtcttccgtactatttgaagtgccaaagcttaagagcggtaagagcgctttggaggccgaaagtgagtctctggactcatttacagccgacagcgattctacatcgagacgagattcacttgacaagagcggtttatttccagagtggaaaaagatgagtgcacccaaaagccaagtagagaaggaaacacagccaggtggccagaatgtggtgtttgtggacgaaggtgaaatgatcttcaagaagaataccaggaaaatcctgcggccaagcgaatatactaagagtgtaatcgaccttaggccagaggacgtggttcacgagagcggcagcctgggggatcgctcaaaatccgttcccggtctgaacgtggatatggttgaagaagaggaagaagaggaggatatcgaccacttagtcaagctccaccgccagaaattagcacggtctagcatgcagagtggcagctctatgagtaccatcggctccatgatgtcaatctattcagaggctggtgattttggcaacatcttcgtgactggccgaattgcattctccctcaagtacgagcagcaaacccaatcgctcgtggtccacgtcaaggagtgtcatcagctcgcatatgcagatgaggctaagaaacgcagcaatccatatgtcaagacttatctgcttccagacaaaagcaggcagggaaagaggaagacctcaattaagcgggacacgattaacccactatacgacgaaactctgcgttatgaaattcccgaaagcttactcgcacagaggactttacaattttcagtttggcaccacgggaggtttgggcggaacactttcctgggcgaggctgaaatccagatggatagctggaagctggacaaaaagctcgaccactgtcttccgctgcatggcaaaatatcagccgaatctcccactggcctgccaagtcataaaggcgagcttgtcgtatctcttaaatacatccctgcctctaagacacctgtgggcggagaccggaagaagagcaaaggaggcgagggaggggagctccaggtttggataaaggaagccaagaatctgaccgcggccaaggctggtggcacctctgacagctttgtaaagggttatctgctgcctatgcggaacaaggcatctaagcgaaagacacccgtcatgaaaaagactcttaaccctcattacaatcacacttttgtctataacggagtgaggctcgaagacttacaacacatgtgcctcgaactcactgtttgggacagagagccattggcttccaacgatttccttggcggggtgagattgggtgttggtaccgggatatcgaatggcgaggtggttgactggatggactccacaggggaggaagtgagcttgtggcagaagatgcgtcagtatcccgggtcctgggccgagggcacccttcaattgagatcttctatggcaaaacagaagctcggcctatag

SEQ ID NO: 136943 - DNA, 2016 bp, Artificial Sequence
  Description of Artificial Sequence: Synthetic coding sequence
atgagtgagctgctggacctgtcttttctcagtgaagaagagaaggacctgatactcagtgtgctccagcgagacgaggaggtgcggaaggccgacgagaagagaatacgacgcctcaagaatgaactgctggagataaaaagaaaaggggctaaaagagggagccagcactactctgataggacatgcgctaggtgtcaggagtcattgggtagactgagtccaaagactaacacatgccgaggatgcaatcatctagtatgcagggattgccgcatccaagagtcaaacggcacttggagatgcaaagtatgtgcaaaagagattgagttaaaaaaggccaccggagactggttttacgaccaaaaggttaatcgatttgcatatcggactggaagtgaaatcattagaatgtcccttcgccataaacctgctgttagtaagagagagaccgtggggcaatcattgttacaccaaacacagatgggcgatatatggcccgggagaaagatcattcaagagagacagaaggagccgagcgtgcttttcgaagttcccaagctgaagtccggcaagagcgcattggaggcagagagcgaatccctggactcatttacggccgattccgattctacctcacgccgcgatagtttagataagtccggtctgtttcctgagtggaaaaagatgtctgcgccaaagtcccaggtggagaaggaaacccagccggggggccagaacgtggtgttcgtagatgaaggcgagatgatctttaagaaaaacacacgaaagatcctcaggccttccgaatatactaaaagcgtgattgacctcaggccagaggacgtggtgcacgaatctggatccctgggcgatcgcagcaaaagtgtgcccggtctgaatgtggatatggaggaggaagaggaggaagaagatatcgatcatctggtgaagctccatagacaaaagctggcccgttcctctatgcaaagcggctcctccatgagcactataggtagcatgatgagtatctactcagaggcaggtgacttcggtaacatatttgtaactggaagaattgctttcagtctgaaatacgaacagcaaacgcaaagtctcgtggtccacgtgaaggagtgccaccaactggcttacgctgacgaagccaaaaagagatccaatccttacgttaaaacgtacctcctgcccgacaagtctcggcaggggaagaggaagactagcataaagcgcgatacgatcaaccctctttacgatgagacactgcgctatgaaattccggaatccctcctggcacagaggaccctgcagttctcggtctggcatcacgggaggttcgggagaaacacctttctgggcgaggccgaaatacagatggattcctggaagctggacaaaaagcttgaccattgtcttcccttacatgggaaaatcagcgcggagtcgccgactggcttgccctctcacaagggagaactggtagtctccttaaagtacattcctgcctcgaaaactcccgtggggggcgaccgcaagaaaagcaaggggggagagggaggagaactgcaagtttggataaaagaagctaagaacctgacagccgctaaggccggaggtacctccgattccttcgtaaagggatacctgttaccaatgcgcaataaggctagcaaacgtaaaacccccgtcatgaaaaaaacccttaatccacactacaaccatacctttgtctataacggggttcgtctggaagatctacaacatatgtgtcttgaattgacagtgtgggaccgagaacctttggcttccaacgacttcctgggaggagttcggcttggggtcggaaccgggatcagtaatggcgaagttgttgattggatggattccacaggggaggaggtgtcactttggcagaagatgcggcaatatccagggtcctgggcggaggggacattgcaacttagaagctccatggcaaaacagaagttggggttgtag

SEQ ID NO: 136944 - DNA, 933 bp, Artificial Sequence
  Description of Artificial Sequence: Synthetic coding sequence
atgcgccgtgccgcgctatggctgtggctctgcgccctagcactgagcttgcaacccgccctgccccagattgtcgcaacaaacctcccaccggaagatcaggatggaagtggcgatgattccgacaatttctcagggtcaggggctggagctttgcaagacatcaccctatctcaacagacacctagcacttggaaggacacccaactgttaacagccatacccacaagccctgaacctactggactggaagccacagcggcaagcactagtacccttccggctggcgaaggccccaaggaaggcgaggctgtggtgctgcctgaagtggagcctggcctgactgccagggagcaggaagcgaccccacgacctagggaaaccacccagttgcccactactcacctggcctccactacaacagccaccaccgcccaggaaccagctacctcacatcctcacagggatatgcaacccggtcatcacgagacgagcacacccgctggcccctcacaggctgacctgcacacacctcatactgaagatgggggcccctctgcgacggagagggccgccgaggatggggcctcctcacagctgccagccgccgagggctcgggggagcaggacttcactttcgagacctccggtgagaatacagctgttgtggcggtcgaacccgaccgcaggaatcaaagtcctgtggaccaaggagccaccggtgcatcccaggggctgttggatagaaaggaggtgctcggaggggtcatcgctggaggccttgtgggtctgatcttcgccgtctgcctagtaggtttcatgctgtatcgcatgaaaaaaaaagacgaagggagctactccctggaagagccgaaacaggccaacgggggagcataccagaaacccactaagcaggaggagttttacgcatag

SEQ ID NO: 136945 - DNA, 933 bp, Artificial Sequence
  Description of Artificial Sequence: Synthetic coding sequence
atgaggagggcagccttgtggttatggctctgcgcgctggcattgagcctgcagcctgccctgcctcagatcgttgcgactaacctgccccctgaggaccaagacgggtcaggagatgactccgataactttagtgggtctggtgcaggcgccttacaggatatcacactttctcagcagacaccaagtacctggaaagacacccaactgctcacagcaatacctaccagcccagaacccacgggactggaggccaccgccgcctcgacaagcacattgcccgccggagagggtccaaaggaaggcgaggccgtggtactgccagaggtcgagcccgggcttactgccagagagcaggaagccacacctcgaccccgggagaccacccagttgcccacgacccatttggcttccaccacaaccgctacaacagctcaggaacccgccacaagccatccccaccgcgatatgcagccaggccaccacgaaacttctacacctgctggcccatcccaggcagatctgcacactccacataccgaggacgggggtccatccgccactgaaagggcagcagaagatggagcatcctctcagttacccgcagccgaagggtccggagagcaggactttacgtttgaaactagcggtgagaacacagctgtggtggccgtggaacctgaccgacgcaaccagtccccagtagatcagggagctaccggggccagccaaggacttctggaccggaaagaggtccttgggggcgtgatcgcaggaggactggtgggccttatctttgcggtgtgccttgttgggttcatgctgtatcgtatgaagaaaaaggatgaagggtcgtatagcctcgaggagccgaagcaggccaacggaggagcataccagaagccgacgaagcaggaggaattctatgcctag

SEQ ID NO: 136946 - DNA, 606 bp, Artificial Sequence
  Description of Artificial Sequence: Synthetic coding sequence
atgaggagggcgtggatccttctaactcttggcctggtggcatgcgttagcgccgaaagtagagccgaactcactagcgataaggacatgtacctagacaattcttcaatcgaggaagccagcggagtttaccctattgatgacgatgactatgctagtgcctccggttctggggctgatgaggatgtcgaatccccagagcttactacaagtaggcccctgcctaagatactgttgacctctgcagccccaaaagtggaaaccaccacgcttaatatccagaataagatacccgcccaaacaaaaagcccagaggagaccgataaggagaaagtgcacctctcagattctgaacggaagatggaccccgctgaagaagatacaaacgtctacacagagaaacattccgattcactattcaagcgcacagaggtgctcgccgctgtcattgctgggggggtgataggcttcctctttgcaatttttctcattctgttactggtttaccgcatgcgcaagaaggatgagggttcttatgacctgggggagcggaagcccagctctgctgcatatcagaaggcccccactaaggaattctacgcatag

SEQ ID NO: 136947 - DNA, 498 bp, Artificial Sequence
  Description of Artificial Sequence: Synthetic coding sequence
atgcgccgcgcctggattctgctgaccctgggactggttgcttgtgttagcgctgagagcgttcgcgccgatgaggatgtggagtcaccggagctaacgaccagtcgtccattaccaaaaattttactcactagcgctgcccccaaggtggaaaccaccacacttaatatccagaataagattccggcacagacaaagtcccccgaggaaacagataaggaaaaagtgcacttgtctgacagtgaacgaaaaatggatccagcggaggaggataccaacgtctacacagaaaaacattctgactctctcttcaaacgaactgaggtgctcgcagcagtcatcgctggcggagtgatcggtttcttgttcgcaatcttcttgattttgctgctagtgtatcggatgagaaaaaaggatgaaggctcatacgacctcggcgaaagaaagcccagtagcgcggcataccagaaggcccccactaaggaattctacgcatag

SEQ ID NO: 136948 - DNA, 519 bp, Artificial Sequence
  Description of Artificial Sequence: Synthetic coding sequence
atgtacctcgacaactcctccattgaagaggcctccggcgtgtaccctattgacgacgacgattacgcctctgcctccggaagtggagccgacgaggatgtggagagtcctgagcttaccacaagtagacccctgcctaaaattctgctgaccagcgccgcacctaaggtggaaaccaccactttgaacatccaaaataaaatccctgcacagaccaaaagtcccgaagaaacggacaaggaaaaggtccatctgagtgacagcgagagaaagatggaccccgccgaggaagatacaaatgtgtatacagaaaagcatagtgattccctgttcaagagaacagaggtcctggcggccgtaatcgctgggggggtgatcggattcctgttcgccatcttcttgatactgctactcgtgtatagaatgcggaagaaggatgaaggttcttacgatttgggtgagcggaagccgtcctccgcagcctatcaaaaggcccctacgaaggaattttatgcgtag

SEQ ID NO: 136949 - DNA, 519 bp, Artificial Sequence
  Description of Artificial Sequence: Synthetic coding sequence
atgtaccttgataactcctcaatcgaagaggcttccggtgtttaccccatcgatgacgatgattatgcctccgcaagcggatcaggcgccgatgaggatgttgagtccccagagctgacaacctccaggccgctgccaaaaattctactgacttcagccgctcctaaggtcgagaccaccacacttaacatccagaacaaaattccagctcagacaaagtctccggaggagacggacaaggaaaaggtgcacctcagcgactccgaaaggaagatggacccggccgaggaggacacaaacgtttacaccgaaaaacattccgactctttatttaaacgcacagaggtgttggctgcagtgatcgcaggcggggttataggattcctattcgctattttcctgatattgcttctcgtctatcgaatgaggaagaaagacgaagggtcttacgaccttggcgagcgcaagccctcgtctgcggcataccagaaggcccctacaaaggaattctatgcctag

SEQ ID NO: 136950 - DNA, 606 bp, Artificial Sequence
  Description of Artificial Sequence: Synthetic coding sequence
atgcgcagggcatggatcctgttgaccctggggctagtcgcttgcgtatcagccgagagcagagccgagttaacctccgataaggatatgtacctggacaattccagcattgaagaggcctccggcgtgtatccaattgacgatgatgactatgcctcagcgagcggatccggtgccgacgaggatgttgagtcaccggaattaaccacatcacgaccacttccgaagatacttctgacctccgctgcacctaaagtcgagacaacaaccttaaacatccagaacaagattccagcacagactaaaagcccggaggaaacggacaaggagaaagtccatctgagtgatagcgagcgcaagatggaccccgccgaagaggacactaatgtctacactgagaaacatagtgactcactgtttaaacgcactgaggtactggcagccgtcattgctgggggagttatcggcttcctcttcgcaatcttcctgatcttactgctggtctataggatgagaaagaaagatgaaggatcctatgacctgggagagaggaagccatcctccgccgcttaccaaaaagctccaactaaggaattttacgcatag

SEQ ID NO: 136951 - DNA, 576 bp, Artificial Sequence
  Description of Artificial Sequence: Synthetic coding sequence
atgcgcgtagcatgtgtatccgccgaatctagagctgaactgacatccgacaaagatatgtatctggataactcaagcatcgaagaggccagtggggtatatcccatcgatgacgatgactatgctagcgccagcgggagtggggccgacgaagatgtcgagagtcccgagctgaccacatccaggcccctgcctaagattctgttaacttcggccgcgcctaaggtagagacaacaaccctaaatatccaaaacaaaataccggctcagacaaagtctcctgaggagacggacaaggagaaagtgcatttgtcagactcagagagaaaaatggaccccgctgaagaagatacaaatgtgtacaccgaaaagcactcggattcactttttaagagaaccgaagttctggctgcagtgatagctggcggtgttattggctttctgttcgccatattcttgattctacttttagtgtaccgaatgcgtaagaaggacgaaggcagctacgacctgggggaacggaaaccatcctcagcagcttatcagaaggcgcctacaaaagaattttacgcttag

SEQ ID NO: 136952 - DNA, 1155 bp, Artificial Sequence
  Description of Artificial Sequence: Synthetic coding sequence
atggctatcgcatacctcggttcctcctgtcccagtcagccccccagctcccttgctctttcactgagccccaccccctccgacttcgaacaggagtccggcattgagacagcaatgcgtttcagcccagatgtagctctggcggtgagtaccacaccggctgtgctgccgaccacaaatatccagcccgtcggcaccccattcgaggagctgccctccgagcgcccaactctggaacccgcaacctcccccctggttgtgacagaggtcccggaagaaccttcacagagggccacgacggtaagtaccactatggccaccactgctgcaaccagtaccggtgaccccactgtcgctacagtgccagcgacagtcgccacggcaacaccctccacccccgctgccccaccgtttaccgcaacgactgccgtgattaggacgaccggtgtaagaagacttctacctctacctttgaccacggtggcaaccgcccgcgccacaaccccagaagctccaagtccccctacaaccgcagccgtgctggatacggaagcacctaccccaaggctggtatccaccgccacatcgcggcctagggccctgccacggcccgcgacgacccaagaacccgacattccagagcggagcaccttgcctctgggcaccactgccccagggcctacagaggttgctcagactcccactcccgagacgttcttaacgacaatcagggacgaacctgaggtgcctgtttccgggggccccagcggagatttcgagctaccagaggaggaaacaactcagccagacaccgccaatgaggtggtggccgtgggtggagctgctgctaaggcctcaagcccacctgggacattaccgaaaggagcccgacccggtccagggctgctggacaacgccatcgattctggatccagcgctgctcagcttcctcaaaagtccatactcgaaaggaaagaagtccttgtcgccgttatagtaggcggggtggtaggagctcttttcgcggcgtttttggtcacccttctaatataccgaatgaagaagaaagatgaaggaagttacaccttggaagagcctaaacaggcgtctgtcacctaccagaagcctgacaagcaggaggagttctatgcttag

SEQ ID NO: 136953 - DNA, 1329 bp, Artificial Sequence
  Description of Artificial Sequence: Synthetic coding sequence
atgaagccgggtccaccacaccgtgccggcgctgctcatggcgccggtgcaggtgcaggagctgctgctgggcctggggctcgcgggctattactgcctcctctgctactgctactcctcgcaggaagggccgccggggctcagcggtggcgctcggaaaactttgagaggccagtcgacctggaagggtccggggacgatgacagcttccccgatgatgagctggacgatctttacagtggctcaggaagcggctacttcgagcaagagtccggaatcgaaactgccatgagattttcccccgatgtcgcactggccgtttctactaccccagccgtgttgcctacaacaaacattcaacccgtggggacccctttcgaggaattgccttccgagaggccaacccttgagccagcaacttcccccctggtggtgacggaggttccagaagaaccatctcagagggcaactaccgtgtcaactacaatggcaacaactgccgcaacatctaccggtgaccctactgtagccacagttcctgctaccgttgccacggccaccccatctacacctgcggcccctccgtttaccgccactaccgccgttatccggaccactggtgtacggagactgctgcccctcccattaactacggttgcgactgcgagagccactactcccgaagcacccagtccaccaacaaccgcagctgtgctggatacagaagccccaactccccgcctggtctctaccgccacctcaaggcctcgagctctgcctcgacctgccaccacccaggaaccggatattccagaaagatctacactcccacttggcactactgcgccgggccccaccgaggttgcccaaacaccaacccctgagactttcctaactaccattcgcgacgagcccgaggtgcccgtaagcggcggcccatctggggacttcgagctccccgaagaggaaactacccagcccgacactgctaatgaggtggttgccgtggggggagccgcggcaaaggcatcctcaccccccggtactctgcccaagggcgcccgacctggaccaggtctgctggacaacgccatagacagcggaagcagcgccgcccagttgccacagaagagtatccttgagcgtaaggaagtcctcgtcgcagtgatcgtagggggtgtcgtgggggccctgtttgccgctttccttgtgacactcctgatctatcgaatgaagaagaaggatgaaggatcctatacgctcgaggaacccaaacaagcttctgtgacataccagaagcccgataagcaggaggagttttatgcctag

SEQ ID NO: 136954 - DNA, 597 bp, Artificial Sequence
  Description of Artificial Sequence: Synthetic coding sequence
atggcacccgccaggctgttcgcccttctgttattttttgtcggcggcgttgctgagagtattagggaaacagaggtcatcgatccacaggatttgctggagggtcggtacttttccggagccctgcccgatgatgaagacgtggtgggacccgggcaggagagcgacgacttcgagctttccgggtctggggacttagacgacctggaggacagcatgataggcccagaagtggtgcacccccttgtacccttggataatcatataccggagcgagctggctcaggcagccaggtccctacagaaccaaagaagctagaagagaatgaggtgataccaaaaagaatttctcccgtggaggaatctgaggacgtttctaacaaggtgtctatgtcttccaccgtgcagggttccaatatcttcgagagaaccgaggtactggccgcgctgatcgtcggtggtatcgtgggcatcctttttgctgtgttcctgatacttttgctgatgtatcgcatgaagaagaaagacgagggcagctacgatctcggaaaaaaaccaatctataagaaagccccaacaaacgagttttatgcctag

SEQ ID NO: 136955 - DNA, 381 bp, Artificial Sequence
  Description of Artificial Sequence: Synthetic coding sequence
atgatcggtcccgaggtggtccatcctctcgtacctctcgataaccatatccccgagagagcaggatccgggtctcaggtcccgacagagcccaagaaactggaggagaatgaagtcatccctaagcgaatttctccagtggaggagagtgaagatgtgagcaacaaggtgagcatgtcctccaccgtgcagggctctaatatctttgagcggaccgaggtgttggccgccctcatagtggggggcatagtcggtattctcttcgcagtgttcctgattttgctgttgatgtatcgaatgaaaaaaaaggacgaagggagttacgaccttggtaaaaaaccaatatataaaaaggcccctacaaatgagttttacgcctag

SEQ ID NO: 136956 - DNA, 1851 bp, Artificial Sequence
  Description of Artificial Sequence: Synthetic coding sequence
atgttccgtacggccgtgatgatggccgcaagtctcgctctgacaggcgcagtcgtggcccacgcttattaccttaaacatcagttctaccctactgtcgtctatcttacaaagtcgtctcccagtatggctgtgctgtacattcaggccttcgtactcgtgtttctgctgggaaaggtgatgggtaaagtgttcttcggacagctgagagccgcggagatggaacacctgttagagcgctcatggtacgcagttaccgaaacgtgcttagcctttactgtcttccgcgacgattttagcccacggtttgtggctctgtttacgcttctcctcttcctcaagtgtttccactggcttgccgaagaccgcgttgactttatggagcggtctccaaacatttcttggctgtttcactgccgtattgtaagtctgatgtttctgttaggaatcttggactttctcttcgtgagccacgcctatcacagcattctcacacgaggcgcctcagtgcagctagttttcggcttcgagtatgcaatattgatgaccatggtgctgaccattttcatcaaatacgtgttgcactctgtggatctgcagtcggagaatccatgggacaataaggctgtgtacatgttatacacagaactcttcacaggcttcatcaaggtcctcctgtacatggcatttatgacaatcatgattaaggtacacactttcccgttgtttgcaatacggcctatgtatctggcaatgaggcagttcaagaaggccgtaaccgacgccatcatgtccaggcgcgccatcagaaacatgaacaccctctatccagatgcgactccagaagagctgcaggctatggataatgtttgcatcatctgtcgcgaggagatggtgactggggctaagagactcccctgcaatcacatttttcataccagctgtctaagatcatggtttcagcgccaacagacatgcccaacttgtcgcatggatgtgctccgtgcctctctgccagcacagtcaccaccacctccagaacccgccgaccaggggccaccccccgccccacacccccctccacttctgcctcaacctcctaacttcccccaggggctgcttcctccctttccaccagggatgttcccactttggcctcccatgggcccgttcccacccgtgcccccgccaccatctagcggtgaagcggtggcccctcccagcaccagcgctgctctcagccgacccagtggggcagccacaaccacagccgccggcacctccgcaactgccgccagtgctacggctagcggacctgggagcggtagcgcccctgaggccggcccggcccccggttttccttttcccccaccatggatgggcatgcctctgccccctccgtttgccttcccacctatgcctgtaccaccagccggcttcgctggattgacccctgaagaactacgggccttggagggccacgaacggcaacacctcgaagcgagactccagtccttaaggaacattcataccctattggatgccgctatgctccaaatcaaccaatatctcactgtcctggcgtcgctgggaccccctaggcctgccaccagtgtcaactccacagaagagaccgccactacagtcgtcgccgcagctagctccacgtccattccgagcagtgaagctaccacccccacccccggcgcctcccctcccgcccctgagatggagaggccaccggcccctgaatcagtcgggaccgaagagatgccagaggatggtgaacctgacgccgcagaactccggaggcggcgcctgcagaaactggagagtccagttgcccattag

SEQ ID NO: 136957 - DNA, 1698 bp, Artificial Sequence
  Description of Artificial Sequence: Synthetic coding sequence
atgtttcgcactgctgtgatgatggccgcgtcattggccttgactggcgcagtggtggctcacgcctattatttaaagcaccagttctaccccacagtggtttacctgacgaagtcctccccttccatggccgtgctctacattcaggccttcgtattggttttccttctggggaaagtaatgggcaaagtattcttcggccagctgagagccgccgaaatggagcatctgctggagagaagctggtatgcagtcactgagacgtgtctcgcttttacggtttttcgggatgatttcagtcctcgctttgtggccctcttcacactcctgctttttctgaagtgtttccattggcttgcagaggatagggtagatttctacgccatcctcatgacaatggtactcactatttttatcaagtatgtactgcacagcgtcgatttacaatcagagaatccttgggataataaggcggtgtatatgctttacacagaactgtttactggctttattaaggtgctcctgtatatggcattcatgaccattatgattaaggttcatacttttcccctcttcgccattaggccgatgtatttagctatgcgccagtttaaaaaggcagtgactgacgccatcatgagtagacgcgccattcgtaacatgaacacgttgtatccagacgcgaccccagaggagttgcaagccatggacaatgtgtgtatcatctgtagggaggaaatggtgacaggggctaaacgcttgccatgcaaccatatttttcacacttcttgcctcaggtcatggttccagcggcagcagacgtgccccacgtgtcggatggatgtgctgcgcgctagcctcccggcccaaagcccccctcctccagaaccagcagatcagggccccccgcccgcgccccacccaccccctcttctgccacagccccccaattttccccagggattgctccctcccttcccccccggaatgttccccctttggcctcccatggggccattcccacccgttccccctccacctagttcaggggaggccgtagctccaccatctactagcgctgccctctcgcggccatccggggcagccactaccacagcggctgggacgtcggcaactgccgccagtgccactgcctctggcccaggctcaggctctgctccagaggctggccccgctccaggatttccctttccgcccccatggatgggaatgcccctccccccaccattcgccttcccaccaatgcctgttccccccgctggatttgccggtctaacccctgaggagcttagagcgctcgaaggccatgaacgacagcacctggaagccagactccaatcactccggaatatccataccctgctggatgcagccatgctgcaaatcaaccaatatctgaccgtacttgcatctctgggaccaccgcggccagcaacctccgttaatagcaccgaggaaacagctacaacggtagtcgcagccgcaagttctacatctatcccatcttccgaggccaccacgcccactccaggcgcttcccctcccgcccccgaaatggaaaggcccccggccccagagagcgtaggaacggaggagatgcccgaggacggtgagccagatgctgctgaactgcgcagaagacggctgcagaaacttgagagtccagtggcacactag

SEQ ID NO: 136958 - DNA, 1854 bp, Artificial Sequence
  Description of Artificial Sequence: Synthetic coding sequence
atgttccggactgctgtgatgatggcagcttccctagccttgactggggcagtcgtagcacacgcttactatctgaagcaccagttttatcctactgtggtatacttgactaagtctagcccctctatggctgtcctgtacatccaggcctttgttctggtgttcttgttgggtaaggtgatgggcaaggtcttcttcggccagctcagggctgcagagatggaacatctgctcgaaagatcctggtacgcagtgactgagacctgcctggcctttactgtgtttagagatgactttagcccacgatttgtcgcattgttcacgttgctactctttctcaagtgtttccattggctggcagaagaccgtgtagatttcatggagcgttcacctaatatcagctggctgttccattgccgtatcgtgtcactcatgtttctcctgggcatcctcgatttcctgtttgttagtcatgcgtaccactcgatcctaacccgcggagcctccgtgcaactggtgtttggcttcgaatacgcaatcttgatgaccatggtgttgacaatctttatcaagtatgtgctacacagtgtagacctgcagagtgagaacccctgggacaataaggccgtatacatgctgtatacagaattgttcaccggcttcattaaggtgctgctatatatggcgtttatgacgataatgattaaagttcacaccttcccattatttgccattaggcccatgtatctggctatgaggcagttcaagaaagccgtgacggacgctatcatgtcccggcgagctatacgcaacatgaacactctgtaccccgacgcgacacctgaagaactgcaggccatggacaacgtttgcattatatgccgagaggaaatggttacgggcgccaaaaggctgccctgtaaccatatcttccacacctcttgcctgaggagctggtttcagaggcagcagacttgcccaacctgccgcatggacgtgctgagggcgtctttgcctgctcaatcaccccctccccccgagcctgcagaccagggtccaccacctgccccacaccccccacccctgttgccccaaccacctaattttcctcaaggcctgctcccgccctttccccctggtatgtttcccctgtggccccccatgggaccctttcctcccgtgccaccacctccgagctccggggaagccgtcgcccccccctcaactagtgccgccgccctgagcaggccgagcggcgccgcgactactaccgctgcagggaccagcgccacagccgcctcggccaccgcctctgggcccgggagtggcagcgccccagaggccggccctgcgccagggtttccgttccctcccccgtggatggggatgcccctaccaccccccttcgcctttccccccatgcccgtacccccagccggtttcgccggcctgacacctgaggagttgcgtgcattggagggacatgagcgtcagcatctggaggcccggctccagtcgttaagaaacatacacacactgctcgatgccgccatgttacagatcaaccaatatctaactgtgctcgcgagtctcggacctccccggccggctacttcagtgaattctaccgaagaaacagcaacaactgttgtggcggctgccagcagtacaagcatcccctcctctgaggccacgactcctacgccgggggcaagcccccctgcgcctgagatggagcgaccacccgcaccagaaagtgtgggaacagaagagatgccagaagacggagaacccgacgccgcagaactccgtcgaaggcggctccagaaactggaaagtcccgtggcacactag

SEQ ID NO: 136959 - DNA, 1890 bp, Artificial Sequence
  Description of Artificial Sequence: Synthetic coding sequence
atgttcaggacggctgtgatgatggcagcatctctggcgctcaccggagcagtggttgcccacgcatattatttgaaacaccagttttatcctacagtcgtctacctgaccaaatcttcgccatcaatggccgtactctacatccaggccttcgtcctcgtcttccttctcggtaaagtgatgggcaaagtattctttggccagttgagagctgccgagatggagcacctcctggagcgctcctggtatgctgtcacagaaacctgtctggcgttcacagtttttcgcgacgatttttcaccacgcttcgtcgcattatttactctgttactgttcttaaaatgtttccactggctcgcagaggatcgggtagattttatggaaagatcaccgaatatatcatggctgtttcactgtcgcattgtctcactaatgttcctgctgggaatcctcgatttcttgttcgtgtcccacgcctatcatagtatcttgacccgcggcgcttccgtgcaactcgttttcggttttgagtatgcgatcctgatgaccatggtgctgacaatctttatcaagtacgtcctgcattctgtggacctgcagtctgaaaatccttgggacaacaaggccgtgtatatgctatacacagagctgtttacgggatttattaaggttcttctgtatatggccttcatgacaataatgattaaggtccacacttttcccctgttcgccataaggcccatgtacctggcgatgcgccagttcaagaaagccgttaccgacgctatcatgagtcgacgtgcaatcaggaatatgaacacactgtaccctgacgccactcctgaagaattgcaagctatggacaacgtgtgtattatctgtagagaagagatggtcacaggagctaagcgcctcccgtgcaaccacatctttcatacgtcctgtctgagaagctggtttcagagacaacagacttgtcccacttgccgtatggatgtgctgagagcttccctgccggcgcaaagtcctcctccacccgaacccgctgatcagggcccccccccagctccccatccaccccctttactgccccagccaccaaactttccccagggtctgcttcctcccttcccacctggaatgtttcctctctggcccccaatgggtccctttcctcccgtgcctcccccaccatccagcggcgaggccgtcgcacccccttcaacctcagccgctgccctgagccggccaagtggtgcagccactaccacagcagctggcacctcagctaccgcggcatctgccaccgccagcggtcccggttctgggagcgcacccgaagccggacccgcccccggtttccctttcccccctccttggatggggatgcccctgccaccaccatttgcatttccccccatgcctgtccctccagccggattcgcaggcttgacccctgaggagctcagagcattggagggacacgagagacaacacttggaggcacgcttgcaatccttgcggaacatccacaccctcttagatgcggcaatgttgcagatcaatcaatacctgacagttttggcttcgcttggcccaccgggcctgcccctccagtccacccccctgcgtcgcctccctttgcaactcctcctcctgcctcccccaccggcttccctggcacagcgcccccgcccacagccccaagaacctccccatcagccgcttaagtggaaggggctgcagctccttagccagtgggcgcagaggaggtgccttaggatggaatcccccatgcagcagtcctcagccggtgctgcatgtaggagctggtccctgcttctccccaccgatacggcccccgcacagcctcagcctcttttgttctag

SEQ ID NO: 136960 - DNA, 1851 bp, Artificial Sequence
  Description of Artificial Sequence: Synthetic coding sequence
atgtttaggaccgctgttatgatggcagccagccttgctctcacaggagcagtggtggctcacgcctactacctgaagcaccagttttaccccacagttgtgtacctgacgaagtcatcacccagcatggctgtgctgtacattcaagcctttgtacttgtctttctcctggggaaagtgatggggaaagttttctttggacagcttagggccgcagaaatggagcatttactcgagaggtcctggtatgccgtgaccgagacgtgcctggctttcacggtgttccgggacgatttctctcccagattcgtggcactcttcacattactgctgttcctgaagtgtttccattggctggcagaagatagagtggattttatggaacgatcaccaaatatctcctggttgttccattgtaggattgtcagtctgatgtttctgctaggcatcctggatttcctgttcgtcagccacgcttaccactctatcctcacgcggggtgcgtcggttcagctggtgttcggattcgagtatgccattctgatgaccatggtgctgaccatttttatcaagtatgtcttacattcggtcgacctgcagtccgaaaacccctgggacaacaaagccgtgtacatgttatataccgagctctttaccgggttcattaaagtcctcctttacatggcatttatgaccatcatgatcaaggtgcacaccttcccccttttcgcaattcggcctatgtacctagccatgaggcagttcaaaaaagctgttaccgacgccatcatgagccggcgagccatcaggaatatgaatacactctaccctgacgctaccccagaagaactacaggccatggacaatgtctgtataatatgtagggaggagatggtgactggcgccaagaggctgccttgtaaccacatttttcacaccagctgccttaggagttggtttcagaggcaacagacttgccctacttgccggatggatgtgctgagggcaagtctgcctgcccagtcgcctcctccacccgagccagccgatcagggcccccctcctgcgccacaccccccgcccctgctgccccaaccacccaacttccctcaaggcttgctacccccattccccccaggcatgttcccactgtggcctccaatgggcccctttcctcccgtgcctccaccaccctcatctggggaagctgttgcccctccaagtaccagcgcagccttaagtcggccctccggagccgctactacaactgctgccggaacgagtgccaccgccgctagcgccacagcatcggggcctggcagtgggtccgcacccgaagctggaccggcaccagggttccctttcccaccaccctggatgggcatgccgctgcctccccctttcgcatttccacctatgccagtgcccccagcgggttttgcaggattaacccccgaggaactgcgcgcccttgagggtcatgaacgccagcacctcgaggccaggctacagagcctgcgcaatattcataccctactggacgcagctatgctgcaaattaaccaatatcttaccgtcttagcttcactaggcccacccaggcctgcaaccagcgtgaatagtacagaggagaccgctaccaccgtggtagctgccgcctcaagcacctccataccttcgtctgaagctaccacccccacccctggggcttcaccaccagcccccgagatggaaaggccaccggctccggagagtgtaggtaccgaggagatgcccgaggatggagagcccgacgccgcagaattgagaaggcgcaggctgcagaagctagagagtcccgttgcccactag

SEQ ID NO: 136961 - DNA, 1191 bp, Artificial Sequence
  Description of Artificial Sequence: Synthetic coding sequence
atgtccgtcgccttcgcctcagctcgtccacgcggtaaaggtgaggtgacacagcaaactatccagaaaatgctcgacgaaaatcatcaccttatccagtgtattttggaatatcaatctaagggtaaaaccgccgagtgtacccagtatcagcagatcctccaccgtaacctcgtttacctagcaaccatcgccgatagcaatcagaatatgcaatctctcctgcctgcaccccctacacaaaatatgaatctgggtcccggtgctctgacacagtcgggctctagtcagggactccattcacagggcagcctgagtgacgcaatttcaaccggcctgccacccagtagcctcctgcaaggccagataggcaacggcccatctcacgtttctatgcagcaaactgccccgaacactctccccaccacatccatgagtatttcaggacccgggtacagccatgcaggacccgccagccaaggtgtccccatgcagggacagggtaccatcggaaactatgtgtcccgcactaatattaatatgcagagcaatccagtgtctatgatgcagcagcaggccgccacctcccattacagttcggcacaggggggcagccaacactatcagggacagagcagcatcgccatgatggggcagggatctcaaggttcttccatgatgggtcagagaccaatggctccttacaggccttcccagcaaggaagttctcagcagtacctgggccaggaggagtactacggtgagcagtactcgcattcccagggagccgccgaacctatggggcaacagtactatcccgatggacatggggattacgcatatcaacagtccagctatacagagcagtcatatgatagatccttcgaggaatcgactcaacattactatgaaggggggaactcccaatactctcagcagcaggccggctaccagcaaggtgcagcccagcagcagacctactctcaacaacagtatccatcgcaacagtcctaccctggccagcaacagggctacgggtcggcacagggggcacctagccagtatcctgggtaccagcaagggcaggggcagcagtatggttcatatcgggccccgcagacagcccccagcgcacagcagcagcgcccatacggctacgagcaaggacagtatgggaattaccagcagtag

SEQ ID NO: 136962 - DNA, 1200 bp, Artificial Sequence
  Description of Artificial Sequence: Synthetic coding sequence
atgcaaagcctttcaaccgaggcgaggtacgttccccgggtccctcagcacagggaccaaatttccccacggtctccccaacatggtggtcaaatctgcccgcggtctccattgcaccgtggacaaatatgtccccgctctccccccgccagacgatatcagcaaatcctgcacaggaacctcgtatacttagctacaatcgctgactcgaaccaaaatatgcagagcctcttgcctgcccccccaactcagaatatgaatctggggccgggagcgttgactcagagtgggtcgagccagggactccactcccagggctcactgagtgatgcaatcagcacaggcctgccaccctcttccctcctgcagggccagattggcaatggaccttctcacgtctcgatgcagcagactgcacccaacacactgcctaccacatccatgagcatctccggccccggatatagtcacgcagggccagcgtcgcagggcgtccccatgcagggtcaggggacaatcgggaactacgtgtccagaaccaatatcaatatgcagtctaatccagtgtctatgatgcagcagcaggctgccacatcacattacagcagtgcacagggaggctcacagcattaccaggggcagagcagtatagccatgatgggtcaaggcagtcagggtagctctatgatgggacaaagaccgatggcaccttatcgtccctctcagcaaggaagcagccagcagtacctgggccaagaagagtactacggagagcaatactctcattctcagggtgcagctgagcccatggggcaacaatattacccagatggtcacggggattacgcctaccagcagagcagctatacagagcagagctacgatcgtagctttgaagagagcacccagcattactatgaggggggcaattcgcagtatagccagcaacaggccggttaccagcagggcgctgcacagcaacagacttattcgcaacaacagtatccttctcagcagagctacccgggtcaacagcagggctatggcagcgcccagggagcacctagtcagtatcctgggtatcagcagggccagggacagcagtacgggtcttacagagcaccacaaactgcacctagcgcacagcagcagagaccatacggatacgagcagggtcaatacggcaactaccaacagtag

SEQ ID NO: 136963 - DNA, 1191 bp, Artificial Sequence
  Description of Artificial Sequence: Synthetic coding sequence
atgtcagttgcgttcgcctcagctcggcctaggggcaagggggaagttacccagcagaccattcagaaaatgctcgatgaaaaccaccaccttattcagtgcattttagaataccagtccaaggggaaaactgctgaatgcacccaataccaacaaatcctgcaccggaacctagtgtacctggccacgatcgccgattcaaatcagaacatgcagtctctgctcccagccccgcccacccaaaatatgaacctgggcccgggagcactaacacaatcgggatcatcgcaagggctacactcacaggggtcgctgagtgacgctatttccacaggcctgcctccatcaagtcttctacagggtcaaatcgggaatggcccgtcccacgtgagtatgcagcaaacggccccaaacactcttcctaccacctctatgagcatttccgggcccggctactctcacgcaggccccgcatctcagggagtacctatgcagggacagggaacaatcgggaattacgtcagccgaacaaacataaatatgcagtcgaaccctgttagtatgatgcagcagcaggccgccacatcacactacagttccgcacagggcgggtcccagcattaccaggggcagtcatccattgctatgatgggccaggggtctcagggaagctccatgatggggcagaggcccatggccccctaccgtccttcgcagcagggttcatcacagcaatacctcgggcaggaggaatactacggcgaacagtactctcactcacagggagccgccgagcctatgggacagcaatattatccagatggtcatggagactatgcttatcaacagagttcatatacagaacaatcctacgacaggtctttcgaggagtctacccagcactattatgagggtgggaattcccagtactcacagcagcaggccggatatcagcagggagccgcccagcagcagacctactcacaacagcagtaccccagccaacagtcatatccaggccagcagcagggctacggtagcgcacagggggccccaagtcagtaccctggatatcagcagggccagggccagcaatacggttcttatcgagccccccaaacagcccctagcgctcaacaacagcggccctatggatatgaacaaggtcagtatgggaactaccagcagtag

SEQ ID NO: 136964 - DNA, 387 bp, Artificial Sequence
  Description of Artificial Sequence: Synthetic coding sequence
atgcaatccctttcaacagaagctagatacgttccacgggtcccacagcatagagaccagatatcaccacggtcccctcagcatggggggcagatctgcccccgctctccactgcaccgcggacagatttgccctaggtctcccccagctcggagatatcagcagatactgcacagaaatctcgtctatctagctaccattgcagattctaatcaaaacatgcagtctctgctgcctgctccgcctacacagaatatgaatctgggacccggcgcacttactcagagtggttcttcacaggggctccattcccagggctccctgtctgacgctataagtactggtctgcctccctcatcccttctccagggccagatcggtaattag

SEQ ID NO: 136965 - DNA, 234 bp, Artificial Sequence
  Description of Artificial Sequence: Synthetic coding sequence
atgtccgtcgccttcgtacccgactggctgagaggcaaggcagaagtcaaccaggagactattcagcgcctgctggaagagaacgatcaactaatacgctgtatcgtcgagtaccagaacaaggggcgcggcaacgagtgcgttcagtatcagcacgtcctccacaggaatctaatttatcttgcaactattgccgacgcctcaccgacatccacgagcaaggcgatggagtag

SEQ ID NO: 136966 - DNA, 234 bp, Artificial Sequence
  Description of Artificial Sequence: Synthetic coding sequence
atgtccgtggccttcgttccagactggctcagaggcaaggctgaagtcaaccaagagacaatccagcggcttctggaggagaatgaccagctgatcagatgtatcgtggaatatcagaataaaggccggggcaatgagtgcgtccagtatcagcatgttctccacagaaacttgatctacttggccacaatcgcagatgcgtcacctacttccacaagcaaggcaatggagtag

SEQ ID NO: 136967 - DNA, 1164 bp, Artificial Sequence
  Description of Artificial Sequence: Synthetic coding sequence
atgtccgtagcttttgccgcgccacggcaaaggggaaagggagaaatcacgcctgcagccattcaaaagatgctggatgacaacaatcatctgatacagtgcataatggattcccagaacaaggggaagaccagtgagtgcagccagtatcagcagatgctgcataccaatctggtgtacctggccactatcgcagacagcaatcagaatatgcagtctctgttgccagctcctccaactcaaaacatgcctatgggtcccggcgggatgaaccaatccggaccaccgccgcctccaaggtctcacaatatgccctctgacggcatggtcggaggaggccctcctgccccacacatgcagaatcagatgaacgggcaaatgcctggcccaaaccatatgccaatgcaggggcccgggccaaatcaattaaacatgacaaactcctcgatgaatatgcctagttcctcgcacggcagtatgggcgggtataatcactctgtgccttcttcacagtcaatgcccgtgcagaatcagatgaccatgagtcagggtcagcctatgggaaactacggcccaaggcccaatatgtccatgcagcccaaccagggccccatgatgcaccagcagcccccatcacagcaatacaatatgcctcagggaggcgggcagcattatcagggtcagcagccccccatggggatgatggggcaggtgaaccagggcaaccacatgatggggcaaagacagattccaccatacaggcctccgcagcaagggccaccccagcagtacagcggccaggaagattactacggagaccaatattcgcatggaggtcagggcccccccgaaggcatgaaccagcaatattaccccgatggtaacagtcaatacggccagcagcaagatgcataccagggacctccaccccagcaaggttaccctccgcagcagcagcagtatccaggtcagcaaggctacccgggtcagcagcagggttatggaccaagccaggggggccccggcccgcagtatccgaactacccacaggggcaaggccaacaatacgggggctatcgccctacccagcccggccctcctcagccccctcagcagaggccctacggttacgatcagggtcagtacggtaattaccaacagtag

SEQ ID NO: 136968 - DNA, 1257 bp, Artificial Sequence
  Description of Artificial Sequence: Synthetic coding sequence
atgtctgtggctttcgccgccccacgccagaggggtaaaggagaaattacacctgcagctatacagaagatgttagacgacaacaatcacctaatacagtgtattatggactctcagaataagggtaagacttcagaatgctctcaatatcagcaaatgcttcacacaaacctggtttacctcgccacaattgctgattctaaccagaatatgcagtcgctgctgcccgctccccctacccagaacatgcccatgggacctggagggatgaaccagtcggggcctccacccccaccacgatctcacaacatgcctagcgacggaatggtcggcggtggccccccagccccccatatgcagaatcagatgaatggtcagatgcctgggccgaatcatatgcctatgcagggaccagggccgaatcagttaaacatgaccaacagttctatgaacatgccttcatccagtcatggcagcatgggaggatataaccatagcgtgcctagttcgcagagcatgcccgtgcagaaccaaatgaccatgtcacaagggcagcctatgggcaactacggcccccgccctaatatgtctatgcagcccaatcagggcccaatgatgcatcagcagccaccgtctcagcagtacaacatgccccagggcggcgggcagcactaccaggggcagcagcctcccatggggatgatgggacaggtcaaccagggaaatcatatgatgggacagagacaaatacctccatacaggccccctcagcaagggccgccccagcaatactctggacaggaagactattacggcgaccaatactcccacggtggtcagggaccccccgagggcatgaaccagcagtattaccctgacggtcataacgactatgggtaccagcaaccttcatacccagagcagggatatgatcggccttacgaggactccagccaacattattacgagggagggaacagtcagtacggccagcagcaggatgcctaccagggacccccccctcagcaaggataccctccacagcagcagcagtaccccgggcagcagggatacccaggacagcagcagggctatgggcctagccagggagggccgggaccgcagtatcccaattaccctcagggacaagggcagcaatacggaggatacagacccactcagcctgggcccccccagcctccgcaacagcggccatatggttatgatcaagggcagtatggtaattatcagcagtag

SEQ ID NO: 136969 - DNA, 1266 bp, Artificial Sequence
  Description of Artificial Sequence: Synthetic coding sequence
ggcggaaatatgagtgtcgccttcgcggctccgagacagaggggaaaaggtgagatcacccccgccgctattcagaagatgctggacgacaataatcacttaattcagtgtattatggacagccagaacaaaggaaagacatctgagtgtagtcagtatcagcaaatgttgcataccaatctggtctatctcgctacaatcgctgacagtaaccagaatatgcagagcctactgcccgccccacctacacaaaatatgcctatgggacctggtgggatgaaccagagtggaccgccccctcctcctagatcacataacatgccgagcgatggtatggtgggtggcggacctcccgctcctcatatgcaaaatcagatgaacgggcagatgccaggccccaaccacatgcccatgcagggacctggccctaatcagctgaatatgactaatagtagcatgaacatgcctagctcaagccatgggagcatgggcggatataaccactctgtgcctagctcccagtctatgcctgtacaaaatcaaatgacgatgtctcaaggtcagcccatggggaactacggccctcgccctaacatgtccatgcagcccaaccaggggccaatgatgcaccagcaacctccatcacaacagtacaacatgccccaggggggcggccagcactaccagggccagcaacctcccatgggaatgatgggacaagttaaccaagggaatcacatgatggggcagcggcagatacctccctacagacccccacagcagggcccgccacagcagtactccggccaagaggattactacggcgaccagtactcccatggcggccagggcccccccgaggggatgaaccagcagtattatccagacggccacaacgactacggctaccagcagccaagttacccggaacaggggtatgatcgcccctatgaggattcttcccagcattactacgaagggggaaacagccagtatggacagcaacaagatgcttatcagggaccccctccacaacagggatatcccccccagcagcaacagtaccccggccagcagggctacccaggccaacaacaggggtacgggccgagccaggggggacctggtccgcaatacccaaactacccccaggggcagggtcagcaatatggaggctaccgtcccacgcagcccgggcctccgcaaccccctcagcagcggccctacgggtacgaccaaggacagtacgggaattaccagcaatag

SEQ ID NO: 136970 - DNA, 399 bp, Artificial Sequence
  Description of Artificial Sequence: Synthetic coding sequence
atgaaccagcagtattaccctgacggtcacaatgactatggatatcagcagcctagctatccagagcagggttacgatcgaccttacgaggacagttctcagcattactatgaaggtggaaattctcagtatggccagcagcaggacgcctatcagggacctcctccacagcaaggctatccaccccagcagcagcagtatccagggcagcaggggtatcccggacaacaacagggctacggcccgtctcagggcggaccagggccacagtaccccaattatccacagggccaaggccaacagtatggtggataccgacctacacagcctggaccaccccagcccccccaacaacggccctacgggtacgaccaaaacagcaggtggacagtttgttag

SEQ ID NO: 136971 - DNA, 1011 bp, Artificial Sequence
  Description of Artificial Sequence: Synthetic coding sequence
atgcctatggggccggggggaatgaatcagtcaggtccacctccacccccccggtcccataacatgccttctgatggaatggtgggtggaggccctccagctcctcacatgcagaatcagatgaacggtcagatgcctgggcccaaccatatgccaatgcagggcccaggccccaatcagctgaatatgaccaactcttcaatgaatatgccgtctagcagtcacggatctatgggcgggtataaccattccgttccatcgagccagtcaatgcctgtgcaaaaccaaatgacaatgtcacaggggcagcctatgggaaactacggcccacggcccaacatgtctatgcagccgaatcaaggccccatgatgcaccagcaacccccctctcagcagtacaatatgccccaggggggaggccaacattaccaggggcagcagcccccgatgggaatgatggggcaggtgaatcagggcaaccatatgatggggcaaagacaaatcccaccttatcgcccgccacagcagggtcctccgcaacagtactctggtcaggaggattactatggcgaccaatacagtcacggcggccaaggccccccagaaggaatgaaccagcaatactaccccgacggacacaacgactacggctaccaacagccatcatatccggaacaaggctatgaccgtccttacgaggactcgtcacaacactactacgaaggcggaaactctcagtacggacaacagcaggatgcgtaccagggacctccccctcagcaaggttaccctccacagcagcagcagtacccgggtcaacagggctatcctggacaacaacagggctacgggccaagccagggaggccccggcccccagtatcccaattacccacaaggccagggccagcagtatggagggtaccggccaactcagcctggtcccccacaacccccccagcagcggccatatggatacgatcaaggccaatacggcaattaccagcaatag

SEQ ID NO: 136972 - DNA, 1188 bp, Artificial Sequence
  Description of Artificial Sequence: Synthetic coding sequence
atgctggatgataacaatcacctgatacagtgtatcatggactctcagaacaaaggtaagaccagcgaatgcagtcagtaccagcagatgttgcacaccaatttggtatacctggccaccatagcagacagtaatcagaacatgcagtccttactgcccgctcccccaacccagaatatgcccatggggccagggggtatgaaccaaagtggaccccctcccccaccgcgtagccataacatgccctccgatgggatggtaggagggggacctccagcgccacacatgcagaatcagatgaacggtcagatgcccggtccgaaccacatgccgatgcagggtccggggcccaaccaactcaatatgacaaactcatctatgaatatgccctctagctctcacgggtccatggggggctacaaccatagcgtcccttcctcacaatctatgcctgtccagaatcagatgacaatgtcccaaggccaacccatggggaactacgggccaaggcctaacatgagcatgcagccgaatcaagggccgatgatgcatcagcagccgccctcccagcagtacaacatgccccagggaggcggacagcactaccagggtcaacagcctcctatgggcatgatgggacaagtgaaccagggcaatcatatgatggggcagagacagattcctccataccggcctccccagcagggtccgccgcagcagtactctgggcaggaggactactacggcgatcaatactcccacggcggacagggcccccctgaggggatgaatcagcagtattatccggatggacataatgactatggctaccagcagccgagttacccggaacaggggtatgatcgcccctatgaagattcatcccagcactactacgaaggcggcaactcgcaatacggacagcagcaggacgcctatcaggggcctcctccgcaacaggggtatcctcctcaacagcagcagtaccctggacagcagggttaccctggacaacagcaaggctacggccctagtcagggcggtccaggacctcagtatcccaattacccccagggacaggggcagcaatacggtggatatcggccaactcagcctggccccccccagccgccacagcagaggccctacggatatgaccaaggccagtacgggaactaccagcagtag

SEQ ID NO: 136973 - DNA, 1008 bp, Artificial Sequence
  Description of Artificial Sequence: Synthetic coding sequence
atgcttcataccaacctggtttacctggcgaccatagcagactctaaccaaaacatgcaaagcctccttccagccccccctacccagaatatgcccatgggccctggcgggatgaatcaatctggaccccctcctccacctcgatctcacaacatgcctagcgatggcatggtggggggaggtccacctgctcctcacatgcagaaccagatgaacggacagatgcctggcccaaatcacatgcctatgcagggtcctgggccgaaccagctcaatatgactaattccagcatgaatatgcccagctcatcccacggctctatgggcggctataatcattctgtaccatcctcccagtccatgcccgtgcagaatcaaatgaccatgtctcagggccaacctatgggcaattatggtccccgtcccaatatgtccatgcagcctaaccagggaccgatgatgcaccagcagccacccagtcaacagtacaacatgcctcagggcggcggccagcactaccagggacagcaaccccccatgggcatgatgggccaggtaaaccaaggaaatcatatgatggggcagaggcagatccccccatatcggcctccacaacaaggcccccctcagcagtactcagggcaggaggattactatggggatcagtacagccacggaggtcagggaccccccgaaggcatgaatcagcagtactatccagacggtaattctcagtacggacagcagcaggacgcttaccagggtcctccaccccagcaggggtatcctccacagcagcagcagtaccccgggcaacaggggtaccctggacagcagcaaggatatggccctagccagggtggacctgggcctcagtaccccaactacccccaagggcagggacagcagtatggaggctacaggcctacccagccaggacctcctcagcctccacaacagcggccctatgggtacgaccagggccagtacggtaattatcagcagtag

SEQ ID NO: 136974 - DNA, 1008 bp, Artificial Sequence
  Description of Artificial Sequence: Synthetic coding sequence
atgctccatacaaatctggtgtatctcgctacgatcgctgattcaaaccagaatatgcagtctctgctacctgctccacccacccagaacatgcctatgggccctggcggtatgaaccagtccgggccacctcctccacccagaagccataacatgccttccgatggaatggtggggggtggtccgcccgctccacacatgcagaatcagatgaatggacagatgcccggccctaaccatatgcctatgcagggtccaggtcctaatcagctgaacatgaccaactcatcgatgaacatgccctccagctctcacgggtctatgggtggatataatcactctgtgccgagcagccagtctatgccagtccagaatcaaatgactatgagccagggtcaacccatgggcaactatggcccacgcccaaatatgtccatgcagcccaaccagggtccaatgatgcaccaacaaccgccatcccagcaatacaatatgcctcaaggaggaggccagcactaccaaggacagcaaccgccaatgggcatgatgggccaggtgaatcaaggcaaccacatgatgggccagcggcagatacctccgtaccgaccccctcagcaaggtcccccccagcagtactcagggcaagaggactactatggcgaccaatatagccatgggggccagggcccgccagagggaatgaatcagcagtattaccctgatggaaactcccaatacggtcagcagcaggacgcctatcagggccctcccccacaacaggggtatccaccgcagcagcaacaatacccaggacagcaaggctatcccggacagcagcaaggttatggcccaagccagggcggccctggaccccagtatcccaactacccgcagggccagggacaacaatacgggggctatcgacccacccaaccaggccccccccagcctccccaacagcggccatacggctatgaccagggccaatacggtaactatcagcagtag

SEQ ID NO: 136975 - DNA, 567 bp, Artificial Sequence
  Description of Artificial Sequence: Synthetic coding sequence
atgaatggggacgataccttcgcaaagcggccacgggacgacgctaaagcgtccgagaagcggtcaaaggcttttgacgatatagctacatacttcagcaagaaagagtggaaaaaaatgaagtatagtgagaagatctcttacgtgtatatgaagagaaattataaggccatgaccaaactcggcttcaaggtcaccctcccccctttcatgtgcaataagcaggcgaccgattttcagggaaatgactttgacaacgatcataacagaaggatccaggttgaacacccacagatgacttttggaagactacacaggattattcccaagattatgcccaaaaaacccgcagaagacgagaatgactctaaaggagtgtccgaggcttccggacctcagaacgacggtaaacagttgcacccacccggcaaagccaatataagcgagaagatcaacaaaaggtccgggccaaagcgaggtaaacatgcctggacacatcggctgcgggagaggaagcaactggttatctatgaggagatcagcgaccccgaagaagatgacgaatag

SEQ ID NO: 136976 - DNA, 672 bp, Artificial Sequence
  Description of Artificial Sequence: Synthetic coding sequence
atgaacggtgacgatgccttcgcaagacgcccaacagtgggggctcagatccccgaaaagatccaaaaagcctttgatgacatcgctaagtactttagtaaggaagagtgggaaaaaatgaaagcttcagaaaaaattttctatgtctatatgaaacgaaaatatgaggctatgacaaagctcggattcaaagccacacttccacctttcatgtgtaataaacgagccgaggatttccaagggaacgacctggacaatgatccaaatcggggaaaccaggtcgaaaggccgcagatgacgttcggcaggctgcagggcatttcgcccaagatcatgcctaagaaaccggccgaagaaggcaacgactcagaggaggtgcccgaagcctcagggccacaaaatgacggaaaagaactgtgtcctcctggtaagcccacaacatcggaaaaaatccatgaaagatcaggaaaccgcgaagctcaggagaaggaggaacgccggggcaccgcccatcgctggagttctcagaatacccataatatagggagatttagtctgagtacttctatgggcgcggtgcacggaacaccgaagaccattactcataaccgtgatcctaagggggggaatatgcctggacctaccgattgcgttagagagaattcgtggtag

SEQ ID NO: 136977 - DNA, 567 bp, Artificial Sequence
  Description of Artificial Sequence: Synthetic coding sequence
atgaatggcgatgacgccttcgcacgccgaccaacagttggcgcccagatcccggagaaaatccaaaaagctttcgatgatattgcaaagtatttttccaaagaggaatgggagaagatgaaagcctctgagaagatcttttatgtgtatatgaaacgcaagtatgaagccatgactaagctgggattcaaggccacgttgccaccctttatgtgtaataagcgcgctgaggacttccaggggaatgacctggacaatgacccaaatcggggtaaccaggtagagcggccccagatgacattcgggaggcttcagggcatatcaccaaagatcatgcccaagaagcctgccgaggaaggcaatgactccgaggaggtccctgaggcaagcggcccgcagaatgatgggaaggaattgtgtccacctgggaaacccacaaccagcgaaaagattcatgagaggtccggcccaaagagaggtgaacatgcttggacccatcggctccgcgaacggaagcagctggtaatctacgaagagatctccgatcccgaagaggatgacgagtag

SEQ ID NO: 136978 - DNA, 567 bp, Artificial Sequence
  Description of Artificial Sequence: Synthetic coding sequence
atgaatggagatgatacattcgccagacgcccaaccgtcggtgcacaaatccctgagaagatccagaaagcctttgatgatattgctaagtacttttccaaggaggaatgggaaaagatgaaggtatctgagaagatcgtatacgtttatatgaaacgaaagtacgaggccatgaccaagctgggcttcaaagccattttgccaagctttatgcgtaacaaaagagtgactgattttcagggtaatgactttgataatgatcccaataggggcaatcaggtccagcgcccccagatgacattcggtcgactccagggaatcttcccaaagattatgccaaagaagcctgccgaagaaggtaatgttagcaaggaggtgccagaggcgagcggacctcagaacgatggaaaacagctttgtcctcccgggaaacctaccacatcagagaaaatcaatatgatctccgggcccaagaggggggaacatgcatggacgcaccgtctgagggaaagaaagcaactggtcatttacgaagagatatcagaccccgaggaggacgatgagtag

SEQ ID NO: 136979 - DNA, 513 bp, Artificial Sequence
  Description of Artificial Sequence: Synthetic coding sequence
atgaacggggatgacacgttcgctaggaggcccactgtgggcgcccagatccccgaaaagattcagaaggccttcgatgacattgcaaagtatttttctaaggaggaatgggagaagatgaaagtgagcgaaaaaatagtatacgtctacatgaagcgtaagtacgaagccatgacaaagctgggttttaaagcaattcttccgagttttatgcgaaacaagagggttaccgatttccagggaaacgactttgataacgaccccaatagaggtaaccaggtacagaggccccagatgacatttggaagattgcaaggaattttccccaagatcatgccgaaaaagcccgccgaggaaggcaatgtgtccaaggaagtgccagaggctagcggccctcagaacgacggcaagcagctctgccccccagggaaaccaacaacttcggagaaaattaatatgatcagcggtgtgctgcagaggtattgtcggtttggtagccggcccctgcagtag

SEQ ID NO: 136980 - DNA, 303 bp, Artificial Sequence
  Description of Artificial Sequence: Synthetic coding sequence
atgtactccctgtcagtgcagcgaccccagatgacatttggtaggttacagggtatatttcctaagattatgccaaagaagccggctgaggaggggaatgtatctaaagaagtcccagaagcatctggaccccagaacgatgggaagcagctgtgtcctccaggcaaacccactaccagcgaaaaaattaatatgatatcaggaccgaaaagaggcgagcacgcttggacgcaccggctgagggagaggaaacagttagtcatctacgaagaaatcagtgacccagaagaggacgacgagtag

SEQ ID NO: 136981 - DNA, 462 bp, Artificial Sequence
  Description of Artificial Sequence: Synthetic coding sequence
atgaatggggacgatgcttttgcaaggcgaccccgagatgacgcgcagatctctgagaagctcagaaaagctttcgacgacatcgcaaagtacttctctaagaaagagtgggaaaaaatgaaatctagtgagaagatagtctacgtgtatatgaagctaaattacgaggttatgaccaaactaggatttaaggtgacccttccaccttttatgagatccaagcgagctgcagattttcacgggaatgacttcggcaatgatcgtaaccataggaatcaggtggaacggccgcaaatgaccttcgggtctctgcaacgaatttttcccaaagaccctaaagggggtaatatgccaggccccaccgactgcgttcgtgagtcatcttggtggttcatgaagcgctctgccacactgcggaagatgacatctaacagccccagagggtatgacacttgtccctag

SEQ ID NO: 136982 - DNA, 567 bp, Artificial Sequence
  Description of Artificial Sequence: Synthetic coding sequence
atgaacggagatgacgcgtttgcgaggcgaccacgggacgacgcccagatttctgaaaaactgagaaaggcgtttgacgacatcgccaaatacttttccaagaaagagtgggagaaaatgaagtcctcagagaagatcgtatacgtctacatgaagttgaactatgaggtcatgactaagctgggcttcaaggtcactcttccccctttcatgcgctctaaaagggccgctgatttccacggtaacgattttggaaacgataggaaccatagaaaccaggttgagcgcccccaaatgacatttgggagtctgcaacgaatattccccaaaattatgccgaagaagccagccgaagaagaaaacggtttgaaagaggtccctgaggcttctgggccccagaacgatgggaaacaactctgccccccaggcaacccctccactctggagaaaatcaacaaaacatcaggtcctaagcggggcaaacacgcctggacgcacaggttgcgcgaacggaagcagctggtcgtgtacgaagagatttccgaccctgaggaggacgatgaatag

SEQ ID NO: 136983 - DNA, 1992 bp, Artificial Sequence
  Description of Artificial Sequence: Synthetic coding sequence
atggggcctctgcgtgagagtaaaaaagagcatcgggtccagcaccacgacaaggagatcagccggtctaggatcccacgtctcatactccggccccatatgccgcagcaacagcacaaagtgagccctgctagtgagagccccttttccgaagaggagtctagggaattcaacccttccagcagtggaagatcagctagaacagtctcatctaactccttctgctctgatgatactggctgcccttcctcccagtctgttagtcccgttaagaccccttccgacgctggtaattcccccatcggtttctgcccaggctccgatgagggcttcacgcgaaagaagtgtacaataggcatggtgggggaagggtcgatccagtccagccggtacaagaaagagtccaaaagcgggctggtgaaacccgggagtgaggctgacttctcctcctcatcatctactggcagtatcagtgcacccgaggtgcacatgtccacagctgggtccaagagatcttctagctctcggaatagaggaccccacggcaggtcaaatggcgcctccagtcacaagccaggtagtagcccatccagtccccgcgagaaagacctgctcagtatgctttgtagaaatcagttgtctcccgtgaacatccaccccagttacgccccaagctcaccaagctcctctaacagcggcagctataagggaagtgattgctcccctattatgcggaggtctggacgctacatgagttgcggagaaaaccatggcgttcgaccccccaatcctgagcagtacttgacccctctgcagcagaaagaggttaccgttaggcacttgaagaccaaactgaaagagtctgagcgcagactccatgaaagagagagcgaaattgtggagttgaagtcgcagttggcgagaatgcgtgaggattggatcgaagaggaatgccatcgtgtggaggcgcaactggccctcaaggaggcccgcaaggagatcaaacagttaaagcaagtgatcgagacaatgcggagttcactagctgataaggacaaaggtatacaaaagtatttcgttgatattaatatccaaaataagaagctagagagtctacttcagagcatggagatggcccacagtggttccctgcgagatgaactttgtttggactttccatgtgatagccccgaaaagtccctgaccctcaatccgccgctggacactatggccgatggcctgtccctggaggagcaggtcacgggcgagggtgctgaccgggaattgctggtgggcgacagcattgccaactcgaccgacctttttgacgagattgttacggccacgaccaccgagagcggtgatctggagctagtacatagtacccccggagccaatgtcctggaacttctacctatcgtcatgggtcaagaggaagggagcgtggtggtcgaacgtgccgtgcagaccgatgtggtgccttactcacccgctatctcagaactgattcagtccgttctgcagaaactgcaagacccttgtccatcgagcctggcctcaccagatgagagtgaaccggactctatggaaagcttccccgaatcattatccgcgcttgtggttgacctcacgccgaggaatccaaatagtgccatactcttatcacctgtcgaaacaccttacgcaaatgtggatgccgaagttcatgccaataggctgatgagggagctcgactttgccgcctgcgtcgaggagagactggacggcgtcatccctctggccagagggggagtggtgcgccagtactggagcagcagcttcctagtcgatcttctcgcggtagcagcccccgttgtcccaactgtcctgtgggcattttcgacacaacgtgggggcacagatcccgtgtacaatatcggagccttgctgaggggatgctgtgtggtagccctgcactccctgcgccgcaccgccttcagaatcaagacttag

SEQ ID NO: 136984 - DNA, 1983 bp, Artificial Sequence
  Description of Artificial Sequence: Synthetic coding sequence
atgtccaatttcgagaaagagcaccgcgtgcagcaccacgacaaagaaattagtcgctctcggattcctcggctgattctgcggccacatatgccacagcagcagcacaaagtgtcaccagcaagcgagtcacccttcagtgaagaggaatcaagggaattcaacccttcttcaagtgggcgcagtgcacggacagtcagcagcaactctttttgttctgatgacactgggtgcccttcttctcagtcggtgtctccggtgaagaccccctcggacgctggtaattcccccatcggcttttgtcctgggtcagatgagggcttcacaagaaaaaaatgtaccatcgggatggtgggtgaagggagcatacaatcaagtcgctataagaaagagtcaaaatcgggcttggtgaagccaggatctgaagctgacttctcctcctcaagtagtactggctcgataagcgcccctgaagtgcatatgtccactgcagggagcaagaggtcttcgtcttcacgtaaccgaggcccacacggccggtcaaatggcgcctcatcccacaagccgggcagtagcccttctagtcccagagagaaggacttgctgtcaatgctgtgcaggaaccaactgagccccgtcaatatccatccttcttatgcaccatcctctcccagcagcagcaactcaggctcttacaagggtagcgactgctcccccattatgcgacggagtggacgctacatgtcatgcggggaaaatcacggagttcgcccccccaacccggagcaatacctgactccactccaacagaaggaggtgacagtcagacacctcaagactaagctgaaggaaagcgagcgccgcctacatgaacgcgagagtgagatcgtggaactaaagagccagctcgctcgcatgagggaggattggatcgaagaggaatgtcatagggtagaagcccagctggcccttaaagaagccagaaaggagattaagcagctgaaacaggtgattgagacaatgaggtcttctctcgctgacaaggacaaaggaatccagaagtattttgtggacatcaatatccaaaataagaagctcgagtccctgctccagtccatggaaatggcccattccgggtccttgcgcgatgaattgtgcttggactttccttgtgactcacctgaaaaatctcttaccctgaatccccctctcgatacaatggccgacggcctgtccctggaggagcaggtaacaggggagggagctgaccgggagctgctagtaggagacagcattgccaacagtaccgatttgtttgatgagatcgtgacggccaccactactgaatctggagacctggaactcgtacattccacccccggcgcgaacgttctggagcttctgccaatcgtgatggggcaggaagagggttctgtggtagtggaacgggctgttcagactgatgttgttccgtactcccccgccatcagcgaactgatacagtccgtgctccaaaaattgcaggacccttgcccgtccagcctcgccagtcctgacgagagcgagccagatagtatggaatcgtttcctgagagtctgtccgccttagttgttgacctgacacctcggaatccaaactccgccattctcttatcccctgttgagacaccttacgcaaacgtagatgcggaagtgcatgctaatcgcttgatgcgggagttggacttcgcagcttgcgtggaggaacgactggatggtgttatccctcttgcacgagggggagtggttaggcagtactggtccagctctttcttggtggacctcctggcagtggccgcacccgtagtgcctaccgttctctgggccttctctacccagcggggggggacggaccccgtctataatataggcgctctgctgcggggctgctgtgtagtggcgctgcacagcctcaggaggaccgcatttagaatcaagacctag

SEQ ID NO: 136985 - DNA, 1635 bp, Artificial Sequence
  Description of Artificial Sequence: Synthetic coding sequence
atggttggcgaaggttctattcaatctagccggtacaaaaaggaaagcaaaagtggcctcgtgaaaccaggctcggaggccgatttttcatcgtcgtcttccacggggtccatctctgcccctgaagtccatatgtctactgctgggtctaagcgctcatcctcatctcggaatcggggcccacacggaaggtccaacggagcctcttctcacaaacctggctccagcccttccagtcccagagaaaaggacctacttagtatgttatgtaggaaccaactgtctcctgtgaacattcacccttcctacgcaccaagctctccatcctcttccaatagtgggagctataaaggctcagattgcagccccattatgcggcgatctgggcgctacatgtcgtgtggagagaatcatggggtgaggccccccaatcctgagcagtatctcactcccctccaacagaaggaagtaaccgtacggcacctgaagaccaagctcaaagagtcggagcgccgcctgcatgagcgggaatccgagatcgtcgagctgaagagccaactggcgaggatgagagaggattggattgaggaagaatgtcatcgggtggaagcccagctagcactgaaagaggccaggaaggagataaagcaacttaaacaggttatagagacgatgcgatccagcctcgccgacaaagacaagggcatccagaaatactttgtagacatcaatattcagaacaagaagctggaatcactcctgcagtctatggaaatggctcatagcggtagcctgagggacgaactgtgcctggattttccctgcgactctccggagaaatcactcacacttaacccccctctagacacgatggctgacggcctatctcttgaggagcaggtgactggggaaggggccgatagagagctccttgtgggcgactccattgcaaattctaccgaccttttcgatgagatcgtcaccgccactactacagagtcaggagatcttgagctggtacattcgacacccggtgcaaacgtcctggagctgctgccaatcgtaatggggcaggaggaaggatctgtcgttgttgagcgggctgtgcaaacggatgtagtgccttacagtcccgccatatcggagctcattcagagcgtgctgcagaagctgcaggacccctgccccagctcactcgcatcgcctgacgaatccgagccagactcaatggagagtttccccgagtctctgagtgccctggttgttgatctaacaccacggaaccctaactccgcgattctcctgagtcccgtagaaacaccatacgctaacgtcgatgcggaggttcacgctaaccgcctcatgcgagaactagacttcgcagcatgtgtggaggagcggctggatggcgtgattcctttagcacggggcggagtagtgaggcagtactggagttccagcttcctcgttgatctgctggcggtggccgcgccagtggtgccaaccgttttgtgggccttctccacgcagcggggcggtactgatcccgtttacaatatcggggccctgctacgcggatgttgtgtggtggcgctccatagcctgcgccgaaccgcctttcggatcaaaacatag

SEQ ID NO: 136986 - DNA, 1992 bp, Artificial Sequence
  Description of Artificial Sequence: Synthetic coding sequence
atgggcccactacgggaaagcaaaaaggaacatcgcgtccagcaccatgataaggaaatctctcgctcacgcatcccaaggttgatcctcagaccccatatgccacagcagcagcataaggtgagtccagcttcggagtcacctttcagcgaagaagagtcacgggagtttaatcctagctcctctgggcgctcagctcggacagtgagttccaattcgttttgcagcgatgataccggctgcccatcttcacagagtgtgagtcccgtgaaaacaccatccgatgccggcaattctccaatcggcttttgccctggctctgacgaagggttcacacggaaaaaatgtactatcggaatggtgggggagggatccatccagtctagccgctataaaaaggaatccaagtcagggctggtgaaacccggcagcgaggcagacttctcatcgtcttcatctactggcagcatctccgcacctgaggttcatatgagcaccgctggatccaagaggagctctagtagtcggaacagaggcccacacggccgctcaaacggcgcctcaagccacaagcccggtagtagcccctcctcccccagggagaaggaccttctgagcatgctctgcagaaaccaactgtctcctgtgaacattcacccctcctacgcccctagttctccttccagttctaacagcgggagttacaagggatcggactgcagtccaattatgagaaggagtggtcggtacatgtcttgtggagaaaaccatggagttcgaccacccaacccagagcaatacctaactcccctgcagcagaaagaagttacagtgcgtcatttgaagactaagttgaaagagtcagagcggaggcttcatgaacgggagagcgagatcgtcgagcttaagtcacaactggccagaatgcgcgaagattggatcgaggaggagtgccaccgcgttgaagctcaacttgctctgaaagaagctaggaaggaaatcaagcaattgaagcaagtgatcgaaactatgcggagctctctcgctgacaaggacaagggcattcagaagtactttgttgatattaatattcagaataagaaactggaaagcctgctgcaaagtatggagatggcacacagcggcagcttgagggatgagctgtgtttggacttcccctgcgactccccagagaaaagcttgaccctcaatccccctctagacacaatggcagatggactgtctctggaggagcaggttactggggagggggcagatagagaactcctcgtcggggatagcattgcgaattccacggatctgttcgacgagattgtcactgccacaaccacagagtcaggcgatctggaactggttcactcaacacctggcgctaacgtgcttgagctactgccaattgtgatgggccaggaagaagggtcagtggtagtggaacgcgcagtgcagactgacgtcgtaccctacagccctgccatcagtgagttaatccagagcgtcttacagaaactgcaggatccctgccccagtagtttggcctctcccgatgaatctgaacctgactccatggagtcgtttcccgaatctctctccgccctagtggttgacctgaccccacggaatcccaattccgccatactgctcagtccagttgagaccccatacgctaacgtcgatgccgaggtccacgctaaccggctcatgagggaattggacttcgcagcatgtgtcgaggaacgcttagatggggtcattcctctagcccgtggaggtgttgttagacagtattggagctctagcttccttgtcgatttgttggctgtggcagcaccagtggtgccaaccgttctctgggcatttagcacacagagggggggtaccgatcctgtatacaacatcggggctctcctccgcggatgttgtgtggtagcgctgcattcactgcggagaacagccttccggataaagacttag

SEQ ID NO: 136987 - DNA, 1989 bp, Artificial Sequence
  Description of Artificial Sequence: Synthetic coding sequence
atggggccactcagggaaagtaaggagcatcgggtacagcaccacgacaaggagatatcaagatcacgaatcccaagactcattcttcgtccacacatgccacagcagcagcacaaggtgtcgccagctagcgaaagccccttcagtgaagaggaaagtagggaatttaaccctagtagttccggccggagcgcccggacagtgagctcaaactcattttgtagcgatgacaccggatgtccaagtagccaatccgtgagcccggtcaaaaccccgagcgacgcagggaatagtccgataggattctgccccggttcagatgaaggctttacgagaaagaaatgcacaatcggtatggtgggggaggggagcatccagtcctctagatataaaaaagaatcaaaaagcgggcttgtaaagccaggctcagaggctgacttctcctcaagcagctccaccggctccatcagcgcccctgaggtccacatgagcactgcgggcagtaaacgatcctcctcaagtagaaatcggggcccgcacggccggtctaacggcgcatcttcccataaacccggcagctccccgtcctcccccagagagaaggacctgctgtctatgctgtgtaggaaccagctctcacccgtgaacatccacccctcctacgctccctccagtcctagctcatccaactctgggagttacaaaggctctgactgttcaccaatcatgcgaagatccggtagatacatgtcctgtggtgaaaaccacggcgtgcgcccacctaatccggagcagtatctgacacccctgcagcaaaaggaggttacagtcaggcatttgaagactaaactgaaggaaagcgagagacgtctgcacgaaagagagtcagagatcgtggagctgaaatctcagctggccaggatgagggaggattggatcgaggaagagtgtcaccgagtggaggctcagctggctctgaaagaagcgaggaaagagataaagcagctgaagcaagtgattgagaccatgcgaagtagtcttgccgataaagacaagggaatccagaagtatttcgtggacatcaatatccagaataagaaactggaatccctgctgcaatctatggagatggcccactctggcagcctcagggatgagctttgtttggacttcccttgtgattcccccgagaaaagcttaacgcttaatcccccattagacaccatggcggatggactcagtttggaggagcaggtgaccggggagggggccgatcgggagctgcttgtcggggactccatcgcgaattcaaccgatctgttcgacgaaatcgtcacagctaccaccactgagagtggtgacctagaattggtgcacagcacccctggggccaatgtcctggagttgctgccaatcgtgatgggccaggaggaaggttccgtcgtggtcgaacgggcagtgcagaccgacgttgtaccatattcgcctgcgatcagtgagctgatacagtcggtactccagaagcttcaggatccctgtccatcaagcctcgcttccccagatgaatccgagcctgacagcatggagagttttccggaatccttaagcgccttggtcgttgatctgaccccacggaaccctaacagcgccattctgctgtctcctgtggaaactccatatgccaatgtggacgctgaagtgcacgctaaccggttaatgcgggaactggactttgcagcctgtgtagaagagcgtctcgacggcgtcatccctctggcgcgcgggggcgttgtgcgacaatattggtcttcaagctttcttgtcgacttactggctgttgcagcacctgtggtaccaacggtgctgtgggcttttagcacgcagcgcggcggaaccgacccagtgtacaacattggagctctgctcagaggatgttgcgtcgttgcactgcactctctccggaggacagcgttccgaataaaaacatag

SEQ ID NO: 136988 - DNA, 1992 bp, Artificial Sequence
  Description of Artificial Sequence: Synthetic coding sequence
atgggcccattacgggaatccaagaaagagcatagggtgcagcatcacgacaaagagataagcaggtcacggattccccggcttattcttcggccccacatgccccagcagcaacataaggtgtcgcctgcctcagagtccccgttcagtgaagaggaatccagggagtttaacccttcctcatctggcaggagcgcccgaaccgtttcctccaattcattttgtagtgatgatacgggttgtcctagtagccagagcgtctcaccagtgaaaactcctagtgatgccgggaattctccaatcggtttctgtccaggctctgatgagggtttcaccagaaaaaagtgcacaatcgggatggtgggagaaggctctatccagagttctcggtataaaaaggaatcgaaatcaggactggtgaaacctggcagtgaagcggacttcagtagtagctccagtactgggagcatctccgctccagaggtgcacatgagtactgcgggcagcaaacggagctcctcctcaagaaacaggggcccacacggccggtctaatggagcgtcatctcataaacctggctcgagcccaagttcgccccgcgagaaggatctgctcagcatgctctgccgcaaccagttatcgcctgtgaacatccatccgtcttatgccccttcttcgccgtcctcttccaactctggcagttacaaggggagcgattgttcccccataatgcgccgtagtggtcggtacatgtcatgcggcgaaaatcatggcgttcgaccccccaaccccgaacagtacttgacccctcttcagcagaaagaggttaccgtcaggcacttgaagactaaactgaaggaaagtgagcggagactacatgagagggaatcggagatcgtggaattgaaatcccaactggcaagaatgagagaggactggatagaggaggagtgccaccgggttgaggcacaactcgcactaaaggaagctaggaaagagatcaaacaactgaagcaggttattgagactatgcgttcctcccttgcagacaaagataaaggcattcagaaatattttgtcgacatcaacattcagaataagaaactggaaagcctccttcagtccatggagatggcccatagtgggagcctcagagatgagttgtgccttgattttccttgtgacagccctgaaaaatcactgacactgaatccgccactggacacaatggctgatgggctttcactagaggagcaggttaccggagagggagccgatcgtgaactcttggtaggggacagcattgccaattccaccgatctgttcgacgagatagtaacagcaaccactaccgagtctggagatcttgagttggtgcattctacaccaggtgctaacgttctggagctgcttccaatagttatggggcaggaagaggggtccgtggtggtggagcgggctgttcaaactgacgtcgtgccatatagccccgctatatctgaactgattcaaagtgtgcttcagaagctccaggatccttgcccttccagcctggcttcacctgacgaatcggaacctgactccatggaatcattccccgagagcctttccgctctcgtagtggaccttaccccccgcaacccgaactctgcgattctgctgtcgccagtcgagaccccttacgctaacgttgatgccgaagttcatgctaaccgcctcatgcgcgagctggattttgccgcgtgcgtagaagaacgtttagacggagtgatccctctggcccggggaggggtggtgaggcaatactggagctcatccttcctggttgatctactggcagtggccgcccccgtcgttcccacggtcctctgggcgttctccacacagagagggggcactgatcctgtatacaacatcggcgccttgctacgcggctgctgtgttgtcgccctgcatagcctacgccggactgcttttcggatcaagacatag

SEQ ID NO: 136989 - DNA, 1992 bp, Artificial Sequence
  Description of Artificial Sequence: Synthetic coding sequence
atggggcctctgcgagagagcaaaaaagaacatcgggtacagcaccatgataaagagatatcccgctcccgcattccccgtcttattctccgcccacacatgcctcaacagcagcacaaagtgagtccagcatccgaatctccgttttctgaggaggaaagccgggagtttaacccatcctcctccggacgcagcgcaagaaccgtatccagcaattcgttctgctctgatgacacaggatgtcctagcagccaatccgttagccccgtaaagacccccagcgacgcaggtaatagcccaattggcttttgcccaggatccgacgagggttttacccggaaaaagtgtactatcgggatggtgggggagggctcaatacagtcctctcgctataaaaaagagagcaagagtggcttggtgaagccaggctctgaggctgacttttcctcttcatcttccaccggttcaatcagtgccccagaggtccacatgtccacagcagggtccaaaagaagcagctccagccgaaatagagggccacacgggagatctaatggtgcaagttcgcataaacctggatccagccctagcagtcctcgggaaaaagatcttctgtccatgctatgcagaaatcagttaagccccgtcaacattcatccctcatacgctccatcatctccttcctcatcgaactccggttcctataaaggctctgattgtagtccaataatgagacgtagtggccgctatatgtcgtgtggtgaaaatcacggagtgcgcccacccaatccagaacagtacctaacgcccctccagcagaaagaggtaactgtgagacacctgaaaacgaagctgaaagagtcagagcggagactccatgagcgggaatctgagatcgtcgaacttaaatctcagcttgcccggatgcgagaggactggatcgaggaagaatgccacagagttgaagcgcagctggctttgaaagaagccaggaaagagataaagcagttgaagcaggtaatcgaaaccatgaggagctccttggcagataaagataaagggattcagaagtactttgtcgacattaatattcaaaacaaaaaattggagagccttctccagtcaatggagatggcgcactcaggctctctgagagatgagttgtgcctagacttcccctgcgactcccccgaaaagtccttaaccctcaatccaccccttgataccatggccgacggccttagtctggaagaacaggtgacgggggagggggcagacagagaactgctggttggggattcaatcgccaattccactgacctgtttgatgagattgtgaccgctaccactaccgagagcggggatctggagctcgtccacagcacgccaggggccaatgttcttgaactactgcccatagtcatgggacaggaggagggatccgttgtggtcgaacgcgccgtccaaactgacgtggtcccctactcacccgccataagcgagttaatccagtcagtcctacagaaactgcaagacccatgcccgtccagcctggcttctccagatgagtcggaacctgacagtatggagtcgtttcccgaaagtctgagtgccctcgtcgtagatttaaccccgcgaaatcctaactccgcgattctgctgtcacctgtggaaacaccgtacgccaacgtagatgcagaggtgcacgccaaccgcctcatgcgagaactggactttgctgcgtgcgtggaggagagactggatggtgtgatacccctagcccgcggcggagttgtccgccagtactggtcttcatcctttctcgttgacctccttgctgtcgctgcccccgttgtgccaaccgtcctctgggctttctctacccaaaggggaggaaccgaccctgtttacaatatcggagcccttctcagggggtgctgtgtggtcgccctgcattcccttcgtaggactgcctttagaataaaaacctag

SEQ ID NO: 136990 - DNA, 1992 bp, Artificial Sequence
  Description of Artificial Sequence: Synthetic coding sequence
atgggaccactccgggagtcaaaaaaggaacacagagtgcagcatcatgataaggaaatctcaaggtcacggatcccgagactgatcctgcgtccccatatgccccaacagcaacataaagtgagcccagccagtgagagtcccttcagcgaggaggaatcaagagagtttaacccttcttcatctgggcgcagcgctcggactgtgtcttcgaactctttctgttccgacgacaccggctgccctagttctcagagcgtttccccggtcaagactccctctgacgccggcaacagtcctattgggttttgccctggatctgacgagggcttcacgaggaaaaaatgcaccattgggatggtcggcgaagggagcattcagtcgagtaggtataagaaggaatctaagagcggactggtgaagccaggctcagaggcagacttttcatcaagttccagcaccgggagtatttcggcaccggaggtgcacatgtcaaccgccggtagcaagcgatcttccagttcgagaaacaggggtccccacggcagaagcaacggcgcctcctcacacaaaccgggcagcagcccgtcttcccctcgcgagaaagatttgctatctatgctttgtcgaaatcagctcagtcccgtgaatattcatccttcttacgctccgagcagcccttccagtagtaatagcggcagctataaaggcagtgattgctccccaataatgaggagatccggtcggtatatgtcttgcggggagaatcatggcgttcggccccctaatccagagcagtacctgactcctctgcagcaaaaggaggtaaccgttagacacctgaagaccaaactgaaagaatcagaacggaggttgcatgagcgcgaatctgagatagtcgaattgaagtctcaactggctcgcatgcgagaggactggatcgaggaggaatgtcatcgcgtggaagcacagttggcccttaaggaggcacgaaaggagataaagcagttaaaacaagtgatcgagacgatgcgatcttccctggcagataaagataaagggattcagaagtacttcgtggacattaatatacaaaataaaaaactcgagtctctgcttcaatctatggagatggcccactccggaagcttaagggatgagctgtgcctcgactttccatgtgatagtcctgaaaaatccctgactcttaatccacctctcgataccatggcggacgggctgtccctcgaggaacaggtcacaggagaaggagcagaccgggagctgctcgttggagattccatagcgaacagtaccgacctcttcgatgagattgtgactgcaaccaccacggaaagtggggacctcgagctggtgcatagcacaccaggcgccaacgtgctggagctactgcccattgtcatgggtcaggaggagggctctgtggtagtcgagagagcagtgcaaaccgatgttgtcccgtatagcccagcgatatccgaactgatccaaagcgttctccaaaagctgcaagacccctgtccatcgtcacttgcctcccccgacgagtcggagccagatagcatggaatcattccccgagtcactgtcggccctggtcgtggatctgacgcctcgaaatcccaacagtgcaattctgctctcgccggtggagaccccttacgccaatgttgatgctgaagttcacgccaaccggcttatgagggagctagacttcgccgcatgcgtcgaggagaggttggatggcgtcattccactggctagaggcggtgttgtccgccagtattggagctcctcgttcctggtcgacctgctggcggtggccgccccggtggtaccaacagttctctgggcgttttccacacagcgaggtggcacggaccctgtgtataacattggagcacttttgcgaggctgctgcgtcgtcgctttgcattcactgagaagaactgccttccgaataaagacttag

SEQ ID NO: 136991 - DNA, 1989 bp, Artificial Sequence
  Description of Artificial Sequence: Synthetic coding sequence
atggggccacttagggagagcaaggagcacagggtgcagcatcacgacaaggagatatcccggagtaggatacctcgactgatactgcggccccacatgcctcaacagcaacataaggtaagcccagcaagcgagtcccctttcagcgaggaagaatccagggagtttaaccccagcagcagcgggcgcagtgctagaaccgtgagctcgaacagtttctgttctgacgatacgggctgcccatctagccagagcgttagccccgtgaagactcccagtgacgccggcaattctcccattgggttctgcccgggtagtgacgaaggtttcacgcggaaaaaatgtaccataggaatggttggtgagggatccattcagtcctcacgttacaagaaggagagcaagtcaggtctcgtgaaacccgggtcagaggcagatttctctagtagttcatccaccgggtctatatcggcccccgaagtgcacatgtcaaccgcaggatcaaagcggtcatcctcttctaggaaccggggcccccatggaagatcaaacggcgcttccagccacaagccgggaagctcgccgtcgtcccccagggagaaggacttgctgagcatgttgtgcaggaatcagctgagcccagtgaacattcaccccagctatgccccctcaagtcccagctcttctaatagcggaagctataagggctccgactgtagccctataatgaggcgaagcggccgttacatgtcatgtggagaaaatcatggggttagacctccaaaccctgaacaatacctaacgcctctgcagcagaaggaggttaccgtgcggcatctgaagacgaaactcaaagaaagcgaaaggcgccttcatgagcgagagagcgaaatcgtggagctcaaaagccagctggccaggatgcgagaagattggatcgaagaggaatgccatagagtagaagcacagctcgcactgaaggaagcacggaaggagatcaagcagctgaagcaggtgattgaaaccatgcgaagcagtctggccgacaaagataagggcattcagaagtatttcgtcgacattaacatccaaaataaaaagcttgagagcctgctgcaatccatggaaatggcacacagcgggtccctaagagatgagctctgtctggacttcccctgtgacagccccgagaagtcattaactctgaaccctcccctggacaccatggcagacggcctgagtctggaagaacaggttactggagagggggctgaccgagagctgttggtgggtgatagcatcgctaacagcacagatctctttgatgagattgtgactgcaacaaccacagagtctggcgacttggagctcgttcactcgactccaggcgctaatgtgctggagctgcttcccatagtgatgggtcaggaagagggatctgtggtggtcgagcgagctgtccagactgatgtagtgccttatagccctgctataagcgagctgatacagagtgtgctgcagaagttacaagatccttgcccaagctcgctcgcttcgccggatgagtcagaaccagattccatggaatctttcccagagtcactgtctgcccttgtggtcgacctcacaccaagaaatcccaactctgccattctgctgtcacccgtcgaaacaccgtacgccaatgtcgacgcagaggtgcatgccaacaggctgatgagagagcttgacttcgcggcctgtgtggaagaaagactcgacggggtgatacccctggcccgggggggtgtggttaggcagtattggtcaagtagcttcctcgtcgatctgctcgctgtggccgctcctgtggtacccactgtcctgtgggctttcagcacccagcgggggggcaccgaccccgtgtataatatcggtgctctcctgcgcggctgctgtgtagtcgccctgcactcgcttagacggacagcgtttagaattaagacttag

SEQ ID NO: 136992 - DNA, 414 bp, Artificial Sequence
  Description of Artificial Sequence: Synthetic coding sequence
atgggaccactgcgggagtctaaaaaagaacatagagttcaacaccacgacaaggagatcagcagatcacgtatccctaggctcatactgagaccacacatgcctcagcaacaacacaaggtgtcccccgcatcggagagcccgttttctgaagaggaatcacgagaattcaacccttccagcagtggtcggtccgcacgcaccgtgtcaagtaattcattttgcagcgatgacacaggctgtccatcctcacagtctgtgtctcccgtcaaaactccgtcggatgctggcaacagccccattggtttctgcccaggtagcgatgaggggttcaccagaaagaagtgtacaatcgggatggtgggtgagggctctatccagagctctcgttataagaaagaatcaaagagctag

SEQ ID NO: 136993 - DNA, 231 bp, Artificial Sequence
  Description of Artificial Sequence: Synthetic coding sequence
atgggcccgctgagggaatctaaaaaggagcacagagtgcagcatcacgacaaggaaatttccagaagtcggatcccaaggttaatattaaggccacacatgccccagcagcagcacaaagtctctccagcttccgagtcgcccttttccgaagaagaatctagagaattcaatcctagtagctcaggccgctcggcgagaaccgtttcctccaactctttctgcagctag

SEQ ID NO: 136994 - DNA, 222 bp, Artificial Sequence
  Description of Artificial Sequence: Synthetic coding sequence
atgggtcccttgcgggagtctaaaaaagaacatagagtgcagcatcatgacaaggaaatctctaggtcaaggatcccccgcctcatcttaaggccacatatgccacaacagcagcacaaggtcagtccagcatccgagtcccctttctcagaagaggagtctcgggaatttaacccttcaagcagcgggagaagcgctcggacagtgtcatctaactcttag

SEQ ID NO: 136995 - DNA, 378 bp, Artificial Sequence
  Description of Artificial Sequence: Synthetic coding sequence
atggtgggtgaaggatccatccagtcctcccggtacaaaaaggagtcaaagtcaggtctggttaagcctgggagcgaggcagattttagctcctccagttccacgggctcaatctccgcccctgaggtgcatatgagcaccgctggcagcaagcggagctcctcaagcagaaatagagggccccatggccggtccaacggggcctcgtctcacaagccagggtcatcaccctcgagccccagagagaaggacttactcagtatgctatgtagaaaccaactaagtcccgtgaatatacatcccagttatgcccccagctcccccagctcatcgaacagcggatcctataagggctcggattgtagccctatcatgtag

SEQ ID NO: 136996 - DNA, 1635 bp, Artificial Sequence
  Description of Artificial Sequence: Synthetic coding sequence
atggtgggtgagggctcgatacagagctcacgttacaaaaaagaatcaaagagcggccttgtgaaaccgggatccgaagcagacttttcttcaagttctagtacagggtccatctcggctcccgaggtacatatgtctactgctggaagcaagcggagttcctcatctagaaaccgggggccccacggaagaagcaacggagcatcgagccacaaaccaggctcgagccccagcagcccgcgcgagaaagacctcctgtccatgctgtgcaggaatcagttgagcccagtcaatatacacccatcttacgccccctcctccccctcatctagcaattcgggatcctacaaaggaagcgactgctctcccataatgagacggagtggccggtacatgtcctgtggggaaaatcacggcgtcaggcctcccaatcctgagcaataccttactccactccagcagaaggaagtcaccgtacgtcacctcaagactaagctgaaggaatccgagcggaggctgcatgagcgggagagtgagatcgtggaattgaagagtcaactcgcaagaatgagggaagactggatcgaggaggagtgtcacagagtggaagcccagctggctctaaaagaagctaggaaggagatcaagcaattgaaacaagtgatcgagacgatgcgctcttccctcgcagacaaagacaaaggcattcagaagtatttcgtggacatcaatatccaaaataagaagttggaatctctcttacaatcaatggaaatggctcactctggaagcttaagagatgaactttgtttagactttccctgcgatagcccggaaaagagcctcaccctcaatccaccactggatactatggctgatggccttagccttgaggaacaggttacgggtgaaggtgctgatcgagagcttctggttggcgactccattgctaactcgacggacctgttcgatgaaatagtgacagccaccacaaccgaatccggcgacctggagttagtgcactctacccctggcgccaatgtgttggagctactacccatcgtcatgggacaggaagaaggcagcgttgtcgtcgagcgcgccgtacagacggatgtcgtgccatactcgcctgcaatctctgagcttatccaatctgttctgcaaaaactgcaggatccctgccctagctcattagcctcccccgatgaatcggagcctgatagtatggagtctttcccagaatccctgtccgcactagtggtggacctcactcctcgtaatccaaactcagccatcctgctgagccccgtggaaacgccatacgcaaatgtcgatgcagaggtccacgccaatcgtctgatgcgtgagttggacttcgccgcttgcgtggaagagagactggatggtgtcattccgttagctcgggggggcgtagtgaggcaatactggtcatccagctttctggtagatctgctcgcagtcgcagcccccgtggtgcctaccgttctgtgggcattcagtacacaacgtgggggcactgacccagtctacaacatcggcgccctgctccgggggtgttgtgtcgttgcacttcacagcttgagacggactgcctttcgtattaaaacgtag

SEQ ID NO: 136997 - DNA, 243 bp, Artificial Sequence
  Description of Artificial Sequence: Synthetic coding sequence
atggtgggggagggatcaatccaatcatcacgctacaaaaaagagtctaaatctggactggtgaaaccagggtccgaagcagatttctcatcttcatcaagcactgggagcatcagtgccccagaggtccacatgtctaccgccggctcaaagagaagcagttcttctcgcaacagaggcccccacgggcgatctaacggcgccagcagtcataagccgggtagttctccctcgtctccttag

SEQ ID NO: 136998 - DNA, 1989 bp, Artificial Sequence
  Description of Artificial Sequence: Synthetic coding sequence
atgggaccattgagagagtccaaggaacatagggttcaacatcatgataaggagattagccgctctaggatcccacggttgatcttgcgcccacacatgcctcaacagcagcataaggtctcaccggcgtccgaatcacccttcagtgaagaagaaagtagagaatttaacccgagttccagcggacgatcagcacggaccgtatccagcaactccttttgttctgacgatacgggatgtccaagctcccaatccgtgtccccggtcaaaacccctagcgatgccggcaactcccccatcggtttttgcccaggaagcgacgagggttttactcggaagaagtgtacaataggaatggttggagaggggagtatccaaagctctcggtacaaaaaggaatcaaaatctggactggtgaaacctggaagtgaggcggacttctcaagctcatcatcgacgggctcgatctctgccccagaagtgcatatgagcactgccggtagcaagcgatcttcaagttctcgaaataggggcccgcacggtagatctaatggggcttcttcacacaagccaggcagcagcccatcctccccacgagaaaaggatctgctatcgatgttgtgtaggaatcagttgtcaccggtgaatattcatccgtcatacgcccctagtagccccagcagctcaaactcgggcagctacaaaggttccgactgttcacccattatgagaaggtcagggagatatatgagctgcggcgagaatcacggcgtgcggcccccaaaccccgagcagtacctaacccctcttcagcagaaagaagtaaccgtgcgacatctgaagacaaagctgaaagagtctgaacgtcggctccatgaacgagagtcggaaattgtcgaacttaaatcccagttggcccgaatgcgggaagactggatagaggaggagtgccacagggttgaggcacagttagccctgaaggaagccaggaaggagatcaaacagctcaagcaggtgattgagaccatgcgctcatcgctggctgataaggacaagggcattcagaaatacttcgtggatataaatatccagaacaagaaacttgaatctctgctccaatcaatggagatggcacattccggctctctgagggacgaactatgccttgattttccttgcgatagccctgagaagtcactcacgctcaaccctccgctggatactatggcggatggactctctctggaggaacaggtgaccggcgaaggcgccgatagggaactgctcgttggcgactcaatagctaattctaccgatctgttcgacgagatcgtgaccgcgaccaccacggagtcaggggatcttgaactggttcactccacacctggcgcaaacgtcctggaactgcttcctatagtaatggggcaggaagagggttctgtggtggtcgagagagcagtccaaaccgacgtcgttccttacagtccagccatctcagagcttatccagagtgtgctgcagaagttgcaggacccgtgcccatccagcctggctagccccgatgaaagtgagcccgacagcatggagagctttccggaatccttgtccgcgctggtggtcgatttaaccccccgcaatccaaatagcgccattcttctttcaccagtcgagaccccatacgccaatgtcgatgccgaagtccatgccaatcgtctcatgcgtgagctggatttcgctgcatgcgttgaggagaggttggacggagtgatccccctagccaggggcggggtagtgagacagtactggagttctagtttcctggtggacctgctggcggttgccgcaccagttgtgcccaccgtcttatgggcattttccacccaacggggaggcacggatcccgtatataatattggagctctgcttcgtggttgctgtgtggtggctctgcattctctgaggcgaaccgcattccggatcaaaacatag

SEQ ID NO: 136999 - DNA, 288 bp, Artificial Sequence
  Description of Artificial Sequence: Synthetic coding sequence
atggggccactgagggagagcaagaaagaacatcgcgtacaacaccatgacaaagaaatttccaggagtcggatacctaggctcatcctccgcccccatatgccacaacagcagcacaaggtttctcccgcctcagaaagtccatttagtgaggaagaatctcgcgagtttaatccaagctcctccggacgcagcgcccggacagtctcctccaatagcttttgcagcgacgacacgggttgtccatcttcccaaagtgtgagtcccgtcaagacgccgagtgattag

SEQ ID NO: 137000 - DNA, 615 bp, Artificial Sequence
  Description of Artificial Sequence: Synthetic coding sequence
atgggcccattgcgggagtcgaaagaacatcgcgtgcagcaccacgataaggagatatcacgcagccgaattccacgccttatactgagaccccacatgccccagcagcagcacaaagtctctccagcaagtgagtcaccattttctgaggaagaatctagagaattcaatcctagcagctctgggagaagcgcccggacagtgtccagtaattctttctgctccgatgatacgggatgccctagtagccagtccgtcagccctgtgaagaccccaagtgacgctggcaactctcccatcggcttttgccccggctccgacgaagggttcactcggaagaaatgtaccattggcatggtcggggaggggtcgatacagtcctctcgatataagaaagagtctaagtctggcttagtgaaaccagggtctgaggccgatttctctagctcgtcctcaactgggagcatatccgccccagaagtgcatatgtctactgccggctctaagcgaagttcaagcagcaggaacagaggaccccacgggcggtctaacggtgccagcagccacaaacctgggagtagcccatcctctcctcgggagaaggacctattgtag

SEQ ID NO: 137001 - DNA, 108 bp, Artificial Sequence
  Description of Artificial Sequence: Synthetic coding sequence
atggttggagaaggaagtatacagtcttcccgatataagaaggaatccaagagtggattagtcaaaccgggctctgaggctgatttcagttccagttcttctacgtag

SEQ ID NO: 137002 - DNA, 105 bp, Artificial Sequence
  Description of Artificial Sequence: Synthetic coding sequence
atggtcggcgaggggtccattcagtcgtctcggtacaaaaaggagtctaagtctggcctagtgaaacctggctccgaggccgacttctctagctccagttcttag

SEQ ID NO: 137003 - DNA, 243 bp, Artificial Sequence
  Description of Artificial Sequence: Synthetic coding sequence
atggtcggtgaaggctcaattcaatcctccaggtataagaaggagagtaaatcaggtctggtcaaacctggttccgaagccgatttcagttccagctcttccacaggctccatttctgccccagaagtgcacatgagcacggcaggctccaaacgttcctcttccagcaggaatcgtgggccacatggacggtccaacggagcaagttcccataagccaggctccagcccaagcagtccatag

SEQ ID NO: 137004 - DNA, 1788 bp, Artificial Sequence
  Description of Artificial Sequence: Synthetic coding sequence
atggggcctttctgggcgagaaaggatgacaccggatgcccctcatcccagtcggtcagtcccgtgaagactccctctgatgctggcaactctcccatcgggttttgccctggcagcgatgaggggtttactcgcaagaaatgtacaatcggaatggtgggagaaggttccatccaatcttcccggtacaagaaggagtctaaatctggtctggttaagcccggctcagaggccgacttcagttcctctagcagtactggcagcattagcgcacctgaggtacacatgagcactgccggttctaagcgatcctccagttctcgtaaccgtgggccccatggacgctctaatggagcctcatcccacaagcccggcagcagcccctcatcccccagagaaaaggacctacttagcatgttatgcagaaatcaactatcaccggtgaatatccacccatcctacgcgccgtcttctccttccagctccaatagcgggtcctataagggaagtgactgcagtcctattatgaggcggagcggaagatacatgagctgcggcgaaaaccacggagtccggcctcctaaccccgagcagtacctaaccccgttgcagcaaaaggaagtgacggtgcgacatctaaagaccaagttaaaagaaagtgagcggcgccttcacgaaagagaatctgagattgtggagctgaaaagccagctggcacggatgagggaagactggatcgaggaagaatgtcaccgggtggaggcccagcttgccttaaaggaagctcgcaaggaaataaaacagttgaagcaggtgattgaaacaatgagatccagtttggctgacaaggacaagggaatacagaagtattttgtggatattaacatccagaacaaaaaattggagagcctactgcagtccatggaaatggcccacagcggcagcttgcgggatgaattatgccttgactttccctgcgattctcccgaaaagtcgctcactctgaatccacctctggataccatggccgacgggctgtctcttgaagaacaggtgactggggaaggtgccgatagggagcttctggtgggtgacagtattgccaattccaccgatctgtttgatgaaattgtgacggcaaccacaacggagagtggtgatttagaactggttcacagcacccccggcgccaacgtgttagaactcctgcccatcgttatgggtcaggaagagggatctgtggtggtggaacgcgcggtccaaacagacgtggtgccctactcacccgccatttcggagctaatacaaagcgtcttacagaagctccaagatccttgtccatcctctttggctagtccagacgagagcgaacctgactctatggaatctttcccagaaagcctgagcgcgctggttgttgacctaacccctcgcaatcctaacagcgcgatcctcctcagcccagttgagactccatacgccaatgtggatgcggaggtccatgccaataggttgatgcgagaactcgacttcgcagcttgcgttgaggagaggctcgatggagtgatacccctagccagaggtggagtggtgcgtcagtactggtcctccagctttttggttgaccttctggcagtggcagcgcctgttgtccccacagtgttgtgggctttttcaacccagagaggcgggacagaccctgtctacaacatcggtgcactccttcgcggttgttgcgttgtcgcgctgcatagcctgcgtcgtacagcttttagaattaaaacttag

SEQ ID NO: 137005 - DNA, 1635 bp, Artificial Sequence
  Description of Artificial Sequence: Synthetic coding sequence
atggtgggcgaaggctccatccagagctcccgctacaaaaaggagagcaaatctgggctggtgaaacccggctccgaagcagacttttcgagttcttctagtactggcagcatatccgcacccgaggtccatatgtcaactgcgggatccaaaaggtcttcctcatcccgcaatcgcggcccccatggaagatccaatggagctagctcgcacaaaccaggtagcagcccatcttcccctcgggaaaaagacctgctctccatgctgtgtcggaaccagctgagccctgtgaacattcatccgtcctatgctccatctagcccctcttcatctaactccggctcttacaaaggcagtgactgttccccaatcatgcgtagaagcggccgttacatgagttgcggcgagaaccatggagtgcgaccacctaacccagagcagtacctgacccccctgcagcaaaaggaagtgaccgtgcgacacctgaagacgaagctgaaagagagtgagcgaaggctccacgaaagagaatctgaaatagtggagttaaaaagccagttagcacgaatgcgggaggactggattgaagaggaatgtcacagagtcgaggcacagttagccttgaaggaggctagaaaggaaatcaagcagctcaagcaagtaatcgagacaatgcggagctccctagcagataaggataagggcatccaaaaatatttcgtggacatcaatatacagaataaaaagctcgaaagtctgctgcagagtatggaaatggcacatagcggcagccttagagacgagctgtgcctggatttcccttgcgatagccccgagaaatcactgaccctgaacccccctctggacactatggcagacggcctgtcactcgaagagcaggtgacaggcgaaggagcagacagggaactcctagtgggtgactctatagccaattcaaccgacctcttcgatgagatcgttacagccaccacaactgagtcgggggatctggaactggtccattccacacctggggctaacgtgcttgagcttctccccattgtcatgggtcaggaagaaggcagtgtagtagtggagagggcagtccaaacagacgtagtgccttacagcccagccatcagtgaattaatacagagcgtgcttcagaagctgcaggacccctgtccttccagccttgcctcacctgacgaatccgagcctgacagcatggagagttttcccgagtctctatcagccctggtggtcgaccttacgccaagaaatcccaacagtgcaattctcctttcccctgtggagacgccctatgcaaatgtcgatgctgaggttcacgctaatcggttaatgcgggagctcgatttcgccgcatgcgttgaggagaggctcgacggggtgatcccactcgcccggggcggggtggtgcgacagtactggagcagtagtttcttggtcgatttgcttgcagtcgctgcccccgtggtgcccactgtcctgtgggctttctcaactcaacgcggtggcacagaccctgtctacaacattggagcactccttaggggttgttgcgtagtagctttgcacagcttgcgtagaaccgcctttaggataaagacttag

SEQ ID NO: 137006 - DNA, 1992 bp, Artificial Sequence
  Description of Artificial Sequence: Synthetic coding sequence
atgggccctcttagggagtctaaaaaagaacatagggttcaacaccacgataaagaaatttcacggtcaagaatcccgcggcttattctgcggccgcacatgccccagcagcagcataaagtgtcgccagcctcagagtcaccgtttagcgaagaagaaagtagggagttcaatcccagcagttccggtaggtctgcacgcaccgtttcatctaactctttttgttctgacgacaccggttgtccttcatcccagtctgtgagtcccgtgaaaactccatccgacgcgggcaactctcccattgggttctgcccagggagtgatgaaggatttacacggaagaagtgcacaatcgggatggtgggcgaaggttcaatacagtcttctagatataagaaggaatccaagagtgggctcgtcaaacccgggtccgaggctgatttctctagcagcagctcaactggcagcataagcgctcccgaggtgcacatgtccacagccggaagcaaacgctcgagctccagccgcaacaggggaccacacggcagatctaatggagcttcgtcgcacaaacctggtagctctccctcctcgcctcgcgagaaagacctactaagcatgctctgtagaaaccagctgagtcccgttaacatccatcctagctatgcacccagcagtccctctagttccaattctggatcatacaagggttccgactgttcccctatcatgaggagatccggccgctatatgtcatgcggagagaaccacggcgtgaggccccccaatcctgaacagtacctgacccctctgcagcagaaggaagttacagtgcggcacttaaagacgaaattgaaggagtcggagcggaggctccacgaacgagagagcgagatcgtggagctcaaatctcaattggcccgtatgagggaggattggatcgaggaggagtgccatcgagttgaagcacagctcgccctgaaggaagctcgaaaagagattaaacagctaaagcaggtgattgaaaccatgcgctccagcctggccgataaggacaagggcatccagaaatactttgtcgacatcaatatccagaacaaaaaactggaaagcctgctgcaatccatggaaatggctcactctggatcacttagagacgagctctgtctagatttcccatgcgattccccagagaaaagtctcaccctgaaccctcccctggacaccatggccgacggcctaagcctggaggaacaggtcactggcgaaggagccgatcgtgagctgcttgtgggagactctattgcaaactcgaccgatcttttcgacgaaattgtgacagccactacaacagagtctggcgacctggagctcgtgcattccacaccaggcgctaatgttctggaactcctccccattgttatggggcaggaggaaggctctgtggttgtggaaagagctgttcagacggacgtggtaccctacagcccggcaatatctgaactgatccaaagcgtgttacagaagcttcaggacccctgccctagttccctcgcctcccctgatgagagtgaacctgattccatggagagtttcccagagtctctttcagcactggttgtcgatctaaccccacgcaatcccaattcggcaatcctactatcccccgtagagactccatacgcaaatgttgacgctgaggtgcatgccaaccgcctgatgcgtgagctagactttgctgcctgcgtagaggaacgactcgacggcgttatccctctggctcggggcggggttgtgaggcagtactggagctcttcctttttggtggacctgctggcagtagccgcgcctgttgtccccacagtgctgtgggcgtttagtacgcagagagggggcacagatccagtgtataacattggcgctctgttacggggatgctgtgtggtagcgctgcatagcctgagacgcaccgcatttcgcattaagacatag

SEQ ID NO: 137007 - DNA, 489 bp, Artificial Sequence
  Description of Artificial Sequence: Synthetic coding sequence
atgggcccactacgggaatctaaggagcatcgagtgcagcaccacgataaagagatttcgcgctcacgcattccgcggctcatactccggccacatatgccacagcagcaacataaggtgtcgcccgcctcagagagcccattctcagaggaggagtcaagagagttcaatcctagcagctccggccgttccgcgcgcacagtttcctctaatagcttctgctccgacgatacggggtgcccctcgtcccagtctgtctcccctgtgaagactccatcagacgcaggcaatagccctatcgggttttgccctggtagcgacgaaggttttaccagaaagaaatgtactattggcatggttggggaggggtcaatccaatcatctagatacaagaaagagtccaaatccggcctagtgaagcccgggtccgaagctgatttctcgagttccagttctacaggcagcatcagtgcccccgaggtccattag

SEQ ID NO: 137008 - DNA, 1989 bp, Artificial Sequence
  Description of Artificial Sequence: Synthetic coding sequence
atgggacccctgcgtgagtctaaagagcatcgtgtccagcatcacgataaagaaatatcccgcagtcgaattcctaggctcatactgcgcccccatatgccacagcagcaacataaagtgtctccggcgagcgaaagcccattttctgaggaggaatctcgagaatttaacccttcttccagcggccgctccgcgagaacggtgtcgtccaactctttttgctcagacgacaccggctgtccatcgtcccagagcgtgagcccggtaaagacacccagcgacgctggaaatagccccatcggcttttgcccagggtcagacgagggttttacacgaaagaagtgtactataggcatggtcggtgagggcagcatccaaagttcccgctacaagaaagaatcaaaaagcgggctggttaagcctggctcagaagccgattttagctccagctcctccacgggatctattagtgccccagaggtccacatgtccaccgcagggtctaaaagatcaagttcgtctaggaatagaggaccccacggccgttccaacggggcaagctcccacaagcccggctcttccccctcatctccacgcgaaaaggacctgttgagcatgctttgccggaaccagctcagcccagtaaacatccatccttcttacgcacccagctctccttcaagttccaactctggatcctacaagggatccgactgctcccccatcatgcgacgctctgggaggtatatgagttgcggcgagaatcatggtgtgaggcctcccaaccccgagcagtacctcacgccactacagcaaaaggaagtgactgtcaggcatctgaagacaaaacttaaggagagtgagagacggttgcacgagagagagagcgaaatcgtggagttgaagtcacagctcgcccgaatgagagaagattggattgaggaagagtgccaccgggtagaagcacagctggcactgaaggaagctcgcaaagaaatcaaacagctcaaacaagttatcgagacaatgcgctcgtccttggccgacaaagataaaggtatccagaagtacttcgtcgatatcaatatacaaaataagaaactggaatcactgttgcagtcaatggaaatggcccactcaggtagcctccgcgacgaactgtgtttagactttccctgcgacagcccagagaagtctcttacgctcaatcctcctcttgataccatggcggatggactctcattagaggaacaggtgacgggtgaaggcgcagaccgggagctcctcgtaggagacagcatcgccaatagcacggatttatttgacgagatcgtcacggctactactacggagagcggtgacttggaactggttcacagcacaccaggggcaaacgttctagagctgttgccgatcgtgatgggtcaggaggagggctccgtggtggtggagcgggccgtgcagacggacgtggtgccttacagccccgccatcagtgaactgatacaaagcgtgctgcaaaagctacaggacccttgtccatccagtctagccagccctgatgaatcagaacccgactctatggagtcctttcctgagtctctgtctgctttagtggtcgacctgactcccagaaaccctaactccgcaatcctcctgagccctgtcgaaacaccctacgcaaacgtggatgccgaggtgcacgcgaatcggttaatgcgcgagctggatttcgcggcttgtgtcgaggagagattggacggtgtcatccctctcgcccggggaggcgtcgtcagacagtactggtccagctcattcttggtcgatctgctggctgtggcagcccctgtggtccccaccgtgctctgggccttcagcactcagcgcggtgggacagatccggtttacaacattggggccctgttacgcgggtgctgtgtggttgccctccacagcctgcgacgaaccgcatttcgaatcaagacatag

SEQ ID NO: 137009 - DNA, 315 bp, Artificial Sequence
  Description of Artificial Sequence: Synthetic coding sequence
atgggacccttgagggagagcaaggaacaccgtgtgcaacatcatgataaggagatttcaaggagtaggatcccccggctgattctacgaccgcacatgccacagcaacagcacaaagtgagtcccgctagcgaatcccctttcagtgaggaggaatctagggagttcaatcccagctcttccggacggtcagctcggaccgtaagtagtaactctttctgctccgatgacaccgggtgccctagcagccagtccgtcagccccgtgaagacaccgtcagatgcgggcaactcccctattggcttctgcccctag

SEQ ID NO: 137010 - DNA, 456 bp, Artificial Sequence
  Description of Artificial Sequence: Synthetic coding sequence
atggggccgctcagagagtccaagaaagagcatcgagtccagcaccacgataaggagatttcccgtagccggattccccggttaattttgcgcccccacatgccacagcagcagcacaaagtcagccctgcaagtgaatcccccttttcagaagaagagagcagggaattcaacccgagttcaagcggcagaagcgccaggaccgtatcctcaaactcgttttgtagcgacgataccggttgcccttcttcccaatctgtatcacctgtcaagacaccatctgacgccggtaactcaccaatcggcttctgtccgggttctgatgaggggtttacgcggaaaaagtgtaccatcggcatggttggtgagggctccatccagagctctcgttacaagaaagaaagcaaaagcggccttgtcaaaccggggagtgaggcggatttctctagctcctag

SEQ ID NO: 137011 - DNA, 231 bp, Artificial Sequence
  Description of Artificial Sequence: Synthetic coding sequence
atgggaccgctgcgggaaagtaaaaaggaacacagagtacagcatcacgataaagagataagtcggagtcggatcccccgtctgatactacgcccacatatgccgcagcagcagcacaaggtgagccctgcctccgaaagccctttctctgaagaagagagcagggaattcaaccccagtagctctggtaggtccgctaggactgtttcaagtaatagcttctgcagctag

SEQ ID NO: 137012 - DNA, 1617 bp, Artificial Sequence
  Description of Artificial Sequence: Synthetic coding sequence
atgccaggcagcggtcccagcgaacggatgacatggcctggccccgccctgagcgccggccctcctacacgcccactgtcgagcgcccctggaatacccccaatcccccccctcacccgcacgcacagtctgatggccatgagcctccccggatcgagacgcaccagtgccggctctcggagacgaacaagccccccagtttcggtgagagatgcttacggaacttcgtcacttagcagttcttcaaatagtggaagttataaagggagcgattccagtccaaccccccggaggtccatgaagtatactttgtgcagcgataaccacgggattaaaccaccgacacctgaacaatatttgacgcctctccaacaaaaagaagtgtgtatcaggcatctaaaagcgcgcctaaaagatacgcaggaccgacttcaggacagagacactgaaatagacgacttaaaaacacagctgagccggatgcaggaggattggatcgaggaggaatgtcaccgtgtggaggcccagctcgccctgaaagaagccaggaaagagattaaacagcttaaacaggtcattgacactgtgaaaaataatctgatcgataaagataaaggattgcaaaagtacttcgtggacattaacatccagaacaagaaattggaaaccctgcttcattccatggaagtcgcccaaaatgggatggccaaagaagacgggaccggggaatcagcgggcggctcaccagcaagatctttaacacggtcctctacctatactaagctgtcagaccccgctgtatgcggagataggcagcccggtgatccaagctctggctccgcagaggacggcgccgacagtgggttcgctgccgccgacgacaccctgtcacgcacagatgcgcttgaggcaagtagcctactaagttctggagtggactgtggcacggaagaaacctcactgcactcctcctttggactggggccaaggttccccgcctccaatacctatgagaagttgttgtgcggaatggaggccggggtacaggctagttgcatgcaagagcgcgctattcagaccgattttgtgcagtaccaaccagacttagacacaattctggagaaagtgacccaggcgcaagtctgcggcacagatcctgaatcaggggaccggtgccccgaactcgatgcccacccatcaggcccaagggacccaaactccgccgtggtcgttaccgtgggagacgaactggaggctcccgagcccattacccggggacctacgcctcagcggcccggagctaatccgaaccctggacagtccgtcagtgtagtgtgtcccatggaggaggaggaagaagccgccgtggccgaaaaggaaccaaaatcgtattggagccgccactatatcgtggacctgctggcagtggtcgtaccagctgtgcccacagtggcctggctgtgccggtctcagcggaggcagggccagcccatctacaacatctcttcacttctcaggggctgttgtaccgtagccctccattctattcgcagaatatcatgtcgcagtctgagccagccaagtccatcaccagccggcgggggaagccagctgtag

SEQ ID NO: 137013 - DNA, 1485 bp, Artificial Sequence
  Description of Artificial Sequence: Synthetic coding sequence
atggcaatgtctctccctggttcacggaggacatctgcagggagtagacggagaaccagccctcctgtatctgtaagggatgcatacgggacgtcatcgctctccagctcatctaatagcggcagctacaaggggagcgactcttctccaaccccccgcaggagcatgaaatacaccctgtgctccgataatcacgggatcaagccaccaacgcctgaacagtatctgacccctcttcagcagaaagaagtgtgcatccggcacttaaaagctaggcttaaggatactcaggaccgcttgcaggatcgtgatacagaaatcgacgacctgaagacgcagcttagtcgcatgcaagaggactggatcgaggaggaatgccaccgggtggaggcccagttagctttaaaagaagccagaaaggaaatcaaacaactgaaacaggtgatcgacactgtaaaaaacaacctgatcgataaagataaaggactgcagaagtacttcgtagatattaatatacaaaacaaaaagctggagacactgctacactccatggaggtagctcagaatggtatggccaaagaagatggcacaggtgaatcagccggtggtagcccggcacggtcactgaccaggtcatctacctatacaaagctcagtgatcctgctgtgtgtggagaccgtcagcccggcgatcccagcagcggatcggccgaggacggtgctgattccggattcgccgccgctgacgacactctgtcccgcactgatgctctggaggcctcatcgttgctttcgtctggtgtggactgtggcacggaggaaaccagtctgcacagcagttttggcttgggcccccggtttccggctagtaatacctacgagaagttgctgtgtggaatggaagcaggagtgcaggcttcctgcatgcaggagcgggccatccagactgacttcgtgcaataccagccagacctggacacaatcctcgaaaaagtgacacaggcgcaggtgtgtggaacggatccagagagcggtgacaggtgtccagaattggacgctcatccttcgggccctagggacccaaattccgccgtcgtggtcacagtgggcgacgagttggaagcccccgagccaatcacgaggggaccaactccccaacggcctggtgctaacccaaatccaggtcagtctgtcagcgtggtctgtccaatggaggaagaagaggaggctgctgtggctgagaaggagccaaagtcgtactggtctcgacactatattgtcgacttactggctgtcgtagtgcccgccgtgcccacagtcgcttggctgtgtcgatcgcaaaggaggcagggacagcctatttataatataagcagcctgttgagaggctgctgtacagtggcattgcattcaattaggcgcatttcgtgcaggagtctatcacagccctctccttcccctgccggagggggaagccaactgtag

SEQ ID NO: 137014 - DNA, 864 bp, Artificial Sequence
  Description of Artificial Sequence: Synthetic coding sequence
atgaaagacagactggcggaattgctggacctgtctaaacaatatgatcagcagtttcccgacggcgacgacgaatttgatagcccacatgaagatatagtttttgaaaccgaccacatactggaaagcctctatagggacattcgagacatacaggatgaaaatcaactgctcgtggccgacgtgaagcgattggggaaacaaaatgcacggtttctcacatcaatgcgaaggctgagcagcattaagcgggacacgaattctatagccaaggcaatcaaagcccgtggcgaggtcattcactgcaagctgagagccatgaaggagctttcagaggcagctgaggctcagcatggcccccattcagcagtggcaaggatttctcgggcccaatacaatgctttgactcttactttccaacgcgccatgcacgactacaaccaggctgaaatgaagcagagagacaactgcaagattagaattcagaggcagttggaaattatgggcaaggaagtctcaggagatcagatagaagatatgtttgaacagggaaagtgggatgtcttttcggagaacctgcttgcagatgtgaagggagcaagagccgctctgaacgagatcgagtcgcgccacagggaactcctgaggctcgagagtaggattcgcgatgtgcatgagctatttttgcagatggctgtcctggtagagaagcaggcggacaccctgaacgtgattgaattaaacgtccagaagactgttgactataccgggcaggccaaggcacaggtgcggaaagcagttcagtatgaggagaaaaatccttgtagaactctctgctgcttctgttgcccctgtctaaaatag

SEQ ID NO: 137015 - DNA, 615 bp, Artificial Sequence
  Description of Artificial Sequence: Synthetic coding sequence
atggccctggtgagcggtataagcttagaccctgaagcggccataggtgtaacgaaacggccgcctcctaaatgggtagatggggtggatgaaattcagtatgacgttggccgaatcaagcaaaaaatgaaggagctggcgtctctgcacgacaagcacctgaaccggccaactcttgacgacagctccgaggaagagcatgctatagaaataaccacgcaggaaattacccaactatttcatcgctgtcagagggctgtgcaagctcttccttctagggcaagagcatgtagcgaacaagagggccgtctgctgggcaacgtcgtcgcctccctcgcccaggctctccaggagctctctacgagctttcgacacgctcaatctggatatctgaagcggatgaagaaccgggaggagagatcacagcactttttcgacacgtctgttccactgatggatgatggggatgataatacactgtaccatcgcgggttcacagaggaccagctcgtcctggtggaacagaacactctgatggtggaggaaagggaacgtgaaatcaggcagatcgtgcagtctatctccgaccttaatgaaattttccgagatttgtag

SEQ ID NO: 137016 - DNA, 927 bp, Artificial Sequence
  Description of Artificial Sequence: Synthetic coding sequence
atggcgacccggcgtctaaccgatgcatttttgctgttaaggaataacagcatccagaacagacagctcctggctgaacaggagctcgacgagctggcagacgaccggatggcacttgtgagcggcatcagtctggaccccgaggctgctataggcgtgacaaagcggcctccacccaagtgggtggacggagtagacgaaatccagtatgatgtgggcaggatcaaacagaagatgaaggaactggcctccctccacgataaacatctcaatcgacccaccctggacgacagttctgaggaagaacatgcgatcgagataaccacccaggagattacacaactcttccacagatgccagagagctgttcaggcactccccagtcgagcgagagcctgtagcgaacaggaaggacgattgcttggcaacgtggttgctagcttggctcaggccctgcaagagctgtctacatcatttcgtcatgctcagagtggatatctgaaacggatgaaaaacagggaggagagatcccagcacttcttcgatacaagtgtgccactcatggatgatggggacgacaacaccctgtaccacagaggctttaccgaagaccagctggttctggtggagcagaacaccctgatggtagaggagagggagagggagattcgccaaatcgtgcagtccatctctgacctgaacgaaatcttcagggatctgggggcaatgatcgtagaacaggggaccgtgttggaccgcattgattacaatgtggaacagagttgtattaagacagaggatggcctgaagcagctgcataaggccgaacagtaccaaaagaagaatagaaaaatgcttgtgattctgatcctctttgtgattattattgtgctaatcgtcgtcttggtgggtgttaagtcacgttag

SEQ ID NO: 137017 - DNA, 966 bp, Artificial Sequence
  Description of Artificial Sequence: Synthetic coding sequence
atggccactcgccgtcttaccgatgcattcctattgcttcgcaataactctatccaaaaccggcagctattagctgaacaggtcagtagccacatcacctcaagcccacttcactcgcgatctatcgccgcactcgctgacgatcgtatggccctcgtgtcggggattagtctcgatccggaggcagcaataggggtcacaaagcgaccgccaccaaaatgggtggacggcgtagatgagattcagtatgatgtggggaggatcaaacaaaagatgaaagagctggcttcactacacgataaacacctcaaccgacccacactagacgattcctcagaggaggaacatgccatcgagattacaacacaggagattacccagctgtttcacaggtgtcagcgggctgtgcaggccctcccatcgagggccagagcttgtagtgagcaggagggccggctgctgggaaatgtagtggcctccctggcacaggcactccaggagctgagcacctcctttaggcatgcgcagtcaggctacctgaagcggatgaaaaatcgcgaagagcggtctcagcacttttttgatacctcagtccccctgatggacgacggcgacgataacaccttgtaccacaggggctttactgaggaccaactggtgctggtggaacagaacacactcatggtggaagaacgagagagagaaattaggcagattgtccaatctatctccgacttaaacgagattttcagagatttaggggccatgatagtggagcaggggacagtcttagacaggatagactacaacgtcgaacaatcctgcattaagacggaagacggcctgaagcagctgcataaagccgagcagtatcagaaaaagaacagaaagatgctggtgatcctgatcttgtttgtcataattattgtgctaatcgtggtcctggtgggagtgaaatctaggtag

SEQ ID NO: 137018 - DNA, 756 bp, Artificial Sequence
  Description of Artificial Sequence: Synthetic coding sequence
atggctttggtttctgggatatcactcgatccagaggcagcaattggcgtaactaaacgcccaccacccaagtgggtggacggagtggacgaaattcagtatgatgtgggtagaatcaagcagaagatgaaggaactcgcttctctccacgataaacacctgaatcggcccactcttgacgactcaagcgaagaggaacacgctatagaaattactacgcaagagattacccagctctttcatcgatgtcaaagggccgtgcaggcgctacctagcagagctcgcgcctgtagcgagcaggaagggagattactcggcaacgtggtcgctagcttggcccaggccctgcaggaactgtctactagttttcgccatgcccagtccgggtacctcaagcgcatgaaaaatagagaggaacgctcgcagcatttcttcgataccagcgttcccttgatggatgatggcgacgacaatactctgtatcaccggggttttaccgaagaccagttagtgctcgtagagcagaacaccctaatggtggaagagcgggagcgcgaaatccggcagattgtgcagtccatctctgatcttaacgaaatctttcgagacctaggggccatgattgtggaacagggtactgtacttgaccgcattgactacaacgtagaacagtcttgtattaagaccgaggatggactgaagcagctccataaagccgaacagtaccagaagaagaaccggaaaatgttggtgtag

SEQ ID NO: 137019 - DNA, 927 bp, Artificial Sequence
  Description of Artificial Sequence: Synthetic coding sequence
atggctactcgccgtctgaccgatgcctttctcctgctgcgcaataattctattcagaataggcagctactagccgaacagcagctgtctaaactggctgacgacaggatggcactcgtttcaggaataagcttggatccagaagccgccatcggggtgaccaaaaggccccccccaaagtgggttgatggggtcgacgagattcagtacgatgttgggcgtatcaagcaaaaaatgaaggaactcgccagcctgcatgataaacacctcaaccgacctactctggatgatagcagcgaagaggagcacgctatcgaaattaccactcaggagataacccagctttttcatcgctgccagcgcgctgtccaggccttgccaagtcgagctcgagcatgctcggagcaggagggtcggcttcttggtaatgtcgtcgcctctctcgcccaggcattgcaggaattaagcacctcgttccgccatgctcaaagcggatatttaaaacgtatgaagaacagggaggagcgcagccagcattttttcgacacttctgtcccactaatggatgacggcgacgataacacattatatcatcgcggatttaccgaagaccaattagtgttagttgaacaaaacacattgatggtggaagaaagagagagagagattcgtcagatagtgcagagcatatctgatcttaatgagatcttcagggacctaggggccatgatcgtcgaacaagggacagtcctagatcgtattgattataatgtcgaacagtcatgcatcaagacagaagatggcctgaaacagctccataaggcggagcagtaccagaagaagaacagaaaaatgctagttatcctgatcctgtttgtcatcataatcgtgctgatagtggtcctggttggtgtcaagtctagatag

SEQ ID NO: 137020 - DNA, 978 bp, Artificial Sequence
  Description of Artificial Sequence: Synthetic coding sequence
atggcaacacgccggctcactgacgcattcttactgctccgcaataactccattcagaataggcaactgctcgccgagcaggtctcttcgcacataacttcttctccactccactccaggagtatcgccgcagctcttgatgaattagccgacgatagaatggcactggtttcagggattagcttggatcccgaagccgctataggtgtcactaagcgcccacccccgaagtgggtcgacggggtagatgagatacagtacgacgttggcaggataaagcaaaaaatgaaagaactcgcttcgcttcacgacaaacacctgaaccggccaaccttagacgactctagcgaggaggaacatgcaatagagataaccacccaggaaatcacgcagctgtttcacaggtgtcagagggctgtccaggcgctgccttccagagccagggcctgcagcgagcaggagggccggttgctcggcaacgtagttgcttcccttgcccaggccctacaggagctgagcacaagtttccggcacgctcagagcggttatctcaagagaatgaaaaatagggaggagcgctcccagcatttctttgacacctccgtgcctctgatggatgatggagatgacaatactttgtatcacaggggctttacagaagaccagctggtgctcgtggagcagaatacactgatggtggaggagcgggagcgcgaaatcaggcaaattgtgcaaagtatttccgaccttaacgagatcttccgtgatctgggcgcaatgatcgtggagcagggtacggtgctagatcgtatcgattataatgtggagcaatcctgcattaaaaccgaggatggactcaaacagctacataaggccgagcagtatcagaagaaaaataggaaaatgctcgtaatcctgatcttatttgtcatcatcattgtgctaattgtggttctggtgggcgtgaaatcccggtag

SEQ ID NO: 137021 - DNA, 915 bp, Artificial Sequence
  Description of Artificial Sequence: Synthetic coding sequence
atggctacccgtcgtctgaccgacgctttcttactgctgcgcaacaactctatccagaacaggcaattactggctgagcagctcgccgatgaccgcatggccctcgtgagtggtatttcgttggacccagaggccgcgattggtgttacaaagagacctccacctaagtgggttgacggcgtcgacgagatccagtatgacgtcggtcgcattaagcagaagatgaaggaacttgcttccctgcacgacaaacacttaaaccggcctactcttgatgactctagtgaggaggaacacgcgatcgagattaccacccaggaaatcacacaactgtttcatcgctgccaacgggcagtgcaggccctgccttcacgcgcgcgcgcctgtagcgagcaagaaggtcgtctgctgggcaatgtagtggctagcctggcgcaggccctccaagagctgagcacctcttttcgccacgctcagagcggatatttgaaacggatgaagaatagggaagagagatcccagcacttctttgacacgagcgtccctctcatggatgatggggatgacaacacactgtaccacaggggtttcacagaggatcagcttgttttggtggaacagaatactttaatggtagaggaacgcgaacgcgagattcgtcagatcgtgcagagcatcagcgatctgaacgaaatttttcgggacttgggcgccatgatcgtggaacagggcacggtgctcgatcgcattgactataatgtcgagcagtcttgcatcaagacagaagatgggctgaaacagcttcacaaggccgaacagtatcagaagaagaatcgcaagatgctggtcattctcatcctgttcgtaatcataatagttctaattgtggtcctggtaggagtcaagtcacgctag

SEQ ID NO: 137022 - DNA, 819 bp, Artificial Sequence
  Description of Artificial Sequence: Synthetic coding sequence
atggctctggtgtcaggtatctctctggaccccgaagctgctattggagttaccaagagacctcctcccaagtgggtggatggtgtcgacgagatccagtacgacgtgggaagaattaaacaaaagatgaaagaattagcttctctgcacgataaacacctcaaccgacccacgctggacgacagttctgaggaggaacacgcaatcgagatcacaactcaagaaattacccaactctttcatcgctgccagcgggccgtgcaagcacttccaagcagggctcgggcctgcagcgaacaggagggaagactcttaggtaatgtggtcgcatctctggctcaggctcttcaggagctgagcacttctttcagacacgcacagtctggctatctgaagaggatgaaaaatagagaggaaaggtcacagcacttcttcgacacatcggtgcctttaatggacgacggagacgataacacgctgtatcaccgcggattcacagaagatcaattagtgcttgtagaacagaacaccctcatggtggaggaacgtgaacgcgaaatccgacagattgttcagagtattagtgacctcaacgagattttccgagatctcggagccatgatcgtcgagcagggcacagtgctagaccgcatcgattacaatgtagagcagagctgcattaagaccgaggacggtctcaaacaactgcataaagctgaacagtatcaaaaaaagaatcgaaagatgctggtgattcttatacttttcgtgatcatcatcgtcctgatcgtcgtcctggtcggtgtgaaatccagatag

SEQ ID NO: 137023 - DNA, 978 bp, Artificial Sequence
  Description of Artificial Sequence: Synthetic coding sequence
atggctacaagacgtctcacagacgccttccttttactgcgtaacaactctattcagaacagacaattgctggccgaacaggtttcaagccatatcacctcctctcctctccacagccggagtatcgcggccgaacttgatgagttagccgatgataggatggcgctagtgagcggaatttccctggatcccgaggctgctatcggcgttactaaacggccacctcccaagtgggtggacggggtggatgaaattcagtatgatgtcggtaggatcaagcaaaaaatgaaggagctcgcgagcctgcatgataaacacctcaaccgaccgaccctggacgactcctctgaggaagagcacgcgatagagattacaacccaagagattacccagctgttccatagatgtcagcgcgctgtccaagctctgccatctcgcgcaagagcatgttccgagcaagaaggacggctcctcgggaacgttgtggcctccctcgctcaggccttgcaggagctcagtactagctttcggcatgcccaatccggttacctgaagagaatgaaaaaccgagaagaacgctcacagcatttttttgataccagcgtgccgctgatggacgacggagacgacaacacgctttatcaccgtgggttcactgaagaccagcttgttcttgttgaacagaacacgttaatggtcgaagaaagggagagagaaattagacagattgtgcaatcaatcagtgacttgaacgaaattttccgcgatctcggcgcgatgatcgtggaacagggtactgtcctggatcgtatcgattataacgtggagcagagctgcatcaagaccgaggatggcttgaagcagctgcataaggctgaacagtaccagaagaaaaataggaaaatgttggtgatcctcattctatttgtgatcattattgtgcttatagtggtccttgtgggcgtgaagtcaaggtag

SEQ ID NO: 137024 - DNA, 366 bp, Artificial Sequence
  Description of Artificial Sequence: Synthetic coding sequence
atggcacttgtaagcggcatctccctggatccggaggccgctatcggcgtgacaaaacgtccccctccaaaatgggtggatggcgtagacgagattcaatacgacgtgggccggatcaaacaaaagatgaaagaactcgcaagccttcacgacaagcacttgaaccggcctacactggatgattcttctgaggaggaacacgcaattgagatcaccacccaggagatcactcagctgtttcacagatgccagcgcgcggttcaggcactacccagtcgggcccgggcatgcagcgagcaggagggccggctcctcggcaacgtggtcgcctccctggctcaggcccttcaggaactcagcacgtag

SEQ ID NO: 137025 - DNA, 420 bp, Artificial Sequence
  Description of Artificial Sequence: Synthetic coding sequence
atgaaaaacagagaggagcggagccaacattttttcgacaccagcgtgccattgatggatgacggagatgacaacaccctataccacagggggttcaccgaggaccagttggtgctggtcgagcagaataccctgatggtggaagagcgggagagagaaatccgtcagatcgtgcagtcgatatcagatctcaacgaaatcttcagggatctgggcgcaatgatcgtcgagcagggaaccgtgcttgaccgcattgactacaacgtcgagcaatcatgtatcaagactgaggacggactgaagcagctccacaaagccgagcagtatcagaaaaaaaacagaaagatgcttgtgatcctgatcctattcgtaatcattatcgttcttatagtggtattggtgggcgtgaagagtcgatag

SEQ ID NO: 137026 - DNA, 660 bp, Artificial Sequence
  Description of Artificial Sequence: Synthetic coding sequence
ggaatttcactggatcctgaggcagccattggcgtgacaaaaagacccccccccaagtgggtggacggcgtggacgagattcagtacgatgtaggaagaataaagcaaaaaatgaaagagctagcctcactgcacgacaaacacctgaaccgaccgactctggacgactcctccgaggaagagcatgcaatagagattactactcaagaaattactcagctgtttcataggtgccagagggccgtgcaggcacttccatctagggcacgagcctgtagtgaacaggagggacgattactggggaatgttgtagcatcattagctcaggccttgcaggaattgagcacctccttcagacacgcccagagcggctacctcaagcggatgaagaacagagaagagcgatcccagcacttcttcgatactagcgtgcctctcatggatgatggggatgacaataccctatatcaccggggaacagtcttagatcgtatcgactataatgtcgagcagagctgcattaaaaccgaggatgggttaaagcagctgcacaaggccgaacaataccaaaaaaaaaacaggaagatgttggtgatacttattctgtttgtaattatcattgtgttaatagtggtgctggtcggggtcaagtctaggtag

SEQ ID NO: 137027 - DNA, 369 bp, Artificial Sequence
  Description of Artificial Sequence: Synthetic coding sequence
atggccctggtgtccggtatcagcttggaccctgaggctgctataggggtcactaagcggcctcccccgaaatgggttgacggggtggatgagattcagtatgacgtgggacggattaaacagaaaatgaaggaattggctagcctgcacgacaagcaccttaatcgtcccacgctggatgactctagcgaggaagagcatgccatagagattaccacgcaagaaatcacacaactgttccatagatgtcaaagagctgtgcaggcccttccgtcccgggcccgggcctgcagcgagcaggaggggagactcctcgggaacgttgtagctagtcttgcacaggccctgcaagaactgtcaacttcttag

SEQ ID NO: 137028 - DNA, 609 bp, Artificial Sequence
  Description of Artificial Sequence: Synthetic coding sequence
atggcgacaagaaggctgactgacgcttttctgctgctgaggaataactccattcagaataggcagctgctggcggagcaagagctggatgagctcgccgacgatcgcatggccctcgtgagtggcatctctttagaccctgaagcagctatcggagttaccaaacgccctcctcccaagtgggtggacggagtcgatgaaatacagtacgatgtggggaggatcaagcagaagatgaaagagctggcatccctccatgacaagcacttgaatcggccgacgttagacgattctagcgaagaagagcatgctatcgaaatcactacacaagaaatcacacaactctttcataggtgtcaaagagcagtacaggccctgccttctagggcccgtgcctgtagcgagcaagaagggagacttcttggcaatgtcgtcgcctctttggcccaagcccttcaggaattgagcacaagtttccgccacgcacagtccggatatctgaaacgaatgaaaaacagagaggagcgttcacagcattttttcgatacttcagtcccgcttatggatgacggtgacgataacacactgtatcataggcgaaccagttag

SEQ ID NO: 137029 - DNA, 909 bp, Artificial Sequence
  Description of Artificial Sequence: Synthetic coding sequence
atgagcgaggacgaggaaaaggtgaaactgagaagattggagcctgcgatccagaagtttattaaaatcgttattccgacagacctggagagattgcgaaagcaccagatcaatatcgagaaatatcagcgatgtaggatctgggataagctgcatgaagagcatattaatgccggacgtactgtacaacagcttcggagtaacatcagagagatcgaaaagctgtgtctcaaggtacgtaaagacgatttggtcctcctgaaaaggatgatagaccccgtcaaggaggaggctagtgccgccacggccgagttccttcagctacacctagagtctgtggaggaacttaaaaagcagttcaacgatgaagaaaccctcctgcagccgcctttaacacgatctatgaccgtaggtggcgcattccacaccacagaggctgaggcatcctctcagtctttgacacaaatatacgcactgcctgaaattcctcaggaccaaaacgccgccgaatcctgggaaaccctagaagcagacctgattgagctgtcacaactcgtcacagacttctctctgctcgtgaactcacagcaggagaagatcgactcgattgctgatcacgtcaatagcgcagccgtaaacgtggaggagggcacaaagaacctgggcaaggccgccaaatataagctcgccgcactgcctgtggctggtgctctgattggcggcatggtgggcgggcctatcgggcttctggctggctttaaagtggccggaattgcagctgcgctcggcggcggcgttcttggcttcacgggcggtaaactgatccagaggaagaaacagaaaatgatggagaaactgacatctagttgcccagatctgcccagccagacagataagaaatgctcatag

SEQ ID NO: 137030 - DNA, 909 bp, Artificial Sequence
  Description of Artificial Sequence: Synthetic coding sequence
atgagcgaggacgaggagaaagtgaagctgcgtaggttggagcctgccatccagaaattcattaagatcgtaatcccaaccgatctggagcggctgcgcaagcaccaaattaacatcgaaaagtatcagaggtgtcggatctgggacaaactccacgaggaacatattaacgccggccgcaccgtgcagcaactgagatcaaacatccgagagatcgaaaagctgtgtctaaaagtacgcaaagacgacctggttcttttgaagagaatgatcgatcccgtgaaagaagaagcatctgccgccactgccgagtttctccagcttcaccttgagtcagtagaagaactcaaaaagcaattcaatgacgaggaaaccctgctgcagccccctctcactaggagcatgacagtggggggggcattccatacaaccgaagctgaagccagctcccagtctctcacccaaatttatgccctacctgagatcccacaggaccagaacgccgcagaaagctgggaaacattagaagccgacttaatcgagctttctcaactggtcactgatttctctctcctcgtgaattcacagcaggaaaaaatcgactctatagccgatcatgttaacagcgccgcagtgaatgtagaggagggaactaaaaacctggggaaagcagcaaagtataaacttgcagctctccctgtggcaggggcgctgattggaggcatggtgggggggcccatcgggctcctggctggtttcaaggtggcgggcattgccgcagctcttggtggaggtgtattaggatttaccgggggcaagctgattcagcggaagaagcagaagatgatggagaagcttacttcatcctgccccgatctgccatctcagacggataagaagtgtagttag

SEQ ID NO: 137031 - DNA, 126 bp, Artificial Sequence
  Description of Artificial Sequence: Synthetic coding sequence
atgagtgaggacgaggagaaggtaaaactgcgaaggttggaaccagcgatacagaaattcatcaagattgttattccgacggacctggagcgactgcgcaagcaccagattaacattgaaaagtag

SEQ ID NO: 137032 - DNA, 126 bp, Artificial Sequence
  Description of Artificial Sequence: Synthetic coding sequence
atgtctgaagacgaggagaaggttaagcttagacggctcgagcccgcaatacagaaattcataaaaattgtgataccgaccgatttggaacgcctgcggaagcaccagatcaacattgagaagtag

SEQ ID NO: 137033 - DNA, 909 bp, Artificial Sequence
  Description of Artificial Sequence: Synthetic coding sequence
atgtcggaggacgaagagaaagtgaagctgaggcggctggagccggctattcagaagttcataaagatcgtgatccccactgatctggagcgattgagaaaacatcagattaatatcgaaaagtatcagcgttgccggatctgggataaattgcatgaagagcatatcaatgcaggacgaaccgtacagcagctcagaagcaatatacgcgaaatagagaagctctgcttaaaagtacgaaaggacgatcttgtcctgctgaaacgaatgatagacccggtcaaagaggaagcctccgcggccacagctgagtttcttcaactgcatttggaatccgtggaagaactgaagaagcagttcaacgatgaagaaactctgctgcaaccacctctgacccgaagtatgactgttgggggcgcctttcacactactgaagccgaagcctcttcccagagtctcactcagatttacgcactgccagagatcccgcaggatcaaaatgccgctgagtcttgggaaactcttgaggctgacctgatcgaacttagtcagctggttacagatttcagcctgctagtcaatagccagcaggagaaaattgactctattgctgatcacgtgaacagtgccgccgtcaatgtggaggagggcacaaaaaatctcgggaaggccgctaaatacaagctagccgcgctccccgtggctggcgcactcataggcgggatggtcggtggtcccatcgggctcctcgccggatttaaggtggcggggatcgcagctgcactaggcggcggcgtgctgggctttacaggtggcaagctcatccaaagaaaaaagcagaagatgatggagaagcttactagctcctgtcctgatctgccatctcagacagataaaaagtgctcttag

SEQ ID NO: 137034 - DNA, 636 bp, Artificial Sequence
  Description of Artificial Sequence: Synthetic coding sequence
atgagactgttcctgtggaatgcagttcttaccctcttcgttacatctctcatcggcgcactgatacctgagccagaggtgaagatcgaagtactacagaaaccttttatctgtcatcgaaaaactaaaggcggggatcttatgcttgtgcactacgagggttatctggagaaagacggcagtctgtttcactctacgcacaaacacaacaacggacagcctatctggtttacactgggtattctggaagctctgaaggggtgggatcagggactgaaaggaatgtgcgtgggggaaaagaggaagctgattattccgccagcccttggatacggcaaagagggcaaaggaaaaatcccacctgaatccactctcattttcaacattgaccttctcgaaataaggaatggaccaagaagtcacgagtcctttcaagagatggatttaaatgatgactggaagttgtccaaggatgaagtaaaggcttatctgaagaaagagttcgaaaagcacggcgcagtggtcaacgaatctcatcacgacgctcttgtcgaggacatctttgacaaggaggacgaggataaggatggatttataagtgcacgggaatttacctacaagcacgatgaattgtag

SEQ ID NO: 137035 - DNA, 783 bp, Artificial Sequence
  Description of Artificial Sequence: Synthetic coding sequence
atgaaagatcggacccaggagctccgcacagccaaggacagtgacgatgacgatgatgttgctgtgactgtggatagggataggtttatggatgaatttttcgagcaggtagaagagatcaggggtttcattgataagatcgcagaaaatgtggaagaggtaaagcgcaaacattccgccattcttgcttcccctaatcctgacgaaaagactaaagaagagctcgaagagctgatgagcgatatcaagaagactgccaacaaggtccggtcaaaactgaaatctatcgaacagagcatcgaacaggaggaagggctgaacagatcttctgctgacctacggatccgcaagacacaacattcgactctatcacgtaaatttgttgaggtgatgtccgagtataacgctacacagagtgactaccgggagcgctgcaaaggccgaatccaacggcagttggaaatcacaggaagaactaccacgtctgaggaactggaagacatgctggagtccggaaaccctgctattttcgcctctggcatcatcatggattcaagcatctctaagcaagcgctgtctgagatcgagactagacattccgagataataaagctggagaactcaatacgggaactccacgacatgtttatggatatggcaatgctggttgaaagccagccccagggggcctttctgaagtcttgtcccgaaccacagcctaacccagaagaaggggctctttggtcatcaggggcacccggtccagccggtagagacgactag

SEQ ID NO: 137036 - DNA, 516 bp, Artificial Sequence
  Description of Artificial Sequence: Synthetic coding sequence
atgaaggacagaacacaagagctgaggactgccaaggactctgacgatgatgatgacgtcgcagtcacagtggatagagacaggttcatggacgagttctttgaacaagtcgaggtaatgagtgagtacaacgccacccagagtgactaccgagagcgctgcaagggacgaatccagcggcagctggaaatcacaggtaggaccacaaccagcgaggagcttgaggatatgcttgaatctggtaaccccgccattttcgctagcggcatcattatggacagttccatcagcaagcaagctctgtctgaaatagaaacaaggcactcggagattattaagttggagatagaatacaatgtagagcatgccgttgactatgtagagagagccgtgtccgacaccaagaaagccgtgaaatatcaaagtaaagccagaaggaagaaaatcatgattataatctgctgtgtaatattaggtattgtcattgcttccacagttggaggcatctttgcatag

SEQ ID NO: 137037 - DNA, 756 bp, Artificial Sequence
  Description of Artificial Sequence: Synthetic coding sequence
atgaaggatcgcacccaagagctccgtactgctaaagattcagatgatgatgacgacgtggcagtgaccgtggacagggacaggtttatggacgagttttttgagcaggtggaggagattcgtgggtttatagataagattgccgaaaacgtggaggaggtaaagagaaagcattcggccatccttgcctcccccaaccctgacgaaaagacaaaagaagaacttgaggaactgatgtccgacataaagaagacagcaaataaggtgcggtccaagctgaaatcgatcgagcagtccatcgaacaagaagagggactcaatcggtctagcgctgacctaagaatccgcaaaactcagcacagcaccctgagccgcaagttcgttgaagtaatgtcagaatacaacgcaacgcaatctgactatagggaacggtgtaaggggaggatccagagacagctggaaattaccggtcggaccactacatcagaggaactcgaagacatgctggaatccgggaaccccgccatcttcgcctctgggatcattatggattcaagcattagcaagcaggcattgtccgagatcgaaacccgccactctgagattatcaagctcgagaatagtatcagagaactgcacgatatgttcatggacatggctatgctcgttgagtctcaaaccatgtggcgcggtccatgcctaacaccccgacgccccagctcgactagagcacgacgtgccgggcgcaagtcctag

SEQ ID NO: 137038 - DNA, 1053 bp, Artificial Sequence
  Description of Artificial Sequence: Synthetic coding sequence
atgtttataaaaggcagagctccgcgagctcctcctagggagaggaggcgcgccacccgcggcggactgcggcaggtcgtcgccccacccagagctcttgggtcaacaagtcggccccactttaggcgcgcaagcgtttgtagacgcagatgtcgtaaatctgggggcctcctcgctgcctccagaaagatggcggccgctgccgtaaacggggctgcaggattctcctcttcgggcccagctgctacaagcggagcggtcctgcaggccgcgaccggcatgtacgagcagcttaaaggtgaatggaaccgaaagagcccaaacctcagcaaatgcggagaagagctcgggaggctgaagctggtacttctcgagttgaatttcctgccaactacaggtaccaagctaacgaagcagcagctcattctggccagagacattcttgaaattggtgcgcagtggagtatcctcaggaaggatataccatctttcgaacggtatatggcacaactcaagtgttactatttcgattacaaagaacagctcccagaaagcgcctacatgcaccagttgctcggcctcaacttgctgtttttgcttagtcagaatcgcgtggcagagtttcatacagagctggaaaggttgcctgccaaagatatccagaccaacgtatacatcaaacaccccgtttctctggaacagtacctcatggaaggttcctacaacaaagtgttcctcgccaaaggcaacatcccagccgagagttatacgtttttcatcgatattctcctggacaccattcgggacgagatcgccgggtgcatagagaaagcctacgagaaaatactgtttaccgaggctactcggatattgttcttcaatactccaaagaagatgaccgactatgccaagaaacggggctgggttctcggcccaaacaattactacagtttcgcctcacagcaacagaagcccgaggatacaacgatcccctccactgagttggccaagcaggtcatagaatacgcccggcagctcgaaatgattgtctag

SEQ ID NO: 137039 - DNA, 864 bp, Artificial Sequence
  Description of Artificial Sequence: Synthetic coding sequence
atgcgcgacagactgcccgatctcaccgcctgcagaaagaatgacgatggggacacagttgtagtagtcgaaaaggaccatttcatggatgacttctttcatcaagtggaggagatcagaaacagtatcgataaaattactcagtacgtcgaggaagtcaaaaaaaatcattctataattctaagcgcaccgaaccccgagggaaaaatcaaggaggaactggaggatctgaataaggagatcaaaaagacagctaataagataagggccaagcttaaggccatcgagcagagtttcgatcaggacgaaagcggcaatcgcacatccgtagatcttcgcatcagacggacccagcactcggtgctcagccgcaaattcgtagaggcgatggccgaatacaatgaagcccagacacttttccgcgagcggagtaagggccggattcaacgtcaattagagatcactggccgcacaactaccgacgacgaactggaggagatgctggaaagcggaaagccgtctatttttacgtccgacattatttcagattctcagattaccagacaagcattaaatgaaatcgaaagtcgccacaaagacattatgaaactcgagacgagtattcgcgaattacacgagatgttcatggatatggctatgtttgtcgagactcagggggaaatgatcaacaacattgaacggaatgtcatgaacgctaccgactatgtggaacacgctaaggaggaaactaaaaaggcaatcaagtaccagagcaaagcaaggcgcaagttaatgttcatcatcatatgcgtgatagtactgcttgtgattcttggcataatcctggcaacaacactgtcctag

SEQ ID NO: 137040 - DNA, 867 bp, Artificial Sequence
  Description of Artificial Sequence: Synthetic coding sequence
atgcgagatcgcctgcccgatttgacagcttgccggaaaaatgacgacggtgataccgtggtggtcgtcgagaaggatcatttcatggatgacttttttcatcaagtagaggaaataagaaactctattgataagatcacgcaatacgttgaggaagtgaagaagaaccatagtatcattctgagcgcacccaatcccgagggcaagatcaaggaagaattggaggaccttaacaaggagattaaaaagaccgccaacaagattagagcaaagctcaaagccatagaacaatcattcgaccaggatgaatcgggcaaccgcacctccgtggatttgagaattagacgcactcaacactccgtgctctcgagaaaatttgtcgaagcaatggctgagtacaacgaggcgcaaaccctttttcgtgagcgatcgaagggccgcattcagagacaactggagataaccggacgcacaaccaccgatgatgaactggaggaaatgcttgaaagcggcaagcccagcatatttacatcggacatcatttcagatagccagattaccaggcaggcccttaacgagattgagagtagacataaggatattatgaaactcgagacatcaatccgtgagctgcacgaaatgttcatggacatggctatgttcgtggaaactcagggggaaatgatcaataatatcgaacgtaacgtcatgaatgccacggactacgttgaacatgccaaagaggagacaaaaaaggctatcaaataccagagtaaggcgagacggaagaagtggattatcatagctgtctccgtggttcttgtggccatcattgcacttattataggcttaagtgttgggaagtag

SEQ ID NO: 137041 - DNA, 777 bp, Artificial Sequence
  Description of Artificial Sequence: Synthetic coding sequence
atggatgagttcttttccgagatagaagaaactcggctcaacatagacaagatatctgagcacgtcgaggaagcgaagaagctctactctattatattgagtgcacccattcctgaacccaagactaaggacgatctcgaacagttgaccactgaaataaagaaacgggcaaataatgtgcgcaacaaactcaagagcatggagaagcatatagaggaggacgaggttcgctcaagtgccgacctgaggatcaggaagagccagcatagcgtgctgtcccggaaatttgtcgaagtaatgaccaaatacaatgaggcccaggttgactttagagaaaggtccaagggaaggatacagagacagctggagatcactggcaagaagacaactgatgaagagctggaggaaatgctagagagcggcaatcccgccattttcacatcaggtatcattgactcgcaaatctccaaacaagccctctctgagatagaaggcagacataaagacatcgtcagattagaaagcagcatcaaagagctgcatgacatgttcatggatatcgccatgctcgtggagaaccaaggcgaaatgttggataatatcgaattgaatgttatgcacacagtcgatcacgtggagaaggctcgagatgaaactaagaaagccgtaaaatatcaatcccaggccaggaagaagttgataataattatagtcttggtggtggttctcctcgggatacttgctttaataatcggcttaagcgttgggcttaactag

SEQ ID NO: 137042 - DNA, 870 bp, Artificial Sequence
  Description of Artificial Sequence: Synthetic coding sequence
atgaaggaccggctggagcaacttaaggccaaacagctaacccaggacgacgatactgacgccgtggaaatcgccatagacaacacagctttcatggatgagttttttagtgagattgaagagacccgactgaatattgacaagatttcagagcacgtcgaggaggctaaaaaactctactcaattatcctgagcgcaccaattccggagccgaagactaaagacgatttagagcagctgactactgagatcaagaaacgtgcaaataatgtccgcaataaactcaagtctatggaaaagcatattgaagaggacgaagtaagatcatctgccgatttgagaattagaaagtcacagcactctgttttgtcgaggaaattcgttgaggtcatgactaaatacaatgaggcccaggttgatttcagggaacgcagtaaagggcgaatccagcgccaacttgaaataacggggaagaaaaccaccgacgaagagctcgaagaaatgctcgagtctggaaacccagctatatttacctcagggattatcgacagccagatatccaagcaggccttatctgagatcgagggccgacacaaagatattgtccgtctggaatcgagtatcaaagagcttcacgatatgttcatggatatagccatgctcgtggagaatcagggcgaaatgctcgataacatcgagctcaacgtcatgcacaccgtcgatcatgtcgaaaaggcaagggacgaaaccaagaaagccgtgaagtatcagtcacaagcccggaaaaagctcattataatcatcgtgctggttgtggtcctgctggggatattagcgctgatcatcggtctgtccgtaggcctcaactag

SEQ ID NO: 137043 - DNA, 543 bp, Artificial Sequence
  Description of Artificial Sequence: Synthetic coding sequence
atggaaaagcatatagaggaggacgaagtaagatcctctgcggacctaagaatcaggaagtcccagcacagtgtcctctcccgtaaattcgtcgaggtgatgacaaaatataacgaggctcaagtggatttccgggagcgaagcaaaggccgcatccaaaggcagctggaaatcaccggaaagaagaccaccgatgaggagctagaagagatgctggaaagcggaaaccccgcaatctttaccagtggcattattgacagtcagatctccaaacaggccctgagtgaaatcgagggccgtcacaaagatatcgtgcgccttgaatcctccataaaggaactccacgacatgttcatggacattgctatgttggtggagaaccagggatcaatgatcgatcggatagagaacaacatggatcagagtgtcggattcgtggagagagccgtggctgatacgaagaaagcagttaaataccagtctgaggcacgcaggaagttgattagtcttcagacaggagtggcaacattagtgttcaggtag

SEQ ID NO: 137044 - DNA, 834 bp, Artificial Sequence
  Description of Artificial Sequence: Synthetic coding sequence
atgaaggatcgcctggaacagctcaaggcgaaacagctgactcaggatgacgatacagacgctgtcgagatcgcgattgataacacagcgtttatggatgagttttttagcgagattgaagagaccaggctcaatatcgacaagatcagtgagcatgtcgaggaagcaaaaaagctgtactccattatactgtctgcacccatcccagagccgaagacaaaggatgaccttgaacaacttaccactgaaataaaaaagagggctaacaatgtccggaataagcttaagtctatggagaagcatattgaggaggacgaggtgcggtctagcgccgacttaagaattagaaagagccagcatagcgtgctgagcaggaaattcgtcgaagtaatgacaaagtataatgaggcccaggtagactttagggaacggtccaaggggcggatccagaggcagttggagatcacagggaaaaaaactacagatgaggagctggaggaaatgctggagagtgggaacccagcaatctttacctccggcatcatcgattctcagatcagcaagcaggctctgtcggaaatcgagggccgtcacaaggatattgtcaggctagaatcttccatcaaggagcttcatgatatgttcatggacatcgccatgctggtcgaaaaccagggcgagatgctggataacattgagttgaatgtgatgcacacagtggaccacgtggaaaaagctagggatgagaccaagaaggcagtaaagtatcagtctcaggctagaaaaaaactaataagcctgcagacaggggtggcgactctcgtcttcaggtag

SEQ ID NO: 137045 - DNA, 231 bp, Artificial Sequence
  Description of Artificial Sequence: Synthetic coding sequence
atgttcatggatatagccatgctagtggaaaaccagggtgaaatgcttgataacatcgagctcaacgtgatgcatacagtcgaccacgtggagaaggcgagggatgaaactaagaaggctgttaaatatcagtctcaggcccgcaagaaacttattatcataatcgtcctagtggtcgtgttgctcggcatactcgctctgatcatcggtttatctgtaggcctgaactag

SEQ ID NO: 137046 - DNA, 759 bp, Artificial Sequence
  Description of Artificial Sequence: Synthetic coding sequence
atgaaagaccggcttgagcagctgaaggcaaaacagcttacccaggacgacgacaccgacgcggtagagatagccattgataatactgccttcatggatgagttcttctccgagattgaagaaaccaggctgaacattgataaaatctcggaacacgttgaggaagcaaagaaattgtattccatcattctctcggctcccatcccggaacctaaaaccaaagatgacctcgaacaactcacaacggagatcaagaagcgcgcgaacaacgtccggaataaactcaagagcatggagaagcatatcgaggaggacgaagtgagatcttcagctgacttgagaattaggaagagtcagcacagtgttctgtcccggaagtttgttgaagtgatgacaaagtataacgaggcccaagttgattttcgggaaaggagcaaagggcggattcagcgtcagctggagatcaccggcaagaagaccaccgatgaggagctggaggaaatgttggagagtggaaatccagctattttcacaagtgggatcatcgatagccagatctcaaagcaggccctgagcgagatagaggggcgccataaagatattgtgagactggagagctcaatcaaggagttacacgacatgtttatggatattgctatgttggtcgagaatcaaaagctaattatcatcattgtgcttgtcgtagttttgctcggcattctcgctttgatcatcggactatcggtgggtctgaattag

SEQ ID NO: 137047 - DNA, 894 bp, Artificial Sequence
  Description of Artificial Sequence: Synthetic coding sequence
atgcgtgatagaacccacgaattgcgacagggggacgatagctcagacgaagaagacaaagagcgtgtcgccctcgtggtccacccagggacggccagacttggttcccctgacgaggagttttttcacaaagttcgcactatccggcaaaccatagtgaagttaggcaacaaagtccaggagctggagaagcagcaggtgaccatcctggccacacctttgccggaggagtcaatgaaacaagagcttcagaaccttcgagacgagatcaagcaactgggtcgggaaattcgtctccagctgaaggccatagagcctcaaaaggaagaggcagatgagaattacaatagcgtcaacactcggatgcgcaaaactcaacatggtgtgctgtcacagcaattcgtggagctgatcaacaagtgtaactccatgcaatctgagtaccgcgagaaaaacgtggaaagaataagaagacagctcaagattaccaacgctggtatggtgagcgatgaagagttggaacaaatgctcgattcagggcaatccgaagtctttgtgagtaatatactgaaagatacccaggtcactcgccaggctctcaacgaaatcagtgcccgtcatagcgaaatacagcagctcgagaggtcaattagggagcttcacgacatctttacttttttggccaccgaagtcgaaatgcagggagagatgatcaacagaatcgaaaaaaacattctttcctctgccgactacgttgagagagggcaggagcatgtgaagacagccctagaaaatcagaagaaggctcgcaaaaagaaggtcttaatcgcgatttgtgtgagcattaccgtagtgttgctcgccgtgataataggtgtgacagtggtgggttag

SEQ ID NO: 137048 - DNA, 888 bp, Artificial Sequence
  Description of Artificial Sequence: Synthetic coding sequence
atgggcatgaccgcgcgcacaaagcgcactcgctccggatcgcgttggtggtgcacgagagccaggcacggatggggcgctcgaacgaggtcctcgtccacttctcccctgggtcatccccctcaagttaggaccattcgacaaacgatcgtgaagctgggcaacaaagtgcaggagctggaaaaacagcaggttacaattcttgctacccctctgcccgaggaatcaatgaagcaagagctgcagaatctacgggatgaaatcaaacaactggggcgagaaattagacttcagttgaaagctatcgagccccagaaggaggaggctgacgaaaattacaactctgtgaataccagaatgcgcaaaacacaacatggcgtgttgtcccaacagtttgttgaactcataaacaaatgcaattccatgcagagtgagtaccgagagaaaaacgtggaacggatcaggcggcagctcaaaatcacaaacgcaggtatggtctcagatgaagagttagaacaaatgttggatagcggacagagtgaggtgttcgtttcaaatatcctgaaagacacccaagttaccaggcaggcacttaatgaaatcagcgcccggcactctgagatccagcaacttgagagatcaatcagagaactgcacgacatttttactttcttagccacggaagtagagatgcagggggagatgatcaataggatcgaaaaaaatatcctctcctccgccgattatgtcgagcgcgggcaggagcatgtgaagactgctttagagaatcagaaaaaagcacgaaaaaaaaaggtgctcatagctatctgcgtaagtatcaccgtggtcctacttgccgtgataatcggggtcaccgtggtgggatag

SEQ ID NO: 137049 - DNA, 1068 bp, Artificial Sequence
  Description of Artificial Sequence: Synthetic coding sequence
atgatccctaggaaacgctatggaagtaagaacacggatcagggggtctatttaggtctgtctaaaactcaagttctgtcgccagccactgccggcagctctagtagtgatatcgctcctctccccccaccagtgactctggtcccaccccccccggacacgatgtcctgccgagacaggacacaggaattcctcagcgcctgcaagtccctgcagacacgacagaatggtatacaaaccaacaagccggccctgcgcgcagtgcgccagagatccgaattcaccctgatggctaagagaattgggaaggatctgtctaataccttcgcgaagcttgagaagctcaccatcttagcgaaacgaaagtctctgttcgacgataaagctgtggaaatcgaggaattgacctacatcattaagcaggatataaacagtctgaataaacagatcgcccagctccaagatttcgtcagagccaaggggtcccaaagcggccgccatttgcagacccactctaataccattgtggtttctctccagagcaaactggccagcatgagcaatgacttcaaatctgtgcttgaggtcagaacagagaatttgaaacaacagaggtcgcggcgtgagcagttcagtcgagctcccgtgtcagctctgccactggcacccaaccatctgggcggcggggccgtcgttcttggcgcagagagccatgcgagcaaagacgtggcaatcgacatgatggattctcggacctctcagcaactccagctgattgatgagcaggacagttatatccagagcagggcggacacaatgcagaacattgaatccaccatcgtggagctcggatccatcttccagcagctggcccatatggtgaaggaacaggaagagaccatccaacgcattgatgaaaacgttcttggcgcgcagcttgacgttgaggccgctcactctgagatcttaaagtatttccagtccgtgaccagcaatagatggctgatggttaagattttcctgattctgattgtctttttcatcattttcgtggtcttcctggcatag

SEQ ID NO: 137050 - DNA, 966 bp, Artificial Sequence
  Description of Artificial Sequence: Synthetic coding sequence
atgatcccccggaaacgctatggatctaaaaatacggaccagggagtctacctgggattgtctaagactcaggttttgtctcccgccaccgcgggatccagtagttccgatatcgcccccctcccacctcctgttacactcgtcccaccacctccagacacaatgagttgtcgcgacaggacgcaagagttcctttccgcttgtaaatctctgcagacccgccaaaatggcattcagacaaataaaccagcccttcgggccgtccgccaaagatctgagtttacgctgatggccaaacggatagggaaggacctatcaaataccttcgctaagttggaaaaattgacgatcttggccaaaagaaagagcctttttgacgataaagccgttgaaattgaagaactgacatacatcattaagcaggatatcaattctctgaacaagcagattgcccagctccaagactttgtgagggcaaagggctcacagtccggtaggcaccttcagactcacagtaacaccatcgtggtttcattgcaatccaaacttgcaagcatgtccaatgattttaaaagcgtattggaagttagaactgagaacttgaaacagcagcggtcgagaagggagcagttttcgcgagcccccgtctcagccttgccattggccccgaaccatctgggaggcggcgcggtcgtgctgggagcagaatcacacgcttccaaagatgtggctattgacatgatggattctagaacatcccagcaactacagctcatcgatgagcaagattcatacattcaatcacgcgcagatacaatgcagaatatagagtctactatagtggagctggggagcatattccaacaattagcccacatggtgaaggaacaggaagagactatacagtccgtactactgtttcctcttttgcccgcgttatctcctgggagcacgagaacctgctag

SEQ ID NO: 137051 - DNA, 906 bp, Artificial Sequence
  Description of Artificial Sequence: Synthetic coding sequence
atgtcttgccgcgatcggactcaggaattccttagcgcttgcaagtcgctgcagacacgccagaatggaattcagaccaacaaacctgctctcagagctgttcgtcaaaggagcgaatttactctgatggccaagcgtattggcaaggaccttagcaatacgtttgccaaattggagaaactgactattctcgcaaagcgcaagagcctgttcgatgacaaggcagtggagatcgaagagcttacatatataatcaaacaggatatcaatagcttgaacaaacaaatagcccagcttcaagacttcgttcgcgctaaaggctctcagtctggacgccatctgcaaactcattctaataccattgtggtgagcttgcaaagcaaactggcctcgatgagcaatgacttcaaatctgtactggaggttcgcactgaaaatctaaagcagcaaaggtcacgtcgcgagcaattctcaagagcaccagttagtgccctgccgctggcccctaatcacctcggaggcggagctgtcgtactcggagctgaatctcatgcttccaaggacgtggccattgacatgatggattccaggacctcacagcagctacagcttattgatgagcaagactcctatatccaaagccgagccgacaccatgcagaacattgaaagcacaattgtggagcttgggtccatatttcagcagctggcccacatggttaaagagcaggaggagacgatccaacgaattgacgagaatgtgttgggtgcacagcttgatgtggaggctgcacactccgagatcttgaagtacttccagtcagtgacatcaaataggtggttgatggttaaaatttttttaattttgatcgtctttttcattattttcgtggtgttcctcgcctag

SEQ ID NO: 137052 - DNA, 780 bp, Artificial Sequence
  Description of Artificial Sequence: Synthetic coding sequence
atggccaagcgcatagggaaggatctcagtaacacttttgccaaactggagaagctcacaattctcgcaaagcgtaagagtctctttgacgacaaagccgtggagatcgaggagctgacctacatcattaaacaagacataaacagtttgaataaacagatcgcccagctgcaggactttgtcagggccaagggatcacagagtgggaggcatctgcagacccactctaataccatagtggtcagtctgcaatcgaaactggcctccatgagcaacgattttaagtccgtgttggaagtgcgcacggagaacctaaagcagcagagatcacgcagagagcaattttctagggccccagtttccgcgttgccattggcaccaaatcatctgggaggaggtgctgtggtgctgggtgctgaaagtcatgcaagcaaagacgtcgccatcgacatgatggatagcaggaccagccaacagctgcagctgatcgatgaacaggactcctatatccaatctagggccgatacgatgcagaacatcgagagcaccattgtcgagttgggttccattttccaacagctagcacacatggtaaaggaacaggaagagaccattcagcgcattgacgagaatgtcctaggcgcacagttagacgtagaagcggctcactctgagattctgaagtactttcagagtgtgacatctaaccggtggttgatggtcaaaatttttttgattctcattgtgtttttcattatatttgtggtgttcctagcctag

SEQ ID NO: 137053 - DNA, 720 bp, Artificial Sequence
  Description of Artificial Sequence: Synthetic coding sequence
atgtcttataccccgggagtggggggcgacccagcgcaactggcacaacgaatctcatccaatattcagaagatcactcagtgctccgtggagatacagcgaacattgaaccagctcggaacaccacaggactcacccgagttaaggcagcagctgcaacagaaacagcagtatacgaatcagctcgctaaggagaccgataagtacataaaggaattcggaagcctgcccaccactcctagcgagcagcggcaaagaaagattcagaaggaccggctggtcgctgaatttactacctccctgactaactttcagaaagtccagaggcaagctgcagaaagggagaaggagtttgtcgccagagtgagggcctcatctcgggtctccggcagctttccggaagattccagcaaggagagaaacctagtttcgtgggagtcacaaacccagccccaggtgcaggtgcaggacgaggagataactgaagatgacctgaggctgatacacgaaagggaatcctccataagacagctggaggcggacatcatggacattaacgaaatctttaaggatctgggcatgatgattcacgaacagggggatgtcatcgactcgatcgaagcaaacgttgaaaatgctgaagtgcatgtgcagcaggccaaccagcaactgtcgcgtgctgctgattatcagaaaaaggattcttgtatgttgatgtag

SEQ ID NO: 137054 - DNA, 786 bp, Artificial Sequence
  Description of Artificial Sequence: Synthetic coding sequence
atgtcttatacgcctggcgtgggcggagatccggcccaactcgcgcagcgaatttcatctaatatccagaaaattacgcagtgcagtgttgaaattcaacgcacactgaatcaattgggcaccccccaggattctccggagttgagacagcaactgcagcagaagcagcagtacacaaaccagttggctaaagagacagacaagtacataaaggagtttggctctcttccaacaaccccctctgagcagaggcagagaaagatccagaaggaccggttagttgccgaatttactaccagcctgaccaactttcagaaagtgcagaggcaggccgccgagagagaaaaggagttcgttgctagagtccgagcatctagtcgcgtgtcaggctccttccccgaggattcatccaaagaacgcaatctggtgtcttgggaatcgcagacccaaccccaggtacaggtgcaagatgaggaaataacagaagacgatctgcgactgatccatgaacgggagagtagcattcggcaactcgaggctgacatcatggacattaacgagatattcaaggatttaggtatgatgatccacgagcagggtgatgtcatcgatagtatcgaggccaacgtagagaatgctgaagtccacgtccagcaggctaatcagcagttgagccgcgcagcagactaccaacgcaaaagtcgtaagactttgtgcattatcattcttattctggttattggagtcgccatcatatcactcatcatctggggcctgaaccactag

SEQ ID NO: 137055 - DNA, 786 bp, Artificial Sequence
  Description of Artificial Sequence: Synthetic coding sequence
atgtcatacacgccgggggtgggtggcgatcctgcacagctggcccaacgcatcagctctaatatccagaaaatcacccagtgctctgtggagattcagcgtacgttgaatcagctggggacaccccaagattcccccgagctgaggcagcagctgcagcaaaagcagcaatatactaatcagcttgccaaagaaactgataaatatatcaaagaatttgggtcgctcccaacaactccgagcgaacagcgacaaaggaagatccagaaagacaggctggtggccgagtttactacctctctcacaaactttcagaaggtgcaacgtcaggcagcagagcgagaaaaggaatttgtcgcgcgagttagggctagctcccgcgtgtccggctcatttccagaagattctagtaaggaacgaaatctcgtctcctgggaatcacaaacacagccacaggtccaggtccaagacgaggagatcacagaagatgatctgcgcctgatacatgaaagagagtcgagtatccgtcagctggaggcggacatcatggatattaatgagatctttaaggacttgggcatgatgattcacgaacaaggggacgtcatcgactcgatagaggccaatgttgagaacgccgaggtgcatgtgcagcaggccaaccagcaactgagtcgggccgcagactatcagcgcaaatcacgtaagactctgtgtattatcatccttatactcgtaattggggttgctatcatcagtctgattatctggggactgaatcactag

SEQ ID NO: 137056 - DNA, 711 bp, Artificial Sequence
  Description of Artificial Sequence: Synthetic coding sequence
atggcccccgacccctggttttccacatatgacagtacctgtcagatcgctcaggaaattgcagagaagatccagcaacgtaatcagtacgagcgaaagggcgagaaagcacctaagctgactgtgaccattcgggccctgctgcagaatctgaaggaaaaaattgcgcttctgaaagacttactcctgcgagcagttagcacacaccaaataacccagctcgagggggaccgacgacaaaaccttctcgatgacctagttaccagggagcgattactactggcaagtttcaaaaatgagggggccgagccagatctgattcggtcttctctcatgagtgaggaggccaaaagaggggcgcccaatccctggctattcgaagagccagaggagacgagaggcctcggttttgacgagatccggcagcaacagcagaaaattattcaagagcaggacgctggtctggacgccttgtcttccatcatcagcagacagaagcagatgggccaggagatcggaaacgaattagatgaacagaatgaaattatcgatgatctggcgaacctagtggagaatactgatgagaagctgagaaacgagacccgaagggtcaacatggtcgacaggaagtccgcctcttgcggtatgatcatggtcattcttcttctgctcgtggctatcgtggtggtcgctgtttggcctaccaactag

SEQ ID NO: 137057 - DNA, 1785 bp, Artificial Sequence
  Description of Artificial Sequence: Synthetic coding sequence
atggcacctattggcctgaaagccgtggtgggagagaagattatgcacgatgtgattaagaaagtcaagaagaaaggcgaatggaaagtgctggtggttgaccaactctcgatgcgcatgcttagctcttgttgtaaaatgaccgatattatgacagaagggattacaatagtggaggatataaataagcggcgtgagcctttgccatcgcttgaggccgtatatctgataaccccctcagagaagtctgttcattctcttatttctgactttaaagacccacctacagcgaaatacagggctgctcacgtattcttcacagactcttgccccgatgccctatttaatgagctggtgaaaagtcgcgcagcgaaagtgatcaagactttaacggaaataaatattgccttcctgccttatgaaagtcaagtttacagcctagactcagctgattcatttcagtctttctactcccctcacaaagcccagatgaaaaatccaatactagaaaggcttgccgagcagatagcaactctgtgtgccacactcaaagagtacccagcagtacgctaccgaggcgagtacaaggataatgccctgctggcacagctgatacaggacaaattagacgcctataaggctgacgaccctactatgggggaaggccccgacaaggccagatcccagctgctaattcttgacaggggctttgatccctcctcacccgtgcttcatgagctgactttccaggccatgtcatacgatttgctaccaatcgagaatgacgtttataagtatgagaccagtggcatcggggaagctagagtcaaagaagtcctcctggatgaggatgatgatctctggatagctctccgccataagcatatcgctgaagtttctcaagaagtcactcgttcacttaaggacttcagcagctccaagagaatgaatacaggcgagaagaccaccatgagagatctttcacaaatgctcaaaaagatgccccagtaccagaaagagctgtccaaatactctacccacctgcaccttgcagaggactgcatgaaacactatcagggcaccgttgataagctgtgtagagtggagcaggacctggctatggggacagatgcagaaggcgagaagattaaggaccctatgagggccatcgtcccaatattgctggatgcgaatgtgagcacttacgacaagattcgcatcattcttctatacattttcctgaagaacggaataacagaagaaaatctgaacaagctgatccagcatgctcaaatcccgccagaagatagcgaaataattactaatatggcccacctaggagttccgatcgtgaccgactctactttgcgcagaaggagtaaacccgagcgaaaggagagaattagtgaacagacttaccaactgagccgatggactccaataataaaggacattatggaggataccatagaagacaagctcgacacgaaacactacccgtatattagcacgcggtcctcggcctcatttagcaccaccgccgtgtctgccaggtatggtcactggcataagaataaggctccaggcgagtataggtcaggcccacgcctcataatttttatcctgggcggtgtctcactgaatgagatgagatgcgcctatgaggttacccaggcgaatggcaaatgggaggtgctgataggctcaacccacatactcactccccagaaactgctagatactctgaagaaattaaacaaaaccgacgaggaaataagttcctag

SEQ ID NO: 137058 - DNA, 1674 bp, Artificial Sequence
  Description of Artificial Sequence: Synthetic coding sequence
atgactgacatcatgacagagggaattaccatagtcgaagacattaacaagagaagagagccacttccctcacttgaggccgtgtacctaatcactccatcagaaaagtccgtccacagcctgatcagcgacttcaaggatccacccaccgcgaagtaccgcgccgctcacgtgttctttactgatagttgcccagacgcattgtttaatgaactggtcaaatcccgagctgccaaggtgataaagactctgactgagattaatatcgcgttcctcccttatgaatcgcaggtctatagtctcgatagcgcagattcatttcagtcgttttacagtccccataaagcacagatgaagaatccaatcctggagcggctagccgaacagattgccaccctgtgtgcaacactgaaggaatatccggccgtcaggtataggggcgagtataaagacaatgcactgctggctcagctgattcaagataagttggatgcttataaagccgatgatccgacaatgggggaaggccccgacaaagctagaagtcagcttctaatcctggaccgcggattcgacccgagcagccctgtcctgcacgaactcacattccaagcaatgagctacgatctccttccgattgaaaatgatgtctataagtacgaaacctccgggatcggggaggcacgtgttaaagaagttctcctcgacgaggatgatgacctgtggatcgccctccgtcacaaacatatcgccgaagtgagccaggaggtgactaggtcactaaaggacttctcatcctctaagcggatgaacacaggagagaagaccactatgagagatctaagccagatgttgaaaaagatgcctcagtaccagaaggagctaagtaagtattccactcacctgcatctggctgaagattgtatgaaacattatcagggcaccgtggataaactctgtcgagtggagcaggacctagccatgggaaccgacgctgagggcgagaagataaaggatccaatgcgcgccattgttcctatccttctggacgccaatgtgagcacctacgacaagattcggatcatccttctctatattttcttgaagaacggcattactgaggaaaacctgaataagctgattcagcatgcccaaattcctcctgaggatagtgaaatcatcacgaacatggctcatttgggtgtgccaatcgtgacagattctacactgaggaggagaagtaaacccgagcgaaaggaaaggattagcgaacagacataccagctcagtcggtggacgcctattattaaagatattatggaagatactatcgaggacaaacttgatacgaaacattacccttatattagcaccagatcttctgcgagcttcagcactaccgcagtgagcgccaggtacggccactggcacaagaacaaggcacccggtgagtaccgctctggccccaggcttattatcttcatcctgggaggagtcagtttgaatgagatgaggtgtgcttacgaggtcactcaggccaatggaaagtgggaggtgctcatcggtagtacccacatactgaccccgaccaagttcctaatggatctgcgccatcctgattttcgagaatcttctagagtgtcgttcgaggaccaggcgccaactatggaatag

SEQ ID NO: 137059 - DNA, 1308 bp, Artificial Sequence
  Description of Artificial Sequence: Synthetic coding sequence
atggcgcccatcgggcttaaggcggtggtgggagagaagattatgcatgatgtgataaagaaagtgaagaaaaagggagagtggaaggtgctagtcgtcgatcagctgagtatgagaatgcttagcagttgctgtaagatgaccgacattatgaccgaggggcctgacaaggctcgctcccagttgcttatcctcgaccgcgggttcgatccatcctctcctgtgttgcacgagctgacgttccaggctatgagctatgatcttctgccaatcgaaaacgacgtgtataagtatgagacctccggcatcggcgaggcccgcgtgaaagaggtgctgctcgacgaagatgacgacttgtggatcgcgttaagacacaagcacatcgctgaggtctcccaggaggtgaccaggtccctaaaagatttcagcagctccaaaaggatgaacaccggagagaagacaacgatgagagatctcagtcagatgctcaagaaaatgccgcagtaccagaaggaactgtctaaatattccacccacctccatctggccgaggattgcatgaagcattatcagggcaccgtcgataaactctgtagggtagaacaagatctggcaatgggcaccgacgcggagggagagaagatcaaagatcctatgagggctatcgtgcccatcctgctagatgctaacgtgtcaacatatgacaaaatcaggatcatcctgctgtacatctttctgaaaaacggtatcaccgaggagaatctgaacaagcttatccagcatgcccagatccctcccgaggacagtgagatcatcaccaatatggcacacctgggcgttcccatagtaaccgattcgaccctgcggcggcgcagcaagcccgaacgcaaggagcgcattagcgagcaaacctaccaactgagtaggtggactccaatcattaaagacatcatggaagacaccattgaagacaaactcgatactaaacactatccttacatttccaccagaagttccgcatcttttagtaccacggccgtgagtgccaggtatggccattggcacaaaaataaggccccaggcgagtatcgcagtggcccaaggctcataatctttatactggggggcgtctctttaaatgagatgcggtgcgcttatgaagtcactcaggctaatggcaaatgggaggtgctcattggcagcacccatatcttaacccccacaaaatttctgatggacctgcggcaccctgactttagagaatctagtcgggttagtttcgaggaccaggctcccacaatggagtag

SEQ ID NO: 137060 - DNA, 1812 bp, Artificial Sequence
  Description of Artificial Sequence: Synthetic coding sequence
atggcgccaattggcctgaaagctgtcgttggcgaaaagattatgcatgacgtgattaaaaaggtgaagaagaagggggagtggaaggtactggtcgtggatcagctgagcatgcggatgctatcatcatgctgtaagatgactgacatcatgacagagggtatcactatagtggaagatatcaacaaaagacgagagccccttccttccttagaggcagtgtacctcataacacccagcgaaaagtcggtccactcgctcatatccgatttcaaagatcctcccacggccaagtaccgcgctgcccacgtgttctttactgatagctgccctgatgccctgtttaacgaacttgtgaaatccagggccgccaaagtcatcaagactctaacggaaataaatatcgcatttttgccctatgagagccaggtttactctctggacagcgccgactctttccaatccttctactcccctcataaggcgcaaatgaagaatcccatacttgagcgcttagcagagcaaatagctacgctgtgcgcaaccctgaaagagtatccagccgttcgttataggggcgaatataaagataatgccttgttggcgcagctgatccaggacaaattagatgcctataaagcagacgatcctacaatgggtgagggacctgacaaagcgagatctcagttgttaatcctggataggggattcgatccatcatctcctgtgctgcacgaattaacatttcaggctatgtcatacgacctcctaccaatcgagaacgacgtttacaagtacgaaacgtctggtatcggcgaggcccgtgtcaaagaagttctcctcgatgaggacgacgatctatggatagccttaagacataagcatatcgcggaggtgagtcaggaggtgacaaggagtctgaaagacttttcttcaagcaagcgcatgaacaccggcgagaaaacaaccatgcgagatttgagccagatgctcaaaaagatgccacagtatcagaaggagctttccaaatactccacacatctgcatctcgcagaagattgcatgaagcactaccaaggcactgttgacaaattgtgtagggtagagcaagatctggcaatgggaacggatgcggagggagaaaaaataaaagaccctatgcgcgccattgtgccaatcctgctggacgctaacgtgtcgacttacgataaaattcgcatcatcttgctatacatctttcttaagaatggcatcactgaggaaaacctcaacaagctcatccagcatgctcagatccctcccgaggattccgagatcattactaacatggctcatctgggcgtgcctatagtgactgactcaaccctgagacgcaggtctaagccggaaagaaaggagcgcatcagtgagcagacctaccagctatcccgctggacccctattatcaaggatataatggaggacactattgaagacaaactcgataccaagcactacccatacattagcactaggtcatcagccagtttctcgaccacggccgtgtcggctaggtacggccactggcataagaataaagcccccggagagtaccggtccggccctcggctgatcatattcatccttgggggcgtttccctgaacgagatgaggtgtgcctacgaggtgacccaggctaacggcaagtgggaagttctcatcgggtctacccacattctgaccccaactaagtttcttatggacttacgacaccccgattttagagaaagctctcgcgtcagctttgaagaccaggctccaaccatggaatag

SEQ ID NO: 137061 - DNA, 1389 bp, Artificial Sequence
  Description of Artificial Sequence: Synthetic coding sequence
atggcccctaccatccaaacacaagcccagagagaggatggccatcgttcaggcgtagtatgtcgagtcaagtactgcaactcactcccagacatacctttcgaccccaagtttatcacttacccgtttgatcaaaatcggtttgtgcagtataaggccacatcgctggagaaacagcataaacacgatcttctcaccgagccagacttgggggttacaatcgatcttattaaccctgatacgtacaggattgatcctaacgtgcttctagacccagccgacgagaagctactggaggaggaaatccaagcccctaccagctctaagcgctcacagcagcatgcaaaggtcgtaccctggatgcgtaagacagagtatatatctactgagtttaacagatatggcatttctaacgaaaaaccggaggttaaaataggcgtctctgtgaagcagcagtttacagaggaggaaatctacaaggatagggactcccagataactgcaatcgaaaagaccttcgaggatgcccagaagtcgatgtggattaacccatgtgcgcaggtcatttttgacagcgacccagccccgaaggacacatcaggtgcagcagcccttgaaatgatgtcacaggcgatgattcggggaatgatggatgaagaaggcaatcagtttgtagcctactttttgccagtcgaagaaaccctcaagaagcgcaaacgagaccaggaggaggaaatggactacgccccagacgatgtgtatgactacaagatagctagagagtacaactggaacgtcaaaaacaaagccagcaagggttatgaagagaattacttctttatttttagggaaggtgacggagtgtactacaacgagcttgaaacccgggttaggctctccaaaaggcgcgccaaggcaggcgtgcaatctgggactaacgccctgctcgtggtgaagcacagggatatgaacgaaaaagagctggaggcgcaagaggctagaaaggctcaattggagaaccacgagccagaagaggaggaggaggaggaaatggagacagaagaaaaggaggccggtggaagcgtgatgcttatcctgaggactatgcccacactcatgatgagaaccgaagatcgacccaaagtggccgtcacaatgattcaaaccgccgcagccatgggagtcgccagtggcgcaggcgcaacagcagcagctcccgtgcctagccctgtggccgctagtactcgtcccagacgcatggctgtgaagctgcagcttctgattcccgttaaactaattgtgaccgtcactgaatcgcagggcatccagggatggttccggcatcactattgtgaacagcagagcacctttcttgtagtgtgcctatag

SEQ ID NO: 137062 - DNA, 1197 bp, Artificial Sequence
  Description of Artificial Sequence: Synthetic coding sequence
atgtgcatacgagtccacgtgtccatgtgtatgtgcatgtgtgttcacgtgtgcgtgcacctctgcatgcacgtctgcgccgtgtgcatgtgtgtttatgtgtgtgtgtgtgtgcacgtccacgtgtgcgcttctgtctgtgcctttgtatgtatgtgcgtctgcgtgtgtgtgtgtggttctgtgtgcgcattcgtgagcgtgcatgtctgcatgagggtgtacgtttgtgtttgtatctgcgtgcatctctacgtgtgcgtgtgcgtctgcttgtgtgcttgtgtatacgcctgcgtatgcatgtgtctgcgattgtgcgtgcggctgtgtgtgagtgtgtgtgcttgtgtgtacgcatgtatatgcatgtgcatatgtgtgcatgtgtcaatgtatgtctgtgcgagcgtctgcgcctgtgtgtgtgtctgcgtctgtgtgtgtgtatgtatgagagtgtgcgcccatcagtgcctccatgtgtgtatctgcgtgtacgtctgtgctagaatttgcgtttgtgcttgtgtctacgtttgtgtatgcatatctgtgtgtgcatgcgtctatgtatgtgtccacttatgcgtatgcgcgtgtgtgcatgcgtgcgtttgcgtttgcgcttgtgttcacctctgtgtgtgtgcctgcgcacacgttggggccactctggtatgtatttgtacctacacctgccctcgcccttcaatgttcgcccatggggggcgatggggagtagccgggaggcctcgccagcctatgtcccttggcgtccaggctcaggcccagcgggttattcacctgccccagagtgtgcaggccctgatcaaggattttcagggaaccccgacgttcacctacaaagctgcacatattttctttacagacacatgcccggaacctctcttctccgagctgggccggagcaggctggctaaggtggtaaagacgctgaaagaaatccatcttgcattcttgccctatgaagcacaagtgaggcctgggcttatactgggacgtggttggggttttgttactaaatgtccacttttcccgcagaaacagacactcagactgggtgccgtcgcccacacatgcaacccctctgccgtagggggccagggccgcaggatcacgtgggggcaggaattcgagactagcttaggcaccgaacaagatccggtgtcatag

SEQ ID NO: 137063 - DNA, 1773 bp, Artificial Sequence
  Description of Artificial Sequence: Synthetic coding sequence
atggcccccagcggcctgaaggcagttgtgggagaaaagattctctctggggtcatccgcagtgtgaaaaaggatggagagtggaaggtactcatcatggaccacccctctatgcgaatcctgtcatcctgttgcaaaatgagcgacatcttagccgaaggcattaccatcgttgaagacattaacaaaaggcgagagcccattccttcgctcgaggccatttatctcctcagccccactgagaaggcattgatcaaagatttccagggaaccccaactttcacttataaggccgcgcacatatttttcaccgatacttgccccgagcctttgttttcggagctggggaggtcacggttggccaaggtggttaagactttaaaggagatccatctggcttttctgccttatgaggctcaggtattttctctggacgcaccacacagcacctataacctttactgtcctttcagagcagaggagcgcacgagacaactagaagtgctcgctcaacagatcgcaacgctctgtgccacactccaggagtatcccgcgatccggtatagaaaggggcccgaagacaccgcccagttagcccatgcagtactggcaaagctgaacgcgttcaaagcagacactccgtccctgggagaggggcccgagaaaacacgaagtcagttgctcatcatggaccgggccgcagatccagtatcacccttgctccacgaactgaccttccaagcaatggcctatgacttgctggacattgaacaggacacttatcggtatgagaccactgggctctcagaagctcgagagaaggctgtactcctcgacgaggacgatgacctttgggtggagctgcgacatatgcacatcgctgacgtgtcaaaaaaagtcactgaattgttgcgcaccttttgcgagtctaaacgattgacaaccgataaggcgaatattaaggatctgtcacaaatcctcaaaaagatgcctcaataccagaaggaactgaacaagtacagtacccacctacatcttgctgacgactgcatgaagcatttcaaagggagcgtggagaaactgtgtagtgtcgagcaagatctcgccatgggaagtgacgccgagggcgaaaagattaaagattcaatgaagttaatcgtccccgttctgcttgatgccgctgtgcctgcttatgacaagatccgagtactgctcctgtacatcctgcttcgaaacggtgtgtccgaagagaacttggcaaaactgatccagcatgccaatgtacaggcgcactcttcccttatccgcaatttggaacaactggggggcacagtcaccaatcccggagggtcaggtacatccagcagactagaaccaagggaaaggatggaacctacctaccaattgtcccggtggacaccggttataaaggacgttatggaggacgctgtggaagacagactggacaggaacctctggccattcgtgtctgatcctgccccaaccgcctcctcccaggcagccgtgagtgcacggttcggacactggcataagaacaaagctgggatcgaagcaagagccggtccgagacttattgtgtatgtcatggggggcgtagccatgtctgaaatgcgggccgcctacgaggttacacgcgctacagaaggaaaatgggaagtgctgatcggctcctctcatattttgacaccaaccaggttcctggatgatctcaaggcactggacaagaagctcgaggacattgctttaccttag

SEQ ID NO: 137064 - DNA, 1815 bp, Artificial Sequence
  Description of Artificial Sequence: Synthetic coding sequence
atggcacctagtggactgaaagctgtcgtgggggaaaagattctgagcggtgtgatccggagcgtgaagaaagacggggaatggaaggtcctgattatggatcacccttctatgcgcatcctgtctagctgttgcaagatgtcagacattcttgcggagggtatcacaatagtggaggatataaacaaaaggagagagccaatcccatccttggaggccatttacctgctttccccaaccgaaaaggcccaggcacagagagtgatccatttgccccagtcagtccaagccctgatcaaagactttcaaggtacccccacatttacctataaggcagcacacattttcttcaccgacacgtgccccgagccactgtttagcgagctcggacgctcccgccttgcaaaggttgttaagaccctgaaagagatccaccttgcattcctcccttacgaggctcaggtcttttctttggatgcgccgcactcaacctataacctgtattgtcccttcagggccgaagagagaactaggcagctggaagttttggcccaacagatagccaccctttgcgcaaccctacaggagtatccagcaatccgatacaggaagggtcccgaggacacagcccagctggcacatgctgtactggccaagctgaacgcatttaaagcagacactccgtcactcggagagggtcctgagaagactcggtcacagctgctcatcatggacagagctgcagacccagtgagtcctttgctgcatgagctgaccttccaggccatggcctatgatcttttggacatcgagcaggatacttacagatacgagactactggtctgtccgaagcgagggaaaaagctgtgttacttgacgaagacgatgacctgtgggtggagctgcggcatatgcatattgcagacgtttcgaagaaagtaaccgagctgcttcgcactttttgtgaaagtaagagactgacaacagacaaggcaaacattaaagacctaagccagatcctaaaaaaaatgccgcagtatcaaaaagagttgaacaaatattctacacatttgcacctggcagacgactgcatgaaacacttcaaggggtcagtggaaaaactttgcagtgtcgaacaggacctcgcaatgggatcggatgcagagggggaaaaaataaaggattccatgaagctgatagtgcccgttttgttggatgcggccgttccagcctacgataaaatacgggtgcttttgctatacatcctcctgagaaatggcgtttccgaggagaaccttgcaaaactgatccagcacgccaatgttcaggctcatagctccctgatacgaaatctggaacagctgggtggaacagtcacgaatccgggcggatccgggacatcctcaagactggaaccccgggagcgaatggagccaacctaccaattaagtaggtggaccccggttatcaaggacgtgatggaagatgccgtcgaagaccggctggaccgaaacctctggcccttcgtgtcagatcccgcccctacggccagttcacaggcggccgtcagtgcccgatttggtcactggcacaagaacaaggcaggtatcgaagcaagagcaggccctagactaatagtctatgtgatggggggcgtagccatgtcagagatgagagctgcctacgaggtgactcgcgccaccgaaggcaagtgggaggtgctcataggcagtagccatattctgactcccacgcggttcctggatgatctaaaagcccttgacaagaaactggaggacattgctcttccctag

SEQ ID NO: 137065 - DNA, 1740 bp, Artificial Sequence
  Description of Artificial Sequence: Synthetic coding sequence
atggccccttcaggtcttaaggccgttgtgggagaaaaaattctgtcgggagtcatccggagtgtgaaaaaggatggcgagtggaaggtgctcattatggaccatccctctatgagaatattgtcatcttgctgtaaaatgtcagatatcctagctgaagggattacaatcgtcgaggacataaataagcgcagggaacccattccatcattagaagccatttacctgctttctcctacagaaaaatcagtacaagcactgatcaaggactttcagggaaccccaacatttacttataaagccgctcatatattcttcactgacacttgccctgaacccctattctccgaactgggcaggagccggttggccaaagtggtcaaaaccctgaaagagatacacttggcctttctgccgtacgaagcccaggtgttttccctggacgcccctcattctacttataatttatactgtcccttccgtgccgaggagagaacacgacagttggaggttcttgctcaacaaatcgccacactgtgtgcaactctgcaggagtatcccgcaataaggtatagaaagggccccgaggataccgctcagctggcacatgcagtgctcgctaagttgaacgccttcaaggccgacacaccgagtctgggcgagggcccagagaaaactcggagtcagctattaatcatggaccgggctgctgatccggtcagtcccctcctacacgaactgacattccaggcaatggcttacgacttgctagatattgaacaggatacctacaggtacgaaacaactggcctgtccgaagcccgggagaaggccgtgctgctggatgaggatgacgatctgtgggtggagttacggcatatgcatatcgctgatgtctccaaaaaggtgaccgaattattacggacattctgtgagtcaaaacggctcaccaccgacaaagctaacataaaagaccttagccagattctgaaaaaaatgcctcagtaccagaaagagctaaataagtatagtacccacctgcacttggccgacgactgcatgaaacacttcaaggggtccgtggagaaattgtgctctgtcgagcaagatcttgcaatggggtccgatgccgagggcgagaaaatcaaagatagcatgaagctgatcgtacctgtccttctggatgccgcagtaccagcctacgacaagatcagggtgctgcttctttatattcttctgcggaacggggtgtcagaggagaacctcgccaagctgatccagcacgccaatgtgcaggcacacagctctcttatacgcaacctggagcagctgggcggaactgttactaaccctggtgggtctggaacctctagcagactggaaccccgggaacggatggagcccacatatcagctgagccgctggactccagttatcaaagatgtgatggaggatgctgtggaagaccgcttggatcgaaatctttggccattcgtttctgaccctgcacccacagcgtctagtcaagccgctgtctcagcacgtttcggccactggcacaaaaataaagccggcatcgaggccagggccgggccgaggctgatcgtatacgtgatgggcggggtggctatgtcagagatgcgggctgcttatgaagtcacccgtgccactgagggaagcggccgatgctctttggctcctcacaccagtagcccacgccctgcatcatggatgacctag

SEQ ID NO: 137066 - DNA, 2421 bp, Artificial Sequence
  Description of Artificial Sequence: Synthetic coding sequence
atgcatggcaagtcaacagcagtgcttgagatggactattccattgtagacttcctcaccctgtgtgagactccttaccccaatgactttcaagaaccctacgctgtcgttgtactgctggaaaaggatctcgttttgatagatctcgcccagaacggctatccaatcttcgaaaacccctaccctttaagtattcacgagagccctgtgacgtgttgcgagtacttcgctgactgcccagtggatctcattcccgcgctatatagcgtaggtgccagacaaaaacgacagggatattccaagaaggaatggccaattaacggaggaaactgggggttgggcgctcagtcgtatcctgagatcattataacagggcatgcagacggcagtgtcaagttttgggatgcctccgccatcaccctgcaggtcctctataagctcaaaacctctaaggtgttcgagaagagcagaaataaagacgaccgccctaatactgacattgtggacgaagacccgtatgcaattcagattatctcttggtgccccgaatctcgtatgctgtgtatcgccggggtttctgctcacgttattatatatagattttctaaacaggaagttatcaccgaggtgattcctatgttagaggtccgcttgctgtatgaaatcaatgatgtggagacccccgaaggggaacaacccccaccattgcccacacccgtcggtggaagtaacccacagcctattccgccccagtcacatccttccacctccagctcaagctctgacggacttagagataatgttccctgcctgaaggtgaaaaactcccccctgaagcaatctcctggataccagacagagctagttatccaattggtgtgggtcggtggcgagcctccccagcaaattacgagtctcgctgtgaacagttcctatggtctcgtggtcttcggaaactgtaatggcatagctatggttgactatttacagaaggcggtacttcttaaccttggtaccattgaactgtacggcagtaatgacccgtatcggcgggagcccaggtctcccagaaagtccaggcagccatcgggagcagggctgtgcgatattagcgaaggcaccgtggtacctgaagacaggtgtaagtcacccacctctggcagctcaagtccgcataatagtgacgatgagcagaagatgaataatttcattgagaaggcgaaaatgtcacgcaaactcagcttacccactgacctgaaaccagatttggatgttaaggataattcctttagccggagcagaagctcctccgtcacgtcaattgataaggagtccagagaggctatatccgccctccacttttgcgagacatttacgaggaaaactgattcttccccctctccctgcctgtgggtggggacaaccctggggaccgtcctggtaatcgcccttaatctgccccccggaggtgagcagcggctgctgcaacccgttatcgtgtccccatccggtacaattctccgactgaaaggcgccatcctgaggatggcttttctggacactaccggatgcctgataccgcctgcatatgagccatggcgggaacataatgtcccggaggagaaggacgagaaggagaaactgaagaaacgccggcccgtgtcggtaagcccaagcagctcccaagagatctcggagaaccaatatgcggtcatctgtagcgaaaaacaagctaaggtgatcagcctccccacacagaactgtgcctataaacagaatattacagagaccagttttgtgctgaggggcgatattgtggccctttccaactctatttgtctcgcctgcttttgtgcaaatggtcatatcatgaccttctcgctgccctcactgaggccactgttagatgtgtactatcttcctctcaccaatatgagaattgcccgcacattttgctttacgaacaatggtcaggcattgtatctcgtcagcccgactgagattcagcgacttacttatagtcaagagacatgtgaaaacctgcaagaaatgcttggggagctgttcacacctgtagaaacaccggaagctccgaatcgcggcttctttaaggggctgtttggggggggtgcccagtcgcttgatagagaggaactattcggagaaagttcctcaggcaaggcttctcgatccctggcccaacatatccccgggccgggcgggatagaaggcgtcaaaggcgctgcttctggagtagtgggcgaactagcccgagcccggctcgcgcttgatgagagaggccaaaagctgggcgatctggaagagaggacagctgctatgctttcatcagcagagagtttcagcaagcacgcccatgaaatcatgttaaaatacaaggacaaaaaatggtaccaattttag

SEQ ID NO: 137067 - DNA, 3456 bp, Artificial Sequence
  Description of Artificial Sequence: Synthetic coding sequence
atgagaaaatttaacattcgcaaggtgttggatggactcacagccggaagctcatctgcatctcagcagcagcagcagcagcaccctcctgggaaccgagaaccagaaatacaggaaaccctccagtccgaacacttccaactatgtaaaaccgtccggcacggattcccctaccagccgtccgctctggctttcgaccccgtgcagaaaatcctcgcagtgggaacacagactggggcattaaggcttttcggaaggcctggcgtcgaatgctactgtcagcatgatagtggcgccgctgtcatccagctccagttcctcattaacgagggcgccttggtcagcgccctggccgatgatacactgcacctgtggaacttaagacaaaaaagacctgccattctgcactcgctgaagttctgtcgggaaagagtcaccttttgtcacttgccttttcaatcgaagtggctgtatgtcggaaccgagcgagggaatattcacatcgttaacgttgaatccttcacattatcgggttacgtgatcatgtggaacaaggctatcgagctcagcagcaagagccacccaggcccggtggttcatatcagcgacaaccctatggatgaaggaaagctgctaatcggctttgagtctggaacagtagtgctgtgggatctgaaatccaagaaggcagattaccggtacacgtatgacgaggcaattcattctgtggcttggcaccacgaagggaagcagttcatttgctcccactccgacggtaccctgactatctggaacgttcggtcccccgctaagcctgtccaaacaataacaccgcatggtaaacagctcaaggatgggaagaaaccagagccatgtaagcctatccttaaagtggaattcaagaccaccaggagcggcgagccgttcattattcttagtggcggattatcttatgataccgtgggccggcgcccctgtctgacagtgatgcatgggaaaagtacagccgtgttggagatggattactccattgttgacttcctcactctgtgtgagaccccatatcccaatgactttcaggagccatacgccgtggtcgtcctgctggagaaagacctcgtgttaattgatctggcacaaaacggctatcctatttttgaaaacccctatcccctgagcattcacgagtcaccagtgacctgttgtgagtatttcgcggattgtccggtggacttaatccccgcactctactcagtgggtgccaggcagaagagacaggggtacagcaagaaggagtggccaataaacggcggtaattggggactcggagcccaatcctaccctgagatcatcataacgggtcacgctgatggttctgtcaagttctgggatgcctccgcaatcaccctacaagtgctgtataagctgaagacctcaaaagtgttcgaaaagagccgtaataaggacgataggccaaatactgatattgttgacgaagatccctacgcaatacagatcatttcctggtgtcccgaatccagaatgttgtgtatcgcgggagtgtccgcacacgtgataatctacaggttttccaagcaagaagtcatcacagaggtaatccctatgttggaagtgcgcctcctgtatgagattaacgatgtggaaacaccggaaggagagcaacctcctccactccctacccctgtaggaggcagcaacccccagcctatccctccccagagccatccatccacgtcgtcttcctcatcggatggcctcagggataacgtgccatgcctgaaggtcaagaatagtcccctgaagcagtctcctggctaccaaacagaactagtgatccagctcgtatgggtagggggagaaccaccacagcagataacgtccctggccgtcaactcttcatatggcctggtggtattcggaaactgtaacggaatcgctatggtggactaccttcagaaggcagtgctcctgaacttagggaccatagagctgtacgggtccaatgacccatacaggagagaacctcgcagcccgcggaagtcacggcagccgtccggggcgggcctttgtgatatctcagaaggaaccgtggtccccgaggataggtgtaagtctccgacaagtggaagctcaagcccacacaactccgacgatgagcaaaaaatgaacaactttattgaaaaagtcaaaaccaagtctaggaagttttcaaagatggtcgctaatgacattgccaagatgagtaggaaacttagcttaccaacagacctgaaaccagatttagatgtcaaggacaatagctttagcagaagtcgaagttccagcgttacctcgattgacaaagagagccgagaagctatttccgctctgcacttctgtgagacattcactagaaaaacagactcttctccctcaccctgcctgtgggtaggaactaccctcggcactgtgctcgttatcgccttgaatctcccgccaggaggtgagcagagattgctccaacccgtgattgtttctccaagcgggaccattcttcgcctgaagggtgccattcttaggatggcattcctagacaccactgggtgtcttatcccacccgcctacgaaccgtggagagaacacaatgtgcccgaagagaaagatgagaaggaaaagctgaagaagagaaggcctgtgtctgtctcccctagtagcagtcaggaaatcagcgagaaccagtatgcagtgatatgtagtgagaagcaggcaaaagtcataagcctgccgactcaaaactgtgcctacaagcagaacattactgaaacatctttcgtgctgcgaggggatattgtagccctaagcaatagcatctgcttagcatgcttctgcgctaacggacatatcatgacgttctcactccctagcctgcgtccattgctcgatgtctactatcttcccctgactaatatgaggattgcaagaactttctgcttcactaacaatgggcaggctctgtacctagtttcccctacggaaatccagagactgacatattcgcaggaaacctgtgagaacctgcaggagatgctcggtgagttattcacacccgtcgagactccggaggctccaaacagaggctttttcaaaggactttttggtggcggcgctcagtccctggaccgtgaggaactgttcggagagtcatcctcagggaaagcctcccgatcgctggctcagcacattcctggtcccggcggaatcgagggtgtgaagggcgccgctagcggcgtcgtgggagaactggccagagcgagactggcactcgacgagagagggcagaaattgggggacctcgaagagcgtacagccgcaatgctgtctagtgccgagtctttctccaagcacgcccacgagataatgctgaaatacaaagataaaaagtggtaccagttctag

SEQ ID NO: 137068 - DNA, 525 bp, Artificial Sequence
  Description of Artificial Sequence: Synthetic coding sequence
taaaaggcagtcctgctgaaccttgggaccatcgaactgtacggctccaatgatccatacaggagagagcctagatcgccaagaaaatcacggcagccctccggtgcagggttgtgtgacatctcagaaggaacggtggtgccagaagatagatgcaaaagtcccacctcgggctcgagctcgccccataactcagacgacgagcagaagatgaataacttcatcgaaaaagccaagatgtccagaaagcttagcttaccaactgacctgaaacctgacctcgacgtgaaagacaactcctttagccggtcacggtctagctctgtgaccagcatcgataaggaaagccgggaggccatttcagccctgcacttctgtgaaacattcactcgaaagaccgattccagcccttcgccatgcctttgggttggaaccacactgggaactgtgctcgtgatagcgctcaacctgccaccaggaggagagcagagacttctccaacccgtgattgtctccccttcttag

SEQ ID NO: 137069 - DNA, 840 bp, Artificial Sequence
  Description of Artificial Sequence: Synthetic coding sequence
atggtagactacctgcagaaagccgttctccttaacctggggactatcgagttatacggaagcaacgacccctatcggagagagcccaggtcgccccgaaagtccagacaacctagtgggggagtattaatagtaacatcgtgtatgtgcggcctcagctccctctattcagaatcgatgaaaaagctgcgctcctctttccttacagggttgtgtgatataagcgagggcaccgtggtgccagaggaccggtgcaaatctcccacctcagcgaagatgtcacgtaaactcagcctgccaaccgacctgaaaccggatctggacgtgaaggataatagttttagcagaagcaggtcttcgtcagtgaccagtatcgacaaggaaagcagagaggccatttccgcactgcacttctgcgaaacttttacccggaagacagatagctccccgtcaccatgcctgtgggtaggcacaacacttggaactgttctagtcatagctctcaatttaccacctgggggtgaacagcgcctgttgcagcctgtgatcgtgagcccttctgggaccatactgcggttgaaaggagccattctcagaatggccttcctcgacacaaccggctgtctcatccctcctgcatatgagccttggcgcgaacacaatgtccccgaagagaaagatgagaaagaaaaactgaagaagcggcgtccagtgagcgtttcgcccagctcttcccaggagatctctgagaaccagtacgccgtgatctgcagcgagaaacaagcaaaagtgatctcactgcctacccagaactgcgcgtacaagcaaaatatcacgtag

SEQ ID NO: 137070 - DNA, 3297 bp, Artificial Sequence
  Description of Artificial Sequence: Synthetic coding sequence
atgaggaaatttaatatccgaaaagtgttagatggcctcaccgccgggagtagcagcgcatctcagcagcagcagcagcagcatccccccggcaaccgagagccagaaatccaggaaacattgcaatctgagcactttcagctgtgcaaaacagttagacacggatttccctaccagccaagcgctctggcctttgatcccgtccagaaaattcttgccgtaggtacacaaactggggccctgcgcctttttggccggcctggtgttgagtgctactgtcagcatgattccggcgccgctgtcatccagctccagttcctgatcaacgaaggtgcattagttagtgcactcgcggacgataccctccacttatggaacttacggcagaaaaggccagccatcctgcactctcttaaattctgccgtgaacgagtgacgttctgccatctgccctttcagtctaagtggctgtatgtcggaaccgagagagggaacattcatatcgttaacgtggaaagctttacgctgtccgggtatgtcatcatgtggaataaagcaattgagctgtcctcgaagagccaccctggtcccgtcgtgcatatcagtgacaaccctatggatgaaggaaaactcctcattgggttcgaatccgggacagtggtgctgtgggatctgaagtccaagaaggccgattacaggtacacttacgacgaggctatccattctgtggcatggcaccatgaaggcaagcaatttatttgttcacattcagatggaacactcacaatttggaacgtgagatcgcctgcaaaacccgtgcagaccatcaccccgcacggtaagcagctaaaagacgggaagaagcctgaaccatgtaagcccatcctcaaagtcgagttcaaaacgacccgatcaggtgagccctttatcattctgagcgggggcttatcctatgataccgttggtcgacgcccctgtctgactgtgatgcacggcaaaagcacagccgtcctggaaatggactactctattgtggattttctcacactctgtgagacaccttatcccaacgatttccaggagccatatgctgtcgttgtgctgcttgaaaaagatctcgtattgatcgatctggctcaaaacggatacccaatcttcgagaatccttatcctctgagcatccatgagtcccctgtcacctgctgtgagtattttgcagactgcccagttgatctgatccccgcactctactcagttggcgcccgccagaagcgacagggctattccaagaaggaatggcctatcaacggtggtaattggggcctaggtgcccagagctacccagagataatcatcactggccacgctgatgggtccgtgaagttttgggatgcctcagctattaccctccaggtgctctataaactcaaaacctccaaggtgtttgaaaaaagtagaaataaggacgatagacctaacacagatatagtggatgaagacccttacgcgatacagattatcagttggtgtccggagagtcggatgctgtgcatagcgggcgtttccgctcacgttattatctataggttcagtaagcaggaggttatcacggaggtgatccccatgctggaagtgcgcttgttgtatgaaatcaatgacgtcgaaacgccagagggcgagcagccccctcccctccccactcctgttggcggatccaatccccagcccatcccgccccaatcccacccttcaactagcagctcttcatccgatggcctgcgggacaatgtgccatgtcttaaggtaaagaatagccccctaaagcagtctccaggttatcaaaccgagttggttatccagctagtgtgggtggggggtgagcctccccaacagatcactagcctcgccgtgaattcctcatatggcttggttgtgtttggcaattgcaacggtatcgcaatggttgactacttgcagaaggctgtgctgttgaacctggggactattgaattgtatgggtctaacgacccgtatcggcgggaaccaaggagtccacgaaagagcaggcagccttctggtgccggtttatgtgacatcagcgaggggaccgttgtcccggaagataggtgtaaaagtcctacctcagatgtgaaagataattcgtttagtcggtcccggtccagctcagttacatcaatagacaaggagtctagagaagctatctcagctttgcacttttgcgagacattcacacggaagacggattctagtccgtcaccttgcctctgggtaggtacgaccctggggactgtgctggtgatcgccttaaacctgccacccgggggggaacagcgacttctgcagcccgtgattgtatctccctcagggacaatactgcggctgaagggtgctatcctacgaatggcttttctggataccactggctgtttgatcccaccggcatacgagccatggcgcgagcacaacgtaccggaggaaaaagatgaaaaggagaaattaaaaaagcgccggccagtcagcgtgagcccatcttcaagccaagaaatctccgagaatcagtacgcagttatatgttcagaaaagcaggctaaggtcatcagcttgccaacccagaattgcgcctataagcagaacatcaccgaaacctcatttgtactgcgcggagatatagtggctttgtccaactcgatatgtcttgcctgcttctgtgctaacggccatataatgacttttagcctgccttccttgcgcccacttctggacgtatactaccttcctctgactaatatgcgcatcgctcggacgttttgttttaccaataacggtcaagcactctatctagtatccccaacagagattcagcggcttacgtattctcaggaaacttgtgaaaatctgcaagagatgttgggcgagctgtttactccagttgaaacacctgaggcccccaacagagggttcttcaagggtctttttggggggggggctcagtcccttgatcgcgaggagctgttcggcgagtctagctccggaaaggcgagcaggtcccttgcacagcacatccccggacccggcgggatagaaggggtgaaaggcgccgccagtggtgtggtgggagagctggctcgcgcccggcttgctctcgatgagcgcggacagaaactcggcgacctcgaggagagaacagcagctatgctgtcttctgctgaatcattttcaaagcacgcacatgagatcatgctgaagtataaagacaagaaatggtatcaattctag

SEQ ID NO: 137071 - DNA, 3348 bp, Artificial Sequence
  Description of Artificial Sequence: Synthetic coding sequence
atgcgaaagttcaatatcaggaaagtcctggacggactgacagccggatcaagcagcgcctctcagcagcagcagcagcagcacccccccggaaatcgcgaacccgaaattcaagagaccctccagtcggaacactttcagttgtgcaaaaccgtcaggcacggttttccgtatcaaccttcagctctggcctttgaccccgtccagaagatcctcgctgtcggaactcagactggcgcactgcggctatttggtcgacccggagtggagtgctactgtcagcacgactctggagcagccgtgattcaattgcagttcttgatcaatgagggtgccctggtatcagctctcgccgacgatacccttcacctttggaatctcagacaaaaaagacccgccatactgcattcactgaagttctgtcgagagagggtgacattttgtcatctgccttttcagagtaagtggctctacgtgggcaccgagagaggaaatattcacatcgttaacgtggagtctttcacgttgtccggatacgtaatcatgtggaataaagcaattgaactctcttcgaaatcccaccccggacctgtggtccacatatctgataatccaatggacgagggcaagctcctgatcggctttgagagtggcactgttgtgctgtgggatttgaagagcaagaaggccgactacaggtacacgtatgacgaggcgattcatagcgtggcctggcaccatgaaggcaaacaattcatctgtagccattcggatggcactctgaccatttggaatgtgaggagccctgctaaaccagtccagactatcacccctcacggcaaacagttgaaggacggtaaaaagccagagccttgtaagccgatattgaaagtggagttcaagacaacaagatccggggaacccttcatcatcctgtccgggggcctgtcgtacgatactgtagggcgccgcccctgtctgacagtaatgcacggaaagtccactgccgtgctcgagatggactatagcattgtggatttcttgaccctgtgtgaaaccccataccctaatgactttcaggaaccctatgctgttgttgtgttactggaaaaagacttggtccttatcgacttggcgcagaacggttatcccattttcgagaatccgtaccctctgtcaatacatgagagccctgtgacatgttgcgaatatttcgcggactgccctgtggacctaatacctgctctctactcagttggtgcgaggcagaaacgtcaggggtatagtaagaaggaatggcccattaacggagggaattggggactgggggcacagtcgtatcccgaaattatcatcactgggcacgctgatggctctgtcaagttttgggacgcctctgcgattacgttgcaggtcctgtacaagctgaagacttctaaggtttttgaaaaaagccggaataaggacgaccgtcccaacacagacattgtagatgaagatccctacgcaattcaaattatctcttggtgcccagagtcacggatgctttgcattgccggcgtgagcgcacacgtcatcatttacagatttagcaagcaagaggtgattaccgaggtgatccctatgctggaagttaggctcctgtatgaaataaacgatgtggaaacccccgagggtgaacagccgcccccattgccaacacctgttggaggctctaacccacagcccatcccaccccagagccatccctctactagttccagtagcagcgacgggttacgcgacaatgtgccgtgcctaaaagttaagaatagcccacttaagcaaagtcccggataccagaccgagctcgttattcaactcgtgtgggtgggcggcgagccaccacagcagatcacttccttggctgtcaactcatcttacggcctggtagtcttcggcaattgtaacggcattgccatggttgattacctgcaaaaagctgtgctgttaaacctcggtactattgaattatatggctcgaacgatccttataggcgcgagcctcgctcgccacgcaagagccgccagcccagcggggctgggttgtgtgacatttctgaggggactgtcgtgccagaagataggtgcaagtcaccaacgagcgccaagatgagccggaaactgtctctgcccactgacctgaagcccgacctcgacgtgaaggataattccttctcccgatcacgctccagtagcgtaacgtcaatcgacaaagagtcccgggaagctatatccgcgctgcatttttgtgagacgttcacgaggaaaaccgactcttctccttcaccctgtctttgggtgggtaccactctgggtactgtgcttgttatagcgttgaacttgccaccagggggggaacagaggttactccaaccagtaatagtgtctccctcaggaacaatcctcagactgaaaggcgcaatccttcgaatggcgttcctggacacgaccggatgcctgattccgccagcttacgaaccgtggcgcgaacacaacgtccccgaggaaaaggacgagaaagagaagctgaaaaaacggagaccagtttcagtttctccatcctctagccaggagatcagcgaaaaccagtatgccgtgatctgctcagagaagcaagccaaggtcatctctcttccaactcagaactgtgcatataaacaaaatatcaccgagaccagtttcgtcctgcgaggtgatattgtggccctatcgaattctatatgcctagcctgtttttgtgcgaacggacacattatgactttcagtctgccgagtcttcgccccctgttagacgtgtattacctgcctttgacaaatatgcggatcgctaggactttttgctttacaaacaacgggcaggctttgtatctggtgagcccaacagagatccaacgcctcacatatagccaagagacctgtgagaacctgcaggagatgctaggcgagctgttcactccagtggagactcctgaggctcccaaccgtgggttcttcaagggactgtttggcggtggtgcccaatcacttgaccgggaggagctcttcggagagtccagctcaggcaaggcttcccggagtctagctcagcatattcccgggcccggcggcatagagggcgttaagggcgccgcctctggcgtagtaggggagctagcccgagcacgtctagcgctggatgagcgaggtcagaagctaggggatctggaagaaagaacagccgccatgctctccagcgccgagagtttctcgaaacacgcccacgaaataatgttgaaatacaaggataagaagtggtatcagttctag

SEQ ID NO: 137072 - DNA, 795 bp, Artificial Sequence
  Description of Artificial Sequence: Synthetic coding sequence
attgagttatatgggagcaatgacccttacaggcgcgaacccagatcgccaaggaaaagcaggcagccttcaggcggtgtgctcattgtcacatcctgcatgtgcggtctgagttcactgtactccgaatctatgaagaaacttcggtcaagcttcctgactggcctttgtgatatatcggaagggactgtcgtacctgaggaccgatgcaagtcccctacttctgcgaagatgtcccggaagctctcattgcccactgacctcaagccggatctggacgttaaagataactcattcagccgttccaggtcctcctcggtgaccagtatagacaaagagtctagggaggccatcagtgctctgcacttttgtgaaacctttacacggaagacagactccagccccagcccatgcctgtgggtgggtacaactctcgggaccgtgctggtaattgcccttaacctcccaccaggtggagaacaaaggctcttgcagcctgtaatcgtgtctcctagcggcaccattttgcgcctaaagggagccattttaaggatggctttcttagatacaaccggatgcctgatccctcctgcctacgagccttggcgggaacacaacgtgcctgaagaaaaggacgagaaggagaagctgaaaaagagacggcctgtctctgtgagtccgtcctcttcccaggagatttccgagaaccagtatgccgtgatctgctccgagaagcaggcaaaagtaatcagtctgcccacccaaaactgtgcatataagcaaaatatcacctag

SEQ ID NO: 137073 - DNA, 927 bp, Artificial Sequence
  Description of Artificial Sequence: Synthetic coding sequence
atgagaaagttcaacatacggaaagtactggacggccttaccgctggtagcagtagcgcttcccagcagcaacagcagcagcaccctccagggaatagggaacctgagatacaggagacgctgcagtccgagcacttccagctttgtaaaacagtgcgtcacggcttcccctatcagccgagtgcactcgcttttgaccccgttcagaaaattctggctgtcggcactcagaccggcgccttgaggttgttcggccgacctggcgtagagtgctactgtcagcacgattctggagcagctgtgatccagctgcagtttctgattaatgaaggggcactggtgtcagccctggcagacgacacactccacctatggaacctgcggcagaagcgccccgccattctccacagccttaaattttgtagggaaagagtgaccttctgtcacctaccctttcagtctaaatggttgtacgtgggaaccgagcgcggtaatattcatatcgtcaacgttgaaagtttcacgctgtccggctacgtcattatgtggaataaagccatcgagctgtcgtctaagtctcaccccggccccgtcgtacacattagcgataaccctatggacgaagggaagttacttatcgggtttgagtccggtactgtggttctgtgggacctcaagagtaaaaaagcagactatcgctacacttatgacgaggccattcatagcgtggcctggcatcatgaaggaaagcagtttatctgcagtcattccgacggcacactgaccatttggaatgtccgctcccctgctaagccagtgcagacaattaccccacacggtaaacaattaaaggacggcaagaagcccgaaccctgtaaacctatcttaaaggtcgaattcaaaaccacaaggagcggcgtctgttag

SEQ ID NO: 137074 - DNA, 3561 bp, Artificial Sequence
  Description of Artificial Sequence: Synthetic coding sequence
atgaaaaagttcaactttcgtaaagtacttgatggcttaactgcaagttcgcctggcagtggctcatccagtggaagcaactctggaggaggtgctgggagcggcagcgtgcatccggcaggcaccgctggagttctgcgtgaagaaatacaggagacgcttactagcgagtacttccaaatctgtaaaaccgtgaggcacggctttccccatcaaccaaccgcactggcatttgaccccgtccagaaaattctagctatagggacacggacaggcgccatccgaatactcggccgcccaggtgtcgactgctactgtcaacacgaatccggagctgctgtgttgcaactgcaatttctgattaatgagggggccctggtctccgctagcagcgacgacactttacacctgtggaacctgagacagaaaaggcccgcgattcttcattctctcaaatttaacagagagcgcataacatactgccacctgccttttcagtcaaaatggttatacgttggtacagagcgtgggaatactcatatagtgaatatagaaagtttcatcctatccggttacgtgatcatgtggaacaaggctattgagttgtctaccaagactcaccctggacccgtggtacaccttagcgattcccctagggacgagggcaagctgctgataggctacgagaacggcacagttgtgttttgggacctcaagtccaaacgggctgaattgcgggtgtattacgacgaagccatacattctattgactggcatcatgagggtaagcaatttatgtgtagtcactcagatggcagcctgaccctgtggaacctgaaaagcccgagcaggccattccaaaccaccataccccatggaaaatctcagagggagggcagaaagtccgaatcctgtaaacccatcttgaaagtcgaatataagacttgtaagaattctgagccattcattattttctctggaggcttgagttacgacaaggcctgtagacggccaagccttactattatgcacggaaaggcaataacagtactggagatggatcacccaattgtcgagttcctgactctgtgcgagaccccctaccccaatgaatttcaagagccctatgcggtcgtggtgttactggagaaagatctaatagttgtcgatttgacacagagtaactttcccattttcgaaaatccgtatcccatggatatacacgaatccccagtgacatgcactgcctatttcgctgattgtccaccagatcttatactcgtactctacagcatcggggtcaagcataagaagcaaggctactcaaataaggagtggcctatatccgggggcgcatggaacctgggagcccaaacatatccagagataatcataacaggtcacgccgacggctcaatcaagttttgggacgccagtgctattactctgcagatgctctataagttgaagacctccaaagtgttcgaaaagcagaaggtcggcgaagggaaacagacctgcgagattgtggaagaagatcccttcgctatacagatgatctactggtgccctgaatctagaatcttttgcgttagtggggtctctgcatacgtgatcatctataaattctctcgacacgaaatcactactgagattgtatctcttgaggtgagacttcaatatgatgtggaagacatcattactccagagccagaaacgagccctccctttcccgatctgtccgcccagctgccatcttcaaggtccctgtccggttccaccaacacagtcgccagtgagggtgtgaccaaggacagcattccttgcctgaatgtcaaaaccagacccgtgaggatgccccccggctatcaggcagagctggtaattcagctggtgtgggtggatggcgagcctcctcagcaaatcaccagcctcgcagtgtcctctgcttatggcatcgtagctttcgggaattgtaacggcttggccgttgtggattttatccagaagacagtccttctgagcatggggacaatcgacctatataggtcttcagatttgtaccagcggcagccaaggtcacccagaaagaacaaacagtttatcgcagacaatttttgcatgaggggtctgtcgaatttttacccagatctaacaaaaaggatcaggaccagctatcaaagtttgacagaactgaacgactccccagtgcctctggagctggagagatgtaagagccccacctctgatcatgttaacggtcattgtacttctccgacctcccagtcgtgctcctcaggtaagcggctgtctagcgccgatgtgagcaaggttaaccgctggggaccagggcgtcctccttttaggaaggcccagagcgccgcttgtatggagatttccctgccagttaccaccgaggaaaatcgcgagaattcctacaaccggagtagaagctctagcatctcatccattgataaggactccaaggaggctataactgctctttattttatggacagttttgctagaaagaatgattcaaccatctccccatgtctgttcgtgggcacctctctggggatggttctcatcatttctctgaatttgccgctggcagatgagcagagatttaccgaacccgttatggtgctgccttccggcactttcctttctttgaaaggcgctgtgcttacgttctcatgtatggatcgaatgggaggattgatgcagcccccctatgaggtctggagagaccccaacaacattgatgaaaacgaaaaatcatggcgccgtaaggtggtcatgaattcctcatctgccagtcaggagataggcgatcaccagtataccatcatttgttctgaaaagcaggccaaggtgttctcgctgccttcacagacttgcttatacgtacacaacatcaccgagacatcatttatcctgcaggccaacgtcgtagtcatgtgtagtagcgcctgcctggcctgcttttgcgccaatggacatataatgatcatgtctctgccttcgcttcgtcccatgctagacgtcaattatctcccactgacggatatgcggatagcccggaccttttgttttacaaacgagggtcaggccctctatctggtgtctcccacagagattcagcgattaacgtacagtcaggagatgtgcgataacctccaggacatgctgggggacctcttcaccccaatcgaaactcctgaggctcagaaccgtggcttcctgaagggattgtttgggggttcagggcagactttcgacagggaggaactttttggggaggctagcgccggtaaggctagtaggtcactggcccaacatattccagggcctgggtccattgagggcatgaagggagctgccggcggagtaatgggagagttgacgagagcccgtattgcattggacgagagggggcagaggttgggcgaactggaggagaagactgctggaatgatgacaagtgctgaagctttttctaaacacgcgcacgagctgatgttgaagtataaggataaaaagtggtatcagttctag

SEQ ID NO: 137075 - DNA, 384 bp, Artificial Sequence
  Description of Artificial Sequence: Synthetic coding sequence
atgaagaagttcaatttccggaaggtgctagacggcctgactgcctccagcccgggatccggctctagttctgggagcaattctgggggtggcgcaggcagcggatcagtccatccagccgggactgccggcgttcttcgggaggagatccaagagacactaacatctgagtacttccagatttgcaagaccgtcagacatgggttcccccaccagcccacagccctcgcctttgaccctgtccaaaagatcctggctattgggactcgaacgggcgcaatccgaatcctagggcgacccggggttgactgttactgccaacacgaaagcggcgctgcagtgttacagttgcagttcttgatcaacgagggcgctctagtctag

SEQ ID NO: 137076 - DNA, 633 bp, Artificial Sequence
  Description of Artificial Sequence: Synthetic coding sequence
atgtctgctaagagtgccatctccaaagagatttttgcaccccttgacgagagaatgctgggagcagttcaagtcaagaggcggacaaagaagaagatcccgttccttgcaaccgggggccagggagaatacctcacctatatctgcctgagcgtgacgaataagaaacccacgcaggccagcattacaaaagtcaagcagttcgagggctcaacgagctttgtacggcggtcccagtggatgctagaacaacttaggcaggtgaatggaatcgacccaaatggcgattccgcagaattcgacctattgttcgagaatgcatttgaccagtgggtcgcctcgacagcctcagaaaagtgtacattctttcagatcctgcaccacacatgccagagatatctgactgacagaaagcctgagtttatcaattgccagagtaaaatcatgggcggcaactctatattacatagcgcagcagacagcgtgacatccgccgttcaaaaggcctcacaggccctcaacgaaagaggggagcgcctcggaagagccgaagaaaaaactgaggatctgaaaaattctgcgcaacagttcgccgagaccgcccacaagcttgcaatgaagcacaagtgttag

SEQ ID NO: 137077 - DNA, 633 bp, Artificial Sequence
  Description of Artificial Sequence: Synthetic coding sequence
atgtcggccaaaagcgctatcagcaaagagatatttgctccactggacgagcgtatgcttggggccgtccaggtgaagcgacgaactaagaaaaagattccatttctggccacagggggacaaggggaatacctgacctatatatgcctgtccgtcacgaacaagaaaccaacccaggctagcatcactaaagtgaagcagtttgagggctccacatcttttgtcaggagaagtcagtggatgctcgaacaactacgacaagtgaacggtatagatcctaatggggattctgctgaattcgatctgctattcgaaaatgcattcgatcaatgggtcgcctccaccgcatcagaaaagtgtacctttttccaaattctgcaccatacctgccaacggtacctgaccgatcgcaaaccagaatttatcaattgtcaatctaagatcatgggcggcaactcaattttacatagcgctgccgactcggtgacctctgccgtgcagaaggcaagccaggctttgaacgagcgcggggagaggctgggaagagccgaagagaaaaccgaagacctcaagaattccgcacagcagtttgcggaaaccgcgcacaaagtcacattccgggggagaaaatag

SEQ ID NO: 137078 - DNA, 633 bp, Artificial Sequence
  Description of Artificial Sequence: Synthetic coding sequence
atgagcgcaaagtcagcaatctccaaggaaatttttgcccctctggacgagcggatgctgggagcagttcaggtgaagagacggacgaaaaagaagatcccgttcctggccactggaggtcaaggagaatatttgacatacatttgtctgtccgtgacaaataaaaaacctactcaagcaagcatcacaaaagtgaagcagttcgaaggcagcacgtcctttgttcggaggtcacagtggatgttggaacagctgagacaagttaatggtattgaccccaacggagactccgcggaattcgacctgctgttcgaaaacgcatttgatcagtgggtggcctcaaccgccagtgagaaatgtacgttttttcagatactgcaccacacgtgtcagcggtaccttactgatcgcaaaccggaatttatcaattgtcaatccaagatcatgggtggaaattcgatattgcattcagcagccgactctgtgacctctgcggtgcagaaagcctcccaggcactgaatgagcgcggagagcgactcggcagggccgaggagaagaccgaggacttaaagaacagtgcccagcaatttgcggaaacggctcataagctggctatgaagcacaagtgttag

SEQ ID NO: 137079 - DNA, 633 bp, Artificial Sequence
  Description of Artificial Sequence: Synthetic coding sequence
atgagtgcaaagtccgcaattagtaaggagatcttcgccccactcgacgagcgtatgctgggcgcggttcaggttaagaggcgaactaagaaaaagataccctttttggcaaccggaggccaaggagaatacctcacctacatctgtttatcggtcaccaataagaagccgacacaagctagcataacaaaagttaagcagtttgaggggagtacaagtttcgtgcggcgcagccaatggatgcttgagcaacttagacaagtaaatggcatcgacccaaacggggatagtgctgagttcgacctgctctttgaaaacgccttcgatcaatgggttgcatccacagccagtgagaaatgcacattctttcagattttgcaccacacatgccagcggtatctgacagatagaaagcctgagttcatcaactgccaatctaaaatcatgggggggaactccatcctgcactctgccgctgactcagtgacctccgccgtccagaaggcctcacaggcgctgaacgagcgcggcgaaaggctgggtcgggcagaggagaaaactgaggaccttaagaactccgcccagcagttcgcagagaccgctcacaagctagcgatgaagcataaatgttag

SEQ ID NO: 137080 - DNA, 633 bp, Artificial Sequence
  Description of Artificial Sequence: Synthetic coding sequence
atgtctgccaagtccgccatatcaaaggaaattttcgcccccctcgatgagcgaatgctcggcgctgtccaggtgaagcggcgcactaagaagaagatccctttcctagccaccggcggacagggggaatatttaacctatatctgcctttctgtaaccaataagaagcctacacaagccagcatcactaaggtgaagcagttcgagggaagcacctcctttgtccggcgcagccagtggatgctggagcaactgagacaagtgaatggcatcgaccccaacggggatagtgccgaattcgacctgctctttgagaatgctttcgatcagtgggtagccagcaccgctagtgagaaatgcactttcttccaaatcctgcaccatacatgccagaggtacttaacagacaggaagccagaattcatcaactgtcaatccaaaataatgggtggtaacagcatacttcattcagccgcagattctgtgacctcagcagtgcaaaaagcgtcccaagccctgaacgaaaggggtgagagactgggacgggccgaagagaagactgaagacttaaaaaattcagcgcagcagttcgcagagaccgcccacaagctggctatgaagcacaaatgttag

SEQ ID NO: 137081 - DNA, 327 bp, Artificial Sequence
  Description of Artificial Sequence: Synthetic coding sequence
atgtctgcctgctttctggataccagacgcgcggctttcctccaatgcgacctacccagtagctatcgaatcttgactttgccagaatccggacattgcggctccgccgagcccgtgtccgatgccccagctctgctactctccgggaattcaatcctgcactccgccgccgattcagtgacctctgcagtgcagaaggcctcccaagccttgaatgaaagaggtgaacggttggggagagcagaagagaagaccgaagatctgaagaattctgcccagcaattcgctgagacggcccacaagcttgccatgaaacacaaatgctag

SEQ ID NO: 137082 - DNA, 633 bp, Artificial Sequence
  Description of Artificial Sequence: Synthetic coding sequence
atgtctgctaagtccgccatatccaaagaaatcttcgcacctctggatgagaggatgctcggtgctgttcaggtcaaaagacgaacaaagaagaagattccattcctggccacgggcgggcagggagagtaccttacatacatatgcctttcagtgactaacaagaagcctacacaggcaagcatcaccaaagtgaaacagtttgagggaagtacctccttcgttcgtcgctcgcagtggatgcttgaacagctgcgccaggtcaacggcatcgatcccaacggagactcggcggagttcgatctgctcttcgagaacgcgtttgatcagtgggtcgcttctacagccagcgagaagtgtactttctttcagattcttcatcatacatgtcagcgctatctgaccgaccggaaacccgagtttattaactgccagtcaaagatcatgggcggtaattcgatcttgcattccgctgccgactctgtgacatctgcagttcagaaggcctctcaggcacttaacgagcgcggtgaaagacttggacgggctgaagagaaaacggaagatcttaaaaattcggcccagcagttcgccgaaaccgcgcataagcttgctatgaaacacaaatgctag

SEQ ID NO: 137083 - DNA, 633 bp, Artificial Sequence
  Description of Artificial Sequence: Synthetic coding sequence
atgtcagcaaagtccgcaatttctaaagagatttttgcacccctggatgagagaatgctgggcgctgtccaagtgaagcgacgcaccaagaaaaaaatcccgttcctcgcaacgggcggccagggcgagtacctgacctacatttgtttgtctgtgactaataagaagccgacacaagcctctatcacaaaagtgaaacagtttgaaggcagtacttcttttgtgcgtcgctcccagtggatgttagagcagttgagacaggtgaatggtatagaccctaacggagactcagccgaattcgacctgctctttgaaaatgcatttgaccaatgggttgcatcaacagctagtgagaaatgtacctttttccaaatcctgcaccatacatgtcaaaggtacttaaccgaccgaaaacccgaatttatcaactgccagagcaaaataatgggcgggaactccatcttacactcggccgccgatagtgtgactagcgcggtccagaaagccagtcaggcactgaacgaaaggggcgaaaggcttgggcgggccgaggaaaagacagaggacctgaagaattccgcccaacaattcgccgaaactgcacacaaactggccatgaaacataagtgctag

SEQ ID NO: 137084 - DNA, 1617 bp, Artificial Sequence
  Description of Artificial Sequence: Synthetic coding sequence
atggccgttgctgccgcggctgctgctgcagggcctgcgggggcaggagggggaagagctcagagaagcggactactcgaggtgttggtcagggatcggtggcacaaggttcttgtgaatctgagcgaggacgcgttagtcctgtcgtcggaagagggcgcagccgcctacaatgggataggcacagccactaacggcagcttttgccgaggcgcaggggcaggacaccccggggcgggaggcgcccagccccccgacagtcccgctggcgtccgcactgccttcacagacctcccagagcaggttccagagtcaatctccaaccagaaacgcggcgttaaagtgttgaagcaggagctcggaggtttgggcatttcaattaagggggggaaggaaaataagatgccgatcctgatctccaaaatttttaaaggcctggccgccgaccagacgcaggcactgtatgtgggcgacgcgattctttccgtgaacggcgctgatttacgagacgctacgcacgacgaggctgtccaagccctcaagcgcgcaggaaaagaagtccttctggaggtaaagtacatgcgggaggctaccccctacgtgaagaaaggttcacccgtcagtgagattggctgggaaactcccccccccgagtccccacgattggggggcagcacctccgacccgcccagcagtcagagttttagctttcaccgcgatcgtaagagcattccactgaaaatgtgctatgtgacacggtccatggcactggcggatccggaaaaccgacaactggaaatccacagccccgatgcaaagcatactgttatcctgcgctcaaaagactcagccaccgcgcaggcttggttctcagctatccactccaacgtgaacgatctgctaacaagggtgatcgcagaggttcgcgagcagctgggtaagaccggtattgctgggtcccgagagattaggcacttgggttggctggccgaaaaggtgccaggcgagagtaaaaagcagtggaagcctgccctggtggtgcttacagagaaagacctgctgatttacgatagcatgcctcgccgcaaggaggcctggttctcacccgtgcatacctatcccctactagccaccagactagtgcattctggacctggcaaaggttccccccaggccggagtcgatctcagctttgcaaccaggaccggaacccggcaaggcatcgagacgcatctttttcgggccgaaaccagccgcgatctttcccattggactagatccatcgtccagggctgccataattccgcagagctgatcgcggagattagcacagcctgtacctacaagaaccaagagtgcaggctaaccatccattacgagaatgggttttcaatcactacagagccccaggagggcgcattccctaagactattattcagtcgccgtacgaaaaactgaagatgtcttcagacgatgggatcaggatgctatacctcgacttcggcggtaaggatggtgaaatacaactggacctgcactcatgtcctaaacctattgtgtttattatccactcgtttctgagtgccaagatcacgcggttaggacttgtcgcatag

SEQ ID NO: 137085 - DNA, 1617 bp, Artificial Sequence
  Description of Artificial Sequence: Synthetic coding sequence
atggctgtggcggctgccgccgctgccgctggccctgctggtgccggcggaggccgcgcccaacggtctggtctactggaagtcctcgtaagagaccgctggcacaaagtcttagtcaatttatccgaggatgcgcttgtactatcttccgaggagggcgcggccgcctacaacgggatcggaactgctacaaatgggagcttctgccggggggccggcgccgggcaccccggggccgggggggcccaaccccctgattcgccggctggcgtccggactgccttcacagatctgcccgaacaggtaccggagtcaatctctaaccagaaaagaggagtaaaagtcctcaaacaggagttaggtggtctaggcatctctatcaagggtggaaaggaaaataagatgcctattcttatcagcaagattttcaaagggttagccgcggaccagacccaagcactctacgtgggcgatgcaattttgtctgtgaatggagccgatctcagagatgccactcacgatgaagcagtccaagcgctcaaaagggctggtaaggaagtgctcctggaagtgaagtatatgcgggaagcaaccccctatgtcaaaaagggttcccctgtgtccgaaataggatgggaaactcctcctcccgagtctcccaggctgggtgggtcgacctccgaccctccctcatctcaatctttctcctttcaccgagaccgtaaatctattcctctgaagatgtgttacgttaccagaagcatggccctggccgatccagagaaccgtcaactagaaatacactcaccagatgccaaacacacagtcattcttaggtctaaggattccgcaactgcccaagcctggttctctgccatccactccaatgtcaacgacttgctgactcgtgttatcgctgaggtgcgggagcaattgggaaaaactggcatcgccggatctcgagaaatacgacatttagggtggctagccgagaaggtgcccggtgagagcaagaagcagtggaagccagccttggtcgtcctcacggaaaaagatcttcttatatatgacagcatgccgaggcggaaggaagcttggttctctcccgtgcatacatatcccttgctcgctactcgcctagtccattccgggccgggaaagggttccccacaagcaggggttgacctcagcttcgccacaagaacgggtacccgccaagggatcgaaacccaccttttcagggcggagaccagtcgagatctgtcacactggacgcgtagcattgtgcagggttgtcacaactccgctgaactcattgctgaaatctccactgcatgtacgtataaaaatcaggagtgccgactcactatacattacgagaatggattctccataacgacagagccccaggagggggccttcccaaaaaccattatccagtcaccatacgaaaagctcaaaatgtcctccgatgatggaattagaatgctgtatctggatttcgggggtaaggatggagagattcagctggatctccattcctgtccaaaacccatcgtgttcattatacacagcttcctgagtgccaagatcaccagactaggacttgtggcctag

SEQ ID NO: 137086 - DNA, 87 bp, Artificial Sequence
  Description of Artificial Sequence: Synthetic coding sequence
atggcagtggcagcagcggccgcagcagcagggccagctggcgcaggagggggacgtgcacaacgaagcgggctcctcgaggtgtag

SEQ ID NO: 137087 - DNA, 1623 bp, Artificial Sequence
  Description of Artificial Sequence: Synthetic coding sequence
atgcgtgttgctgcggcaacggccgctgccggggccggccccgccatggctgtgtggacacgggcgaccaaggccggactcgtcgagcttttgttgagggagcggtgggtgcgcgtggtcgccgagctgtccggtgagagtctaagtctgacaggagacgcagccgccgctgaactcgaacctgccctgggccctgccgccgctgcatttaacggcctgcccaacggaggaggcgccggcgatagccttccgggtagcccatctagggggcttggccccccatctccacccgctccaccaagaggacctgcgggcgaagctggtgcttctccaccggtgcggagagtgcgcgttgtgaagcaagaggccggtggtctgggaatcagcattaagggtggccgggagaatagaatgccgattttgatctctaaaatttttccaggactagcggctgatcagagcagggcactccggttaggtgatgctattctatctgtgaatgggaccgatcttaggcaggcaacccacgatcaggccgtgcaagccctgaagcgggccggcaaggaggtactattggaggtgaagttcatcagggaggtgactccatacatcaaaaagccctccctagtttcagacctgccctgggagggcgccgctccccagagccccagcttcagcggctccgaggactccgggtcaccaaaacaccagaactctactaaggataggaagattatcccactgaagatgtgtttcgcagccaggaacttgagtatgccggatctcgaaaaccgtctaattgagctccattctccggattctagaaacaccttaatcctgcggtgtaaggataccgctacggcccactcctggtttgtcgcaattcatactaatataatggcattgctgcctcaggtgcttgccgaactgaatgccatgctgggggcgacgtccaccgcgggaggatccaaagaggttaaacatatagcatggctggctgaacaagctaagctggacggcggtagacagcagtggagaccagtgctgatggccgtgaccgagaaggacttgctgttgtacgattgtatgccatggaccagggacgcctgggcatcgccgtgtcattcctatcctctagtcgctacccgcttggtacactccggatccggatgtaggagtccaagtctcggttcagatcttactttcgcaacccgaaccggatcccgccagggcatagagatgcacttgttccgtgttgagacacacagagacttgagtagttggactagaatcttggtgcagggctgccatgccgcagcagaattgattaaggaagtcagcctcggttgtatgctgaacggacaagaagttcgcctcaccattcactacgagaacggtttcacaatctcaagggagaatgggggcagcagctctatcctttataggtatccattcgagcgactcaagatgtccgccgatgatggcatcagaaatttataccttgactttggagggcctgaaggagagctgacaatggacttgcactcttgtcccaagccaatcgttttcgtactgcatacttttctgagtgctaaggttacgaggatgggactgctggtgtag

SEQ ID NO: 137088 - DNA, 1443 bp, Artificial Sequence
  Description of Artificial Sequence: Synthetic coding sequence
atggacttccgaaccgcctgcgaggagactaagactggaatctgtctgctgcaggatggaaaccaagaacctttcaaggtgcgcctgcacctcgcgaaggacatcctgatgatccaggagcaggatgtgatctgcgtgagcggagagcccttttacagtggtgagaggacagttaccatccgccgtcagacagtcggagggttcggcctgagtattaaaggtggggccgagcacaatataccagttgttgtatccaagatatccaaggagcagagagccgagttgtctggactcctcttcattggtgacgctatactgcagatcaatggtatcaatgttcgaaagtgtagacacgaagaagtagtgcaggttctccgcaacgcaggagaggaagtaacccttacagtgagctttttgaaaagagcccccgcttttctaaaactgccgttaaacgaagattgcgcatgcgcaccatctgaccagtctagcggaacctcgtctccattatgcgatagtggactccatttgaactatcatccgaacaatacggatacactttcttgttccagttggcccacctcccccggattgcgatgggaaaagcgttggtgcgatttgcgccttatcccgctgttacacagccgcttttcacagtacgtgcctggtaccgatctgagccgccagaacgcttttcaagtgatcgctgtcgatggcgtctgcaccggaatcatccagtgtctaagtgcagaagattgcgtggactggctccaggccatcgcaaccaatatatccaaccttactaagcacaatattaaaaaaattaacaggaactttccagtgaatcagcagatcgtctatatggggtggtgtgaggctcgggaacaggacccgttacaggatcgggtttatagcccaacgtttcttgcccttagaggtagctgcttatacaagttcctggcaccacctgttactacctgggattggacacgggcggaaaaaaccttcagtgtgtatgaaataatgtgcaagatcctgaaggatagcgatctgctggacagacgaaagcagtgctttactgtgcagtccgaaagtggtgaagacctctacttcagcgtggagctggagagcgacctggctcagtgggagagggctttccagactgccacatttctcgaagtggagagaatacagtgcaaaacctacgcttgcgtgctggagtcacacctcatggggctgacgatcgacttcagcaccggattcatttgtttcgacgccgccactaaagaactggagttttccaacttatttgcagtcctgcactgcatccactccttcttcgccgccaaagtcgcgtgtctggacccactctttttaggaaaccaagcgactgcctccaccgcagcctcttcagcaaccacgagtaaagccaagtatacaacgtag

SEQ ID NO: 137089 - DNA, 1443 bp, Artificial Sequence
  Description of Artificial Sequence: Synthetic coding sequence
atggatttcaggaccgcctgcgaagagaccaaaacaggaatctgccttctccaagacggaaaccaggaaccatttaaggtccgtctgcacttggcgaaggacatcttaatgatccaagaacaggacgttatttgtgtgtcaggtgaaccgttttattcaggagagagaaccgtcacaatcaggcgacaaaccgtgggaggtttcgggttgtctatcaaagggggagccgagcacaatatccccgtggtcgtgtccaagatcagcaaggagcagagggccgaactcagcggacttctctttatcggggatgcaatcctacagattaacggcatcaacgtgcggaaatgcaggcatgaagaagtcgtccaggtcctcagaaacgccggcgaagaggtgaccctgactgtctcattcttgaagagggctccggcgtttctgaagttacctctgaatgaagactgcgcctgtgcgccaagcgatcagtcctccggtacctccagtccactgtgcgatagcggccttcatcttaactaccatccaaataacacagatacactgtcttgctcctcttggcctacttccccaggactgcgctgggaaaaacgttggtgcgaccttaggctgattccgctcctccactctcgcttctcacagtacgtgccaggaactgaccttagtaggcagaatgcatttcaggtgatcgccgttgacggcgtgtgcacaggaataattcagtgtttgtccgcagaggattgcgtcgactggctgcaggctatagccaccaatatttccaacctgacgaaacataacatcaaaaagataaacagaaattttccagtgaatcaacagattgtgtacatggggtggtgcgaggcccgcgagcaggacccactccaggacagggtctattccccgacctttctcgctctgagggggagttgcctatataagtttctggcacctcccgttacaacttgggactggactagggctgagaagaccttttccgtctatgagatcatgtgcaagattttgaaagactcagacctactggacagacggaagcagtgtttcacggtacagtcagagagtggagaagatctctactttagcgtggaactggaatccgatctagcccagtgggagagagcttttcagacagccaccttcctcgaggtcgagcgcatccagtgtaagacgtacgcttgtgtgctggagagtcatctcatgggccttaccatagatttttccactggattcatatgctttgacgccgcaaccaaagagctagagttcagcaatctattcgcagtgttacactgcatccactctttctttgccgcaaaagtggcctgcctggaccctctttttctgggaaaccaggcgaccgcgagcacggcggctagttccgctaccacgtcaaaggccaaatatacaacgtag

SEQ ID NO: 137090 - DNA, 1554 bp, Artificial Sequence
  Description of Artificial Sequence: Synthetic coding sequence
atggacttccggacagcttgcgaagagactaagaccggcatctgtctgctccaggatggaaaccaggagccattcaaggtgcgactgcatctcgctaaagacattctgatgattcaggaacaggatgtgatttgtgtgagtggggagccattctactccggcgagagaactgtgactataagacgacagactgtcggtggattcggcctgtcaataaaaggcggcgcggaacacaacattcctgtggtcgtttctaagatcagcaaggaacagagagcagagctgtccggtctgttgttcatcggagatgccattctgcaaataaatggtattaacgtgcgtaaatgtcggcacgaagaggtggttcaggtcttacggaacgccggcgaggaagtgaccctcaccgtctcttttttgaagagagccccagcttttctgaagcttcctttgaacgaagactgcgcctgtgcaccgtcggatcagagcagcgggacaagttcccctctatgcgactccggcctccacctgaattatcatccaaataacacagatacactctcatgctcgtcttggccaaccagccccggactcagatgggagaagagatggtgtgacctccgactaatccccctgctgcactctcgattttcccagtacgtccccggcacagacttgtcccgccagaacgcattccaggtgatagctgtggatggcgtgtgtacgggcatcattcaatgcctttctgctgaggactgtgtggattggctgcaggcaatcgcgacaaacatcagtaatctcacaaaacataacattaagaagatcaatagaaattttcccgtgaaccagcagatcgtttacatgggttggtgcgaagcaagggaacaggacccgcttcaagacagggtatacagccctacgttcctcgcactgagggggtcttgcctgtataagttccttgctcctccggtcacaacatgggactggacacgcgcggaaaagactttctccgtctacgaaatcatgtgtaagatcctaaaagacagcgatctcttagatcgcagaaagcaatgttttaccgttcaatctgagtcgggcgaagatctctactttagtgttgagctagagagcgacctggcacagtgggaacgcgccttccagactgctactttccttgaagttgaacggatccaatgcaaaacatacgcgtgtgtgctcgaatcccacctgatggggctcaccattgacttctctaccggattcatctgcttcgacgccgcgactaaggccgtcctgtggagatacaagttcagtcaactgaaaggctcgagtgatgacggcaaaagcaagatcaagttcctgttccagaaccctgatacaaagcaaatcgaagccaaggagctcgagtttagcaacctgtttgctgtcctgcactgtattcatagcttcttcgccgcgaaggtggcctgtctggatcccctattcctcgggaaccaagcaactgcatccacagccgcctcctcagctaccacctccaaggccaagtacactacatag

SEQ ID NO: 137091 - DNA, 1554 bp, Artificial Sequence
  Description of Artificial Sequence: Synthetic coding sequence
atggacttccggacagcgtgcgaagaaacaaagacaggaatctgccttctccaagacggcaatcaggagccatttaaggtcagactgcacctggctaaggatatcctgatgatccaagaacaggatgtcatctgcgttagcggagagcccttttacagcggagagaggaccgttactatcaggaggcagaccgttggcggattcggtctgtccattaaaggcggggccgagcacaatattcccgtagttgtatctaagatttccaaggagcaaagagcagagctcagtgggttgctgtttattggcgacgccattctccagatcaatgggattaacgttcgcaagtgtaggcacgaagaagttgttcaagttctccgaaatgccggagaggaggttacactgactgtgtccttcctcaagagggcacccgctttcctgaagctgcccttaaatgaagattgcgcgtgcgccccatcagatcagagcagcggaacgagctcccctttgtgcgactctggcctacatttaaactatcaccccaataataccgacaccctctcttgttcatcatggcctacttcaccgggcctaagatgggaaaaaaggtggtgtgatttgcgccttataccactgttacatagcaggtttagccaatatgtcccaggaaccgatctgtccagacaaaacgcgtttcaagtgatcgctgtggacggggtctgtacaggcattattcaatgtctgagcgccgaagactgcgtggattggcttcaggccatagctaccaacatcagcaacctcactaagcacaacattaagaagattaatagaaattttcctgtgaatcagcagatcgtatatatgggttggtgtgaggccagggaacaagatccactccaggacagagtttacagtcctacattcctagctctccgggggtcatgcctttacaaatttttggcgccgcccgtgaccacctgggactggacccgtgccgagaagacattctcggtgtatgaaattatgtgcaagattctgaaggacagtgatctgcttgaccggcgcaaacagtgttttacggtgcagtccgagtcgggggaggacttgtatttctctgtcgagctggagtccgacctagcgcagtgggagagggccttccagaccgctacctttcttgaggtcgagcgtatccaatgtaaaacatacgcgtgcgtcctggagtcccatctgatggggctgaccatcgatttttctacgggcttcatctgctttgacgccgcaacaaaggcagtcctgtggcgttataagttttcccagctgaagggcagcagtgatgatggcaagagcaagatcaagtttttgttccagaacccagacacgaagcaaattgaggccaaagagctcgagtttagcaacctctttgccgtactgcattgcattcactccttttttgctgccaaggttgcgtgcctggaccccctctttttaggaaatcaggctactgcctcaaccgcggccagcagcgctactacatcaaaagccaagtacaccacatag

SEQ ID NO: 137092 - DNA, 279 bp, Artificial Sequence
  Description of Artificial Sequence: Synthetic coding sequence
atggactttagaactgcctgcgaggagacaaaaactggcatctgcttactgcaagacggaaatcaggaaccatttaaggtcaggctgcacctagcaaaggatattctgatgattcaagaacaggatgtgatctgtgtctccggcgaacctttttatagcggagagcgtacggtgactatccgacgccagacagtcggaggatttggactgtccattaaggggggcgctgaacataacatccctgttgtggtctccaagatcagcaaggagcagcgctag

SEQ ID NO: 137093 - DNA, 423 bp, Artificial Sequence
  Description of Artificial Sequence: Synthetic coding sequence
atggacgtgttcatgaaaggcttgtcgaaagccaaggaaggcgtagtggccgccgccgagaagaccaagcagggcgtggcagaggcagctggtaagaccaaagagggcgtcttatacgttgggtccaaaactaaagaaggggttgtccatggggtggcaactgtagccgagaaaacaaaggagcaggttaccaacgtcggtggcgctgtcgtcactggcgtaaccgccgtggcccagaagactgtggaaggggccggcagcatcgccgcggcaactggctttgtgaagaaggatcagctgggcaaaaacgaggagggggccccacaagagggcattctcgaggacatgccggtcgatccagataacgaggcatatgaaatgcccagcgaagaaggctaccaggactatgagcctgaagcctag

SEQ ID NO: 137094 - DNA, 339 bp, Artificial Sequence
  Description of Artificial Sequence: Synthetic coding sequence
atggacgtgtttatgaaagggctctccaaggcaaaagagggagtcgtggcagcagctgagaaaaccaagcagggagtggccgaggccgctggaaagacaaaagaaggcgtgttgtacgttggatctaaaacgaaagaaggagtggttcatggggtggcaaccgtagcagaaaagaccaaggagcaggtcacgaacgtgggaggggctgtggtgaccggcgtaactgcagtggcccagaagactgtggaaggtgccggcagtatcgcagccgcaacggggtttgtcaagaaggatcagctcgggaaggaaggctaccaggactacgaaccagaagcctag

SEQ ID NO: 137095 - DNA, 423 bp, Artificial Sequence
  Description of Artificial Sequence: Synthetic coding sequence
atggatgtatttatgaaaggattatcaaaagcaaaggagggagtggtcgctgccgccgagaaaaccaaacagggcgtggctgaagccgccggtaaaacaaaggaaggagtgctttatgtcgggagcaagaccaaggaaggggtagtgcatggggttgctaccgtcgcagagaagacaaaggagcaggtcaccaatgttggtggggcagtggtcactggggttacagccgtggcacagaagaccgttgaaggtgcaggcagcatcgcagccgccaccggcttcgtgaaaaaggaccagctcggcaagaacgaagaaggcgccccacaggagggcatcctcgaagatatgcccgtagatccagacaacgaagcctacgaaatgcccagtgaagaggggtatcaggattatgaacctgaagcgtag

SEQ ID NO: 137096 - DNA, 381 bp, Artificial Sequence
  Description of Artificial Sequence: Synthetic coding sequence
atggacgtgttcatgaaaggattgtctaaagctaaggagggcgttgtagccgcagccgagaagaccaaacagggggtggcggaggcagcaggaaaaaccaaggagggggtactatatgtcgtggcagaaaagactaaggagcaagtgacaaatgtcgggggcgcggtggtgacaggtgttaccgctgtggcacagaaaaccgttgaaggtgcaggcagcatagctgctgctaccggctttgtcaagaaggatcagctcggaaagaacgaggagggggctccacaggagggcattctggaggatatgccagttgatcccgacaacgaggcttacgagatgccgtcagaggagggctatcaggactatgagccagaggcatag

SEQ ID NO: 137097 - DNA, 423 bp, Artificial Sequence
  Description of Artificial Sequence: Synthetic coding sequence
atggatgtctttatgaagggactgtctaaggctaaggaaggggtggtggcagccgctgagaaaacaaagcagggcgtggccgaggctgcgggtaagacgaaggagggggtgctgtacgtgggcagtaaaactaaggagggtgtggtgcatggggtggcaaccgtggcagaaaaaacgaaggaacaggttacgaacgtagggggggcagttgtgactggagtgacagccgtggctcagaagacagtcgagggcgctggatctattgcagcggcaaccggcttcgtgaagaaagatcagttagggaagaacgaagagggggcgccacaggagggtattttagaggatatgcctgttgatcctgacaatgaggcctacgaaatgcctagtgaggagggctatcaggactatgagccagaagcctag

SEQ ID NO: 137098 - DNA, 339 bp, Artificial Sequence
  Description of Artificial Sequence: Synthetic coding sequence
atggacgtctttatgaagggactcagcaaggccaaggagggggtcgtagccgccgcagagaagacaaaacagggggtggcagaagccgccggaaagacaaaagagggggtgctgtatgttggttctaaaaccaaagagggagtggtccacggagtggccaccgtcgccgagaagaccaaggagcaggtgacgaacgtgggcggagctgttgtcacaggcgttacagccgtggctcagaagacagtggaaggagctggctcaatcgcagcagccaccgggtttgttaagaaagaccaactgggaaaggagggttatcaggactacgagccagaggcctag

SEQ ID NO: 137099 - DNA, 348 bp, Artificial Sequence
  Description of Artificial Sequence: Synthetic coding sequence
atggatgtctttatgaagggcttgtctaaagccaaagaaggcgtggtcgctgctgccgagaagacaaagcagggcgtcgccgaagcggccgggaagacgaaggaaggcgtgctatacgtgggctcaaaaactaaggaaggggtggtccatggtgtcgccacagtagcagaaaagaccaaagagcaggtaaccaacgttgggggggctgtcgtgactggcgtgaccgccgtggctcagaagaccgtcgagggcgcagggtctatcgctgctgctaccggttttgtgaaaaaggaccagctcggcaaagtctggctgtgtacattctgcgttacttttatcagctggtag

SEQ ID NO: 137100 - DNA, 381 bp, Artificial Sequence
  Description of Artificial Sequence: Synthetic coding sequence
atggacgtattcatgaaggggctctccaaggctaaagaaggcgtcgtggctgcggccgagaagacgaaacagggagtggcggaggcagccggcaaaacaaaagagggggtgctttacgtggtggccgaaaagaccaaagagcaagtcacaaatgtgggaggtgccgtcgtcacaggtgttactgccgtggcgcaaaaaactgtggaaggcgctgggtcaatcgctgccgctacaggcttcgtcaagaaagatcagttaggcaagaacgaggaaggagcaccccaggaggggatcctcgaggatatgccggtggatcccgacaatgaagcctacgagatgccgtctgaagagggctaccaagactacgaacctgaggcctag

SEQ ID NO: 137101 - DNA, 423 bp, Artificial Sequence
  Description of Artificial Sequence: Synthetic coding sequence
atggacgtgttcatgaaaggcctgtccaaggcaaaggagggtgtggtggcagccgctgaaaaaactaaacagggcgtggccgaggctgccggcaaaactaaagaaggtgtgctatacgtcggctccaaaacaaaggaaggggtggttcatggcgttgcaaccgtcgcagaaaagactaaggaacaagtgaccaatgtgggcggggcagtggtgactggcgtcaccgccgtggcacagaagaccgtagagggcgccggctcaattgcggctgccaccggctttgtcaaaaaggatcagctcggtaagaatgaggaaggggcgccgcaggagggcatcctggaggatatgcctgtagatccagataacgaggcttacgagatgccatccgaagagggataccaggactacgaacccgaggcctag

SEQ ID NO: 137102 - DNA, 204 bp, Artificial Sequence
  Description of Artificial Sequence: Synthetic coding sequence
atggacgttttcatgaagggactcagtaaagcgaaggaaggggtggtggccgccgcagagaaaactaagcagggcgtggcggaggctgccggcaaaacaaaagaaggcgtcctctacgtaggtagcaagaccaaagagggggtggtgcacggggtcgctaccgtggcggaaaaaaccaaagagcaggtgacaaatgtgggatag

SEQ ID NO: 137103 - DNA, 423 bp, Artificial Sequence
  Description of Artificial Sequence: Synthetic coding sequence
atggatgtattcatgaagggcttgtccaaagcaaaagagggtgtggtggccgccgcggaaaaaaccaaacagggggtcgccgaggccgccggaaagaccaaggagggggtgctgtacgtaggatccaaaactaaagaaggtgtagtacacggtgtcgccaccgttgccgagaagactaaagagcaggtgactaatgtgggcggggcagtggtgaccggggtgactgccgtagcacagaaaacggtagagggcgcgggatcgattgccgccgctactggcttcgttaaaaaggaccaactcggaaagaatgaagagggagctccacaggaagggatcttggaagatatgcccgtggatcccgataacgaagcttacgagatgccctctgaggagggataccaggactatgagcccgaagcctag

SEQ ID NO: 137104 - DNA, 2760 bp, Artificial Sequence
  Description of Artificial Sequence: Synthetic coding sequence
atggaggcgcctgaatatctggacctggacgagattgacttcagcgatgacatctcatatagcgttacgtctcttaagacaatacccgagctgtgcaggcgctgcgatacgcaaaatgaggatcgaagcgtgtcctcatcttcatggaactgcgggataagtacgctgataacaaacacacagaaacccaccggtattgcagatgtgtactccaagtttagacccgttaagagggtgtctcccctgaaacatcaacccgagactttggagaacaacgagagcgacgatcaaaaaaatcaaaaggtggttgaataccagaagggtggtgaatctgacctgggaccccagccacaagaacttggacccggggacggcgtgggcggaccacccgggaaaagctcagagccaagcacctccctcggcgagttggagcactacgacctggacatggatgagatcttagatgtcccctacatcaaaagctctcagcagctggcttcgtttacgaaggttacatccgagaagcgcatcttaggcttgtgtacaaccatcaacggcttatctggtaaggcctgttctactggatcatccgagtccagctccagtaacatggccccattttgtgtgctttccccagtcaaatccccccacctcagaaaagcttcagccgtaatacatgatcagcacaagttatccacagaggagactgagatctccccccccttagttaaatgtggcagcgcttatgaacccgagaatcagagtaaagacttccttaacaaaacattttccgacccacacggccgcaaggtcgagaaaactacccctgactgtcagcttcgagcttttcatttgcagagctctgccgctgagagtaaaccagaggaacaggtgtcgggactcaaccgcactagctcccaaggcccggaggaaaggagtgagtaccttaagaaggtcaagtctatactgaacatagttaaggagggtcagataagcctgttgccccacctggcagctgacaatctggataagattcacgatgaaaacgggaataatctgcttcacatagctgcgtctcaaggacacgctgagtgcttacagcaccttacaagtctgatgggtgaagattgtttgaatgaaagaaacactgagaagctcacccctgcaggactggccattaaaaatggccagctggagtgcgtaaggtggatggtgtccgagaccgaggccatagcagaactgtcatgcagcaaagattttccgagcctgatccactacgctggctgttacggccaggagaagattctgctgtggctgctccaatttatgcaagagcaaggaatctcccttgatgaagtggatcaagacgggaacagcgctgtgcatgtggcctcacaacacggctaccttggctgtatccagaccttagtggagtacggtgccaacgtgactatgcagaatcatgccggtgaaaaacccagtcagtctgccgaacggcagggccatacactctgctcccggtatttggtcgtagtcgagacatgcatgagtttggcttcccaggtggttaaactgaccaaacagctgaaagagcagactgtagaaagggtgactctccagaatcagcttcagcagtttctcgaagcccagaaatctgagggcaagtccctaccctcatccccctcaagcccgtccagtccagcatcccgtaagagtcaatggaagtcacctgacgctgacgatgatagcgtggccaagtctaagccaggcgtccaggagggcatccaggtgttgggatctctaagtgcttccagcagagcacgccccaaggccaaggacgaagatagcgataagattctcagacagctgcttgggaaggagatcagcgagaacgtttgtacacaagaaaaactttcacttgaatttcaggacgctcaggcttccagccggaattccaagaagatccctctggagaagagggagttaaagctggcccgtcttaggcagcttatgcagaggtcactgagtgagtctgacactgattcaaataatagcgaagatcctaaaactacgcccgtgcgcaaggctgaccggcccagaccccagccaattgtggagtccgtggagtcaatggactctgcagaaagtctgcatctaatgattaagaagcacactctggcctcaggcggaaggagattcccctttagtatcaaagcttcaaaaagcctcgatggtcattcaccctcccccacatcagaaagctcagagcctgatcttgaaagtcagtaccccgggtctggttcgattcccccgaaccagccttcgggagaccctcagcagccgtctccagattcaaccgctgcccaaaaggtcgctaccagccctaagagtgcgctgaagtccccatcatcaaagaggagaacgagccagaacctgaagctacgggtgacttttgaagagccagtagtgcagatggagcagccctctcttgagctcaatggggaaaaagataaagataagggccgaaccctgcagcgaacgtctacatcaaatgagagtggggaccagctgaagagaccgtttggagctttccgctccattatggaaactctcagcggtaatcagaacaataacaacaactaccaagcggctaaccagctgaagacatctacactcccgctgacctcgctgggccgtaagactgacgccaagggcaatcctgccagttctgcctccaaggggaagaacaaggctgcctag

SEQ ID NO: 137105 - DNA, 3051 bp, Artificial Sequence
  Description of Artificial Sequence: Synthetic coding sequence
atggaagcccctgagtacctcgatctggatgagatagattttagtgacgatatctccgacaacagatcacagggaaacagattgcaaaaactaggacttgaggacaccgatagggaggacgccatggggttcgggtcacatcgcgcgaaactgaccgtggtggcagctctgggggcctgccattgtcccgagaatgagtattccgtcacttccctcaaaactatccctgaactctgtcggcggtgcgacacacagaacgaggaccgctcagtgagctcatcctcctggaactgcgggattagtaccctaatcaccaacactcaaaaacccacggggatcgcggacgtatacagcaagtttcggcctgtcaaacgtgtgtctcccctcaagcaccagccggagacattagagaataacgaaagcgacgaccaaaaaaaccagaaagtagtcgaataccagaagggaggggagagtgacttgggtcctcaaccacaagagctgggcccaggggatggcgtaggagggccccccggaaaatcatcagaaccctctaccagtctgggagaactcgagcactacgatcttgacatggacgagatcctggatgtaccttacataaaatcatctcaacagcttgcctccttcacgaaggtcaccagcgagaagaggattctcggcctgtgcactaccattaacggactgtctggcaaggcttgttccacaggctccagtgagtcttcctcctccaacatggcccctttctgtgttctgtcccccgtaaaaagtccacacttgcggaaggccagcgctgtgatccacgaccagcataagctgtctacagaggaaacagaaatctcacccccccttgtcaagtgcggttctgcctatgaacctgaaaatcagtctaaagactttctaaacaaaacattttcggatccccacggtaggaaagtcgaaaagacaacacctgactgtcaactgcgggctttccatttgcaatcctctgctgccgagagcaagcccgaagagcaagtgtcgggactcaatcggacatcttctcagggacccgaagagcggtctgagtatctcaagaaagttaaatctatccttaatatcgtgaaggaggggcagatctccctgctgccacacctcgctgctgacaatctagacaagatccatgatgagaacggtaacaatttgttgcatatcgctgctagccagggccacgccgagtgcctacagcacctcacttccttgatgggcgaggactgtctgaacgaacgcaatacagaaaaactaacgcctgcaggcctcgccatcaagaacggtcaactcgagtgcgtcagatggatggtcagcgagaccgaggccatcgccgaactgagctgtagcaaagacttcccttccttgattcactacgccggatgttatggccaggagaaaatccttctctggttgttacagtttatgcaggaacaggggatctctcttgatgaagtggaccaagacggaaattctgctgtgcatgtggccagtcagcacgggtatctgggatgcattcagactctcgtggaatacggagcaaacgttactatgcagaatcacgccggcgagaagcctagccagagcgccgagcgtcaagggcatacactatgcagccgctatttggtggttgtggagacttgcatgagcctagcgtcacaggtagtcaagcttacaaagcagctcaaggaacagacagtggagcgggtgacgttgcagaatcagttgcagcagttcttggaggcccagaagagtgagggaaaatccctgccaagctctccgagttctccaagcagcccagcttcacgtaaaagccagtggaaaagcccagacgcagacgacgatagcgtagccaagtccaaaccaggagttcaagagggtattcaggtcttaggcagtctcagcgcaagcagtagggcaagacccaaagctaaggatgaggactcagataagatactaaggcagctgttggggaaagagattagcgagaatgtatgtacccaggagaagttaagtctggagtttcaggatgctcaggctagcagtagaaatagtaaaaagatccctctcgagaaacgcgagctaaaattagccaggttacggcagctaatgcagagatctctgagcgagtcagacactgattcgaacaattccgaggaccctaagaccacacctgtgagaaaggctgatcgaccgagaccccagcccattgtggaatccgtggagtcaatggacagtgccgaaagccttcatctgatgattaagaaacatacacttgcctccggtggcaggaggtttcctttttctatcaaagcaagcaagtctttagacggccactcccctagccctacaagcgagagctcggaacctgacttagagagccagtatccagggagtggaagtatccccccaaaccagccctctggggatccccaacagccatcccccgactccaccgccgcacagaaggtggcaacatcccccaaatccgctctgaaatctcccagttcaaaacggaggaccagtcagaacttgaagctgcgcgtcacattcgaagagccagtggtccagatggagcagcccagtcttgaactaaatggcgaaaaagacaaggacaagggtagaaccttgcagcgcacatccacatcaaatgaatcaggggaccaactgaaaaggcctttcggcgcttttcggtccattatggaaactctctcaggcaatcaaaataacaataataattaccaggccgctaaccagttaaagactagtaccctgcctctgacctctttggggcgaaagacagatgccaaaggcaacccagccagctctgcatccaaaggaaagaacaaagcggagatgtactcctcgtgcatcaacctgtcaagcaatatgcttatcgaggagcacctgtgtaacgatacccgtcataatgacattaatcggaagatgaaaaagagctattccatcaaacatatcgccgagccagagtctaaagagctgttcctgtag

SEQ ID NO: 137106 - DNA, 2580 bp, Artificial Sequence
  Description of Artificial Sequence: Synthetic coding sequence
atggaggcacccgagtatctcgacctggatgagatcgatttttcagacgacatttcatatagcgtgacttccctgaagactattccagagctgtgccgtcggtgcgatactcagaatgaggacagatccgtcagttccagtagttggaattgcgggatctcaactctgattaccaacacacaaaagcccactgggatcgcggacgtctatagtaagtttagacccgtcaaacgcgtgtcacccctgaagcatcagccagagaccctcgagaacaacgaatcagatgatcagaagaaccagaaggtcgtggaataccaaaagggcggggaatcagaccttgggcctcagccgcaagagcttgggccaggcgacggtgtgggagggcctcccggtaagtcctcagagccatcaacttctctgggggagttggagcactacgacctcgacatggatgaaatcttggacgtcccatacatcaaatcatcccagcagttggctagttttaccaaagtgacaagtgagaaacgtatactcggactctgtacaacaattaacggcctgagcggtaaggcctgttctactggtagcagtgaatcctccagctctaatatggcccccttttgcgttctatcgccggtgaagagcccacatcttcgaaaagcctcagcagtcatccatgatcagcacaagttatctaccgaagagaccgagattagtcccccattggtgaagtgtggttctgcctacgagcccgaaaaccagtccaaggatttcttgaataaaaccttctctgatccgcatggtagaaaagtcgaaaagaccacacccgactgtcagcttagagcctttcatttgcagtccagtgccgccgagagcaaacctgaggagcaggtgtcaggtctgaacaggacttccagccagggacctgaggaaagaagtgagtatctcaagaaagtcaagagtattctcaatattgtcaaagagggacaaatttctctcctgaatggccaactggaatgcgtccggtggatggtgtcagagacagaagctattgccgagctttcttgttctaaagatttcccaagcctcattcattacgccggatgctacggacaggagaagatcctgctttggctgctgcagtttatgcaggagcagggcataagccttgacgaggtggatcaggacggaaatagtgctgttcacgtggctagccagcatggctacttggggtgcatccagactctcgtcgaatacggagccaatgtaaccatgcagaaccatgccggcgagaaaccttcgcagagtgctgagagacaaggccatactctctgtagtcgttatctcgtagtagtggaaacgtgcatgagtctggccagccaggtggttaaactgaccaaacaactaaaagaacaaacagtcgagcgggtcacactgcagaaccagcttcagcagttccttgaggcgcagaagagtgaagggaaatccctcccatcttccccctcaagtcccagttcgcccgcctctagaaaatcccagtggaagtcgcctgacgccgatgacgattcggtcgccaagtctaagcctggggtgcaagaggggatacaggttctggggagccttagcgcttcatctcgggcgcggccaaaggcaaaagatgaagatagtgacaagatcctgcgtcagctcctcggtaaagaaattagcgagaacgtgtgtacccaggagaaactgagcttggagtttcaagacgcccaggcaagctcacgaaatagcaagaagattccactggagaaacgcgaactgaaactggcccgcttaagacagctgatgcagcgtagtctgagcgaaagtgatacagacagcaacaactcagaggatcccaagacaacccccgtgagaaaagctgaccggcccaggcctcaacccattgtggaaagcgttgagagtatggacagcgccgagagcttacatctcatgattaaaaagcatacccttgcctctggaggcagaaggttcccattcagcattaaggccagcaaatcgctggacggacactcccccagcccgacttcagagagtagcgaaccggaccttgagagccagtaccctggatcaggaagcatccctcctaaccagcctagcggggatccccaacagccttctccagactccacagccgctcaaaaagttgctacaagccctaaatccgccctcaagtcgccgagctccaaaaggagaaccagccagaacctgaagctgcgagtaacgtttgaagagcccgtggtgcagatggaacagcctagtttagagttgaacggagagaaagacaaggacaaaggaaggacattgcagagaacaagcaccagcaatgagtcaggggaccagctgaagcgaccgttcggggcttttcgctcaatcatggaaaccctctccgggaatcagaacaacaacaacaactaccaggcagcaaatcaactcaaaacatcaacactgcccctcacaagtttgggcaggaaaacggacgccaaaggtaatccagcttccagcgcctctaaaggcaaaaataaggctgcctag

SEQ ID NO: 137107 - DNA, 1812 bp, Artificial Sequence
  Description of Artificial Sequence: Synthetic coding sequence
atgacatatctcatccagtcccatcacagccgcaggtcacagaattgcgccgaggatgttattaggaagaccaaaacagaccaaaatggtcaactggaatgtgttaggtggatggtctcggagacggaggccatcgcagagctcagctgcagcaaagattttcccagcctcatccattatgcgggttgctacggacaggagaagattctgctgtggcttctccagttcatgcaagaacaaggcatctcactcgacgaggtggatcaggatggaaactccgccgtgcatgtggcctctcaacacggctatctcggatgcattcagactctagttgagtatggcgctaatgtgacaatgcagaaccacgccggcgagaagccctcccagagtgcagaaaggcagggccacacactctgcagccgctacctggtggtggtggagacatgcatgtccctggcgagccaggtagtgaagttgacgaagcagctaaaagagcagactgtagaacgggttaccttgcagaatcagctgcaacagttcctggaggcccagaaaagtgaagggaagtccctcccgagcagtccgagttctccgagtagccctgcgagtcggaaatcccagtggaagtcccctgatgcagatgatgatagcgtcgccaaatcaaagcctggggtacaggaaggaattcaggttctaggctcactgtcagcatccagtagggctcggcccaaggctaaagatgaggacagcgataagattttacgccaactcctgggaaaagagatcagtgaaaatgtgtgtacccaagaaaaactatccctggaattccaggacgcgcaggcctccagtcgcaactccaaaaaaatcccactcgaaaagcgtgagctcaaactggctcgtttgaggcaactcatgcaacgatctctgtccgagtctgacaccgatagtaacaacagtgaagatccgaaaactacccctgtccgaaaggctgataggcctagaccccaacctattgtggagagtgttgaaagcatggatagcgccgagagtctgcatttgatgattaagaagcacaccttggctagcggggggcgacggtttccattttccatcaaggcttcaaagtctctcgacggccattccccctcccctaccagcgagtcgtccgagcctgatctggaaagccaataccccggcagcggcagcatccctcctaaccagccctcaggggatcctcagcagccttctcctgactcaaccgccgctcagaaggtggctacatcaccaaagtcagccttaaagtccccaagctccaaacgccggacctcgcagaacctgaagcttagagttacattcgaggagcccgtggtccagatggaacagcctagcctggaactcaatggagaaaaggataaggacaaagggcgcaccctacagaggactagcacttcaaacgaaagcggagaccagctgaaacgcccttttggagctttccgctcaatcatggagaccctgagtggtaatcaaaacaacaacaacaattatcaagccgctaatcagctgaagacgtccaccctaccgttaaccagcctgggccgcaagaccgatgcgaagggaaatccagcaagttcagctagtaagggcaagaacaaagctgagatgtatagctcttgtatcaatttaagttcaaatatgctcatagaggaacacctgtgtaacgatacacggcacaatgacatcaataggaaaatgaagaaaagctatagcatcaagcatattgcagaacccgaaagcaaggaactgttcctgtag

SEQ ID NO: 137108 - DNA, 1566 bp, Artificial Sequence
  Description of Artificial Sequence: Synthetic coding sequence
atgaagctcaccctcgtcatgacgtaccttattcaaagtcaccatagcaggaggtctcagaactgtgcagaagatgtgatccggaaaactaagacggaccaggaaaagattctcctgtggctcttgcagtttatgcaggaacagggaattagcctggacgaagtcgatcaggatggcaacagcgcggtacatgtggcttcgcaacacgggtacctcggctgtattcagactctcgtggagtacggggccaacgtaactatgcagaaccacgctggagaaaaaccttcccagtcagccgaacggcagggccacaccctatgttcccgctatttggtagtcgtggaaacgtgcatgtctctggctagccaggtcgtgaaactcacaaaacagctgaaagagcaaactgtggaaagggtaacactccagaatcaactgcagcaatttctagaggcacagaagtcagaagggaagtcactcccctcatctccctccagtccatcctcacctgcttccaggaagagccaatggaaatcccccgatgcggacgatgacagcgtcgcaaaatcaaagccaggggttcaggaagggattcaggtgcttgggtccctatctgcttcaagccgggccaggcctaaggctaaggacgaggattccgacaaaattcttcgacaactgctcgggaaggagatatccgaaaacgtgtgcacccaggagaaactcagcctggagttccaagacgcccaggcaagcagccggaatagtaagaagatcccattagagaaaagagagcttaagctggcccgactcagacagcttatgcagagaagcctttcggaaagcgacaccgactcgaacaactcagaggatccaaaaacgactccagtacgcaaggctgaccgcccgcggccgcagcccattgtcgagtcagtcgaaagtatggacagtgctgagtccctccatcttatgataaagaaacatactttagcctctggcggccgccggtttcctttttccatcaaggcatctaaatcattggatggccatagtccttctcccacctctgagagctccgaacctgatctggaaagtcagtaccccggctcaggatctatcccacccaatcaacctagcggcgatccacagcaaccctcgccagacagtacagccgctcagaaagtggcaactagtccaaagtccgccttaaagagcccaagctcgaaacggaggacctctcagaacctaaagctgagggttacatttgaggagcccgtggtgcagatggaacagcctagcctggaattaaatggggaaaaggataaagataaaggccggacactgcaacgcacctctacatcaaatgaatctggagatcagttgaagcgcccattcggggccttcagaagtattatggaaacattgtctgggaaccagaacaataataataactaccaggccgcaaatcagctgaagacatctaccctgcctctcacctccctcggaaggaagaccgacgccaaagggaatcccgcctcatccgccagtaagggcaaaaataaggcagcatag

SEQ ID NO: 137109 - DNA, 1146 bp, Artificial Sequence
  Description of Artificial Sequence: Synthetic coding sequence
atgaagcttaccctcgttatgacatatttgattcagtcccaccatagccgtcgcagccagaactgtgcagaagacgttattcgcaaaaccaagactgatcagaatggacaactcgagtgcgtcaggtggatggtctccgagaccgaggctattgcagagttgtcatgtagcaaggacttccctagtctgattcactatgcggggtgctatggtcaagagaaaatacttctatggcttttacagttcatgcaggagcagggaatttcgctagatgaggtcgatcaggacggcaacagtgcagtgcacgtggctagccaacatggatatctgggctgtatccagacactagttgaatacggtgcaaacgtgaccatgcagaaccatgcgggagagaaaccttcccagagcgctgaacgccagggacacacgctctgttcacgttacttagtggtcgtcgagacctgtatgagcctggcatctcaggtggtgaaattgactaagcaattgaaggaacaaactgtggaaagagtcaccctgcagaaccagctacagcagtttctcgaagcccagaagtccgaggggaagtctctcccttcttccccaagttctccttcgtctcctgcctcacggaagtcccagtggaagtccccggatgctgacgatgactctgtagccaagagtaaacctggagtccaagaaggcattcaggttctgggcagcctaagcgcaagctcgagggcccgacccaaggccaaagatgaagattccgataagattctccgccagcttttgggtaaggaaatttccgaaaatgtctgtacacaggaaaaactgtccctggaatttcaggacgcccaggcaagcagccgcaattctaagaaaataccgcttgaaaaacgagagctgaagctggcgagacttcgacaattgatgcagcggtctctttccgagagtgacacggacagtaataacagcgaggatcccaaaaccacccccgtccgcaaagccgatcgaccaagacctcagccaattgtggagtcagtggagagcatggattctgccggcttcctgtccgcctcaagaccacctaacccttggatggcaacggcacatctcccaccacagagggctgcaaaccagacatag

SEQ ID NO: 137110 - DNA, 1767 bp, Artificial Sequence
  Description of Artificial Sequence: Synthetic coding sequence
atggaagctcccgagtacctggatcttgatgagatcgatttctcagacgatatcagcgacaacaggagccaggggaatagattgcaaaaactgggtctggaggacaccgatagagaagatgcaatgggatttggatctcaccgggcaaaattgactgtcgtagccgcgctgggcgcctgccactgtcctgaaaacgagtacagtgtaactagcctgaagactatacctgagctctgccgcagatgcgatacacagaacgaggatcggtcagtctcgagctcgagctggaactgcggcatctcaactttaataacgaatacccaaaagcccaccggaatcgcagatgtatatagcaaattcaggccagtgaaacgagtctcccctctcaagcaccagccagaaactcttgagaacaatgaatcggatgaccagaagaaccagaaagtggtagaataccagaaaggtggggagtctgatcttggtccacaaccgcaagagttgggtcctggtgacggtgtcggagggcccccgggtaagagctctgaacctagtaccagcctgggagaacttgagcactacgatttagacatggatgaaatccttgacgtcccctacatcaagtcgagccagcaacttgcaagcttcacaaaagtgacgagcgagaagaggatcctgggcctatgtacaacgatcaacggcctgagtgggaaggcttgcagcacagggtcctcagaaagctcttcaagcaacatggctccattttgcgtcctgagccccgtcaagtccccacatctgagaaaagcatccgctgtcatccacgatcagcataagctctctaccgaagaaactgaaatctcaccgccactcgtaaagtgcgggagcgcttacgagcctgagaaccagagtaaagacttccttaacaaaacctttagtgatccccacggacgcaaggtggaaaaaactacaccagattgtcagctgagagccttccacctccagtcttccgctgccgaatccaaacccgaggaacaagtatccgggctgaatcgcacgtcatcacagggacctgaagagcgttccgagtatctgaaaaaggtcaaaagcattcttaatatagttaaggagggacagatatcactcctccctcacttggcagccgacaacctcgataaaatccacgacgagaacgggaacaatcttttgcacatcgcggcgtcccagggacacgcagagtgtctacagcacttgaccagcttgatgggcgaggattgccttaacgaaagaaacactgagaaactgactcccgccggcctcgctataaaaaacggacagctggaatgcgtgcgctggatggtgtctgaaactgaagccatagcagagctgagctgttcaaaagactttcctagtctcattcactatgccggctgctacgggcaggaaaaaatcctgttatggttgctgcagtttatgcaagagcagggcatctcactggatgaagtggaccaggatggcaactctgcagtccatgttgcttcgcagcatgggtacctgggctgcatacagaccagacttaagatccaggggacgtggaatggaagtgaaacatgcctctttacacaccatttttcttcttaccctccaatctccagcgggttgcagtgtcagggacaagagggcgttctcttcattccagaccaagtgggcgctgcaaccaataaacaggtcttgttccagaaccagttgcccgagactaaatcttcctattag

SEQ ID NO: 137111 - DNA, 267 bp, Artificial Sequence
  Description of Artificial Sequence: Synthetic coding sequence
atggaagcccctgagtacttggacctggacgaaattgactttagtgacgacatctcatacagtgtcactagcctcaagaccatccccgagctgtgtaggcgatgtgatacccaaaacgaggaccgctcagccactccttcgtgccggcaaagccgtcagaactctaggcgtaaatggaaacagagcattacctactgcggcgtgacgggaacccgccgtgtgtccacagccccgcacttcttcgatggacgccgcctcccccagtag

SEQ ID NO: 137112 - DNA, 297 bp, Artificial Sequence
  Description of Artificial Sequence: Synthetic coding sequence
atggaggctcccgagtacttggatctcgacgaaatcgatttttccgatgatattagctattctgtgacctccctcaaaactatccccgaactgtgcagaagatgcgatacacagaacgaagacagatcagtcagttctagcagttggaactgcggcatttctacgctgataacaaatactcagaaaccaactggtatcgccgacgtctacagtaagtttcgaccagtcaaaagagtgagtcccctgaagcaccagccggaaacactggagaacaatgagagtgatgaccaaaaatag

SEQ ID NO: 137113 - DNA, 45 bp, Artificial Sequence
  Description of Artificial Sequence: Synthetic coding sequence
atggaagctcccgaatacttggaccttgatgaaatcgatttttag

SEQ ID NO: 137114 - DNA, 408 bp, Artificial Sequence
  Description of Artificial Sequence: Synthetic coding sequence
atggaggctcctgaatatctcgatctcgatgagatcgatttctccgacgatatttcttatagcgtgacgtcccttaaaactattccagagctgtgccggcggtgtgatacccaaaatgaagacagaagcgtgagcagttcatcatggaattgcggtattagcacactcatcactaatacacagaaacctactgggattgcagatgtttatagcaagttcagacccgtcaagcgcgttagtcctctgaagcatcagccagagacgctcgaaaacaacgaaagtgatgatcaaaaaaatcagaaagtcgtggagtaccagaaaggaggcgagagtgacttgggtccccagccacaggagctgggccctggcgacggggtaggcggccctcctggtaaatcgtccgagtag

SEQ ID NO: 137115 - DNA, 1434 bp, Artificial Sequence
  Description of Artificial Sequence: Synthetic coding sequence
atgcaggaacagggcatcagtctagacgaggtggatcaggacgggaacagcgcagtgcacgtcgcaagccagcatggatacctgggctgcatccaaaccctggtggagtacggggccaatgtgactatgcagaaccacgccggcgaaaagccctcacagagtgctgaacgccagggccatactctgtgttctcgttatctcgtggttgtggagacctgcatgagtctagcgagtcaggtggtcaaactgacaaaacagctgaaagaacagacagtcgaaagagttaccctccaaaatcagcttcagcaatttctagaagcgcagaaaagcgagggtaaatctctgccgagcagccccagcagccccagcagtccagctagtcgcaaatcccagtggaagtcgcccgatgcagacgacgactccgtggccaagtctaaacctggagttcaggaaggaatccaggttttaggatcactcagcgccagttctagagcccgccccaaggccaaagacgaggactcagataagattctgcggcagcttctgggtaaggaaatcagcgagaacgtgtgcactcaggaaaagttgtccctggagttccaggatgcgcaagcttcttccagaaactctaaaaaaatcccgctagaaaaacgggagttgaaactggccaggttaaggcagttgatgcagaggagtctttctgagagtgacaccgactcaaacaattccgaggatccaaaaacaactccggttcggaaggcagatcgtccaaggcctcaacctattgtggaatctgtggaatcaatggacagtgcagaatcattacacctcatgatcaagaaacacacccttgcttcggggggccgacggttcccattttctatcaaggcaagcaaatccctggacggccactccccaagcccaactagcgagagttccgaacccgacctggaatcacagtaccctggcagcggcagcattcctcccaaccagccctccggggaccctcagcagccaagtccagattccactgccgcacagaaagtggcaaccagtcctaagtcagcactgaagagcccaagctcaaagagacgaacttcacagaatctcaagcttcgagtcacatttgaggaacccgtagtgcagatggagcaacctagcctggagctgaacggcgagaaggataaggataagggaagaaccttacaaaggactagcacaagtaacgaatctggcgaccaattgaagagacccttcggtgcctttcgatccataatggagacgctttctggcaatcagaataataataataattaccaggctgcaaaccagctgaagaccagtaccctgccattgacatccttgggcaggaaaaccgacgcaaagggcaatcccgcatcctctgcctccaaaggcaagaataaggcagcatag

SEQ ID NO: 137116 - DNA, 405 bp, Artificial Sequence
  Description of Artificial Sequence: Synthetic coding sequence
atggatgtgtttatgaagggactatctatggcaaaggaaggtgtggtggccgcagcagaaaagaccaaacaaggggtcacggaagccgcagagaaaacgaaggagggtgtactttatgtgggctctaagactagagagggggttgtccagggcgtggccagcgtagccgaaaagacgaaggaacaagctagccaccttggtggcgccgtcttcagtggagctggaaatattgctgctgccacggggctggtgaagcgtgaggagtttccgacggatctgaagcctgaggaggtcgcgcaagaagcagctgaagaaccactgattgaacctctcatggagcctgaaggtgagagctacgaggaccccccacaggaagagtaccaggaatacgagcctgaagcttag

SEQ ID NO: 137117 - DNA, 405 bp, Artificial Sequence
  Description of Artificial Sequence: Synthetic coding sequence
atggatgttttcatgaaggggctatccatggccaaggaaggtgtggtcgctgccgctgagaaaacaaagcaaggcgtgactgaggcagccgaaaagaccaaagagggggtgttatatgtgggctcaaagacaagagaaggagttgtgcagggagtggccagcgttgctgaaaaaaccaaagaacaagcctcccacctaggcggtgccgtatttagtggggcaggaaacatcgccgccgcaaccggtcttgtgaaacgtgaagagtttccaacagatcttaagccggaggaagttgcccaggaagcagcggaggagccccttatcgaacctcttatggagccagagggcgaatcctatgaggacccaccacaggaagaatatcaggagtacgaaccagaggcctag

SEQ ID NO: 137118 - DNA, 405 bp, Artificial Sequence
  Description of Artificial Sequence: Synthetic coding sequence
atggatgtgtttatgaagggcctaagtatggccaaagagggcgtggttgctgccgccgaaaaaacgaaacagggcgtgacagaagctgcagagaagactaaggagggggtgctctatgtcggatcgaaaacacgcgagggagtggttcagggggtggctagcgtcgctgaaaaaacaaaggaacaggccagtcacctgggcggagctgttttttcaggtgccggcaatattgctgcagccacaggcctggtgaaacgggaggaatttccaactgacctgaaacccgaggaggtggcccaagaagccgctgaagagcccttgatcgagccactaatggagcctgagggcgagagctatgaggatcctccgcaggaagagtatcaggaatacgagccagaggcgtag

SEQ ID NO: 137119 - DNA, 405 bp, Artificial Sequence
  Description of Artificial Sequence: Synthetic coding sequence
atggacgtttttatgaagggcctgtccatggccaaggagggcgtagtcgccgcggcagagaaaactaagcagggggtcacggaagcggccgaaaagactaaagagggcgtcctctatgttgggtctaaaacaagggaaggggtagtgcagggcgtggcaagtgtagcagagaagaccaaggaacaggcttctcacctcggaggggctgttttctcaggggccgggaacattgccgccgccactgggctggtcaaaagggaggaattccccaccgatcttaagcccgaagaagttgcgcaggaagccgctgaagagccccttattgagccacttatggagcccgagggagaaagctacgaagacccaccacaagaagagtaccaggagtacgagcccgaagcctag

SEQ ID NO: 137120 - DNA, 381 bp, Artificial Sequence
  Description of Artificial Sequence: Synthetic coding sequence
atggatgtcttcaagaagggattcagcatagcaaaagaaggggtggtgggcgcagtggaaaagacaaaacagggggtaaccgaggccgccgagaaaacgaaagaaggggtgatgtacgtgggagcaaaaaccaaggagaatgtggttcaatctgtcacatctggcttaccctggggctggggctgggggggagggcagcctgtctcttctcattccggacgggaggatcagggagctgggcagcggcgtgaacggggctgtggagagcagagacagcactgcggtcaccaagacagagggggaggcggagagcataggggccacctgcgcggcggggcgcagggaggcttggaagctatttgtcctcccacggggggctag

SEQ ID NO: 137121 - DNA, 384 bp, Artificial Sequence
  Description of Artificial Sequence: Synthetic coding sequence
atggatgtttttaagaaaggattcagtattgcaaaagagggcgtcgtaggcgccgtggaaaagaccaagcagggggtgacggaagcagccgagaaaacaaaagagggggtgatgtacgtgggtgccaagactaaggagaacgtggtccagagtgtgacatcagtagccgaaaaaacgaaagagcaggcgaatgccgtcagtgaagcggtggtttcgtccgtgaacaccgtagccacgaagacagtagaggaggccgagaatattgcggtgacatcaggcgtagttagaaaagaggacctacgaccaagcgcaccccagcaagagggcgaagccagcaaagagaaggaagaggtggcggaggaggctcaatctggaggagactag

SEQ ID NO: 137122 - DNA, 471 bp, Artificial Sequence
  Description of Artificial Sequence: Synthetic coding sequence
atggcgggacaatttaggtcctacgtctgggacccactgctgatcctgtcccagatagtgttgatgcagacggtctactatggctcactggggctctggctggctctcgttgacggactcgtgcgttctagcccctccctggaccagatgttcgatgctgaaattttgggcttctcaacgccacctggacgattatcaatgatgagtttcatactcaatgcacttacatgtgctcttggtctgttgtacttcatccgaagaggtaagcagtgcttagacttcaccgtgactgttcatttctttcatctattgggatgttggttctactcatctcggtttcctagcgccctcacctggtggctcgtgcaggctgtatgtatcgctctaatggccgtgataggcgaatatctgtgtatgagaacagagctgaaggagatccccctcaattccgctcccaaaagcaatgtctag

SEQ ID NO: 137123 - DNA, 471 bp, Artificial Sequence
  Description of Artificial Sequence: Synthetic coding sequence
atggcgggtcaattccggagctacgtgtgggatcccttgctgatcctttcccagattgtgctgatgcagaccgtgtattacgggtcattgggtttgtggctggccctggttgacggcctggtgagatctagcccttctctcgaccagatgtttgatgccgagattctaggcttctcaacgccaccaggtaggctgagcatgatgtccttcatacttaatgccctgacgtgtgcactgggcctgctatactttataagacgcggaaaacagtgcttagatttcaccgtgacagtacactttttccatctactgggatgctggttttatagtagtcgcttcccctctgcgttaacatggtggcttgtccaagctgtatgtattgcactaatggccgtgatcggagaatatctgtgcatgcgcaccgaattgaaggagatcccattaaacagcgcccccaagagcaatgtgtag

SEQ ID NO: 137124 - DNA, 357 bp, Artificial Sequence
  Description of Artificial Sequence: Synthetic coding sequence
atggctggccagtttaggagctacgtgtgggatccgctcctaatcctgtcccagatagtgttgatgcagacggtctattacggcagcctgggcctgtggttagcacttgtcgatggtctggtcaggagctcgcccagcctggaccagatgtttgacgccgaaatcctaggctttagcactccacccggtcggctctcaatgatgtcctttattctcaacgccctgacctgtgctctgggcctgctgtattttatccggcggggcaaacagtgcctggacttcactgtgactgtgcactttttccacctgctgggctgttggttctactcctctagattcccttctgccttgacctag

SEQ ID NO: 137125 - DNA, 231 bp, Artificial Sequence
  Description of Artificial Sequence: Synthetic coding sequence
atggccggacagtttcgctcttacgtgtgggaccccttgctgattttaagccagattgtgctgatgcaaaccgtgtactacgggtcactaggtttgtggcttgctctggtagacgggttagttaggtcgtctccctcactggaccagatgttcgacgctgagatccttgggttcagtacgccacccgggaggctatcaatgatgtcttttatcttgaacgctctgacctag

SEQ ID NO: 137126 - DNA, 1134 bp, Artificial Sequence
  Description of Artificial Sequence: Synthetic coding sequence
atgagcagccccggaaccgaatccgccggaaaaagcctgcagtatagagtcgaccaccttctctccgccgtggaaaacgagctgcaggccggatctgagaagggcgaccctaccgaacgcgaactgcgcgtcggcttggaagagagcgaattgtggttgaggtttaaggaacttacgaatgaaatgattgtaacaaagaacggccggcgcatgtttcccgtcctcaaggtaaatgtgtcaggattggacccgaatgccatgtattccttcctgttggactttgtcgctgccgataaccatcgttggaaatacgtcaacggcgagtgggttcctggagggaagccagagccccaggctccatcttgtgtttacattcacccagattccccaaacttcggcgcacactggatgaaggcacccgtcagctttagcaaggtcaagctgaccaacaaactgaacgggggaggacagatcatgttaaacagcttacataagtatgagccgaggattcatatcgttcgagtcggaggcccccagcgaatgatcacatctcattgcttcccagaaacccagttcatcgccgtcacagcttaccagaatgaagaaataaccgctctgaagataaaatacaatcccttcgcgaaagccttcttggacgccaaggaacggtccgaccacaaggagatgatggaagagcctggagattcacaacaacccggatattctcagtcttactctgataatagcccggcttgtctgtctatgttacaaagccacgacaactggtcttctctcggtatgcctgctcacccatccatgctgccagtcagtcacaacgctagcccccctacctcgtccagtcaatacccttctctgtggtccgtttccaatggagccgtgacacccggctcacaagccgccgccgtgagcaacgggctgggagcacagtttttcagaggtagtcctgcgcactacacaccgctaacgcatccagtatctgccccctccagttctggttcgcccctgtatgaaggggcagcggcagcaaccgacatcgtcgactctcaatatgacgccgcagcccagggtaggctgattgcatcttggactcctgtcagccccccatccatgtag

SEQ ID NO: 137127 - DNA, 735 bp, Artificial Sequence
  Description of Artificial Sequence: Synthetic coding sequence
atgagatggtgcctgctcttgatctgggcacagggattaaggcaagcccctctagccagcggcatgatgactggtaccattgagactaccggcaacatcagtgccgaaaagggcggctccataatcctgcaatgccatctgagtagcaccaccgcccaggtgacccaggtgaattgggagcagcaagatcagttgttggccatatgtaatgctgacctcggctggcacatttccccttcttttaaggaccgggttgccccgggccctgggctgggtctgacgctgcagagcctaacagtcaatgatacgggtgagtatttctgtatctaccacacatatccagatggcacatacacaggtaggatcttcttagaggttttggagagcagtgtggccgagcatggtgcccgtttccaaatcccactgctgggagccatggccgccaccctggtggtcatctgcacagccgtgatcgtcgttgtagccctaacaaggaagaaaaaagcattgcggattcattctgtggaaggagacctgcgtcgaaaaagcgccgggcaggaagaatggtccccctccgccccctccccaccagggtcatgcgtacaggcagaggccgctccagcaggactgtgcggcgagcagcgaggggaggactgcgccgaacttcacgactactttaacgttcttagttatcgcagcctgggcaactgcagtttttttactgagacaggttag

SEQ ID NO: 137128 - DNA, 936 bp, Artificial Sequence
  Description of Artificial Sequence: Synthetic coding sequence
atggctttcctagtcgctcatccaatgcagtttgtgtacctattgaccacgctgtgtgtctttaatatggtgtttgccaaattaggcttttccgagactgtattttctcagagactgtccttcaccgtgctgagcgcagtgggctacttccagtggcagaagcgcccgcacctcctccctgtagggccactcggtaggtctatgcgctggtgcctgctgctgatttgggcccaaggcctgcggcaagctcctttggcctctggcatgatgacaggcactattgaaaccaccggcaatatcagtgcagagaagggtggttcaatcatcctgcagtgccatctgtcctccactacggcccaggtaactcaagtgaactgggagcaacaggatcagcttctggccatttgcaacgctgatttgggatggcatatctctccaagcttcaaagacagagttgccccaggccccggactggggttaacgttacagtcattgacagtgaatgacacaggagagtacttctgtatataccacacgtatcctgacggcacgtacactggacgaatctttttggaagttctcgagtcatcagttgcagagcacggggccaggttccagatcccactgctgggcgctatggcagctacgttggtagttatctgcacagctgttattgtagtcgtggcattaacaagaaagaagaaagccttgagaatccattctgtggaaggggatctgaggagaaaaagtgccggccaagaagagtggagcccgtctgccccgagtccaccaggctcctgcgtgcaagccgaagcagcacccgctggactttgtggcgaacagagaggcgaggattgcgcggagttgcatgactacttcaacgtgctttcttatcgcagcctgggtaattgctcattcttcaccgagactgggtag

SEQ ID NO: 137129 - DNA, 735 bp, Artificial Sequence
  Description of Artificial Sequence: Synthetic coding sequence
atgcgctggtgtctcctgcttatttgggctcaaggactcaggcaggctccactggcctccgggatgatgactggtactattgaaaccactggcaatatctccgccgaaaaaggtggaagcataattttgcagtgccacctgagtagtacgacagcccaggttacccaagtgaattgggaacagcaggaccagctgctagcgatatgtaatgctgatctcggctggcatattagcccctcattcaaggaccgggtggcgcccggccccgggctagggttgaccctgcagtctctcactgtcaatgatacgggtgaatatttttgcatataccacacctacccagatggaacatatactggacgtatttttctggaggtgcttgaatcttccgtggctgagcacggggctagattccagatcccgcttctgggcgctatggctgccacccttgtggtgatttgcacagctgtgattgtggttgtcgcgttaacacggaaaaaaaaggccctacggatccactcagtggagggcgatctgcggcggaagtctgcggggcaggaggagtggtcacctagcgctcctagcccccccggcagttgcgtccaagccgaggccgccccagcaggtctatgtggcgagcagcggggcgaagattgtgcggaacttcacgactactttaatgttctcagttatagaagcctgggaaactgtagcttctttaccgaaacagggtag

SEQ ID NO: 137130 - DNA, 561 bp, Artificial Sequence
  Description of Artificial Sequence: Synthetic coding sequence
atgagcggcataagtggctgtccctttttcctttggggccttctcgcgctgctggggctggcactggttatttcattgatatttaacatctcccactacgtggagaagcagcgccaggacaaaatgtacagctactcttccgatcacacgagggttgacgaatactacatcgaggacactcctatttacggcaatttggacgacatgatctccgaaccaatggatgagaactgttacgaacagatgaaagcaaggcctgagaagtcggttaacaaaatgcaggaggcaaccccgagcgctcaggcaaccaacgagacacagatgtgctacgcttccctcgaccacagcgtaaaaggtaagcgaaggaaacctagaaagcagaacactcatttttcagacaaggatggcgacgaacagctgcatgccatcgacgcctcggttagcaagactacactggttgactccttcagtccagaaagccaggcagtcgaagagaacatccatgatgaccccatccgtttgttcggcttgattcgagccaaacgggagccaattaactag

SEQ ID NO: 137131 - DNA, 1308 bp, Artificial Sequence
  Description of Artificial Sequence: Synthetic coding sequence
atgtcgagccctggcactgagagtgccggaaagagcctgcaatacagggtagaccatctgctttctgcggtcgaaaacgaactacaggctggtagcgagaaaggcgatcccactgaacgcgagttacgcgtgggtttagaagagtcagagttgtggctgcgctttaaagagctgactaacgaaatgattgttactaagaatgggcggcggatgttccccgtgctgaaggtgaatgtttctgggctcgaccccaacgctatgtatagctttctcttggacttcgttgcagcagacaaccaccgctggaaatacgtaaacggggaatgggtccccgggggcaaacctgaacctcaggccccatcatgcgtctacattcatcctgacagccccaactttggagctcactggatgaaggcgcctgtgagcttcagtaaagtgaagctgaccaacaaactgaatggtgggggccaaattatgcttaattccttgcataaatacgagcctagaatccacattgtccgtgttggagggccccaacgaatgattacttcccactgttttccagagactcagtttatcgccgtgacagcatatcaaaacgaagagatcaccgccttgaagataaaatataacccttttgccaaggcatttctcgatgcgaaggagagatcggaccacaaggagatgatggaggaacctggagactcacagcaaccgggctactcccagtggggctggctcttgccaggtaccagcacgctgtgtcctccggccaaccctcacccccagttcggaggagccctttccctcccctcaacacattcatgcgataggtatccaacacttcgatcgcaccggtctagtccttatccgtcgccatacgcccaccgaaacaatagcccaacctatagcgacaacagccccgcctgtctctctatgctccagtcacacgataactggagcagtctgggtatgccagcacacccctccatgcttcccgtttcccacaacgcatccccacccactagctcttctcagtaccctagtctgtggtctgtctccaacggggccgtcacccctggatcacaagccgcagccgtcagtaacggattgggagcccagttctttagaggctcccccgcccactacacaccactcacccaccccgtgtcagccccttcgagctccgggtctccactgtatgaaggtgctgcagccgcaacagatatcgttgacagtcaatatgacgctgccgcccaaggtcggttgattgcgtcatggacccccgtgagtcctccctctatgtag

SEQ ID NO: 137132 - DNA, 732 bp, Artificial Sequence
  Description of Artificial Sequence: Synthetic coding sequence
atgagttccccagggacagagagcgcaggcaagtcccttcagtaccgtgtggaccacctgttgtcagccgtagaaaacgagctacaggccggcagtgaaaaaggcgaccctaccgaaagagagctgcgtgtcggtctagaggaaagcgaactttggctacgatttaaagaacttaccaacgaaatgatagttaccaaaaatggtagaaggatgttccctgtcctgaaagtgaatgtgtcggggttggaccctaatgcaatgtattctttcttattggatttcgttgccgctgataaccatcgctggaaatatgtaaacggagaatgggttcccggggggaagccagagcctcaggccccgtcgtgtgtgtacatccatccagactctccgaacttcggtgctcattggatgaaggcacctgtgagtttctctaaggtgaaacttacaaataaattgaacggcggcggccaaatcatgctgaattccctccataaatacgagccgcgtatacacattgtcagggtgggtggcccacagcgtatgattacttctcactgcttccctgaaactcagttcattgccgtgaccgcttaccagaacgaagaaatcaccgccttaaagattaagtataatcctttcgcaaaagcttttctggatgcgaaagagcgaagcgaccacaaagagatgatggaggagccgggtgacagtcagcagcccgggtatagccagtag

SEQ ID NO: 137133 - DNA, 366 bp, Artificial Sequence
  Description of Artificial Sequence: Synthetic coding sequence
atgaggattatgctgctattcaccgctatacttgctttttcactcgctcaatcatttggagctgtatgtaaagagccccaggaagaggtcgtgccagggggaggaaggtccaagcgcgacccggacttataccagctcttgcaaagactctttaaatctcattcttcccttgaaggcctgttaaaagctctgtctcaggcaagcacggatcccaaagaatcaacgagccccgaaaaaagagacatgcatgacttctttgtgggactcatggggaaaaggtccgtgcaacccgatagccccaccgacgtgaatcaagagaacgtgcccagcttcggaatcctgaaatatccaccacgcgcggaatag

SEQ ID NO: 137134 - DNA, 366 bp, Artificial Sequence
  Description of Artificial Sequence: Synthetic coding sequence
atgcggataatgctgctcttcactgctattttagccttcagtctagcgcagtcatttggtgccgtatgcaaagaacctcaagaggaagtggtcccggggggagggcgctccaagcgagatcccgacctgtaccagctgctgcagcgactgtttaaatcccactcttccctggaaggcttactgaaagcgctttctcaggcttccacagacccaaaggagtcaacttcacctgaaaagagagatatgcacgacttcttcgtggggctgatggggaagcgctctgtgcagcccgactccccaacagacgttaaccaagaaaacgttcctagctttggaattttgaagtatccaccaagagctgagtag

SEQ ID NO: 137135 - DNA, 312 bp, Artificial Sequence
  Description of Artificial Sequence: Synthetic coding sequence
atgaggataatgttgctgttcacagcaattttggcgttctccctcgcacagagcttcggtgcagtatgtaaggaaccacaagaggaagttgtgcctggggggggtaggtcaaaaagggatcctgacctgtatcagctgctgcagcggctttttaagagtcactcatctctagaggggttgctgaaggctttaagccaagcatccaccgaccccaaggagtctacatctcccgaaaaacacagccctactgatgtgaatcaagaaaacgtgccatcctttggaattctcaagtacccgcctagggcagaatag

SEQ ID NO: 137136 - DNA, 366 bp, Artificial Sequence
  Description of Artificial Sequence: Synthetic coding sequence
atgcggattatgctcctgttcactgccattctcgccttcagcctcgctcagagtttcggtgcagtttgtaaagaaccccaggaagaggttgtgcctggggggggaagatctaagagggatccagacctctaccaactgctgcagcggctgttcaaaagtcactcatccttggagggactgctgaaggctctatcccaggcaagcaccgatccaaaggagagtacgtccccagaaaaacgagacatgcacgatttttttgtcggactgatgggcaagcggtcggttcagcctgatagcccaacggacgtgaatcaggagaacgtgccttcatttggcatcctcaaatatccacccagagccgaatag

SEQ ID NO: 137137 - DNA, 1224 bp, Artificial Sequence
  Description of Artificial Sequence: Synthetic coding sequence
atggacaacgtgctgccagtcgactccgatctttcccccaatatttctactaacacatctgagccaaatcagttcgtccagccggcatggcagatcgtcctatgggccgccgcgtacaccgtgatcgtggtcacgtcagttgtcggcaatgttgtggtgatgtggataatacttgcccacaagcgcatgaggacagtcactaactactttctggtcaacttagcattcgccgaggctagtatggctgcatttaacaccgtagtcaattttacgtatgctgttcataatgagtggtattatggcctattttactgtaagttccacaatttctttcccatcgcagctgtgttcgcatctatctatagtatgacagccgtcgcctttgatcgctacatggctatcatccaccctctgcagcctaggctgagcgcaacagcgaccaaagtcgtgatatgcgtaatatgggtgttagccctgttgctggcctttccacagggttattactcgactactgagactatgccatcccgcgtcgtgtgtatgatcgaatggccagagcatccgaataaaatttatgaaaaggtgtatcacatctgtgtcaccgttctcatttattttctgcccctgctggtgatcgggtacgcttacaccgtggtcggcatcacattgtgggcgtctgaaatccccggcgattcatccgaccgctaccacgagcaggtaagcgccaagcgtaaggtcgtgaaaatgatgatcgtggtggtatgtaccttcgcgatctgctggctgccgtttcacatcttttttctcttgccctatataaacccggatctctacctgaagaagttcattcagcaggtatatcttgctatcatgtggctcgccatgagttctaccatgtacaatccaatcatttattgctgcctaaacgatagattccggttgggctttaagcacgcttttcggtgctgcccattcataagcgccggagactacgagggtctggagatgaaatccacccggtacttgcaaacacagggctcagtatacaaagtgtccagacttgaaactaccatcagcacagttgtgggcgctcacgaggaagaacccgaggacgggcctaaagctacccccagctcactggatctgactagcaactgctcctcgcgctccgattctaagacaatgactgaatcgttttccttttcatcaaacgtcctttcttag

SEQ ID NO: 137138 - DNA, 936 bp, Artificial Sequence
  Description of Artificial Sequence: Synthetic coding sequence
atggataatgtcctgcctgtcgactcagatctttcccctaatatttctaccaacacctcagagcccaatcagtttgtgcaacctgcatggcaaatagtgttgtgggcagcagcttacaccgtgattgtggttacttccgtggtggggaacgtggtggttatgtggatcatacttgctcacaaacgaatgcgcaccgtgaccaactactttctcgttaacctggcctttgccgaggcctccatggccgcctttaataccgtggtgaattttacctatgctgtccacaatgagtggtactacgggctgttctattgcaagttccacaatttctttccgattgctgctgtattcgctagcatttactcaatgacagctgtggctttcgatcgatacatggccattatccaccccttgcagccccggctcagcgccaccgcaaccaaagtggtaatctgtgtgatatgggtgctagccctgctgctcgcttttccccaggggtattactcaaccactgagactatgcccagccgggtggtgtgcatgattgagtggccagagcatccaaacaaaatctacgagaaggtgtaccacatttgtgtgactgtactcatttacttcttaccgctgctcgtgatagggtatgcatataccgttgtggggattaccctgtgggcctccgagattcctggggacagctctgaccgttaccacgaacaggtgtcagccaagcgtaaggtggtgaagatgatgattgtagtggtctgcacctttgctatttgttggctaccctttcacattttttttctcctgccgtacattaacccagatttgtacttgaaaaagttcattcagcaggtgtatctggccattatgtggctagccatgagctcaactatgtataatccaatcatatattgctgtttaaatgatagatag

SEQ ID NO: 137139 - DNA, 1197 bp, Artificial Sequence
  Description of Artificial Sequence: Synthetic coding sequence
atggggacttgtgatattgtgacagaggccaacatttctagcggcccagaatccaacaccacggggatcaccgctttttcaatgccttcctggcaactcgcactgtgggcaaccgcttacctggcactcgtgctggtggccgtcacgggtaacgcaatcgttatctggattattctggcccaccgcagaatgaggaccgtcaccaattactttattgtcaacctcgcgcttgccgatttatgcatggccgctttcaatgcagctttcaactttgtttacgcgtcccacaacatctggtacttcggaagggccttttgttatttccaaaacctcttccctatcacagccatgtttgtgagcatatattcgatgacagctatcgcagcagataggtacatggctattgtccacccatttcagccccgtctgtccgctccctctaccaaagccgtaattgctgggatctggctcgtggccctagccctggcttctccccagtgtttctacagcacggttacaatggatcaaggtgctacaaagtgcgtggtggcctggccagaagattctgggggaaaaacattgttactgtaccatctggtggttatcgctttgatttattttctccccttggcggttatgttcgtcgcctactctgtcattggcctgaccctctggcgccgtgcagtcccggggcatcaagcacatggagctaaccttagacacctgcaagcaatgaaaaaatttgtaaagaccatggtcctggtggtcttaacttttgccatttgctggctgccataccatttgtatttcattttgggaagcttccaggaggatatctactgccacaaatttatccagcaagtctatctcgcacttttctggctggccatgagttcgaccatgtacaatccaatcatttactgctgccttaaccaccggttcaggagtgggtttaggcttgcgttcaggtgttgcccgtgggtgactccgacaaaggaagacaagctggaactgacccccactaccagtctaagtacccgcgtcaataggtgtcataccaaagaaaccctctttatggccggggacaccgcgccaagtgaggccacatctggcgaagccggacgtccccaagatggatcaggcttgtggtttggctatggattactggccccaaccaaaactcatgttgaaatctag

SEQ ID NO: 137140 - DNA, 561 bp, Artificial Sequence
  Description of Artificial Sequence: Synthetic coding sequence
atgttcgtggcttatagtgtgatcggtcttacactctggaggagagctgtccccggccaccaagctcacggagctaacctcagacatctccaggccatgaagaaatttgtcaagacaatggtattggtggtgctcacatttgctatttgctggctgccatatcacttgtatttcatcttgggatcattccaggaagatatttattgccacaaattcattcagcaggtttacctggctttgttctggctggctatgtcttccactatgtacaacccaatcatttactgttgcctcaatcatcgctttcgaagtgggtttagactggctttccggtgttgtccctgggtcacaccaactaaagaggacaaactggagctgactcctacaacatcactgagcaccagggtcaaccgctgccacaccaaggaaacgctgttcatggctggagatactgcgccaagcgaggcaacctctggagaggccgggaggccccaggacggatcaggtctgtggttcgggtatgggctgttagctcccaccaagacccatgtggagatctag

SEQ ID NO: 137141 - DNA, 1398 bp, Artificial Sequence
  Description of Artificial Sequence: Synthetic coding sequence
atggccaccctgcccgccgctgagacatggatagatggggggggaggcgtgggtgctgacgcagtgaatctgacagcaagcttagctgccggcgctgccacaggcgcagttgagacgggctggttacagctgctcgatcaggctggaaatctgagttcctctccctcagccctggggcttccagtggctagcccagccccctcccaaccatgggctaacctcactaaccagttcgtgcagccaagttggagaattgctctatggagcctggcctatggtgtggtggtggctgtggcggttcttggcaatctgatagtaatttggatcatactggcacacaaacgcatgcgaaccgtgaccaactatttcctggtcaatcttgcctttagcgacgcctccatggcagcatttaacactctcgtcaatttcatatatgccctccattcggagtggtactttggagctaactattgccggtttcagaactttttccccatcactgcagttttcgcatccatttactctatgaccgctatagcggtggaccgttacatggcgatcatcgatcccctcaaaccccggctgtcagcgaccgctaccaagatcgtcataggatctatctggattctcgccttcctgctggcttttccccagtgtctgtactctaagaccaaggtaatgccgggccggacactctgcttcgtgcagtggccggaagggcccaagcagcactttacctaccacattatcgttatcatcctcgtgtactgtttccctctcctgatcatgggtattacgtatacgattgtgggaatcacactatggggtggcgagataccgggcgatacgtgcgataagtaccacgagcagctaaaggccaagaggaaggtggtaaaaatgatgatcatcgtggttatgactttcgcaatttgttggctgccctaccacatctattttattttgaccgccatctaccagcagctcaatcgatggaagtatatacagcaagtgtatctcgcatctttttggttggctatgtcctctacgatgtacaatccaattatatactgttgcctcaacaaacgctttcgggcaggcttcaagcgggctttccgatggtgtccatttatcaaggtgtcatcatacgacgaattggaattgaagacaacacggtttcaccctaatcgacaatctagtatgtatacagtcacacgcatggaatcgatgacggttgtttttgaccctaatgatgccgatactaccagaagcagccggaagaaacgagccacaccccgagatccatcatttaacggctgtagccgtaggaactctaagagcgcatccgcgacaagctctttcatctcgagtccttacactagcgtcgatgaatatagctag

SEQ ID NO: 137142 - DNA, 5682 bp, Artificial Sequence
  Description of Artificial Sequence: Synthetic coding sequence
atgggacctggatgcgatctcctcttgcgaacagccgcaacgattaccgccgccgctatcatgagtgatacggactcagatgaagactcagcaggcggcgggccttttagcctggctgggtttctgttcggaaacattaatggcgccggtcaattggagggcgaatcagtcctggacgatgaatgtaagaagcatctggctggactgggggctctagggttgggcagtttgatcacagagctcactgcaaatgaagagctgaccggcacagacggggccttggttaatgacgaaggatgggtgcggtctaccgaggacgccgtggattacagcgacatcaacgaggtggctgaggatgagtcacgccgataccagcagaccatgggctcattacagccactttgtcacagtgattacgatgaagatgactacgacgcagactgcgaggacattgactgcaagctgatgccccctccacctcctcctcctggacctatgaagaaggataaagatcaggactccatcacaggggtaagtgaaaatggtgaagggataatcctgccgagtatcatcgcccccagctccctggccagtgagaaggtggacttctcttcatcaagtgattcagagagcgaaatgggaccacaggaagcgacccaggcggagagcgaggatggaaaactgactctccccctggcaggcataatgcagcacgatgcgacaaaactgctgccctctgtgactgaactctttcctgagttccgccctggcaaggtcctgcggttcttacggctctttgggcccggtaagaacgtcccaagtgtgtggcgctcagctcgtcgaaagagaaaaaaaaaacaccgggagcttatacaggaggaacagattcaggaggtggaatgcagcgtcgagtctgaggtgtctcagaagtcattgtggaactatgactatgcccctcccccacccccagagcagtgtttgtcagatgacgagatcacgatgatggcacctgtggagtcgaagtttagtcagagtacaggcgatatagacaaggtcaccgatacaaaaccacgagtcgccgaatggagatacggcccggcgagactctggtatgacatgctgggcgttcccgaggatggctctggctttgattacggctttaagttacggaaaacagagcatgagcctgtgattaagagccggatgattgaagagtttagaaagctcgaggagaataacggcactgacctccttgccgatgagaacttcttgatggtgacacagttgcactgggaagacgacataatctgggatggggaagacgtgaagcataagggaacaaaaccccagagagctagccttgctggttggttgccaagcagcatgactaggaatgccatggcctataatgtccagcaggggttcgcagcaactttggatgatgataagccctggtactccattttccccatagacaatgaagatcttgtctatgggagatgggaagataatatcatctgggatgctcaggcaatgccacggctgttggagcctcctgtactcaccctggaccccaatgatgagaacctgatcttggaaatcccagatgaaaaggaggaagccaccagcaattccccatccaaagaatctaagaaagaatcatccctcaaaaagtcccgaattctgctggggaaaacaggggtgataaaggaagaaccccagcagaatatgagtcagcccgaagtgaaggacccatggaatttatctaacgacgagtattattaccccaagcagcaagggctcaggggcactttcgggggtaacatcattcagcactctatcccagccgttgagctccgccagcccttcttccccactcatatgggtcccattaaactgcgtcagtttcacagaccacctttgaagaaatacagcttcggggcactgtcccagcctggcccccatagtgtgcagcccctgctgaaacacattaaaaaaaaggctaagatgagagaacaggagagacaggcgtccggcggcggcgagatgtttttcatgaggaccccacaagacttgacgggaaaagacggcgacttgattttggctgagtattccgaagagaatggccctctcatgatgcaggtgggcatggcaacgaagattaagaattattacaaaagaaagcccggtaaggatcctggcgcccctgactgcaagtatggagagactgtgtattgccacacttcacctttcctgggctctttgcacccaggccagctgctccaggctttcgagaacaatctcttccgggcacctatatacctccacaagatgcccgagactgattttctgattatccggacgcgccaggggtactacatcagggaactcgtggatatctttgttgtaggccagcagtgccccctattcgaagtgcccgggcctaattcaaaaagggccaacacccacatccgggacttccttcaagtgtttatttaccgtcttttctggaaatcaaaggatagacccaggagaatcaggatggaagacataaaaaaggccttcccatcccactcagagagctccattaggaaacggctgaagctgtgcgctgatttcaagagaaccgggatggattcaaactggtgggtgctgaagagcgacttcaggctcccaaccgaggaggaaattcgagcaatggtgtcccctgagcagtgttgcgcatactacagtatgatagccgccgaacagaggctgaaggacgcgggatacggtgagaagtcgttcttcgcccccgaagaggagaatgaggaagacttccagatgaaaattgacgatgaggtgagaacagcaccatggaacaccacccgggctttcattgccgcaatgaaagggaagtgcctgttggaagttacaggggtagctgatccaacaggctgtggggaagggttttcttacgtcaaaataccaaataagcccacacagcagaaagatgataaagagccccaacccgttaagaaaaccgttacaggaacagacgctgacctgaggaggctgtccctaaagaatgccaaacaacttcttagaaaatttggcgttcctgaggaagaaatcaagaaactgtcacggtgggaagtgatcgacgtcgtgagaaccatgagcaccgagcaggcccggagcggagaggggcctatgtccaaattcgctaggggatcgagattcagcgttgcagaacaccaggagagatacaaggaggaatgccagaggatctttgaccttcagaataaggtgctgtcgagcaccgaggtcttaagtacagatactgactcatcatcagccgaggactccgactttgaagaaatggggaaaaacatcgaaaatatgctccagaacaagaagacatcttctcagctatctagagaaagggaagagcaggagcggaaggaactgcaaaggatgctactggcggcagggagtgcagctagtggcaataaccaccgagacgacgatacagcttccgtgacctcacttaactccagcgcgactggacgctgtctcaagatttatcgtacttttagggacgaggaggggaaggagtacgtgaggtgtgagacagtaagaaaacccgcagtgattgatgcctacgtgagaatccgcacgaccaaggatgaggagttcataagaaagttcgctctgtttgatgagcagcatcgagaggaaatgcgcaaggaacgtcgtaggatccaggagcagctgcggaggctgaaaagaaaccaggagaaggaaaagctgaagggacctccagagaagaagcccaaaaaaatgaaagaaaggcccgatttgaagctcaaatgcggagcatgcggcgccattggacacatgcggaccaacaagttctgtccactttactatcagactaatgctcccccctcaaatcccgtcgcaatgactgaagagcaggaggaggagctggaaaagacggtcattcataacgataacgaggaactcatcaaggtcgagggcacaaaaatcgttctgggcaagcagcttattgagagtgccgacgaagtgcggagaaagagcctcgtgctgaaatttccaaagcagcagttgccaccgaagaagaagcgcagggttggaacaacagtgcactgcgattatctgaacaggccccataagtcaatccaccgacgtcggacggacccaatggtgaccctgtctagtatcttagagtcaatcattaatgacatgagagacctgcccaatacatacccattccacacgccagtgaacgcaaaggtcgtgaaagattattataaaattattacccgccccatggacctgcagacgttgcgggagaacgttagaaagcgactgtacccctctcgggaagaattcagagaacacttggagctcatagttaagaactccgctacttataacgggccgaagcacagcctgacacagattagtcagtcaatgctcgatctctgtgatgagaagctgaaggagaaagaagataaactcgccaggctggagaaggccatcaaccctctgctcgatgacgacgaccaggtggcattctcattcatactagataatattgttacgcagaaaatgatggcagtgccagattcttggcctttccaccatcctgtgaataagaaatttgtacctgactattataaggtcatcgtcaatcctatggatcttgagaccattcgcaaaaatatctccaagcacaaatatcagtctcgagaaagttttttggacgatgtgaatcttattctggctaactccgtaaagtataacggtcctgagtctcagtacacaaagaccgctcaggaaatcgttaatgtgtgctaccagactctcacggagtatgacgagcacctaacccagctggaaaaggacatctgtaccgcaaaggaggcagcattggaggaagctgagctggagagcttggacccaatgacccccggcccctatacccctcaacctccagatctgtatgacaccaacacgtcgctcagtatgtcccgggatgcgagcgtcttccaggacgaatcaaacatgtccgtgctggatatcccgtccgcaactcctgagaaacaagtcacgcaggaaggcgaggacggggacggagacctggcggatgaggaagagggaaccgttcagcaacctcaggctagcgttctctacgaggatttgcttatgtcagaaggtgaagatgatgaagaagatgctggatcggatgaggaaggagacaacccattctccgccatccaactctccgagtcaggcagcgatagcgacgttggatcaggcggaatccggcctaagcagcccagaatgctgcaagagaacactaggatggacatggagaatgaagaatctatgatgtcgtatgagggcgacggcggtgaggcatcacacggattggaggactctaacatttcttatggctcttatgaagaaccagacccaaaaagcaacactcaggacacgagttttagctccatcggcggttacgaggtctccgaggaggaggaagacgaggaagaggaggaacagaggtctggaccatctgtgctttctcaggttcacctgtctgaggacgaggaggacagcgaggacttccactccatagctggtgactcagatctggacagtgatgagtag

SEQ ID NO: 137143 - DNA, 5619 bp, Artificial Sequence
  Description of Artificial Sequence: Synthetic coding sequence
atggggccgggttgcgatttgctcctgaggactgccgcaactatcacagccgctgcaataatgtctgatactgatagcgacgaggactctgcaggaggagggcccttctccctggctgggtttctcttcggcaatattaatggagcaggccaattggagggcgaaagcgtactcgacgatgaatgcaaaaaacacctggcaggtctgggcgcactggggcttggctccctgatcacagagctaacagctaatgaagaactgacggggaccgacggcgccctggtgaacgacgagggatgggtgaggtcaaccgaggacgccgtggattacagtgacataaatgaagtggccgaggatgaaagtaggaggtaccaacaaaccatgggttccctgcagcctctctgccatagtgactacgacgaagacgattatgatgcagactgcgaggacattgactgtaagctgatgccgcctcccccaccaccgcccggacctatgaagaaggacaaggatcaggattccatcactggtgaaaaagtggacttctcgtcaagcagtgactccgaatctgagatgggcccgcaggaggcaacacaggcggagagcgaagatggcaagctgaccctgcctcttgccggcattatgcaacacgatgccaccaagctgctcccttcggtgacggaactcttccccgagttccggccaggcaaagttctgcgctttctgaggctattcgggcccggaaagaatgtgccttcggtgtggagatctgctaggagaaagaggaaaaaaaagcaccgcgagttgatacaggaggaacagattcaggaggtcgaatgcagcgtggagagtgaggtgtcacagaagtcgctgtggaactatgattacgctcctccccccccacccgaacagtgtttgtccgatgatgagattaccatgatggctcctgttgagagcaagttttcccaaagcacaggtgatattgataaggtgacggacactaagcctagggtggccgaatggcgttatggtccagctcggctctggtatgatatgttgggtgtccctgaggacggtagcggtttcgactatggcttcaaactacggaaaaccgagcacgagccagtgatcaagtctcggatgattgaggaattccgcaagctggaggagaataacggcactgacctgctcgctgacgagaacttcctgatggttacacagttgcattgggaggatgacatcatttgggatggggaagacgtgaagcacaaaggtacgaaacctcagcgtgccagcttggctggatggttaccatcttctatgacccggaacgccatggcctacaatgtacagcagggttttgctgccaccctggacgatgataaaccctggtactctatctttcctatcgacaacgaagatctggtatacgggcggtgggaagacaatattatttgggatgcccaggcaatgccccgtcttttagagccccccgtactgaccctcgatccaaatgacgagaacctgatcctggaaattccagatgagaaggaggaggcaaccagcaattcaccctcaaaggagtcgaagaaagaaagctctttgaagaagtcccgcatactgcttgggaaaactggcgtgatcaaagaggaacctcaacagaacatgtcccagcccgaagtgaaagatccttggaatctgtccaacgacgaatactattatcctaagcaacagggcctgcgtggtactttcggtggcaatattatccaacatagcatcccagctgtggaattgcggcaacccttcttccctacacacatgggcccgataaagctgcgacagttccataggccaccacttaaaaagtactcttttggagccctgtcacagcccggtccccactcagtccagcccctcctcaagcacattaaaaagaaagcaaaaatgagggagcaggaacggcaggccagcggtggcggcgaaatgttctttatgcggaccccgcaggacctgaccggcaaggatggggatcttattcttgcagaatactcagaagagaatggccctctgatgatgcaggtcgggatggccactaagattaaaaactactacaagagaaaaccaggaaaagaccccggggcaccagactgtaagtatggagagaccgtgtattgtcacacaagccctttcctggggtccctgcaccccgggcaattgcttcaggcgttcgaaaataatctgttccgcgcccctatctatttgcataagatgccagagaccgattttctgattatccgtacaagacaaggctattatattagagagttggtggacatttttgtggtcggacaacagtgccccctgtttgaggtgcccggacccaatagtaagcgggccaacacccacattcgtgattttcttcaggtgttcatttacagattattctggaaaagcaaagaccgacctagaaggatccgtatggaagatattaagaaggcctttcccagccacagcgagtccagcattcggaaaagattgaaactgtgcgcggactttaagaggactggcatggattccaactggtgggttctgaagagcgatttcagattgccaaccgaggaagagatcagagccatggttagtcctgaacaatgctgtgcatactatagcatgatcgccgctgaacagcggctaaaggatgccgggtacggtgaaaagtcctttttcgctcctgaggaagagaatgaggaggatttccaaatgaaaatcgatgacgaagtgaggactgccccctggaacactacccgggcattcatcgctgccatgaaagggaaatgcctgttagaggtgacaggcgtggccgaccccactggctgcggcgagggtttctcttacgtgaaaatcccaaacaagcccacccaacagaaggacgacaaagagcctcagcccgtgaaaaaaacggtgactgggacagacgcggacctcaggcgactgagcttgaaaaacgccaaacaactgctcagaaagtttggcgtccctgaagaggaaattaaaaagttatccagatgggaggttatcgatgtcgtcaggacaatgtcgactgagcaagcccgaagtggcgagggtcccatgtcaaaattcgcaagaggcagtcggtttagtgtcgccgaacatcaggagcggtataaggaagagtgccaaaggatctttgaccttcagaacaaagtgctgagttcaaccgaagttctttcaacagataccgatagtagcagcgccgaggactccgacttcgaggagatggggaaaaatattgagaatatgctccagaataagaagacctctagtcagctgtctcgagaacgtgaagaacaggaaagaaaagagctccagaggatgctactggctgcgggcagtgccgcctctggcaacaaccatcgcgatgatgacaccgcttccgttacttcactcaactctagtgcaaccggccggtgccttaagatttatcgcactttcagagatgaggagggaaaagagtatgtgcgctgcgaaacagtacggaagccagccgtcatcgacgcctatgtcaggattcggaccactaaagatgaagagtttattagaaaatttgcgctgtttgatgaacagcacagggaagaaatgcgtaaagaacgccgccgtattcaggaacagctccgcagattgaagaggaaccaggagaaggaaaagttaaagggcccccctgaaaaaaagcccaagaaaatgaaggagaggcctgacctcaagttgaaatgcggagcctgcggtgcaattgggcatatgaggaccaacaagttctgcccattgtattaccagaccaatgcccccccgtccaatcccgtggctatgactgaggagcaggaagaagaactggagaaaaccgtgattcataacgataatgaggaactcattaaagtggaaggcaccaaaatagtgctgggaaaacagctgatagaaagtgccgatgaggtcagaagaaagtcactggtgttaaagtttcctaagcagcagctgcccccaaagaagaagcgtcgcgtgggcaccaccgtgcactgcgactacctgaatcgtcctcataagagtatccatcgtcggcgaactgaccccatggtcacactatccagcatcctggaaagtattattaatgatatgcgggacctgcccaatacctatcctttccacaccccagtaaacgctaaggtggtgaaggactactacaagattattacgaggccaatggacctgcagaccctgcgggagaatgtcaggaagcggctgtacccctcgagggaagaattcagggagcacctggagctgatcgtgaagaatagcgcaacttacaacggtcctaagcatagtctcactcagatcagccagtccatgctcgacctgtgcgacgaaaagctgaaggaaaaagaggataaactagctcgactcgagaaggctatcaatcctcttctagacgacgacgaccaagttgctttttccttcattttagataatatagtgacgcaaaagatgatggccgtgcccgacagttggcccttccatcatccggtgaacaagaaatttgtgccggattattataaagtgatagtgaatcctatggatctggagactatccgaaagaacattagcaaacataagtaccagtctcgcgagagcttcctcgacgatgtcaacctgattttagctaactcagttaagtacaacgggcctgagtcccagtacaccaagaccgcgcaagagatcgtaaacgtgtgttatcagaccctgaccgaatacgacgagcatctgactcagctcgagaaagatatctgcaccgcaaaggaggcggcattggaagaagctgagctggagtcccttgaccctatgacacctggcccttacacacctcaaccaccagacctgtatgatacgaataccagcctctccatgagccgcgacgcttcagtgtttcaggacgagagcaatatgagcgtgctggacatcccgagtgccactcccgagaaacaggtgacccaggaaggcgaagacggggacggagacctggcagacgaggaggagggtacagtccagcagccccaggcgtccgtgctgtatgaggatttactcatgtccgaaggtgaggatgatgaggaggacgctgggtccgatgaggagggcgacaatccattctctgcgatccagctgagcgagtcaggctccgattctgatgtaggaagtgggggtatcagacccaaacaaccccgcatgcttcaggaaaatacccgaatggacatggaaaacgaagagagtatgatgagctatgagggagatgggggggaagccagccatggcctggaggactctaatatctcatatggctcctacgaagaaccagatccaaaatccaacacccaggatacttcgttctcttcaatcggtggatacgaggtgagtgaggaggaggaggacgaggaagaggaagaacaacgctccgggccctcagtcttgagccaagtgcatctgtctgaggatgaggaggacagtgaggacttccactctattgccggcgatagtgaccttgatagcgatgagtag

SEQ ID NO: 137144 - DNA, 1632 bp, Artificial Sequence
  Description of Artificial Sequence: Synthetic coding sequence
atgacagaagagcaggaggaggagcttgagaagaccgtgattcataacgacaacgaagagttgatcaaggtggaaggcacgaaaatagtgctgggcaagcagctgatcgaatccgctgatgaggtgcgacggaagagtcttgtcctgaagtttccgaagcagcagcttccacctaaaaaaaagagacgtgtaggaacaaccgtccattgcgactatctgaacaggccccataagagcattcacagaaggagaacagaccctatggttaccttgtcctcaatcctggaaagcataatcaacgatatgagggatttgcccaatacataccccttccatacccccgtgaatgctaaggtggtgaaggactattacaaaatcataacacggcccatggacttgcagactttgcgtgagaatgtgcggaagcggctttatccaagccgagaggagttcagggagcacctcgagctgatagtgaaaaactctgccacatacaacggacctaagcattccctgacccagatctcccaatcaatgctggacctctgcgacgaaaaactgaaagagaaggaggacaagctagcgcgccttgaaaaggcaataaaccccctcctcgatgatgatgaccaggtcgcttttagcttcatacttgataatatcgtgactcagaagatgatggcagtgcctgacagttggccttttcatcacccggtcaacaagaaattcgtcccggactactacaaagtgatcgtgaatccaatggatctggagaccattagaaagaacatttcaaaacacaaataccagtctcgcgaaagctttctcgacgacgtgaacttgatcttggctaactcagttaagtacaatggcccagaaagccaatacaccaaaacagctcaggagatagttaacgtttgttatcagacacttaccgagtatgacgagcacctcactcagctggaaaaagacatctgtaccgctaaggaagccgctctggaagaggctgagctcgaatcgctagatcccatgacccccggaccttataccccacaggctaagccacctgacttgtacgatacaaatacctccttatcgatgagtcgcgacgcctcagtgttccaggacgaatctaatatgtcagtcctcgacattccctccgccaccccggagaagcaggtaacacaaatgagacaaggccggggccgactaggagaggaggactccgatgttgacatcgagggctacgacgacgaggaagaggacgggaagcctaagaccccggcgccagaaggcgaggacggagacggggacttggccgatgaggaagagggcaccgtccaacagccgcaagccagtgtgttatatgaagacctgctcatgagtgaaggcgaagatgatgaggaggacgccggctcagatgaagagggggacaacccattttcagcgatccagttgtccgaatctgggagtgacagcgatgttgggagtgggggcatcagaccaaaacagccccgcatgctgcaagaaaacacccggatggacatggaaaatgaagagtccatgatgagctacgaaggtgatggaggagaagcatcccacggactggaagatagtaacattagccaccagtag

SEQ ID NO: 137145 - DNA, 5688 bp, Artificial Sequence
  Description of Artificial Sequence: Synthetic coding sequence
atggggccagggtgcgacttgctcctgcggacggccgcaacaatcacagctgcggccatcatgtcagacaccgactccgatgaggatagtgcaggaggtggtccattctctctggccggctttttattcgggaatattaacggagccgggcagttggaaggcgaaagcgttttggatgacgagtgtaaaaagcacttggccgggttaggggccctggggttgggctcactgatcactgagctgacagcgaacgaagagctgaccggtaccgacggcgctctcgttaacgatgagggttgggtccgatccacggaagatgcagtggattactcggacattaatgaagtggctgaggacgagagtcgccgatatcagcagaccatgggctcgcttcaaccactgtgccattccgattatgacgaggatgactatgatgcggattgcgaggacattgactgtaaactgatgcctcctccaccccccccccctggcccaatgaagaaggacaaggaccaggatagcatcactggcgtctccgagaatggagaaggaatcatcttgcccagtatcatcgcccccagcagtttggcgagtgaaaaggtcgattttagtagctcatcggattccgaaagcgagatgggacctcaagaggcaacacaggctgaatctgaagacggcaaacttactttgccgttggcaggtattatgcagcatgacgccacaaaactactgccatccgtgaccgagttgttccccgagttccgccccggtaaagttctcagatttcttagactgttcgggcccggcaaaaatgtgcccagcgtctggcgcagcgcccgaaggaagaggaaaaaaaagcatcgcgagttaattcaagaggagcagattcaggaggttgagtgctcagttgagtctgaggtctcacagaagagtctgtggaattacgactacgcacccccccccccacctgaacagtgcttaagcgacgacgaaatcacaatgatggcccccgtggagtccaaattctctcagagcaccggcgatatagacaaagtcactgatacgaagccacgcgtcgctgaatggagatacggcccagccaggctgtggtatgatatgctgggcgtgccagaagatggatccggatttgattatgggttcaaacttaggaagactgaacatgagccggtgattaagagcagaatgatcgaggaattcagaaaattggaggagaacaacggaacagacctgttagccgacgagaacttcctcatggtcacccaattgcattgggaagacgacattatctgggacggtgaggatgtcaagcataaggggacgaagccccagcgagcaagtctggcagggtggctcccaagttccatgacacgtaacgccatggcgtataacgtacaacagggtttcgcggccacattagacgacgataaaccctggtattcaatttttccaatcgataatgaggatttagtgtatggaagatgggaagataatatcatttgggacgctcaggcaatgccacgattactggagcctccagtgctgaccctggatcccaatgacgaaaacctcatcttggaaatccctgacgaaaaggaggaggccacatctaactcaccctcaaaggaatcgaagaaagagagcagtctgaagaagtccaggatcctgctgggcaaaaccggcgtaatcaaagaagagccccaacagaacatgagccagccagaggtcaaggatccgtggaacctgagcaacgacgagtactactaccctaaacagcagggtctacgtggcacttttggtggcaacattatccagcacagcatccccgcagtcgagctgaggcagccattttttcccacccacatgggtcccatcaagttaaggcagttccaccgcccgcctctgaagaagtatagcttcggggcgctgagccaacctggaccccactctgtccagcccctcctcaagcacattaaaaaaaaagcaaagatgagggagcaagagcgtcaggcctctggcggcggagaaatgttttttatgcggaccccccaggacctcacaggaaaggacggagacctcatcctggctgagtattccgaagagaatgggcccctgatgatgcaggtagggatggcgactaagatcaaaaattattataaaaggaaacccgggaaagaccctggggcgcccgactgcaaatatggtgagactgtctattgtcatacaagcccgttcttgggttctcttcaccctggacagttactccaagctttcgagaacaatctttttcgggcaccaatctacctgcataagatgcccgaaacagactttctcataataagaactaggcaaggctattatatccgggagcttgtggacatctttgtggttgggcagcagtgcccactgttcgaggtccctgggcctaacagcaagcgcgcgaacactcatatacgcgactttcttcaggtgtttatatataggctgttttggaaaagcaaagaccgacctcgccgaattcgtatggaagacatcaagaaagcatttccctctcacagcgagtccagcataaggaagagactgaagttatgcgccgattttaagcgcacagggatggacagcaactggtgggttttgaagtctgacttccgcttgccgactgaggaggagatccgagccatggtttctccagaacaatgctgcgcttattatagtatgatcgcagcggagcagcggttgaaggatgccggttatggagaaaagtcattctttgcccctgaagaggaaaacgaggaagattttcagatgaaaatcgacgatgaagtgcgcactgctccctggaacactaccagggcatttatcgccgctatgaaaggaaaatgcttattggaggtgacaggggtagctgatcctacaggctgtggggaagggtttagctacgtgaagattcccaataagcctacacagcagaaggacgacaaggaacctcaacctgtcaaaaaaacagttaccggaaccgacgccgaccttcgccggctctctctaaagaatgcaaaacagctgttgaggaagttcggagtcccagaggaagagattaaaaagctgagcagatgggaagtgatcgacgtggttcggaccatgtcgactgagcaggcgagatcaggcgaaggccccatgtctaagttcgctcgaggatcaagattttccgtagccgagcaccaggagcggtacaaagaggaatgtcagaggatattcgacctacagaacaaggtgctgagttcaacggaggtattaagcaccgatacggacagctcttccgccgaagacagtgacttcgaggagatgggcaaaaacatcgagaacatgctgcaaaacaaaaagacatccagccagctgagcagagaacgcgaggaacaggagaggaaagagctgcagcggatgctgttggcggccgggtcagcggcatctggcaacaatcatcgtgatgacgataccgcctcagtgacaagtcttaactcctccgcaaccggccgatgtctgaagatctatcggactttccgcgacgaggaaggcaaagagtatgtcaggtgcgaaacagtccgcaagcctgccgtcatcgatgcatatgtgcgaataagaacaacaaaagacgaggagttcattcggaagtttgccctgttcgacgagcaacacagggaagagatgagaaaagagaggaggcgaatacaggagcaattaagacggctaaagcgtaaccaggaaaaagaaaagctcaaaggtccacccgagaagaagccaaagaaaatgaaagaaagacccgatcttaaactcaaatgtggagcttgtggagctatcggccatatgcgcaccaacaagttctgccctttatattaccaaaccaacgctcccccgagcaaccccgtggcgatgaccgaagagcaggaagaggagctggaaaagaccgtaattcacaatgacaacgaggaactcattaaggtcgaagggactaagatagtgctcggcaagcagctaatcgagagcgcagatgaggttcggcggaagagtctcgtgcttaaattcccaaaacagcagctaccacccaaaaagaaaagacgtgtgggcactaccgtgcattgtgactacctgaatcgtcctcacaaaagtattcaccgaaggcgtacagacccaatggtgaccctgagttccatcctcgaatcaatcataaatgacatgcgggatttgcccaatacatatccatttcataccccagtcaatgccaaagtcgtgaaagattattataaaataattaccagacccatggatctccagactctgcgcgaaaatgtccggaagcggctgtatccatctagagaggagtttcgagaacacctagaattaatcgtgaaaaattcggcgacttacaatgggcccaagcactctctgacgcagatctctcaatctatgcttgacttatgtgatgagaagcttaaggagaaggaggacaaattagcccgcttggagaaagcaatcaaccccctgcttgacgatgacgatcaggtggcgttcagtttcatactggacaatatagtcacccaaaaaatgatggccgtgcccgattcgtggccattccatcaccccgtgaacaagaagtttgttcccgactactataaagtaattgtcaatccgatggaccttgagacaatacggaaaaacatctctaaacacaaatatcaatcgagagagtctttcctggatgatgtcaatctgatcctcgccaattccgtgaagtacaacggtcccgaatctcagtatacaaagactgctcaagagatcgtcaatgtgtgttatcagaccctgacagagtatgatgagcatctgactcagctcgagaaggacatatgtaccgcaaaggaagccgcgctggaggaggcagagttggagtccttggatccaatgaccccaggaccatatactccgcaggcgaagccgcccgacttatacgatacaaataccagcctcagtatgtcccgagacgcgtctgtcttccaggatgagtccaatatgtcggtcctcgatattccatcagcaacacctgagaaacaagtgacacaagaaggtgaagatggtgatggagatctagcagacgaggaggagggcacagtgcagcaacctcaagcatctgttttatatgaggacctgctgatgtccgagggcgaggatgacgaggaagacgcgggctcagatgaggagggagataacccgttttctgcaatccagctgtccgaatcaggatccgactccgacgttgggagcgggggtattagaccaaaacagcccagaatgctgcaggaaaatactcgaatggatatggaaaatgaggagagcatgatgtcatacgagggagacggaggagaagcttcccacggtcttgaagacagcaatataagctacggtagttatgaagagcctgatccaaaatccaatacgcaggatacaagtttcagctctataggtggttacgaagtttccgaagaggaagaggacgaggaggaagaagagcaaaggagcggccccagcgtgcttagccaagttcatctctccgaggatgaagaggattctgaagattttcactccatcgccggcgacagcgacctggatagcgacgagtag

SEQ ID NO: 137146 - DNA, 5721 bp, Artificial Sequence
  Description of Artificial Sequence: Synthetic coding sequence
atggggcccggctgtgacctgctgctgcgaactgctgcaactatcacagcggccgctattatgtctgacaccgattcggacgaggactctgcaggcggcggacctttctccttggcaggatttcttttcggcaacattaacggcgccggccagctggaaggagagtctgtgctcgatgatgaatgcaaaaaacatcttgccgggctgggagcactcggtctgggaagcctgattacggaactaacggccaatgaggaactcacagggactgatggagcactcgtgaacgacgaaggctgggtgcgatccaccgaggacgccgtggattatagcgatatcaacgaggttgctgaagatgagagccggagatatcagcagacgatggggtctttgcagcccctgtgccatagcgactatgacgaagatgactatgacgcagattgcgaagacattgactgtaagctcatgcctccgcctccgccgccaccaggaccaatgaagaaagataaagaccaagactcaataactggggagaaggtggatttttcgagctcatctgatagtgagagcgagatggggcctcaggaagccacacaggccgagtccgaggatggaaagcttacacttccgctggccggtatcatgcagcacgacgcgacaaagctactgccgtccgtcaccgaactcttcccagagtttcgaccaggcaaggtgctacgtttcctaagacttttcggcccaggtaaaaatgttcctagcgtatggagatccgcccgtcggaaaaggaaaaaaaaacaccgggagcttatccaagaggagcagatacaggaagtggagtgcagcgttgagtccgaagttagccagaaatcactgtggaactatgattacgccccaccccctccccccgagcagtgcctgtctgatgacgaaatcacaatgatggcgcctgtcgagtcaaagtttagtcagtccactggggacattgacaaggtgacggacacaaagcctcgcgtagcggagtggcggtacggaccagcccggttgtggtatgacatgttaggagtgcccgaggatggatcgggattcgattacgggtttaagctgcgaaagaccgagcatgagcccgtgatcaagtccaggatgattgaggagttcaggaagcttgaggaaaacaacggtaccgatcttctggcagatgaaaacttcctaatggtcactcagctccattgggaagatgatattatctgggatggcgaagacgtgaagcacaagggaaccaagccgcaaagggcatctctcgctggatggctccccagctccatgaccagaaacgcgatggcctacaacgtgcaacaaggctttgctgctaccctggacgacgacaaaccctggtatagtatttttcctattgacaacgaggacctagtgtacggccggtgggaggacaacattatttgggacgcccaagccatgccccggctgctggaacctcccgtattaactctggatcccaatgacgaaaacttaattctggagatcccagatgagaaggaagaggctactagtaacagcccttcaaaggagtctaagaaggaatcatctctcaaaaagtcacggatacttctgggcaagaccggtgttattaaagaagagcctcagcagaacatgtcacaacctgaggtgaaggacccctggaacttgtcaaacgatgagtattactacccaaagcagcaggggcttagagggacgttcggaggcaatatcattcagcatagcattccagccgtcgagctgcggcagccttttttccctacacacatgggtcccatcaagctacgccaatttcaccgaccacccctgaagaagtacagtttcggcgctttgtcccaacccggcccgcattccgtccagccccttctcaaacatataaagaagaaagcaaagatgagagagcaggagcggcaggcgagcggcggtggcgagatgtttttcatgaggactcctcaggacctgactgggaaagacggggatcttatcttggcggagtattcagaggagaatggacccctgatgatgcaggttggcatggctacaaagataaagaactactacaagagaaaacccgggaaggatccaggcgctccagattgcaagtacggagaaaccgtttactgtcacacctctccatttctgggatctctgcaccccggacaactgttgcaagcattcgagaataatctgtttagggctccgatttatctgcataaaatgccagagactgattttcttattattcggaccaggcagggatattacatccgtgaactcgtcgatatttttgtggttgggcaacaatgcccgttgtttgaggtcccaggccccaacagtaagagggcaaatactcatattcgcgacttcctgcaggtctttatatatcgtctcttttggaaaagtaaagacagaccgcggcgaattcgaatggaagacatcaaaaaagcctttcctagtcattcggaatcttccatccgcaagagactcaagctttgcgctgatttcaaacgaacgggaatggatagcaattggtgggttttgaagagtgactttcgactccccacagaagaagagattcgcgctatggtctcccctgaacagtgctgtgcttattattcaatgatcgccgcagagcagagactcaaagatgctggctatggcgaaaaaagcttcttcgctccagaggaggagaatgaggaggacttccagatgaaaatcgatgacgaagtgcgcaccgccccttggaatacaactcgcgctttcatcgctgccatgaaggggaagtgcttactcgaggtcacgggggtggcagacccgactggctgcggtgaaggattttcctacgtcaagatcccgaataagccaacgcagcagaaagatgataaggagccgcaacccgttaagaaaaccgtgaccggcacagacgccgacctccgcagactaagcttgaagaatgccaagcagcttctgaggaagtttggagtgcctgaagaggagataaagaaactgtccagatgggaagtgatcgatgtggttagaacaatgtctacggaacaggcgcgctcaggggaggggccaatgtccaaattcgcgagagggtctcggttctctgtggcggaacaccaggagagatataaagaggagtgccagcgcattttcgatctgcagaacaaagtgctctcctccactgaagttctgtctacagatactgactcctctagcgctgaggattcagacttcgaagagatggggaagaacatcgaaaatatgttacagaataagaaaacttcatcacagttatcaagggagagggaggagcaggaaaggaaggaactgcagcggatgttgctggccgccggatctgcggcttccggaaacaatcacagggacgatgacacggccagtgtcacctcattaaattcctctgcaacaggaaggtgcctgaagatttaccgcacatttcgcgacgaggagggcaaagaatacgttcgctgcgagaccgtcagaaagcccgccgtcattgacgcatatgtgcgaatacgcaccacgaaagatgaggaattcattaggaagttcgcccttttcgacgaacaacatcgggaagagatgcgtaaggagcgtcggcgcatccaggagcagctgaggcgtctcaaaagaaaccaggagaaggaaaaactgaagggcccacccgaaaagaaaccaaagaagatgaaggagcggcctgatctgaagctgaagtgtggcgcctgtggagctatcggccacatgcgcaccaacaaattttgccccttgtattatcagactaacgccccaccttccaatcctgtagcgatgactgaagaacaggaggaggagctggagaagactgtcattcataatgacaatgaggagctaattaaggtcgagggtaccaaaatagttctcggtaaacagctgattgagagtgcagacgaggtgaggagaaagtcgttagtgctgaagttcccgaaacaacaactgccacctaaaaagaagagacgggtgggcacaaccgtgcactgtgattatttaaataggcctcataaatccatccaccggcggagaacagatcccatggtgaccctgtctagtatactcgaatccattataaacgatatgagagacctccccaacacctatccgtttcacactcctgtgaatgccaaggtcgttaaggactactataaaattatcactagacctatggacctacagactctgagggaaaacgtgagaaagagactgtacccgagcagggaagagttccgggagcacctcgagctcatagtgaagaactctgctacttataacgggcccaaacattctttaacccaaatttcacaaagcatgttggatctgtgcgacgagaaactgaaggagaaagaagataagctggcccgtctggagaaagcgataaatcccctcctggatgatgacgatcaagtggcgttttctttcatcctggacaatattgtcacacagaaaatgatggctgtcccggactcatggccgtttcatcacccagtgaataagaagtttgtgccggactattacaaggtgatcgtgaatccaatggaccttgagaccatccggaagaacatctcaaagcacaaatatcagagccgagagtcctttctggatgacgtcaatttaatcctggccaactctgtgaagtacaacggcccagagtcccaatacaccaaaaccgcccaggagattgtgaacgtttgttaccagactctcacggaatacgatgagcaccttacgcagctagagaaagatatctgcacagcaaaagaggcagctcttgaggaggccgaattggaatcgctcgatcccatgaccccggggccttataccccccagccccctgacctgtatgacactaacacttcactgtcgatgtcacgggacgccagcgtcttccaggacgagagcaatatgtctgtgctcgacatccctagcgctacacctgagaagcaggttacccaaatgcgccagggcaggggacgcctgggcgaagaagatagcgacgtggatattgaggggtatgacgacgaagaggaagacgggaaaccaaaaactccagcccccgagggggaggacggcgacggagatctggccgatgaggaggagggcacagtccaacaaccccaggcttccgtgctgtatgaggatttgctgatgtcagagggagaagatgatgaagaagacgccgggtccgacgaggaaggcgataacccttttagcgctattcagctaagtgaatcaggcagtgactcagacgttggatccgggggcatcaggccgaagcaacctaggatgttgcaggagaatacgcggatggatatggaaaatgaagagtctatgatgagctatgaaggcgacggcggggaggcaagtcacggactggaagactctaacatatcgtacggcagttacgaggaacctgatcccaagtctaatacccaagacacttcattcagctcaataggcggctacgaagtgtccgaggaggaagaagacgaggaagaagaggaacagcgctctgggccgtcggtattgtctcaggttcacctctcagaagatgaggaggattccgaggacttccacagcatagctggggattccgatctggacagcgatgaatag

SEQ ID NO: 137147 - DNA, 897 bp, Artificial Sequence
  Description of Artificial Sequence: Synthetic coding sequence
atgacagaggagcaggaggaggagttggagaagacagtgatccacaatgacaacgaagagcttataaaagttgaaggtaccaagattgtactgggaaaacaactcattgaatccgccgacgaagtgcgtcgcaaatccctggtgctgaaatttccgaagcagcaactcccaccgaagaagaaacgtagagtgggaacaacggtacactgcgactacctgaaccggccccacaagtccatacatagacggaggacggaccctatggtcactctctccagcatcctggaaagcataatcaatgacatgcgagatctgcccaatacttatccctttcacacaccagtaaatgcgaaagtggtgaaggattactacaagatcatcaccagacctatggacctgcagacactgcgagagaacgtccggaagaggctttatccttcaagggaggagttccgtgaacacctcgagctgattgtgaagaactccgccacctacaatggtcctaaacacagcctgactcagattagtcagtcaatgctcgacctgtgcgatgagaagttgaaggaaaaagaggataagttagcccggttagagaaggccattaatccactgttggacgatgatgaccaggtggccttctcttttatccttgacaacatcgtcacccaaaaaatgatggccgtccccgactcctggccgtttcaccatcccgtcaacaagaagttcgtccccgactattataaggtcatagtcaatcctatggacctcgaaacaattaggaagaatatttctaaacataagtatcagagccgagagagcttcctcgacgacgtgaatctgatcctggctaactctgtcaaatacaacggctacatgtgtacgacatgccgattctag

SEQ ID NO: 137148 - DNA, 657 bp, Artificial Sequence
  Description of Artificial Sequence: Synthetic coding sequence
atgtcatgctccggatctggagctgatcccgaggccgcacctgcctcagctgcgagtgcacctgggcccgcaccccccgtttccgcccctgccgcactcccgtcctccacagccgcagagaacaaggcctctcccgccggtacagccggtggacctggcgccggcgccgcggccggcggtaccggaccattggccgcacgggctggagaaccggcagagcgcagaggggcagcccctgtgagcgccgggggagccgccccccccgagggggctatttccaatggagtgtatgtgctacctagtgccgctaacggagatgtgaagccagtcgtcagctcgactcccttagtcgactttttgatgcaactggaagattacacgccaactatcccagatgccgtgacaggatactacctgaatagggctgggttcgaggcctctgaccctcggatcatccgcctgatatctttggcagcacagaagttcatttctgacatcgccaatgatgcgctccagcactgcaagatgaaaggcacggctagcgggagttccaggtctaagtccaaggaccggaaatatacactcactatggaagatctcactcctgctctgagtgaatatggtatcaacgttaagaaaccgcactacttcacctag

SEQ ID NO: 137149 - DNA, 636 bp, Artificial Sequence
  Description of Artificial Sequence: Synthetic coding sequence
atggacgatgctcacgagagtccaagtgataaggggggggaaaccggtgaatccgatgaaacagctgcagtgcccggtgacccaggcgctaccgacacagatggaatacccgaggagacggacggcgatgcggatgtcgacctgaaggaagccgctgccgaggagggagaattagagtcccaggacgttagcgacctgaccactgtggaaagggaggatagctctctcctgaaccctgcggccaaaaagctgaagatagacactaaagagaagaaagaaaaaaaacagaaggtggatgaagatgaaattcaaaaaatgcagatactagttagctccttctccgaagaacagctaaaccggtacgagatgtatagacgttctgcattcccaaaggctgccatcaagcgccttatccagtccatcacgggcacaagcgtctcacagaacgtcgtgatcgcgatgtctggcatatctaaagtttttgtgggggaggtcgtggaagaagccttagatgtgtgtgagaagtggggagaaatgccgccgcttcagccgaaacatatgcgggaagcggtgcggcgtttaaaatcaaaaggccaaattcctaatagcaagcacaagaagattatttttttctag

SEQ ID NO: 137150 - DNA, 465 bp, Artificial Sequence
  Description of Artificial Sequence: Synthetic coding sequence
atggatgatgcccacgaatccccctctgataagggtggcgaaaccggggaatctgatgaaaccgctgcagtgccaggagaccctggagcgactgacactgacggcatccctgaggagactgatggtgatgcggacgtggacttaaaggaggctgccgccgaagaaggcgaactggaaagccaggacgtgtccgacctcactacagttgaacgggaagattcctcccttctcaacccggctgctaaaaagcttaagattgataccaaagagaagaaggagaagaagcagaaggtggacgaggatgagatccagaaaatgcagatccttgtgtcctctttctctgaagagcaactcaatcggtatgaaatgtataggagatctgcctttccaaaggcagctataaagcgccattggatgtgcgtccgctctggcgaaaagtgccatcattataatcccaacatttag

SEQ ID NO: 137151 - DNA, 486 bp, Artificial Sequence
  Description of Artificial Sequence: Synthetic coding sequence
atgaatcagtttggccccagcgcccttattaatctgtctaatttttctagcatcaaacccgaacccgcgagcacaccaccccagggatcaatggcgaatagtacagccgtagttaaaatcccgggtacacctggggctggcggcagactcagccctgagaacaatcaggtccttaccaaaaaaaagttgcaggacctggtacgcgaagtcgacccgaatgagcagttggacgaggacgtggaggaaatgctgctccaaatagcagatgacttcatagagagtgtagtcacagctgcttgtcagttagcaagacatagaaaaagctctaccttagaggtcaaagatgtccagttacatctcgagcgccagtggaacatgtggattcctgggtttggttcagaagaaatacgaccatacaaaaaggcctgtaccaccgaggcacataagcagcgtatggccctgatacgaaaaactaccaagaagtag

SEQ ID NO: 137152 - DNA, 486 bp, Artificial Sequence
  Description of Artificial Sequence: Synthetic coding sequence
atgaaccagttcggacccagtgccctcattaacctctccaacttcagctctatcaagccggagccagctagcacacccccgcagggctcaatggcgaactcaaccgctgtagtgaaaatcccaggcactcccggcgccggcggcaggctcagtcccgagaataaccaagttttgacaaagaaaaagttgcaggatctggtaagggaggttgatcccaacgagcagcttgatgaggacgttgaagaaatgctccttcagatcgccgacgacttcatagaaagcgttgtgactgctgcctgtcagcttgctaggcatcggaagagttcgacactcgaagttaaggatgtgcagctccaccttgaaagacagtggaatatgtggatccctggttttggctccgaggaaatcaggccttataagaaggcatgtactactgaagcccataagcagcggatggccctcattaggaaaaccactaaaaagtag

SEQ ID NO: 137153 - DNA, 1779 bp, Artificial Sequence
  Description of Artificial Sequence: Synthetic coding sequence
atgtcggattctgggtcgtatggacaaagcggaggagagcaacagagttatagcacttacgggaaccctggaagtcagggctatggccaggcttcccagtcatacagtggttacggacagaccaccgattcttcttacggccaaaactacagtgggtatagctcttatgggcagagccagtccggctatagtcagtcttacggcgggtatgagaaccaaaaacagtccagttactctcagcagccttacaacaatcaggggcagcagcagaacatggagtcaagtggcagtcagggtggacgggccccaagttacgatcagcccgactacgggcagcaagacagctacgatcagcagagcggctacgatcaacatcagggctcctatgatgagcaatccaactacgatcagcagcacgacagctattcccagaaccaacagtcctatcattctcagagagagaactatagccatcacacgcaagatgaccggcgggacgtcagtcgctacggagaggacaaccgggggtacggcggttctcaggggggcggacgggggcggggaggatacgacaaggacggaaggggccccatgaccggctcctccggcggcgacagaggcggattcaagaacttcggcgggcacagagactatggaccccggacagatgccgactccgagtccgataattctgacaataatacgatcttcgttcagggcctgggggagggagtatctactgaccaagtgggtgaattcttcaagcagatcggcattatcaagactaataagaagacaggaaaaccaatgattaacctctacactgataaggacacaggcaagcctaaaggcgaagctaccgttagcttcgatgacccaccatccgccaaagcagcaattgattggtttgacggaaaagaatttcacggtaacattattaaggtgtcttttgctacccgaagaccagagttcatgagaggaggcgggtcgggaggtggtcgtagagggaggggtgggtaccgcggcaggggagggtttcaggggagaggaggcgatccaaagagtggagactgggtctgcccaaacccctcttgcggaaacatgaatttcgcccgcagaaattcctgcaaccagtgcaacgaaccacgccccgaggacagtcggccaagcggtggagatttcagaggtcgcggttatggcggagagcgcggctaccgcggtcgcgggggacgagggggcgatcgaggtggatacggcggtgaccggtcgggcggaggatacggaggagatagatcctctggtggcggttatagtggagatcgcagtggtggcggctacggcggtgacagaagcggcggagggtacgggggagaccgcggcgggggctacggtggcgataggggcggtggatatggcggagaccgcgggggaggttacggaggagacagaggcggttacggtggtgatcggggcggcgggtacgggggcgacagaggtgggtacggcggggatagaggcgggtatgggggagatcgtggcgggtatgggggcgacaggggaggatatggaggcgaccgttcccgcggcggctatggtggagacaggggaggcggaagcgggtatggcggcgaccggtcaggcggttacggtggagaccgttcaggcgggggatatgggggggataggggcggcgggtacggaggcgacaggggcggctacggcggaaagatggggggtcggaacgactataggaatgaccaacggaaccgcccctattag

SEQ ID NO: 137154 - DNA, 1779 bp, Artificial Sequence
  Description of Artificial Sequence: Synthetic coding sequence
atgagcgactccgggagctacggccagtctggtggggagcaacagtcctattccacttacgggaaccccggaagtcagggatatgggcaagccagtcaatcttactcaggttacggtcaaaccaccgatagtagctacggacagaactacagtgggtattctagttacggacagtcccaatccggttactcccaatcatatggagggtacgagaatcaaaaacagtcttcatacagccagcagccctacaacaatcaggggcaacagcagaatatggaatcatctggatcccagggagggagagcgccgtcctatgatcaacccgactatggccagcaagattcctatgaccagcagtcaggatatgatcaacaccagggtagctatgacgagcaaagtaattacgaccaacaacatgacagctatagtcagaaccagcaatcatatcattcccagcgagagaactattctcatcacacccaagatgatcgccgagacgtaagtagatatggggaagataataggggctatgggggatctcagggcgggggaaggggccggggaggctacgacaaagacggccgcggacccatgaccggcagtagcggaggtgacaggggggggttcaagaatttcggcggccatcgggactacggccccagaactgacgctgactccgagagtgacaattctgataacaacaccatttttgtgcaaggcttgggcgaaggtgtgtctacggatcaggtgggcgagtttttcaaacagattggcatcatcaagacaaacaagaaaacgggaaagccgatgatcaatctttatactgacaaggatacagggaaaccgaagggcgaagcaacggtgagcttcgacgatccaccatcagccaaggccgctatcgactggttcgatggaaaagaatttcatggaaatattatcaaggtgtcttttgcaaccaggaggccagaattcatgagaggcggaggcagcgggggcggacgcagaggtcggggggggtataggggccgaggtggcttccaaggtagaggaggcgaccctaagagcggggattgggtctgtccaaacccttcttgcggcaacatgaatttcgctagacgtaactcatgtaaccagtgcaatgagcctaggcctgaggattcccgcccttctggcggcgactttagaggccgaggctatggcggcgaacgggggtatcgcggacgaggaggcaggggtggcgaccgcgggggctacgggggcgatcggtcaggcggggggtacggtggagacaggtcctcaggcgggggttacagcggagataggagcggcggaggctacggcggagacagatccggaggcggttatggcggggatagagggggtggctacggaggcgatcgaggaggtgggtacggtggagaccggggcggaggctatggcggggacagagggggctacggtggcgatcgaggaggcggatatggaggcgaccggggcgggtacggcggcgatcgcggcggctacgggggagaccgtggcggatatggaggtgataggggaggctacggaggcgaccgctctcggggcgggtatggaggagatcgcggcggaggaagcgggtacggaggtgaccgctccgggggctacggaggcgacagaagcggaggaggatacgggggtgataggggcggcggatacggaggtgacaggggcgggtacggaggcaaaatggggggtagaaacgactatcgcaacgatcagcgcaacagaccctattag

SEQ ID NO: 137155 - DNA, 1188 bp, Artificial Sequence
  Description of Artificial Sequence: Synthetic coding sequence
atgacaggatcctctggaggggatcggggtggcttcaagaacttcggaggccaccgcgactatggcccacgcactgatgcagattcagagtctgacaatagcgataataacacgatattcgtccaggggctcggcgagggcgtctctacagaccaagtcggagaatttttcaagcagataggtattataaaaacaaataaaaagacagggaagcctatgattaatctctatacagacaaagacacggggaagcccaagggcgaggctaccgtcagttttgatgatcctcctagtgctaaggcggctatcgattggttcgatggcaaagagttccacggaaacataattaaagtcagctttgctactcgtcggccagagtttatgcgtggcggcgggtcaggaggggggcgtcggggaagaggcggctatcggggtcgcggcggtttccaggggagaggcggcgacccaaagagtggcgattgggtctgccctaacccttcctgtggcaacatgaattttgctcgcaggaattcctgcaaccagtgcaatgaacctaggcctgaggacagcaggccctcaggcggggatttcagaggaaggggctacggcggggaacgcgggtatcgtgggcgcggcggacgggggggggaccgtgggggctatggcggtgatcgatctggcgggggctacgggggagacaggtcatcaggaggcggctattcgggcgataggagtggtggcggttatggcggcgaccgctccggcggaggatacggtggcgacagaggcggaggctacggtggagaccgagggggaggatatggcggcgatcggggtggggggtatggaggggaccgggggggatatgggggcgatagaggggggggatacgggggagaccggggcggctacggtggggacagagggggatatggcggcgaccgtgggggttacggaggagatcgcggagggtatggcggagacagatctagaggaggatatggaggggacaggggaggagggtcggggtacgggggcgacaggtccggcgggtacgggggcgacaggtctggcgggggctacgggggggatcgcgggggaggttacggtggtgatagaggcggctacggcggaaagatgggcgggcgcaatgactaccgaaatgatcagagaaaccggccctactag

SEQ ID NO: 137156 - DNA, 2790 bp, Artificial Sequence
  Description of Artificial Sequence: Synthetic coding sequence
atgtgcgagtcatattcgcgttccctgctccgcgtgagtgtagctcagatctgccaggccctgggctgggactctgttcagcttagcgcatgtcaccttcttaccgatgtgctccagcgctatctgcagcagcttgggcgggggtgtcaccggtactccgaactgtatgggaggactgatcctatcctcgacgatgtgggggaagctttccagctgatgggcgtgagcttgcacgagctggaggattacattcacaacattgaaccagttacattcccacaccaaatccccagtttcccggtgagcaagaacaacgtattgcagtttccccagcccgggagtaaggacgctgaagaaagaaaggagtacatccctgattacctgccacccatagttagcagccaggaagaagaggaggaagaacaagtccccacagacggcgggactagtgctgaggctatgcaggtaccacttgaagaagacgatgaactggaagaagaggagattatcaacgacgaaaactttcttggcaagagaccccttgatagccctgaggccgaagaactgcccgcaatgaagcggccccggctcctctcaacaaagggcgatacactggacgtggtcttgctggaagcccgggaacctctgtcctctattaacacccagaaaataccacctatgttgagtcccgtacatgttcaagacagtactgaccttgcccctccttcaccagaacctccaatgctggccccagtcgccaagtcccaaatgcctaccgccaaacctctagagaccaagagcttcactcccaagactaagacgaagacaagttcccccggtcaaaagactaagtcaccaaagacagcccagtctccagctatggtaggatctcctattaggagcccgaagaccgtgagcaaggagaagaagagtccaggtcgatccaaaagtccaaagtcccctaagtcccccaaagtaacgacacacatcccacagactcccgtcaggccagagaccccaaatagaactccctcggctacacttagcgagaagatctcaaaagagactatccaggtgaagcagatccagacgccgcctgatgccggaaagctgaatagtgaaaatcagcccaagaaagcggtagttgcagataaaaccatcgaggctagcatcgatgctgtgattgcacgcgcctgcgccgagcgtgagccggacccgtttgagttcagtagtggatctgagtctgaaggcgacatttttacttcaccgaaaagaatttccggcccggaatgcaccacaccaaaagcctcaacgtcagcgaacaactttaccaagagcggttctaccccgctaccactgagcgggggtacctcatcctctgataactcatggaccatggatgcatcaattgacgaagttgtaagaaaggccaaactcggaaccccctcaaatatgcctcctaacttcccatatatctcttctccatctgtatcacctcctacaccagagcccttgcataaggtatacgaggaaaaaactaagcttcccagcagcgttgaggtcaagaaaaagctgaagaaggagctcaaaactaagatgaagaagaaagagaagcagagagaccgagaacgggagaaggataagaacaaagataaaagcaaggaaaaagacaaagtgaaagagaaggagaaagataaggagaccggccgcgaaacaaaatacccctggaaagaatttctaaaagaggaagaagccgacccttacaagttcaaaattaaggagttcgaggatgtggaccccaaggttaaattaaaggatggcctggttcgcaaggagaaagagaaacacaaggataagaagaaggaccgtgaaaagggcaagaaggacaaagataagcgtgagaaggagaaggtcaaggacaagggacgggaagacaagatgaaagcccctgcacctccgctggtgttacctcccaaggagctcgcgctgcctctcttcagtccggcaactgcatcgagggtgccagctatgctgccgagcttgctacccgtcctgcctgaaaagttgttcgaggagaaagaaaaagtcaaggagaaagagaagaagaaggataaaaaagagaaaaaaaaaaagaaggagaaagaaaaggaaaagaaggagaaggaaagagagaaagaaaagcgcgaacgcgagaagcgtgaaaaagagaaggagaagcacaagcatgaaaagattaaggtggagccagttgcactggctccttccccagtaatcccgaggctgaccttgagggtgggcgccggccaagataagatagtaattagcaaagtggtaccagctcccgaagcaaagccagcaccttcacagaacagacctaaaacacccccaccagcccccgctccagcccccggccccatgttggtttcgcctgcgcccgtgcccctgccactcttagcccaagcagctgcaggccccgccctgctgccttcacctggccccgcagccagtggggcaagcgcaaaagcgcctgtgagatctgttgtcaccgagacagtgtcgacctacgttatccgcgatgaatggggcaatcagatctggatctgtcctggttgcaacaagcccgatgatgggtcacccatgattggatgtgacgactgcgacgactggtaccactggccctgtgtggggatcatgacagctcctccagaggaaatgcaatggttttgcccaaaatgtgctaacaaaaaaaaggataagaagcacaagaaaaggaaacaccgggctcattag

SEQ ID NO: 137157 - DNA, 852 bp, Artificial Sequence
  Description of Artificial Sequence: Synthetic coding sequence
atgtgcgagtcttattcccggagtctcctcagagtctcagtggctcagatatgtcaggccttgggttgggattctgtccagctgagcgcttgccatctacttaccgacgtgttgcagaggtatctgcagcaacttgggaggggctgtcaccgatactccgagttatatggaagaactgatcccatcctggacgacgtgggggaggcatttcagctcatgggcgtgagccttcacgaactcgaagactatattcacaacatcgagcccgtcaccttccctcaccagatcccatcgtttccagtgagcaagaacaatgtgttacagttcccacagcccggcagtaaggacgcagaagaaagaaaagaatacattcccgactatttgcctcccatcgttagctcccaggaggaggaggaggaagagcaggtgcccactgatggcggtacctctgctgaggctatgcaggtcccgctggaggaagatgacgagctggaggaagaagagataattaatgacgagaactttctgggaaagaggccattggacagccctgaagctgaggaacttccggccatgaagcggcctagactgctgagtacaaagggagacaccctagacgtagtgcttctggaagcccgagagcctctgtcctcaatcaacacccagaaaatacccccaatgctctcccccgtgcacgttcaagattcaacagacctggcacccccttcccctgaaccgcctatgctggcccccgtagcaaagtcccagatgcccacagcaaagccactggaaaccaagagctttacacccaagactaagacgaagaagaagaaaaagaagaagaagagttag

SEQ ID NO: 137158 - DNA, 3258 bp, Artificial Sequence
  Description of Artificial Sequence: Synthetic coding sequence
atggccgcaggcagtgatctacttgacgaggtattttttaactccgaggttgacgagaaagttgtttcggacctggtgggctctctggagtcccagcttgctgcatccgctgcacaccaccaccatctggccccgaggactcccgaggttagagctgccgccgccggggcactcggaaaccatgtggtgagcggatcccccgcgggcgccgccggtgctgggccagccgccccagccgagggcgccccaggcgcggcgcctgaaccacctccggctggaagagcccggccaggaggcggcggaccacagcggccaggccccccaagtccccgacgtccgctggtgcccgccggtccagccccacctgcagccaagctgcgacccccccccgaaggctccgcaggctcctgtgcccccgtgcccgccgcagccgccgtggccgctggccctgagcctgcgcctgccggaccagccaagcctgcgggccccgccgcactggccgccagggctggacccggacctggacctggtcccggaccaggtccagggcccgggcccggcaagcctgctggcccgggcgccgcacagactttaaatggcagtgccgcactcctgaatagtcaccacgccgctgctccagctgtatcattagtgaataatggccccgctgcactcctgcctctgccaaagcctgccgccccgggcacggtgattcagactcccccctttgtcggcgctgcggcgccacctgcacccgccgccccctctcctccagcagccccagcgcccgccgctcccgccgcagcacccccaccccccccacccgctccagccacacttgcacgcccaccagggcatccggcaggccctccaaccgcagctccagcagtccctccacccgcagctgcccagaacggcggctccgccggagcagctccagcaccggcgccagcagccggaggtccagccggagtctccggccagcccggccctggggcagctgcagcggcaccagccccaggcgtgaaagcagaatctcccaaaagggtggttcaggccgcccctccagccgcccagaccctcgctgcttctggtcctgcttccaccgctgcaagcatggtgataggtcccacaatgcagggggctttaccctctccggccgccgtcccacctcccgccccaggcactccaactggattacctaaaggcgcggcaggcgcggtgactcaatcactttctcgaaccccaactgctactacttctggcatccgggctacactgacccccacggtccttgctccaagactccctcagcccccacagaaccctactaatatccaaaactttcaactgcccccaggaatggtactggtgagatctgagaatgggcagctgttaatgattccccagcaggctctggctcagatgcaggcacaggcccacgctcaaccccagactacgatggctccaaggccagccaccccaacttccgctcctccagtgcagatatccactgtgcaggcccctggaacccctataatcgccaggcaggtcacccctacaaccattattaagcaggtgtcccaggctcagacaactgttcagcccagcgccactctgcagagaagccctggggtgcagcctcaattggtcttgggcggtgccgctcaaaccgctagtctggggaccgcaaccgcagtgcagaccggtacaccacagcgcacagtgcctggggctacaaccactagttccgcagctaccgagaccatggaaaatgtgaaaaagtgcaagaacttcctgagtacactcattaagttggccagctctggaaagcagtccactgagacagctgctaatgtcaaagagttggttcagaacctgctggacggcaagatcgaggccgaagatttcacaagtaggctttaccgcgaacttaactcctctccgcagccttatcttgtcccatttctgaagcgctcccttcccgccctgagacaactcactcctgattccgcggccttcatacagcagagccaacaacagccacccccacccaccagtcaagctaccacagccctgacagcagtcgttctctctagctctgtgcagcgcacagccggaaagacagctgccactgtaacatccgccttacagccgcctgtcttgtcgttgacacagcctacacaggttggggtgggaaagcagggacagccgacccctttggtgatccagcagcccccaaagcccggggccctaattcggcctcctcaggtgacgcttacccagacccctatggttgcgctgcgccagcctcacaatcggattatgctgaccactccacagcagatacaactaaatccccttcagcccgttccagtcgtgaagcccgctgtactacccgggacaaaggccctgtccgctgtttcagctcaggctgcagctgctcagaaaaacaagctcaaggaaccaggcggcggtagcttcagggatgatgatgacatcaatgatgtcgccagtatggccggagtgaatctgtccgaggagagtgctcgaatcctggccaccaattccgaactggtcggcactctgacgcgaagttgtaaggatgaaaccttcctcctccaagcaccgcttcagcgacggatcctggaaatcggaaagaaacacggtattactgaactccatcctgatgtagtaagttacgtttcccatgctactcagcagcgtctgcaaaatctggtcgagaaaattagtgaaactgcgcaacaaaagaacttctcttacaaggacgacgaccgatacgaacaggcgtctgacgtgagggcacagctgaaatttttcgaacagctcgaccagatcgagaaacagagaaaggatgaacaggagagagagattctcatgcgggcggcaaagtcccggtccaggcaggaagacccagagcaactgcggctgaagcagaaggccaaagagatgcagcaacaggagctcgcccaaatgcgtcagagagacgccaatttaaccgccttggcagcaatcgggcctcgtaagaaacgaaaagtcgattgccccgggccaggaagcggtgccgaagggtccgggccaggctccgtagtccctggtagcagtggagtggggacaccaaggcagttcacgcggcagaggataacccgggtgaatctgagggacctcattttctgcctggaaaatgagagagagaccagtcactccctgctgctctacaaggcattcctcaaatag

SEQ ID NO: 137159 - DNA, 2850 bp, Artificial Sequence
  Description of Artificial Sequence: Synthetic coding sequence
ggccggggcctcctgcagcagcgcgggggaagagaaagcggccccgctcctcccgccgctaaactccgcccacctccggaggggtctgccggctcctgcgccccggtgccagccgcagctgcggttgcagcaggtcccgaaccagccccggccggccctgccaagccagctggccctgctgcccttgcggcacgagcaggaccaggccctggtccaggaccaggccccggcccagggccaggcccggggaagccagctggtcccggggcggcgcaaactctgaacggaagtgctgccctcctaaattcacatcacgcggcggctcccgccgtgagcctggtgaacaacggtcccgctgccctgctgcctctgcccaagcctgccgcacctgccgccgccccccctcctcctcctccggcccccgccacccttgcccggccccctggccatccagcaggccccccaaccgctgcacctgctgtgcccccacctgcagctgcccagaacggcgggtcagctggtgcagccccagcccccgcccccgctgctggcggcccagcaggcgtgtcaggccaacccggccccggcgccgcggcggccgccccagctccaggagttaaggccgagagcccaaagcgcgttgttcaggccgctcctccggccgcgcagactctcgctgcgtcagggccagctagcaccgccgcttcaatggtcatcggcccgactatgcagggagcacttccgtccccagcagcggtgccacccccagcacccggtactcctaccggtctgccaaagggagcagccggcgccgtgacccagtccctgtcccgtacacccacagccacaaccagcggcattagggccactcttacaccgaccgtcctggcacctagactaccacagcctcctcagaatcctactaacatccagaattttcagttgcctcctggaatggtcctggtcagaagtgaaaacggtcaacttcttatgattccacaacaggctcttgcccagatgcaggcacaggcacatgcacagccacagacgacgatggctccccggcccgcaacccctacctccgctcctcccgtgcagatcagtacagttcaggcacctgggacacctatcattgcccgccaggttacaccaactaccatcataaagcaggtgtcacaagctcagactaccgtgcaaccatccgcaaccctccaaagatcacccggggtgcagccacagctagtactaggaggagccgcgcaaacagcatccttgggtacagccacggcggtgcaaaccgggaccccccagcgcaccgtcccaggtgcaaccacaacctcgtcagccgcaacggagacaatggagaatgtgaagaaatgcaagaactttttatccacgctgattaagttggcttctagcgggaagcagagtaccgaaacagcagccaacgtgaaggaactggtgcagaatctactggatggaaagatagaggccgaagacttcacctcccggctctacagggagcttaactcttccccccagccctatcttgtgcctttcctgaaaaggagcctgccagctctgcgacagttaacccctgatagcgcagctttcatccagcaaagccaacagcagcctccaccaccaaccagccaagctacgaccgctctgaccgctgtggttctctcctcatcggtccagaggacagccggcaaaacagctgcaaccgtcacctctgcattgcaaccccccgttctctcacttactcaaccaacccaagtgggcgtggggaagcaaggccagcctaccccactggttatccaacaaccaccaaagcccggcgctctcattcgccccccacaggtgacgctaacccaaactccaatggttgctctgcgacagccccacaaccggatcatgctgacaactccccagcaaatccaactgaatcccctgcagccagtacctgtagtgaagcctgctgtgctgccaggaaccaaggctctttccgccgtctcagcacaagccgctgccgcccagaagaataagttgaaggaaccaggtggaggctctttccgcgacgatgacgacataaatgacgttgcctccatggcaggagtgaatttatctgaggaaagtgcccggatcctggcaactaacagcgagctcgtcggaaccctgacccgcagctgcaaggatgaaacgtttctgctgcaggcaccactgcaacgaagaatcctggaaatcggaaaaaagcatggcattactgagctccaccctgatgtggtgtcttacgtcagccacgcgacgcagcagagacttcagaacctggttgaaaaaatctcagagactgctcagcaaaagaatttctcttacaaggacgacgataggtatgagcaggccagtgacgtgcgggcccagctcaagttttttgaacagcttgaccagattgaaaagcagcgtaaagacgagcaagaaagagaaattctgatgcgggctgccaagagtcgaagcagacaagaggaccccgaacaacttcggcttaagcagaaagcaaaagaaatgcagcaacaggagctggctcagatgagacagcgtgatgccaatcttacagcactggccgccattgggcctcgaaaaaaacgcaaagtcgactgtcccggtcccgggtcaggagctgaggggagcggaccgggtagtgttgtccctggatctagtggtgtgggcactccacggcagtttactaggcagagaatcacaagagtgaacctacgcgacctgattttttgtctcgaaaacgaaagagaaaccagccactccctcctgctgtacaaggcgtttttaaaatag

SEQ ID NO: 137160 - DNA, 2589 bp, Artificial Sequence
  Description of Artificial Sequence: Synthetic coding sequence
atgcccgctggactaaccgagcccgccggcgctgcgcctcccgcagccgttagcgcttctgggacagtgaccatggcacccgccggggccctccccgtgagggtcgagtctacacctgtggccttaggagccgtgactaaagcccctgtctcagtctgtgtagaacccacggccagtcagcctctcaggagtccagtggggactttggtaacaaaagtggccccagtcagcgcgccaccaaaggtgagttccggtcctagactccccgctcctcagatcgtggccgttaaggctcctaacacaactactattcaattccccgctaatctgcagctgccgcctgggacggtgctgatcaagtccaacagtggtccactgatgctggttagcccacagcagactgttacacgggcggagaccacgagcaatatcacgtcccggcctgccgtgccagctaatcctcagactgtgaagatctgcacagttcccaatagcagttcgcagctaatcaaaaaggttgccgtgactccagtgaagaagttggcacagattggcacaaccgtggtcaccactgtacccaagccttcctctgtgcaatccgtagccgtgcccacctcagtcgtcaccgttacaccggggaagccactgaacacagtaactaccctgaaacccagctcactgggagcctccagtacacccagtaacgagcccaatctgaaggctgaaaacagcgccgcagttcagatcaatttgtctccaaccatgctggagaacgtgaagaagtgcaagaactttctagcaatgctgatcaaactggcgtgctctgggtctcagtctccagagatgggccagaacgtgaagaaattggttgagcagctgctggacgcaaagattgaagccgaagaatttacacgcaagctctacgtggagctcaagtcttcccctcaaccacacctggtgccgttccttaagaagagcgttgtagcgctccgacagctccttccaaattcccaaagttttattcagcagtgcgtacaacaaacctcttctgatatggttattgctacctgcacaactaccgtgactaccagccctgtcgttaccacaaccgtgtcatcaagccagagcgagaaaagtatcatcgtttctggggctaccgcacccagaacagtctcggtccagacactcaatcccttagcaggtccagtcggagccaaggctggcgtcgtgacactgcactccgtgggtcccaccgccgcaaccggaggcactacagctgggactgggctgctacagacctccaagcctctcgtaacaagcgtagccaatacagtgactaccgtgagcttgcagcctgagaagccagtcgtatcgggaacagcagtgacattaagcctacccgcggtgacattcggcgaaacttcaggagccgccatttgtctgccctctgtgaagcccgtcgttagttccgcaggaaccacctccgataagcccgttataggcacaccggtgcagataaagctggcccaaccaggtccagttttgagccagcctgctgggattcctcaagccgtgcaggtgaagcagttggtggttcagcagccaagtgggggcaacgagaaacaggtcacaacaatctcccacagctccaccctcacaatccaaaagtgtggtcagaagaccatgcccgtgaatacgattattccgacttcccaattcccacctgccagcatactgaagcagattacgctgccaggaaataaaatcctgagtttgcaagccagtccaacacaaaaaaaccgcattaaagaaaatgtcaccagttgtttccgcgacgaggacgacatcaatgatgtgacttccatggccggtgtgaatttaaatgaggagaatgcttgtattctggctaccaattccgagctggtgggaacgctgattcagtcatgcaaagatgagccctttctgtttataggtgcgctccagaagcgcattctagatattggcaagaaacatgacattaccgaactgaattctgacgccgtaaaccttatctcacaggctacccaagaaaggttaaggggactgctggaaaagctgaccgcaatagcccagcacagaatgactacatacaaagcttctgaaaactacattctatgcagcgacacccgcagtcagctgaagtttcttgagaaactggatcagctggaaaagcagaggaaagatttggaggagagagagatgctgcttaaagcggctaagtcacgttcaaacaaggaagatccggaacagctacgcctcaagcagaaggcaaaagaacttcaacagcttgagctggcgcaaattcagcaccgcgacgccaacctcaccgccttagcggctatcgggcctaggaagaagaggcctttagaaagtgggatagagggcttgaaggataacctcctcgcaagtggaaccagctcactcaccgccacgaagcagctacatagacctagaattacccgcatttgcctccgcgacctgatcttctgtatggaacaggagcgtgagatgaagtattctagggcactgtatctcgcgctgctcaaatag

SEQ ID NO: 137161 - DNA, 1857 bp, Artificial Sequence
  Description of Artificial Sequence: Synthetic coding sequence
atgcctgcaggcctcactgaacccgctggtgcagcaccgccagcagccgtgagtgccagcgggaccgttaccatggcacccgccggagccctgcccgtccgagtagagtcaaccccagttgcgctgggggcagtgactaaagcccccgtgtcagtgtgcgtggaaccaaccgctagtcagcccctccgctctcccgttggaaccctcgtaaccaaagtggcgcctgtcagtgctccacctaaggtcagttcaggtcccaggctaccagcgccacagatcgtggcagtgaaggcccctaatacaacaacgattcaatttcctgccaaccttcagctgccccctggtaccgtgctgataaagagcaactcggggccactcatgctggtgtccccacagcaaaccgtgacacgcgccgaaaccacatccaatatcacgagtcgacctgccgtccccgccaatccccagacagtgaaaatttgcaccgtgcctaattccagctctcagcttattaagaaggtagccgtcacccccgtgaagaagctcgcccaaattgggacgaccgttgttacgactgtgcccaaaccctcttctgtccagtcggtcgcggtacctacctctgtcgtcaccgtaacgccaggaaagccgctcaacactgtcacaaccttgaagccctcatccctgggtgccagcagtacacctagcaacgaacccaacctcaaggcagaaaattctgctgccgtacaaataaatctatcacctactatgttagaaaatgttaaaaaatgtaagaacttcctggccatgctcataaagcttgcatgttccggctctcagagtcctgagatgggccagaacgtcaagaagctcgtggaacaactcctcgatgccaagattgaggcagaagagtttacccgcaagctctacgtggagctgaaatcctctccacagccccacttggtgccattcctgaagaagtcagtggttgcactaagacagttgctgcctaattcacagagcttcatccagcaatgcgtgcagcaaacctccagtgacatggttattgcaacttgcaccacaacagtcacaacctctccggtcgttaccacaacggtatcttcctcacagagtgagaaaagtatcatcgtgtcgggcgccacagctccccgtactgtgtccgtgcaaaccctgaatccccttgccggtccagtcggcgccaaagcaggcgtggtaactctgcactccgtcggccctactgcagctactggcgggaccacagctggcaccggcctgttgcagacctccaagcctctagtgacctcggtggccaacacggtcacaaccgtgagtctacagcccgagaaaccagtagtttctggaacagccgtgaccttgtcactccccgccgtcacgttcggagagacatctggagccgctatttgtttgccgagcgtaaagccggtggtgagctccgcgggcaccacctcagataagcctgtcatcggcacaccagtgcaaatcaaactggcccagccagggcctgtgctgagtcagccagcagggatccctcaggcagtccaggtgaaacagctggtggttcaacagccgtctggcggtaatgagaaacaggtcacaacaatcagccacagtagcacactaacaatccagaaatgcggacagaagaccatgcccgtcaacaccataattcctacatctcaattcccccctgcatctatcctcaaacaaatcactttacctgggaataagattctgtctctccaggcctcgccaacccagaaaaacagaatcaaagagaacgtcacaagctgtttcagatctactttcatttgtgtgtactag

SEQ ID NO: 137162 - DNA, 2598 bp, Artificial Sequence
  Description of Artificial Sequence: Synthetic coding sequence
atgcccgcaggtctgaccgagccagccggcgctgctccaccagccgcagtgtctgcatccggcactgtgaccatggctcccgctggagccctgcctgtgcgagtcgaatcaacccctgttgccctgggcgcagtgaccaaagcaccggtttcagtgtgtgtagaaccaactgcaagccagcctttgcgcagccctgttgggacactggtgacaaaggtggctcctgtgagcgctcctcctaaagtaagttctggtcctagactccctgcacctcagattgttgccgtgaaagctcctaatacgacaactatccaattcccagctaatctgcagctcccacctggcacagtcttaatcaaatcaaacagcggacccctgatgctcgtctccccacagcagacagtgaccagagccgaaaccacgagtaacatcacctctcgtcctgctgtgcccgcaaatccacaaactgtcaaaatttgtaccgtgcccaactcttctagccagctgatcaaaaaggtggctgtgacccctgtcaagaagctggcacagatcggcactaccgtagtgaccaccgtgcctaaaccaagttctgttcagagcgttgcagtgccaactagcgtcgtaactgtgacaccgggcaagcctctaaacaccgtgacgaccctgaagccatctagcctgggggcgtcttcgacgccatccaacgagcctaacctgaaagccgagaactctgccgctgtccagatcaaccttagtcctactatgctggagaatgtgaagaaatgcaagaacttcttggctatgttgatcaagcttgcatgctccggttcgcagtcacccgagatgggccagaacgtgaaaaaactcgtcgagcagcttctcgatgcaaaaattgaggccgaagagtttactagaaaattatacgtagagttgaaaagcagccctcagccgcacctggtaccattcctaaagaagtccgtggtggcactgaggcagctgctgcctaactctcaatcctttatacagcagtgcgtacagcaaacatcatccgatatggtcatcgccacatgcacaactactgtcaccacatccccggttgtgacaacaaccgtatccagcagccagtccgagaaaagcattattgtgtccggagctaccgctccccggaccgtgtcagttcaaacactgaaccctctggcgggtccagtaggagccaaggcaggggtggtgacattgcattctgtaggacccactgcagctacaggcggtacgacggcaggaacaggcctcttgcagacctctaagccactggtcactagcgtggctaacaccgtaactaccgtgagtcttcagccggagaaacccgtggtgagcggcacagctgtgaccttgagcttacccgccgttacctttggtgagacctccggcgctgccatctgcctaccgagtgtgaaacccgttgtgttttgctgggatcacataaagcccgtaatcggcactccagtccaaattaagctggctcagcccggtcctgtcttaagtcagccagccgggatcccacaagcagtgcaggtcaagcaacttttcagcttattccaggtggtgcagcagccttctggggggaacgagaaacaggtcactaccatcagccacagcagtaccttgacgatccaaaaatgcggccaaaaaacaatgcccgttaacaccattattccaacttctcagtttcctcccgccagtatactaaagcagatcaccctgcccgggaataagattctttctctgcaggccagtcctacgcagaaaaaccggatcaaagagaacgttacatcctgctttagagacgaggatgatatcaatgacgtgacctccatggcaggggtcaatttaaacgaagagaatgcgtgcatcctggcaaccaacagcgagctcgttgggacgttgatccaatcatgtaaggacgagccattccttttcattggcgccctacagaagcgaatattggacattgggaaaaagcatgacatcactgagctcaactcggatgccgtaaatctgattagccaagccacacaggagaggctgagggggctcttggagaagctgacagctatcgcgcagcatagaatgactacatacaaggcaagcgagaactatatcctgtgtagcgataccagaagccagctaaagtttctggaaaaattggatcagcttgaaaaacagcgcaaagatctcgaagaaagagagatgctcttgaaggccgcgaaatctagatccaacaaggaagacccagagcagttacggctgaaacagaaagctaaggagcttcagcagctggaactggcccagattcagcatcgcgatgcaaatctcacagccttagccgccatcggccccaggaaaaaacgaccactcgaatccggaatcgagggcctgaaagataaccttctagcatctggcacctctagcctgaccgcgacaaagcaactgcaccggccacggatcactcgcatttgtctgagagacttaatattttgcatggaacaggagagagagatgaaatatagccgggccctgtacttggccctgctgaaatag

SEQ ID NO: 137163 - DNA, 2238 bp, Artificial Sequence
  Description of Artificial Sequence: Synthetic coding sequence
atggccgctctcgctgaggagcagacagaggtggctgtcaagctcgagcccgagggcccccctacactgcttcctccccaggcaggcgacggagccggcgaaggaagcgggggcactacaaataacgggccaaatggggggggcggcaatgtggcggcctcaagcagcacgggcggcgacggaggcacaccaaagccgactgttgcagtgtccgccgcggccccggccggagctgcaccagtgcctgccgccgcaccggatgcaggcgccccacatgaccggcagacacttctcgcagtcctgcagttccttaggcaatctaagttacgggaggctgaggaagccttaaggagggaggccggcctattggaggaggcagttgctggatccggtgctcccggcgaagtagattccgccggcgccgaagtaacgtcggcacttcttagtcgggtcaccgccagcgcgccaggcccggccgctcctgacccgcccgggacaggagccagcggggcaactgtcgtgagtggctcagcctccggtccagccgcccctggtaaggtcgggagcgtcgcggttgaggaccagcccgatgtgtcagcggtcttgagcgcttacaatcagcaaggagacccaacaatgtatgaggaatattatagcggattgaagcacttcattgaatgctccctggactgccatcgagcagaactgtcacagctgttttatcctctgttcgtacatatgtacctggaactggtgtacaatcaacacgagaacgaggctaagtcgtttttcgaaaaatttcatggagaccaggagtgctattatcaggacgatctgcgagtgctttcaagcctgaccaagaaggaacatatgaaaggcaacgagactatgcttgatttcaggacctccaaatttgtgctccgtatcagcagagacagctaccaactcctgaaacgccacctgcaggagaagcagaataatcagatatggaatatcgtgcaagagcacttgtatatcgacattttcgatggtatgcctaggtctaaacagcaaattgacgccatggtggggtctctcgccggcgaagcaaaacgtgaagccaataaatccaaggttttcttcggccttctgaaggaacccgagatcgaggtgccactcgacgatgaggacgaggaaggcgaaaatgaagagggaaagcccaagaagaagaagccaaagaaagactccattggatccaagtcgaaaaagcaagatcctaacgctcctccacagaatcgcattcccctgccagaattgaaggacagcgacaaattagacaagattatgaacatgaaggagactaccaaacgcgtccgcctaggccctgactgcctcccaagtatatgtttctatacttttctgaatgcgtatcagggactgacagccgtagatgttactgacgatagcagcctgatcgccgggggattcgctgattcgacagtacgggtgtggtctgtcacacctaaaaaactgagaagtgtcaagcaggcctcagacctctctcttatcgacaaggaatcagatgacgttctagagaggatcatggatgaaaaaaccgcttcagagctcaagattctgtatggtcacagtggccccgtatacggagcctcattttcacccgacaggttatgggcgaccgaccactaccagcccctgagaatcttcgcaggccacctcgctgatgtgaattgcacaagatttcacccaaactcaaactatgtggcgacaggtagtgcggatagaactgttcgcctctgggatgttctgaatggcaattgtgtaagaatattcacaggacacaaggggcctattcattccctcactttttctcccaacgggcgatttctcgccacaggcgccactgatggccgagtgctgctctgggacatcggacatgggcttatggtgggagaattgaagggccatacggataccgtgtgttcattgaggttcagcagggatggagagatcctcgcgagtggatcaatggacaacacagttagactgtgggatgccatcaaggcctttgaggacctcgaaacagatgacttcaccaccgctactggccatatcaacctcccggaaaatagtcaggagttgctgctggggacatatatgacgaagagtactccagtagtccatctgcacttcacaaggcgaaacctcgtgctggcggccggggcctattcacctcagtag

SEQ ID NO: 137164 - DNA, 2403 bp, Artificial Sequence
  Description of Artificial Sequence: Synthetic coding sequence
atggcagctctggcggaagaacaaacggaagtggcagtcaaacttgaacccgaggggcctcctaccctacttcctccacaagcaggtgatggcgccggcgaaggtagtggagggacaactaacaacggacctaatggggggggtggcaacgtggccgcatctagttccacaggaggcgacggtggcactcctaagcccactgtggctgtgtccgctgccgcccctgcaggagccgctcccgtgcccgcagccgctcctgatgcaggggccccccacgaccggcagaccttgctggcagtgcttcagtttctccgacagagcaaactgagagaggccgaggaggccttgagacgggaggccggattgctagaagaggccgtggctgggagcggcgccccgggtgaagttgatagcgccggggccgaggtaacaagcgccctcttaagccgcgtaacagccagcgcacctgggccagccgctcccgatcctcctggaaccggtgctagtggggcaaccgtcgtctccggcagcgcctcagggccagccgcccccggtaaggtgggaagtgtagccgtggaagaccagccagatgtctccgccgttttgtctgcatataaccaacaaggagacccaacgatgtatgaggagtattatagcggccttaaacacttcattgaatgcagcctggattgtcaccgggctgagctgtcacagcttttttatccactgttcgtgcacatgtacctcgagctcgtgtataatcagcacgaaaatgaagccaagagcttcttcgagaaattccatggggatcaggaatgctactatcaggatgacctcagggtgttatctagtctcaccaagaaagaacacatgaaagggaacgaaactatgctggactttcggacctccaaatttgtgttaaggatttcccgcgactcataccagctcttgaagcgccacctacaggaaaaacagaacaatcagatttggaacattgtacaagagcacctgtatatcgatatctttgacgggatgccaaggtcaaagcagcagattgacgcgatggtggggagcctcgctggcgaggccaagcgtgaagccaacaaaagcaaggtattttttggactgctcaaagaaccggagattgaagtgccactggatgatgaggacgaggagggcgagaacgaggagggtaaacccaaaaaaaagaagcccaaaaaggattctataggtagcaaatccaaaaagcaggatccaaatgctcccccccagaatcgcatccctctcccggaacttaaagactcagataagcttgataaaattatgaatatgaaggaaaccactaaacgcgtcaggctgggtcccgattgcctgccttcaatttgtttctacacttttctgaacgcataccagggcctaactgccgtcgatgtgaccgacgatagtagtctcatagcaggcggttttgctgacagtacagtgcgcgtgtggagtgttactccgaaaaagttgagaagcgtcaagcaagctagcgatctgtccttaatcgacaaggagtcggatgacgttcttgagcgcatcatggacgagaaaactgcatccgaactgaagattttatatggacactctggccccgtgtacggcgcctctttctctccggatcggaattatctgctgtccagcagtgaggatggaaccgtgcggctgtggagccttcagactttcacatgcctggttggctacaaaggacacaactatcccgtctgggacacccagtttagcccttatggctactacttcgtgtccggcggacatgaccgcgtcgcccgtttatgggcaactgaccactaccagcctctcaggattttcgcaggccacctggcggacgtgaattgcactcggttccaccctaatagcaactacgtggcaaccgggagtgcagaccgtacagtgcgcttgtgggacgtcctgaacgggaattgtgttaggatttttaccggccacaaggggccaattcactccctgactttcagcccaaacggcaggttcctggcgacaggcgccacagacggaagagtgctgttatgggacatcggccatggcctgatggtgggagagctgaagggacacactgacacggtatgttctctgcgctttagccgtgacggcgaaatcctagcctcagggagtatggacaacacagttcgcctgtgggacgctatcaaggcttttgaggacctggaaaccgatgattttaccaccgctaccgggcatatcaatctgcccgaaaactctcaggaactcctactgggcacctacatgacaaagtcaacccctgtcgtccacctccacttcacaagaaggaatcttgtcctcgctgccggggcttattcacctcagtag

SEQ ID NO: 137165 - DNA, 2034 bp, Artificial Sequence
  Description of Artificial Sequence: Synthetic coding sequence
atggcagaggaaaagaagcttaaactgagcaacactgtgctgccatcagaaagcatgaaagttgtcgcggagtccatgggcatagcccagatccaggaagagacttgtcagcttctgactgatgaagttagctacagaattaaggagattgcccaggacgctttaaaatttatgcatatgggaaaacgacagaagcttactacaagcgatatagactacgccctgaaactcaagaacgtggaaccgctgtacggctttcacgcgcaggagtttattccgtttcgattcgcatctgggggtggccgtgagttgtacttctacgaggaaaaggaagtggacctaagtgacatcatcaatactcctcttcctcgggtacctttagatgtgtgtttaaaagcccattggttatccatcgagggatgccagcccgctatcccggagaaccctcctcctgctcctaaagagcagcagaaagctgaagctacagagcctttgaaatccgccaagcctggccaggaagaagatgggccgctaaaaggaaaaggccagggggctacaaccgcagatggaaagggaaaggaaaagaaagcccccccactgttggaaggggccccactaagattaaagcctcgtagcattcatgaattatccgtagaacagcagttatactataaggagatcacagaggcctgcgtcggaagttgcgaggctaagagagcggaagctctgcagtccattgcaactgacccgggcttgtaccagatgctgccccgattcagtacctttatttccgagggtgtacgggttaacgtggtgcagaataatctggctttgttaatttatctgatgaggatggtcaaagccttgatggacaatcctacgctatatttggagaagtatgtccatgagcttatcccagccgttatgacatgtattgttagccggcagctttgcctgaggccggatgtcgataatcattgggccttgagggatttcgctgctcgtctcgtagcccaaatatgcaaacatttcagcacaaccaccaacaatattcagagccggatcaccaagacgttcactaagtcttgggtcgacgaaaagactccatggacaactcgctacggatctattgccggcctcgccgaactgggccacgatgtgatcaaaactctgatactgcctaggttgcaacaggaaggagaacgcatccgcagcgtgctcgatgggccggttctgtcaaacatcgaccggattggggctgaccacgttcagtccctgcttctaaaacattgtgctccggtactcgctaagttgaggccacctccggacaaccaggacgcttatagggccgagttcggctcactcggccccctcctttgctctcaggtggtgaaggcaagagcccaggccgcattgcaagctcagcaggtcaaccggacaacacttacgattacccaaccgagaccaaccttaacactatcccaggccccccagcctgggccccgaactccaggactgctgaaggtgccaggatccattgcgctgccggtacaaacgctcgttagcgccagggcggccgctcccccacagcccagccccccccccacaaaattcatcgtcatgtcttcctccagctcagcacccagcactcagcaagtcctgtctctctccacaagtgctccaggatcagggagtaccactacctcacctgtgaccaccactgtgcccagtgtacagccgattgtcaagctggtctccaccgccacgacagccccaccgagtacagccccgtccggacccggctccgtccagaaatacatcgttgtgtccctgccacccaccggggagggcaaaggcggccctaccagccacccttcacccgtgccccctcctgcctctagcccgtcccctctgtccggatccgctctgtgcgggggcaaacaggaggccggagatagccctcccccagctcctggaacaccaaaagcgaatggctctcagccgaattctgggtctccacagcctgccccttag

SEQ ID NO: 137166 - DNA, 231 bp, Artificial Sequence
  Description of Artificial Sequence: Synthetic coding sequence
atggcggaagaaaagaaacttaagctgtccaataccgtactgccaagcgaaagcatgaaggtggtagctgagtcaatgggaattgcacaaatacaggaggagacttgccagttgctgaccgatgaggtgagttacaggattaaagaaatcgcccaagacgccttgaaattcatgcatatgggcaagcgacaaaagttgacaacatccgatatcgactatgcacttaagtag

SEQ ID NO: 137167 - DNA, 1806 bp, Artificial Sequence
  Description of Artificial Sequence: Synthetic coding sequence
atgcacatgggcaaacgccagaaactgaccacgtctgacattgactatgcgctcaagttgaagaacgtggaaccgctttacggttttcacgcgcaggagttcatcccgtttcggttcgcgtcaggtgggggcagggagctgtacttctatgaagaaaaagaggtggatctatctgacatcattaacacccccttacccagagtgcccctggatgtgtgtttaaaggcccctaaagaacagcaaaaagctgaggctaccgagcccttaaagtcggcaaagccaggacaagaggaagacggcccgctcaagggaaagggccagggggccaccacggcggacggcaagggaaaggagaaaaaagcacctcccctcctggaaggcgctccgctgcgtcttaagccacgttcaattcatgagctctccgtagagcaacaattgtactacaaagaaataaccgaagcttgtgtagggtcttgcgaggccaagcgtgccgaggccctgcagagcatcgctaccgatcctggtttataccaaatgctcccccgcttcagtactttcatctctgaaggagtgcgcgtcaatgtcgtgcagaataacttagcactgctcatctatctgatgaggatggtaaaggccctaatggataatcccacgctctatctggagaaatacgtccacgaactcatcccggccgtgatgacctgtattgttagccgccaactgtgcctgcggccagatgtggacaatcactgggccctccgagatttcgccgctcgcctcgttgcccagatttgtaaacacttttctacgactactaacaacatacagtcgcggatcacaaagacatttacgaagagttgggtggacgagaagacaccatggacgactcgttacggatccatcgctggcctagcggagctggggcacgatgtcatcaagacccttatcttacctcggctgcaacaagaaggagaaagaatccgcagcgtgctggacgggccagtacttagtaatatcgataggattggagctgaccacgtccaatctctattgcttaagcactgcgctcccgtcttggcaaagctgcggccaccacccgataatcaggacgcttacagggccgagtttggctcactggggcctctcttatgctcccaagttgtcaaagctagggctcaggccgctctccaggcacagcaagtcaaccgcactacgctaacaatcactcaaccacgaccaaccctgactctgtctcaggccccacagccaggacccaggacaccaggacttctgaaggtgcccggttctattgctttgcctgtgcaaactttggtcagcgcacgcgcagcagcccccccgcaacctagtcctcctcctaccaagtttatcgtgatgtcctcttctagttccgcaccatccacacagcaggttctatcgttgtccacctccgccccaggaagcgggagcactaccacttcccccgttacaactactgtacctagcgtgcagcctatcgtgaaactggtgtcaaccgcaaccactgctccgccttccaccgcaccatctgggccaggttctgttcagaaatacatcgtggtgtccctcccaccgacgggcgaaggcaagggcggacccacaagccacccttcaccggtacccccacccgcctcaagcccttcccctttgtctgggtctgccctgtgcggcggcaaacaggaggccggagattcccctcctcccgcccccgggaccccaaaagccaatggatctcagccaaattcaggctctccccaacctgccccctag

SEQ ID NO: 137168 - DNA, 45 bp, Artificial Sequence
  Description of Artificial Sequence: Synthetic coding sequence
atggccgaagaaaagaagctcaaattgagcaacaccgtactgtag

SEQ ID NO: 137169 - DNA, 2145 bp, Artificial Sequence
  Description of Artificial Sequence: Synthetic coding sequence
atgactaaacgacggctccagactatcaccgcctgcttacagctccgagagggttcgccaagtctgcatagaggcctacatccttctcgagaagaaaaacgggatagcagaatggcggaggagaagaaactcaagttgagcaacactgtgcttccaagtgagagcatgaaggttgtcgccgagagcatgggcattgcacagatacaagaagagacgtgccagcttctgacggacgaggtcagttaccgcatcaaagagattgctcaggacgctctcaagttcatgcacatgggaaagcgtcagaagctcaccacctctgatattgattacgctctgaagctaaaaaacgtggaacctctgtatggctttcacgcccaagagtttattcccttccggtttgcttcagggggaggacgggagctttatttttacgaagagaaagaggtcgacctgtccgatattatcaacactccactgccccgtgttcctttggatgtttgtctcaaagcacactggctgtctattgagggctgccagcctgctatccctgagaatcccccccccgcgcctaaagaacagcagaaggccgaggcaactgaacccctgaagtccgccaagccagggcaggaagaggacggcccactgaaaggcaagggacagggagccacaacagccgatgggaagggaaaggagaaaaaggccccacctttgttggagggagctcccctccgactgaaacctaggtccatccacgaactgtctgttgagcagcagctttactataaagaaattactgaagcatgcgttggcagctgtgaggctaaaagggcagaagctcttcagagtattgccacagatcccggtctgtatcaaatgctaccacgattttcaacgtttatctcggaaggcgtgcgcgtgaacgttgttcagaacaacttagcattgctcatatatctgatgcgtatggtgaaggccttaatggataaccctacactctacctggagaagtacgtgcatgaactgattcctgcagtgatgacttgcatcgtcagccgtcagctgtgtttgagacctgatgttgataaccactgggcgcttcgcgacttcgcggcccggctggtggcgcagatctgcaaacacttttccactaccacgaataacattcagtcaaggattaccaaaacattcactaaatcatgggtggatgagaagactccctggaccacacgatatggttctattgctgggctcgctgaactgggtcacgacgtaatcaaaacactcatcctcccccggctgcagcaggaaggtgaacggattcgctcagtcctggacggtccagttctgagtaatattgaccgcattggagcagaccacgtccaaagtctgttactgaagcactgcgcacctgtgctggccaaacttagaccgccgccagataatcaggacgcctatagagccgagtttggatccttggggccactactgtgttcacaagtggtgaaggcacgggcccaggcagctctgcaagcgcaacaggtcaaccgcaccacactgactattacccagccaagacctacactaaccctgtcccaggctcctcagcccggcccacgcacgcccggcctgctgaaggtgccgggctccattgcactccctgttcagacactcgtatctgcacgcgccgccgcaccccctcagccctctccacccccaaccaagtttattgtaatgtcgagctcatccagtgcgccgagcactcaacaggtgcttagcctcagcacctcggcccccggctccggctcaaccaccaccagccctgtaactacaactgttccttcagttcagccgatcgtaaagctggtgagcacagccactacagcccccccctcaactgccccaagtgggcctggctccgttcagaaatacatagtggtgtctttaccaccaacgggtgaaggaaaggggggacctaccagtcaccccagcccagtcccacctcctgcttctagtccatctccactgtctggctccgcactgtgtgggggcaaacaggaagccggagattccccaccccccgctccagggacgccaaaggccaatgggtctcaacccaactccggatcacctcagcctgccccttag

SEQ ID NO: 137170 - DNA, 702 bp, Artificial Sequence
  Description of Artificial Sequence: Synthetic coding sequence
atggccgaggaaaagaagctaaagctgtccaacacggttcttccatctgaatccatgaaggtggttgctgagtccatgggcatcgcccagattcaggaagaaacctgtcagttgctcactgacgaagtttcctacagaatcaaagagatcgcccaggatgccctcaagtttatgcatatgggaaagcggcagaagctgaccaccagcgatatagactacgctcttaagctgaagaatgtggagcctctatatggtttccatgcccaggaattcatacctttccggttcgcatcgggcggcgggagggaactttacttctatgaggagaaggaagttgatctctccgacattatcaacacccctctcccacgcgtgccactggacgtgtgcctgaaggcccccaaggagcagcaaaaggcagaggcgactgagccgctgaagtctgccaaacctggacaggaagaagatggtccattgaagggaaaaggccaaggcgcgaccacggctgacggcaagggaaaagaaaaaaaggcacccccattgcttgagggagctccgctgcggctgaagccgcgctctatccatgagcttagcgtagagcagcagctgtattataaagagatcaccgaagcgtgtgttggtagctgtgaagctaagagggccgaggcactacagtcaatcgccacagaccccgggttatag

SEQ ID NO: 137171 - DNA, 405 bp, Artificial Sequence
  Description of Artificial Sequence: Synthetic coding sequence
atggccgaagagaaaaagcttaaactgtccaacacagttctgcccagcgaatctatgaaggtggtggccgagtcaatgggcattgcgcagatccaggaggagacatgccaattgctcaccgacgaggtctcatatcgcataaaagaaatcgctcaagacgctctcaaattcatgcatatgggcaagagacagaagctgaccacaagtgatattgactacgctctaaagttgaaaaatgtcgaacccctgtatggatttcatgcccaagagttcatccccttccgcttcgcgtcagggggaggcagggaactgtatttttatgaagaaaaggaagtggatctatccgacattatcaataccccgctgcccagggtcccccttgatgtgtgtctcaaagcacactag

SEQ ID NO: 137172 - DNA, 345 bp, Artificial Sequence
  Description of Artificial Sequence: Synthetic coding sequence
atggcggaagaaaagaagttgaaattatcaaacaccgtccttccatcagagtcaatgaaagtggtggccgagtcaatgggtatcgctcaaattcaggaggagacctgtcagttgcttaccgacgaggtgtcttacagaatcaaggaaattgcacaagacgccctcaagtttatgcacatgggaaaacgccagaagttaactacgtctgatattgactatgccttgaaactgaaaaacgtcgagcccttatacggcttccacgcacaagagtttattcccttcagattcgccagcggaggcggacgggagctgtatttctacgaggaaaaggaggtcgatctgtag

SEQ ID NO: 137173 - DNA, 2034 bp, Artificial Sequence
  Description of Artificial Sequence: Synthetic coding sequence
atggctgaggagaagaagctcaaactgagcaatacagtgctcccctcagaaagcatgaaagttgtggcagagtccatggggatagcgcagattcaagaagagacctgccaattgctgacggacgaggtctcttacagaattaaggaaattgcacaggatgccctcaagtttatgcacatgggaaaacgccagaagctcacgacctccgacattgattacgccctgaaactgaagaacgtggaacctctgtacggctttcatgctcaggagttcattcccttcagattcgcttccggcggcgggcgagagttatacttctacgaagagaaggaggtggacctgtctgacattatcaatacaccactgcccagagtacctctagacgtgtgcctaaaggcccactggttgagtatcgagggatgtcagccggccattccagaaaacccacctccagcccctaaggagcagcagaaagctgaggccaccgaacccctcaagtccgccaaaccaggccaggaagaggatggccctttgaaagggaaaggacagggagccactactgccgacggcaaagggaaggagaaaaaagcccctcctctccttgagggtgccccattaagattaaagcctaggtcaatacatgagttgagtgttgaacagcagctttactacaaagaaataactgaggcctgcgtcgggagctgcgaggctaaacgcgctgaagccctgcagagcattgcgacagacccaggtctgtatcagatgctgcccagattttcaacgtttattagcgaaggggttcgggtgaatgtggttcagaataatttggcgctactcatctatctcatgaggatggtaaaggctctgatggacaatcccacgctttaccttgagaagtacgtccatgaactgattcctgctgtgatgacttgcattgttagccgacagctgtgcctccgcccagatgtcgacaatcattgggcgctgcgcgactttgccgccagactggttgcccaaatatgtaagcatttctccacaacgactaacaatatccagagcagaattaccaaaaccttcacaaaatcttgggtcgacgagaagaccccttggaccacacggtacggcagtatcgcaggtctggcagagttaggccacgacgttatcaaaacactcatcctccctaggttacagcaggagggcgaacggatacgctcggttctggacggacccgtgctgtctaacatcgatagaatcggcgccgatcatgttcagtctcttcttctcaaacactgtgctccggtattggccaagctcaggccccccccagataatcaggacgcttatcgggcagagtttggttcacttggccccttactgtgcagccaggtagtgaaggcacgcgcgcaggctgccctgcaagcccaacaggtgaataggacaaccctaacaattacacagccccgccctactctgactcttagccaggccccccagcctgggcctagaacgcctgggctgctgaaggtgcctggatccattgcattgcctgtgcagaccttggttagtgcccgagccgcagccccgcctcagccctcacctccaccaaccaagtttatagtcatgtcttcatcatcaagcgcgccctctacccagcaggtgctgagcctttcaactagtgccccgggatccggctctaccacgacatctccagtgactactaccgtgccctccgtccagccaatcgttaagctggtatcaactgcaacgaccgccccaccatcaacggccccatcaggtccaggatccgttcagaaatacatcgtggttagtttgccacccaccggtgaaggcaagggtggcccgacttcccatcccagccctgtgcccccccctgcgagctcacccagcccgttatctggctccgccttgtgtggcgggaagcaggaggcaggcgactccccgccaccagcgcccggaactcccaaagccaatggctctcagcctaactcagggtctccccagcccgcaccatag

SEQ ID NO: 137174 - DNA, 2034 bp, Artificial Sequence
  Description of Artificial Sequence: Synthetic coding sequence
atggctgaggaaaagaagctgaaactgagcaacactgtgctgcctagtgaaagtatgaaggtagtggcagagagcatgggaatcgctcagatccaggaggaaacatgtcagctccttactgatgaagtgtcctaccgcatcaaggagatagcccaagacgcacttaagttcatgcatatgggtaagcgacagaaactaacgacgagcgatattgattacgcccttaagcttaaaaatgttgaacccctgtacggattccatgcccaggagtttattccgttcagattcgcttccggcggaggcagggaactgtacttctacgaagaaaaagaggtcgacctctccgacatcataaatacacctctcccccgtgttccgctggacgtctgtctgaaagcccattggttgtccatcgaagggtgtcagcctgccatacccgagaatccccccccagcccccaaggaacagcagaaagctgaggcaactgagcccctgaagagcgcaaaacccgggcaagaggaagatggaccactcaaagggaaaggacagggagccacaacagccgatggtaaagggaaggagaaaaaagctcctcctctgttggagggtgcacctttaagactgaagccacggtctatccacgaactgtccgttgagcagcagttatattataaggaaataaccgaagcatgtgtcggctcgtgcgaggccaagcgggcagaagcactgcagtccattgctaccgacccggggttgtatcaaatgctgccgagattctccacgttcatctctgaaggcgtgcgggtaaacgtggtgcagaataacctggcattgctgatctacctgatgcgaatggttaaggctctaatggacaatcccactctgtatctagagaagtacgtccacgagttaatccccgcggtgatgacttgcatagtgagtcgacaactgtgtctcagacctgatgtcgacaatcattgggctctgagagatttcgcagcaaggttggtggctcaaatttgcaagcatttctcgaccactaccaacaacatacaatctcgcattacaaagacatttactaaatcttgggtggacgaaaaaacaccttggaccacacgttatggaagtatcgcgggcctcgctgaactgggtcatgacgtcataaaaactctcatcttgcctagactgcagcaggaaggcgaaaggatacgcagtgtgcttgatggacccgtgttgtcaaatatcgaccgtattggagctgaccatgtgcagagtctcttattgaagcactgtgctcccgttctggctaagctgcgccccccgccagacaatcaggatgcttatcgagccgagtttggtagcctgggccccctcctctgctctcaggtcgttaaggcgagggcccaggctgctcttcaggcacagcaagtaaacaggacaacactgacaatcacccagccgagacccaccctgactctctctcaggcaccccaaccggggccccggacccctggactcctcaaggtccctgggtccatcgcattgcccgtccagactctggtgtcagcgagagccgctgcccccccccagccctcaccaccccctactaagtttatagtgatgtcttcatcttccagcgccccatctactcaacaggtactgtctctgtccactagcgcacccggcagtgggtccaccactacttccccagttaccaccactgtaccctcagtgcaaccaattgttaagttagtctctacagccactaccgcccctccttctacggcccctagcggccctgggagcgttcaaaaatacatcgttgtgtctttaccacctacaggagagggcaagggcggaccaacctctcatccctcaccagtccctccacctgcttcaagcccttctccactttctgggtcagccctgtgtggtggcaagcaagaggcaggagattctccccctcctgctccgggcacccccaaagccaatgggagccagcccaatagtggttcccctcagccggctccctag

SEQ ID NO: 137175 - DNA, 30 bp, Artificial Sequence
  Description of Artificial Sequence: Synthetic coding sequence
atggcagaagagaaaaagcttaaattgtag

SEQ ID NO: 137176 - DNA, 2205 bp, Artificial Sequence
  Description of Artificial Sequence: Synthetic coding sequence
atggatattcggcacagcgaattcctgccctgtcttcactgtccccctttcgtgggccctctgcccgtttctcacgtttccttctcctctgcttgccccgtccccctccccggaagcccaagcctgcaccggggcttgcaccccagcagagaggaaaagcgcgacagtagaatggcagaggagaaaaagcttaagttatcaaataccgtcctgcccagcgagagtatgaaagtcgttgccgagtccatgggcattgcccagatccaggaggaaacctgccagcttctgacagacgaggtgtcctaccggatcaaggagattgcacaggacgctctaaaatttatgcacatgggaaagaggcagaaacttacaacctccgacatagactacgccctgaagttaaagaacgtggaaccactttacgggtttcacgcccaggaattcattccctttaggtttgcttctggcggtggtcgggagttgtacttttatgaggaaaaggaagtggatctgtccgacataatcaacacgccacttccgcgcgtccctctggacgtatgcctaaaagcgcattggttgagcattgaaggttgccagccagcaattccagagaacccgccacccgcccccaaagagcagcagaaggctgaggccaccgagcctctgaagtcggccaaacctgggcaagaagaggacggacctcttaaaggcaaaggccagggtgccacaactgccgatggcaagggtaaggaaaagaaagcacccccactgcttgaaggggctccgctccgcctaaaacctcgcagcatccacgagctaagcgtcgaacagcagctgtactataaagagatcaccgaagcttgcgtaggttcttgcgaggctaaaagggccgaagctcttcagtcaattgctacagacccagggctgtatcagatgctgcctcgattcagcactttcatctctgagggtgtacgagtcaatgtggtgcagaacaacctggccctgctaatctatttgatgcgaatggttaaagccctgatggacaaccccacactctatctcgagaagtatgtccatgagctcatccccgctgtcatgacctgtatcgtttcccggcaactgtgcctcaggcccgatgttgataaccactgggcgctaagggattttgccgctcgacttgtagcacagatttgcaaacacttctcaacaaccactaataatattcagagtaggatcaccaaaacattcaccaaaagttgggtcgacgagaagacgccctggactaccaggtacggctccatcgcaggcctggccgaactggggcacgacgtcattaaaacgctgatccttccaagactccagcaggagggagagagaattcggagcgttttggatgggcctgtactgtctaatattgaccgcattggagctgaccatgtgcaatctttgctgctcaaacactgtgcgcccgtgctggcaaagttgagacctcccccagacaaccaggacgcctaccgggcggaatttggtagtctcggacctctgttgtgttctcaggtcgtaaaagcacgggcccaggctgcccttcaagcccaacaggtcaatcgcaccaccctgacaattactcagcccagacctaccctgaccctctcgcaagcccctcagcccggtccacgtacaccaggcttgctcaaggtacctgggtccatcgctctccctgttcagacgctcgtttctgccagggccgcagcacccccacaaccatcacctccacccacgaagtttatcgtaatgagctcttcctcctccgccccatcaacccagcaggttctcagcctttcaactagtgctcccggctccggttccacgaccacgtctcccgttacaaccacagttccttcggttcagccaatcgttaaactagtgtccacagcgactacggcgccaccctctaccgcaccatcaggacccggaagtgtccagaaatatattgtagtctctcttccccccaccggcgaaggcaagggagggccaacaagccatccctctcctgtgccaccaccagcaagtagccccagcccccttagcggcagcgccttgtgtggtgggaaacaggaagcaggagattcccctccacccgcccctggtacccctaaggctaatggcagccagcctaattcaggatcaccccagccagctccatag

SEQ ID NO: 137177 - DNA, 768 bp, Artificial Sequence
  Description of Artificial Sequence: Synthetic coding sequence
atggccgaggaaaagaaacttaaactcagcaacactgttctcccctcagagagtatgaaagtggtcgcagaatctatggggatagcccagatacaggaagaaacctgccagctgctgacggatgaggtgtcatatcggatcaaagaaatcgctcaggacgcactcaaattcatgcatatggggaaaaggcagaaacttactacttccgatattgattatgccctaaagctgaagaatgtcgagcccctatacggcttccacgcacaggagtttatcccattcagattcgcctctggaggaggtcgcgagctttacttctacgaagagaaggaagtcgacctgagcgacattatcaatacacccttgcccagggtgccactcgatgtgtgcctgaaggcacactggctatctattgaagggtgtcaacctgcaataccagaaaaccctccaccggccccgaaagaacagcagaaagcggaagcgaccgagcccctgaagtccgctaagccaggacaagaggaggatgggccattaaaggggaaagggcagggtgccacaacggcggacggcaagggaaaggaaaaaaaggcaccaccactccttgagggcgcacccctgaggcttaagccgagaagtatccacgaattgtcagtggagcagcaattgtattataaggaaatcaccgaagcatgcgtcggttcatgtgaagctaagagggccgaggcgttgcagagcatagcgaccgatcccggtttgtaccagatgtag

SEQ ID NO: 137178 - DNA, 1050 bp, Artificial Sequence
  Description of Artificial Sequence: Synthetic coding sequence
atgtcaaaatccaaggatgatgccccacacgagctggagagccaatttatactgcgattgccgccagaatacgcatctactgtgcgcagagccgtgcagagtggccatgtcaatctcaaggatcggctaaccatcgagttgcatcctgacggcagacatggaatcgtacgcgttgacagggttcccctggcttccaagttagtggatctgccttgcgtgatggagagtctcaagactatagataaaaagactttttataagaccgctgatatatgccagatgttggtgtcaaccgtggatggtgacttgtaccctcccgtggaggagccagtggcgtcaaccgatcctaaggcgtctaagaagaaggataaggataaggagaagaagttcatctggaatcacggcatcaccctgccccttaaaaacgtgcgtaaaaggcggttcaggaagaccgccaaaaagaagtatattgagtcacccgatgtggagaaagaggtgaagcggctactgtccactgacgctgaggcggtgtccactagatgggaaatcattgcagaggatgaaaccaaggaagcagagaaccagggcctcgacataagtagccccggcatgagcgggcacaggcaggggcacgacagcctcgaacatgatgaattgcgcgaaatctttaatgacttaagctccagtagtgaagatgaggacgaaactcaacaccaggatgaggaagacattaatatcattgacactgaggaggatctggaacgccaactgcaagacaagctgaatgagtctgacgaacagcatcaggaaaacgaaggtaccaaccagctggtgatggggatccagaaacaaattgacaacatgaaggggaagctgcaagagacccaggaccgggctaaacggcaggaggaccttatcatgaaggtggagaatttggctctaaaaaatcgtttccaggccgtcctagatgagctgaagcaaaaggaagatcgcgagaaagaacagctttccagcctccaggaagaattagaaagcctactggagaagtag

SEQ ID NO: 137179 - DNA, 909 bp, Artificial Sequence
  Description of Artificial Sequence: Synthetic coding sequence
atgtcagaaagtcaggatgaggtgccagacgaggtagaaaatcagtttatccttcggttacccctggagcatgcttgtaccgtgcgtaacctagcaaggagccagagcgtgaaaatgaaagataagctgaaaattgacctcctgcccgatggccgccatgcagtggtagaggtggaggacgtaccactagccgcaaagctcgtggacctcccttgcgttatcgaatcactcaggactctagataagaaaactttttacaaaacggctgacatatcgcagatgctggtttgcacagcggacggtgatattcatttgtctcctgaagagccagccgcatctactgacccgaacatcgtgcgcaagaaggaaaggggacgggaggagaagtgtgtgtggaaacatggtattaccccacccctaaaaaacgtaagaaagaagagatttagaaaaacccagaaaaaggttccagacgtgaaagagatggaaaagagtagcttcaccgagtacattgagtcacccgatgtggagaacgaggtgaaaagactgttgagaagcgacgcggaagctgtgtccacgaggtgggaagtgatcgcagaggatggtactaaggagatcgaaagccaaggaagcattcccggctttttaatctccagcggtatgagttcacacaagcaaggccacaccagctccgtgatggagatccaaaaacagatagagaaaaaagaaaagaagctgcacaagatccagaataaagcccaaagacaaaaggatttgatcatgaaagtcgagaatcttaccctcaagaaccattttcagtccgtgctcgagcagcttgagctgcaagaaaagcagaagaacgagaaacttatctcgcttcaggagcaacttcagcgatttctgaagaaatag

SEQ ID NO: 137180 - DNA, 1131 bp, Artificial Sequence
  Description of Artificial Sequence: Synthetic coding sequence
atgagcgaatctcaggacgaggtgcccgatgaggtcgagaaccaattcattctgcgtcttcctctggagcacgcgtgcaccgtgagaaacttagcgagaagtcagtcagtgaaaatgaaagataagctgaaaatcgacttgttgcccgacggacgtcatgctgtggtggaggtggaggatgtgcctcttgcggccaaattggtcgaccttccatgcgtcattgagtctctgaggactcttgataagaagacgttttacaagactgctgatatctcgcaaatgctggtatgtacagccgatggggacatccacttgtctcccgaagagccagccgctagcacggacccaaacatagtgcgcaagaaggaacggggcagagaagagaagtgcgtctggaagcacggcataaccccacctctgaagaatgttcggaagaaacgtttccggaagacgcaaaaaaaggtaccggatgtgaaagagatggagaagtcttcctttacagagtatattgaatctccagacgtggagaacgaggtaaagcgtcttctgcgctccgatgccgaagcagtttccacccgctgggaggttattgcagaggatgggactaaggaaatagagtcccagggaagtatccctggttttctgatctctagtggcatgtcaagccacaaacagggacacaccagtagcgagtatgacatgttgagagagatgttttctgactcgcggtccaacaatgatgatgacgaggacgaggatgacgaggacgaagatgaagatgaggacgaagatgaggatgaggataaggaggaggaggaggaagattgtagcgaggaatatttggagcgccaacttcaggccgagtttatcgagagcgggcaatatcgcgctaacgagggcaccagcagcattgtgatggagatccaaaaacaaatcgaaaagaaggaaaagaagctccacaagattcaaaataaggctcagcgtcaaaaggacctaattatgaaggtggaaaaccttaccctgaaaaaccatttccagtctgtgctagagcagctggaacttcaggagaaacagaagaatgagaaactcatcagcctacaggaacagctacagcggttcctgaaaaagtag

SEQ ID NO: 137181 - DNA, 909 bp, Artificial Sequence
  Description of Artificial Sequence: Synthetic coding sequence
atgtcagagagtcaggacgaagtccctgacgaagtcgagaaccagtttatattaagattgcccctcgaacatgcctgtacagtgaggaatctcgctcggagtcagagcgtgaagatgaaagataagctcaaaatcgacctgctccctgacggccgacacgctgtggtggaagtggaagacgtgcccttagccgcaaagcttgtggacctcccctgtgtcattgagagcttaaggacactcgacaagaagaccttttacaaaaccgccgacattagccagatgctggtctgcactgcggacggcgatatacacctgagccccgaagagccagctgcctcgacggatcctaatattgtccgaaagaaggagcgcgggcgcgaggaaaagtgcgtgtggaaacatggtataacccccccactgaagaacgtgagaaaaaaaagattccggaaaactcagaaaaaggtgcccgacgtcaaagagatggaaaaaagtagcttcactgagtacatcgaatcaccagacgtggaaaacgaggttaagcgactccttagatctgacgctgaggctgtgagtacgcgctgggaagtgatagctgaagacgggaccaaggaaatcgagagtcagggatctatacctggattcttaatttccagtggaatgtcaagccacaaacagggtcataccagctctgtcatggaaatccagaaacaaatcgagaagaaggaaaagaaactccacaagatacagaataaggcgcagaggcagaaggacctcataatgaaagtagagaaccttactctgaaaaatcactttcagtccgtgcttgaacagttggaattgcaggagaaacagaagaacgaaaaattgatttccctgcaggaacagctgcagaggttcctcaagaagtag

SEQ ID NO: 137182 - DNA, 1389 bp, Artificial Sequence
  Description of Artificial Sequence: Synthetic coding sequence
atggaatgtcccgagggacagctgcccatcagcagtgagaacgactcaactcctacagttagcaccagtgaggtgacatcccagcaggaacctcaaattctggttgatcgtggctctgagaccacgtacgagagctcagccgacattgccggcgacgaaggtacacaaattccagcggatgaggacactcagaccgatgccgatagcagtgcacaggccgccgcccaggcccccgagaactttcaggagggaaaggacatgagtgagagccaggatgaggttcccgatgaagtcgaaaatcagtttattcttcggctacctcttgagcatgcatgcaccgtaagaaatctcgcacgatcccagtcagttaaaatgaaagataagcttaagatcgatctcctgcctgatggacgacacgcagtggtagaagtggaggatgtgccgctagctgccaagcttgtggacttgccttgcgtgatcgaatctctccggactcttgataagaaaactttctacaaaacagccgacatttcgcagatgctggtatgcactgccgacggtgacatacatctctctcctgaagaacccgccgcgtccactgatccaaacatcgtacggaagaaagaacgcggtagagaagagaaatgtgtgtggaagcacggaatcactcctcccttaaagaacgtccgcaagaaacgcttccggaaaacacaaaagaaggtccccgatgtgaaagaaatggagaaaagttcctttaccgaatacattgaatctccggatgttgaaaatgaagtgaagcgcttattgcgttcggatgccgaggcagtctccactagatgggaggtaattgctgaagacgggacaaaggagattgagagccaaggatccataccaggattccttatctccagtggaatgtcatcccacaagcagggtcatacctccagcgaatacgacatgcttagggaaatgttctccgacagtaggagcaataacgatgatgatgaggatgaagatgatgaagatgaggacgaggacgaggatgaggatgaggacgaggataaagaagaagaagaagaggattgtagcgaggaatacctcgagaggcaactccaggcagaatttatcgagtctggacagtatcgcgctaacgaaggcacttcatccatcgtcatggagatacagaaacagattgaaaaaaaggagaagaaactgcacaagatacagaataaagcccagcgtcaaaaggatctgatcatgaaggtggaaaatctgactcttaagaatcattttcaatccgtcctggagcaactggagctgcaagagaaacaaaaaaacgagaagctcatcagtcttcaagagcagttgcagagatttcttaagaagtag

SEQ ID NO: 137183 - DNA, 1548 bp, Artificial Sequence
  Description of Artificial Sequence: Synthetic coding sequence
atgggcaactgggtcgtgaatcactggttttcagtcttgtttctggtagtgtggctggggctcaacgtatttctgtttgttgacgcctttctgaaatatgaaaaagccgataaatactattatactcgtaaaatcctgggatccaccctcgcctgtgcccgcgcgagcgcgctttgtttaaactttaattccaccctgattctgctgccagtctgccgcaaccttctctcctttctgcgcggaacttgcagcttttgctctcgcaccctgagaaaacagctcgaccataaccttaccttccataaacttgtggcctacatgatttgtttacacaccgccatccacattattgcccatctctttaacttcgactgctactcgaggagtagacaggccaccgacgggagtctggcctccatcctctccagtttgagccacgatgaaaagaagggagggtcctggctgaatccgattcagtctagaaacactacagtggagtatgtcactttcacttccattgccggactgacaggagtgatcatgacgatcgcactgattctgatggtcactagtgccacagagttcatccgcagatcctatttcgaggtgttctggtacacacaccatctgttcattttctatatcttgggcttaggcatacacggcatcggaggaatagtaaggggacagaccgaggagtcgatgaacgagtcgcacccgcgaaaatgcgcagagtccttcgagatgtgggacgatagggacagccattgccgccgtcccaaatttgagggacacccccctgagagctggaaatggatcctcgctccggtgattctgtacatctgtgagaggatccttagattttacagatcgcagcaaaaggtggtcataactaaagtcgtcatgcacccttcaaaggtgttagagctgcagatgaataaaagaggcttttctatggaggtaggacagtacatctttgttaattgtccatctatttcgctcctggaatggcatcccttcaccttgacttccgctccggaggaggacttcttctctatacacattcgagcagcaggagattggaccgagaatctcattcgggccttcgagcagcagtacagtcccataccacgcatagaagtcgatgggccattcggaacagcctctgaagacgtctttcaatacgaggtagccgtcttggtcggagccgggattggagtaacccctttcgcgagtatcctgaaatccatctggtacaagtttcagtgtgccgaccataatctcaagaccaaaaaggttggccacgcggcgcttaatttcgataaagctaccgacatcgtgacgggactgaaacaaaaaacttccttcggaaggcccatgtgggataatgaattttctaccattgctacaagccacccaaaatctgtcgttggggtgttcctctgtggccccaggacactggcaaaatcactgcgcaaatgttgccatcgatacagctcccttgatcccagaaaagttcagttttatttcaataaagagaatttttag

SEQ ID NO: 137184 - DNA, 795 bp, Artificial Sequence
  Description of Artificial Sequence: Synthetic coding sequence
atggagtcaggtaagacagcttcccccaagagcatgccaaaggacgctcagatgatggcgcaaatccttaaagatatgggcattactgagtacgaaccacgagtgatcaatcaaatgctggagtttgcctttcgatatgtgaccaccatactcgacgatgccaagatttatagtagccatgcaaagaaagccaccgtagatgctgacgacgttagactcgctatacagtgtagagccgaccagtccttcacctcaccaccaccgagggattttctgttagacatcgcccggcagagaaatcagacacctttacccctgatcaagccctattccggtccacggctgcctcctgatcggtattgtctgacggcccccaattaccgtctgaaatccctccaaaagaaggcgtccacgagcgcaggacggatcacagtgccacggctgtctgtgggaagcgtgacatcccgtccatcaacacccaccctggggacaccgacccctcagactatgagtgtgtcaactaaggtcggtacaccaatgtctctgactggccagcggtttaccgtacagatgcccactagccagtctcctgccgtgaaggcttcaatacctgcaacgagcgctgtccagaacgtgctgatcaacccgtctcttatcggttctaaaaatattctaattacgacgaacatgatgtcctcccagaacactgcaaatgaatcgagtaacgcactgaaacggaaacgggaagatgatgacgacgacgacgatgacgacgatgattacgataacctttag

SEQ ID NO: 137185 - DNA, 510 bp, Artificial Sequence
  Description of Artificial Sequence: Synthetic coding sequence
atgtgccataggaagccaggcacccctggtgtggggaagaccactctgggtaaggagctcgcttccaagtctggcctcaagtatattaatgtcggcgatcttgctcgagaggagcagctgtatgacggttatgacgaggagtatgattgtccgatcctcgacgaggatcgggtcgtcgacgaactggacaaccagatgagagagggcggggtgattgtagattaccatggctgtgacttctttccagaaaggtggttccacatagtgtttgtgctgcgcaccgacactaatgtcctgtacgaacggttagaaacacgaggctacaatgagaaaaaactgactgacaacatccagtgcgagatcttccaggtcctgtacgaagaagcaactgcatcttataaggaagagatagtgcaccaactccccagcaacaagcctgaagagttggagaacaacgttgaccagatccttaaatggatcgaacaatggattaaggaccacaacagttag

SEQ ID NO: 137186 - DNA, 519 bp, Artificial Sequence
  Description of Artificial Sequence: Synthetic coding sequence
atgctgcttcccaacatactactgacaggaactccaggagtgggcaagaccacactcggaaaagagcttgcatcaaaatctggactgaaatatatcaatgtcggggacctggctagagaagaacaactttatgacggttatgatgaggagtacgattgtcccattctggatgaagacagggtcgtggatgaattagacaaccagatgcgggagggcggggtcatagtggattaccacggctgcgatttctttcctgaaagatggtttcatattgtgttcgtgctgcgcacagacacaaatgttttgtacgagcgactggaaacacgcggctataatgagaagaagctgaccgataacattcagtgcgagatcttccaagtcttgtacgaagaggcaaccgcgtcctacaaggaggagattgtccaccagttgccaagcaacaagccggaggagctggaaaataacgtggaccaaattttaaaatggatcgagcagtggatcaaggatcacaacagctag

SEQ ID NO: 137187 - DNA, 597 bp, Artificial Sequence
  Description of Artificial Sequence: Synthetic coding sequence
atggagtccggcaagaccgcctctccaaaatccatgccaaaagatgcccagatgatggctcagattctcaaagacatgggtataactgaatatgaaccaagagtgatcaaccagatgctcgagtttgctttcaggtatgttacaaccattctggatgacgctaaaatatacagttcccatgccaagaaggctactgttgatgccgacgacgtaaggttggcgatccagtgtcgggctgaccagagcttcacttcacctccgcctcgggatttcctgctcgatatcgctcgccagcgtaaccagacacctctgcccctgataaaaccttacagcgggcctagacttccaccggatcggtactgcctgactgcaccgaactaccgattaaagagcctgcagaagaaggcatccacgtcagctggccgcataacagtcccccgactcagtgtagggtcagtgacttcaaggccatcaaccccaactctaggaaccccaaccccccagaccatgagtgtgtcaacgaaggtgggaaccccgatgagcttaactggtcagcggttcaccgtccagatgcccacctcccagtcacctgcatag

SEQ ID NO: 137188 - DNA, 411 bp, Artificial Sequence
  Description of Artificial Sequence: Synthetic coding sequence
atggagtcaggtaagacagcttccccaaagtctatgcctaaggacgcacagatgatggcacagatcctcaaagatatgggtattactgagtatgagcctcgggtcataaaccagatgcttgaattcgcctttcgatacgtcaccacaatacttgatgatgcaaaaatctactccagccacgcgaaaaaggcgacagtcgacgccgacgatgtgcggctagcaatccagtgtagggctgatcagtccttcacttctccccctccgagggacttcctgcttgatatcgctaggcagaggaatcaaacacccctcccgctaattaagccctattcagggcccaggttaccccctgatcgatactgtctgacagctcctaattatagactcaagtccctacagaagaaggcttag

SEQ ID NO: 137189 - DNA, 795 bp, Artificial Sequence
  Description of Artificial Sequence: Synthetic coding sequence
atggaaagcggaaagactgcatctccaaaatctatgccaaaagatgcacaaatgatggctcagattctaaaagatatgggcataaccgaatatgagcctcgcgtgatcaatcaaatgctcgaatttgcatttcggtatgtaactactatactggacgacgcaaaaatatattcctcgcatgctaagaaagccacagttgacgcagatgatgtccggctcgccattcagtgccgagccgatcaatcattcacctcaccccctcccagagacttcctgctcgatattgcgcggcaacgaaatcagactccactgccattgattaagccatactccgggcccaggctgccccctgaccgatattgcctgaccgcccccaactataggcttaagtccctccagaaaaaagcatccacaagcgcgggcagaatcaccgtcccccggctctccgtcggcagtgtgacttcgaggccgtctacacccactttgggtaccccgaccccccagacaatgtctgtatctacaaaggtgggtacacctatgagtctgaccgggcaacgctttaccgtgcaaatgccaacatctcaatcccccgcagtcaaggcatccatccctgctacctctgccgtgcagaatgtcctcattaatccatccctcatcggttccaagaatatcctcattactacaaacatgatgtcatctcaaaatacggcaaatgaatcttcgaacgcccttaaacggaagagagaagacgacgatgatgacgatgacgacgatgatgactatgataatctgtag

SEQ ID NO: 137190 - DNA, 309 bp, Artificial Sequence
  Description of Artificial Sequence: Synthetic coding sequence
atggaaagtggcaaaactgcatccccaaaatccatgccaaaagacgctcagatgatggcgcagatcctgaaagacatggggataactgagtatgaacctcgagttatcaaccaaatgctggagtttgcctttagatatgtgacaacgattctcgatgatgcaaagatatattcttctcatgctaaaaaagccaccgtggacgccgacgacgtcaggctggccatacaatgtagagctgaccagtcttttacctctccgcccccgcgggacttcctgcttgacatcgctagacagaggaatcagacctag

SEQ ID NO: 137191 - DNA, 501 bp, Artificial Sequence
  Description of Artificial Sequence: Synthetic coding sequence
atggaaagtgggaaaactgcctcccctaagagtatgccgaaagacgcgcagatgatggcccagatcttgaaggatatgggcattacagagtacgagccccgagttatcaatcaaatgttggagtttgccttccggtatgtcacaactatcctagatgacgccaagatctacagcagccacgccaaaaaagcaacggtggacgccgacgatgtacgtctggccattcaatgtcgtgcagaccaaagctttacaagcccccctccgcgcgatttcttgctggatattgcccgccagcgaaatcagacccccctgccccttatcaagccgtacagcggaccccgactgcctcccgatcgatattgcctgaccgctcctaactaccgtctgaaaagcctgcagaaaaaagcaagtacaagcgctggccgtatcacggtgcctcggctcagcgtaggctctgtcacctcccgaccctccacacccaccctgggaacgcccacgtag

SEQ ID NO: 137192 - DNA, 384 bp, Artificial Sequence
  Description of Artificial Sequence: Synthetic coding sequence
atggagagcggcaagactgctagccctaaatctatgcctaaagacgcccagatgatggctcaaattctgaaagatatggggatcactgagtacgaaccacgagtaatcaaccagatgctagagtttgcttttcgctatgtaactacaatccttgatgatgctaagatatattcttcgcatgccaagaaggccacagtggacgcagatgatgtcaggcttgccattcagtgcagagccgaccagagctttaccagtcccccccctcgggactttctcctcgacatcgcaaggcagagaaaccagacgcctcttcccctgatcaaaccttactccggcccacggctccctccagatcgatactgtctcacggcccccaactattag

SEQ ID NO: 137193 - DNA, 756 bp, Artificial Sequence
  Description of Artificial Sequence: Synthetic coding sequence
atggagagcggaaaaatggctccccccaaaaacgccccaagggacgccctggtgatggcacagattctgaaggatatgggtataactgagtatgagccccgtgtgatcaaccagatgctggagtttgcgttccgctatgtcacaacaattctggatgatgcaaagatttactcatcccacgccaaaaagccaaacgtagatgccgatgatgtgcgcctggctattcagtgtcgtgctgaccagtcattcacatctcccccacctcgagactttctgctagatatcgctcgccagaaaaaccagactccactgccactgatcaaaccctatgccggaccaagactgccaccagatcgttattgcctgaccgcccccaactatcgactaaaatccctcattaagaagggaccgaatcagggacgactcgtccccagactttcagtgggtgcagtcagctctaagcctaccacccctactatcgctacaccccagacagtctcagtcccaaataaagtcgctaccccaatgagtgtgacgagtcagcggtttactgtgcaaatccccccgtctcagagtactcccgtgaagcccgtaccagccacaaccgcagtgcagaatgtgctgatcaacccatctatgatcgggcctaaaaatattctgattaccaccaacatggtgtcctcccaaaatacagcaaacgaagctaacccattgaagcggaagcatgaggacgatgatgacaacgacatcatgtag

SEQ ID NO: 137194 - DNA, 879 bp, Artificial Sequence
  Description of Artificial Sequence: Synthetic coding sequence
atgcctcttcatgtgaaatggcccttccctgctgtacccccccttacatggactctggcatctagtgtggtcatgggcctggtcgggacatattcttgcttctggaccaagtacatgaaccacctgacggtgcacaacagagaagtgctgtatgaactcatagagaaaagggggcctgctacgcctctgattaccgtctccaatcatcagtcatgcatggacgatccacacctttgggggattctaaaacttcgccatatttggaatctgaagttaatgagatggactccagcagcagcggacatctgttttaccaaggagcttcactcccatttttttagccttgggaaatgtgtccctgtatgcaggggcgccgagttctttcaggctgagaacgagggcaagggagtgctggacactggcagacacatgccaggtgcgggtaaacgccgtgaaaaaggcgatggcgtataccaaaaaggtatggattttatattagaaaagctgaaccatggggactgggttcacattttccccgagggtaaggtcaatatgtcctcggagttcttacgcttcaagtggggcattggtcgcttaattgctgagtgtcacctaaatcccatcatcctgcccctgtggcacgtagggatgaatgacgtccttcccaactctccgccttacttccctcgattcgggcagaagataactgtactcatcggaaaaccattttccgccctgcccgtcctcgagaggctccgcgcagagaacaaatcggctgtggaaatgaggaaggcgctgacagacttcattcaggaagagtttcaacatttaaagacccaggccgagcagttgcataatcatttacagcctggcagatag

SEQ ID NO: 137195 - DNA, 789 bp, Artificial Sequence
  Description of Artificial Sequence: Synthetic coding sequence
atgccacttcacgtcaaatggccctttcccgccgtgccccctctcacatggacactcgcaagctcagtggtgatgggccttgtaggcacctacagctgcttttggacaaaatacatgaatcatcttactgtacacaatcgcgaggtgttgtatgaactgatagaaaagcgggggcccgcaaccccacttatcacggttagtaaccatcagtcatgtatggatgacccccatctctggggtattctaaaacttcggcacatttggaacctgaagctcatgagatggactcctgcagctgctgacatctgcttcactaaagagctacactcacattttttcagcctggggaaatgtgtgcccgtgtgcagaggcgacggtgtctatcagaagggtatggacttcatcctcgagaagttgaatcatggggactgggtgcatatctttcccgagggcaaagtcaacatgtcctccgaattcctgcgctttaaatgggggatcggtcgcttaatcgctgagtgccacctcaacccaatcattctccccctgtggcatgttgggatgaacgacgtactccctaactcccccccttactttcccaggttcggccagaagattaccgtgctgatcgggaaaccattttccgctctccccgtcctggagcgcctccgagccgaaaataagagtgccgtggaaatgcggaaagctctgacagatttcattcaagaggagttccaacatctcaaaacacaggcagaacaactgcataaccacctgcagccaggcagatag

SEQ ID NO: 137196 - DNA, 837 bp, Artificial Sequence
  Description of Artificial Sequence: Synthetic coding sequence
atgccactccacgtgaaatggccctttccagccgtgcctcccctgacgtggacactggcctcatctgtcgtgatgggacttgtcgggacgtattcctgcttttggaccaagtacatgaaccaccttaccgtacataaccgcgaagttctgtacgagctgattgagaagaggggcccagccacaccactaatcacagttagcaaccaccagtcctgcatggatgaccctcacctgtggggcatcttaaaactgcggcacatctggaatttaaagctgatgcggtggacaccagccgcggccgatatctgtttcactaaggagcttcattcgcacttcttcagcctcgggaagtgcgtacccgtgtgcaggggcgctgagtttttccaggccgagaacgaagggaagggcgtgctcgacaccggcaggcatatgccaggggctggcaaaagaagggaaaaaggcgacggggtataccaaaaagggatggattttatcctcgaaaagctgaatcacggcgattgggtacacatttttccggaaggaatcggccggctcatcgccgaatgtcatcttaaccccataattctgcctctgtggcatgtgggaatgaatgatgtactcccaaatagtcctccgtacttccccaggtttgggcaaaagatcactgttctgataggcaagcctttctccgctcttcctgtattggaaagattacgggctgaaaacaaaagcgccgtcgagatgagaaaagcactcaccgactttatccaggaggagttccagcacctcaaaacccaggccgagcagctgcataaccacctgcagcccgggaggtag

SEQ ID NO: 137197 - DNA, 747 bp, Artificial Sequence
  Description of Artificial Sequence: Synthetic coding sequence
atgccgcttcacgtgaagtggccatttccagctgtgcccccccttacatggacgctcgcctcgtcagtcgttatggggcttgttgggacttatagctgtttttggacaaagtacatgaaccacctgaccgtgcataatcgcgaggtgctctatgagctcattgagaaacggggacccgctacacccctaatcactgtatcaaaccaccaatcatgtatggacgatccgcacttgtggggcatactaaagttgaggcacatctggaatcttaaacttatgcgttggactcccgcagcagccgacatctgcttcacaaaggaacttcactcgcatttcttctccctggggaagtgcgtgccagtgtgcaggggggacggggtgtatcagaagggcatggatttcattctggagaaactcaaccacggagactgggtgcatattttccccgaaggtatcggccgcctgattgcagagtgtcacctcaaccccataatcttgcctttatggcatgtgggtatgaatgatgtcctgccaaacagccccccatattttccacggtttggacaaaaaattacagtcttgatcggaaaaccgttctctgccctgcccgttttggagcgtcttcgggcagagaataaatctgctgtggaaatgaggaaggcgctgactgatttcattcaggaagaattccagcacctaaagactcaggctgaacagctgcacaaccacttgcaacctggtcgttag

SEQ ID NO: 137198 - DNA, 798 bp, Artificial Sequence
  Description of Artificial Sequence: Synthetic coding sequence
atgccactgcacgttaaatggccattcccagccgtcccacctcttacatggacattggctagctctgtcgtgatgggactggtcggaacttacagttgtttttggacaaagtatatgaatcacctcaccgtacataacagagaggtactgtacgaattgatcgaaaagagaggccccgccacacctctgattaccgtctctaaccaccagagttgcatggatgacccgcacttgtggggaatccttaaattgcgccatatctggaaccttaagcttatgagatggaccccagccgcagctgatatctgtttcaccaaggaacttcactcccattttttctccctgggtaagtgcgtaccagtctgtcgtggggcagaattctttcaggcagagaatgaaggaaagggggtgctggatacagggcgccatatgcctggagcaggcaagcgacgtgagaagggcaaagtgaacatgtctagcgagtttttacgtttcaagtggggtatcggacgtcttatagcggaatgccacttgaaccccattatcctgcctctgtggcacgtagggatgaacgatgttctaccaaatagtccaccctatttcccacggttcgggcagaaaataaccgtgctgatcgggaaacccttttcggccttgccagtgctagagcgtttgagagcggaaaacaagtctgccgtggaaatgcggaaagccctgaccgacttcattcaggaagaatttcagcatctgaagacccaggcagagcaactccacaaccacttacagccaggccggtag

SEQ ID NO: 137199 - DNA, 7629 bp, Artificial Sequence
  Description of Artificial Sequence: Synthetic coding sequence
atggtggccctgagcctgaagatctgtgtgagacactgcaacgtcgtgaaaacaatgcagtttgagccaagtaccgctgtttacgacgcttgcagggtgattcgggaacgcgtacctgaggcacagaccggccaggctagtgattacggactgtttctgagcgacgaagaccctcgaaaaggcatctggctggaagccggacgtacccttgactactacatgctcagaaacggggacattctcgaatacaaaaagaagcaacgcccccagaagattaggatgttggacggctcagtgaagaccgtcatggtggacgattcaaagactgtgggcgaactccttgtcacgatttgtagtagaatcgggattacgaattacgaggagtacagcttaattcaggagaccattgaggaaaaaaaagaagaaggcacgggtactctgaaaaaggacaggaccctgctcagggatgaaagaaagatggaaaaattaaaggctaagctccacactgacgatgatcttaactggcttgatcattccaggactttcagagagcagggagtggatgaaaacgagaccttgctgctacggcgcaaattcttttacagtgaccaaaacgtggatagcagagatcctgtacaactgaatctgctgtatgttcaggcccgcgacgatatcctgaatgggtcccaccctgtcagtttcgaaaaagcttgtgagttcggcgggttccaggcccagatccaattcggaccccacgtggagcacaaacataagcccggcttcctggacctaaaagagtttctgcccaaggaatacattaaacagaggggagcagagaagcggatctttcaggaacacaagaattgtggagaaatgagtgaaatagaggcaaaagtgaagtatgtcaagctggcaaggtctctcagaacctacggcgtgagcttttttctagtgaaagagaagatgaaaggcaagaataaactcgtgccccgtctgctgggtattacaaaagattctgtcatgagggtggacgagaagacgaaggaggtcttacaagagtggcctcttacaactgtcaaaaggtgggcagcctcccctaagtctttcacattggatttcggtgagtaccaggagtcttattactcagtgcagaccacagagggcgaacagatctcacagctgatagcaggctacatcgatattattctgaagaaaaaacagagcaaagaccggttcggactggagggggatgaagaaagtaccatgctggaagaaagcgtttccccaaaaaaaagcacaatcctgcagcaacagtttaaccgaaccggaaaggccgagcacggcagcgtagcactgcctgcggtcatgaggtccggaagctcaggacctgagacctttaacgtcgggtcaatgccttccccacagcagcaggtcatggtcggtcagatgcacaggggccacatgccccccctcacttcagctcagcaggctttaatgggaacaattaacacatctatgcatgcagtgcagcaggcccaggacgacctatctgaactggattctttaccaccactcggccaggatatggcctctagagtatgggtccagaacaaagttgacgagtcaaagcacgaaattcacagccaagtggacgctattacagccgggacagccagtgtggtgaatcttacagccggggatccagcggacaccgactacacagcagtcggatgtgcaatcactaccatttcatccaatttgacagagatgtccaagggggtcaagctgcttgcagcgctgatggacgacgaggtggggagtggagaagacctccttagggccgcccgcactctcgccggagccgtatctgacctgctgaaggccgtgcagccgacctctggggagccacgacaaaccgtgctgaccgccgctggaagcattggccaggccagcggcgaccttctcaggcagataggagagaatgaaaccgatgaaaggttccaggatgtactgatgtctctggctaaggctgtcgcgaatgcggcagccatgttagtgcttaaagcaaagaacgttgcgcaagtcgccgaggacaccgttctgcagaaccgtgtgattgcagcggctacccagtgtgccctgtccacatctcagttagtggcgtgcgcaaaagtggtgagtcccacaatttcatcacctgtatgccaggagcagcttatcgaggctgggaagttagtggatagatctgtggaaaactgcgtgcgggcgtgccaagccgcaaccacagacagcgaattactcaagcaggttagtgcagcagctagcgtggtttctcaggccctccatgaccttctgcagcacgtgcgccagtttgcatccaggggagaaccaattgggcgttatgaccaggctaccgacacgatcatgtgtgtgaccgaaagtatcttctcttccatgggcgacgcaggcgaaatggtccggcaggcaagggtcctggcccaggcaacctccgatctggtgaacgcaatgcgatctgatgctgaggcagagattgacatggaaaattccaagaaacttctggcagccgcaaagcttctggccgattctactgctcgaatggtagaagctgcaaaaggtgctgccgctaaccccgaaaacgaagatcagcagcagcgtctcagagaggccgctgagggcttgcgagtggcgacaaacgccgcggctcagaatgcaatcaagaaaaaaattgtgaatcgcttagaagtcgcagccaagcaggccgctgctgcagccactcagaccattgctgcaagtcaaaatgccgcggtaagcaacaaaaaccccgccgcccagcaacaactggttcaaagttgcaaagctgtggccgaccacatacctcaactggtccagggcgtccgaggtagtcaggcgcaggccgaggacctgtctgcccagctcgctctgatcattagctcacagaacttcctgcagccaggctccaagatggttagcagcgcaaaggccgctgtcccaacagtgtctgaccaggcagccgcgatgcagctaagccagtgcgccaaaaacctcgctaccagcctcgccgaactaaggaccgcctcccagaaggcccatgaggcttgtgggcccatggaaatcgattctgctcttaacaccgtgcagactttaaagaatgaactccaagacgccaagatggccgctgtcgagagccaactgaaaccactccccggcgaaaccctcgagaaatgcgcccaggacctgggatctaccagtaaggccgtgggatccagcatggctcaactgctgacctgcgctgcccaaggaaacgagcactataccggggtcgctgcccgggagactgcgcaggccctgaaaacactcgcccaggctgcgcgaggcgtagctgcatccactaccgatccagctgccgcacacgccatgctggattctgccagggatgtcatggaggggtccgccatgctgatccaggaagctaagcaggccttgatcgctccaggcgatgctgagaggcagcagcgactggcacaggtggctaaagccgtaagccactccctaaacaactgcgtcaactgtctgcccggacaaaaggacgttgatgtcgcccttaagtccatcggtgaatctagcaaaaagttactggtggattctcttcctccctccacaaaaccttttcaggaggcccaatcagagcttaatcaagccgccgcagatctgaaccagagcgcgggcgaggtggtacacgcaacgcgcggacagagtggtgagttggccgcggcctccggcaagttctcagacgatttcgatgagttcctggacgcagggatcgaaatggcaggtcaggctcaaaccaaagaggatcagattcaggtaatcggaaatttaaagaacatcagtatggctagcagcaaactgctgttggccgctaagtctttatctgtggatcccggagcacccaacgctaaaaacctcctggcggccgccgcgcgggcagttacagaatccatcaaccagctgatcacactgtgcactcagcaggcccctggtcaaaaggaatgcgataatgctctgagggaacttgaaactgtcaagggcatgctagacaatccaaatgagcccgtgtctgacctgtcctacttcgattgcattgaatccgtgatggaaaattccaaggtgctgggagagtctatggccggtatatcccagaatgccaaaacaggggatttacccgcatttggagagtgcgtggggattgcatctaaagcactgtgcggtttgacagaggcagctgcccaggccgcatacctggtgggaatcagtgatcccaatagccaggcgggccaccagggcctggtcgaccctatccaatttgctcgagcaaatcaggccattcagatggcctgccagaacttggtggaccctggctctagcccaagccaagtactgtctgccgccaccattgtggctaagcatacttccgcactgtgtaatgcctgtcgcatcgcttcatctaagacagccaacccagtggccaagcgtcactttgttcagagcgctaaggaggtggcaaactctaccgccaacttggtcaagacaatcaaagctctcgacggcgacttctcagaggataacaggaataaatgccggatcgctacagcaccgctgatcgaagccgtggagaacctgacagccttcgcttcgaacccggagttcgtcagtatacctgcacagatcagttccgaggggtcccaggcccaggagcctatcctggtctctgctaaaaccatgctagagagctcctcttacctgatacggactgccaggagcctcgctattaatcccaaggacccccccacgtggtccgtcctggcggggcactctcacaccgtctcagattcgataaagtctctcatcaccagcattagagataaggcccccgggcagagagaatgtgattattcgattgacggaatcaacagatgtatccgcgatatcgaacaggcttctcttgcagcagtttcccaaagtttagccacacgcgacgatatctcagttgaggccctccaggaacagttgaccagtgtggttcaagaaatcggtcacctcattgatccaatcgccactgcagcccgaggcgaagctgcgcagctggggcacaaagtgacccagctagcaagctactttgagcccctaatcttggccgccgttggggtcgcttctaaaatcctcgatcatcaacagcaaatgaccgtgttggatcaaactaaaacactcgctgaatccgccctccaaatgctatatgctgccaaagagggaggaggcaaccccaaggcccaacacacccacgatgcgataacggaggcagctcagttaatgaaagaggctgttgatgatataatggtgaccttgaatgaggctgccagcgaagtcgggctggtgggaggcatggtcgatgcaatcgctgaggcgatgtccaaactcgacgagggaacccccccggagcctaagggaactttcgtggattatcaaactaccgtggtcaagtattcaaaagccatcgccgttaccgctcaggagatgatgactaagtcagtgaccaacccagaggagctgggcggcctggcaagccagatgacaagcgactacggccacctagctttccagggacagatggctgccgcaacagcagagcctgaggaaataggctttcaaatcagaactagggtgcaggacctgggccatggttgtatatttctagtccagaaggctggggctctccaggtgtgcccgactgattcttatacaaagagggagctcattgagtgcgcacgcgcggtgactgagaaagtgtcactggtgttgagcgccctgcaggcgggcaataaggggactcaggcatgcattacggcggccaccgcagtttctggaatcatcgcagatcttgacaccactattatgtttgccacagcgggcacattaaatgcagaaaatagcgagacgttcgccgatcatcgagagaatatactcaaaaccgccaaagccctggtcgaagacactaaactcctggtgagcggggccgcttccactccagataagcttgcccaggccgcccagagctctgccgcaaccatcacacaattggctgaggtcgtgaaattaggcgctgctagcttggggagtgacgaccctgaaacccaggtcgtacttatcaatgccattaaagacgtggcgaaagctctgtcagacctgatctcggccactaagggggcggcatcgaagcccgttgatgatcctagcatgtatcaattgaaaggcgcagcaaaggtaatggtcaccaacgtgacaagtcttctgaaaactgtgaaggccgtggaagatgaagccaccagaggaacacgggcactggaggcaaccatagaatgcattaagcaggagctgactgtgttccagagcaaggacgtgccagagaagacaagcagcccagaggagtcaattcgcatgacgaagggaataactatggctaccgccaaggcagttgcagccggcaacagctgtcgtcaggaagacgttattgcaacagcgaacctgagcagaaaagcagttagcgacatgctcacggcgtgcaagcaagcgtcattccatcccgacgtatcagacgaagtgaggacccgtgccctaagatttgggaccgaatgcacattaggatacttggatttattagaacacgttctggtcatcttgcagaagcccacaccagaattcaagcaacaactcgccgccttctcaaagagagtcgcaggcgctgtaacggaactcatccaagcagctgaggccatgaagggtaccgaatgggtggatccggaagatcctaccgttattgctgagacagagctgctgggcgccgccgccagcattgaggccgcagccaaaaagctagagcagttgaagcctcgggcaaagcccaagcaagccgacgagactctagattttgaggagcagatattagaggctgcgaaatcgattgccgcagccacttcggcactggtaaagtctgccagtgcagcacagagagagcttgtagcgcagggaaaagttggatccattcctgcaaacgcagccgatgatgggcagtggtcccaggggctgatctcagctgctcggatggtggctgcagcaacgtccagcctttgcgaagccgcaaacgcttccgtgcagggccacgcatcagaggagaagctgattagcagcgcaaaacaagtggccgcctcgaccgctcagttgctggtggcatgtaaagtgaaggctgatcaggacagtgaagccatgaggagacttcaggccgctggaaatgctgttaaacgcgcaagtgacaatctggtgcgggccgcacagaaggccgccttcggcaaagctgacgatgacgacgttgtagtgaaaacaaaatttgtgggaggcattgctcagatcattgcagcacaagaagagatgctgaagaaggaacgcgagctcgaggaggcaagaaagaaattagcccaaatcagacagcaacagtacaagttcctgcccactgagctgcgggaagacgaagggtag

SEQ ID NO: 137200 - DNA, 7629 bp, Artificial Sequence
  Description of Artificial Sequence: Synthetic coding sequence
atggtcgccctttcattaaagatttgcgtgcgccactgcaacgtggtgaaaacaatgcagttcgaaccatcaactgcagtttacgacgcgtgtcgagtcataagggagagagtcccagaggcacagacagggcaggcctcggattatggattattcctttctgacgaggacccccgcaagggtatttggttggaagcggggcggaccttagattactatatgctccgtaacggcgacatcttggagtataaaaaaaagcagcggccccagaaaatcagaatgcttgatggttctgtgaagacagtgatggtcgacgacagtaagactgtgggcgaactgcttgtcaccatttgtagccgtattgggatcactaactacgaggaatacagtctgattcaagagacgatcgaggagaagaaagaggagggcaccggcactttaaagaaagacagaacactactgcgcgacgaacgaaagatggaaaaactgaaagccaaacttcatactgatgacgacttgaattggctcgatcacagtaggacgtttagggaacaaggtgtggatgagaacgagacactgcttctgcgcaggaagttcttttattctgaccaaaacgtggactcgcgcgaccccgtgcagctgaatctcctctatgtacaggctcgtgatgatatcttgaacggaagtcaccctgtatccttcgagaaggcctgcgaattcggcgggtttcaggcgcagatacagttcgggcctcacgtcgaacacaaacacaagcctggtttcctcgacctgaaagagttcctgcctaaagaatatatcaagcaacggggagccgagaaacggattttccaggaacacaagaattgtggggaaatgtctgagatagaggctaaggtgaaatatgtgaaactggcacgctccctccgcacctatggcgtgtcgttttttctggtgaaggaaaagatgaaggggaagaacaagcttgttccgcgactgctgggcatcaccaaagatagtgtcatgcgcgttgatgaaaaaacaaaggaagtcctgcaggagtggccacttacaacggtcaaacgctgggccgcgtcaccaaagtcctttaccctggacttcggcgagtaccaggagtcctactacagcgttcagactacagagggagaacaaatttctcagctaatcgccggctacatcgacattatccttaaaaagaaacaatctaaagaccgcttcggactggagggcgatgaagaatcaacgatgctggaagagtctgttagccccaagaaatcgactattctccagcagcagttcaaccgcaccgggaaagcggaacatggaagcgtggccttgccggccgttatgaggtccgggtcctccggccctgagacattcaatgtcgggtctatgccctcgccacaacagcaggtgatggtgggacagatgcaccggggccacatgccccccctgacctccgcccagcaagccctgatggggactataaatacgtcgatgcacgcagtgcagcaggctcaggacgacctgtctgaattggattcgctgcctccactgggacaggacatggcatcaagagtgtgggtgcagaataaggtggacgagagtaagcatgagattcacagccaggttgacgccataaccgccgggactgcctcggtggtaaacttgacagccggcgacccagctgatacggattatactgctgtaggttgtgccatcacgactatctcctcaaacctgacagagatgtcaaaaggggtgaagctcctggctgctctgatggacgacgaggtggggtctggcgaagacctccttcgcgctgccagaaccctggccggcgccgttagcgatctgctcaaggccgtgcaaccaacgtccggggagccgcgacaaacagtgctgaccgcggccgggtcgatcggccaggcttcgggtgaccttctgcgccaaattggcgagaacgaaacagacgagagatttcaagatgtgttgatgtcccttgccaaagcagtggccaacgccgccgctatgctggttctcaaagccaagaatgtggctcaagtggcagaggacaccgtgcttcagaacagagttatcgcggccgctacccagtgcgccctgagcacatcgcagcttgtagcctgtgcgaaagtggtctcccccacgatttccagccctgtttgtcaggaacagctgatcgaagcaggtaaactcgtcgatcgaagcgtcgaaaactgtgtgcgcgcatgtcaggccgcgaccacagacagtgagctcttaaagcaagtaagcgccgctgcatctgtagttagtcaggcacttcacgacctactgcagcatgtgcgacagttcgctagccgcggtgaacccatcggacggtatgaccaagccacagacactatcatgtgcgtgaccgagagcatcttttcctccatgggagacgccggtgagatggtgaggcaggccagagtattagcgcaagctacatcagatctggtgaatgccatgcgctcagacgccgaagctgaaatcgacatggagaactccaaaaaactgttggctgcagcaaagttgctcgcagattccaccgcccggatggtggaagcagctaagggcgcagccgccaatcctgagaacgaagaccagcaacagcggctccgcgaggccgcagagggccttcgcgttgcaactaacgccgctgcacagaacgcaatcaagaaaaagatcgtgaatcgcctggaggttgccgcaaagcaagccgcagctgcagccacgcagaccattgccgccagtcagaatgctgcagtgtccaacaaaaatccagcggcccaacagcagcttgtgcagagctgtaaagcggtagcggaccacatcccacagctggtccagggggtgcgggggagccaggcccaggccgaggacctgtcagctcaactggcactcattattagcagtcaaaatttcctgcaaccagggagtaaaatggttagctccgccaaagctgccgtccccactgtgtctgatcaagccgccgcgatgcagctgagccagtgtgcaaagaacctggcaactagcctggctgagctgcgaaccgcttctcagaaggctcacgaggcttgtgggccaatggaaattgattccgctctcaatacagtccagacattaaaaaacgaactgcaggacgccaagatggccgcagtcgaaagccaattaaagcccctgccaggcgagacactcgagaagtgcgcccaggacctggggagcaccagcaaggccgtgggatcgtccatggcacagctgctgacttgcgctgcccagggcaatgagcattatactggggtagctgcccgagaaaccgcccaggctctgaaaaccctggcccaagcagcccgtggcgttgccgcttcaacaacagatccagccgctgcccatgctatgctggacagcgcaagagacgtaatggaagggagcgccatgctaatccaggaagctaagcaggctctcatcgcacctggtgacgccgagaggcagcaaaggctggctcaggttgccaaggccgtgtcccattccctgaacaattgcgtgaattgtctgccggggcagaaagacgtggacgtggccctgaagagcatcggggaaagtagtaagaaactgttggtggattcccttcccccttcaacaaaaccctttcaggaggcccagagcgaactgaatcaagccgccgccgatttaaatcagtcagcgggagaagtggtgcacgccacaagaggacagtccggagaacttgcagcggcatcagggaagttctcagatgatttcgacgaatttctcgacgcaggaatcgagatggcagggcaagcacagacaaaagaagatcagatacaggtgattggaaacctgaaaaatatctccatggcatcttcgaagttactgctggcagctaagagtttgtcggtggacccaggtgcgcctaatgcaaagaatttacttgctgccgcagcgcgggccgtcactgagtccatcaaccaactgatcactctgtgtactcagcaggctcctggccaaaaagagtgtgacaatgcactgcgagagctcgagactgtgaagggtatgttggataacccaaacgaacctgtgtctgacctttcttactttgattgtattgaaagtgtgatggaaaatagtaaagtgctgggagagtctatggcaggaatttcacagaacgcaaagactggagatctgcctgcttttggagagtgtgtgggtatcgcatctaaagccttgtgcgggcttacagaggctgcggcgcaggcggcttatctcgtaggcatttctgatcccaatagccaagcgggtcaccagggactggtggatccaattcagttcgctcgagcgaaccaggctatacagatggcttgtcaaaatctggtcgatcccggctctagcccaagccaggtgctgtccgcagctactatcgtggctaagcacacttccgccctgtgcaatgcctgtcggatagctagctcaaagacagccaatcccgtagccaaaaggcatttcgttcagtcggccaaagaggtagctaactccaccgctaacctcgtcaaaaccatcaaggctctcgatggcgacttttccgaggacaatagaaacaaatgcagaatcgcaaccgctcccctgattgaagccgtagaaaacctcactgcttttgcatcaaatcctgaattcgtaagcatcccagcccaaattagttccgaaggctcacaggctcaggagccaatactggtcagcgccaagacaatgctggagagtagttcatatttaatcagaaccgcacggagcttggccatcaatccaaaggatcctcctacgtggtcggtgttggctggccacagtcatactgtatccgattccatcaaatcattaattacatcaatccgagacaaagccccaggccagagggagtgcgactacagtatcgacggaattaatcgctgtatccgggatatagaacaggcctctttggccgcagtgtcccagtcgttagccacaagagatgacatctcagtggaggctcttcaggaacagcttacttcagtcgttcaagaaatcggacatctgattgaccccatcgccacagctgcccggggagaagccgcgcagctcggacataaagtgactcagttggcatcctatttcgagcccttgatcctcgccgctgtcggggtagcgtccaaaattctggatcaccaacaacagatgacagtacttgaccagactaaaacgttggcggagtcagccctacagatgctttacgcggccaaggaaggaggcggaaatcccaaggctcagcacacacacgacgcaataaccgaggctgcgcagctcatgaaggaagccgttgacgacatcatggtgactcttaatgaagcagcaagcgaggtcggcctggtgggaggaatggtcgacgccattgcagaagcaatgtctaaactggacgagggaactccccctgagccaaaaggcacattcgtggactaccagaccacggtcgtgaagtattctaaagccattgcagttacagcccaggagatgatgaccaagtccgtcacgaacccagaggagctggggggactagccagccaaatgactagtgattatggacatctggccttccaaggccaaatggccgctgctaccgcagagcctgaagagatcggttttcaaattagaacccgggtacaggacctgggacatggatgcattttcctggtgcaaaaggccggtgcattgcaggtgtgtccaaccgactcctatactaaacgtgaacttattgagtgcgcaagggcagttaccgaaaaggttagcctggtcctgtctgccttacaagctgggaataaggggacgcaggcctgtattacagccgccacggcggtctctgggatcattgctgacctggataccacaattatgtttgctacagccgggaccctgaatgccgagaattcagagacatttgcagatcacagagaaaacatactcaaaactgctaaagcgttggtggaggatacaaagctgctggtcagtggcgccgcttccacacccgataagttggcccaagcggctcagtctagcgctgcaactatcacacagctggctgaggtagtcaagcttggggccgcctctctgggatcagacgatccagagacccaggtagtattgattaatgccattaaggatgtggcaaaggctctgagcgatttgattagtgcaaccaaaggagcagcctccaagcccgtcgatgacccttctatgtatcagctcaagggggcggcgaaggtcatggtaacaaatgtgacgtccctcctgaagaccgtgaaagcagttgaggacgaagcaacacgcggcaccagggccctagaggctaccattgaatgcatcaagcaagagttaacggttttccagtcgaaagacgtgcccgagaaaaccagttcgcccgaggagagcatccggatgactaagggcattaccatggccactgccaaggctgtggcagctggcaattcttgcaggcaggaggatgtaattgccacagcaaatttaagcaggaaggctgtatccgatatgttaacagcctgtaagcaggctagcttccatcccgacgtcagcgacgaagtcaggacgcgagccctgcgttttgggaccgaatgcactctggggtacctcgatctcctggagcacgtgctcgtgatcctgcagaagcccacacctgagttcaaacagcagctggccgccttcagtaagagggtagctggagcggtgacggaactgattcaggcggccgaggccatgaaggggaccgagtgggtggaccccgaggacccgaccgtcatcgccgaaacggagctgctgggcgccgccgcatctatcgaggctgcagctaagaaactggaacagctgaagccgagagctaaacccaaacaagctgacgaaaccctggattttgaggagcagatcctcgaggccgccaaatccatagctgcagccacctcagcactcgtcaagtctgccagcgctgcccagcgagagctagtcgcccaaggaaaggtcgggagtatacccgccaacgctgcagatgacggccagtggtcgcagggtttgatctccgctgctcgtatggtggccgccgctacctctagcctctgtgaagccgctaatgctagtgttcaagggcacgcatccgaggagaagttgatcagcagcgccaagcaggtggccgcgtcaacagcacagctgctggtagcgtgtaaggtcaaggccgaccaggattccgaggccatgagaaggctccaagcagcaggaaatgccgtgaagcgcgcaagtgataatttagtgcgtgcagcccaaaaggctgcctttggaaaagcggacgacgatgacgtcgtggttaagactaaattcgtgggagggatagcccagattattgccgctcaagaggaaatgctcaaaaaagaacgagagctggaggaggcccgtaaaaaattggcccagataaggcagcagcagtacaagttcctgcccactgagttgcgggaagacgaggggtag

SEQ ID NO: 137201 - DNA, 5190 bp, Artificial Sequence
  Description of Artificial Sequence: Synthetic coding sequence
atgaaagttagcacgttacgtgagagttctgccatggcttccccccttcctcgagaaatggaagaagagctggtaccaaccgggtccgaacccggcgatacaagggctaagccccctgtaaagccaaaacctagggcactccctgccaagcccgcgctgccagccaagccaagcctcctggttcctgtgggcccacgaccccccagggggcccctcgctgagctcccttccgctaggaagatgaatatgcttgctggaccgcagccttacggggggagcaagaggccactgccatttgcccctcgacccgcagttgaggcctccacgggaggagaagccacccaggaaacaggtaaggaggaggccggcaaggaggaaccgccaccgcttaccccacctgcaaggtgcgctgccccagggggcgtccgtaaagcccccgcccctttcaggcccgcgtctgaacggtttgctgcaacaaccgtcgaagaaatcctcgctaagatggagcagcctcgcaaggaggtgctcgcgagtcccgaccgcctgtgggggtctagacttactttcaatcacgacggatcatcccgctacggaccaaggacttacggcacaacaacagctcctcgggatgaagacggttcaacactttttcggggctggtctcaggagggacctgttaagtcgcccgccgagtgccgcgaagagcactcaaaaacccctgaggagcgcagtctgcccagcgacttagccttcaatggcgacctggcaaaggccgcatcttccgagctacccgccgacatctcaaaaccatggattccttctagtcctgcaccttcttctgagaacggtggaccagcttccccaggtctccccgccgaggcttctggttcgggccccggctcccctcacctgcaccctcccgacaagagttcaccctgccactcacagctgcttgaggcccagacacccgaagcctcacaggcgtccccatgtcccgccgtcactcccagcgccccatcagctgcacttcctgatgaaggtagccggcacacaccatcgccgggtctaccagccgagggcgcacccgaggcaccaagaccatcttcccccccgccagaggtgcttgagcctcattcactggaccaaccgccagcaacttctcctaggcccctgattgaagtgggtgagttgctcgatctgaccaggaccttcccttcaggaggggaggaagaggctaaaggtgatgcgcatctacggccgacgtcacttgtgcagcgccgctttagcgagggagtactgcagtctccatcacaagaccaagagaagctcggaggaagtctcgctgccttaccacagggccagggcagtcaactggccctagataggccctttggagctgaaagcaactggtctctttcgcagtctttcgagtggactttcccaacaaggccctctggtctcggcgtgtggaggctcgatagtcccccaccctccccaatcaccgaggctagtgaggctgcggaggccgctgaggcaggcaatttagccgtgagttctcgtgaggagggagtgagtcagcaagggcagggagccggatcagcacctagtggatccggatcttcttgggtgcagggcgatgatccctctatgagtcttacacagaaaggagacggagagagccagccgcagttccctgccgtgcctttggagccgctgcccacaacggagggtacccccgggttgcctctccagcaggccgaagagcgctacgaatcccaggagccactagcaggacaagagtccccacttcccctggctacccgtgaggccgcacttcctatactggaaccagtgctcggccaggagcagcctgcagcccccgatcagccatgcgtactctttgctgacgcacctgagcccggccaagccttgccagtcgaggaagaggcagtcacgctcgctagggccgagacaacacaggcgcgaacagaggctcaggatctgtgtcgagcatctccagaacctccaggtcccgagtccagtagcagatggctggatgatctattggctagcccacctccatctggcggaggcgccagaaggggagctggtgccgagctgaaggacacccagagcccttccacatgttctgaaggtctgctggggtggagccaaaaagatctgcagagcgagtttgggataaccggagaccctcagcccagcagcttctccccctcttcatggtgccagggggccagccaagactacggcctaggcggagcaagcccccggggggatcctgggctgggagagagggattggacctctaagtacggccagggcgcaggcgaaggctcaacgcgcgaatgggcttctaggtgcggcatcgggcaggaagagatggaagcaagctcttctcaagatcagtccaaagtttcagcccctggcgtcctgaccgctcaggacagagtggttggaaagccggctcagctggggacccagagatcccaggaggccgacgtgcaagactgggagttccgtaaacgtgactcccagggtacttacagcagtcgcgatgcggagctgcaggatcaggaattcggaaagcgagacagtttagggacctatagctctagagatgtctctttgggggactgggaatttgggaagcgcgacagcctcggcgcgtacgcttcacaagacgccaacgaacaaggacaggatctcggtaagagggaccatcacgggaggtatagtagccaggatgccgacgaacaggactgggagttccagaagagagatgtgtcgttaggcacctatgggagcagagctgcagaaccgcaggagcaggaattcggtaagagcgcttggatccgggattatagctctggaggctccagccgcaccctggacgcgcaagatcgcagtttcggtaccagaccattgtcctctggcttctctccagaggaagcccagcaacaagatgaagaatttgagaaaaagataccaagcgtagaggacagtctgggcgaaggaagtagggacgcaggccggccgggagagcggggttccgggggactcttctcaccctcaactgcccatgtgcctgacggcgctttgggtcagcgagaccagagttcatggcagaacagtgatgccagtcaggaagtaggcggacaccaagagagacagcaggccggcgcacagggcccaggtagcgcagacttagaggacggagagatgggcaagagagggtgggtgggcgagttttccctcagtgttggtccccagcgggaggccgctttcagccctggacagcaggattggagtagagatttctgcattgaagcatcggagcgcagttatcagtttggaatcattggaaatgacagggttagcggagctgggttttctccgagctctaagatggagggcggccactttgtgccacctggcaaaactaccgctgggtcagtggactggaccgatcagttgggtttgcgtaatctggaggtgtcctcatgtgtgggaagtggaggcagctcggaagctagagagtctgcagttggccaaatgggctggagcggtggcctgtcactgagagatatgaatctgacgggatgccttgagtctggaggctctgaagagccagggggaattggcgtaggagagaaagactggaccagcgatgttaatgtcaaaagcaaggacctggctgaagtaggggagggaggcgggcatagccaggccagagaatctggtgtgggacagaccgactggagcggtgtggaagccggcgagttcctcaaatctcgggagcggggtgtgggacaggctgactggacacccgatctggggctcagaaatatggcgcccggagctgtctgttcccctggcgagtccaaggaactaggagtcgggcagatggactggggcaataacttaggactgcgggacctcgaagttacatgtgaccctgatagcggagggtcgcagggattgcgcggctgtggtgtggggcagatggactggacacaagatcttgctccgcaaaatgtggaactgtttggagctccgagcgaagcgcgggaacatggagtcggcggggtaagccagtgccccgagcccgggctacgacataacggaagtctgtccccaggtctagaagctagagaccctctagaagcacgggaactgggcgtcggggaaacctccggtccggagactcagggcgaggactactcgagcagctcccttgaaccccatcccgctgatccaggcatggagactggggaggccttatctttcggggccagccccggcagatgccctgctcgcccacccccatcagggtcacagggcttgctggaggagatgttggccgcttctagtagcaaggccgtcgctcgccgcgaatcagcggcatctggcttagggggcctcctcgaagaggaaggcgccggcgccggcgctgcgcaggaggaagtactggaacccggacgggattctcctccttcttggcgcccccagcctgatggcgaggcttcacaaactgaagacgtggacggcacttggggcagttccgccgctcgttggagtgatcagggaccagcccagacatcccgccggccaagtcagggccctcctgcacgaagcccgtcccaggattttagttttatcgaggataccgaaatcttagactccgcaatgtatcggagcagggcaaatctcgggcgcaagaggggccaccgggctcccgtgatcagacccggcgggacgctgggactttccgaggccgccgacagtgacgcccatctatttcaagacagcactgaaccccgggcaagtcgggttccatccagcgacgaggaggttgtcgaagagccccagtcaaggcggacgcggatgagtttgggcaccaagggattgaaggtcaaccttttccccggactgtctccttcagccttaaaggctaagctgcggccaagaaacagatctgccgaagagggagagcttgcagagtcaaagagctcacagaaagaaagcgcggtacagaggagcaagagctgtaaggtgccaggcctcggcaaaccactcacacttcctcccaagcctgaaaagagctcagggtctgagggctccagcccaaactggctgcaagcactgaagttaaagaaaaagaaagtatag

SEQ ID NO: 137202 - DNA, 432 bp, Artificial Sequence
  Description of Artificial Sequence: Synthetic coding sequence
atgaaggtttctacattgcgcgaatcatcagcaatggcctctcctctgcctcgggagatggaagaagagcttgtgcccaccggaagtgagccgggcgacaccagagccaaacctcctgtgaaaccgaagcccagagcccttccagcaaaaccagcgctgcccgctaagcctagcttattagtccccgtgggacccagacctccgaggggccctctggccgaactccccagcgcacgcaaaatgaatatgctagcgggaccgcaaccctatggcggcagtaaacgcccactgccctttgcacctagacctgctgtagaggcctctaccggaggcgaagctacgcaggagacaggtaaagaggaggcagggaaagaggaacctcccccactgacaccccccgcacgctgtgctgcccccggcggcgtcagatag

SEQ ID NO: 137203 - DNA, 5190 bp, Artificial Sequence
  Description of Artificial Sequence: Synthetic coding sequence
atgaaggtctctacattaagggagtcaagtgccatggccagtcccttaccacgggagatggaggaggagcttgtacccactggctctgagccaggtgacactcgggctaagccacctgtgaaaccaaagccaagagcccttcccgcaaaacccgcgctcccagctaaaccgtccctattagtgcccgtgggacccaggcctcccagagggcccctggcagaactcccgagtgcaagaaagatgaacatgctggccggtccccagccctatggggggtccaaaagacctctgccctttgcgcctagaccagctgtggaggcttccaccgggggcgaagcgacacaagagacgggaaaagaggaggctgggaaagaggaaccccctcctttgacccccccagctagatgcgcagcccctggcggcgtgaggaaagctccagcccctttcagaccagcatctgaacgttttgctgccacaaccgtcgaggaaatcctcgccaaaatggagcagccgcgaaaggaggtacttgcatcacccgaccgcttgtggggctcccgccttacattcaaccacgatggttccagccggtatgggccgcgtacctacggtaccaccaccgcgccccgcgatgaagatgggagcacactgtttagagggtggtcccaggaaggacctgtcaagtccccagctgagtgtcgtgaggagcattcgaagactcctgaagaaagatccctccctagtgacctggcctttaacggagatttggctaaggctgctagcagtgaactccccgccgatatctctaagccatggattccgtccagccccgccccgagttcggagaatggcgggcccgctagccctggtctgccggccgaggcctcaggctctggcccgggatctccgcacttgcacccaccggataagtcgtcgccctgccatagccagctgcttgaggctcaaacgcctgaggcaagccaggcctctccatgtccagctgtaactccgtccgccccctctgcagcgctgcccgatgagggtagtcgacacacaccatcccccgggctgcccgctgagggtgcacctgaagccccacggccatcctcacccccccccgaggttctggagccccactcactggatcagccccctgcgactagccctagaccacttattgaagtcggagagctcctggacctaacccgaactttcccttctggcggcgaggaggaagcaaagggggatgcccacctcaggcccactagcctagtgcagaggaggttctcagagggagtgcttcagagcccttctcaggaccaggaaaaactgggcggcagcctggctgctctcccacagggacagggctcccagctggcactggaccggccattcggggcggagagcaactggtctctctcacaaagcttcgagtggacattcccaacccggccgtcagggctcggcgtgtggcgcttagacagcccccccccaagtccaatcaccgaggcctctgaggcagccgaagccgccgaggctgggaatttagccgtctccagtcgggaggagggtgtgtcgcagcaaggccaaggtgcgggaagcgcccctagcggatccggctcatcgtgggtgcaaggcgacgacccctccatgagcctgacccagaaaggcgacggggagtcacagccccagtttcctgccgtgccactggaaccactgccgacaactgaaggcacccctggtctccccctgcaacaggctgaggagaggtacgaatcccaggaacccctcgctggacaggaaagtcctctgccgctcgccacaagagaggccgcgctccctatactggaaccagtgcttggacaagagcagcccgctgcacctgaccagccatgtgtgctgtttgctgacgctccagagccaggtcaggccctgcctgtcgaagaagaggctgtgacattagcccgtgccgagacgacccaggctagaaccgaggcccaggacttgtgtcgggcaagtccagagccacccggaccagaatcctcctccaggtggctggatgatctactggccagcccacctccgagcggtggcggggcaagaaggggtgccggcgccgagttaaaggacactcaaagtcctagcacctgttccgagggcctgctgggttggagccaaaaggacctgcagagcgaattcggaattaccggcgatccccagcctagctcctttagccctagttcttggtgccaaggggccagccaagactatggactgggtggtgccagccccaggggcgacccagggctcggtgagagagattggactagcaagtacggacagggcgcaggcgaggggtcgacccgagaatgggcaagccgttgcggcataggtcaggaggaaatggaggcttcttcctcccaggatcagagcaaggtcagcgccccaggagttctgacagcccaggaccgcgtggtgggcaaacctgcccagctggggacacagagatcacaggaagccgatgtccaggattgggagttcagaaagcgagattcccaggggacttatagctcgcgagacgccgagcttcaggaccaggaattcggaaaacgcgactcccttggcacatatagcagccgggacgtatcccttggcgactgggagtttggcaagagagactccctgggagcctacgcttcacaggatgcaaacgaacagggccaggatctgggtaagcgtgatcatcacggaaggtactcctcacaggacgctgatgagcaggattgggagtttcagaaaagagatgtcagcctggggacctatggatctagagctgcggaaccccaggagcaggagttcgggaaatccgcctggattagggactattccagcggcgggagcagcagaactctagatgcccaggatagatcattcggtacccggccactctcgtcaggttttagcccagaggaagcccagcagcaggacgaggagtttgagaagaaaattccctcggtcgaggattctttgggggaagggtctcgcgacgccgggaggcccggggagaggggctctggcggcctgttctcaccctccacagcacatgttccagacggcgccctcggtcagcgggatcagtcctcctggcagaattccgacgcttctcaggaagtcggtgggcatcaggaaaggcagcaggcgggcgcccaggggcctggctccgccgacctcgaagacggcgagatggggaaacgtgggtgggtgggcgagttttcactatctgtgggtccccaacgggaggcagctttctcgcccggccagcaagattggtcacgtgacttctgtattgaagcgagcgaaagatcataccagttcggcattatcggcaatgaccgggtttcgggagctggattttccccaagtagcaagatggaaggcggtcacttcgtgcctcccggaaagaccaccgctggcagtgttgactggaccgaccagctgggacttcggaacctggaagtctcctcttgtgttgggtcgggaggctcctctgaggctcgcgaatctgcagtggggcagatgggctggtctggcggactgtccctccgggacatgaaccttaccggctgcctcgagagcggaggctcggaagaaccgggcgggatcggcgtcggcgagaaagactggactagcgatgtcaacgtgaaatctaaggacctggccgaggttggcgaaggggggggtcattcacaggcccgcgagagcggcgtgggccagacagactggtctggagtcgaggctggagagtttctgaaaagtcgagagaggggtgtcggacaagctgactggacccccgaccttgggctgcgcaatatggctccaggcgcggtgtgttcacctggagagagtaaggaactgggtgtagggcagatggactgggggaataacctgggcttgagggacctggaggtgacgtgtgatcccgactcgggaggctcacagggactccgcgggtgcggcgtggggcagatggattggacacaggatctagcacctcagaacgtcgaactgtttggcgctcctagcgaggccagggagcatggagtgggcggagtatcacagtgccccgagcctggactgcgtcacaacggcagcctgagcccaggacttgaggcccgcgacccactggaggcgagggagctgggggtgggggaaactagtggacccgaaacgcagggtgaagattactcttcctctagtcttgagccccacccagccgatcctggaatggaaacaggcgaggcactttcatttggtgcctcacctgggcgctgcccagctaggccgccaccaagcggatcccagggccttctcgaagaaatgctggctgcatctagttccaaagctgttgcaaggagggagagtgctgccagcggcctaggaggactccttgaagaggagggagccggcgctggcgcagctcaggaggaggtcctggaaccaggccgggatagcccacccagttggcggccccagcctgatggggaagcgtcgcagactgaggacgtggatgggacctgggggtcctctgcagcccggtggagtgaccagggtccggctcagacctctagaaggcccagccagggccccccagcacgttccccaagccaggatttttctttcattgaagacacagagattctggactcagctatgtaccgctccagagccaatctgggtcgaaaaagaggacacagagcccctgtgattcggcccggaggaactctcggtctgtctgaagccgccgatagcgatgcccatctatttcaggatagcaccgaaccccgggcctcccgagtccccagctcagacgaagaggtggtcgaagagccacaaagccgacgcaccagaatgtcgctcggcaccaaaggcctcaaggtaaatctatttccagggcttagccccagcgccctcaaagccaagttgcgacccaggaaccgctccgccgaggagggcgaactcgccgagtccaaaagttcacagaaagaatccgccgtccaacggagcaagagttgcaaagtgcccggcttaggtaagccactgactctgcctcctaagcccgagaagagctctggttccgaaggaagctcccctaattggctgcaggccttaaagctgaaaaaaaaaaaagtttag

SEQ ID NO: 137204 - DNA, 3006 bp, Artificial Sequence
  Description of Artificial Sequence: Synthetic coding sequence
atgccaagcaccaaccgggccggctcgctaaaggatccggaaattgccgagctcttctttaaggaagaccccgaaaaactgttcacagatctgcgtgagatcggccacggaagtttcggtgccgtttatttcgcaagggacgtgcgaaccaacgaggtggttgctattaagaagatgtcctattccggaaaacagagtaccgagaagtggcaggatatcatcaaggaagtgaaatttctgcaaagaataaagcaccccaacagcatagaatacaaggggtgctacctccgtgaacacacggcctggcttgtgatggaatattgtttaggaagtgctagcgacttactggaggtccacaagaagcctctccaggaagtggagatagccgcgattacccacggtgctcttcaggggctcgcttatttacattctcacaccatgattcacagagatatcaaggccggcaatattctgctaaccgagccaggtcaggtgaaactagctgacttcggttctgctagcatggcatcccctgctaattcttttgtagggacgccctactggatggctcctgaagtgatcctggccatggacgagggacagtatgatgggaaggtagatgtctggtctttggggatcacatgcatcgaactggcagagagaaagcccccactctttaacatgaatgctatgtccgctctctatcacatcgcccagaatgagtctcctacgttacagagcaacgagtggagtgactacttccgtaatttcgttgatagctgcctccagaagattccccaagataggcccacatccgaggagcttttaaaacatatttttgtactaagagagaggcctgagacagttctgatagacctcatacaaaggacgaaggacgcagtgagggaactcgataatctgcaatatagaaagatgaaaaagttactgttccaggaagctcacaatggccctgcagttgaggcgcaggaagaggaggaagaacaggaccacggtgtggggaggaccggtaccgttaatagtgtcggctccaatcagtccataccatcgatgtccatcagtgcatcaagtcaatcatcgagcgtcaattcactgccagatgtgagcgacgataagtccgaattggatatgatggaaggagaccacaccgtgatgagtaatagcagtgtgatccacctcaaaccagaggaggagaattacagagaggaaggcgatcctcgtactagggcctcagacccgcagagtccaccccaggtgtctcgccacaagtcccattaccggaaccgcgagcattttgctactatacggaccgcctccctggttacccggcagatgcaagaacatgagcaagattccgaactgcgtgagcagatgtcaggctataaacggatgcgcagacagcaccagaaacaactgatgacactcgagaacaagctcaaggcggaaatggatgagcatagactccgtctggataaggatttagaaactcagcggaacaatttcgccgccgagatggagaaattgattaaaaagcaccaagctgccatggagaaggaggcaaaggtgatgtcaaacgaagaaaagaagttccagcagcatattcaggctcagcagaaaaaagaactcaactcatttctcgaatctcagaagcgggagtacaaacttcggaaggaacagttgaaggaagagttaaatgagaaccagtcaacaccaaaaaaagagaagcaggaatggctctcaaaacaaaaagagaacatccagcactttcaggcggaggaggaagccaacctgcttcgccggcagaggcagtatctggagctagagtgccgtcgctttaagaggcgtatgctactcggtcggcataatctggagcaagatttggttcgagaggagttgaataagcggcaaacccagaaggacttggaacacgcgatgctactgaggcagcacgagtcgatgcaggagctggagttcagacacctgaacaccattcagaagatgagatgtgagctcatcaggcttcagcaccagaccgaactcacgaaccagctggagtataacaaacggagagagcgggagctgaggcgtaaacacgtgatggaggttagacagcagcccaaatcactaaaatcaaaagaactgcaaataaaaaagcaattccaggatacctgtaagatccagacacggcagtacaaggccctgcggaatcatctgctcgaaaccacgcctaaatctgaacacaaagccgtcctcaagcggctgaaagaggaacagacccggaagttagcaattctggcagagcagtacgatcactctatcaacgagatgctctctacccaggcactgagactggatgaagcccaagaagcagaatgtcaagtattgaagatgcaactccagcaggagctggagttactgaatgcctatcagagcaaaattaaaatgcaagccgaggcccagcatgaccgggaattacgtgagctggagcagagagtatctttgcgtcgcgccctcttagagcagaagatcgaagaggagatgcttgcactgcagaatgaaagaacagagagaatccgaagcctacttgaacgccaagccagggaaattgaggcgtttgatagtgaaagcatgaggctggggttcagtaacatggtgctttctaacctcagccccgaggctttctcccattcataccctggcgccagcggctggagccacaaccccaccggcggacccgggcctcattggggacatccaatggggggccctccccaggcatgggggcatcctatgcagggaggaccgcagccttggggacacccctccggccctatgcagggagtgcctcgggggtcgagcatgggcgtccggaattcacctcaagcactgcgtaggaccgcctcagggggaaggactgagcagggtatgagccgttccacatctgtgacatcccaaattagcaacggctctcatatgtcttatacctag

SEQ ID NO: 137205 - DNA, 2562 bp, Artificial Sequence
  Description of Artificial Sequence: Synthetic coding sequence
atgccatccaccaaccgagcagggagcttgaaggatcctgaaatagctgaattattcttcaaagaggatccggaaaagctatttacagatctccgggagattggccacggctctttcggtgccgtatatttcgccagggacgtaagaactaatgaagtcgtggcaattaagaaaatgagttacagtgggaagcagagcaccgaaaaatggcaggacatcatcaaggaagtgaaatttttacagcgtatcaagcacccaaactccatcgagtacaaaggctgttatctgagagagcacactgcatggctggttatggaatactgtctgggaagcgcatccgatttactggaagtgcataagaagcccttacaggaagtggagatcgccgctataacacatggggccctgcaaggtctggcttacctccattcacacaccatgattcaccgggacatcaaagctggaaacatccttctcaccgagcctgggcaggtgaaacttgctgatttcggctccgcgagcatggcgtctcccgcaaacagtttcgtgggtaccccatattggatggcccccgaggtgatcctggccatggatgagggtcagtatgacgggaaagtggatgtgtggtccctcggtatcacgtgtattgagttggccgagcgaaaacccccgctgtttaacatgaatgccatgagcgctctctatcacatagctcagaacgagtctcctaccctgcagtcaaacgaatggagcgattacttccggaacttcgtggatagctgcctgcagaaaatcccacaggaccggccaacttccgaggagctgcttaagcacatttttgtgctgcgcgagaggcctgaaaccgtgctcatcgacctcattcagcgaacaaaggacgcagtccgcgaactcgataacctgcagtaccgcaagatgaagaagctgctgttccaggaagcccacaacggccccgccgtggaggcgcaagaagaagaagaggagcaggatcacggggtcggacggactgggaccgtgaactccgtagggagtaaccagagtattccctctatgtccattagtgctagctcccaatcttcaagcgtgaactcacttccggatgtgagcgatgacaagagcgagttggatatgatggagggtgatcacaccgttatgtctaactcatctgtcatacaccttaaaccagaggaggaaaattatcgagaggagggggaccccaggaccagagcgagcgaccctcaaagccccccccaagtgagccgacacaaatcacattaccgtaacagggagcacttcgccacaatcaggaccgcttcgctggtgacaagacagatgcaggagcacgaacaagattctgaacttagggaacaaatgtctggatacaaacgaatgagacgccaacaccagaagcagttaatgaccctggagaacaaactcaaggctgaaatggatgaacataggttgcgcctggataaagacctggagacacaacggaacaactttgccgcagaaatggagaagttgattaagaaacatcaagccgcaatggaaaaagaggccaaggttatgagtaacgaggagaagaaattccaacaacacatacaggctcagcagaaaaaagagctgaactctttcctcgagtcccagaagcgagaatataaacttcgcaaggaacagctgaaggaatccaaagaattgcagataaagaaacagttccaggacacctgcaagatccagacacgccagtataaggccctgagaaaccacctactggaaaccactcccaaatcagaacacaaagccgtgcttaaacggctaaaggaagaacagactcgcaaactcgcaatcctggcagagcagtacgatcatagtatcaatgaaatgctgagcacccaggccctccgactggacgaggcccaggaggccgaatgtcaggtcctgaagatgcaactccagcaagagctggagctcctgaatgcataccaaagtaagattaagatgcaggcggaagcccagcacgaccgggaactacgcgaactggagcagcgggtctctctccgccgggccctgttggaacagaaaattgaagaagaaatgcttgcgcttcaaaatgagaggacggaaagaattaggagcttgctggaaaggcaagctagggaaatagaggcctttgactccgaaagcatgcggttggggttctcaaatatggttctcagtaacttgagccccgaagcatttagtcattcataccccggagccagcggttggagccataatcccaccggcggacccggccctcattggggacacccaatgggcgggccaccgcaggcatggggacaccccatgcagggcggcccgcaaccttgggggcaccccagcggccccatgcagggagtgcccagaggaagttctatgggcgtgaggaatagtccgcaggccttgcgaagaaccgcttccggtggccgcactgaacaaggcatgagccggagcaccagtgttacttcccaaatttcaaacggttcgcacatgagttatacatag

SEQ ID NO: 137206 - DNA, 3150 bp, Artificial Sequence
  Description of Artificial Sequence: Synthetic coding sequence
atgcctgctggaggcagggctggctccctcaaggacccagatgtggcggagcttttcttcaaagacgatccagaaaaactgttttcagatcttagggaaatcggtcatggctctttcggcgctgtttacttcgctagagacgtgagaaacagcgaggtagttgccatcaagaagatgtcatattccggcaaacagagcaacgaaaagtggcaggatattataaaagaggttcgctttctccagaagctgaggcatccgaacactatccaatacagaggatgttatttgagagaacataccgcatggctggtgatggaatactgcctgggaagcgcgagcgacctcttggaggtgcataagaaacctctccaggaggttgaaatcgccgccgtgacccatggggcactacaggggctggcgtatctgcactcacataatatgatccaccgggatgtgaaagccggcaatatcttgctgtccgaaccgggattggtgaagcttggagatttcggttccgccagcattatggcaccagctaactcattcgtggggacaccttattggatggccccagaagtgattctcgctatggacgagggacagtacgacggcaaggtagatgtgtggtctctcggcattacttgcatcgagctcgctgaacgcaaacctcctctgtttaacatgaacgctatgtcagcgttataccacattgcacagaacgagtccccggttctgcagtcaggacattggagcgagtactttcgcaactttgtggactcatgcttgcagaaaattccccaagacagacccacttcggaagtgctactcaagcatcgatttgtccttagagaaaggcctccaacggtcatcatggatctcatccagaggaccaaggacgcagtcagagaactggacaatctgcagtatcgcaaaatgaaaaagatactgtttcaggaggcccctaacggccctggggccgaggccccagaagaagaagaggaggccgagccttacatgcatagggccgggactttaacctctctcgagagctcgcactcggtgccctcgatgagtatatctgcttcctcgcagagcagctcggtgaacagcctcgccgacgctagcgacaatgaggaagaagaggaagaggaagaggaggaggaggaggaggaggaaggtccagaagctcgcgagatggctatgatgcaagaaggtgaacataccgtcaccagtcactcgtccatcatccacaggttgccagggtcggacaacctttatgacgatccataccagcccgagatcaccccaagcccattgcagccacccgcagccccagcacccacaagcacgactagttccgccaggcgacgagcttactgcagaaacagggaccatttcgcaacaataaggactgcttccctcgtgagccgacagatccaagaacatgaacaggatagcgccctgagagaacaactaagcggatataagcgcatgagaaggcaacaccagaagcagctgctcgcactcgagagcagactgagaggagaacgggaggagcactctgccaggctccagagggagctggaagctcagagggctggatttggtgcagaagccgagaaattggcccgccgacatcaagcaattggtgaaaaagaagcccgggccgcacaggccgaagaaaggaagttccagcagcacattctcggtcaacagaaaaaagagctggctgccttacttgaggctcagaaaagaacttacaagctgagaaaggaacagttaaaagaggaattacaggagaatccaagcacccctaaaagggaaaaggcagagtggctcctccgtcagaaagagcagctccaacaatgtcaagctgaggaagaagcaggcctactgcgtcggcagcggcaatacttcgaactgcagtgcaggcagtataaacggaaaatgcttctcgcccggcactctctcgatcaagacctgctcagggaggatttgaacaaaaagcagacccagaaggatctggaatgcgccctgcttctccggcaacatgaagccactcgtgagctggaactgaggcagctgcaagcagtccagagaactagagctgagctgactcggttgcagcaccagaccgagctcggcaatcagctggaatacaacaagagacgcgaacaagagcttagacagaagcatgcagctcaggttaggcagcagccaaagtccttgaagtccaaagagctccagatcaaaaagcagtttcaggaaacgtgcaaaatccagaccagacagtacaaggccctgagggctcatttactggagaccacacccaaggcccaacataagagcctattaaaacggttgaaagaagagcagacccgaaagctggcaatcctcgccgagcaatacgaccagagtatttctgaaatgctgtcgtcccaggcgttgcggctcgatgaaactcaagaggctgagtttcaggccttacgccaacagttgcagcaggagctcgagctgctcaacgcctaccagagtaagattaaaattaggacagagtctcaacacgagcgtgagctgagggaattagaacagagagtcgctctgcggcgagcactgctggagcaacgcgtcgaagaggaactgctggccctgcaaacaggtcgctcggaaagaatcaggagcctcctggagagacaggcacgggagattgaagccttcgatgctgagtcaatgaggctcggcttcagctccatggctttaggcggaatcccagccgaagccgctgctcaagggtatcccgcccctccacctgcccctgcctggccctcccgtcccgtacctcggtctggcgcgcattggagtcatgggcctccccccccagggatgccccctccggcctggcgtcagccctctctgctggccccccctggtccgccaaattggctcggtccaccgactcagtccggtactccccggggtggagctttactcctgctgagaaatagccctcaaccgctgcggcgcgcagcttccgggggaagcggcagtgagaatgttggtcctccagcagccgcagttcccgggcccctctctcgatccacgagtgtagcttctcatattctgaacgggtcatctcatttctactcttag

SEQ ID NO: 137207 - DNA, 3708 bp, Artificial Sequence
  Description of Artificial Sequence: Synthetic coding sequence
atgcccgcgggcggaagggcaggctctcttaaagatcccgacgtagccgaactgttctttaaagacgatccggaaaaactgttttccgatctgagggaaatcggccatgggtcattcggagcagtgtactttgcacgggatgtgagaaattctgaagtggtcgccatcaagaaaatgagctactccggcaagcagtctaatgagaagtggcaggatatcataaaggaggttcggttcctgcagaaactccggcaccctaacactatacagtatcggggatgttacctgagggagcataccgcatggctggtgatggaatattgcctgggatccgccagtgatcttctcgaggtacacaagaagcctctgcaggaagtagaaatcgccgcagtaacgcatggagctctgcagggcttggcctacctgcatagccacaatatgatccacagggacgtaaaggcggggaacattctgctgtccgaacctgggctggtgaaactaggggatttcggcagcgcctccatcatggcgcccgccaattccttcgtgggaactccctattggatggccccagaagtcatcttagctatggacgagggacagtacgacgggaaggtggatgtgtggagtctggggattacctgcatcgagctggccgagcggaagccccccctctttaacatgaacgcaatgagcgctttgtatcacatcgcccagaatgagtctcctgtgttacagagtgggcactggagcgagtatttccggaactttgtggatagttgcttacagaagattccacaagacagacccacgtccgaggtgctccttaagcatcgattcgtgctgcgcgagaggcccccaaccgtgattatggacctgatccaaaggacaaaggacgcggtgcgcgaattagataatctacaatatcggaaaatgaagaaaattctgtttcaggaagccccgaatggcccaggtgcagaggctcctgaagaggaggaagaagcggaaccatacatgcaccgggctgggaccctgacatctctcgagtcttcccactccgtgccatctatgtctataagcgctagtagccagtctagtagcgtgaatagcctcgctgacgccagcgacaacgaggaagaagaggaggaggaagaggaagaggaagaggaagaggagggacctgaggcccgggaaatggcaatgatgcaggaaggggaacatacagtcacaagccacagttctatcatccaccgccttcctggcagcgacaacctgtatgacgatccctaccagcccgagattacaccttcaccactgcagcctccagccgcccccgcccccacatcgacaacttctagcgccaggaggcgggcttactgtcgcaaccgagatcacttcgcaaccattcgaaccgctagcctggtctcaaggcagatccaagaacacgagcaagattcagctctgagggaacaactgtccggatacaagcggatgcgcagacagcatcagaagcagctgttggctttggagagccgcctccggggagaacgggaggagcattcagccaggctgcagcgcgaactggaggcgcagcgagcaggatttggcgccgaggcagagaaactggccaggcgccaccaggctattggagagaaggaggcacgcgccgcccaggccgaggagaggaagttccaacagcacatcctcgggcagcagaagaaggaactggctgctttgctcgaggctcagaagcggacttacaagctgagaaaggagcagctgaaagaggagcttcaggaaaaccctagcaccccaaagagggagaaagcagaatggctccttagacagaaagaacaactacagcagtgtcaggccgaagaggaagccggactgttgaggcggcaacggcagtactttgaacttcaatgccggcagtacaagagaaagatgctcttagccagacattcactagaccaagatttgctcagagaagatttaaataagaagcagactcagaaggacctggagtgcgcactgctattgcggcagcacgaggctactagagagttggaactccgccagctccaggccgttcagcggactagggcggagctgactcggctgcagcatcagactgaattgggaaaccaattagagtacaataagcggagggagcaggaattaaggcagaagcacgcagcccaagtgagacagcagcctaaaagtctgaaagtgcgcgccggccagcggccacctggactacccttgcccattccgggcgctcttggccctcccaacaccggaactcctattgagcagcagccttgctcccccggccaggaagcagtgctggaccagcgcatgctgggagaagaggaggaagccgtcggagagaggagaatcctgggcaaggagggggccacgctggaaccaaaacagcagagaatactgggggaggagtcaggtgccccatctcctagcccgcaaaaacatggctcacttgtcgatgaggaggtctgggggcttcctgaggagatagaggagctgcgagtcccaagtcttgtaccccaggagaggagcattgttggccaggaagaagctggaacctggagcttatggggtaaagaggacgaatccctactcgacgaagagtttgagctgggctgggttcagggcccagccctcactccagtcccggaggaggaggaggaagaggaagagggcgcccccattggcacccctagggaccccggagatggttgccctagtcccgacatcccaccggagccgccccccactcatctgaggccctgtcccgctagtcagttgcctggactgctgtcacacggtctgttagccggcttgtcattcgccgtaggctcatcctcaggcctgttgccgctgctgctgctcctcttacttccactcttggccgcgcagggcggaggcggcctccaggccgccctcctggcactggaggtaggtctggtgggattgggggccagctatctcctgctatgtacagcactgcatcttccgtcaagtttattcctgctgcttgctcaaggtaccgccttgggcgctgttcttgggctaagttggaggcggggcctcatgggagtgcccctgggcttaggcgccgcctggctgttggcatggccaggtctggccctaccattggtagccatggctgctgggggaagatgggtccggcagcagggcccgagggttcgcagaggaatttcccgattgtggctgcgcgtgcttctaagactgtcgccaatggcattccgagcactgcaggggtgcggtgccgtaggtgatcgtgggctcttcgctctgtacccaaaaaccaataaggacgggttccggtcgcggctgcctgttccaggacccagacgccgaaaccctcggactacacagcatcccctcgcccttctggctagggtctgggtcctgtgtaaagggtggaactggcgactggctagggcaagccagggattagcttctcacctgccgccatgggcgatccacacactggccagctggggcctcctgcggggggaacggcccactcggattccacggttgctcccaaggagtcagcggcaactcggaccacccgcctcgaggcagcctctccccggcacgctggcaggaaggagaagccgtactaggcagtcccgcgccctccccccttggcgatag

SEQ ID NO: 137208 - DNA, 2268 bp, Artificial Sequence
  Description of Artificial Sequence: Synthetic coding sequence
atgcccgctggaggccgtgcaggatcccttaaggatcccgacgtcgctgagctttttttcaaagatgatcctgagaaactcttctcagatctgagagagataggacacggcagcttcggagccgtctactttgcccgcgacgtcagaaatagcgaggtggtggctattaaaaagatgtcatactcaggcaagcagtcgaatgaaaagtggcaggacataatcaaagaggttaggttcttacagaaactgcgacatccaaataccatccagtaccggggctgttatctcagggaacacaccgcctggctggtcatggaatattgtctcggtagcgcaagtgatttgctggaggtccataaaaagccactgcaggaggtggaaatagcggctgtgactcatggcgctcttcagggcctggcctacctgcactcccataatatgattcaccgtgacgtcaaagcaggcaacatcctcctctccgagcccggcctggtgaaacttggggattttggtagcgctagcatcatggcccctgctaactcttttgtcggcaccccttactggatggcacccgaggtgattttagcaatggatgagggacagtatgacggcaaagtggatgtttggtccctcggcataacgtgtattgaactcgcggagaggaagccccctctgtttaacatgaatgctatgagtgccctgtaccatatcgctcagaacgaatctccagtgctccagtctgggcactggtccgagtacttcaggaacttcgtggacagctgcctgcagaaaatcccccaggatcggccaacgagcgaggtgctactcaagcacagattcgttctgagagaaagacccccgacagtcattatggatctgatccaacgaacgaaggacgctgtgagggaactggataatttgcagtacagaaagatgaaaaagatcttgtttcaggaagccccgaatgggcccggggcggaggcccccgaagaggaagaagaggcagagccatacatgcatcgtgctggaactctcacttcgttggaaagtagtcatagcgttccttctatgtccatcagcgctagctcacaatccagctctgtgaacagccttgctgacgcaagcgacaacgaagaggaagaggaggaggaggaggaggaggaggaagaggaggagggacccgaagcccgtgagatggccatgatgcaggaaggcgagcacacagtgacctcccattcgagtattatacacagactgcccgggagtgacaatctgtacgatgatccctaccaacctgagattactcccagtccattgcaaccccctgctgcacccgctcccactagtaccacctcttcggctagacgtcgcgcctactgccgtaatcgggaccacttcgctactatccgaaccgcctcattagtgagtcgccagatccaggagcatgaacaggactccgccctgcgtgaacagctctcggggtataaaagaatgcggcggcagcatcagaaacagctgctggcactggagagcagactgaggggtgagagggaggagcactccgctaggctgcagagggaactggaggcccaacgcgcaggctttggggcagaggccgaaaagctcgcacggcgccatcaagccattggagaaaaggaggctcgagccgcccaggcagaggaaaggaaatttcagcagcacatcctcggccaacagaaaaaggagctcgccgcccttcttgaggcccagaaacgaacttataaattgaggaaggaacagctcaaagaagaactccaggaaaacccttcaacacccaagagagaaaaggcagagtggttgctgagacaaaaggagcagttacagcagtgccaggccgaggaggaggccggattgctgcggagacaacgtcagtactttgaactgcagtgcaggcagtacaagaggaagatgcttcttgcccgtcacagccttgaccaggacctgctgcgggaggacctgaacaaaaagcaaacacagaaggacctagagtgtgccctgctactgagacagcacgaggcaactagagaattggagcttcggcaattgcaagctgtccagaggactcgtgcggagctaacaaggttgcaacatcaaactgaattgggtaatcagctggaatataacaaaaggcgtgagcaggaactgagacagaagcacgcggctcaggtgagacaacagcctaaaagccttaagaaaaagaccaatacaaacaaaatttccgaacgctag

SEQ ID NO: 137209 - DNA, 3369 bp, Artificial Sequence
  Description of Artificial Sequence: Synthetic coding sequence
atgcccgccggtgggcgcgctggctctctcaaggatcctgatgtggccgaattgttctttaaggacgatccagagaaattattcagtgaccttcgtgagattggccacggctccttcggtgcggtgtacttcgccagagacgttcgaaactccgaagtggtggcaataaagaaaatgtcatatagcggtaagcagtccaacgagaagtggcaagacattattaaggaggtgcggttcttgcagaagctccgtcaccctaacaccatccagtaccgaggctgctatttgcgagagcacaccgcgtggttggtcatggaatattgcctgggctcagcgagtgacctgctggaggtacacaagaagcccctgcaggaggtcgagatcgcggcagtaactcacggggcgcttcaggggctggcttacctccacagccacaacatgatccatcgggatgtcaaagcagggaatattctcctgagcgagcctggcctggttaaactgggcgactttggctcagcctcaatcatggccccagctaatagctttgtgggtactccctattggatggcaccggaagttattctggccatggatgaaggccagtacgacggcaaagtcgacgtgtggagcctcggcatcacatgtatcgagttggcggagagaaaacctcctttgttcaacatgaacgcgatgagtgcactttatcacatcgctcaaaacgaatccccagtgctgcagagcggccactggtcagagtactttcgaaacttcgtggactcttgtcttcagaagatcccccaagacaggcccacatccgaagtgctcctgaagcatagatttgtgctgagggagcggccgccaactgtgattatggacctgatccagcggacaaaagatgcagttcgggagctggacaatctgcagtaccggaaaatgaaaaagatcctgtttcaagaggctcctaacgggcccggcgccgaagcccctgaggaagaggaggaggcagagccttatatgcacagggcagggacgttgactagcttagagagtagccactcggttcccagcatgtcaatttcagcctcgtctcagtcttcatcagtgaattctctagccgacgcatcagacaatgaagaggaggaagaggaggaagaagaggaggaagaagaggaagaaggccctgaggctagggagatggctatgatgcaagagggggaacatacggtaacaagccattcttcaatcatacaccgtctcccaggctctgataacctctatgatgacccttatcagcctgagattactcccagtccacttcaacctcccgccgcccctgccccaacttcaacgacatcctcggctcgccgacgggcatattgccggaatagggaccattttgcgacaatccgcactgcttctctcgtgagccggcagatccaagagcatgaacaggatagtgccttgcgagagcaactctccggatacaagcggatgaggagacagcaccaaaagcagctcctggccctggagtctcgcttgcggggtgaacgagaggagcatagcgcccgtctgcaacgcgaacttgaagcccagagggcaggatttggcgcagaagccgagaaactggcacgaaggcaccaagctattggggaaaaggaggccagagccgcgcaggcggaggaacgcaagttccagcagcacatactgggccaacagaagaaagaactagccgccctcctggaggcccagaagaggacatacaagctccgcaaagagcaactgaaggaggaactccaggagaatccatccactccaaagcgcgaaaaggctgagtggcttcttcgacagaaggaacagctccaacaatgtcaggcggaggaggaagccggcctgctgcgcaggcagcgccagtactttgaactgcagtgtaggcagtacaaacgcaagatgttgctggcccgccattccctggaccaggatttacttcgagaggatctcaacaaaaaacagacgcagaaagacttagaatgtgctttgttattacgccagcatgaagcaaccagagaacttgagctccggcagctccaggcagttcagcgtacaagagctgaactcactagactccaacatcaaacggagctggggaatcaattagagtacaataagaggcgcgagcaggagctgagacaaaaacacgcagcccaggtcagacagcagcccaagtccttgaaggaaaggtctatcgttggacaggaggaagctgggacgtggagcctgtggggtaaagaagatgagtccttactggatgaggagtttgagttgggctgggtccagggcccagcccttacacccgtaccggaagaagaggaggaggaggaggagggggcacctatcgggacaccacgcgaccctggggacggctgtccatcacccgatatcccccctgaaccaccacctacacaccttcgcccatgccctgcttcacaactacccggcctcttgtcccatggcctacttgctggcctgtcgtttgctgtgggatcctccagcggcctgctgccactcctgctcctgttgctgctgcctttactggctgctcaggggggggggggcctgcaagccgccttacttgccctcgaagtagggctggttgggctgggggccagctacctgctattgtgcaccgctctgcaccttccgtcctcattgtttctgcttctcgctcagggtacagcactgggtgccgtactcggcctgagctggcgaagaggcctgatgggcgttccactggggctcggcgccgcctggctgctggcctggcctggacttgcattgcccttggttgccatggcagccggaggacgctgggtccggcagcagggaccacgggtgaggcggggaattagtcggctgtggctgcgcgtgctgttgcggctgtcccctatggcgtttcgggcattgcaaggatgtggagctgtgggcgatagaggtctctttgccctgtacccaaagacaaacaaggacggattcaggtcccggctacccgtcccagggccccgaagacgcaatccccggacaacccagcatcccttagcactcctagccagagtgtgggttctctgcaagggttggaactggcgcctggcaagggcatcccaagggttggcctcccacctccccccctgggccattcatacgcttgctagttggggactgctgcgtggcgagagaccaactagaatcccacggttactccctcgctctcagcggcagttgggccccccggcctcaaggcagccattaccaggtactctcgctggtaggagatccagaacaagacaaagtcgcgccctgccaccttggcggtag

SEQ ID NO: 137210 - DNA, 1401 bp, Artificial Sequence
  Description of Artificial Sequence: Synthetic coding sequence
atgaagagcctgagcttactgttagctgtggctctgggcctagctacggccgttagcgcgggacctgcagtgatcgagtgttggttcgtcgaggatgcatccggcaaggggctcgcaaagcggcctggagctctcctcctgagacagggacccggagagcccccaccaaggccagacctcgatccagagctgtatctgtccgtgcacgatcctgctggggctctgcaagccgcgttccgcaggtaccctagaggagcccctgcccctcactgtgagatgtctaggttcgttccgctgccagctagcgctaaatgggctagcgggctgacccctgctcagaattgcccgcgcgcccttgatggcgcctggctcatggtgtccatatcttcgcccgtactttcactgagttcccttctcaggcctcagccagagccacagcaggaaccagtgttaatcaccatggcaaccgtggaaatgggctttcatcacgtcggacaggcagccctcgaactgctgacatccgttgtgttaactgtgctgactcacacccctgcacctcgggtacgcctgggccaggacgctttattagatctcagcttcgcatatatgccgccaacttcagaagccgcctcttctctggcaccaggcccccccccttttggcctggaatggcgtcggcaacacttgggcaaggggcacctgcttcttgccgcaactccggggctcaacgggcagatgcccgcagctcaagagggcgctgttgcttttgccgcctgggatgacgacgagccatggggaccatggacgggcaacggaacattctggctgccacgggtgcagccattccaggagggcacctatctggctactatccacctcccgtacttgcagggccaggtgaccttggagctggctgtatataaacctcctaaagtgtcgctgatgccagctacacttgcgagagccgcaccaggcgaggctcctccagagttactctgcctggtatctcatttctacccaagtggagggttggaagtcgagtgggagcttaggggcggcccgggcggccggtcgcaaaaggcagaaggacagagatggctgagcgccctgagacatcactccgatggatcggtttcactgagcgggcacctgcagccccctcctgttaccacagaacagcacggggcacggtatgcatgtcgaatccaccacccatctcttccggccagcggaagaagcgccgaagtgacgctggaggtggccggcctgtctgggcctagccttgaggacagcgttggtttgttcttgtccgcctttctgctgttaggactctttaaagccctgggctgggctgctgtctacctgagtacatgtaaagatagcaaaaagaaggcagaatag

SEQ ID NO: 137211 - DNA, 1347 bp, Artificial Sequence
  Description of Artificial Sequence: Synthetic coding sequence
atgaaatccctgagtctcctcctggccgtcgccctcgggttagccaccgcagtgtctgcaggtccagccgttatagagtgctggttcgttgaagatgcaagtgggaaaggtctggccaaacgaccaggcgctttgttgctgcgccagggtcctggcgaacctccacctaggcctgacctcgatcccgaactgtatctctctgtgcacgatcccgcaggcgcattgcaggctgcattccgcagatatccacggggcgctcccgctcctcattgtgagatgagtaggttcgtgccccttcctgccagcgccaaatgggcatctgggctcacacccgcacagaattgcccaagggccctggacggggcctggctaatggttagcatttcatcccctgtattgagtttgtcctcattactgcggccccagccagaaccccaacaggagcccgtgctgattaccatggctaccgttgtcctgacagtcttaacacacactcctgcaccgagagtacgtttggggcaggacgctctgctggatctctcctttgcgtatatgcctccaaccagcgaggctgcctcctcacttgccccaggtccaccgcctttcggcctggagtggagaaggcagcacctcggcaaaggccacctgctcttggctgctactccaggcctaaatggccagatgcctgctgctcaggagggggctgtggcgtttgcagcctgggatgacgacgagccatgggggccatggactgggaacggaacattctggctgccaagggtacagccctttcaggaaggtacttatctagcgacgatacaccttccttatctgcagggtcaggtcacactagaactagccgtgtataaaccccctaaggtgtctctcatgccagctactctcgccagggccgctccaggagaggcccctcctgagttgttatgtctcgtgtctcacttctatccaagcggcggccttgaggtggaatgggaactcaggggagggcccggaggaagatcccagaaggcggagggtcagcgctggttatcagccctcagacaccattctgacggttccgtgagtctgtctgggcatctgcaacccccccctgttacaacggaacaacatggagcacgctatgcttgccggatccaccaccctagcctacccgcctccggccgctctgccgaagtgacactggaagttgcaggactgtccggtccctccctcgaggacagcgtgggcttgttcctgtcggcgtttctgcttctaggtcttttcaaagccttaggatgggccgcagtgtacttatcaacgtgcaaggactccaaaaagaaagctgaatag

SEQ ID NO: 137212 - DNA, 1515 bp, Artificial Sequence
  Description of Artificial Sequence: Synthetic coding sequence
atgaagtcactgtccctcctgctcgctgtggcactgggtctggcaacggccgtctcggctggcccagccgtcatcgagtgctggtttgttgaggacgcctcaggtaaaggattggctaaacgaccaggagccctgctgctgcgacagggccctggcgagcctccccctagacccgacctggaccccgaactctacctgagtgtgcatgaccctgccggtgccttgcaggcagccttcaggcgctaccctcggggagcaccagccccccactgcgagatgtctcggttcgtgccacttcccgcatcagccaagtgggcctccggccttacaccagcacagaattgtcccagggctctcgacggggcgtggctgatggttagtatttcttccccggttctgtcactgtcctctctgctccgaccccagcccgaaccccagcaagaacctgtgctcattaccatggcaacagtggtattgaccgttctgacacatacgcccgccccaagagtgagactgggccaggatgccctgcttgatttatctttcgcctatatgccccccacttcggaagctgcctcgagcctcgccccaggacctcctccttttggcctggaatggagacgccagcatttggggaagggccacttactcctggccgccaccccaggactgaacgggcagatgccagcagcccaggagggagcagtagcatttgctgcctgggacgatgacgagccttggggaccttggacaggaaacggcacattctggttacccacagtacagccctttcaggaaggtacgtacctcgccactatacacctgccttaccttcaggggcaggtgaccttggagttagccgtgtacaagcccccgaaagtgtcgctcatgcctgccaccctcgctagagctgctcctggagaggctcccccggaactgctatgtcttgtgtcgcacttttatcccagtggtggacttgaggtcgagtgggagctgcgcggcgggcccggcggacggtctcaaaaggcagaagggcagcgctggcttagcgccctgcgccatcatagtgacggctctgtcagtcttagcggccacctgcagcccccgcccgttactaccgaacagcacggcgcccggtatgcctgccgcatccatcatccgagcctacccgcctccggaagaagcgccgaagtaaccctggaggtggccggcctgagcggaccctccctggaggattccgtcgggttgttcctcagcgcctttctgcttcttggcttgttcaaagcactgggctgggcagcagtgtatctctctacctgcaaggattccaagaaggtgcagtgttctaccagtctgtatctgtcgctggtcactttgtccccacatccgatctcaaagccaatggagggcgggtgctggtgcggaagacagaatctgggcctagagtttacactgatctgggtgaaaacatggcactatattttgactgtgggtctgtttgaacacgcgacttag

SEQ ID NO: 137213 - DNA, 1347 bp, Artificial Sequence
  Description of Artificial Sequence: Synthetic coding sequence
atgaagtcccttagtttgctactagccgtggcactcgggcttgcgacagccgtgtccgccggacccgcagtaattgagtgctggttcgtcgaagacgcttctggcaaagggttggccaaacgacccggggccctgttgctcagacagggaccgggagagcctccgccccgccccgaccttgaccccgaactctatctatcggtgcatgatccggccggagctctgcaggccgcctttcgccgatacccacgcggagcaccagcaccgcactgtgaaatgagccgatttgttcctctgcccgctagtgccaagtgggcctcaggacttacacctgcccaaaactgtccacgagctcttgatggtgcgtggttaatggtgagcatcagtagtccagttcttagcctgtcttccctgttacgtccgcagcctgaacctcagcaggagccagtgctcataactatggctacggttgtgttgactgtcctcacacacacacctgctccacgagtcagactgggacaagatgctctattggacctgtccttcgcatacatgccgccgacatcagaagccgccagctctcttgcaccaggacccccacccttcggactcgaatggaggcgccagcacctgggtaagggccacttgctcctggcagcgacccccgggctaaacggccagatgcctgccgctcaagagggcgctgtggcattcgccgcatgggacgatgatgagccttggggaccttggaccggcaacggaaccttttggctgcctacagtgcaacccttccaggagggcacatatctggccaccattcacctgccctacctccaagggcaagtgacactcgagttagctgtctataaacctcctaaggtctcactgatgccggctactttggcaagggcagcccccggtgaggcccctcccgagctgttatgcctggtgtcgcacttttatccctctggaggactggaagtggagtgggaactgagaggtggacctggtggcagaagtcagaaggccgaaggccagcgctggctttcagctcttcgtcaccactctgatgggtctgtgtccttatctgggcacctccagcccccccccgtgacgacggagcagcatggcgccagatatgcctgcagaatacaccatccaagcctcccagccagcggaaggagtgctgaggtgaccctcgaggtggcaggtctgagcggtcctagtctagaggactcagtgggcctgtttctgagcgcttttctgctgctcggcctgtttaaggctttaggctgggccgccgtctacctgagcacttgcaaggattccaagaagaaagctgagtag

SEQ ID NO: 137214 - DNA, 1401 bp, Artificial Sequence
  Description of Artificial Sequence: Synthetic coding sequence
atgaaatctctttccttactgcttgcagttgcccttggtttagccacagctgtcagtgcggggcccgctgtgatcgaatgctggtttgtggaggacgcctcaggcaagggcctggccaagagacctggcgccttactattgcgacaaggccctggggagccgcccccgcgtcccgacctggatcccgagctctacttgtcagtgcacgatcccgctggcgcactccaggccgccttcaggcggtaccccagaggagcccccgccccacattgtgagatgtctagatttgttccactgcccgcttccgccaaatgggcctctggcctaacaccagcccagaactgcccacgcgccctggacggagcttggcttatggtgagcatatctagcccggtgctgagcctctcctccctgctgaggccccagcctgaaccacagcaagaacccgtcctcatcactatggcaacagtggaaatgggattccatcatgtgggccaggcagctctggagctgttaacctctgtggtgctcacagtgctgacccatacaccggccccacgggttaggcttgggcaggacgccctgctggacttgtcctttgcctatatgccccctacctctgaggcagccagctcgctagcacctggaccacctccctttggcctcgagtggcgcagacagcatcttggcaaggggcatcttctgctcgctgctactcccggactgaacgggcagatgcctgcagctcaagaaggagccgtggccttcgccgcttgggatgatgacgaaccctggggcccctggaccggaaatgggacattctggctgcctaccgtgcagccttttcaggagggcacgtacctggccacgatacatttgccatacctccagggacaagtgaccttggaattggcggtgtataagcctcccaaggtgtccctcatgcccgcaaccctggctcgcgctgctccgggagaagctccccccgagctgctgtgtctggtctctcatttctaccccagcgggggcctggaagtcgaatgggagttgaggggcggaccgggggggagaagtcagaaggccgagggccagaggtggcttagtgctctgcgccatcattctgacgggtccgttagcttgagtggccacctacaacccccccctgtcactacggaacaacacggggcccgatatgcttgtcggatccaccatccatcgcttcccgcctccggtaggagcgccgaggtcacactggaggtggccggtctgtctgggccatctttggaggactccgtggggctgtttctctcggcatttctcttgctgggcctattcaaagctttgggatgggccgcagtctacctcagtacctgcaaagatagtaaaaagaaagccgaatag

SEQ ID NO: 137215 - DNA, 1515 bp, Artificial Sequence
  Description of Artificial Sequence: Synthetic coding sequence
atgaagtcactgtctctgctactggccgtggctttgggcctggccacggcagtgtccgctggtcctgcggtgattgaatgttggttcgtggaggatgcttcaggcaaggggctcgcgaaaaggccaggagctctcctacttaggcagggcccaggcgagccaccgcctagacctgatttggacccagagttatatctgtccgttcatgaccctgccggcgctcttcaagccgccttccggagatatcccaggggagcccccgccccccactgtgaaatgtctaggttcgtccctctaccagccagcgcgaagtgggcctctggattgacgcctgcacaaaactgtccacgcgcgcttgacggcgcgtggctgatggtatcaatcagttccccagtgctgtccctgtccagtctgctgcgcccacagcccgaaccgcaacaggagcctgtgctgatcacaatggccactgtggtgctgactgtgctgacacatacgcccgctcccagagtcagactggggcaggacgctttattggatctctcgttcgcatacatgcctcctacttccgaagctgctagcagtctggcaccaggccctccgccatttggtttggaatggaggcggcagcacctaggcaaagggcatctactccttgccgctacacccgggctgaacgggcagatgccggctgcgcaagaaggagccgtcgcctttgccgcctgggacgatgacgaaccctggggcccatggacagggaacgggacattctggctgccgcgggtacagcctttccaggagggaacgtacctggctaccattcatctcccctacctgcaaggacaagtgaccttggagctggctgtctacaagcctcctaaagtgtccctcatgcccgctacactggcccgcgccgccccaggtgaggcaccaccagaattgctctgtctcgtctcccacttttacccaagcggagggctcgaggtcgagtgggagctgcggggaggtccaggaggccgcagccagaaagctgagggtcagagatggctgtccgccctgcggcatcacagtgatgggtcagtgagcctgagcggccacctacagcctccaccagttacaaccgagcagcacggggctcggtatgcatgcagaatccaccatccctcgcttcctgcctctggccggagcgccgaggtgacactcgaggtggcaggcctgtccgggccgtctctcgaagacagcgtcggcctctttctatccgccttcctactcctgggcttatttaaggccctgggttgggcggccgtttatctgagcacttgcaaagatagcaaaaaggtacaatgctcaacgagcctgtatctctctcttgtgaccctatctccccacccaatcagcaagcccatggaaggcggttgttggtgcggcagacagaatctgggactggaatttaccctcatttgggttaagacctggcattacattctaacggtagggctgtttgaacacgctacatag

SEQ ID NO: 137216 - DNA, 1347 bp, Artificial Sequence
  Description of Artificial Sequence: Synthetic coding sequence
atgaagtctcttagcctcctgctcgcggtcgcactcggcctggccactgctgttagcgccgggcccgctgtcattgagtgctggtttgtggaagacgctagcggaaaggggctggcaaaacgcccaggggccttgctgctccgccagggtcctggagaacctccaccccggccggacctcgatccagaactttacctgagtgtgcatgatcctgccggcgccctgcaggctgcttttcggcgatacccgagaggagcgcccgccccccattgcgagatgtcaagattcgtacctctccccgccagcgccaagtgggcctcagggttaaccccggctcagaattgtccgagggccctagacggagcttggctgatggtgtctatctcttccccagtcctcagtttatcctctttgctgcgcccacaacccgaacctcagcaagaacccgtgcttatcacaatggctactgtggtgctgacggttctgactcatactcccgctcctcgggtccgactgggtcaagatgccctgttggacttgtccttcgcctacatgcctcctacctcagaggccgccagtagcctggcgccaggccctccgccattcggcctggagtggagaagacagcacctgggtaaggggcatctgcttttagctgcgacacccgggctgaatggtcaaatgccagccgctcaggagggagcagtggccttcgcggcatgggatgacgatgagccatgggggccctggactggaaacggtacgttttggctccctagggttcagccgttccaggaaggtacatacctggccactattcatcttccttatttacaggggcaggtcaccttagaactggccgtgtacaagccccctaaggtttccctgatgcccgctaccttggctagagctgcccctggtgaggcccctcccgaactgctctgtcttgtatctcacttctaccctagtggcggcctcgaagttgaatgggaattgagaggaggcccaggcggcagatcccagaaggcggagggtcaaagatggctgagcgcattacgtcatcattcagatggctccgtctcactctcaggtcacttacagcccccaccggttacaaccgaacaacatggggctcggtacgcctgtcgtattcaccacccttccctgcccgcgagcggccgctcagccgaggtgacgttagaggtcgccggtctatctggccccagcctggaggatagtgttggcctgttcctgtccgcttttttgctgctcgggctcttcaaagccttgggctgggctgcagtttatctctctacctgcaaagacagtaagaaaaaggcagaatag

SEQ ID NO: 137217 - DNA, 1515 bp, Artificial Sequence
  Description of Artificial Sequence: Synthetic coding sequence
atgaagagcctgagcttattgttggcagtggcccttggacttgcgaccgcggtgagtgcaggacctgccgtaattgagtgctggtttgtcgaggacgcctcagggaagggacttgctaaacggcccggcgccctgctgctcagacaaggcccaggcgagcccccacccagacccgatttagaccctgagctctacttgtctgtccacgatccggctggtgctcttcaggccgctttcagaagatatccccggggagcgcctgccccccattgcgaaatgtcgagattcgtgcccttacccgcgagcgccaaatgggcaagtggactcacacccgcccagaactgccctcgtgcccttgatggagcatggctaatggtgagcatttctagcccagtcctcagtctctcctctctgcttcgcccacagccggaaccccagcaggagccggtccttatcacaatggcgactgtagtgctgacggtgctcactcatacccccgcgccacgggtgcggctgggccaagacgccctcttggatctcagctttgcgtatatgcctccaacctccgaagccgccagcagtctcgcgccaggcccacccccgtttggcctggagtggaggcgccagcacttagggaagggacacctgctgctcgccgccaccccaggcctgaatgggcagatgcctgccgctcaggagggcgcagtggcttttgcagcctgggatgacgacgagccttggggcccctggaccgggaatgggaccttctggctgccaagggtgcagccgtttcaggagggaacatacctggccactattcatctaccctatctgcaaggccaagtaaccttggaactggctgtgtataagccacccaaggtgtccctgatgccggctacattggcgagagcagccccaggagaggctccacccgaactgctttgtctcgtgtctcatttttatccctctgggggattggaagttgagtgggagctgaggggggggcccggtggcagaagccaaaaagccgaaggtcagagatggctgagcgctcttagacaccactccgacggctctgtgtccctgtccggccatctgcaacccccgcctgtgactactgagcagcatggagccaggtatgcgtgcagaattcatcacccgagtctgcccgcgtcagggcgttcggcagaggtcaccctagaggtcgctgggctgagtggaccaagcctggaagattccgtgggattgtttctgagcgctttcctcctgttgggcctcttcaaggccctcggatgggccgcagtgtatctgtctacatgcaaagacagcaaaaaagttcagtgcagcacctcgctgtacttgagtttagtaaccctctcgccgcatcccattagtaaacctatggagggaggctgctggtgtgggaggcagaacctgggactggagtttacccttatatgggtcaaaacgtggcactacatactgaccgtcggcctgttcgagcacgccacctag

SEQ ID NO: 137218 - DNA, 1401 bp, Artificial Sequence
  Description of Artificial Sequence: Synthetic coding sequence
atgaaaagcctgagcctcctgctggctgtagccctgggcctcgctaccgccgtgtctgcagggccagcagtcattgagtgctggtttgtggaggacgcatcgggaaagggcttagccaagcggcccggcgcactgctgctacgacagggacccggcgagccccctcctcgtccagacctcgatccagagttgtacctttccgtgcatgaccctgcaggcgcactgcaggctgcttttaggcgataccccaggggcgcaccagctccccactgtgagatgagtagatttgtacccttgcctgcttctgccaagtgggccagcgggctgacgccagcacagaactgtccccgggccctggacggcgcctggcttatggtctctatatcatcaccagttctctcattgtcgagcctgctccgaccccagcccgagccccagcaggaacccgtgctgatcacaatggcaacggtggaaatggggttccaccacgtgggacaagccgctttagagctactgacatcagtggttctcacagtactaacacacacgcctgctccccgtgttcggctcggccaggacgccttgctggacctgtccttcgcctatatgccccctacgagtgaggccgcttcttcactggcgcccgggccaccaccctttggattagagtggcgcaggcagcacttaggaaaggggcacttactcctggccgccacccctggtttgaatggacagatgcctgccgctcaggagggagccgtggccttcgccgcttgggatgacgacgaaccctggggtccttggacggggaatggcactttctggctgccccgcgtacagccattccaggagggcacctacttggccactattcacttgccctatttacaaggtcaagtcaccttagagctcgcagtgtacaagccgccaaaagtgtccctcatgcctgctacactggcacgtgctgctcctggggaggcacccccagagctcctttgtctagtatcgcatttctacccctccggcggattggaggtcgagtgggagcttcgcggcggccctggaggcagatctcagaaagcagaggggcaaagatggctgtctgcactgcgccaccactctgatggatctgtcagcctttcaggacatctccagcctcctcctgtaacgactgagcaacacggcgcccggtatgcctgccggattcaccacccatctcttcctgccagtgggcgcagcgccgaggtgacgctcgaggtggcgggcctaagcggcccgagcctggaagattcagtgggcttgttcctgagcgcctttctcctcctcggcttatttaaggctctgggctgggccgcagtatatctgagcacttgtaaagacagcaaaaaaaaggcggaatag

SEQ ID NO: 137219 - DNA, 1347 bp, Artificial Sequence
  Description of Artificial Sequence: Synthetic coding sequence
atgaagagcttgagccttctgcttgccgtggccctcggattagccacggcagtttcagcagggccggctgtgatcgaatgttggttcgtcgaggacgcgagcggcaaggggctggcaaaacggcccggagccttgctgctgagacaaggaccgggggaacccccgcctaggccagatctcgacccggagctgtatctctctgtgcacgatcccgcgggcgcactgcaagccgcattcaggaggtatcccagaggagctccagctccccactgcgaaatgagtcgcttcgtacctctcccagcctctgcaaagtgggcctcaggtctgaccccagcccagaattgtcctcgagccctggatggggcctggcttatggtgtctatcagttccccagtgctgtccctgtcctcattgctgcggccccagcctgaaccccagcaggagcctgtgctgatcacaatggccaccgtggtcttaaccgtgctgacacacacacctgctcctagggtacggcttggacaggacgctttgctggatctatccttcgcttacatgccaccaacctccgaagctgcgagttctttagcgccgggccccccaccctttggactggagtggaggcgtcagcaccttgggaaagggcacttactgctggccgccacgccgggactcaacggccagatgccagctgctcaggagggagccgtggcctttgcagcctgggacgatgatgaaccatggggtccgtggaccggtaatggcactttttggttgccccgtgttcagccatttcaggagggtacttatttagctaccattcacctcccctatttgcagggccaagttactttggagctggccgtctataagccaccaaaagtctccctcatgcccgccacattggcccgagccgctcctggtgaggctccgcctgagctactatgcctcgtgagtcacttctatcctagcggcggcctggaggtcgaatgggaacttcgcggcggccccggcggcagatcccagaaggcagaaggccagagatggctgagcgctttgaggcaccactctgacggctccgtgtccctgagcgggcacctccaacctcctccagtgactacagagcagcatggcgctcggtacgcttgccgaatccaccacccctcccttcctgcttctggcaggtcagccgaagtcactctcgaagtcgctgggctgtcagggcccagtttggaggactcagtgggattgttcttgtctgcctttctgctactaggcttattcaaggcgctgggatgggccgcagtttatttaagcacgtgtaaggactcaaagaagaaggcagagtag

SEQ ID NO: 137220 - DNA, 1515 bp, Artificial Sequence
  Description of Artificial Sequence: Synthetic coding sequence
atgaagtcgctctcactgttattagccgtggccctggggctggcaactgctgtgtccgcgggacccgccgttatcgagtgctggttcgtcgaagatgcttccggcaaaggccttgcaaaacgaccaggggcgctactcctcagacagggtcccggggaaccccccccacggcctgacctggatcccgaactgtacttgtccgttcatgatccagctggggccctccaggccgccttccgccggtacccaagaggggctcccgctccacactgtgagatgagcaggtttgtcccccttccggcgagcgctaagtgggcatctggtttgaccccggcccagaactgccccagggctttggatggggcgtggctgatggtgtccattagttccccagtactttcgctctcgtccctgcttaggccgcagcccgaaccacagcaagagccggtactgattaccatggcaactgtcgttctgaccgtgctgacacatacccctgccccgcgggtccggttggggcaagatgccctgcttgacctgtctttcgcctacatgccgcctacctccgaggctgcctctagtctcgcacccgggcctccacctttcggattggagtggcgaaggcaacatctcgggaagggtcatttgctgttggccgctacccctggccttaacggtcagatgcccgctgctcaggaaggcgctgtcgctttcgccgcttgggatgatgacgagccatggggcccctggaccggtaatgggactttttggttgcctactgtgcagccattccaggagggcacctacttagctacaatccatctaccctatttacaaggccaggttactctggagctggccgtgtataaaccccccaaagtgtccttgatgccagccacactggctagagctgctccaggggaggccccacccgagctgctgtgtctagtgtcacacttctaccctagtggaggactggaagtggaatgggaactgagggggggcccaggtggccgcagccagaaagcggaaggacagcgctggctcagcgcactccgacatcacagcgatgggagcgtgtcattaagtggccatctgcagccacctcctgtcacgactgagcagcacggggccaggtacgcttgccggatccaccacccgagtctgccggcttcaggcagaagcgctgaggtaacactggaagtggctggtctttctggaccctcactggaagattccgttggcttgttcttgagcgctttcttacttttaggcctgtttaaagctcttggctgggcagcagtttacttgtctacatgtaaggatagcaagaaggtccagtgttcgacaagtctgtatttgagccttgttacgctgtccccccaccctatttccaagccgatggaagggggttgttggtgcgggcggcagaacctggggttggagttcactctcatttgggtgaaaacatggcactacattttaactgtgggcttatttgagcacgccacctag

SEQ ID NO: 137221 - DNA, 609 bp, Artificial Sequence
  Description of Artificial Sequence: Synthetic coding sequence
atgaagtcgctgagtctgcttcttgccgtggctctcgggttggccaccgctgtctcagccggaccagctgtcatcgagtgctggtttgtggaggacgcttcaggcaaggggcttgcaaagcgccccggcgctctgctgctgcgtcagggccccggggagccgcctccccgcccagatctcgatccggagctctacctgtcagtacacgtggttctcacagtcctgacccacacccctgctcccagagtccgacttggacaggatgcactgctcgacttaagctttgcctatatgcctccaaccagcgaggccgcctcctcacttgccccggggccacccccctttggccttgagtggaggagacaacatttgggcaagggacatctgttactggctgccactccgggcttgaatggacagatgcccgccgcccaggagggcgccgttgcctttgctgcgtgggatgacgacgagccttggggtccctggaccggtaatggcactttttggctgccacgagtccaacccttccaggagggcacttacctagccaccattcatctcccctaccttcaagggcaggttaccctggaactcgccgtctactag

SEQ ID NO: 137222 - DNA, 1347 bp, Artificial Sequence
  Description of Artificial Sequence: Synthetic coding sequence
atgaaaagcctgtcccttcttctcgcggtggcccttgggctggctaccgctgtatcggcgggtccagctgtgatagaatgctggtttgtcgaggacgcttccggaaaggggctggccaagcgaccaggcgccctgctccttcgacaaggacccggagagcctcccccccgacccgatttggaccccgaattgtatttgtcagtgcacgatcccgccggggccctacaagcagctttccgcaggtaccctcggggagcacccgcaccacactgcgagatgtccaggtttgtccctttgcctgctagtgccaagtgggcctcgggcctaacgccagcccaaaactgcccacgcgctctggatggcgcctggctcatggtttcaatttcttctcccgtcttatctctgtcctcactcctgagaccccagccagagccccagcaggagccggtcctgatcaccatggcaacagtcgtcttgaccgtgctgacccacacccctgctcctcgagtgcgcctgggccaggacgccctgctggatttatcctttgcgtatatgcctcctacatccgaagcagcgagctctttagcccccggcccccccccttttgggctggaatggcggcgccagcatttaggtaaaggtcacctgcttctcgctgccacccctggcctgaacggccagatgccagccgcccaagagggtgcggttgcttttgctgcctgggacgacgacgagccatgggggccctggactggcaacggtaccttctggctcccgacagttcagccattccaggaaggtacgtatctggccactatccacttaccttacttgcagggccaggtgactttggagttggccgtatacaagccacctaaagtgagcttaatgcctgctacattagccagggcggccccgggcgaggccccccctgaactgctctgtcttgtgagccatttctacccgtcaggcggcctcgaggtggagtgggagctacggggcggacccggaggccggagtcaaaaggcagaggggcagagatggctttcagcccttcgccaccactcggacggcagtgtcagtttgtctgggcacctccagcctccgccagtaacaacagagcaacacggcgccaggtacgcctgtagaattcatcaccctagcctgcccgctagcggccgctccgctgaggtgacactcgaggtggccggcttaagtgggccatccctggaagacagcgtgggcctgtttctgagcgccttcctacttctcggtctgttcaaagcgctgggctgggcagccgtctacctgagtacatgtaaagattctaagaaaaaagccgagtag

SEQ ID NO: 137223 - DNA, 1401 bp, Artificial Sequence
  Description of Artificial Sequence: Synthetic coding sequence
atgaagtccctctccctgctcctggcggtagctctgggacttgcaacagctgtaagtgctggccctgctgtgatagagtgctggttcgtcgaggacgccagcgggaaaggtcttgctaaacggcccggtgcgctcctactgcgccagggcccaggggagcctccaccaaggccggacttggacccagagctctatctgtcagttcacgatcctgcaggggcactacaggcagcgttcagaagatatcctcgcggagcccccgcccctcattgcgagatgtcccgctttgtgcccctacctgcctcagccaaatgggcctctgggctcactcctgctcagaattgtccacgcgcgctggatggagcatggctcatggtgagcatcagctcccctgtgctgagcctgtcatctctcctgcgtcctcagccagagccacagcaggaacccgtactgataacaatggctacggtagaaatgggttttcaccacgtcggacaggccgccctggagctcctcacaagcgtcgttctgacagtgctgacacatacaccagcaccccgggtcaggctcggacaagatgctctgctggacctgtccttcgcttacatgcctcctacttccgaggccgcttcctcattggcaccaggtccaccgccgtttggcttagagtggcgtcggcagcatctgggcaaaggccatctgttactcgccgcaacccccggattgaacgggcagatgccagcagcgcaggaaggcgccgtagcttttgccgcatgggacgacgacgaaccttggggtccatggaccggcaacggcaccttctggcttccccgggtccaacccttccaggaaggcacttacctcgcgacaattcatcttccttatctgcagggccaggtgactctggagttggcagtgtataaacctccaaaggtcagtctgatgcctgccacactcgcccgggccgcccctggggaggccccacctgaattgttgtgccttgtcagtcacttctatcctagtggcgggctggaggtagagtgggagttgagaggaggtcccggaggacggagtcagaaagccgagggacagagatggctgtcagccctgcggcaccattctgatgggagtgtgtcccttagtggtcacctccagccacctccagtcacaaccgaacagcatggcgcccgctatgcatgccgaatacaccaccccagccttcctgcctcgggtcgctcagctgaggttacgctcgaagtggcaggcctgagcgggccctctttggaggattcggtgggtctgttcctgtccgccttcttgctgctcgggctctttaaggcgctcgggtgggccgccgtgtatctgtcaacatgtaaggattctaagaagaaggcagagtag

SEQ ID NO: 137224 - DNA, 609 bp, Artificial Sequence
  Description of Artificial Sequence: Synthetic coding sequence
atgaagagcctatcactgcttttggccgtggcgctcggactcgcgactgccgtctctgcaggacccgccgtcattgagtgttggttcgttgaggacgcctccggcaaaggactggccaaacggcccggcgcgctgctgttgcggcagggcccaggtgagcccccgccaagacccgatctggatcccgagctttatttgagcgtccacgtcgtgctgaccgtactcactcatacacctgctcctcgcgtcaggctcggccaagatgcccttctggacctttccttcgcgtatatgcctccaactagcgaggctgccagcagtttggctcctggtccgccaccttttggactggaatggaggagacaacatctggggaaaggtcacctccttttggcggcaacccccggcctcaacggacaaatgcccgcggcacaggaaggcgccgttgcctttgctgcctgggatgacgacgaaccttggggcccttggaccggaaatggaacattctggctccccaccgtccaaccgttccaggagggaacctacctggctaccatccatctgccatatctgcagggacaagttaccctagaacttgccgtgtactag

SEQ ID NO: 137225 - DNA, 609 bp, Artificial Sequence
  Description of Artificial Sequence: Synthetic coding sequence
atgaagagtctgtcccttctgcttgctgtagctctggggcttgccacggctgtgagcgccggccctgccgtaattgaatgctggtttgtagaggatgcctcagggaaagggctcgccaagaggccgggagctctgctgttaagacaaggtcccggggagccccctcccaggccagacctagaccccgagctgtacttatccgttcacgtggtgctgactgtactaacacatacgcccgccccccgggtccgccttgggcaggacgccctccttgacctctcttttgcttatatgccaccaacctccgaagcagccagctccctcgctcctggacctcctccatttgggcttgagtggagaagacagcacctaggcaaaggacacttgctgctagccgccaccccaggcctgaacgggcagatgccggccgcacaagagggcgctgtggcctttgccgcctgggatgacgatgaaccttggggcccatggacaggcaatggaaccttttggttgccaagagttcagccatttcaggaagggacatacctggccacgattcatctcccgtacctacaaggccaggtgacgctggagctggccgtgtactag

SEQ ID NO: 137226 - DNA, 609 bp, Artificial Sequence
  Description of Artificial Sequence: Synthetic coding sequence
atgaagtctctgtcactgctgctggctgtggctctaggcctggccacagccgtcagcgcgggaccagcagtcatagagtgctggttcgtggaggatgcttccggaaaaggactggcaaagagacctggagcgcttctgcttcgccagggaccgggcgagcccccccccagacccgatctggatccagaactctatttgtccgttcacgtggttctgactgtcctcacccatacgccggcaccccgggtgcgactagggcaggacgctctcttagacctcagctttgcatatatgcccccaacatcagaggctgccagctcactggcacctgggcctcccccattcggtctggagtggaggaggcaacacttagggaaaggacatctgctgctggcagcgacaccaggactgaatggtcagatgcctgcggcacaggaaggggctgtcgccttcgcagcctgggatgatgacgaaccctggggcccatggaccgggaacggcacattctggctgcccagggtgcagccttttcaggaaggtacatatctcgcgaccattcacctgccctacctacaaggtcaggtgaccctggagctggccgtttattag

SEQ ID NO: 137227 - DNA, 1347 bp, Artificial Sequence
  Description of Artificial Sequence: Synthetic coding sequence
atgaagtcactgtccctgctgctggcagtggcgctgggcctggcgacagctgtctcagctggccctgcagtgattgaatgttggtttgttgaggatgcttccgggaagggtctggctaagcggcccggagcattgctcttacgacagggacccggagagccaccccctaggccagatttagacccagagctgtatctgtcggttcatgacccagccggggccttgcaggctgcctttcggcgatacccacggggcgcccccgccccacactgcgaaatgagccggtttgttcctttgcccgcgtcagccaaatgggcgtctgggcttacccctgcacagaattgtccaagggccctggacggcgcatggctgatggtgtcaattagtagtccagttctgagtctcagctcactgctgagaccccagcccgagcctcagcaggaaccagtcctcatcacgatggcgaccgtggtgctcacagtcctgacgcataccccagcccctagggtaagactgggacaagatgccctgcttgacctttcattcgcctacatgcctcccacaagtgaggctgcatcatccctggcaccaggccccccgccttttgggttagagtggcgaaggcaacacctgggtaaaggccatttattacttgctgccacaccggggctgaacggacaaatgccagccgctcaggaaggtgccgtggcattcgcagcgtgggatgacgacgagccttggggtccctggaccggtaacggcacgttctggctgcccaccgtgcaaccattccaggagggaacctacctcgcgacgatacacttgccatatttgcagggccaggtcaccctggagctggctgtttacaagccccctaaggtttcactgatgcccgccaccctcgctagggccgcccctggggaggcacctcctgaactgttgtgcctcgtgtctcatttctacccctccggcggtttagaagtggagtgggaactgagaggaggccctgggggccgcagtcagaaagctgaaggacagaggtggctgtccgcccttcggcaccacagtgatggctctgtcagtctctcagggcacctgcaaccaccacccgttaccacagagcaacacggtgctcgatacgcctgcaggatccaccaccccagcttgccagcgagcggccgaagcgccgaggtgactctagaggtagcaggactatccgggcccagcctggaggatagcgtggggctttttctgtctgcctttctgcttttgggtttgtttaaagcactcggttgggcagcagtatatctgtctacgtgcaaggacagcaaaaaacatgctacctag

SEQ ID NO: 137228 - DNA, 1515 bp, Artificial Sequence
  Description of Artificial Sequence: Synthetic coding sequence
atgaaaagccttagcctcctgctggcggtagctctaggactggcgaccgcagtgtcagctgggcctgccgtgatcgaatgttggttcgtagaggacgcatctggaaagggactggctaaacgccccggagcactgttgttgcggcagggacccggcgagccaccccctagaccggacttggatcctgaactctatctttctgtccacgatcccgccggagcgctccaggccgctttccgcagatatcccaggggggcccccgcgccccactgtgagatgtctcgttttgtgccactgcctgcgagcgccaaatgggctagcggtctcactccggcccagaactgtcctagggctctggacggggcatggctgatggtgagtatatcttcaccagtactgagcttatcatctttgctccgtcctcaacccgagccacagcaggaaccggtgttaattacaatggctacggtggtgttgacagtactgacacataccccggcacctagagtgcggctgggccaggacgcactcctggatctaagctttgcttacatgccacccacaagtgaagccgcctctagccttgctcccggcccgccacctttcggccttgaatggcgacggcagcacctgggaaaaggacaccttctactggccgcgactccaggactgaatggtcagatgcccgctgcccaggaaggtgcggttgcttttgccgcctgggacgatgacgagccatggggcccatggacagggaacggcactttttggctacctagagtgcagccctttcaggagggaacgtacctcgccacaatacacctcccttacctgcagggccaggtgactctagagctggcagtgtacaaaccgcccaaggtgtcccttatgccggctaccctggcacgggccgcacctggggaagccccccctgagctcctttgccttgtctcccatttctatccatccggtggtctcgaggttgaatgggagctgcggggaggccccggtgggcggagtcagaaagctgaagggcaaaggtggctgtcagcactgcgccatcatagcgatggcagtgtgagtctgtctgggcaccttcagccccctcctgtcacgactgagcagcacggggctcggtacgcttgccgcatacatcacccctccctgcctgcttcggggagatccgcggaagtcacgctcgaggtagcgggcttatctgggccctctctggaagactccgtggggctgtttctgtctgccttcctcttacttggtctgtttaaggcattggggtgggctgccgtgtaccttagcacatgtaaagatagtaagaaagtgcagtgctctacttcattgtatctgagccttgtgaccctgtctccccaccctatctccaaacccatggagggggggtgttggtgcggccggcagaacctggggttggagtttacactaatttgggtcaagacatggcattatatccttacagtcggtctattcgaacatgccacctag

SEQ ID NO: 137229 - DNA, 471 bp, Artificial Sequence
  Description of Artificial Sequence: Synthetic coding sequence
atgaaaagcctgtcactgcttctcgcagtggcactcggcctagccaccgcagttagtgcagggcctgccgttattgagtgctggtttgttgaggatgcatccggaaaaggcttggctaaaagacctggagccctcctgttacgacaaggccccggagaacccccaccaagacccgacctggatcctgagctttacctgagcgtgcatgaccccgcgggcgcgctccaggcagcctttcggaggtaccctaggggcgcaccagccccccactgtgaaatgagccggttcgtgccgctgcccgcttccgccaaatgggcaagcgggcttactccggctcagaactgtcctagggccctggacggagcgtggctgatggttagcatttcttctatggggcacgccatgcccgttgagtttaccattcccgcgtgcttaccacgcggggccgccctccgttctccttggagatag

SEQ ID NO: 137230 - DNA, 1401 bp, Artificial Sequence
  Description of Artificial Sequence: Synthetic coding sequence
atgaaatcactaagcctcctgcttgctgttgctcttgggttggccacagctgtgagcgccggtccagcagttatcgagtgctggtttgtggaagatgcatcagggaaaggcctggctaaaagaccaggcgctcttctactgagacagggtccaggcgagccccctcccaggcccgatctcgatcccgagctgtatctgtcagtccatgatcccgctggtgctctccaggccgcatttcgacgttatccgagaggtgcccctgccccccactgtgaaatgtcccggtttgtgcccctccccgcatctgccaagtgggcctcaggcttaacccctgcacagaactgccctcgggccctggacggagcttggctcatggtatccatctcttcccccgtattgtctctgtccagtctcttgcgcccacaaccagaaccccagcaggaaccagttctgattaccatggcaacagtcgaaatgggatttcatcacgtcggacaggcggccctagaactgctgaccagcgttgtgttgaccgttctgacgcatacccctgccccaagggtccgcctggggcaggatgctctgctggacttgtcctttgcttatatgcccccgacttccgaagcggccagttctctggcccctggtcccccaccgtttggactggaatggaggcgccaacatctgggcaagggacatcttctcctggctgccacacccggactgaacggccagatgcccgccgcccaagagggggccgtcgcttttgctgcctgggacgacgatgaaccatgggggccttggacagggaacggtaccttttggctgcccaccgtccagcccttccaggagggaacctatcttgccaccattcacctcccttatctgcagggccaggtcacattggaacttgcagtctacaagcctcccaaagtgtccctgatgccagctaccctagcacgcgctgctccgggggaggctccccctgagttactctgtctcgtttctcatttctacccatcaggcgggcttgaggtggaatgggagctcagaggaggtccggggggacgctcccagaaagctgaagggcagagatggctttccgcactcagacaccactctgatggcagtgtgagcttatctggccacctccagccccctccggttacaacagagcaacatggtgcccggtatgcttgtcgcatacatcatccatctctgcctgcctcagggcgatctgcagaggtgaccttggaggtcgctggattgagcggtccgtctctggaggattccgtgggcctcttcctcagtgctttcctgctgcttggcctgtttaaagcgctgggttgggccgccgtctacctgtcaacatgcaaggattctaagaagaaagcggaatag

SEQ ID NO: 137231 - DNA, 1086 bp, Artificial Sequence
  Description of Artificial Sequence: Synthetic coding sequence
atgaagagcctgtcactgctcctagccgtggcgctgggtctcgctactgcagtgagcgctggcccagcagttatagaatgttggttcgtggaggatgctagtggcaagggattggctaaacggccaggagccctcctactacggcagggaccaggcgagccgcctccccgacctgatttggatccagagctttacttgtcagtgcacgttgtcctgactgtcttaacccacactccagcaccccgggtgaggctgggtcaggacgcgctactggacctgtcattcgcctacatgccgcctactagtgaggccgctagctctctcgctccaggccctcctccatttgggctggagtggaggagacaacacttgggcaaaggacacttgttactcgctgcgacgccaggcctgaatggtcagatgccagcggcacaggaaggcgccgtcgctttcgccgcctgggacgacgatgagccttgggggccatggactggtaacggcactttctggttacccaccgtacagccctttcaggagggcacttaccttgctaccattcacctgccttatctgcagggccaagtgacgctggagctcgccgtgtataagccacccaaggtctctctcatgcccgccaccctggctcgggccgctccaggggaggcacctccggagttgttgtgcctagtaagccacttttacccaagcgggggactagaggttgaatgggagctccgcggggggccaggcggaaggagccagaaggccgaggggcagagatggctctcagccctccgccatcattctgatgggtcagtgagccttagtggccatctgcaacctccacctgttacaactgaacagcatggggcccgttatgcctgcaggatccaccatcctagcctccccgcctctgggaggagcgcagaggtgacactggaggttgccgggctatctgggccttctctggaggacagcgtgggactgtttctctctgcctttctgcttctgggtcttttcaaggccctcggatgggctgccgtgtatctgtctacctgcaaggattctaagaagaaagctgagtag

SEQ ID NO: 137232 - DNA, 1347 bp, Artificial Sequence
  Description of Artificial Sequence: Synthetic coding sequence
atgaagtctctcagtttgctcttggcagtagccctcggcctggccacagccgtgagcgcaggacccgccgtgatcgagtgctggtttgttgaagatgcatcaggtaaggggctggctaagcgccctggtgctctcctgctgcgccagggcccaggagagccaccccctcgcccagatctcgaccccgagctgtatctgtccgtgcacgatcccgccggtgctctgcaagctgctttcaggaggtacccaaggggcgcacccgcaccacactgcgaaatgtcaaggttcgtcccattgcctgctagcgctaaatgggctagtggccttactcccgcgcagaactgtcctcgggctttagacggagcctggttaatggtttccatttctagtccagtattatctctgagttctctccttcggccccaaccagaaccccaacaggagcctgtcctcataaccatggccacagtggtcttaactgtgctgacccataccccagcaccccgcgtccgcctagggcaggatgccctgctggatttgtccttcgcttatatgcctcccacttcagaggcagcctcaagtctggctccaggtccacctccttttgggctcgagtggcggcgtcaacacctgggcaaaggccaccttctgctggccgcaacccctggattgaatggccaaatgccagctgcgcaagagggcgctgtcgctttcgcagcttgggatgacgatgagccctggggtccctggaccgggaatggtactttctggctgcccaccgttcagccgtttcaagagggcacataccttgccactatacaccttccgtatctgcagggtcaagtaactttggaactggcagtgtacaagcctcctaaggtctccttgatgccagccactctggccagagccgcacccggagaggcccccccagaattgctctgcctggtttcccatttttacccttcagggggtctcgaagtggaatgggaactccggggcggacccggggggagaagccaaaaagcagagggacagcggtggctgagcgccctgcgccatcactcagatggatccgtttctctgagtggccatttgcagcctccaccagtcaccacggagcagcacggagctaggtacgcctgtcgtatccaccacccgtctcttcctgccagtggccgcagcgcagaggtgaccctcgaggtggccggcttatccggacccagcctcgaggattcagtgggactgttcctgagtgcctttttattactgggtctgtttaaggcactgggctgggccgcagtctacctgtcaacttgtaaggacagcaagaagcacgcgacttag

SEQ ID NO: 137233 - DNA, 471 bp, Artificial Sequence
  Description of Artificial Sequence: Synthetic coding sequence
atgaagagtcttagtctgctcctggcagtagctctcggacttgccaccgcagttagtgccggtcccgcagtaattgagtgctggtttgtggaggatgcaagcggtaaaggactggctaaacgacccggagcactcctccttcgccagggtcccggagaaccccccccacggccagacttagaccccgagctatacctttcagtgcacgatcccgccggcgccctccaggccgcatttaggaggtacccccgtggggctccggcgcctcattgtgagatgagtaggttcgtgccactgcccgcgagcgcaaaatgggcgtcaggcctcacaccagcccaaaactgtcctagagccctggatggcgcgtggcttatggtcagcatcagctctatgggtcacgcgatgcctgtcgagttcacaatcccagcctgcctcccccggggagccgccttgcggagtccatggcgttag

SEQ ID NO: 137234 - DNA, 1086 bp, Artificial Sequence
  Description of Artificial Sequence: Synthetic coding sequence
atgaagtccctgtctcttctcctggccgttgccctggggctggctactgccgtgtctgccggacctgcagtcattgaatgttggtttgtcgaggacgcaagtggaaagggactggcaaagcgacctggggcgcttctgctgcgccaggggcctggcgaacctccccctaggccggatctagaccctgagttgtacctgtctgtgcatgtcgttctcacagtcctcactcataccccagccccacgagtgcgcttggggcaggacgcactgctggatctatcattcgcttacatgccgcccacctctgaggccgcatcatccctcgccccgggccctcctcccttcggcctagaatggcgtcgccaacacctgggtaaaggacacctcctgctggctgcgactcccgggcttaatggccaaatgcctgcagcgcaggagggggctgtcgcgttcgctgcgtgggatgatgacgagccttggggaccttggactggcaatggcactttctggctgcctagggtccagccttttcaagaagggacgtatctggccacaatccacctaccttacctccaggggcaggtgaccctggagcttgcggtgtacaagccacccaaagtcagcctgatgccggccactctggctcgagctgcacccggcgaagctcctccagagctcctctgcctggtcagccatttctatccgagtggaggcttggaggttgagtgggagctgcgcggaggccccgggggaagaagccagaaggcagagggccagaggtggctctccgcactgagacatcactccgacggatcagtgtccctgtctgggcatttgcagcccccgcctgtcactaccgaacagcatggggcccgatatgcgtgtcgtatccaccacccgagcttgcctgcctctggacggtctgcggaggtaactctggaagtggcggggctgagtgggccctccctggaggattctgtcgggctttttttatctgcattcctgttgcttggactattcaaagcgcttggatgggccgcagtatatctctccacttgcaaggatagcaagaagcatgctacctag

SEQ ID NO: 137235 - DNA, 1347 bp, Artificial Sequence
  Description of Artificial Sequence: Synthetic coding sequence
atgaagagtttaagtcttctgcttgctgttgcgcttggcctggcaacagccgtgtccgccgggcccgcagtcatcgagtgctggtttgttgaggacgcctcgggtaagggcctcgcgaagcgccccggcgcactgctccttcgacagggacccggagagccgccaccaagacccgacctggatccagaactttatttgtcagtgcatgatcctgccggtgcactccaggcggcttttcggaggtatccaaggggggcccctgccccacactgtgaaatgagcaggttcgtccctttgcctgcctctgctaagtgggcaagcggactcacccctgcacagaactgcccgagagctctggacggggcctggctgatggtgtctatatccagtccagtgctgtcgctctccagcctcctgagacctcagccggaacctcagcaggagccagttttaattaccatggcaaccgtcgtcctgactgtattgactcacacacctgccccccgggtgcggctcggccaggatgccctgctagatttgagttttgcttacatgccaccaactagtgaggccgcttcttcactggcccccggcccgccgccttttggtttggaatggaggagacagcacttgggcaagggacatctgcttctggccgctacccccggcctcaatggtcaaatgcccgccgcccaggaaggcgccgtggcctttgcggcgtgggatgacgacgaaccatggggcccctggacgggtaacggcaccttctggttacctagggtgcaaccttttcaggagggaacctaccttgcgaccatccacctcccatatctgcagggtcaggtaaccctggagctagccgtgtataagccacctaaggtcagcttaatgcccgcgaccctggcaagagctgctcctggagaggcgcctcccgagctgctgtgtctggttagtcatttctatccgagcggcggattggaagttgagtgggagctccgggggggccccgggggtagaagtcaaaaggcagaggggcagagatggctttccgcacttcggcatcattccgatggctcggtctcactaagtgggcacctgcaacctccccctgtcacgactgagcagcacggtgctcgctatgcttgcaggatacaccatccttctctgcctgcttccggcaggagcgcagaggtgaccttggaagttgccggactgtccgggcccagcctggaagacagcgtcgggctgttcctgtccgcgtttctgctgctggggcttttcaaggcgctgggctgggcggccgtgtacctctctacatgtaaagactccaaaaagcacgcaacttag

SEQ ID NO: 137236 - DNA, 1086 bp, Artificial Sequence
  Description of Artificial Sequence: Synthetic coding sequence
atgaaatccttgtcactcctgcttgccgtggccctcggacttgcaaccgccgtctccgccggcccagctgttatagaatgctggttcgtagaggatgcgtcagggaaaggtctggcaaaaagaccaggagctctgctgttaagacagggcccgggtgagccacctcctagaccagacctggacccagaactatatttgagcgtgcacgtagtcttaactgtccttacccatacacctgcacctcgagttaggctaggccaagatgctctcctcgacctgagtttcgcctatatgccccccacttcagaagccgcttcatctctcgcacccgggccacccccctttggattagagtggcgacggcaacatctcggaaagggccaccttttgcttgcagctacccctgggctgaacggccaaatgccggctgcccaggaaggtgcagtggccttcgctgcttgggacgatgatgaaccatggggcccatggactggaaatggtaccttctggctccccagagtccagccttttcaagaaggtacctatttagccaccatccacctgccatacctgcagggtcaagttactctggagctggcagtgtacaaacctcccaaggtctcgttgatgcctgcaactctcgccagagctgcacccggagaagctccacccgaattgctgtgcttggtttctcacttctacccttcaggcggactcgaagtggaatgggagttacgcggtggtcctggaggcaggtcacaaaaggccgaagggcagcgctggttgtctgctctccgtcatcactccgacggctccgtgagtctgagcgggcaccttcaaccacctcctgttactaccgaacaacatggcgcaaggtacgcatgtaggatccatcatccctccctgccggcatctggcaggtctgcagaggtaaccctggaggtcgccggcctgtcaggtccttcactggaagattctgtcggcctctttctatctgctttcttgttgttgggactctttaaagccctcggttgggctgccgtgtacctctctacatgcaaagactctaaaaagcatgcaacatag

SEQ ID NO: 137237 - DNA, 471 bp, Artificial Sequence
  Description of Artificial Sequence: Synthetic coding sequence
atgaagtccctgagcctgctactcgccgttgccctgggcttggccacggcagtatccgcgggtcctgctgtgattgaatgctggtttgtggaggacgcaagcggaaaagggctggctaaacggcccggagccttactgctgagacaggggcctggggagcccccaccgcggcccgatctagaccctgagctctacctcagtgtgcacgatcctgcgggcgctctgcaggcagcattcaggcgttaccctagaggtgctccggcgcctcactgtgagatgagccggttcgtgccactgcccgcttcggcaaaatgggcatcgggattaaccccagcacagaactgcccccgtgctctggatggggcatggttaatggtatccataagctccatggggcacgcaatgcctgtcgagttcacaatccctgcctgtctccctcggggagctgccctgaggtctccttggagatag

SEQ ID NO: 137238 - DNA, 1347 bp, Artificial Sequence
  Description of Artificial Sequence: Synthetic coding sequence
atgaaatcacttagtctcctgctcgccgtggctttgggactggcgacggccgtttccgctggccccgctgtgatagaatgctggtttgtggaagacgcaagcgggaaaggcctcgcgaagagacctggcgcgttgctactccgccagggtccgggggaaccccccccaaggcccgatctggatccagaactataccttagtgtacacgacccagcaggcgccctgcaggcggcttttaggcgctatccacggggggctccagccccgcactgtgagatgtcccgattcgtgccattacccgccagtgccaagtgggcatcaggactgacaccagcacagaactgtcctcgagccttggatggagcatggctgatggtatcgatatcgtcaccagtcttgagtctctcttcactgctgaggccacagcccgagcctcaacaggagcctgtgctcatcaccatggccaccgttgtcctaactgtcctgacacacacaccagcacctagagtgaggctaggacaggatgccctgctcgatctctcatttgcctacatgccaccaacaagcgaagcagccagctcactggcaccagggccaccccccttcgggcttgaatggcggcgacagcatttaggaaaaggtcatcttctcctggcagctacgccgggcctgaacggccaaatgcctgcagcccaagagggcgcagtggcttttgccgcctgggacgacgacgagccttggggaccatggaccggtaatggcactttttggcttcctcgagtgcaaccttttcaagagggtacgtatttagctaccatacatctaccctacctccagggacaggtcacgttagaactggctgtgtataaacctccaaaagtgtctctcatgcccgctaccctggcccgggccgcgcccggggaggctccccccgagcttctatgtctggtgtctcacttctatccatcaggcggcctggaggtagagtgggagctccgcggagggcctgggggacgatcacagaaggccgaagggcagcggtggctttcagctctccgccatcactcggatgggtctgtcagtctctcaggccacctgcagcctccgcctgtcacaacggagcagcatggtgcgagatatgcttgtagaatccatcaccctagtctccccgcctccggtcggagtgctgaagttactttggaggtggcaggacttagcggtccctcactcgaagacagcgtcggcttgtttctatccgcatttctgctcttgggactgttcaaagcactcggatgggctgccgtctacctctctacctgcaaagactctaagaagcatgccacttag

SEQ ID NO: 137239 - DNA, 1086 bp, Artificial Sequence
  Description of Artificial Sequence: Synthetic coding sequence
atgaaatcattatcactgctgttagcggtagccttgggcctagccacagcagtttcagccggcccagccgtcatcgagtgctggtttgttgaggacgctagcggaaaagggctagcgaaaaggccgggggcactgctgctgaggcagggccctggagagccaccaccccggcccgatctggacccggagctgtacttgtccgttcatgtcgtgctgaccgtgttgacccacacgcctgcccccagagtccgactggggcaagatgccctgctcgacctctcttttgcctacatgccccccacttcagaagctgccagctcactcgctcctgggcctcccccctttggcttagagtggcggcgccagcacctgggtaagggccatctgctgctggcagccaccccaggattaaatggccagatgcccgccgcccaggagggtgccgtggccttcgcggcctgggatgacgacgagccatgggggccctggacaggcaatggaacgttttggctgcccacggtccagcccttccaagagggcacttatctcgccacaattcatctgccctacctgcagggtcaggtgactctggagttggctgtgtataaacctcccaaggtctcgctgatgccagcgacattggcaagagccgcccctggcgaggccccacctgagctcctctgtcttgtctcacacttctatccgtccggtggcttggaagtggaatgggaacttaggggaggccctggcggcaggtcccagaaggctgaggggcagagatggctctccgctctaaggcaccatagcgatgggtccgtgtctctgtcaggtcaccttcagccgccccccgtgacaaccgagcagcatggagctcgatatgcatgtcgaattcaccaccctagcctgcccgctagcggcagatccgcggaagtaaccctggaggtggccggattgagcggaccctcactggaggactctgtgggactgttcctgagcgcgtttctcctcctcggactcttcaaggctcttgggtgggccgctgtgtacctttcgacctgtaaagattctaaaaagaaggcagagtag

SEQ ID NO: 137240 - DNA, 1347 bp, Artificial Sequence
  Description of Artificial Sequence: Synthetic coding sequence
atgaaaagcctaagtctgttgctagccgtcgcactgggcctggcaactgcagtgagcgctgggcctgctgtcattgagtgctggttcgtcgaggacgcaagtggaaaaggactcgccaagcgccctggcgcgctcctccttcggcagggacccggggagccacctccaaggcccgacctggaccccgagctctatctgtccgtccacgaccccgcaggcgcacttcaggctgcttttcgccgctacccccgtggagctcccgccccgcattgcgaaatgagtcgcttcgtgccactccccgctagcgcaaagtgggcttctggcctcacccctgctcaaaattgtccaagggcccttgatggagcgtggcttatggtcagcatatcctccccggtgctctccctatcctccctcttaaggccacagccggagccgcagcaggaaccagtcctgataaccatggcgacagtggtactgactgtcctcacccacacaccagctcctagggtgagactcggacaggatgccctgttggacctgagcttcgcctatatgcctccaacttcagaagcagcatccagtcttgcccccggcccacccccgttcggcttggagtggcgccggcaacatctgggaaagggtcatcttctgctcgccgccacacccggattaaacgggcaaatgcccgccgcccaggagggcgccgttgccttcgcagcatgggatgacgatgagccttggggcccctggactggaaacggaacattctggttgccccgtgttcaaccatttcaagaggggacctatttagccaccatccacttaccatacttgcaggggcaagtgaccctggaactggcggtttacaagccgcctaaagtcagcctgatgcccgctactttggctcgtgcggccccaggagaggcgccacccgagctgctctgccttgtgtctcatttctatccttccgggggactcgaagtggagtgggagctcagaggcggacccggaggacgcagtcagaaagccgaagggcagcgctggcttagtgctttgaggcaccattccgacggatccgtgtcgctatccggacacttgcaacctccacccgtaacaacagagcagcatggggcccgctatgcctgtcgcatccaccatccttcccttcctgcctcaggtagatccgcggaggttactttagaagtggccggcctgagtggcccctctcttgaggacagtgtgggactgtttctgtcagccttcctcctcctgggactgtttaaagcgcttggatgggccgccgtgtatctgtcgacgtgtaaagattcaaaaaaacatgctacctag

SEQ ID NO: 137241 - DNA, 1086 bp, Artificial Sequence
  Description of Artificial Sequence: Synthetic coding sequence
atgaagtctttaagcctcctccttgccgtcgccttggggctggccactgcagttagcgccggtccggccgtcattgaatgctggttcgtagaagacgcgtcgggtaaaggccttgcgaaaagaccaggagccttgcttctgcgtcaaggacccggagagccccccccaagaccagacttggatccagagttgtacctcagtgtccacgtggttctgacggtcctgacacacacaccggcccctcgcgtccggctcggccaggatgcactccttgacctcagtttcgcctatatgcctcccacttcggaggctgcgtcctcactagccccagggccaccccctttcggtctagagtggagacgccagcatctgggtaaagggcatctccttctggccgcaacacccggccttaatggtcagatgccagcagcacaggagggggcagtggccttcgccgcctgggacgacgatgagccttgggggccatggacaggaaacggtaccttttggctgcctagggttcaaccattccaggaggggacatacctggctactattcacttgccttatctgcagggccaggttactctcgaattagcggtgtataaaccccctaaggtgtcccttatgcccgcaacactggctcgggcagcccccggagaagcaccgcccgagctgctgtgcctagtcagccatttttaccccagtggtggcttagaagttgaatgggagctcagagggggcccgggagggcggtcacagaaggctgagggacaacgttggctcagtgccctgcgacaccacagcgacggctcagtgagcttatccggacatcttcaacctcctccagtcaccaccgagcagcatggggcacgatatgcatgccggattcatcaccccagccttccggcaagtgggcggtcggccgaggtcaccctggaggtggctgggctatccggaccttctctagaggactcagtaggcttatttctgtctgctttcttgttgcttggcctcttcaaagcccttggctgggctgcagtgtacctctccacatgcaaagattccaaaaaacatgcaacatag

SEQ ID NO: 137242 - DNA, 2037 bp, Artificial Sequence
  Description of Artificial Sequence: Synthetic coding sequence
atgctgctggaggctgagcgcagaagaggaggaggggccgccggcgcacggttactcgagagatatcgccgtgtgcccggggtgagggcactgcgcgccgactctgtactaatcattgaaaccgtgcccggtttccctcctgctccccctgcaccgggggccgcccaaattcgggctgctgaggtactcgtgtacggagcaccacccggccgcgttagtcgccttctcgaaaggtttgacccaccggccgcaccccggcggcgggggtccccagagagagcccgtccccccccaccgcctccacccccagctccgcctagacctccacctgctgccccttccccaccagcggcgcccggccccaggggcggaggagcttccccaggagccaggcggtcggacttcctccagaaaaccggtagcaacagttttacggtccacccccgcggcttgcacagaggagccggcgcacgccttctaagcaatggccacagcgcacccgagccacgcgccggccctgctaatcgcttggccgggtccccccccggctcaggccagtggaagccgaaggtggaaagtggagacccctctttgcacccccccccttcacccggcacccccagtgctacacccgcctcgccacctgcctctgccaccccgagccagcgacagtgtgtgtcagccgctacatctactaatgactcctttgagattagaccggcccctaaacccgtgatggagactattcccctcggagacttgcaggccagggccctggctagcctgcgggctaactcacgcaacagcttcatggttatccccaaatctaaggccagtggagccccacctccagaggggcgccagagcgtcgaactaccaaaaggggacctaggtcccgctagccccagccaagaactgggtagccaacccgtaccagggggggacggagctcccgcattgggcaaatcacccttagaagtagaggcccagtgggcagtggaggagggagcgtgtccccggacagccacggctcttgccgaccgagctataaggtggcaaaggccaagctcccccccaccattcctgcccgccgcttctgaagaagcagagcccgccgaaggcttgcgggtacctggattagctaaaaattcacgggagtatgtacggcccggcctgccagttacttttatcgacgaggttgattctgaagaagccccccaagctgcaaaactcccttacctgcctcatccggctcggcctctgcacccagcgcgccccgggtgcgtggctgagctgcagcctcggggtagcaacacattcacagtagttccgaaaagaaagcccgggaccctgcaagatcaacacttcagtcaagctaatagggagcctaggcccagagaagcagaggaagaggaggctagctgcctgttaggcccaaccttgaaaaagcgataccccaccgtccacgagatcgaagtgataggcggctacctggctctccaaaaatcatgtttgacgaaggccggcagctcccggaagaagatgaaaatctctttcaatgacaagtcgcttcagactacctttgagtacccgtccgagtctagcctcgaacaggaggaggaggtggatcaacaggaggaagaggaagaagaggaggaagaagaggaagaagaggaggaaggctctgggtccgaggagaagccattcgcattgttcctgccccgggcgacatttgtaagcagtgtgagacccgagagtagtcgcctccccgagggttcctccgggctgagctcctacaccccgaaacactccgtcgcttttagcaagtggcaggagcaggcgttggaacaggcgcctagggaagcagagcctccccccgtggaagcaatggtcaggtgcggaggagtggagcggtggggggagtccgataccagggcatccccttgcgtgcacatcctgtcatcccatttccaactcacacccgcatctcaaaatgacctgtctgacttcagatctgagcccgccctgtatttctag

SEQ ID NO: 137243 - DNA, 2136 bp, Artificial Sequence
  Description of Artificial Sequence: Synthetic coding sequence
atggcagccttggggagaccaggaagtgggccccgggcagccgtcccggcctggaaacgggaaatcctcgagcgcaagagagcgaagttggctgccttaggtggcggggctggtcctggcgctgctgagccagaacagcgcgtgctggctgaatctttggggcccctgcgcgagaatccttttatgctcctggaggcggagcgtcgacgtggcggcggagcagccggtgctcgcctccttgagaggtataggcgcgttccaggtgtgcgggcgctcagggccgacagtgtgttgatcatcgagacggtgcctggctttccaccagcacctccagcccccggcgctgcccagatcagggctgccgaagtgctggtctacggtgcccctcctggtagggtcagccggctgcttgaacgattcgaccccccggcagcgccccgccgccgagggagtccggaacgagctaggccccccccccccccaccccctcctgcccctcccagaccaccccccgcggctccatctccacccgctgccccaggacctaggggcggtggcgccagtcccggggctcgcagaagtgattttctacaaaaaaccggcagcaattccttcacggtgcacccaagagggctgcaccggggtgccggggctcggctgctgtccaatgggcattctgccccagagccacgcgctggtcctgccaacaggctcgctggttccccgcctggaagtggacagtggaagccgaaggtggaatcgggagatccgtcccttcatccacctcccagtcccggtacaccctccgccacccccgcaagcccacctgcctctgccacaccttcccagagacagtgcgtttctgccgctacatccacgaatgatagcttcgaaatcagaccagctcccaagcctgtcatggaaacaattcccctgggagatctccaggcccgggctctggcatccctcagggctaattctcgcaactcttttatggttattccaaagagcaaggcctcgggggctcctccccccgaaggtcgtcagtcagtggagctgcctaagggcgatttgggacccgcaagtccctcgcaagagcttggaagccagcctgtgcccgggggagacggtgcgccagccctcggcaaatcacccctggaggtggaagcccaatgggcggtcgaagagggtgcctgtcctcggactgcgaccgctcttgcagaccgagccattagatggcagcgcccctcaagccccccacccttccttcccgctgcctctgaggaagctgaaccagcagagggtctgagagtgccaggtctcgctaagaactccagggaatacgtgcgtcccggactccctgtgacttttatagacgaggtggattcggaagaagccccgcaggccgctaagcttccatacctgccgcatccggctagacctctgcatcctgccagaccagggtgcgttgcagaacttcagcctaggggttccaacacctttactgtggtacccaagaggaaaccaggtaccctgcaagatcagcacttcagccaggcgaatagagaacctagacccagggaagccgaggaggaggaggccagctgtctgctgggcccgactttaaagaagcgctatcctaccgtgcatgagattgaagtgattggcggttacctggcacttcagaaaagttgtttaacaaaggccggctctagtcggaaaaaaatgaagatcagcttcaacgacaaaagcctgcagacaaccttcgagtacccatctgagtccagtctggagcaggaggaggaggtggatcagcaggaagaggaagaggaggaggaagaagaagaagaggaagaagaagagggctctggcagcgaggagaagccgttcgccttatttctgccccgcgcaacatttgtgtcctccgtgaggccagaatcatcacggctgcccgaagggagcagcggactctcctcgtacactcctaagcacagcgtagcattttccaagtggcaggagcaggcactggaacaggctcccagagaagccgaaccaccacctgttgaggctatgctgactcctgccagtcagaacgatctatccgattttaggagtgaaccggccttgtacttctag

SEQ ID NO: 137244 - DNA, 4866 bp, Artificial Sequence
  Description of Artificial Sequence: Synthetic coding sequence
atggagtgggtgctggcagaggctttactctcccagtctcgcgatccacgagcactgttgggagcactgtgtcagggcgaagcatcggctgagcgcgtagagaccctgcgctttctgttgcagagacttgaagatgaggaagctagaggaagtgggggggcaggcgccttgccggaagccgctcgggaggtcgctgcggggtacttagtgccattattacgatctctccgggggagacccgccgggggaccagatccatccctgcagcccaggcacagacggagagtgctcagggccgccggtgcagcgctgcgctcctgtgtgcgcctggctggacgtccacagctcgcagctgccttggcagaggaggccctgagagatctgctggccgggtggagggctcctggtgctgaggccgcagtggaagtgctggcagccgtcggtccttgtttgcgcccccgggaggacggccctttactggagcgcgtcgctggcaccgctgtagcccttgcgttagggggaggtggtgacggtgacgaggccggtcccgccgaggatgccgcagccctcgtggccggaagactcttgccagttcttgtgcagtgtggtggcgccgccttacgagcagtttggggcggactagccgctccgggggcttccctcggctccggtcgagtggaggaaaaactgctcgtgttgagtgcactcgccgagaagttactacccgagccaggaggagacagagctcgcggtgccagggaggctggtcctgacgcacggcgctgctggcggttctggagaacagtgcaggcaggtcttggccaagcagatgctctcacacgcaaacgcgccagatacttattgcaacgggccgtggaggtcagcgctgagttgggagccgattgtacatgcggacctcaggaaggaaatggaccgtcgctgttctggtggagcgagaggaaaaaggacgagcttttaaagttctgggagaactatatcctcatcatggagacgttagagggcaaccagatccacgtaatcaaaccagtgctgccaaaacttaataacctgtttgaatacgccgttagcgaagagaacgggtgttggctgtttcatcccagctggcacatgtgcatatacaagaggatgttcgagagcgaaaacaagatcctgtctaaggaaggagtgattcatttcctcgagctgtacgaaacaaaaatattgcccttttctccagagttctctgagtttatcattgggcccctgatggacgcactgagcgagagttctctgtattccaggagtcctggccagccaattggctcttgctctccattgggcctcaagctccagaagtttctggtgacatacataagcctcctgcctgaagagattaagtcgtcatttctgctgaagtttatccggaaaatgacctcccgacactggtgtgcagttcccattctgttcctgagtaaggctttagccaacgtgccccgtcacaaggccctgggtatagacggtcttctcgccttaagagatgttatacactgtaccatgattacacatcaaattttattgcggggagctgcgcagtgctacttgctccagactgccatgaatctgctagatgtagaaaaggtaagtctgtctgatgtcagtacctttttaatgtctttaaggcaggaggaatctctcggacggggcacgtccctttggaccgagctctgtgactggcttcgcgtgaatgaatcatatttcaagcccagccctacctgttcttctattggattgcacaagacctctctgaatgcatatgtgaaatccatcgtccaagaatacgtgaagagctctgcctgggaaactggggagaattgtttcatgccagactggttcgaagcaaagctggtgagtcttatggtcctgctggccgtggatgtcgagggcatgaaaacacagtatagtgggaagcagcggactgaaaatgtactaaggatctttttggatccccttctcgatgtattgatgaagttttcaaccaacgcctacatgcctctgctgaaaactgatcgctgcttgcagttgctacttaagctcttgaacacatgtcgtctcaaggggagttccgctcaagatgatgaagtttccaccgtgttacagaacttcttcatgtcaactacagagtccatctctgagtttatacttagacggctaaccatgaatgagctaaattctgttagcgatctcgaccggtgccatctgtatcttatggtccttactgagcttatcaacctacatctgaaggtgggttggaaacggggtaacccgatctggcgtgtgattagcttgctaaaaaatgcttctatccaacacctgcaggaaatggacagcggccaggagcccaccgttggatcacagatccagagagtcgtgagtatggctgcgctcgccatggtttgtgaagctattgatcagaagccggagctgcagctggattcactgcatgccggaccactggagtcattcctgagttcccttcagctgaaccaaacactgcaaaagccccatgctgaagaacaaagctcttacgctcaccctcttgaatgcagctccgtcctggaggaatccagtagctctcagggatggggaaaaattgtcgctcaatatattcatgatcagtgggtctgtctcagcttcctgcttaagaagtaccataccctgattccaaccacgggatccgaaattttggagccctttttacccgccgtccagatgcccatcagaactttgcaatccgctctcgaggctctgaccgtcctgtccagcgaccaggtcttgcccgttttccactgcttaaaggtgctcgtccctaagctgctgacatcctcagagagcttatgtatagaaagtttcgacatggcatggaagatcattagctctctgtccaatactcagcttatattttgggcgaacctgaaagcattcgtccagtttgttttcgacaacaaagtgctgacaatagccgccaagattaaggggcaggcctacttcaagattaaagagattatgtacaagatcattgaaatgtcggcaatcaaaacaggagtcttcaacacactcataagttattgttgtcaatcttggattgtctccgcgtccaacgtgagccaggggagcctctcttcggcaaaaaattactcagaactgatactggaggcgtgtatctttggcacggtcttccgtcgggatcaaaggcttgttcaggacgtgcagacttttattgagaatctcggacacgactgtgccgccaatatcgttatggaaaacactaagcgggaggatcactacgtccgcatctgtgctgtgaagttcttgtgtttgttggatggttctaatatgtcccacaagctcttcattgaggacctagcaatcaaacttttggataaagatgagctggtgtccaaaagtaagaagcgctattatgtgaattccttgcaacatagagttaaaaacagagtgtggcagaccctccttgtgctctttccgcggctggaccagaattttctgaacggcattattgatcggatctttcaggctggctttacaaacaaccaggcaagtatcaagtactttattgaatggatcatcatcctaattcttcataagttccctcagttcctgccaaaattttgggattgctttagttacggggaggaaaatctgaagacatctatatgtaccttcctggctgtgctttctcatctcgacattatcacccaaaatatccccgagaaaaagcttatactgaagcaggccctcatcgtcgttctgcagtggtgtttcaatcacaattttagcgtgcggctgtacgcgcttgtggccctcaagaagctttggacagtctgtaaagtgctctcggtcgaggagtttgatgcacttacccccgtcattgaaagcagcctgcaccaagttgagtcaatgcacggagcagggaatgcaaaaaaaaactggcagagaatccaggagcactttttctttgccacattccatcctctgaaggactattgtctggagacgatcttctacattttgccacgcctgagtgggctgattgaggacgaatggataacaatcgacaagttcaccagattcaccgacgtgccattggccgccggatttcagtggtaccttagtcaaacccagctgtcaaaactgaaacctggcgactggtcccagcaggatattggaactaatttggtagaagctgacaatcaagccgagtggactgacgtgcagaaaaaaattattccctggaatagtagagtctccgatttggatctggagctgttattccaagatcgcgccgctcggctcggaaaatctattagccgactcatagtggttgcaagccttatagacaaaccaacaaatttaggaggtttgtgcagaacatgcgaagttttcggcgcttcagtcctggtggtggggagcctgcagtgcatttctgacaaacaattccaacacctgtctgtgtccgccgaacagtggctccccctggtagaagtgaaaccacctcagctaattgattacttacagcaaaaaaaaactgagggttatactattattggggtagagcagaccgcgaagagcctcgatctgacccaatactgttttcccgaaaagagcctccttttgctcgggaatgagagagagggaattccagccaatctcattcagcaacttgacgtttgtgtggagatccctcagcaaggcataatccgcagtctgaacgtgcacgtgtcgggcgcactgttaatatgggagtatactagacagcagctcctttcccatggggataccaagccctag

SEQ ID NO: 137245 - DNA, 1101 bp, Artificial Sequence
  Description of Artificial Sequence: Synthetic coding sequence
atgtcagaagaagagcagggcagcggtaccaccaccggctgtggcctcccatccatcgagcagatgcttgctgctaaccccgggaaaacccccatctccctgttgcaggagtatggaacgcggatcgggaaaacccccgtgtatgatctgttaaaagctgagggacaagcacaccagcccaacttcacattcagagtgaccgtcggagacacgtcatgtactggtcagggtcccagcaagaaggctgcaaaacacaaggcggcagaggtagctctgaagcatttaaaagggggcagcatgctcgaacccgcactggaagattcctccagcttttcccctctggattcctccctccctgaagatattcccgtgttcaccgccgctgcagcagctacaccagttccctctgtagtgctgacccgatctccacccatggaattgcagcctcccgtgtctcctcagcagtccgagtgtaaccctgttggcgccctgcaggagttggttgttcaaaagggatggcggctgcccgaatacaccgttacacaggagagcggacctgctcatagaaaggaattcaccatgacttgcagagtcgaaagattcatcgaaatcggctctgggacttctaaaaagcttgcgaagcggaacgccgccgcgaaaatgctcctgagggtgcacacagtccccctggacgcacgagatggaaacgaggttgaacctgatgacgatcacttttctatcggtgtggggtctcgattggacggcctcaggaaccgaggtcccgggtgcacatgggattctctgcggaactccgtgggagagaagattctgtctctgcgctcctgtagcttagggtccctgggagccctgggaccagcttgttgtagggttttatcagagctgagcgaggagcaggcttttcacgtgagttacctcgatatcgaggaactaagtctctccggcctgtgtcagtgtttggttgagctcagcacccagcctgcaaccgtatgccacggctcagccacaaccagggaggccgcacggggggaggctgccagacgtgcattgcagtaccttaagataatggccggcagcaaatag

SEQ ID NO: 137246 - DNA, 1038 bp, Artificial Sequence
  Description of Artificial Sequence: Synthetic coding sequence
atgctggctgcaaaccccgggaagacaccaatctcactgcttcaggagtatggcacgaggatcggaaaaactcccgtgtacgatctgttgaaggccgaagggcaggcacaccagccgaattttacgttcagggtcactgtaggggacacctcttgtacagggcagggaccatcaaaaaaggcagctaagcataaggccgcagaggttgctctaaaacacttgaagggcggctctatgctggaaccagctttagaggatagttcttctttcagcccattagactcctcactgccagaagatattccagttttcaccgctgccgcagctgccacgcccgtgccaagtgtcgtgctcacccgctctccccctatggagctccagcctcccgtaagcccacagcaatccgaatgtaatcccgtaggggctctccaggaactggtggtccagaaagggtggagactgccggagtatactgtgacgcaggagtcaggacctgcccaccgcaaggagttcactatgacgtgtcgagtggagcgatttatcgaaatcggcagtggaacatctaagaagcttgctaagcgcaatgccgctgcgaagatgctgcttcgcgtacacacagtacccctggatgcacgggacgggaatgaggtggaacccgacgacgaccatttttccatcggcgtgggcagccgactggacggcttacgcaatagggggcctggctgtacttgggatagtctgagaaacagtgtgggagagaagatcctctcccttcggtcttgcagtctcgggtcacttggcgccctgggcccagcctgctgtcgggtgctgagtgagctgtctgaagaacaggcattccacgtatcctatcttgacatcgaggagctgagcttgagtggcctgtgccagtgcctcgtggaactgtccacgcagcctgcaacagtgtgtcacgggtctgccactacaagagaggcagcacggggtgaagctgcccgtcgagcattacagtatttaaaaattatggcagggtccaagtag

SEQ ID NO: 137247 - DNA, 1038 bp, Artificial Sequence
  Description of Artificial Sequence: Synthetic coding sequence
atgcttgcagctaatccaggaaaaacgccgatcagcctcctacaggagtatggtacaaggattgggaagacccccgtgtatgatctcctgaaggccgaaggtcaggcccatcaaccaaatttcacttttcgggtgaccgtgggagatacctcatgtaccgggcagggcccctccaagaaggcggccaaacacaaggctgccgaggtcgcattaaagcatcttaagggcggtagcatgctggaaccagccctcgaggactccagcagtttttctcccctcgacagctcattgcccgaagatatcccggtcttcaccgcagcagccgccgcgacacccgttccgtccgtagtgctgacccgctccccgcccatggagttgcagcctcctgtcagtcctcagcagagcgaatgtaatcccgttggagccctacaggagctcgttgtgcagaagggctggcgtttgccggagtatacagtgacgcaggagtccggccctgcccacagaaaggagttcaccatgacctgtagagtcgagagatttatagagattgggagtggaaccagtaaaaagctcgctaagagaaatgccgcagctaagatgctgctgcgtgtgcatacagtgcctttggatgcacgggacggcaatgaagtagagcctgatgacgatcatttctctataggagtgggtagccggttagacggtctaagaaaccgtgggcccgggtgtacatgggactcacttcgcaatagcgtaggcgagaagatcctgagcctaagatcttgttctctggggtctctcggagctttgggccccgcctgctgcagagtgcttagcgaactaagtgaagaacaggcgtttcacgtgagttatcttgatatcgaagaactcagtttgagcggcctctgccagtgcctcgtggagcttagcacccagccagcgaccgtgtgtcacgggtccgccacaacaagagaggcagcccgcggtgaggcagcaagacgcgctctccagtatctgaaaatcatggccggaagtaagtag

SEQ ID NO: 137248 - DNA, 1245 bp, Artificial Sequence
  Description of Artificial Sequence: Synthetic coding sequence
atgagcgaatatattcgagtgaccgaagacgagaacgatgaaccgattgagattccctcagaggatgatggaacagtgttgcttagcactgtgaccgcacagtttccaggtgcctgtggcctgaggtaccggaatcccgtgtctcagtgtatgcggggggtcagactagtggaggggatcctgcacgcaccagacgccggctggggaaatttagtgtatgtcgtgaactacccaaaggacaataaaaggaaaatggatgagaccgacgcaagctctgccgtgaaggtgaagcgtgccgtgcaaaagacctcagatcttattgttttgggcctaccatggaagactactgagcaagacctgaaggagtacttcagcacatttggcgaagtgctgatggtacaggtgaagaaagacctaaagactggccattcgaaaggcttcgggtttgtacgcttcactgaatatgaaactcaggtgaaagtgatgagccagcgccacatgatcgacggcagatggtgcgattgcaagttgcccaactctaagcagtcgcaggatgagccactgcggagccggaaggtgttcgtgggacgctgtaccgaagatatgacggaagatgagttgcgtgaatttttcagccagtatggtgacgtcatggacgtgttcatccctaaaccattcagagcattcgccttcgtgactttcgctgatgaccaaatagcccaaagcctctgcggtgaggatttgataatcaagggaatttctgtccatatttccaacgccgagccgaaacataacagtaacaggcagttggaacgcagcggtaggttcggcggcaatcctggcggtttcgggaatcagggaggtttcggcaacagccggggcgggggcgccgggttaggaaacaatcagggaagcaacatgggaggcggtatgaactttggtgcattcagcatcaaccccgccatgatggcggccgcccaggctgccctgcaaagctcttgggggatgatgggcatgttggcctcccagcaaaatcagtccggccccagcgggaataaccaaaaccagggcaatatgcagagggaacccaatcaggctttcgggagtggaaataacagttacagtggttccaactccggagctgctataggctggggaagcgccagtaatgcgggatcgggatcgggatttaacggcggtttcggatcttccatggattcgaagtcttccggatggggaatgtag

SEQ ID NO: 137249 - DNA, 888 bp, Artificial Sequence
  Description of Artificial Sequence: Synthetic coding sequence
atgtctgagtacatccgagttacggaagacgagaacgacgagcccatcgaaatcccatccgaggatgacggaacagtgctgctgagcactgtcacagctcagtttccaggcgcttgcggtctgagatatagaaatccagtttctcagtgcatgagaggggtccggctggttgaggggatacttcatgcccccgacgccggttggggtaatctggtatatgttgtcaattatcccaaagataataagcggaagatggatgaaactgacgctagctcagcagtaaaagtgaagagggccgtgcagaagacatctgatcttattgtgctgggactgccttggaagaccacggaacaggacctcaaggagtatttttccacgttcggggaagtgctaatggtacaagtcaagaaagacctcaaaacaggccactcaaaagggtttggcttcgtaaggttcaccgagtacgagacacaggttaaagtcatgagccagagacatatgattgacggacgctggtgcgattgcaagctgccgaactctaaacagagtcaggacgagccgctccgatcccgcaaggtgttcgtggggagatgcactgaggatatgacagaggacgagctgcgcgaattcttttctcagtacggagatgtcatggacgtgttcatccctaaacctttccgagcgttcgcatttgtgacattcgcagacgatcaaatagctcagtcactgtgtggtgaggacctgatcattaaaggtatctccgtccatattagcaacgccgagccaaagcacaattccaacagacaactggaacgctcaggacggtttggggtccacctgatctctaatgtttacggccggagcaccagcctgaaggtagtgttatag

SEQ ID NO: 137250 - DNA, 897 bp, Artificial Sequence
  Description of Artificial Sequence: Synthetic coding sequence
atgccgcagatgctagcaggggagatttggtgcatgctgtccacaattcagaaggttaagaaggacctgaagactggacacagtaaggggttcggcttcgtgcggtttaccgagtacgagacccaggtgaaggtcatgtcacagagacatatgatcgacgggcgttggtgtgactgcaagctgcccaatagtaagcagtctcaagatgagcctctaaggtcacgcaaagtttttgtaggcagatgcaccgaagacatgacggaagatgagctgagagagttcttctcccagtacggcgatgtaatggatgtgttcattcccaaacctttcagggccttcgccttcgtgactttcgccgatgaccaaatcgcccagtccctctgtggagaggacttaattatcaagggaatctccgttcatatttccaatgcagagcccaagcacaacagcaataggcagctggagcgctctggtcgctttggcggtaatccaggaggttttggtaatcagggcggcttcggcaactcacgcggtgggggggctgggctgggaaataaccagggtagtaatatgggtggagggatgaactttggcgcgttttctataaacccagctatgatggccgctgcccaggccgcgctgcagtcgtcatggggaatgatgggtatgctggcttctcagcagaaccagtccggccctagcgggaataatcagaatcaggggaacatgcagcgcgagccgaaccaggcctttggtagcggaaataactcctacagcggcagcaatagcggtgccgccatcgggtggggtagcgcgtccaacgccgggagtggctctgggtttaacgggggcttcggctcctccatggatagcaaatcatccggctggggcatgtag

SEQ ID NO: 137251 - DNA, 1533 bp, Artificial Sequence
  Description of Artificial Sequence: Synthetic coding sequence
atggcggcagattcagacgacggagctgtcagtgcacccgctgctagcgacggcggagtgtctaaatccactacttcgggcgaggagctggtggttcaagtccctgtggtcgatgtccagtccaacaattttaaggaaatgtggccttcactgctactggccatcaaaacagccaatttcgtcgctgtagacacggagctatctgggctcggtgaccgcaagtcattactgaatcaatgcattgaagaacggtacaaggcagtgtgccacgcagcccgaactcggtctatcctgagcctcggtctcgcgtgttttaagcgtcagcctgacaagggtgagcacagctatttggctcaagtttttaaccttacactgctgtgcatggaggaatacgtaattgagccaaaaagtgtgcagtttctgatccagcacggattcaatttcaaccagcagtacgcgcagggcatcccttatcacaaaggcaacgataagggggacgaatcacagtctcaatccgtacggacgctgttcctggaattgattagggctcggcgtcctctggtgcttcacaatgggctcatcgacctggtgtttctctaccagaacttttatgcccacctgcccgaatccctggggacttttaccgccgacctgtgcgagatgttccccgccggcatctatgataccaagtatgcagccgagttccacgcgcggttcgtcgctagctatctcgaatatgccttccggaagtgcgagagagagaacggcaaacaacgcgccgcaggatccccccatctgacactcgagttttgtaactacccatcatcaatgcgagaccacatcgattaccgctgctgtctgccgcccgccacgcaccgaccacatcctacctctatctgcgacaatttctctgcgtatggctggtgcccgctcgggccccagtgccctcaatcacatgatatcgatctgatcatcgataccgatgaagctgctgcggaagacaaacggcgccgaagacgtcgcagggagaagcgcaagagagccctgttaaatttgccgggtacccagacctctggtgaggccaaagacggtccacccaagaaacaggtgtgcggcgattcaattaagcctgaggaaaccgaacaagaagtagccgcggatgagacccgaaatttgccccacagtaagcagggcaacaagaatgatttggagatggggataaaggcggctcgccccgagatagccgaccgcgccacctccgaggtgccaggttctcaggcatctccaaaccccgttcctggcgatggattgcatcgcgccggtttcgatgcttttatgaccggatacgttatggcttacgtcgaagtgtctcagggaccgcagccttgtagcagcggtccgtggttaccagagtgccataataaggtctacctgagtggcaaagcggtgccgctgacagtggcgaaatcacaattcagcagaagcagcaaggcacacaaccaaaagatgaaactgacctggggcagcagctag

SEQ ID NO: 137252 - DNA, 1293 bp, Artificial Sequence
  Description of Artificial Sequence: Synthetic coding sequence
atggctgccgactccgacgacggcgccgtgagcgccccagctgcatccgacggagcagaatgggcctgggggcaagaagaattcgcagagccaggggagcatagttatttggcccaggttttcaatctgacactcctttgtatggaggaatatgtgatcgaaccaaagtctgtccagtttttaattcaacatggttttaatttcaatcagcagtacgcacagggcatcccgtaccacaaggggaatgataagggggacgaaagccagagccagtcagttcgcactctgttcttggagctgatccgcgctagacgcccactggtgcttcacaacgggctgattgatctcgtgttcctgtatcaaaacttctatgcgcatctccccgagtcattgggaacctttactgcagacctgtgcgagatgtttccagcaggtatctacgacaccaaatacgccgccgaattccacgctaggtttgttgcaagctacctggaatatgcttttagaaagtgcgagcgggaaaacgggaagcaaagggccgccggcagtccccatttgacgttggagttttgcaattacccatctagcatgcgagatcatatcgattacaggtgttgcctgccgcccgccacacatagaccacatccaacatctatatgtgacaacttcagcgcttacggatggtgtcccctcggtccccagtgtccccagagccatgatatagacctgattatagacaccgatgaggccgctgcggaggacaaacggcgacggaggagacgccgtgagaagcgcaaacgtgcattgctgaatctcccaggcactcagacctccggcgaggcgaaagatggacctcccaagaagcaggtttgtggtgatagcattaagcccgaagaaactgagcaggaagtcgccgcggacgagacgagaaacctcccccacagtaagcagggtaataaaaacgacttagaaatgggaataaaagctgcaaggcctgagatcgctgatagggctactagcgaggtcccgggcagccaggcctcccccaaccctgtgccgggagatggtctgcatcgggccggcttcgatgcgttcatgactggttacgtgatggcctatgttgaggtaagccaaggacctcaaccttgtagctccggcccttggctcccggaatgccataacaaagtgtacctgtctgggaaggccgtacctcttactgtcgccaagtctcaattctcccgttcctcaaaggcccataatcaaaagatgaagttaacatggggcagcagctag

SEQ ID NO: 137253 - DNA, 1263 bp, Artificial Sequence
  Description of Artificial Sequence: Synthetic coding sequence
atgaccatggagaagggaatgtcctcaggcgaaggcttgccatcgcgctccagccaagtgtccgccggtaaaattacggccaaggaactggagaccaagcagtcgtataaggaaaaacggggagggtttgtgcttgttcacgctggggccggataccatagcgaatctaaggccaaagaatataaacatgtgtgcaaacgggcctgtcagaaagcaattgagaaactccaggcgggggctttggcaactgatgcagtcaccgcagccctcgtggagcttgaagattccccctttaccaatgccggtatggggtcaaatctgaacctgctgggagaaatcgaatgcgatgcctctatcatggatggtaagagtctgaacttcggcgccgtgggtgcattgtcaggcataaaaaaccccgtttcagtcgccaatagactcttatgtgaaggccaaaaaggaaagctctctgctgggcgtatcccaccctgcttcctagtcggcgaaggcgcctaccggtgggccgtagatcatggcatccccagctgtccaccaaatatcatgacaactcgattctctctggccgcattcaaaagaaataaacgtaagttggagctggccgaaagagtcgataccgattttatgcaactgaaaaagagaagacagagtagcgaaaaagaaaacgactcaggcacccttgatacagttggggcagtagtggtggaccacgaggggaacgttgcagctgcagtgtcgagcggcggtttagctctcaagcatccggggcgagtcggacaggccgcactgtacggatgcggatgctgggctgagaatactggagctcataatccatacagcactgccgtaagcacgtcaggctgtggcgagcatctggtgcgtacaattttggccagagagtgcagccatgctctgcaggctgaggatgctcaccaggctctgctggaaaccatgcagaacaagtttatctccagtccctttctcgcgagtgaagatggcgtgctgggaggggtgatcgtactgcggtcctgtaggtgttccgctgagccagatagctctcagaataagcagactttgctggttgagtttctatggtcgcacactaccgaatctatgtgtgtagggtacatgagtgcccaggacggcaaggcaaagacgcatatttctcggcttccccccggcgctgttgccggacaatccgtggcaattgagggaggcgtgtgccgcctggagtctccagtgaactag

SEQ ID NO: 137254 - DNA, 918 bp, Artificial Sequence
  Description of Artificial Sequence: Synthetic coding sequence
atgacaatggaaaagggaatgagctccggtgagggtctaccctcacggtcttctcaggtgtcagctggtaagattacagcaaaagagctcgagaccaagcagtcctacaaagagaaacggggtggatttgttttggtgcatgccggtgcagggtatcactccgaatcaaaagcaaaagaatacaaacacgtatgtaagcgggcatgtcagaaggattccccatttacgaacgccggcatgggcagcaatctcaatctgctgggggaaattgaatgcgatgcctctatcatggatggaaaatctctgaactttggagcagtcggcgctctgagcggcatcaagaacccagtgagcgttgccaacagactcctatgcgaaggacaaaagggcaaactctctgccggcaggatccccccgtgctttctggtgggcgagggtgcataccgctgggcagtggaccatgggattcccagctgcccaccaaacatcatgaccaccaggttctctctcgcagctttcaagcgcaacaagaggaagttggaactggcagagagggtcgacactgatttcatgcagctaaaaaagcggcgccaaagttccgagaaagagaatgatagtgggactttggatacagtaggcgcggtggtcgtcgaccatgagggaaatgtggcagcagcggttagcagtggcggcctcgcgcttaaacatcctggacgggtgggtcaagcagcactctatggctgcggatgttgggctgagaatacaggagcccacaatccatatagtactgcggtgtcaacctcaggatgcggcgagcacctggtccggacgatacttgctagagagtgtagccatgcccttcaggctgaggacgcccaccaggcactactggagactatgcagaacaaatttatatag

SEQ ID NO: 137255 - DNA, 333 bp, Artificial Sequence
  Description of Artificial Sequence: Synthetic coding sequence
tgaaagatcactgccaaggaattggaaacgaagcaaagctacaaggagaaacgaggagggtttgtgctcgttcacgcaggggctgggtatcatagcgagtctaaagctaaagaatataagcacgtgtgcaagcgggcatgtcagaaggccatcgaaaagctccaagccggtgccctcgccacggacgcggtcactgccgccctcgttgagttagagctgatgtggaaagggcaattccaggtcctttgcgtgctgaccaatctgtttttggatattatcaaaaatcccacgaaaactaagttcaagacaattagcaacgtcaaagtgtactag

SEQ ID NO: 137256 - DNA, 918 bp, Artificial Sequence
  Description of Artificial Sequence: Synthetic coding sequence
atgaccatggaaaagggcatgagtagcggggaaggacttcctagtcggtcctctcaagtgtctgccggaaagatcaccgccaaagaactggaaacaaagcaatcatacaaggagaagcgaggagggtttgtgctcgttcatgccggtgcagggtatcatagcgaatctaaggctaaggagtacaagcacgtgtgtaaaagggcttgccaaaaggattccccgttcacgaatgctggaatggggtctaatcttaacctgctcggtgaaattgagtgcgacgcctccatcatggatggtaaaagcttgaacttcggagcagtgggcgctttaagtgggattaagaatcctgtgtctgtggccaacagactattatgcgagggccagaagggtaagctttccgcagggagaataccaccatgctttctagtgggggagggggcctacaggtgggccgtggaccacgggataccttcttgcccacccaacatcatgactacgcgcttttcactggcagcctttaagcggaataaacggaagctggaattagcagagagagttgatactgattttatgcaactcaaaaagcgcagacagagctccgagaaggaaaatgactctgggacactcgataccgtgggagccgtcgttgttgatcatgaggggaacgtggcagccgcggtgagtagtggcggcctggcactgaaacaccccggccgagtcggccaggccgccttgtatggctgtgggtgttgggctgaaaataccggagcacacaatccgtattccacagccgtgtcaactagcgggtgcggcgagcatctggtgcggacgatcctcgcccgtgagtgctctcacgccctgcaggcagaagatgctcaccaggcactcctggaaaccatgcagaacaagttcatctag

SEQ ID NO: 137257 - DNA, 438 bp, Artificial Sequence
  Description of Artificial Sequence: Synthetic coding sequence
atgacgatggaaaagggaatgagctccggtgaaggcttacccagtcgttcaagccaggtcagcgccgggaaaatcacggccaaggaattggagactaagcaatcctacaaagaaaaaagaggtgggtttgtcctggtccatgccggagccggctaccatagcgaatcaaaagccaaagaatataaacacgtgtgtaagagagcatgccaaaaggctatcgaaaaactgcaggctggcgcgctggccactgacgccgttaccgcggccctggttgagctggaagacgtagaatccatcctgtgtgccccctactggctggagaacgttcatatgctctacaagctgcgcatgctgacaaaaccttgctggcggttgtgtaaaacatcactgtccgtccacctaagcctgcccgtgaaaatggcatgcttagctgaatag

SEQ ID NO: 137258 - DNA, 390 bp, Artificial Sequence
  Description of Artificial Sequence: Synthetic coding sequence
atgacgatggaaaaaggcatgagtagcggcgagggattgccgtcgcgcagcagtcaggttagcgcggggaagattaccgcaaaagagctagagaccaaacagagctataaagaaaagcgggggggctttgtattggtgcacgcaggcgcaggctaccattcggagagtaaagccaaagagtacaagcatgtttgcaagagggcctgtcagaaggcaatcgagaaacttcaggccggcgcactcgcaacagacgcagtgactgctgctttggtcgagctggaagtgtacacgcattcttacactagctggtcctgcattcaaccaagtatacatgtgctgctcgttaagagacaacgcaagagtccactaccaaggatcagcactttttag

SEQ ID NO: 137259 - DNA, 1443 bp, Artificial Sequence
  Description of Artificial Sequence: Synthetic coding sequence
atgctcctttgcacagcaaggttagtgggtctacagctgctgattagctgttgttgggccttcgcttgccactcgacggaatcatcgcccgatttcactctaccaggtgactatctgctggcgggcctcttcccactgcactctggctgtctccaggttcgtcacagacccgaagttacgctctgcgaccgttcttgcagttttaacgaacatggttaccatctatttcaggcaatgcgcctgggggtcgaagagatcaacaattccaccgccctcctccctaacattacactcgggtatcagctctacgacgtgtgtagcgattcagcaaatgtctatgccacacttagggtactgtccctgcccgggcagcatcatatcgagctccaaggcgatttactgcattattcacccacagtactggccgtgatcggccctgattctaccaacagagcggccaccaccgctgcactgctgtctccgttcctagtgccaatgattagttatgcggcttcttctgaaaccctgtcagttaaacgccagtacccaagctttctcagaaccatccccaatgataaatatcaagttgagactatggtattgcttctccagaagttcggttggacctggatctcccttgtgggctcttctgatgactatgggcagctgggcgtgcaggccttagaaaaccaggccaccggccagggtatatgcattgccttcaaggatattatgccattctctgctcaggtgggtgacgaaagaatgcaatgcctaatgaggcatttagctcaggctggtgccacagtcgttgtggtgttctcgtcaaggcaactcgcacgtgtattctttgaaagtgtggtgctgaccaacttgactgggaaggtttgggtggccagcgaagcttgggccctgtcacgccacattactggcgtccccggtatacagaggatagggatggtgctgggagttgccatccaaaagcgggcagtccccggcttaaaggccttcgaggaagcttacgccagggccgataagaaggccccgaggccgtgccacaagggctcttggtgctccagtaatcagctttgcagagaatgtcaagcatttatggcgcataccatgcccaaactgaaagcgttttcaatgtcctctgcctacaacgcatacagagctgtatacgctgtcgcccatggtcttcatcagttactcggatgcgcatctggagcatgcagcagaggccgcgtctacccctggcagacctcgacagacgcgtcactggttggtaagaagtccggccacctgcgcgaagctagaccagcctcccgagcgctctggtgtttctggctgtgcgtgagcacgcccctcgggtgttgttggcagctgacccggtgctgttgttgttgttgcctggggttgctcgcctgcttgcccgggacctag

SEQ ID NO: 137260 - DNA, 2526 bp, Artificial Sequence
  Description of Artificial Sequence: Synthetic coding sequence
atgctgttgtgtacggccaggctagttggattgcagttgcttattagctgctgctgggccttcgcatgccactcaaccgagtccagtcctgattttactctccctggcgattatctcctcgcgggactgttccctttgcactctggctgtctgcaggtgcggcaccgccccgaagtcacgttgtgtgaccgatcctgcagctttaacgaacacggctaccatcttttccaagctatgcggctcggtgtggaggaaattaacaacagtaccgctctcctgccaaatattaccctgggctaccagctgtatgacgtttgttcagactcagctaacgtttatgctactttgcgagtcctcagcttgcccggacagcaccatatcgagttacagggagacttactccactactctcctaccgttcttgctgtgattggcccggattccaccaatcgggcggctaccacagccgctctgctgagcccgttcctggttccaatgatctcatacgccgcctcaagcgaaactctatccgtgaaaagacaatacccaagctttctgagaacaatccccaacgacaagtaccaggtcgagacaatggtgctgttgttacagaagttcggatggacctggatctcccttgtgggctcgtctgacgattatggccagttgggcgttcaagctttagaaaaccaggcaacaggtcaagggatctgtatcgcattcaaagacattatgccttttagtgcacaggtgggcgacgaacggatgcagtgcctcatgcgtcatctcgcacaggcgggtgctactgtagtggtcgtattctcttcccgacagctagcccgcgttttcttcgagtccgtcgtccttactaatctgactggaaaagtttgggtcgcctcggaggcttgggccctgtccaggcatatcactggcgtgcccgggatccagcggattggcatggtgcttggtgtcgctatccagaagcgtgctgtccccggactgaaagcctttgaggaagcgtatgctagagccgataagaaggccccacgaccttgccataaagggtcgtggtgttcctcaaatcagctgtgccgagagtgccaagccttcatggcgcatacaatgcctaagctaaaggcctttagcatgtcctccgcatataacgcgtacagagccgtgtatgcagtcgctcatggacttcaccagcttcttgggtgtgcttcaggcgcatgtagtagaggaagggtgtatccatggcaactcctcgaacaaatccacaaggtacacttcctcttgcataaggataccgtggcattcaatgataaccgggatccactttcttcttacaatataattgcctgggactggaacggcccaaagtggactttcacggtgctcggctcatcaacctggtccccagtgcagttaaacatcaacgagaccaaaatccagtggcatggtaaggataaccaggttccaaagtctgtgtgcagtagcgattgtctggaggggcatcagagagtcgtgacggggttccaccactgttgctttgagtgcgtgccatgtggcgccggcaccttcctcaataaaagtgacctctaccgatgtcaaccctgcgggaaggaggagtgggctcccgagggaagtcagacctgcttcccccgtaccgtggtctttcttgcactgagggaacatacatcttgggttctgctggccgcaaacaccttactgctgctgcttctgctcggaacagccggcctgttcgcatggcacttggatactccagtcgtgagatcagccggtggcagactgtgcttcctcatgcttggcagcttggccgctgggtcaggatctttatacggattctttggggaacccactagaccagcctgcttgctcagacaggcgctttttgctctcgggtttacaatttttctaagctgtcttacagtcaggagtttccaactgattatcattttcaagttcagcaccaaggttcccaccttctatcacgcctgggtgcaaaatcatggggctggtttgtttgtgatgattagctccgcagcacagcttctgatatgtctgacgtggttagtcgtgtggacgcctttaccggccagagaataccaacggttccctcatttggtgatgctcgaatgtactgagaccaacagtcttggctttatcctcgcatttttgtataatgggctcctgtctatcagtgcctttgcctgtagctacctgggcaaagacttgccagagaactataacgaggctaaatgtgtgacatttagcctgcttttcaacttcgtatcttggatcgccttctttacaaccgccagcgtctatgatggaaagtacctcccagctgctaacatgatggcaggactgtccagcctgagcagcggttttgggggatatttccttcccaagtgctatgtcattctgtgccggcccgacctcaactcaaccgagcattttcaggccagcatccaggactacacacgaagatgcggcagcacgtag

SEQ ID NO: 137261 - DNA, 1764 bp, Artificial Sequence
  Description of Artificial Sequence: Synthetic coding sequence
atgttgttatgtactgccagactggtgggcctgcagctgcttattagttgctgctgggctttcgcctgccatagcactgagagctctccagatttcacgctccccggcgattacttgctcgcggggcttttcccgcttcactctgggtgcttgcaggtgagacaccggcccgaggtcactctgtgcgaccggagctgctctttcaatgagcatgggtatcatctgtttcaggcgatgcgccttggcgtcgaagagatcaacaactctacagcgttgcttccaaatataactctgggctatcagctgtacgatgtttgcagcgacagcgccaacgtctatgctaccctcagagtgcttagcttaccaggccagcaccacatcgaactccagggggacctactgcattattcccccaccgtgttggcagttatcggccctgatagcactaaccgtgcagccacaaccgctgcgctgctgagcccttttctcgttcccatgctgcttgagcagatacacaaagtgcactttcttctccacaaggacactgtggcctttaacgataacagggacccactctctagttacaatatcattgcttgggattggaacgggccaaagtggacgttcacagtcctcgggagcagcacctggtctccagtgcagctgaacataaatgagaccaagatacaatggcacggaaaggataaccaagtgccaaaatccgtgtgttcctctgattgtctggagggacaccaaagggtcgttactggtttccaccactgctgttttgaatgcgttccctgtggcgcagggacattcttgaacaagtcagatctctatcgttgccagccctgcgggaaagaagaatgggctcctgaaggcagccagacctgttttcctcggaccgtggtcttcctggcccttcgtgagcatacctcctgggtccttctggcggcaaatacgctcttgctcctactgctccttggtacggctgggttgtttgcctggcatcttgacactcccgttgtgcggtccgctggggggcggctgtgtttcttgatgctagggagtctggccgctggttctggaagtctgtacggtttttttggagagcctacccgccccgcgtgtttgctgcgtcaggcgctattcgcgctgggcttcaccatctttctgtcttgccttaccgttcggtcgtttcagcttatcattatatttaagttcagtacaaaggtgccaaccttctaccacgcctgggtacaaaatcatggggccggactgttcgtgatgatctcctccgcagcacagctgttgatttgcctcacatggctggtcgtatggacccctcttcctgcccgggagtaccaaaggtttccacacctcgttatgctggaatgcaccgagaccaacagtctggggtttatcttggccttcctctacaacggtctgctgagtatctccgccttcgcatgtagctatctcgggaaagacttgccagaaaattataatgaagcaaaatgcgtaacattcagtctattgttcaatttcgtgtcctggattgctttcttcacaacggccagtgtttacgacggaaaatatctcccagcagcgaacatgatggccggcctctcttctctgtcttcgggctttggcggatattttctgcccaagtgctatgtaattctgtgtcgcccagacctgaactccacagagcactttcaggcctccattcaggactatactagacgttgcggaagcacctag

SEQ ID NO: 137262 - DNA, 921 bp, Artificial Sequence
  Description of Artificial Sequence: Synthetic coding sequence
atgaggctcggggtggaggaaattaataatagcaccgccctgctccccaatatcactctggggtatcaattgtatgatgtctgcagcgactctgccaatgtgtacgctacgttgagagtgctgagcctgcctggtcagcaccacatcgaactgcagggggacctgctacattacagtccaaccgtgttggccgttatcggtcctgattctaccaaccgcgcggctacaactgcggcactgctatccccgtttctggtccccatgctcctggagcaaattcacaaggtgcatttccttctccacaaggatacagtggccttcaacgacaacagggaccctctgtcgtcatataacattattgcgtgggattggaacggaccaaaatggacctttaccgtgctagggtcatcaacctggtccccggttcagttgaacataaacgagaccaaaattcaatggcacgggaaagacaatcaggttccaaaaagcgtgtgttcgagcgactgtcttgaagggcatcagcgggtggtgacgggcttccaccattgctgtttcgaatgcgtaccatgtggcgccggcacatttctcaataaatctgatctgtaccgatgccagccctgtggcaaagaggaatgggccccggagggcagtcagacatgcttccctcgtacagtcgtcttcctcgcactccgcgagcacacctcttgggtactcctggctgcaaataccctactgttgctgctactgctgggcactgcaggcctgttcgcctggcatttggatactcccgtggttagaagcgccggcggccggctgtgctttctcatgctgggttcactggcggccggatccggttccttgtatggttttttcggcgaacccagtctgccactggtttccccgagcagttgtcccgcatag

SEQ ID NO: 137263 - DNA, 2520 bp, Artificial Sequence
  Description of Artificial Sequence: Synthetic coding sequence
atggggccgcgagctaaaacaatcagctctctgttcttcctgctttgggttctggccgaacctgccgaaaactccgacttttatctcccgggcgactacctcttgggcggtctattttcattacacgccaacatgaagggaatcgtgcatcttaattttcttcaggtgcccatgtgtaaggaatacgaggtgaaggttatcgggtataatctgatgcaggccatgagattcgccgtggaagaaatcaataatgactcaagtttactacccggcgttctcctggggtacgaaatcgtggacgtctgttacatctcaaacaatgtgcaaccagtgctgtatttcctggcccatgaagataacctactgcccatccaggaggactactccaactatattagtagagtggtagcagtaatcggtcccgataactcggagtcagtgatgacagtcgctaacttcttgtccttgtttcttctgcctcagataacgtattcagcaatcagtgacgagctgcgcgataaagtacgtttccctgcactgctgcgcacgaccccgagcgccgaccaccatatcgaagccatggtgcaacttatgttacatttcaggtggaactggatcattgtgctggtctcttctgatacatacggcagggataacgggcaactgctgggagagcgggtggccagacgagacatttgtattgcgttccaagaaacactgcctacccttcaacctaatcaaaatatgacatccgaagagcgtcagcggctggtgaccatagtggataagctccagcaatcgaccgcccgggtggtggtagtgttttctccggacttaacactttaccatttctttaacgaggtgctgcggcagaatttcaccggcgcagtgtggatcgcaagcgaatcttgggcaatcgatcctgttctgcacaacctcaccgaactgcgccaccttggcaccttcttgggcataacgatacagtccgtccccattcccggattcagtgaatttagggaatgggggccacaggcagggccccctcctctgtctcggacttcccagagttatacatgtaatcaagaatgcgacaattgtcttaacgcgaccctgtcttttaacaccatcctgcgtctctcaggtgagcgcgtggtgtactccgtgtacagtgccgtgtatgcagtggctcacgctttacacagtctgttgggttgcgataagagcacttgtacgaaaagggtggtctatccctggcagctcctggaggaaatatggaaagtgaacttcactcttctggatcatcagattttttttgacccgcaaggagacgtggcacttcatctggagatcgtgcagtggcagtgggaccgctctcagaacccgtttcagtcggtggcatcctactatccactgcaacgacaattgaaaaatatccaggacattagctggcatactataaataataccattccaatgtcaatgtgcagcaaacgatgccagtcagggcaaaagaaaaaaccagtgggcattcatgtttgctgttttgaatgtattgactgcctccccggaaccttcctgaaccacactgaggatgaatacgagtgtcaagcatgcccgaacaatgaatggtcttatcaatccgagaccagctgcttcaaaagacaactggtattcctcgaatggcatgaggcgcccacaattgctgtagcgctcctggcggcccttggattcttgtcgacattagccatcctggtgatcttttggcgccacttccagactcccattgtacgatcggcggggggaccaatgtgttttctcatgctcactctgttactggtggcctatatggttgtgcctgtttacgttggtccgccaaaagtgagtacatgcctttgccgccaggctctattccctctgtgctttaccatctgtataagctgtattgcggtgcgtagcttccagatcgtgtgtgcattcaaaatggcatcaagattccctagggcatattcttactgggttcggtaccagggtccttacgtgtccatggcgtttattacagtgctgaaaatggtgatagtagtgatcggaatgttagccacggggctcagccccacgactcgcaccgatcccgatgacccaaaaattacaatcgtttcttgcaacccaaattacagaaattccttattattcaacacttcactggaccttctcctctccgtggtgggtttctcatttgcatacatgggcaaggaactccccactaattataacgaggcaaaatttataaccctgtctatgacgttttactttacctcatccgttagcctgtgcaccttcatgtcagcttacagtggggtcctggtcaccatcgttgacctgttggtaactgtccttaacctcctggctatctcactgggatattttgggccgaagtgttatatgatcctcttctacccagagcgtaacacgcccgcctacttcaactccatgattcagggctatacaatgagaagagattag

SEQ ID NO: 137264 - DNA, 2559 bp, Artificial Sequence
  Description of Artificial Sequence: Synthetic coding sequence
atgctcgggcctgccgtgctaggtctgagcctttgggctctcctacaccctggtactggtgcccccctttgtctgtcccagcaactcagaatgaagggagattatgtccttgggggtctcttccctctcggcgaggcagaagaagctgggctgcgttctcggacaaggccctcatctcccgtttgcactagatttagcagtaatggactgctgtgggccctggctatgaaaatggccgtggaagagattaataacaaatctgatttgctccccggattgcgcctcggatatgacctatttgatacgtgctcagagcctgtcgtagccatgaagccttcacttatgttcctggccaaagccggatcaagagatatcgctgcgtattgtaattacacccaataccagccacgggtgctagctgtaattggtccacacagctccgaactcgctatggtgacgggaaaatttttttccttcttcttgatgccccaagttagctatggtgcttcaatggaattgctgtccgcgagggagacgtttccctcattttttagaacagtgccgtccgatagagtacagttgacagctgctgctgagcttcttcaggagttcgggtggaattgggttgctgccctcggatcagacgatgaatacgggcgacagggactctcaattttctccgctctcgcagctgcgcgcgggatctgtattgcccatgaaggccttgtgcctttaccccgagcagatgattcgcggctgggcaaggtccaggatgtattgcatcaggtgaaccagtcatccgtccaggtagtcctacttttcgcgagcgtccatgctgcgcatgccctgttcaattacagcataagcagccgcctgagtcccaaggtctgggtggccagcgaggcctggttaacctcagatctggtcatgggtctccctggcatggcgcagatgggcaccgtcctgggcttcctgcagaggggcgctcaattgcatgaattcccccagtatgtcaagacacatcttgccttggccacagaccccgccttctgctcagccctgggtgaacgtgagcagggtcttgaggaagatgttgttggccaacgttgccctcagtgcgactgtattacactgcaaaacgtctctgcgggactcaatcaccatcaaacattttctgtgtacgcggccgtgtatagtgtggcccaggctttgcacaacactctgcagtgcaacgcctcaggatgccctgctcaggaccctgtcaaaccttggcagttactcgaaaatatgtataacctgaccttccatgtgggcggactcccccttcgattcgattcttcaggtaatgtcgatatggaatatgacctgaagctctgggtttggcagggcagtgtgcctcggctgcatgacgtgggaagatttaacggatcactccgtaccgagcggctgaagattcgttggcatactagcgacaatcagaagcctgtgtctagatgctcccgacagtgtcaggagggacaggtcagaagagtgaaaggcttccattcttgctgctatgattgcgtagactgtgaggctggctcctataggcaaaacccggatgatatcgcttgcacattttgtggacaggacgagtggtcccccgaacgttcgacccgttgcttccggcggcggagccgttttttggcatggggggagccagcggtcctgttgctgctgctcctcctgtcactcgcactcggactggtgctcgcagcactgggcttatttgtccaccatcgagattctcctctggtgcaggcatctggcgggccacttgcttgtttcggcttggtgtgtttaggcctggtttgtctcagtgttctgctgttcccagggcaacctagtccggcccggtgtctggcacagcagcctctttctcacctccccctgaccggctgtctgtcgaccctgtttctgcaagcagccgaaatatttgtagaaagcgagttacccctttcctgggccgaccgactgagcggttgtttgcggggcccctgggcatggctggtagttctgttggctatgttagtggaggtggccctgtgcacatggtatttggttgcctttccccctgaagtcgtaactgattggcacatgctgcctacagaagcattagtgcactgccgcacacggagctgggtttcatttggacttgctcatgctacgaacgccactctggcattcctttgcttcctggggacatttctcgtgaggtctcaacctggatgctacaacagggctaggggcctgaccttcgctatgttagcttattttataacatgggtgagctttgtgccactattagccaatgttcaggtcgtcttacgaccggctgtccaaatgggggccctgctgctatgtgtgttgggaatcctggccgcattccatcttcctcggtgctatctcctgatgcggcagcctggactgaatacgcccgaattcttcttgggcggggggcccggtgacgcacagggccagaacgacggtaacactggcaatcaaggaaaacacgagtag

SEQ ID NO: 137265 - DNA, 876 bp, Artificial Sequence
  Description of Artificial Sequence: Synthetic coding sequence
atgatccccattcaactcacggtctttttcatgattatctacgtgttggagtctctgacaataatcgtgcagagctcattgatagttgctgtgctcggtagggagtggttacaggtgcgcaggctcatgcccgttgatatgatactgatcagcctcggaatatcccgattttgcctgcagtgggcatccatgctaaataacttctgctcctacttcaacctgaattacgtgctgtgtaatctaacaatcacttgggagtttttcaacattctgaccttctggctgaactcactgctcactgtgttctactgtattaaggtttccagcttcactcatcacatctttctctggttgcggtggaggattctgaggcttttcccctggattctgctgggctcgctgatgattacatgtgtcacaattatcccctctgccattggtaactatatacaaattcagcttctcacaatggagcatcttcctagaaattccaccgttacggacaaactggaaaacttccatcagtaccaatttcaggctcatactgtggcacttgtgattccatttatactttttctcgcgagcacaatctttttgatggcttcactgacaaagcagattcagcaccacagcactggtcactgcaatccttctatgaaagcccgttttaccgcactgcgatccttggccgtgctttttatcgttttcacttcctattttcttacgatccttataacaatcattggaacgctatttgacaaaagatgctggctttgggtgtgggaggcattcgtctatgcattcatactgatgcactctacaagcctgatgttgagcagccccacactgaaaagaattcttaagggcaaatgctag

SEQ ID NO: 137266 - DNA, 900 bp, Artificial Sequence
  Description of Artificial Sequence: Synthetic coding sequence
atgatgtgcttcctgttaatcatttccagcattctggtggtgttcgcatttgttttgggaaacgtggccaacgggttcattgcgctggtcaacgttatcgactgggtaaatactcgcaaaatcagcagtgcagagcagatcttaacagccctcgtcgtgtcacggatcggcctcctgtgggtgatgctgtttctctggtacgcaaccgtctttaacagcgctttgtatggtttggaagtgaggatcgtggccagcaacgcttgggctgttacaaaccacttttccatgtggcttgctgcaagtctctctatcttttgcctgctgaagattgccaatttctctaacctaatcagtttacaccttaaaaaacgcattaaaagcgtggtactcgttatcttgttagggccactcgtatttctcatttgcaacctggctgttattaccatggatgaaagagtgtggaccaaggagtatgaggggaacgtgacttggaaaatcaaactgaggaatgcgattcatctgtctagtttgaccgtgaccacgctcgccaacctcattcctttcaccctaagcctgatttgcttcctgctgctgatctgctccctatgcaagcatctgaaaaagatgaggcttcactcgaagggatctcaggacccttctaccaaggtacacattaaagccctccagaccgtcactagtttcctgatgctgtttgcaatctattttctttgtattatcacctctacatggaatctccgtacacagcaatcaaaactcgtgctccttctttgtcagactgtagccattatgtacccttccttccattcctttatactcataatgggctccaggaagctcaaacagacctttctttcagtcttatggcagatgacacgttag

SEQ ID NO: 137267 - DNA, 930 bp, Artificial Sequence
  Description of Artificial Sequence: Synthetic coding sequence
atgatgtcttttctgcacatcgtcttctctatcctcgtggtcgtcgccttcatcctgggaaactttgcaaacggattcattgcccttatcaatttcatcgcttgggtgaagcggcaaaaaattagttctgctgaccagatcatagccgctcttgccgtgtccagagtgggacttctgtgggtgatactgctccattggtatagcactgtgcttaaccccacgagcagcaacctaaaggttataatcttcatatctaacgcttgggctgtcacaaatcacttcagcatttggttggctaccagtttaagcatattctatcttttgaagattgtgaacttcagccgtctgatctttcatcacctgaagcgtaaagccaaatcagtcgtgctggtgattgtgttgggaagcctatttttcctcgtttgtcacttggttatgaaacacacatacataaatgtgtggaccgaggaatgtgagggaaatgtgacttggaagatcaagttgaggaatgctatgcatctctcaaacctgaccgtggctatgctggcaaatctcattccttttacgcttaccctcatcagctttctacttcttatttattctctatgcaagcaccttaagaaaatgcaattacacggcaaggggtcccaggaccccagcaccaagatccatatcaaggccctgcagaccgtaacgtcctttctcatcctcttggcgatttactttctttgcctgattattagtttctggaatttcaagatgcgcccaaaagaaatcgtgctcatgctctgtcaggcctttggaatcatctaccctagtttccactcctttatcctcatctggggcaacaaaacgctgaagcaaacttttttatccgtcctgtggcaggttacatgctgggcgaagggccagaatcagagtacaccgtag

SEQ ID NO: 137268 - DNA, 951 bp, Artificial Sequence
  Description of Artificial Sequence: Synthetic coding sequence
atgatgggtctcactgaaggagtgttcctgattctgtcaggtacccaattcaccctggggatcttggtgaactgtttcatcgaattggttaatgggtccagttggtttaaaaccaagagaatgagcctgagtgacttcataattactaccctggcgcttctgcggattatactcttgtgtatcatacttaccgattcttttctgattgagttcagtcctaacacacacgatagcggcattatcatgcagattattgacgtgtcatggacattcacaaaccacctgagcatttggctggccacttgccttggagtgctctactgcctgaagatagcctctttttcacatccgacattcttgtggctgaagtggcgtgtgtccagagtgatggtgtggatgctgctgggggccttgctgctgtcttgtggaagtacagcatccctgatcaacgaatttaaactgtacagtgtatttagaggtattgaggcaacaagaaatgtgacggagcactttaggaagaaacgaagtgaatactacctgatccatgtcctagggaccttgtggtacctgccccctctgattgtgtctctggcttcatatagcctcctcatcttcagcctgggcagacacacacgtcagatgctgcagaacgggacatcaagtagggatcccacaactgaagcccacaagcgcgccattaggattatactctcattctttttcctatttctactttactttcttgcattccttatcgcatcatttggtaacttcctacctaagaccaagatggctaaaatgattggcgaagtaatgacgatgttttaccctgctggccactcttttattctaattctcggaaattctaagcttaagcagacctttgtggtgatgctacgctgcgagtccggacatctgaagccaggtagtaaaggccctatcttttcctag

SEQ ID NO: 137269 - DNA, 960 bp, Artificial Sequence
  Description of Artificial Sequence: Synthetic coding sequence
atgataactttcttgccaattattttttcgatcctgatcgtggtgatctttgtgattggcaactttgctaacggatttattgcattggtgaatagtattgaatgggtgaaacggcagaagataagcttcgtggatcaaattctgacggctttagccgtgagccgcgtcggactactgtgggttcttctcctgcattggtacgctacccaactgaacccagccttctactccgtagaggtccggatcaccgcttacaacgtttgggccgtgactaaccacttttcaagctggctggcgacatccctcagcatgttctacctcctacggatcgccaactttagcaatctgatattcctccggataaaacgacgtgtaaaaagcgtggtgctggtcattctgctggggcctctactgttcctggtctgtcaccttttcgtgatcaatatggatgaaaccgtctggactaaagagtacgaaggaaacgtcacttggaagatcaagttgcggtctgcaatgtaccacagcaacatgaccctcactatgctcgccaactttgtgcctctgacccttacgttgatctcatttttactacttatctgctctttgtgtaagcacctgaaaaaaatgcagctgcacggcaagggcagccaggacccttctactaaggtccatattaaagccctccagactgtgaccagttttttgctgctctgtgcgatttattttctgtccatgattattagtgtctgcaatttcggcagactcgagaagcagcccgtctttatgttttgccaggcaattatcttttcctacccttctacgcatccattcatccttattctgggaaacaaaaaactgaagcagatttttttgtcagttctacgccacgttcgctattgggtgaaggatagatctctaagactgcatcgctttactcgtggcgcgctttgcgtcttctag

SEQ ID NO: 137270 - DNA, 930 bp, Artificial Sequence
  Description of Artificial Sequence: Synthetic coding sequence
atgaccacttttataccaatcatcttttcctctgtggttgtggtcctcttcgttataggtaacttcgccaacgggttcattgccctggtcaattccattgaaagagttaagagacagaagatcagcttcgcagatcagattctgacagctctggccgtatcacgtgtcggcctcctctgggtcctcctgctgaactggtactccactgtgttcaatcctgcgttctactcagtggaggtacgaaccacggcctataacgtgtgggccgtaacaggccacttctctaattggctcgccacatcactaagtatcttctatctgctaaaaatcgccaattttagcaacctgatttttctccacctcaaacgccgagtcaagtctgtgatattggtgatgctcctcggtcccttactgtttctggcctgccagctgttcgtaattaacatgaaggaaatagttcgtaccaaggagtatgagggcaacctgacttggaaaatcaaactcagatccgccgtgtacttaagcgacgctacagtcacgaccctgggaaatctggttccctttacactgactctgttgtgctttctcctactgatttgcagcctgtgtaaacacctcaaaaagatgcagctacacggcaaaggctctcaggacccctcaacaaaagttcacataaaagccctacaaaccgtgattttctttcttctactctgtgcggtatacttcctgtcaatcatgataagcgtctggtcatttggttctctggagaacaagccagtgtttatgttttgcaaagccattagatttagctatccatctattcacccgtttatcttgatatggggtaacaaaaagctaaagcagaccttcctttctgttctaagacaggtgcggtattgggtcaaaggagagaagccatcttcgccctag

SEQ ID NO: 137271 - DNA, 1002 bp, Artificial Sequence
  Description of Artificial Sequence: Synthetic coding sequence
atgttgactctaacgcgaatccgcactgttagctacgaagtgagatctacttttctattcataagcgtgcttgaatttgccgttggcttcctcaccaatgctttcgtgtttctcgtcaacttttgggacgtggtgaagagacaggccttgagtaattccgactgtgtgctgctgtgtcttagtatctcgcgtctcttcctccacgggttgctgttcctttctgccatacagctcacccactttcagaagctttccgagccactgaatcactcttaccaggcaatcattatgctgtggatgattgccaatcaggcaaacctatggctcgcagcatgtctcagcttgctgtactgtagcaagctgatccggttctctcacactttcctgatttgtttagcttcttgggtgtcccggaagatctcgcagatgctgcttggcatcatcctctgttcctgtatttgtaccgtgctgtgcgtctggtgcttcttctcccgcccgcattttactgttaccaccgtgctttttatgaacaacaacacacgccttaattggcagattaaggacctgaatttattttactcattcttattctgctacttgtggagtgtacctccgttccttctattcttagtgtcctcaggaatgttgactgtgagcctgggacgacatatgaggaccatgaaggtgtacactcggaactctcgtgacccaagcttggaagcccacattaaggcactcaaaagcctcgtgtccttcttctgcttcttcgttatttcctcctgtgccgcatttatctccgtccctctactgatactgtggcgcgacaagattggggtcatggtttgcgtcggaattatggcagcctgcccaagcggccacgcggcgatcctgattagtggaaatgccaaattgcgacgggctgtgatgacaatcctcctatgggctcagagctccctaaaagtgcgggcagatcacaaggccgatagccgtacattgtgctag

SEQ ID NO: 137272 - DNA, 900 bp, Artificial Sequence
  Description of Artificial Sequence: Synthetic coding sequence
atgctgaggctgttttatttctctgccattattgcctcggtgatcctgaactttgtgggcattattatgaatctctttatcacagtggttaactgcaaaacctgggttaagtcacaccgaatttcatccagcgataggattctgttctctctcggaattactagatttttaatgcttggcctctttctcgtgaacacaatatacttcgtgtcaagcaatactgagaggagtgtgtacctcagtgccttcttcgtcctgtgttttatgttcctagacagctcatcagtctggttcgtgactctactgaacattctgtattgcgtcaagatcactaactttcagcattcagtcttcctactgctcaagagaaatatcagccccaagatcccacggctgctcctggcctgtgtcctcatttccgccttcacaacatgcctttacattacacttagtcaggcatcccctttcccagaacttgtgacaaccagaaataacacgagcttcaatatcagcgaaggtattctgagtctagtggtgtcactagtattaagctccagcctgcagtttattattaatgtgacgtccgcatccttactgattcattccctgcggcggcacattcagaaaatgcagaaaaacgctaccggattttggaaccctcagacagaggctcacgtgggagcgatgaaactcatggtttatttcctgattctgtacattccttactcagtagctacccttgttcagtatctgcccttctacgccggcatggatatgggaactaaatcgatctgcctgatttttgcgacgctatatagcccgggccacagtgtgttgatcattataacccaccccaagctcaagactacggctaaaaaaatactctgtttcaagaaatag

SEQ ID NO: 137273 - DNA, 972 bp, Artificial Sequence
  Description of Artificial Sequence: Synthetic coding sequence
atggctaccgtcaacactgacgcaactgacaaggatatcagcaagtttaaggtcacttttacccttgtggtttccggcatcgaatgcattactggcatcctggggtcaggcttcatcactgccatctacggtgcagagtgggcacggggaaagacgctgcccactggggataggatcatgctgatgttgtctttctccagactgctcctccagatttggatgatgctcgagaatatattttccctactgttccggatcgtgtataaccagaacagcgtgtatatattgttcaaagtgattactgtgttcttgaatcactctaatctctggttcgcagcctggctcaaggtgttctactgtttaaggatagcaaattttaatcatccgctgttcttcctaatgaagagaaagattattgtcctgatgccctggttattgagacttagcgtgcttgtgtccctttcatttagttttcccctaagtagagatgtgttcaacgtgtacgtcaatagctcaatacccatcccatcttcaaatagcactgaaaagaaatatttttcagaaactaatatggtgaacctcgttttcttttacaatatgggcatattcgtgcctctgatcatgttcattctagcagccaccttgcttattctcagcctgaaaagacatacactccatatgggcagtaatgcaacaggatcacgtgatccgtctatgaaggcgcatatcggcgccatcaaagctacctcttattttctcatcctgtacatttttaacgccatcgccctttttctgtccacttcgaacatttttgacacttatagttcttggaacatactgtgtaaaatcatcatggcagcttaccctgccggtcattccgtgcagcttatccttggcaatccaggactgcgaagggcatggaaaagattccagcaccaggtccccctgtatctaaaagggcagacgctttag

SEQ ID NO: 137274 - DNA, 924 bp, Artificial Sequence
  Description of Artificial Sequence: Synthetic coding sequence
atgcaggctgcactgactgcctttttcgtgctattgttctccttgctgagccttcttggaatagccgccaatggattcatagtcctagtcctgggaagagagtggctgcgctacggccgtctcttgcccctggatatgattctgatctcactcggggctagtagattctgcctccagctggttggcacagtccataacttttactacagtgcgcagaaggttgaatattccgggggcctgggaaggcaatttttccaccttcactggcacttccttaatagtgcaaccttctggttctgtagctggttatcggtattattttgcgtcaagattgctaacattactcatagtaccttcctttggctgaagtggcgatttccggggtgggtgccttggctcctcctgggtagtgtcttaattagttttatcattacgctgctgtttttctgggttaattacccagtgtaccaggaatttctgatccggaagttcagtggtaacatgacttataagtggaacactcgcatcgagacgtattatttcccatcactgaagctagtcatttggtccatacccttctcagtttttctggtgtccatcatgctgctgatcaactcgctgaggcgccatacacagcgcatgcagcacaacggccacagcctccaagacccctctacacaagctcacacgagggctctcaaatcgctgatctccttccttatcttgtatgccctaagcttcttaagcttgataatagacgcggccaagttcattagcatgcagaatgacttttactggccctggcagatcgctgtctacctctgtattagcgttcacccgtttattctgatcttttcgaacctgaagctgaggtccgtcttctctcagttgctgttgcttgcccgtggattctgggtcgcctag

SEQ ID NO: 137275 - DNA, 945 bp, Artificial Sequence
  Description of Artificial Sequence: Synthetic coding sequence
atggcaacagagctggacaagatcttcttaatcctggccatcgccgaattcatcatcagcatgcttgggaacgtctttatcggcctggtcaattgttccgaaggtattaagaaccagaaagttttcagtgccgacttcatcctcacatgtttagctatcagtacaataggccagctcttggtgatcctcttcgattcatttttggtgggcctggcaagccatctgtacaccacctataggctgggcaagacggtgattatgctgtggcatatgacaaaccatctgaccacctggctggccacctgtcttagcatcttttatttcttcaagatcgcacattttccccactcgttattcctttggttacgatggaggatgaacggaatgatcgtcatgttgctcatcctctctttgttcttattgatctttgactccctcgtccttgaaatttttatcgatatttccctgaatattattgacaaatccaatctcactctttacttggatgagagcaagaccctatacgacaagctcagcatcctaaagaccctcctcagtttgacgtccttcataccattcagtctatttttgactagtctgctgtttctgttcctgagtctggtgaggcataccagaaacctgaagctgtcctctcttggtagtagggacagctcgaccgaagctcaccgaagagcgatgaagatggtgatgtccttccttttcctgtttattgtgcacttcttcagcctgcaggtcgccaacgggatcttctttatgctgtggaataacaaatacatcaagttcgtcatgctggcgctgaatgcatttccctcatgccattcattcattctcatcctaggcaattccaagctgagacagacagccgtgcgcctgttatggcatttgaggaactacacgaagactcctaacgcgttgccactttag

SEQ ID NO: 137276 - DNA, 930 bp, Artificial Sequence
  Description of Artificial Sequence: Synthetic coding sequence
atgattaccttcttgccaatcatctttagctcgcttgtggttgttacattcgtcattgggaattttgccaacggtttcattgcactggtcaactctatcgagtggtttaagaggcagaagatctctttcgctgatcaaatcttgacagctctcgctgttagtcgtgtaggcctcctctgggtgttgttgctcaattggtactctaccgttctgaatcccgcctttaattccgtagaggtacggaccacggcttataatatctgggccgtaatcaatcattttagcaattggctggccaccactttatcaatcttttacctgctgaaaatcgccaatttctccaattttattttcctgcaccttaagcggcgcgtgaaatctgtaatcctggtaatgttgctgggtccactactgttcctcgcttgtcacttatttgtgattaatatgaacgagattgtccgcaccaaggagttcgagggcaatatgacttggaagattaaactgaagtctgcaatgtacttttctaacatgaccgtcacaatggtggccaatcttgttccattcactttgaccctgttgtcattcatgctactgatttgttccctgtgtaagcacctgaaaaagatgcaactacatggcaaaggctcccaggacccttccacaaaggtgcatatcaaggcgctccagacagtgatttcctttttgctgctctgcgcaatttacttcttaagcattatgatttctgtgtggtcttttggtagcctcgaaaacaaacccgtctttatgttctgcaaggccatccgattctcctatccaagcatccatcctttcatactgatttgggggaataagaagttaaagcaaacattcctgagtgtcttctggcaaatgaggtactgggtgaaaggcgaaaaaactagttccccttag

SEQ ID NO: 137277 - DNA, 930 bp, Artificial Sequence
  Description of Artificial Sequence: Synthetic coding sequence
atgatcaccttcctccctattatctttagtatcctgatagttgtgacgttcgtgattggtaactttgcaaacgggttcatcgccctggtgaactcgatcgagtggttcaagcgtcaaaagatttccttcgccgatcagatcctcactgctctggcagtcagccgagttggtctgctgtgggtcctggtgctcaactggtatgctacagaactcaatccggcctttaatagtattgaggtccggatcacggcttacaacgtgtgggccgttattaaccatttcagcaactggctggcaacaagtctgtctatattctatctactgaagatagccaacttcagcaatctcatttttctccacctgaaaaggcgcgtcaagagcgtggtgttggtcatcttactggggccattgctctttctcgtgtgtcatctcttcgtgatcaacatgaatcagatcatctggacaaaggagtatgaaggcaacatgacctggaagatcaagctgcgcagtgccatgtatcttagcaataccactgttaccatcctggcaaatttagtacccttcaccctgacactgataagctttctgctcctgatttgcagcttgtgcaaacatttgaagaagatgcagctccacggcaaggggagtcaggaccctagtatgaaggtgcacattaaagccctccagacagtgacttcctttctgctcctgtgtgctatatactttctctctatcattatgtctgtgtggtctttcgaatcactcgagaacaagccggtattcatgttctgtgaagcaatagccttctcatatccaagcacccacccctttatcctgatatggggcaacaaaaagcttaagcagacattcttgagcgtcctgtggcatgtgcggtactgggttaagggtgaaaaaccaagctcctcatag

SEQ ID NO: 137278 - DNA, 900 bp, Artificial Sequence
  Description of Artificial Sequence: Synthetic coding sequence
atgctctctgctggcctggggctgttgatgctcgtagcggtcgtggaatttttaataggactgatcgggaacgggtcgctggtggtgtggtcttttagagagtggattagaaagtttaactggagctcctacaatcttataatcctggggttggcaggctgccggttcctcctgcagtggctaatcattctagacctcagcttgttcccactcttccaaagcagccgttggctcaggtacctgagcattttctgggtgctggtgtcccaggcatcgctgtggttcgccaccttcctttcagttttctattgtaaaaagattacaaccttcgacagaccagcctatctctggttaaaacagcgcgcatataatctcagcctgtggtgtcttcttggatacttcattatcaacctcctcctgacagttcagataggactgaccttctatcaccccccccagggaaattctagtataaggtatccgtttgagtcatggcaatatttgtacgccttccagctaaattctggatcctatctgcctctggtggtctttctggtgagcagtggcatgctcatcgtctccctgtatacccatcacaagaaaatgaaagtgcatagcgcaggaagacgggatgtgcgtgctaaggcccatattacagcactcaaaagcctcggatgttttttactgcttcacctcgtctacattatggcaagcccttttagcatcacctcgaaaacttaccccccagacctgacctcggtgtttatctgggagacactcatggcagcttatcctagcctccatagtctgattcttattatggggattcctagagtaaaacagacatgccagaagattttgtggaagacagtgtgcgctcggaggtgttggggtccatag

SEQ ID NO: 137279 - DNA, 900 bp, Artificial Sequence
  Description of Artificial Sequence: Synthetic coding sequence
atgatcactttcctctacatttttttttcgattctgatcatggtgctgtttgttttgggaaactttgccaacggattcatcgcactcgtgaacttcattgattgggtcaaacggaagaagatatccagcgccgaccaaatattgactgcccttgcagtgtcgcggattgggctcctgtgggccctgcttctgaactggtacctgacagtgcttaaccccgcattctacagcgtagaactgaggattactagctataatgcatgggtcgtgaccaatcacttcagtatgtggttagccgccaacttaagcatcttttacttactgaaaatagcaaatttctctaaccttttattcctccatctaaaaaggcgcgtccgctcagtgatccttgtcattctcctggggacactgatctttctggtttgtcatttactcgtggccaatatggatgagtccatgtgggctgaagaatacgagggaaacatgaccggtaagatgaagcttagaaacaccgtacacctgtcatatctgactgtcacgaccttgtggagttttatccctttcaccctatccctgattagtttccttatgctcatctgcagcctgtgtaagcatctgaagaaaatgcaattacacggagaaggcagccaagacctttctactaaggtgcacattaaggcgctccaaactctgataagctttctgctgctttgcgcgattttctttctgtttctcattgtgagtgtttggtcccccaggagattgcggaacgatcctgtggtcatggtgtcgaaagccgtgggaaacatttatcttgcttttgattctttcatccttatctggagaacgaaaaaattaaaacacacatttctcttgatactgtgccaaattcgttgctag

SEQ ID NO: 137280 - DNA, 957 bp, Artificial Sequence
  Description of Artificial Sequence: Synthetic coding sequence
atgaacggggatcatatggtcctgggttcaagtgtaacggataaaaaagcgatcattctcgtcacaatcttgcttctgctgaggttggtggctattgccgggaacggtttcatcacagctgcactgggagtggaatgggtgctgcggaggatgctcttgccttgcgataaactgctcgttagcctgggtgccagcaggttttgtctgcagtcagtagtgatgggcaaaactatttacgtgtttctgcacccgatggctttcccctataaccctgtactccagttcctggctttccagtgggattttctcaatgctgctaccttgtggtccagcacttggttgtctgttttctactgcgtaaagatcgcaacattcacacatcccgtgtttttttggctgaagcacaagctcagtggatggctcccctggatgctcttttccagcgtgggccttagttctttcaccaccatccttttctttatcggtaaccacaggatgtaccagaattacctccgcaaccacctgcagccttggaacgtcaccggggattccattcgctcatattgtgagaaattctatctgttccctctgaagatgatcacatggaccatgccgacagccgtgttcttcatctgtatgatcctgctgatcacttccttagggcgccacagaaaaaaagccttgctgaccacatccgggttccgcgagccaagcgtccaagcccacataaaagcgctgttggccctactgagtttcgcgatgctgtttatctcgtactttctgagccttgtgttctctgcagccggcatattcccacctctggattttaagttctgggtatgggaatcggtgatttacctatgtgccgctgtgcaccccatcatccttctgttcagcaactgccgattaagggccgtgcttaagagcagacggagctccagatgcggtacaccctag

SEQ ID NO: 137281 - DNA, 1314 bp, Artificial Sequence
  Description of Artificial Sequence: Synthetic coding sequence
atgcctaaatttaaggctgcaaggggcgtgggagggcaggagaagcacgcccctcttgccgaccagattctcgctggcaacgccgtgcgggcaggtgtccgcgaaaagcgtcgaggaaggggtaccggcgaggctgaagaggagtatgtcggccctagactcagccgtaggatcctgcagcaagcgaggcagcagcaagaagagttagaggccgaacacggcacaggagacaaacccgctgcccccagagaacgtaccacacgcctcggaccacgaatgccccaagacggaagcgacgatgaagacgaagagtggcctacgctggagaaggcggccacaatgactgccgccggacaccatgccgaagtcgtggtggatcccgaggatgagagagccatcgagatgttcatgaataagaacccccctgcccgccggacactcgccgatatcatcatggaaaaactcactgagaagcaaacagaggtggaaactgtaatgagtgaggtgtctgggtttcccatgccccagctggatcctcgggttctcgaagtgtaccgcggcgtccgcgaggtgctgtctaaatatcggagtggcaagttgccaaaagcatttaaaatcatacccgctctctccaattgggaacagatattatacgtcacagagcccgaggcgtggaccgctgctgctatgtaccaggccaccagaatcttcgcaagcaatttaaaggaacgcatggcgcaaagattttacaacctggtactgctccctcgggtccgcgatgatgttgctgagtacaaacgtctgaatttccacctctatatggccttgaaaaaggccctgtttaagcccggggcttggttcaaaggtatactgatcccactgtgcgagtccggcacctgcactcttagggaggccatcattgtgggaagcatcataacaaaatgttctatccccgttctccattccagtgccgcaatgttaaaaattgctgagatggaatacagcggggccaacagcatcttcctgcggctgcttttggataagaagtatgcgctgccctacagggtgctggacgcattggttttccattttcttggtttcagaacagagaagcgggagcttcccgtgctatggcatcagtgcctcctgacacttgtccagaggtacaaggctgatcttgctacagatcagaaagaagccctgctggagctgctccggctccaaccgcacccacaactgagcccggagatccgaagggagctgcaaagcgcggtcccacgggacgtcgaagatgtcccaatcacggtggagtag

SEQ ID NO: 137282 - DNA, 951 bp, Artificial Sequence
  Description of Artificial Sequence: Synthetic coding sequence
atggaccagaacaatagtctgccaccatatgcgcaaggcttggcgagtcctcagggcgcgatgacccccggaatacctatcttctcgccaatgatgccttatggcaccggtttgacgcctcagccaatccagaacacgaattcattgtccatacttgaggagcagcagagacagcaacagcaacaacagcagcagcaacagcagcaacagcagcaggcggtggccgctgccgctgtgcaacagtctacatcgcaacaggccactcagggaaccagcgggcaggcccctcagctcttccactcccagacattgacaactgcgcccctgcctggcactaccccactgtatccttcccctatgacaccgatgacacctatcacgcccgccaccccagccagtgagtcatctggtattgtgccacagcttcagaacatcgtctccacagtgaatttgggatgtaaattagacctgaagacaattgcactcagagcaagaaacgctgagtataaccccaaacgtttcgcggcagttatcatgagaattcgcgagccgagaacaaccgctttgattttctcgtcgggtaaaatggtctgtacaggggctaagtccgaagagcagtcgagactcgcggctagaaagtacgcccgggtggtgcagaagttaggcttccccgctaagtttttagatttcaagatccagaacatggtaggaagctgcgacgtcaaattccccatcaggctggaaggcttggtcctgacccatcagcagttcagtagctacgagccagaactgtttcccggcctgatctataggatgatcaagcccaggatcgttcttctgattttcgtctctggtaaggtcgtcctgaccggcgctaaagtgagagcagagatatacgaagcattcgagaatatctatccaatcttaaagggttttagaaagactacctag

SEQ ID NO: 137283 - DNA, 1020 bp, Artificial Sequence
  Description of Artificial Sequence: Synthetic coding sequence
atggatcagaacaactcactcccaccatatgctcagggcttggcctctcctcaaggagccatgacacccggcattcccattttctcccccatgatgccttatggaactggattgaccccacagcccatccaaaataccaatagcttatccattctggaggagcagcagcgacaacagcagcagcaacaacagcagcaacagcagcaacagcagcagcaacagcagcaacagcagcagcagcagcagcagcagcagcagcagcagcagcagcaacagcagcagcaggctgtagcagcagcagctgtccagcagagcacctcccaacaggctactcagggaacctcaggacaggccccacaactcttccattctcaaaccttaactaccgccccattgcccggcacaacaccactgtacccaagcccgatgactcctatgactcccatcacaccagccacccccgccagcgagtcctctgggattgtgccccagctccagaatatcgtcagcacagtaaatctgggctgtaagcttgaccttaaaaccattgccctgcgagctcgcaacgccgagtacaaccctaagcgattcgctgcagtgatcatgcggatcagagaacccagaaccacagccctgatcttttctagcgggaaaatggtgtgtaccggggcgaagtcagaggaacagagccgcctggccgctaggaagtacgctcgagtcgtgcagaaactcgggtttcctgccaagttcctggatttcaaaatccaaaatatggtggggagttgtgatgtgaagtttccgataaggctggaggggctggttttaacacaccaacagttcagcagctatgagcccgagctcttccctgggctgatctatcgcatgataaaaccacggatagtgctgctgatcttcgtttctgggaaagtggtcttgactggagcaaaagtgagggccgagatatatgaggcttttgagaacatctaccctattctgaagggcttcagaaaaacgacgtag

SEQ ID NO: 137284 - DNA, 627 bp, Artificial Sequence
  Description of Artificial Sequence: Synthetic coding sequence
atggaccagaacaactccctgccaccatatgcccaaggcttggcctctcctcagggagctatgacgccaggcataccaatcttctctccaatgatgccatacggcacgggcctgaccccccagcctattcaaaatacgaattcactgagcatcttggaggaacaacaaaggcaacagcagcaacagcagcaacagcagcaacagcagcagcaacagcagcaacaacagcagcagcaacagcagcagcagcaacaacaacagcagcagcagcaacagcagcagcaagcggtcgccgccgccgcggttcagcaaagtacttcccagcaagcaacgcaaggcacctccgggcaggccccccaactgttccatagccagacactgacaacagctcccctgccaggcacaaccccactatacccatcccctatgaccccaatgactccaattacacccgccacacctgcaagcgaaagttccgggatagtacctcagttacaaaatattgtgtcaaccgtgaatctcgggtgtaagctggacctgaagacaatagccttgagagcgcgcaatgccgaatacaatccaaagagatttgcggccgtgatcatgcgaatacgagaaccacgatag

SEQ ID NO: 137285 - DNA, 456 bp, Artificial Sequence
  Description of Artificial Sequence: Synthetic coding sequence
atggatcagaataactccctgccaccatacgcgcaggggctggctagtccacagggcgctatgactcctgggattcccatcttctctccaatgatgccctacgggacaggccttacaccccaaccaatccagaacacaaactctctcagtattctggaagaacagcagcggcagcagcagcagcagcagcagcaacagcagcagcaacaacagcagcagcagcagcagcagcaacagcagcagcagcaacagcagcagcagcagcagcagcagcagcagcagcaggctgtggctgctgcagccgtgcaacagagtacctctcagcaggccacccagggcacgtctggccaagccccacagctcttccattctcagactcttaccactgcccctttacctggcacaaccccgctatacccttcccctatgaccccgatgacccctattaccccatag

SEQ ID NO: 137286 - DNA, 306 bp, Artificial Sequence
  Description of Artificial Sequence: Synthetic coding sequence
taagaggaacagagtaggttggcagctcgtaaatatgcaagagtggtgcagaagttagggttccccgccaagttcctagactttaaaatacagaacatggtcgggagctgcgacgttaagtttcccatctcctacgagcctgagctgtttccaggacttatttatcgcatgataaagcccagaatagtgctgcttatcttcgtgtctggcaaggtagtgcttaccggtgccaaggtgagggccgaaatctacgaagccttcgaaaatatctaccccatcctgaaaggttttcggaaaacgacatag

SEQ ID NO: 137287 - DNA, 960 bp, Artificial Sequence
  Description of Artificial Sequence: Synthetic coding sequence
atgactcccggcatccctatcttctctccaatgatgccctatggaactgggttgacaccacagccaatacagaacaccaatagcctgagtatcctggaagagcagcagcgccagcagcagcaacagcaacagcagcagcagcagcaacaacagcagcaacagcagcaacaacagcagcagcaacagcagcagcaacagcagcagcagcagcagcagcagcaacaggccgtggctgcggctgcggtacagcaatctaccagtcaacaggcgacccagggtacctctgggcaggctccgcagctgtttcattcacagacactgaccaccgccccactacccggcacaacaccactgtatccctccccaatgacacctatgacacctatcactccagcgaccccggcatccgaatctagtggcatagtcccccagctccagaacattgtatcaactgtgaatcttggctgtaaacttgatcttaaaactatagccctgagagctaggaatgcagaatacaatccgaagcgcttcgcagccgttattatgcggataagagagccacgaactactgcgctgatcttctcaagtggtaaaatggtgtgcaccggagctaaatctgaggaacagagcagattggcagcacggaagtatgcacgggtcgttcagaagctcggctttcccgccaaatttttggactttaagatccaaaatatggtaggtagttgcgatgtgaaatttcctatccgactggagggcttagtgcttacccaccagcagttctcttcttatgagcccgaactcttccccggcttgatttaccgaatgattaagccaaggattgtcctgctgatctttgtgagtggcaaggttgtcctgaccggtgctaaggtcagagctgagatttacgaggcctttgagaatatttacccgatcctgaagggatttcggaagactacctag

SEQ ID NO: 137288 - DNA, 2610 bp, Artificial Sequence
  Description of Artificial Sequence: Synthetic coding sequence
atggatttccccagtagtttgcggcccgccctctttcttactgggccactggggttgtcagatgtacctgatctgagctttatgtgttcatggcgagatgcactcaccctgcctgaagctcagcctcagaatagcgaaaatggcgccctgcatgtgaccaaggatttactatgggagccagcaacacctggtccactcccgatgcttccccccctgattgacccatgggaccccggccttactgcgagggatctgctgttccgggggggttgcaggtacaggaaaaggcctcgggtcgttttagatgtaaccgaacaaattagcagattcctgttggaccatggcgatgttgcatttgcccctctgggtaaattgatgctcgaaaatttcaagctcgaaggcgctggcagccggacaaagaaaaagactgtcgtttccgtaaagaaactgctccaggatcttggaggacaccagccatggggctgcccatgggcatatctgagtaaccggcagagaaggttctctatcttggggggtccaatattgggcactagcgtcgcaagccacctcgctgaactgctccacgaagagctcgtgctaaggtgggagcaactcctactcgatgaggcgtgtacaggtggcgcactggcatgggtgcctggcaggacccctcagttcggccagctcgtgtatcccgcgggtggcgctcaggacagattgcattttcaagaggtggtgttgaccccgggggacaacccgcagtttctggggaaaccagggaggatccaattgcagggcccggtgagacaagtggtcacctgcacagttcagggagagagcaaggccctgatctacacctttctccctcactggctgacttgctatcttacacctggcccttttcaccctagctcagcactgctcgccgtccggagcgactaccattgcgcagtgtggaagttcggaaagcagtggcagccgaccctgctccaagcaatgcaagtggaaaagggggctaccggtatctccctgtctccacatctgccgggcgagctggcgatttgcagccgcagcggtgctgtctgtctatggtcccctgaagacggactgcgccagatctacagggaccccgagacgctggtgtttagagactcctcaagctggaggtgggccgacttcaccgcccacccccgagtcctgaccgtcggagaccgtactggtgtcaagatgctggatacacagggacctcctggctgtggtcttttgttattccgcctgggtgcggaggcttcatgccagaagggggaacgcgtgctcctgacacaatatctaggccattcttcccctaaatgtctgccaccaactctgcatctcgtatgcacgcaattctcattatatctagtcgatgaacggctcccactcgttcccatgctcaaatggaaccatggcctgccttcaccgctcttattggctagactcctccccccaccccggccttcctgcgttcagcctctgttgctaggaggacagggcggtcagctgcagcttttacacctcgctggagaaggagcttctgtgcctaggctggctggaccaccgcagagtctgccctcacgaattgattcgctccctgcttttcccttgctcgagccaaagattcaatggagactacaggaacgcctcaaggcccctaccatcgggctggccgccgtggtgcctcccctccctagtgccccaacacctggcctagtattgtttcagcttagtgctgctggcgatgtgttttatcaacagctgcgaccccaagtagattcatcactccgccgggatgcgggcccccccggcgacacgcagccagactgccacgcccctacggcgagctggacttcacaggatacggcaggttgttcgcagtggctgaaggctctgctgaaggtgccactggccccccccgtgtggacagccccaaccttcacacacaggcagatgctgggcagcaccgaactgagacgggaggaggaagagggccagagactgggagtgctccgcaaggccatggcccgtggccaactgctgctacagcgtgacctaggaagtcttcccgccgcagagcctccacccgcacctgagagtggtctggaagacaaattgtccgaacgacttggggaagcttgggcaggccggggggctgcgtggtgggaacgtcagcagggacgaacctctgaacctggaaggcaaacgcgccgccccaaacggcgaacacaactgtcctcctcatttagcctctcagggcacgtggacccctctgaagatacttcaagtcctcacagtcctgagtggcccccagcagacgcactgccgctgccccctacaacgcccccatcacaggagctgaccccagatgcatgtgcacagggcgtcccgtccgagcagcgtcagatgttgagagattacatggccaagctgccgccccagcgggacacacccggttgcgctactacgcctccccactctcaggccagcagtgtacgggcaacccgcagccagcagcacacccccgtgctgagttctagtcagcctctgcggaagaagcctaggatgggcttttag

SEQ ID NO: 137289 - DNA, 1353 bp, Artificial Sequence
  Description of Artificial Sequence: Synthetic coding sequence
atgagcgactttagcgaggagctgaaaggacctgtgacagatgacgaggaggtcgaaaccagtgtgctctcaggtgcagggatgcacttcccctggctccagacgtacgtggagaccgtagccattggaggaaagcgccggaaagattttgcacaaactacctccgcgtgcctgagtttcatccaggaagcgcttctcaagcaccaatggcaacaggccgctgaatacatgtacagctacttccaaaccctcgaggatagtgattcctacaaacgtcaagccgcccccgagatcatttggaagttaggcagcgaaatcctcttttatcacccaaaatcaaatatggagtctttcaacaccttcgcgaaccgtatgaaaaacataggggtcatgaattacctgaaaatcagtctgcagcacgccctttatcttctccaccacgggatgcttaaggacgctaagaggaacctcagtgaggctgaaacctggagacacggcgaaaacacttcaagtagggagattttaatcaatttaattcaggcttataagggacttctgcaatactatacctggagtgagaagaaaatggaactgagtaaactcgataaggatgactatgcctacaacgccgtggcacaggatgtcttcaaccacagttggaagacatctgcaaatataagcgccctcatcaagataccaggggtgtgggacccattcgtgaagtcgtacgtggaaatgttagagttctatggtgatcgcgatggtgcgcaggaggtactgaccaattatgcttacgatgaaaagtttccttcaaatccaaacgcgcacatctacctgtacaatttcttgaaacgacaaaaggcacctcggagtaagctgattagcgttcttaagattttataccagatcgtgccttcccataagcttatgctcgaattccacactctgctgcggaaaagcgaaaaggaagagcaccgcaagttaggcctggaggtgcttttcggcgtcctcgatttcgccgggtgcactaagaacatcacagcttggaagtacctcgcaaagtatttaaagaacatcttgatgggtaatcacttggcatgggttcaagaggaatggaacagccgcaagaattggtggcctgggttccatttctcttatttctgggccaagtcggactggaaggaggacactgctctggcgtgcgagaaggcgttcgttgctggcctgctcttgggtaagggctgtcgatatttccgctatatcctgaagcaagaccaccaaattcttggcaaaaagatcaagaggatgaaaagatccgtcaaaaaatattccattgtgaatccccgactatag

SEQ ID NO: 137290 - DNA, 1353 bp, Artificial Sequence
  Description of Artificial Sequence: Synthetic coding sequence
atgagcgacttctccgaggaactcaagggcccagtgaccgacgacgaagaggttgagacttcggtgctgtcgggtgccggcatgcattttccttggctacagacttacgtagagacagttgccattgggggcaagaggagaaaggactttgcacagactacgtccgcttgtctgtcatttatccaggaggcactgttgaagcatcaatggcagcaggcagcagaatatatgtacagctacttccagaccttagaagacagcgattcctataagaggcaagcagcccctgaaatcatctggaaattggggtctgagatccttttttatcatccaaagagtaacatggaaagcttcaatacttttgcaaataggatgaaaaacataggggtgatgaattacttaaagatctcactgcaacatgctctttacctactccatcatgggatgctcaaggatgctaagagaaacctgtctgaagctgaaacgtggcgccatggcgagaatacttcttcacgcgaaatcctcatcaacctgatacaggcttacaaaggccttctgcaatactacacttggagcgaaaaaaagatggagcttagcaaactggataaagacgactatgcctataatgccgtggcccaggacgttttcaatcactcgtggaagacctccgctaacatcagtgccctcataaagatccccggagtgtgggaccctttcgttaagagttatgtggagatgctagagttctacggcgacagagatggcgcccaggaggtgctgaccaattatgcatacgacgaaaagttcccctctaatcccaatgcccatatatacctgtacaacttcctaaagcggcaaaaagctccgcgcagcaaactcatctcggtcctcaagattttataccagatcgtcccaagtcacaagcttatgctcgagtttcacaccctcttacgcaagagcgagaaggaagaacacaggaagctgggcttggaagtcctcttcggggtgctggattttgccggatgtaccaaaaacataactgcctggaagtatctggccaagtatctgaagaacatccttatgggcaatcacctggcttgggtgcaggaggagtggaatagcagaaagaattggtggcctggtttccatttctcctacttttgggcaaaatcagactggaaggaagatacagctttggcctgtgagaaggccttcgtcgccgggcttctgttggggaagggctgtagatactttaggtacatactgaagcaggaccatcaaattttaggaaagaagattaaacgcatgaagagatccgtgaagaaatacagcatagtaaatccaagattatag

SEQ ID NO: 137291 - DNA, 1011 bp, Artificial Sequence
  Description of Artificial Sequence: Synthetic coding sequence
atggagagctttaacacatttgccaacaggatgaaaaacatcggggtgatgaactatctgaaaatatccctccaacatgccctgtacttgctgcaccacggaatgcttaaggatgcgaagagaaatttgtccgaggcagagacatggcgacacggcgaaaacacatcttccagagagatcctcataaacctgattcaggcttataaaggactgctccaatactatacatggagcgagaagaagatggagctctccaagcttgacaaggacgattacgcttataatgccgtcgcacaggacgtgttcaatcattcatggaaaacatcagccaacatctccgccctgatcaagattcctggcgtctgggacccatttgtgaagtcatacgtggaaatgcttgagttttatggggacagagatggagctcaagaggttctgacgaactacgcgtacgatgagaaattcccatcaaacccaaacgctcacatttacttgtataactttctgaaaaggcagaaggctccccgctccaagctgatcagtgtactgaaaattctgtaccagatcgtgccctcccataagctgatgctagaattccacaccttactgcggaagagtgagaaagaagaacacagaaaattgggactggaggttttatttggtgtattggatttcgccggatgcaccaagaacattactgcatggaagtacctggctaagtatcttaagaatattctgatgggcaatcatctcgcctgggtgcaggaggaatggaacagccgaaagaactggtggcccggattccatttctcgtacttctgggctaagagcgactggaaagaagacaccgcactggcctgtgagaaggcatttgtcgccggtcttctcctgggcaaagggtgtcgatacttccgatacatactgaagcaggatcatcagatccttgggaagaagattaaaaggatgaaacgcagcgtgaaaaaatattccatagtcaacccacggttgtag

SEQ ID NO: 137292 - DNA, 1011 bp, Artificial Sequence
  Description of Artificial Sequence: Synthetic coding sequence
atggaaagcttcaatacgttcgcgaaccgaatgaaaaatattggcgtaatgaactatctgaagatctctctgcagcatgcactatacctactgcaccacggaatgctcaaggacgctaagaggaacctctctgaggcggagacctggagacacggggagaatacctcttcccgggagatcctgatcaatctgatccaggcttacaaaggactacttcagtactatacttggtccgagaagaaaatggagctcagtaagctcgataaagatgactatgcctacaatgccgttgcccaagacgtgttcaaccactcctggaagacctcagcaaacatatccgctctgataaagatccctggggtctgggatccttttgtgaagagttacgttgagatgctcgaattctatggtgaccgcgatggcgcccaggaagttctgactaattacgcctatgatgaaaagttccccagtaacccaaacgctcatatatacctttataacttcctcaagagacagaaagctccccggtcaaagctgatctccgtgctgaaaatcctctatcaaattgtccccagccataagctgatgcttgagtttcacactcttctgcgcaaaagcgaaaaggaggagcaccgcaagctgggactggaagtgctgtttggagtgctcgacttcgccgggtgtactaaaaatatcactgcgtggaagtatctcgcaaaatacttgaaaaatattctgatgggtaaccacctggcctgggtccaagaggagtggaactctcgcaaaaattggtggccggggtttcacttctcctacttttgggctaaaagcgattggaaggaggataccgccctagcgtgtgagaaggccttcgttgctggactgcttttgggtaagggctgcagatatttccggtacattcttaaacaggaccatcagattctgggaaagaaaatcaagcggatgaaaagatctgtcaaaaagtattccatcgtaaacccgagactttag

SEQ ID NO: 137293 - DNA, 861 bp, Artificial Sequence
  Description of Artificial Sequence: Synthetic coding sequence
atgagcgacttttctgaggagctcaagggacctgtcaccgatgacgaggaagtagagacatccgtgctatcaggggctggaatgcacttcccctggctgcagacctacgttgagacagtggcaatcggtgggaagcgcaggaaggatttcgcacaaacaacttccgcctgcctgtccttcatccaggaagccctcctgaaacatcagtggcagcaagctgcggaatacatgtattcctacttccagacacttgaggactctgattcctacaagaggcaagccgcgccagagattagtcttcagcacgcactttatcttctgcatcacggcatgctgaaagacgccaaacgaaatctgtccgaagccgagacttggagacatggcgaaaacactagttcacgggagatactcatcaatctgatccaggcgtataagggacttttacagtactacacctggtcagagaagaaaatggagttatcaaagctggacaaggacgattacgcctataatgccgtggcacaggacgtattcaaccacagttggaagacaagcgctaacataagcgcgttgatcaaaatcccgggagtttgggatccatttgtgaaatcctacgtggaaatgttggagttttatggggatagggatggcgctcaggaagtgctgaccaattatgcttatgacgagaagttcccaagtaatccaaatgcacatatctatctctacaatttcctgaaacgccagaaggctcctcgatctaaactgatcagtgtcttgaagatcctgtatcagatcgttccatcccataagctgatgctagagtttcatacactcctgcggaagtcggagaaggaagaatag

SEQ ID NO: 137294 - DNA, 849 bp, Artificial Sequence
  Description of Artificial Sequence: Synthetic coding sequence
atgtcagactttagtgaggaactgaaaggtccagttaccgatgacgaggaagtggagacatctgtcctctctggggctggcatgcattttccctggctccagacttatgttgaaactgtggctattggtggaaaacgccgcaaggattttgctcaaacaacatccgcatgccttagttttatccaggaggcgcttctcaaacatcagtggcaacaggccgcagaatatatgtacagctacttccagacgctcgaggatagcgactcgtataagaggcaggcagctccagaaatttccttgcagcacgctttatacttattgcatcacggcatgctcaaggacgctaagcggaacttgtcagaggctgagacttggcgccacggggaaaatacatcatccagggaaatcctcataaaccttatccaggcttacaagggtcttttgcaatattatacatggtcggagaagaagatggaactctcaaagctcgataaggacgattatgcgtataacgccgtggcacaagacgtgttcaaccactcgtggaagacaagtgctaatatatcggctctgatcaaaatccccggtgtctgggacccatttgtaaaatcatatgtcgagatgttagagttctatggtgatcgagacggagctcaggaggttctgaccaactacgcctacgatgaaaaattcccctctaatccgaatgcacacatctacctctacaatttcctgaagaggcaaaaggcccccaggagtaagctcatatcggtgttaaaaattctgtatcagattgtgccaagccataaattgatgctggaattccatacactattacgcaaatcatag

SEQ ID NO: 137295 - DNA, 936 bp, Artificial Sequence
  Description of Artificial Sequence: Synthetic coding sequence
atgtccgatttcagtgaggagttaaaaggaccagtgaccgatgatgaggaggtggagacctcagtgctcagtggggccgggatgcatttcccttggctgcaaacctacgtggaaaccgtcgcaatcggcgggaaacgacggaaagattttgcccaaactacctctgcctgtctttcattcatccaagaggctcttcttaaacatcagtggcagcaagcagcagagtacatgtatagttatttccagaccctggaagatagcgactcgtataaacgtcaggccgctcccgaaattatttggaagctgggtagtgagattctcttttaccatcccaagtccaacatggaatctttcaacacgtttgcaaacaggatgaagaacattggggtgatgaactacctcaaaatcagtcttcagcatgctctgtaccttctgcaccatgggatgctgaaagatgcgaaacgtaatcttagcgaggccgaaacctggcgacatggcgaaaacacctcttcaagagaaatactgatcaatctgatacaggcctacaaaggactgctgcaatactatacttggtcggaaaagaaaatggagttaagcaagttagataaagatgactacgcatataacgcggtggcacaggacgtctttaaccacagctggaaaacgagcgcaaacattagtgcgctcatcaagatccccggcgtgtgggacccctttgtcaagagctatgttgagatgctggagttttacggagatagggacggcgcccaggaggtgttaaccaactacgcatatgatgagaagtttccttccaacccgaacgcacacatatacctgtacaacttcttaaaaagacagaaagctccaaggtcaaagctgatctccgttctgaagcacctgcagaagatctcaatcatgtattctacgcttaggtag

SEQ ID NO: 137296 - DNA, 2328 bp, Artificial Sequence
  Description of Artificial Sequence: Synthetic coding sequence
atgctccctcccctgattgacccatgggacccaggtctgactgcgcgggacttgctgtttaggggtggctgccggtataggaagcgtcctcgcgtggtgctggacgtgaccgagcagatatcccgatttttattagaccacggtgacgtagccttcgcgcccttaggaaaattgatgttggaaaatttcaaactcgaaggggccggaagtcgtacaaaaaaaaaaacagtggtcagtgtgaagaagcttcttcaagatctcggcggacatcagccttggggatgcccctgggcctatctttctaaccggcagcgccgtttctcaattctgggcggacccattctcgggacgtctgtcgcaagccatttggctgagctgttgcacgaagagctggtgctcagatgggagcagctcttgctagatgaggcctgtaccggcggagcgctggcctgggtgccggggagaacaccccagtttggacagctggtctatccagcagggggcgcacaagaccgtctgcactttcaagaggtagttctgacccccggagacaatccccaatttctaggcaaaccagggcgcattcagctccaaggccctgtgcgccaagttgttacttgcaccgtgcagggcgagacgctactggcggttcggtcagactaccactgtgcggtgtggaaattcgggaaacagtggcagcccaccttactccaagcgatgcaggtggagaagggggccactggtattagtttgtcaccacacctgccaggagaacttgctatctgttcccgaagcggcgccgtgtgcctctggtctccggaggatggactccgacagatctatagagatcccgaaactttggtgttccgggattcctctagttggcggtgggcagattttacagcccatccccgcgtgctgacagtgggggataggacaggtgtgaaaatgctggacactcaagggccacctggctgtggcctgcttttgtttagactaggagctgaggcatcctgtcaaaagggtgagagggtgctactcacccagtatctcggccacagcagccccaagtgtttgccacctacgctgcaccttgtgtgcacacagttctcactgtatctggtggacgagagattacccctcgtgcccatgctgaagtggaatcatggattaccatcacccctcctcctggcccggctgcttcccccaccacggccatcctgtgttcagcctttgttgctggggggacaggggggccaactccagcttctgcatctggccgagggggcttctgtgccgcggcttgccgggccaccgcaaagtctcccgtcccggatcgactcactgcctgcttttccactgctggaacctaagatccagtggagactccaagagcgtttgaaagccccaacgatcggattagccgccgtggtgcctcccctgcccagcgcccctacacccggactagtcctcttccagctgtcagccgccggcgacgttttctaccagcagcttcgcccgcaggtcgacagctcactgaggcgtgacgcaggtcctccaggcgacacacaacccgactgccacgccccaacggcttcttggacttctcaggacacagccggctgctcacagtggctgaaggcgctgctaaaggtgccactggcacccccagtttggacggctcccacttttacacataggcaaatgttggggtccaccgagctgcggagggaggaggaagagggccagcgcttaggggtgcttcggaaggcgatggcgagaggccagcttctcctgcagagagatctgggttcattgccagctgcagagccacctcctgccccagagtccggtctggaagacaagctgagcgaaaggctcggggaagcatgggcgggcaggggggctgcatggtgggaacgccaacaggggcgaacaagcgagccaggccgacaaactagaaggccaaaacggcgtacccagctctctagcagcttttccctgagcggacatgtcgacccgagcgaggacacgagcagcccccacagcccagagtggcccccggccgacgcccttccccttccacctaccacgcctccctctcaggagcttacaccagatgcctgtgcacaaggagtgccttcagaacaaaggcagatgctgcgggactatatggctaaactccctcctcaacgcgacacaccagggtgcgccacaacacccccacattcccaagcctccagcgtgagagctacccggtcccagcagcatacgcctgttttaagtagcagtcagccacttaggaagaagccgcgtatgggcttctag

SEQ ID NO: 137297 - DNA, 2610 bp, Artificial Sequence
  Description of Artificial Sequence: Synthetic coding sequence
atggactttccctcctctcttcgaccagctctgtttttgaccggacccctgggcctatcggacgttcccgacttgtcattcatgtgctcctggcgcgatgccctcacccttccagaggcccagccccagaattcagagaacggcgccttgcatgtaacaaaggaccttctgtgggagcccgccacgcctggaccacttccgatgttaccgcccctgattgacccgtgggatcctgggctgactgcccgcgaccttctttttaggggcggatgccgctatcgtaaacggccgcgtgtcgttctcgacgtcacagagcagataagcaggttccttcttgaccacggtgacgtggcgttcgcccccctgggaaaattgatgctagagaatttcaaactcgagggtgccggatcaagaacgaagaaaaagaccgttgtgtccgtgaagaaacttttacaggacctgggagggcaccagccatggggatgcccgtgggcatacctctccaataggcagcgccggttcagtattctggggggtcctatcctggggacttcggtggcctcccatcttgcagagctgctccacgaagagctggtgcttagatgggagcaattactgctcgacgaagcgtgcaccggtggggctctggcatgggtccctggacggacgccacaattcggccagttggtttatccggccggtggagcccaggatagactccacttccaggaagttgtgttaacacccggggacaatccccagtttttgggaaaacccggccggattcagttgcagggcccagtaaggcaggtcgtcacttgtacagtgcagggggaatctaaggcactgatctatacctttctgccccattggctgacatgttacctcacgccaggtccatttcatccgtccagcgccctgctcgctgtccgcagcgactaccactgtgcggtttggaagttcggcaaacagtggcaaccaacactgctgcaggctatgcaggtggagaaaggagctactggtatctccctgtcacctcatctgcctggtgaactggcaatctgttcaaggtctggggccgtgtgcctttggagcccggaggatggattgaggcaaatctatcgagacccggagacattagtgtttagggacagttcttcttggcggtgggctgatttcacagctcatcctagggttttgaccgtgggagacaggacgggcgtaaagatgctggacacccagggtcccccaggatgcggattgctgctgttcaggcttggtgccgaggcgtcttgccagaaaggggaacgagtcctgctgactcagtacttggggcatagcagtcctaagtgtctgccccccactctgcacttagtctgtacacagttctcgctatatttagtcgatgaacgtctcccacttgtgcctatgctgaaatggaaccatggcctgccctctccactcctcctggcgcgtctgttaccccccccccgtccttcctgtgtgcagcccttactgctgggggggcagggaggtcagcttcagttgctgcacctggcaggggagggagccagtgttcctaggctggccggcccgccgcaaagcctccctagcagaattgattccttacccgccttcccgctgctggagcccaagatccagtggcgccttcaggaaaggctgaaggcgcctaccatcggacttgctgccgtcgttcctccactgcctagtgcaccgacccccggtttggtgctgttccagctgagcgctgctggcgacgtgttttatcaacagctgagacctcaggttgattctagcctccgccgagacgccggaccgcctggggacactcagcctgattgtcacgcccctacagcaagctggaccagccaggacaccgccggctgtagccagtggctgaaggccctgcttaaagttcctctcgctccacccgtatggacggcccccaccttcacccacaggcagatgctgggaagcacagaactccgcagggaggaggaggagggacaacggttaggcgtgctgcgtaaggcgatggcaagaggccagttgttactgcagagagatcttggtagcctaccagccgccgaaccgccccccgcaccagagtctggactcgaggacaaactgtccgagcgtcttggagaagcctgggccggcagaggagcagcctggtgggaaaggcaacaaggccgcactagcgaacccggccgtcagactcgcaggcccaagcggcggacccagctgtcaagctccttctcactctctggccacgtggatccctctgaggacacatcgtcgccccactccccagaatggcctccagctgacgcattacccctgcccccgactacaccgccgagtcaggaactgactcctgatgcctgtgcccagggggtgcctagcgaacaacgacaaatgctgagagactacatggctaagttgcctcctcagcgcgacaccccgggctgcgctactaccccgccacacagccaggcctccagcgttcgcgcaacaagatcccagcaacacacaccagtgctatcatctagccagccactgaggaaaaaacccagaatgggtttctag

SEQ ID NO: 137298 - DNA, 1047 bp, Artificial Sequence
  Description of Artificial Sequence: Synthetic coding sequence
atggactttccaagctctctcagacccgccctgtttttaactgggccacttggtctgtcagacgtgcctgacttaagcttcatgtgttcttggagagacgccttgacgctcccagaagcacagccacaaaattccgaaaatggtgctttgcacgtcaccaaagatctcctctgggaacccgctactccgggaccacttccaatgttaccacccctcatcgatccttgggaccccggcctcaccgcacgtgatttgctctttagaggagggtgcaggtataggaaacgccctagggtagtgctcgacgtgaccgagcagatctctcgcttcctgctcgaccacggtgatgtagcatttgcaccactggggaagctcatgcttgaaaactttaagctcgaaggtgctggatcacggactaagaagaagacagtagttagcgtgaagaagttgcttcaagacctggggggccaccagccatggggatgtccctgggcgtatctatccaatagacagcgaaggttctcgatcctgggtggtcctattctggggacttccgtagcatctcatctggcggagctcttgcatgaggagttagtgcttcggtgggagcaactgctattagatgaagcttgcaccggtggggctctggcttgggttcccggacgtactccgcagtttggccagttggtgtacccggccggtggggctcaggatcggctccatttccaggaagtggttctcactccaggagataatccacagtttctgggcaagccaggacgcatccagctgcagggccctgtgaggcaggtggtgacatgcaccgtacagggtgaaacactcctcgccgtgcgttcagattatcattgtgcagtgtggaaatttggtaaacagtggcagccaacactgctccaagccatgcaggtggaaaagggagctaccggaatatccttgagtccgcacctgccaggggaattagccatatgtagccgtagcggggctgtatgtctatggtctcctgaggacggctaccggaggttcctgtag

SEQ ID NO: 137299 - DNA, 2331 bp, Artificial Sequence
  Description of Artificial Sequence: Synthetic coding sequence
atgttaccccccctcattgatccgtgggaccccggtcttaccgccagggacctcctattccggggaggatgccgatatagaaagcggcctagggtagtgctggatgtaaccgaacagatttctcgcttcttgctggatcacggtgacgtggcttttgcaccactgggcaaacttatgcttgagaatttcaagctggagggggctgggtcgcgaaccaagaagaagacagtagtgtctgttaaaaaattactccaggatctcggaggacaccaaccctggggctgtccgtgggcttatctgagcaatcggcagaggcggttctccatcctcgggggaccaatcctgggaacaagtgtggcatctcacctagcagagctcttgcatgaggagctggtgcttagatgggaacagcttctattagatgaggcgtgtacagggggtgcccttgcatgggtgccaggccgaacccctcagttcggacagttagtctatccagccgggggggctcaggatagactccatttccaagaagtcgtcctcacgccaggagacaatccacagtttctgggcaagccgggaaggattcagctgcagggacctgtaaggcaggtcgtgacctgtactgtccagggggagacgctgctcgcagtgcggtccgattaccattgtgccgtctggaaatttgggaagcagtggcagcctacattattgcaggcgatgcaggtggaaaaaggcgccaccggaatatccctatccccccacctgccgggtgaactggctatctgctcccgatccggtgcagtgtgcctatggagtccggaagatggactgcgccagatctatagagaccccgaaacgctggtgttccgggactcaagttcatggcggtgggcggacttcacagcccacccgagggtgctcactgttggcgatcggaccggtgtgaagatgctcgacacccagggaccgccggggtgcggcctccttctgttccggttaggggccgaagcttcctgccaaaagggggagagagtcctgctgacgcagtatctgggccactctagccctaagtgtctgccccccacattgcatcttgtgtgtacccagttctctctgtatctagtagatgaacgcctgcctctggtgcccatgcttaaatggaaccatgggctgccatccccccttttgctggccaggttgttgcccccacctcgcccatcatgcgtgcaaccactgttgctgggagggcagggcggtcaactgcagctgttgcatctcgctggcgagggggctagtgtacctagactggccggtccaccacagtcactgccctcccggatcgacagtttgccagcttttcctctgctcgagccaaagatccaatggaggcttcaggagcgcctgaaggcccccacaatcggcctggctgcagtggttccccctcttccttcagcccccacgcctggcctggttctattccagctgtccgccgcaggagacgttttttaccaacagctgcgccctcaagtcgattccagtctcaggcgcgacgcaggtcccccaggagacacccaacccgattgccatgctccaaccgccagttggacgagtcaggacaccgctggatgttcccagtggctgaaagcactcctgaaggttccacttgctcccccagtgtggactgcccccacattcacacatcggcagatgctgggttcaaccgagctgcgccgggaagaggaggagggccaaaggctgggagttctgagaaaagcaatggctaggggacagctcctcctgcaacgcgacctgggttcactacccgcagcggaaccccctccagccccagagagcggactggaagacaaactcagtgagaggctcggtgaagcctgggccggtagaggggcggcatggtgggagcgccagcagggacgcaccagcgagccgggtaggcaaacgaggcggccaaagcgcagaacgcagctgagcagcagtttttccctgtctggccatgttgacccttcggaggacacaagctcaccccacagccccgaatggccacctgcggacgccctccccctaccgcccacgaccccgcctagccaggagcttactccagatgcctgtgcccagggggtgcccagcgagcagagacagatgctccgcgactatatggcgaagctgcctccccaaagggacacgcccggatgcgcgaccactcctccacacagccaagcctctagcgtgagagccacacggtcacaacaacatactcccgttctgtcgtcatctcagcctctgcggaaaaaaccgaggatgggcttctag

SEQ ID NO: 137300 - DNA, 1179 bp, Artificial Sequence
  Description of Artificial Sequence: Synthetic coding sequence
atgctgaagtggaaccacggcctaccgagcccactcctcttagctagactcctgccgccgccaaggccctcttgtgttcagccgcttctcctgggagggcaaggcggacagctgcagctcctacatctggctgagggcgctagcgttccgcgattagcagggccaccacagagcctgccaagcagaatcgactcgcttcccgccttccccctgcttgaaccaaagatccagtggcggttgcaagagcgcttgaaggcaccaacgatcggcctggctgcagtggtgcccccattgccctctgcccccactccaggccttgtactctttcagttatcagcagcaggagatgtgttttaccagcaattgcggccccaggtcgacagtagtctgcggagagacgccggacctcccggggacacacaacccgactgccacgcgccaaccgcgtcctggacgagtcaggacactgcaggatgctctcagtggttgaaggccctgctcaaagttcccctggctcccccggtctggaccgcccccaccttcacccacagacagatgctgggctctaccgagctcagacgggaagaggaagaggggcagcgactcggtgtgctacgcaaagcaatggcccgagggcaacttcttctccagagggatttggggagcttacccgcagcggaacctccgcctgccccggaatccggcctggaagataagttgagcgagagattaggcgaggcatgggcaggcaggggagctgcgtggtgggaacgccagcagggacggacctccgagcccggacgccaaacgagaagacctaagcgcaggacccagttgagcagtagtttttctcttagtggacatgtagacccttctgaagacacttcctctccccatagtcccgagtggccccctgctgacgcgctgcccctgccacccactacccccccgagccaggaattgacccccgacgcttgtgctcagggggtaccatcagagcaacggcagatgctgcgggactacatggcaaaattgccaccacagcgcgacaccccaggttgcgccactacaccgcctcatagccaggcctcttccgtcagggccactcggtctcaacagcacacccctgttctgtcatccagccagccccttaggaagaagccgcgaatgggattctag

SEQ ID NO: 137301 - DNA, 837 bp, Artificial Sequence
  Description of Artificial Sequence: Synthetic coding sequence
atggacaaatcagggatcgactcgttggaccatgtgaccagcgacgcagtggagttagccaataggtccgacaacagcagtgactcctcgctgtttaagacacaatgcattccttactcgcctaaaggagagaagcgcaatcctattcgcaagttcgtacggacccccgagagcgttcatgccagtgattcttcatctgactcctcattcgaaccaatcccgttgactatcaaggccatcttcgagaggttcaaaaaccggaagaaacgctacaagaaaaagaagaagcgaaggtatcaacccaccggccgccccaggggacgccctgagggtagacggaatcctatctattctctgatcgataagaagaaacagtttagatcccgcggcagcggattcccatttctggaatccgaaaacgagaaaaacgccccttggcgcaagattttgacttttgaacaagcagtggcgcgtggattcttcaattacattgaaaagctaaagtacgagcatcatctgaaggagtcattgaagcagatgaatgttggcgaggacctggaaaacgaggatttcgatagccgcaggtataaatttttggacgacgacgggagcatctcccctatcgaggaatcgactgctgaggatgaggacgcaacacacctggaagacaacgaatgcgacataaaattggctggagattcctttattgtttctagtgagttcccagtgcgactctccgtttacctggaagaagaagatataactgaggaggccgccttgagcaaaaaacgggcaactaaggctaagaacacgggtcagcggggcctgaaaatgtag

SEQ ID NO: 137302 - DNA, 837 bp, Artificial Sequence
  Description of Artificial Sequence: Synthetic coding sequence
atggacaaatcgggcatcgacagccttgaccacgtcacctctgacgccgtagagcttgctaaccgcagtgacaactcctcggatagttccctcttcaaaacccagtgtatcccatatagtcctaaaggggagaagagaaatcctatacggaagttcgtaagaaccccagagagtgttcacgcatccgacagtagttccgactcaagcttcgagccaattcctctcactatcaaagctattttcgaaaggtttaaaaataggaaaaaaagatataagaagaagaaaaagcgccgctatcaacccacggggcgaccacgcgggcggcctgagggccggcgcaacccgatttactccctgattgacaagaagaaacagtttaggtcccgtgggagtggcttccctttcctggagagcgagaacgagaagaacgctccctggagaaagatcctgacgtttgaacaggccgtggccaggggtttctttaattacatcgaaaagctaaagtatgagcaccatctgaaagagagcctgaagcagatgaatgtaggtgaggatcttgaaaacgaagactttgattctaggcgttataaatttctcgacgacgacgggtccatttctcctatcgaggagtcaacagctgaagacgaagacgccacgcatctagaggacaatgagtgtgatataaaacttgccggggattcatttatagtgtcgtccgagtttccagtccggctgtcggtctacctggaagaggaagatatcaccgaggaggctgcattaagtaagaaaagagcgacgaaggcaaaaaacaccggccagcgcggtctgaagatgtag

SEQ ID NO: 137303 - DNA, 837 bp, Artificial Sequence
  Description of Artificial Sequence: Synthetic coding sequence
atggacaaaagcggaatagattccctggatcatgtgacctctgacgccgttgagttggcaaaccgctcagacaattcctccgattctagcctcttcaagactcagtgcattccttattccccaaaaggtgaaaagagaaatccaatccggaagttcgtgcgaactccagagagcgttcatgcctctgactcctcatcagacagctcgttcgagcccatcccactcacaattaaggcgattttcgaacggttcaaaaaccgcaaaaagcggtataaaaagaagaaaaaaaggcggtaccagcctacagggcggccacgagggcggcctgagggtcggcgtaatcccatttattcattaattgataagaagaagcagtttagatcccggggctctggcttccccttcttggaatccgagaatgaaaagaacgccccatggcgcaaaatcctcacattcgagcaggccgtcgctcgcggattctttaattacatagagaagctcaagtacgagcatcacttaaaagaaagcctcaaacagatgaatgtgggggaggatttggaaaatgaggatttcgactccaggcgctacaaattcctcgatgatgatggatccattagtcccatcgaggagtctaccgccgaggatgaggacgccacacatttagaggataacgaatgtgatatcaagctcgcgggcgattcctttatagtatcaagtgagttccccgtcaggttgagcgtgtacctcgaggaagaagacatcactgaagaagccgcgctctcaaaaaagagagcaacgaaggccaaaaatactggacagcggggcctcaagatgtag

SEQ ID NO: 137304 - DNA, 27 bp, Artificial Sequence
  Description of Artificial Sequence: Synthetic coding sequence
atggacaagtctggcatcgacagttag

SEQ ID NO: 137305 - DNA, 3030 bp, Artificial Sequence
  Description of Artificial Sequence: Synthetic coding sequence
atgtcatggtttaacgcctctcaactgagctccttcgccaaacaggctctgagtcaggctcagaagagcatagaccgcgttttggacatccaggaggaagaaccttctatctgggcggagaccatcccctacggagaaccgggaatttcatccccggtgagtgggggatgggacacgtcaacttggggtttaaaatcaaatactgagccgcagtctccccctattgcctctccgaaggctattaccaagcctgtgcgccgaacagttgtagacgagagcgaaaatttcttttctgcctttctgtctccaacagtgtccctgaaggtcagcgaatccgtcattgacgtgaagactactatggaatcaattagcaataccagcacccaaagccttactgcagagactaaggatatcgcactggagccaaaggaacagaaacacgaggacaggcaaagcaacacgcccagcccgcccgtgagcacattctctagtggaacttcaacaacatcagacatcgaggtgctggaccatgagagtgtgatctctgagtccagcgctagcagtcgacaggaaactactgatagcaaatctagcttacatctgatgcagacatcatttcagttgttgagcgctagcgcctgccccgagtataataggttggacgacttccaaaaactcaccgaatcttgctgtagcagcgatgccttcgaacggattgacagcttcagcgtgcaatccctggattcgagaagcgtgtcagaaattaactcagacgacgagctgtctggaaaggggtacgccctggtgccaattatcgttaatagctctacgcccaagagcaagactgtggaatccgctgagggcaagtccgaagaagtgaacgagactctggtcatacctaccgaggaagctgaaatggaggaatccgggcggtccgctactcctgtgaactgcgaacagccagacattctagtgagctcgacaccaattaatgagggtcaaacggtgcttgataaggtggctgagcaatgtgaacctgccgaatcacagccggaggcgctgtcagagaaggaagatgtctgcaaggtgactcttaccgtcgaattcttaaacgaaaagctagaaaaaagagaggcccagctgcttagcctatctaaagagaaagcccttctggaagaggcatttgacaacctcaaggatgaaatgttcagggtgaaagaagaaagttcctccatctcatcccttaaagatgagtttacacagaggattgcagaggccgagaaaaaagtacagctggcctgcaaggaacgcgacgccgcgaagaaggaaattaagaacatcaaagaggagcttgccacaagattgaacagttccgagactgccgatctgctgaaggagaaggacgaacagatcagggggctcatggaggagggcgagaagttgagcaaacagcagctgcacaactctaacatcattaaaaagctgagagcaaaggacaaggaaaacgagaacatggtggctaagcttaataagaaggtgaaggagctggaagaggaactgcaacatctgaaacaagtcctagacggaaaggaagaagtcgaaaagcagcacagggagaatataaaaaaactgaacagcatggttgagagacaggagaaagacctgggtcgacttcaggtcgatatggatgagctggaggagaaaaacagatccatccaggcagcgcttgacagcgcctacaaggaacttaccgacctgcacaaggctaatgctgcgaaggatagcgaagctcaggaagccgctctttccagagagatgaaggcgaaagaagaactttctgcagcacttgagaaggcccaagaggaagccaggcagcagcaggaaactttggctatccaggtgggagacttgaggctggcattacagcggactgagcaagctgccgcccgcaaggaagactacctgcgacatgaaatcggagagttgcagcaacggctccaggaggctgagaatcggaaccaggaattgtcacagtccgtgtcctcaaccaccaggccactgttacgccagatcgaaaacttacaagcaactttggggtctcagacaagtagttgggaaaaactggaaaaaaatctctccgaccggttgggcgagagccagaccctgctggccgccgcagtggagcgggaaagggccgctaccgaggagctgctcgctaacaaaatccagatgtcctccatggaatcacagaatagcctgttgaggcaagagaatagccgtttccaagcccagctcgagtctgaaaagaacaggctgtgtaagcttgaagacgaaaataatcgttaccaggtggaattggagaatctgaaggacgagtatgtgagaacactagaggagacacggaaggagaagactctgctgaattctcagcttgaaatggagcgaatgaaggtcgagcaggagaggaagaaagccatattcacccaggaaacgattaaggaaaaggagagaaaacccttcagcgtctccagtacgccaactatgagcagatcctcatccatatctggtgtggacatggcgggtcttcaaacctcctttctctcccaagacgaatcacacgatcactcattcggaccaatgcctatttctgctaacgggtccaatctgtacgatgcagtgcgaatgggtgcgggaagttccataattgaaaacctgcagagccagttaaagctgcgggagggggaaataacccacttgcagctcgagataggaaatctggagaagactcggtctatcatggccgaggagctcgttaaactgactaatcaaaacgacgagcttgaagagaaggtgaaagaaattccaaaactacggacacagctgagggaccttgatcaaaggtacaacactatcctgcagatgtacggcgagaaagccgaggaggccgaggaactgcgtctggacttggaggatgtaaagaatatgtataagacgcagatcgacgaactcttgcgacagagcctctcctag

SEQ ID NO: 137306 - DNA, 3282 bp, Artificial Sequence
  Description of Artificial Sequence: Synthetic coding sequence
atgtcatggtttaacgctagccaactgtcttctttcgccaagcaggcgctgtctcaggcgcagaagtcaatcgaccgcgttttagacatccaagaagaagagccctccatatgggccgagactataccctatggcgaacctggcatttcatcccccgtttctgggggctgggacacgtccacctggggccttaagagcaatacagaaccacagagcccacctatcgcatcacctaaagcaatcaccaaaccggtgaggcgaactgttgtcgatgagtctgaaaattttttctccgcattcttgtcgcccactgatgtccagacaatccaaaagtcccctgtcgtttccaaaccccctgcgaaaagtcagcggcctgaagaggaggtaaaatcatccttacacgagagcttgcatattgggcagagccggacacccgaaaccaccgagtctcaagtgaaggatagcagtctgtgtgtcagcggcgagaccttggccgccggaactagctctccaaagacagaaggaaagcatgaggagacagtgaataaagagtctgacatgaaggttccaacagtgagccttaaagtttcagaaagtgtgatcgatgtgaaaaccaccatggagagcatttctaatacctccacgcagagccttacagctgagactaaagacatagccctggagcctaaagagcagaaacatgaagatcggcagtcaaacacaccctcacctcctgtgtctaccttcagttccggtacgtctacaacgtcagatattgaagttctggatcacgagtccgtgatctccgaaagtagtgcaagctccagacaggagacgactgatagtaagtcctccttgcatctgatgcagacatcctttcagctgctgtcggcctccgcttgtcctgaatacaacagactggatgactttcagaagctaacagaatcatgctgtagcagcgacgcattcgagagaatcgattcctttagcgtgcaatctctggacagcaggtctgtgtcggaaattaactcagacgatgaactctcaggaaaaggttacgcgctagtgccaattatcgtaaattcctcaacgccaaaaagcaaaaccgtggaaagcgctgaaggcaaaagcgaagaggtgaacgaaacactggttatccccacagaagaggcggagatggaagaaagtggtaggtccgctactccagttaactgtgaacagcctgatatcctggtgagctctactcccattaatgagggccagaccgtcctggataaggtagccgagcagtgcgagcccgcagagagccagccagaggcgttgtctgaaaaggaagatgtgtgcaagaccgtggaatttctcaacgagaagttagaaaaaagagaggcccagttgctctctctatccaaagaaaaagcactgcttgaagaggccttcgacaatctgaaagacgagatgtttcgagtaaaagaggagagttcctccatctccagtctgaaggatgaattcacccagcgcatcgcagaggcagagaagaaggtccagctggcatgtaaggaaagagacgccgccaaaaaagaaatcaagaacattaaagaggagctcgcaaccaggctcaatagcagcgaaacagctgacctcctgaaggaaaaggatgaacaaatcagggggctgatggaggaaggcgaaaagttgtccaagcaacaattacacaactccaacattataaaaaaactgcgggcaaaagacaaggagaacgagaacatggttgcaaagctgaacaaaaaggtgaaagaattagaagaagagctgcagcacctcaagcaagtcctggatggaaaggaagaggtcgaaaagcagcacagagaaaacatcaagaagttgaactcaatggttgaacgccaggaaaaggacctggggaggctgcaggtcgatatggatgagctggaggagaagaaccgttccatccaggccgcgctggactccgcctacaaagaactcaccgatctccacaaggccaacgctgccaaggatagcgaagcccaggaagcagctctgagtcgggaaatgaaggcgaaggaagagctgtctgccgccctggagaaggcccaggaagaggctaggcagcagcaggagactctggcaatccaggttggggatctgcggttggccctccagagaactgagcaggctgccgccaggaaggaggattatctccgtcatgagataggggagctccaacagagactgcaggaggctgaaaataggaatcaagaactgagccagtctgtgagtagcactaccaggcccttactccggcagatcgaaaacttacaggccacactcggttcccagacatcgtcatgggagaaacttgagaaaaatctttccgatcggctaggagaatcacagactttgcttgcagcagcagtggagcgagaaagagctgcgacagaggaactgctcgccaataaaattcagatgagctctatggaatcgcagaactctctactacgtcaagagaattcacgcttccaagctcagcttgaatccgaaaagaataggctttgcaaattggaagacgagaataataggtaccaggtggaattggagaacctgaaagatgaatatgtccggactctcgaggagacgcggaaggagaagacactattgaacagccagttggagatggagcgcatgaaagttgaacaagagcggaagaaagccatttttacccaggagacgataaaagaaaaggagaggaagccattctctgtaagtagcacacccactatgtccagaagctcttctatatctggggtggatatggccggcctccagacaagtttcctgagccaggacgagagccacgaccacagttttggcccaatgcctatttctgccaacggatccaatttatacgatgctgtgaggatgggtgcgggaagttcaatcattgagaatcttcagagtcaactgaagctcagagaaggggagataacccaccttcagctcgagattggcaatctcgaaaagactaggtcgattatggccgaagagctggtgaagctcacaaatcagaatgatgaactggaagaaaaagtgaaagagattccaaaattgcggacgcaactcagggacctggatcagcgttataatacgattttacaaatgtatggggaaaaagctgaagaagccgaggaactgagactggatctggaggacgtgaagaacatgtataaaacccagatcgacgagcttctacgacagtccctgtcttag

SEQ ID NO: 137307 - DNA, 1602 bp, Artificial Sequence
  Description of Artificial Sequence: Synthetic coding sequence
atgtcttggtttaatgcatctcaactctcaagtttcgccaagcaggcgctttctcaagctcaaaagtccattgatagggtgctcgacattcaagaagaagagccatctatctgggccgaaaccataccctatggggaaccaggaatcagctcccctgttagtgggggatgggataccagcacctgggggctgaagagcaacacagagcctcagtctccaccaatcgcatccccgaaggcgatcaccaagccggtgaggcggaccgtcgtcgatgagagtgaaaacttcttttcggcttttcttagtcccaccgacgttcaaacgatccagaaaagtccagtggtgtctaagcctcccgccaaatcccagcgtccggaagaagaggtcaagagctccctccatgagagtctgcatatcggacagagcaggacacccgagaccacagagagtcaagtgaaagactctagcctgtgtgtctccggggagaccttagccgctggaaccagcagtcctaagaccgaagggaaacacgaagaaaccgtgaataaggaaagcgacatgaaggtgcccaccgtctccctaaaggtttccgagtccgttatcgacgtgaagactactatggagtccatttctaacacgtcaacacagagtctaactgcagagaccaaggatattgccctggagcctaaggagcagaagcacgaggaccggcagagtaatactccaagtccacctgtaagtaccttctctagcggcacgagtaccacctctgatatcgaggtgctggaccacgaatccgttatctcagagagtagcgcctctagcaggcaagagacaacggacagcaagtctagtctccacctgatgcaaacaagtttccagctgttatcagctagcgcgtgccctgagtataacaggctggatgactttcaaaaacttacagagagctgttgcagtagtgatgctttcgaacgcatcgatagcttctcagtgcaatctctggattcccgatccgtatccgaaatcaactccgatgacgaactatccgggaaagggtacgccctcgtgcccatcatcgtcaattcatccacccccaagtctaagaccgtcgagagcgcggaggggaaatcagaagaagtgaatgagaccctggtgatcccaaccgaggaagccgagatggaggagagcggtcgaagcgccactcccgtcaactgtgagcagccagatattctggtgagcagtacccccatcaatgagggacagacagtcttggataaggttgcagagcagtgtgaaccggccgaatctcagcccgaagccttaagcgaaaaagaagacgtctgcaagacagtggagtttctcaatgaaaagctggagaagagagaggcccagctattaagcctcagcaaggaaaaggccttgctcgaagaggcctttgacaacctcaaggacgaaatgttccgagtgaaggaggagagctctagtatatcgtcattgaaggacgagtttacacaacgtatagcagaggccgagaagaaagtacagcttgcctgcaaagagcgcgacgcagccaaaaaggaagtaaaaaggaagaaaaggtag

SEQ ID NO: 137308 - DNA, 3291 bp, Artificial Sequence
  Description of Artificial Sequence: Synthetic coding sequence
atgtcttggtttaacgcatcccagctgagctcgttcgcgaaacaggccctgtcacaggcacagaagtcaatcgatcgggtgctggatattcaagaggaagaaccctcgatatgggcagaaacaatcccttatggagaaccagggattagttcccctgtctcaggcgggtgggatacaagcacatggggactgaagtccaatactgaaccacagagccccccaattgccagcccaaaagccataaccaagcctgttcggaggactgtcgtggacgagtccgagaacttcttctcagcatttcttagccctactgacgtacagaccattcagaaatcgccagtggtatctaaaccgcccgctaaatcccaacgacccgaggaggaggtgaagtcttccctgcatgaaagcctacacattggtcagtcccggacccccgaaacaactgaatcccaagtgaaggatagtagtctgtgcgtgagcggggagactctcgcagccggtacatctagccccaagacggagggcaaacacgaggaaacggtgaacaaggagtctgatatgaaagtgcccaccgtcagtttaaaggtatctgaatctgtgattgacgttaagacaacaatggaaagcatttcgaacacgagtacacagtcactgactgcggagacgaaggatatcgcccttgaacctaaagagcagaagcacgaagacaggcaatctaatacaccttccccaccagtgtcaactttctcaagcgggacttcaacaaccagtgacatcgaggttctggatcacgagtccgttatatccgagtcttctgcgagttctcggcaggaaacaaccgatagcaaaagcagcctacatcttatgcaaacgtcttttcagctcctctcagctagcgcctgccccgaatacaataggctggatgatttccagaagttaactgaaagctgctgctcttccgacgcctttgaaaggattgattccttcagtgtccagtccctggattctaggtccgtgagtgagatcaattccgatgacgaattaagcgggaagggctatgctttggtgccaattattgtaaactcgtcaacccccaaatcaaagacagtcgagtcagccgagggcaagtccgaggaggtaaacgaaactctggtaatccccacagaggaagccgagatggaggaatccggaaggtccgcaacacctgtcaactgcgaacaaccggatatactcgtaagctccacccctataaacgagggccagacggtactggataaggttgcagagcaatgtgaacctgccgagtcccaacccgaggctctgtctgagaaagaggatgtgtgcaaagtgacacttacagtggagttcttgaacgagaaactggaaaagagagaagcccagctcctgtccctgtcgaaggaaaaggccctattagaggaggccttcgacaacctgaaagacgaaatgttccgcgtgaaagaggagagttcaagcataagcagcctgaaagatgaatttactcagcgaatcgccgaggcggaaaaaaaggttcaactggcttgcaaagagcgggacgccgcaaaaaaggaaataaaaaatataaaagaggaactagctacacggttaaattcctctgagactgcggatcttttgaaagagaaggacgagcagattagggggcttatggaagaaggggagaaactctctaagcagcaactgcacaactccaacatcataaagaagctcagggcgaaagataaggagaacgaaaacatggtcgctaagctcaacaagaaagtgaaggagttagaggaagagctgcaacacttgaaacaggtgctagatggcaaggaagaagtggaaaagcaacaccgcgagaacatcaaaaagctgaatagcatggtcgaaaggcaggagaaggacctgggtcgtctgcaggtggatatggacgaattagaagagaaaaataggagcatccaagcagcactggatagcgcctacaaggaattgactgatcttcacaaggccaacgccgcgaaagatagtgaggctcaggaggcagcactttcgcgggaaatgaaggccaaggaggaactcagcgctgccctcgagaaggcccaggaagaggcaagacagcagcaagagacactagccattcaggtgggcgacctaagattagcgctccagcgcacagagcaggcggcagcaaggaaggaggactatctgcgccacgaaattggtgagctgcaacagaggctgcaggaggcggagaacagaaaccaggagttatcccaaagtgtgtcaagcacaacgagaccactgttgaggcagatcgagaatttacaagccacattgggatctcaaaccagttcgtgggagaagctagagaaaaacctttctgatagacttggcgaaagccaaacccttctggccgctgcagtggagagagagcgagccgccactgaagagctgctcgccaacaagatccagatgagtagcatggagtcacaaaacagcctcctcagacaggagaattcacggttccaagctcagttggaaagcgaaaagaaccgcctttgcaaactggaggatgagaacaataggtaccaggtggaattagaaaacctgaaagacgagtacgtacggacattagaagagaccagaaaagagaaaactctgctgaattctcaattggaaatggagaggatgaaggtcgaacaggagagaaaaaaggctatcttcacacaagagactattaaagagaaggaacgcaagcctttcagcgtgtccagcacccccaccatgtcacgcagctcttctatttccggcgtcgatatggctggactccagacatccttcctgagccaggatgaatcccacgaccatagcttcggacctatgccgatttctgccaatggtagtaatctttatgatgccgtgaggatgggcgccggtagctctattatcgaaaatctgcaatcccagctcaagcttcgggaaggagaaattacacaccttcagctggaaataggaaatctggagaagaccagaagtattatggcagaagagttggtcaaactcacaaaccaaaatgacgagctggaagagaaggtcaaggagattcccaagctgcggactcaattacgcgacctggatcaacggtacaacaccatactgcagatgtacggtgaaaaagccgaggaggcagaggagttgcgcttagaccttgaggacgttaaaaacatgtacaagacccaaatagatgagctgctgagacagtcactatcttag

SEQ ID NO: 137309 - DNA, 4950 bp, Artificial Sequence
  Description of Artificial Sequence: Synthetic coding sequence
atggagagcgtcgaaaaagattggggctggggtctgtggagaaacctgcgttgtctgggccatgcacatcaagggaagtgttgtaccgaaggcggcattagcagtaccaccaaaacatctagtgagaacggcagttgctgttttgaaaaagccgctcggaaagaccacgtttgccgctttatagggtgtggtcgaaatgatcgatttaattacgtggtcatgcagctccagggcagaaatctggccgacctgagacggagccagtctcgcggcacgtttacgatttcaaccaccttaagactgggccgccagatccttgagtcgatcgagtccattcattctgtcggatttttgcatcgggacattaagccctctaactttgccatgggcaggttcccatcgacatgtagaaagtgctacatgctcgattttggtctcgcaagacagtttaccaatagttgcggagacgtccgtccacccagggcggtagcgggctttcgagggactgtgcggtatgcctcgatcaacgcccataggaaccgcgaaatgggaagacacgatgatttgtggtcccttttctacatgctggtagaattcgtggtcggccagttgccttggcggaagatcaaagataaagagcaggttggatccatcaaggaacgatatgatcacagattgatgcttaaacacttgccccccgaattttccatcttccttgatcacatctccagtctggattacttcaccaaaccagattatcagatgtccattagagttacaagaaagagctataaggtgagtactagcggcccccaggcattcaattccctgagctacaccagtggacccggcgcgtgcattagtagtagcagcttctcacggatgggctcttcctcatttcgcggcggtttaggggctggttatggcggagcctccggggggattaccaccatcacagtcaatcagtccctgctgtcacctctgaacctcgaggtggatcctaacatacaggccgttaggacccaggaagagaagcagataaaaaccctgaataataaattctttagctttattgacaaggtgaggtttctcgagcagcagaacaagatgctggagacgaagtggtcactcgtacagcagcagaagatggcccgcagtaatatggataacatgtttgaatcctacattaacaacttaaaatggcagctggagaccctcggtcaggagaagttgaagttggaagctgagctgggcaacatgcacggattggttgaagatttcagaaacaagtacgaagtagagatctccaaatgcaccgagatggagaacgagtttgtccttattaaagaatatgttgatgaagcttacatgaataagatggaactggaaagctctctgaaagagcttactgcaaagatttcttttctgagacagctctatgaggaagagattggaagctgctcacccaggtcaagaatacacttgtggtgctgctcttggaccacagcagccagttggacctggacagcctctagtctccgcagtcgtcccgagggttttccaggagggtgccatgccgacaccgagcagcgcggggagttagccatcaaggatgcaaacgctaaactgtctgaactggaggcagcattgcagctcgcgtcacaggatatggcgcgacagttgcgggaataccaggaactgatgaatgtcaagctcgcgcttgacataaagatcgccacttacagaaagctcctggagggggaagagtcgtggttggaatcagggatgcagaatatgtcaatccacatgaaaacaacgtctagctatgcaggagggcagtctctcgcgtatggtgggctcacaagccccggtttaagttacggactgggatccagtttcggcagtggcatgggctcgtcttccttctcacacacctcttccagccgggcggtggttatgaagaaaattgaaacccgcgatggtaaattggtctctgaaagctcaaatgtactgcctaatctgcgcatcacagcaacactgctcacctccgtatttgacaattctattaagactttcggggtaatcgaaagcgaccctttcgattgggagaagacagggaatgacggatctctgacaacaaccaccaccagtaccacccctcagttgcataccagactcacccctgctgctatcgggatagcaaacgccacccctattccaggggacttacttcgcgagaacactgacgaagtcttcccggacgagcaactcagcgacggcgagaacggcatacccgtcggagtatcacccgataagctgcccggtagtttgggccacccacgacctcaggaaaaggatgtgtgggaggagatggatgccaataaaaacaaaataaagctgggcatctgtaaggccgcaacagaggaggagaactctcatggtcaggcaaatggtctcctgaatgccccttctcttggctctcccataagagtgagatccgaaattactcagcctgaccgagacatccctttagtcagaaagctaaggagcatacattcatttgagttagagaagcgcctcacactggaacctaagcccgacaccgataaatttctggaaacgtgcctcgaaaagatgcagaaagatactagcgccggtaaggaatctatcctccccgctttgctgcataagccctgtgtcccagcagtgagccggacggaccatatatggcactacgatgaagagtatctcccggacgcgtcaaaacctgctagtgccaacaccccagagcaagccgacggcggaggctccaatggctttatagccgtgaacttgagtagttgcaagcaagaaattgattccaaagagtgggttattgttgacaaagagcaagatttgcaagatttccgaacgaacgaggccgtaggtcacaaaaccaccgggtccccttccgacgaggaaccggaagtcttacaggtcctggaggcaagcccacaggacgagaagctgcagctgggcccatgggccgagaacgaccatctgaaaaaggagacatcgggagttgttctggccctgtctgcagaaggcccacctaccgccgcttccgagcagtacaccgatcgcctcgaactccagcccggcgccgcaagtcagttcatcgcggccacgccgacttcccttatggaggcccaggcagaaggtccgctcaccgccatcaccatcccccggccttcagtcgcatcgacccagtccacatcaggaagcttccattgcgggcagcagccggaaaagaaagatctgcagcctatggagcccactgtggaactatatagcccacgtgaaaatttttctgggctggtggttactgagggtgaacctccctcagggggctcgcgcacagatcttggactccagattgaccacatcggccacgatatgctgcctaatattcgggaaagcaacaagagtcaggacttggggcctaaggagctgccagatcacaatagactcgtggtccgcgagttcgagaacttgccaggggagaccgaagagaaatctattcttctggaatccgacaacgaagacgaaaaattatcacgcgggcagcactgcatagaaatctcttcattgcctggcgatcttgtaatcgttgaaaaggatcactctgcaaccaccgagcctcttgacgtgacaaagactcagacttttagcgtggttcccaaccaagacaaaaataatgagataatgaagctgctcactgttggaacaagcgaaatcagtagtagggacatagacccacacgttgaaggccaaattggacaggtggccgaaatgcagaaaaacaagatcagcaaggatgatgacataatgagcgaagacctgccagggcaccaaggggacttgtctaccttcctgcaccaggagggaaagagggagaaaatcaccccaaggaacggtgagctgttccattgtgtgtccgaaaatgaacacggagccccaacacggaaggacatggtgaggtccagcttcgttaccaggcacagccggattcctgtccttgcgcaggaaatcgattccaccctcgaatcttcatccccagtctcggccaaggagaaacttctacagaagaaggcgtatcagccagacctagtgaagctgctagtggagaaacggcaatttaaatccttcctcggcgatctttcctctgccagcgacaagctattggaagagaaactcgccaccgtcccggctcccttctgtgaagaagaagtgctgacaccctttagccgtcttacggtggattcccatttaagccgctcagccgaggatagctttctgtctcctatcatttctcagagtcgaaaaagtaagattccaaggccagtgtcctgggtcaataccgatcaggtcaatagctcgacaagctcacagttctttccaagacccccaccaggtaagccccccactagaccgggcgtagaagcacgcctccggaggtacaaagtgctcgggagttccaattcggacagcgatcttttcagtcggttggcgcagattctacaaaacggctcacaaaagccccgcagcacaacgcagtgcaagtctccgggctcacctcataaccctaagacgcctcccaaatccccagtcgtgccccggagatccccttctgcgagccctcggagtagctcccttccaaggactagttcaagctcacctagtcgggcaggacggcctcaccatgatcagcgtagcagttccccccacctgggcagatctaaatccccgccatcacattccggctcgtccagtagccgccgatcttgccagcaggagcactgcaagccctccaagaacgggctgaagggctcaggctcgctacatcatcacagcgcctctaccaagaccccacaggggaagtccaaaccagccagtaagctgtccaggtag

SEQ ID NO: 137310 - DNA, 3735 bp, Artificial Sequence
  Description of Artificial Sequence: Synthetic coding sequence
atgagtggtggcggcgagcagctcgatattctgtctgttggtatcttggtgaaagaaagatggaaagtactacgaaaaatcgggggggggggtttcggggaaatctacgatgcattggatatgctcacacgggaaaacgttgcattgaaagtcgagagcgcccagcagcctaaacaggtcctgaaaatggaagttgctgtgctgaagaagctccaagggaaggaccatgtctgccgctttatcggatgcggaagaaacgaccggttcaattatgtggtgatgcagcttcaaggtagaaatttggccgacctccggcgatcacagtcccgggggacttttacaatttcgacaactcttcgcctggggaggcagatcctggagtctatcgagagcattcactctgtgggctttcttcacagggacattaagccatctaactttgctatggggcgctttcctagcacttgtcgaaaatgctatatgcttgatttcggattggctcgccagtttacgaactcttgtggggacgttagaccgcctcgcgcagtggccggttttagaggaacagttcgctacgcaagtattaatgctcatcggaacagagagatgggccgacatgatgacctttggtcacttttttatatgctcgtggaatttgtggtggggcagctgccatggcggaaaatcaaagacaaagaacaggtgggctccatcaaagaaagatatgaccatcggttgatgctcaaacacctacctcctgaattctcaattttcctggatcatatttcttcactcgactacttcaccaagccagactatcagttactcacatccgtcttcgacaactcaataaagacattcggggtcattgaatcagacccattcgattgggagaaaactggcaacgatgggtctctcactactacaacaactagcacgactccacagctgcatacacggttgacaccggccgccataggaatcgccaacgctacccctattcctggagatttgctgagagagaatacagatgaggtgttccctgatgagcagttatccgatggagaaaatggtattcctgtgggcgtgagtcctgacaagcttccaggttccctggggcacccacggcctcaggaaaaggacgtttgggaagaaatggatgctaacaaaaataaaatcaagctgggcatctgcaaggccgccacagaagaagagaatagtcacggccaagctaatggcctccttaatgcaccaagcctgggcagtccaattagagttcgttccgagatcacccagcctgaccgcgatattcccctggtgcgtaaactgcggagtatccatagtttcgagctagagaaacggctgaccctggaacctaagcccgataccgacaaattcctggaaacttgtctggagaagatgcaaaaagatactagtgcaggaaaagaaagcatccttcctgctctattacataagccctgcgtgcccgcggtctcgaggactgaccacatttggcattatgacgaggagtaccttccagatgcatctaaaccagcaagcgccaatactcccgagcaggctgatggtggagggtctaacgggttcatcgccgtgaacctatcgagctgtaaacaggaaatcgatagtaaagaatgggtgatagttgacaaggagcaggaccttcaggactttagaaccaacgaggccgttggacacaagacaacaggaagcccatcagatgaagagccggaagtgctgcaggtcttagaggccagtccacaggatgagaagctgcaactgggaccatgggccgaaaatgatcacctgaagaaggagaccagcggcgtggtcttggcgctgtccgcggagggccctccaaccgccgccagcgaacagtatactgataggctggaactccagccaggcgccgcgtcacagttcatcgccgcaacacccacaagtctaatggaggcacaggccgagggaccacttaccgctataactatccctagaccctcagtggcttcgacacaaagtacttccggcagttttcactgcggccagcagccagaaaaaaaggatttgcagcccatggaaccaacagttgaattatatagtcctagagagaacttctctggtctagtggtgaccgagggagaacctccttcaggcggtagcaggactgatctggggctccagatcgaccacatcggccacgacatgctcccaaatattagagaatccaacaaaagccaggatctggggcctaaggaacttccagatcataatcgtctggttgtccgggaatttgaaaatctgcccggggaaaccgaagaaaaaagcatacttctggagagcgacaatgaggacgagaaattgtctagagggcagcactgcattgagattagctctcttcccggggacctggtaatcgtggagaaagaccactcagccacaactgagccactcgacgtgacaaaaacccaaacatttagtgtggtgcccaaccaggataaaaacaacgaaataatgaaactgctgaccgtcggtacctccgagattagttctagagacatcgaccctcatgttgagggccagattggccaggtggccgaaatgcagaagaataagataagcaaagacgacgatattatgtccgaggacttgcctggtcaccagggagatcttagcaccttcctgcatcaggaaggcaaaagagaaaagattacaccacgaaacggggaactattccattgcgtcagcgaaaacgagcatggagcaccaaccaggaaggacatggtgagatccagcttcgtgacccgtcactcaaggatccccgtgctggcccaggaaatcgactccacgctggaatccagttcaccggtaagcgcaaaagagaaactccttcagaaaaaggcctatcagcccgaccttgtcaagttgctggtggagaagagacagttcaagtcgtttctcggggatctctcctccgcttccgacaagttgcttgaagagaaactggccaccgtccccgcccctttttgtgaggaggaagtactgactcccttttctcgcctcacagtcgactcacacctgtccagatctgcggaggacagctttctcagccccattatctctcagagcagaaaaagtaaaattccacgacctgtaagttgggtaaatacggaccaggtcaattcctctacgtcttcccagtttttccctagaccaccacccggcaaaccccctaccagacctggggtcgaggccagactccggcgatataaggttctaggctccagcaactccgacagcgatctcttctctcgcctggcccagatactgcagaacggctctcagaagccgagatctacaactcaatgtaagtctccgggaagcccacacaacccaaaaacccctccaaagagcccagtagttcctagaaggtcaccaagcgccagcccacgatcatcctccctaccaaggacaagcagttcatctccttcccgggctgggagaccacatcatgatcaaaggagttctagccctcaccttggcagatctaagagtcctccttcacattccggctcttcttctagcagacggtcttgtcagcaggagcactgcaagccctccaaaaatggtcttaaaggttcaggcagcctgcaccatcactccgcctcaaccaagacccctcaagggaaatcgaagcctgcttctaaactgtcccgttag

SEQ ID NO: 137311 - DNA, 3525 bp, Artificial Sequence
  Description of Artificial Sequence: Synthetic coding sequence
gagccgggcaaggatcacgtgtgcaggttcatcgggtgcggaagaaacgacaggttcaactacgtcgtgatgcagctgcagggcagaaatcttgctgaccttaggcgatcacaatcacgggggacctttactatcagcacaaccttgagattaggtagacagatactcgagagcatagagagcattcatagtgtgggatttctccatcgcgatatcaagccctccaatttcgctatgggccgcttccctagtacgtgtcgcaagtgctatatgttggactttgggctggcacgccagtttaccaattcttgcggagatgtcaggcctccacgggcggtggcaggatttcgcggcacagtgaggtacgccagcataaacgcgcaccggaaccgtgagatgggacgccacgatgacctttggtcactgttctatatgctggtggaattcgtcgtgggccaactgccatggcgtaaaataaaagataaggagcaggtgggcagtataaaagagcgttacgatcacagactgatgttaaaacacctcccacctgagttttctatctttttggaccacatctcttctttggactacttcactaaacccgattatcaattgctgacctctgttttcgacaacagcatcaagaccttcggggtgattgagagcgacccatttgattgggaaaagacggggaatgacggaagtctcaccaccacaactacatccaccactccccaattacatacacgtttaacacctgcggcaatcggcattgcaaatgcaactccgatccccggtgatctgctgcgcgaaaacaccgatgaagtgttcccggatgaacagctgagcgacggagagaatggcatccccgtcggggtcagccccgacaagctgcccggaagccttggccatccgagaccacaggaaaaagacgtgtgggaagaaatggatgcaaataagaacaagatcaaactaggtatttgtaaggccgccacagaggaagagaacagccacgggcaggctaacggtctcctgaacgctccaagcctgggaagccccattagggtcagatctgaaattacacaaccggacagagatatacctctcgtgcggaaactgaggagtatccattcgtttgagcttgaaaagcgcttgacccttgaacccaaacctgacaccgacaagtttttggagacctgtttggaaaaaatgcagaaggatacgagtgcaggcaaagagtccattctccctgccctcctccataaaccctgcgtgcccgctgtttctcgtactgatcacatttggcattatgatgaagaatacctcccagacgcgtccaagccagccagtgccaataccccagagcaggctgacggcggcggttcgaatgggtttattgcagtgaatctgtccagctgtaagcaggagatcgacagtaaggagtgggtgatcgtggataaagaacaggacctgcaagacttccgcactaacgaggctgtgggacacaagactaccggttctcccagcgatgaagagccggaagtactgcaagtgctggaggcttcaccacaggatgagaaactacagttgggtccgtgggctgaaaatgatcacctgaaaaaggaaacttctggcgtagttctcgccttgtctgctgaagggcctcccacagccgcttcagagcagtacaccgaccggcttgagttacaacctggggccgccagtcaatttatcgcagcgacgccgacatccctgatggaggcacaggccgaaggtccgctaacagcaatcactatcccacggccttcagtggccagtactcagtccacatccgggagctttcactgcggccagcagcccgagaaaaaggacctccagccaatggaacccacagtcgaactgtattctccccgagaaaatttttctgggttagttgtgactgagggagagcctccttcaggtggctcgcggacagatcttggcctgcagatcgaccacatcggacacgatatgctgccaaacatacgtgagtcgaataagtcccaggacctggggcctaaggaattgcccgaccataaccgcctggtggttcgggagtttgagaatttacctggagagacagaggagaagtccatcctccttgaatcggacaatgaggacgaaaaattaagccggggacagcattgcattgaaataagttctctcccgggcgacctcgtcattgtagagaaagatcactctgcaactacagagccgctggacgtcaccaagacacagacctttagtgtcgtcccaaatcaagataaaaacaacgaaataatgaaactcctcaccgtggggacctcagaaatctcctctcgcgatattgacccgcatgtggagggccaaattggccaggtggccgagatgcaaaagaacaaaatctcaaaggacgacgatattatgtcagaggatctgcctgggcaccagggcgacttatccacttttctccatcaggaaggcaaacgcgaaaagattactccccgcaatggtgaactttttcactgtgttagcgagaatgagcatggggctcctacacgtaaggatatggttaggagcagcttcgtgacccggcactctcgtattccggtcttagcccaggaaattgattccacactcgaaagctcctccccagtgtccgcaaaggagaagctgttgcagaagaaggcctaccaacctgacctggttaagctcctggttgagaaaagacaatttaagtcgtttttaggagatctctcatctgcctcggataagctcctggaagagaaactggcaaccgtgcctgcaccgttttgtgaggaagaggtgttgactcccttcagcagactgactgtggactctcatctgagccgcagtgccgaagacagcttcttatcccccatcatctctcagtctagaaaaagcaagattccccgtccagttagttgggttaatacagatcaggtgaacagttccacgagttctcaatttttcccaaggcccccacctgggaaaccacctacgcgccccggggtagaggccagattgcgaaggtataaagttctgggtagtagtaatagtgactcagacctgttctctcgcctcgcgcagattttacagaatggctctcagaaaccacgaagcactactcagtgcaaaagtcccggctcccctcataaccccaaaacaccacctaagagtcctgtagtcccccgtagatcaccgtccgctagtcccaggagctcctcgctgccacgcaccagtagttcgtcacctagccgagcaggtcgtccacaccacgatcaacggagtagttcacctcacctgggtcgtagcaagagtcctccctctcactccgggagcagctctagcagaaggtcgtgccaacaggagcattgcaaaccatccaagaacgggcttaagggatcagggtcgcttcatcaccactctgcctccaccaagactcctcagggaaagagcaaacctgcctccaaattgtcgagatag

SEQ ID NO: 137312 - DNA, 2244 bp, Artificial Sequence
  Description of Artificial Sequence: Synthetic coding sequence
atgacgagtttccaagaagtgcctctgcagacatccaattttgcccacgtcatcttccagaacgtggcaaaaagttacctgcccaacgcccaccttgagtgtcattatacattgactccgtacattcacccacacccgaaggattgggtcgggatcttcaaggtgggctggtccacagcacgcgattattacacattcctttggtcccccatgcctgagcactatgtggaaggaagcaccgttaactgtgtgctggccttccaggggtattacctgcccaacgacgatggggaattctatcagttttgttacgtgacacataaaggcgagataagaggggccagcactccattccagttccgggcttctagcccggtcgaggaattactgaccatggaggacgagggaaattcggatatgctagtggtaaccacgaaggccgggctgcttgaactcaagatcgaaaaaactatgaaagagaaggaagaattgcttaagctgatcgccgtactcgagaaagagactgctcagcttcgcgaacaagtgggtaggatggaacgagaactgaatcatgagaaagagcggtgtgatcagctgcaggccgagcagaaggggctgacggaagtgacccagtccctcaagatggagaatgaggagtttaagaagcgattttctgatgctacgagcaaggcccatcaactggaggaggacatcgtctctgtgactcataaggccatcgagaaggagacggagctggattccctgaaagataagctgaagaaggctcagcacgagagggagcagctcgaatgtcagcttaaaactgaaaaagacgaaaaagaactatataaagtgcacctgaagaatacagagatcgaaaacacaaagttgatgagtgaagttcagactttgaagaatttagacggaaataaggagagtgtgattacgcatttcaaagaagagataggaagactccaactctgcttagctgaaaaagagaatttgcagcggacgtttctcctaacgactagttccaaagaggacacatgcttcttaaaggaacagctccgtaaggcagaagaacaggtccaggcaacacgccaggaggtagtgttcctagccaaagagctatcagacgctgtcaatgtgcgggatcggactatggctgatcttcacacagcaaggctggagaacgagaaggtaaagaagcagttggcagacgcagtagctgaactgaaactgaacgcaatgaagaaggaccaagacaaaaccgacactcttgagcacgagctgaggcgcgaagtggaagacctgaagctgcggttacagatggcggcagatcactataaggaaaaatttaaggaatgccaacgtctacagaagcaaatcaataaactgtccgaccagtccgcaaacaacaataacgtgttcacgaagaaaacagggaaccaacagaaggtaaatgacgctagcgtgaataccgaccctgcgaccagcgcctcaaccgtagatgtgaaaccctccccttccgctgccgaggccgactttgacatcgtcaccaaaggccaggtgtgcgagatgactaaagagatcgccgataagacagaaaagtacaacaagtgcaagcagctgttacaggacgagaaggctaagtgcaataaatacgcagatgaacttgccaagatggagttgaagtggaaggagcaggttaaaatcgccgaaaatgtgaagctggagcttgccgaggtgcaggacaattacaaggaactcaagcgctccctggagaacccagccgaacgtaagatggaggatggggccgatggagccttctaccctgacgagatccagagaccaccagttagagtgccgagttgggggctggaggacaatgtggtgtgcagtcaacccgctcgcaattttagcaggccagatggattagaggactctgaggactcaaaggaagatgaaaacgttcccaccgctccagaccccccatctcagcatctgcgaggccatggaacaggcttctgctttgactcgagcttcgatgtccataagaaatgtcccctgtgcgaactgatgtttccgccaaactatgaccagtcaaaattcgaagagcacgtggagtcacactggaaggtgtgccccatgtgctcagagcagtttcctcctgattatgaccagcaggtgtttgagaggcacgtgcagacccatttcgaccaaaatgtcctgaatttcgactag

SEQ ID NO: 137313 - DNA, 2370 bp, Artificial Sequence
  Description of Artificial Sequence: Synthetic coding sequence
atgaccagctttcaggaggtgccactccagacctcaaacttcgcacatgtgatcttccagaatgtagcgaaatcctatcttccgaacgcacacctggaatgtcactatacgcttaccccatatatacatccccacccaaaggactgggtcggcatctttaaggttggctggtcaaccgctcgggactattatactttcctctggagccccatgccagaacattacgtggaaggaagcactgtcaattgcgtgctggctttccaaggatactatttaccaaacgatgacggcgaattttatcagttttgttacgtcacccataaaggcgagatcaggggcgctagtactccgttccagttcagagccagcagtccggtggaagaacttttaaccatggaagacgagggaaacagtgacatgctagtcgttacaacaaaggcagggcttttggagttgaaaatcgagaaaactatgaaggagaaggaagaactgctcaaactcattgccgtacttgagaaagagactgcacagctgcgagaacaggtgggaaggatggagagggaactgaatcatgagaaagaacgctgcgatcagctccaagcagagcagaaaggactgaccgaagtgacacagtccctgaagatggagaatgaggagttcaaaaagcgtttcagtgatgcaacctcaaaagctcaccagctggaggaagacattgtatccgtgactcataaggcgatcgaaaaggagacggaactggactctctgaaagacaagctgaaaaaggcccaacatgagcgggagcagctcgagtgtcagcttaaaactgaaaaagacgagaaggaattgtataaagtgcatttgaagaacacagagattgagaatacaaaacttatgtccgaggttcaaacgttgaagaacttggatgggaataaggaaagcgtgatcactcacttcaaggaggagataggacgcttacagctgtgcctggctgagaaggaaaaccttcagaggacttttctccttaccacatcgagtaaggaagacacctgctttctgaaggagcagctgcgtaaagctgaagagcaggttcaagctaccagacaggaggtagtgttcttggcgaaagagctgtccgacgctgtgaatgtgagagataggacgatggcggacttacataccgctcggttggaaaatgaaaaggttaagaaacaactggcggatgccgtagccgaattaaagctgaatgccatgaaaaaggaccaagacaagaccgataccctggagcacgaactgaggagagaagtagaggatctgaaactgagattacagatggccgctgaccactataaggagaagtttaaggagtgccagagactccagaaacagatcaataaattaagcgatcagtctgcgaacaacaataacgtgttcacaaaaaagacaggaaatcagcagaaagtgaacgacgcaagcgtgaacaccgatccagccacctccgcttccactgtggatgtgaaacctagcccttccgcagccgaggccgactttgacatagtgacaaaagggcaggtctgcgagatgactaaggagatagccgacaagacagagaagtacaataagtgcaagcagttgctgcaggatgaaaaagccaagtgtaacaagtacgccgacgaacttgccaagatggaacttaagtggaaggagcaggtgaagatcgctgagaatgtcaagctggaacttgcagaggttcaggataattacaaggaactgaagagatccctcgagaacccagctgaaaggaaaatggagggccagaactctcagtcaccgcagtgctttaagacgtgctccgaacaaaacgggtatgtgctcactcttagtaatgctcagcccgttttacagtatggcaatccttatgccagccaggagaccagggatggcgcggatggagccttctatcctgatgaaatccagcggcctcctgttcgggtgccgtcatggggccttgaagacaacgtcgtgtgtagccagcctgccaggaattttagcagaccagacgggcttgaagacagtgaggacagcaaggaagatgaaaatgtgcctacagcgccagaccctcccagtcagcacctgagagggcatgggaccggcttctgtttcgactcctcctttgacgtccataaaaaatgtccactgtgcgagctcatgttccctcctaattatgaccagagcaagttcgaggaacatgttgagagccattggaaggtgtgtcctatgtgctccgagcaatttccgcccgattacgaccagcaagtgtttgaaagacatgtccagactcatttcgatcagaacgtgctcaacttcgattag

SEQ ID NO: 137314 - DNA, 417 bp, Artificial Sequence
  Description of Artificial Sequence: Synthetic coding sequence
atgaccagttttcaggaggtgccactacaaacttccaacttcgcacacgttatcttccagaatgtggctaagtcttatctgccaaacgctcacctagagtgtcactataccctaactccctacatccatccacacccaaaggattgggtcggcatcttcaaggtcggttggagcactgcccgagactattatacattcctatggtcacctatgcccgagcactacgtagagggtagtaccgtcaactgcgtgctggctttccagggctactatctcccaaatgacgatggtgagttttaccagttctgctacgttacacacaaaggggagattcgaggtgcttctacgcccttccagtttagggcctccagtccagtggaggagctccttaccatggaagatgagggaaatagttag

SEQ ID NO: 137315 - DNA, 297 bp, Artificial Sequence
  Description of Artificial Sequence: Synthetic coding sequence
atgacctccttccaagaggtgcctctgcagacctctaacttcgctcacgttatcttccagaacgttgctaaatcttacctgcctaatgctcacctggaatgccactacaccctcactccctacatccacccgcacccaaaggactgggttggaatattcaaggtgggctggtcgactgcaagggactactatacattcctgtggagtccgatgcctgaacattacgtcgaaggtagcaccgtgaactgtgtcctcgctttccaggggtattatctaccaaatgatgacggtgagtag

SEQ ID NO: 137316 - DNA, 1773 bp, Artificial Sequence
  Description of Artificial Sequence: Synthetic coding sequence
atgaaggagaaggaagaattactgaaactgattgcagtactagagaaagagacagctcagttacgggaacaggtgggcaggatggaacgcgagctgaaccacgaaaaggagcggtgcgaccagctgcaggctgagcagaagggactgacggaggtgacacagtccttgaaaatggaaaacgaagaattcaagaagcggttttccgacgccacttctaaggctcatcaactagaggaggacatcgtatctgtgacacataaggcaattgaaaaggagactgagctggactccctgaaagataaactaaagaaggcgcaacatgagagagaacaactggaatgccaactgaagaccgagaaagacgagaaggagctgtataaagttcatctaaagaacactgaaatcgagaacacgaaactcatgtctgaagtccagaccctaaagaatttagacgggaataaggagtccgttatcactcactttaaagaggaaatcggtcggttacaactgtgcctcgccgagaaggaaaacctccaaaggactttccttcttaccacgtcttcaaaggaggatacgtgcttccttaaagaacaattgaggaaagcagaggagcaggtacaagcaaccaggcaagaagttgtgtttctcgccaaggagctgagcgacgccgtgaacgttcgtgatcggacaatggccgacctccatactgcgagactcgagaatgagaaggtgaaaaagcaattggcagatgccgttgctgaacttaagctgaacgccatgaagaaagatcaggataagaccgacacgctcgaacacgaactcagacgggaagttgaggatctgaagctccggctccagatggccgcggaccattacaaagaaaagtttaaagaatgtcagagacttcagaaacaaattaataagctatctgatcagagtgccaataataacaacgtgttcactaagaagaccggcaaccaacagaaagtgaacgatgcatcggtcaataccgaccctgccacatcggcctccaccgtggacgtcaaaccctctccctccgccgccgaagcagattttgacatcgtcacaaagggtcaggtgtgcgagatgacaaaggagatcgctgacaagactgaaaaatacaacaagtgtaagcagcttctacaggacgagaaagccaagtgtaacaaatacgccgacgaactagctaaaatggagttgaaatggaaagagcaagttaagatagctgagaacgtcaagttagagttagcagaggtgcaagacaattacaaggagctcaagcggagtctagaaaatccagcggagagaaagatggaagatggcgccgatggcgctttttatcccgacgagattcagcggccaccagtgcgcgtcccctcatgggggctggaggacaatgtggtctgctctcagccagcccggaatttcagcaggccggatggcctcgaagactcggaagacagtaaggaagacgaaaacgtgccgaccgcccccgatcctccctcacagcacctgcggggccacggtacaggtttttgctttgattctagctttgacgtacacaaaaaatgtccgctttgtgagcttatgtttccccctaactacgaccaaagtaagtttgaagagcacgttgagtcacactggaaggtgtgccctatgtgttccgagcaatttccccccgactacgatcaacaggtctttgaacgccatgtgcagacccattttgatcagaacgtcctgaattttgactag

SEQ ID NO: 137317 - DNA, 2244 bp, Artificial Sequence
  Description of Artificial Sequence: Synthetic coding sequence
atgacatcattccaggaggtaccactgcaaacctctaatttcgcacatgtcatctttcaaaacgtggcaaagtcctacctgcccaacgctcatctggagtgtcactatacactgaccccctatattcatccgcacccgaaggattgggtcgggatatttaaagtaggctggtctactgctcgagattactatacgttcctgtggtcaccgatgcctgaacattatgtggaaggctcaacagtgaattgtgtcctcgcctttcaaggatactatctgccaaacgatgatggcgaattttatcagttttgttacgtcactcacaagggcgagattcggggcgcgtctacccctttccagttccgagcaagctccccggtagaggagctcctaacaatggaggacgaggggaacagtgacatgctggttgtgaccaccaaggcaggattgttggaacttaagatcgaaaaaactatgaaggagaaggaggagttacttaagctgattgccgtcttggaaaaggaaacagctcagcttcgagagcaggtaggccgcatggagagagagttaaaccatgaaaaagagaggtgtgaccaacttcaagcggagcagaaggggctgacagaagtcacacaaagcttgaagatggaaaacgaggaattcaaaaaaagattttccgatgccacttccaaagcacatcaactggaggaggatatcgtctcggtcacgcacaaagctatcgagaaggaaactgagctggactctctgaaggacaagctcaagaaggcacagcatgaacgcgaacaactggagtgtcagcttaaaaccgagaaagacgagaaagagttatataaagtccacctgaaaaatacagagatcgaaaataccaaactgatgtctgaggtacagacacttaagaaccttgacggaaacaaagaatccgtgatcacgcattttaaggaggaaatcggacggctccagctttgcctggcagagaaggagaatcttcaacgcacgttcctcctgaccacttcctcgaaagaggacacttgctttctgaaggagcagttgagaaaggctgaagaacaggtccaggcaacccgccaggaagtggttttcttggctaaggagctgtctgacgctgtcaacgtccgcgatagaacgatggccgatcttcacacagccagattggaaaacgagaaagtgaagaagcaactcgctgacgccgtggccgaacttaagctaaacgccatgaagaaggatcaggataagactgatacacttgagcatgaactgcggagagaggtggaggacttgaagctacggttacaaatggccgcggatcattacaaagagaaatttaaggaatgtcagaggttgcagaaacagataaacaaactaagcgatcagtcagcaaacaataacaacgtttttactaaaaagactggcaatcagcaaaaggtgaatgatgcgagtgttaacacagaccccgctaccagtgcgagcactgtggatgtgaaaccttctcctagcgctgcagaggccgattttgacatcgtgaccaaaggccaagtctgcgaaatgactaaggaaatcgccgacaagactgaaaagtataataagtgcaaacagctgctgcaggacgaaaaggccaaatgcaataagtatgccgacgagctggcaaagatggaactgaagtggaaagagcaggtgaaaatcgctgagaatgtcaagctggaattagccgaggtgcaagataactataaagaattaaaacgatcgcttgagaacccggccgaacgtaaaatggaagacggcgctgacggggccttctatcccgacgaaattcaaaggccccccgtgagagttcccagctgggggctggaagataatgtggtttgttctcagcccgctaggaatttctctaggccggacggcctggaggattccgaggattctaaggaggatgagaacgtgcccacagccccggacccaccgagccagcatctacgcgggcacgggacagggttctgtttcgattcatccttcgatgtccataaaaaatgtccattgtgtgagctgatgttccccccaaattacgatcagagcaagttcgaggaacatgtcgagtcccattggaaagtgtgcccaatgtgcagtgagcagtttcctcctgactatgatcaacaagtctttgagcgccatgtccagacccatttcgaccagaacgtgctgaatttcgattag

SEQ ID NO: 137318 - DNA, 3480 bp, Artificial Sequence
  Description of Artificial Sequence: Synthetic coding sequence
atggagccaatcacattcacagcccggaagcatctgttgtccaacgaagttagcgtagactttggcctgcagctggtgggttccctccccgtccactctctgacaacaatgcctatgctgccctgggttgttgccgaggttagaagattgtcaaggcaatccacaagaaaggagccagtgactaagcaagtgaggctctgtgtgtccccgtcagggctccgttgcgaacccgagcctggtaggtcacaacagtgggacccactgatttattccagcatctttgaatgcaagcctcagcgggtgcataagctcattcataactctcacgatcctagctacttcgcctgtctcattaaggaggatgccgttcaccggcaaagcatttgttacgtcttcaaagcagatgatcagaccaaggtcccagagattatcagcagcatcagacaggccgggaaaattgcccgacaggaagaactgcactgcccatcagaattcgacgacacttttagtaaaaaattcgaagtgctgttttgtggaagggtcaccgtcgcccataagaaagccccgcccgctctcattgatgaatgtatcgagaagttcaatcacgtgtccggatcacgaggatctgagagtcctcggccaaatcccccccatgctgcccccactgggagccaggagcccgtgcgccgcccaatgaggaagagtttctctcagccgggactgcgatcactggctttcaggaaagagctgcaggacggggggctgcgctcatccggcttcttctcctcttttgaggaatccgacatagagaaccatctgatctcaggtcataatattgttcagcccaccgatattgaggagaaccgaacaatgctctttactattggacaatcagaggtgtatttgatctctccagatactaaaaagatcgcattggaaaaaaatttcaaagagatctctttttgtagccaggggatccggcatgtggaccatttcggttttatctgccgcgaaagctcaggaggaggggggttccatttcgtctgttatgtctttcagtgtacaaacgaggctctggtggatgagataatgatgactctgaagcaggccttcactgtagccgccgttcagcagacggcaaaggcaccagctcagctgtgtgaggggtgtcccctgcagtctttacacaagctctgtgagcgtatcgagggcatgaactcctcaaagaccaaacttgaactgcagaaacacctgacaaccttaacaaaccaagaacaggccaccatctttgaagaagtccagaaactacggcccagaaatgaacagcgagaaaacgaactgatcatttcctttctgcgctgcctgtacgaggagaagcagaaggagcacatccatattggagagatgaagcaaacatctcaaatggcagctgagaatatcgggtccgagctgcctccaagcgccactagattccggctcgacatgcttaaaaacaaagcaaagaggagtctgacagaatctctggagagcatactgagcagggggaacaaagcccgcggcctgcaggaacatagcatcagcgtggacctcgattcctcattgtccagcactctgagcaatacctccaaggaaccatctgtgtgtgaaaaagaggccttgccaatctcagaatctagctttaagttgctcggaagtagtgaagacctctccagtgacagtgagagccatctgcctgaagagcctgcccccctctcccctcaacaagcatttcggagacgggcaaataccctcagtcactttccaatcgagtgccaggagccgccacagccagcgagaggatcgccaggcgtatcacagcgaaaactgatgcgataccacagcgttagcacggagacgccacatgaacgaaacgtcgaccctagccctgtcggggagagcaagcacaggcccggtcagtctagcgctccggctcctccgcccaggctgaaccccagtgcttctagccctaatttctttaaatatctgaaacacaactcctccggcgaacagtccggtaacgccgtaccaaaatcaatttcttatcggaacgctctgcgcaaaaagctgcattcaagcagctccgtgcccaatttcctgaagtttctggctcctgtggacgaaaacaacacatccgatttcatgaacacaaagcgagactttgagagcaaggccaaccaccttggcgattcagggggcacgccagtgaagactcgccgacatagctggaggcagcaaatctttctgcgagtggccactccccagaaggcctgcgactcaagctctcggtacgaagactactccgaactgggtgagttgccacctcgcagccctctggaacccgtgtgcgaagatggaccattcggcccaccaccagaggaaaagaagaggacttctcgggagctcagggagttgtggcaaaaggctattctgcagcagattctgctactccgcatggagaaagaaaaccagaaattgcaggcctctgagaatgaccttcttaataagcggctcaagctggattatgaagaaatcacaccatgtctcaaggaggttactactgtgtgggagaagatgctgagtacaccgggtcgatcaaaaatcaagtttgatatggaaaaaatgcacagcgccgtgggccagggagtgcccagacaccaccggggagagatatggaaattcctggctgagcaatttcatctcaaacatcagttcccaagtaagcagcagcctaaggatgtcccctataaggaattattgaagcaattgacaagccagcagcacgccattctcattgatctggggcgcacttttccaacacatccatactttagtgctcagctaggcgcaggccaactgagcctctataacatcctgaaagcttatagcctgctggaccaggaagtgggctattgtcagggactctcttttgtggcagggatcctcctgctccatatgtctgaagaagaagctttcaaaatgctgaaattcctcatgttcgacatgggattgcggaagcaatataggcctgatatgatcattctccagatggagaagaccatcaatcaggtgttcgagatggatatcgcaaaacagctgcaggcctatgaggtcgaatatcacgtcctgcaggaggaactaatagactcatcccccctgtccgataatcagagaatggataagctggaaaaaacgaattcctccctgcgaaagcagaacttagacttgctggaacagctgcaggttgctaatggaagaattcaaagcctcgaggctactattgaaaagctcctgtcaagtgagagcaaattgaagcaggccatgttgactctcgaactggaacgctcagcgctacttcagaccgtagaggagctcaggaggcgcagtgctgaaccctcagatagagaaccggaatgtacccaaccggagcccaccggggactag

SEQ ID NO: 137319 - DNA, 3507 bp, Artificial Sequence
  Description of Artificial Sequence: Synthetic coding sequence
atggagcctataacattcaccgcgaggaagcacctcctctccaacgaagtgagcgtggacttcggacttcaattggtgggcagtctgcccgttcactcgctcacaaccatgcccatgctcccttgggtcgtggccgaagtaagacgtttgagtaggcaatcaacacgtaaggaaccagtgacaaagcaggtcaggttatgcgtgagtccctccggcctgaggtgcgagcctgagcctggcagaagccaacaatgggaccctctgatatattcatcgatatttgagtgtaaacctcaaagagtgcataaactgatccacaactcccacgatccgagctacttcgcatgcctcattaaagaggatgccgtacaccgacaaagcatctgttacgtgttcaaggccgacgatcagactaaggttcctgagattataagcagtatccgccaggctggcaaaatcgcccgtcaggaagaactgcactgtccaagcgaatttgacgatacgttctcgaagaaatttgaggtgctcttctgtggcagggtcactgtggcccacaaaaaggctcctccagccctgatagacgagtgtatcgaaaaattcaatcatgtgtctggcagtagaggcagcgagagcccaaggcctaatccacctcacgcagcccccaccggatcccaagagcccgtaaggcgaccaatgaggaagagcttttcacaacccggtttacgttctctcgccttccgcaaggagttgcaggacgggggactgaggtcctcaggattcttttcctccttcgaggagtctgatatcgagaaccatctgatcagtggccacaatatcgtgcagcccaccgatattgaggagaacaggactatgttgtttacaattgggcaaagcgaagtttatctcatttccccggataccaagaaaattgctctggagaagaattttaaggaaatttcattttgctctcaaggcattcgtcatgtggaccattttggtttcatctgtcgggaatctagcggtgggggcggctttcattttgtgtgctacgtgtttcagtgcacgaacgaggcactggtggatgaaatcatgatgaccctgaagcaggccttcacagtcgctgctgtgcagcagaccgcaaaggcaccagcccagctatgcgagggctgtccgctgcagtctctgcataagttgtgcgaacgaattgaggggatgaattctagcaagactaagctcgaactgcagaaacacctgactaccttaacaaatcaagagcaggccactatcttcgaagaagtccagaagctcagacctcgtaatgagcagcgagaaaacgagctgataattagcttcctgagatgtttgtacgaggagaagcagaaggaacacatacacatcggcgaaatgaaacagacaagtcaaatggccgccgaaaatatcggcagcgaattgccaccctctgcgacaagatttcgtctggatatgctgaaaaacaaagccaaacgcagtctgacagagtccctcgagtccatcctgagcagaggaaataaagcccgtggtctgcaggaacatagcatatccgtcgatttggatagcagcctctcctcaaccctgtctaatacctctaaggagccatccgtatgtgagaaggaggccctaccaatttctgaaagctcatttaaactcctcggatcaagtgaggacctcagttcagatagcgaaagccacctgcccgaagagccagcccccctctcaccccagcaagcattccgccggcgcgccaatactctcagtcactttccgatcgagtgtcaggaaccaccccagccagcgaggggctccccaggcgttagccagcgaaagctgatgcgctatcactccgtgtccacagaaacccctcacgaaaggaaagatttcgaatctaaggcgaaccacctgggagattctggggggacgcccgtgaagacccgacgccattcctggcggcagcagattttcttgcgcgtcgccacccctcagaaggcttgcgattcttcctcccgctacgaagactactcagaactaggagagttacctccccggtccccacttgagcctgtgtgcgaagatggaccatttggaccacctcctgaagaaaaaaaacgcactagccgcgaactaagggaactctggcagaaggctattcttcaacagatcctcctgttacgcatggagaaggaaaatcagaagctacaagcaagcgagaatgatttgctgaataaaaggttgaaactcgactacgaggagataaccccttgtctgaaggaagtcaccaccgtttgggaaaaaatgttatcaacaccaggacgctctaagattaaatttgatatggagaaaatgcacagtgccgtcgggcagggagtgcctaggcaccacagaggggagatctggaagtttttagccgagcagtttcatctgaagcatcagttcccgtcaaagcagcagccaaaagatgtgccctataaggagctgctaaagcagctgactagtcagcagcatgctatcttaatcgacctgggacgcacttttcccacacacccctattttagtgctcagctgggcgccggacagctatctttgtacaacattctcaaggcatactctttacttgaccaggaggtcggctattgtcaggggctcagcttcgtggccggtatcctcctgctgcatatgagcgaagaggaagcattcaaaatgctgaaattcctgatgtttgatatggggttaaggaaacagtatcggcctgatatgatcattttgcagatccagatgtatcagctttcacggctcctacacgattaccatcgagatttgtataaccatttggaggagcacgagatcggcccttcactctatgcagctccatggtttctgactatgttcgcgagccaatttcccttaggctttgtggcgcgcgtgtttgacatgatctttctccagggcaccgaggtgatatttaaggtggccctcagtctgctcggtagccacaaacccctaatcctgcagcacgagaatctcgagaccatcgttgactttatcaaatccactctgcccaatctgggactggtgcagatggaaaagacaattaaccaggtctttgaaatggacatcgcaaaacagttacaggcatacgaggtcgagtaccatgttctgcaagaggagcttatcgattcttcaccgctcagtgacaaccaaagaatggataaacttgagaaaacaaattccagtctgcgcaaacagaacctggatctattagagcagttgcaggtcgcgaatggccgaattcaaagtctggaggcaacaatcgaaaaactgcttagttccgaatctaaactgaagcaggccatgctgacactcgaattggaacgatccgctctgctacaaaccgttgaggagctgcgcaggcgttcagcagaaccgagtgatagggaacctgagtgtacacaaccagagccaaccggcgactag

SEQ ID NO: 137320 - DNA, 1299 bp, Artificial Sequence
  Description of Artificial Sequence: Synthetic coding sequence
atggagaaggagaatcagaagctacaggcttcagagaatgatctgctcaacaagaggttgaagttggactatgaggagatcacgccctgcctcaaagaagtcacgaccgtttgggaaaaaatgctgagtactcccggccgctcaaaaatcaaatttgacatggaaaagatgcacagtgcagtgggccaaggggttccaaggcaccaccgcggagagatatggaaattcctggccgagcagtttcatctaaagcaccagtttccgagcaaacagcaacccaaggacgtgccatataaggagctcctgaagcagctcacctcccaacaacatgccatcctgattgacctgggcaggacattccccacacacccttatttttcagctcagctaggagccgggcagctatccttgtacaacatcctgaaagcatactccttactagatcaggaggtaggctactgtcaaggtctgtcgtttgttgccgggatcctgcttttgcatatgagtgaggaagaagcctttaagatgctgaagtttctcatgtttgacatgggtctgcggaagcaatatcgcccagacatgattatccttcagattcagatgtatcagctgtcccgcctcctccacgattaccaccgcgacctttataaccatcttgaggaacacgagattggaccctcattgtacgcagcaccttggtttcttaccatgtttgcttcacagttccctcttggtttcgtggcacgggtgtttgatatgatatttctgcagggaaccgaagttattttcaaagttgcacttagtctgctgggctcacacaaaccccttattctgcagcatgagaacctggagacaattgttgattttattaaatccactcttccaaatttaggcctggtccagatggagaagacaattaaccaagtttttgaaatggacattgcaaagcagctccaagcttatgaagtcgagtatcatgtgcttcaggaagagctgatcgacagctccccactgagcgacaaccaacgtatggacaagcttgaaaagacaaattccagtctgcggaaacaaaacctggatctcctggagcagctccaggtggccaatgggagaatccaatcactggaagctaccattgagaagctgctgagcagcgaatctaagctgaagcaggctatgctgactttagaactcgaacggagcgcgttgcttcagactgtggaggagttgcgaaggagatcggcagaacccagtgatagggagcctgagtgtacccagcctgagccaacgggggattag

SEQ ID NO: 137321 - DNA, 933 bp, Artificial Sequence
  Description of Artificial Sequence: Synthetic coding sequence
atggcccaagctctgggcgaggacctggtccagccccccgagctacaggatgactcttcaagcctcggaagcgactccgagctcagcggcccaggcccttaccgtcaggctgaccgctatggatttatcggcggaagttcagctgaaccagggccgggacacccacccgccgacctcattaggcagcgcgagatgaagtgggtcgagatgacttcccactgggagaaaaccatgagccggaggtacaagaaagtgaagatgcaatgtcgcaagggtatcccttcggctctgcgcgccaggtgctggcccttgctttgcggggcccacgtatgccagaaaaattcgcccggaacataccaggagttggctgaggcgccgggggacccacaatggatggagacaattggaagggatctgcatcgtcagttccctcttcacgagatgtttgtctcacctcaaggacacggacggggatcgtgtaggtgtagcagaccgactccttgcatcgaccgctcacgggctaccgcaaggccgcggggtccctggctcctgtgttgctcctgcacatgcccgcagcggcgtccgtcaggcgcttggtgtcgatcagtccggtcaacctccctgggcacaacaggcccgacttggtgccagtccactgtaccctgcggggccgatacaggcgcccccggtgcaggccattgcagggccgctcggggtttgccctggccgcccggtgacaccggttccccgtcctcacatcccccgcgcgctgccgcggggggcggcctgcatgtgacgggagcccagcgcggcgctgtgcgtgccgggcccgctgccggagatcagggccccgccggtcccgccgcccgatttagggccggcacaccagcccccgcaacaggaccgccccgccgggggccttcacacctctag

SEQ ID NO: 137322 - DNA, 1662 bp, Artificial Sequence
  Description of Artificial Sequence: Synthetic coding sequence
atggattcaccagggtataactgtttcgttgacaaagacaaaatggacgcggccatccaggacctggggccgaaagaattgtcgtgtaccgagctgcaggaactaaaacaactggctcgccaaggctactgggcgcagtctcacgccctgagaggcaaagtgtatcagcggttaatcagagatatcccctgccgcaccgtaacacctgatgccagtgtatattcggacattgtcggtaaaattgttggcaagcatagctcctcatgtttgcctctgcctgaatttgtggataacactcaggtgccttcttactgcctcaacgctcggggggaaggagctgtgaggaagatactgttgtgtctggcgaatcagtttcctgatatctcattctgccccgcactgcccgctgtcgtcgcactgctcttacattacagcattgacgaagcagagtgttttgaaaaagcttgtcgtatcttggcctgtaatgatcctggacgtagactgattgatcagtcgttcctggcctttgagagtagctgtatgacttttggtgatctggtcaacaaatattgccaagccgctcataagctgatggtggcagtgtccgaggacgtactgcaggtctacgctgattggcaaaggtggcttttcggggaactccctttgtgctatttcgccagagtgtttgacgtgtttttagtggaggggtacaaagtgctgtacagagtcgctctggcaatccttaaattttttcataaggtccgagcaggccagccactggagagcgattcagtgaaacaagacatacgaacttttgtgagggatattgccaagaccgtgtccccagaaaaactgctggaaaaggcatttgcaattagactgttcagtagaaaagaaatccagcttctgcagatggcaaacgagaaagccctgaagcagaaaggtataactgtgaaacagaagcgtcaattcgtccatctggcagtgcacgccgaaaattttcggagcgagatcgtgtctgtccgcgagatgcgagatatctggtcttgggtacccgaaagatttgctctgtgtcagccactgttgctgtttagctctctacagcacgggtatagccttgcaaggttttactttcagtgcgaggggcatgaaccaacgttgctcttgataaaaactactcagaaagaagtctgcggcgcttacctaagtaccgactggtcagaaagaaacaagtttggcggtaaactcggattcttcgggactggtgagtgcttcgtgtttcgcctgcagccggaggtgcagcggtacgaatgggtggtcattaagcaccccgagctaacaaaaccaccacccctgatggccgccgaaccaactgcgcccctcagccacagcgccagcagtgacccagctgaccgcttgagcccttttctggctgctagacattttaacctcccatcgaagaccgaatctatgtttatggccggaggaagcgactgtctgattgtcggcgggggcggcggacaggccctgtacattgacggagatctgaacagaggtcgcacctctcattgcgacacttttaataatcagcccctgtgctcggaaaacttcctgatcgccgcagttgaagcatggggattccaagatccagacacacagtag

SEQ ID NO: 137323 - DNA, 759 bp, Artificial Sequence
  Description of Artificial Sequence: Synthetic coding sequence
atgggcgtcttgttgacccagcggaccctgcttagtcttgtgctggctctccttttcccatcgatggcctcaatggcagcaattggaagttgctcaaaggaatatcgcgtcttactggggcagctgcaaaaacaaacagatctgatgcaggacacgtctagactcctagacccttatatccgaattcagggccttgatgtgcctaagctgcgtgagcattgtagagagcggcctggggcctttccttccgaggagacattaagaggtttagggcgccgggggttcctacagacgctgaatgctacccttggttgcgtgttacatcggttggccgacctggagcagcggttaccgaaagcacaggatctcgaacgtagcggactcaacatcgaagacctagagaaacttcagatggctagaccgaatatcttaggcctccggaacaatatctactgtatggctcagttgctggacaactccgataccgccgagcctaccaaggctggccgcggggcatctcaaccacctacaccgactcccgccagcgacgcctttcaaagaaaactcgagggctgtcgcttcctgcatgggtatcaccgttttatgcactctgtggggagggtgttctccaaatggggcgagtctcccaaccgatcgcggcgccacagccctcaccaggccctccggaagggagtccgccggactcggccgtcccgtaagggaaagcgcctgatgacgcgagggcagctgcctagatag

SEQ ID NO: 137324 - DNA, 1263 bp, Artificial Sequence
  Description of Artificial Sequence: Synthetic coding sequence
atgttaaacaattgggacaagtggatggccaaaaagcacaagaaaatcagactgcggtgccagaaggggatccctccctctctgcgagggagggcgtggcagtatttgagtggggggaaggttaagctgcagcaaaatcctggaaagttcgacgaactggacatgtccccaggagacccaaagtggctagatgtgatcgaacgggacctccataggcaatttccgttccacgaaatgtttgtgagtaggggcggccacggccagcaggacctgttcagagtgctcaaggcttatactctctacaggcccgaagaaggctactgccaggctcaagcacccattgcggctgtgctcctcatgcatatgcctgctgaacaggccttctggtgcctggttcaaatatgcgagaagtacctgcccgggtattactcagaaaagctagaggccatacaattagatggggaaatcctcttcagtttactccagaaagtgtctcccgttgcccacaaacacttgagccggcagaagatcgaccctttactgtatatgacggagtggttcatgtgcgctttcagccgaactttgccatggtctagtgtcctgcgtgtgtgggacatgttcttttgtgaaggggtaaagataatctttcgagttggtctcgtgctgctcaagcatgcactggggtcaccagagaaggtaaaggcttgtcaaggacagtatgaaactatagagagactgagaagtctgtcacccaaaataatgcaggaagcattccttgtgcaggaagtggtggagctgccggttaccgagaggcagatagaacgggagcacctaattcagctacgtagatggcaggagacccgcggcgagttgcagtgccggtcacctccaaggctgcacggagctaaggcgattctggatgccgagcccggccctagacctgccctacagcccagcccttctatcagactgccgctggacgctcccctgcctgggtccaaggcgaaacccaaaccccctaaacaggcccagaaagaacaacgaaagcaaatgaaggggagaggccaattggagaagccacccgcacccaaccaggccatggtcgtcgcagcggccggcgacgcatgccctccccagcacgtgcctccaaaggattcggcccctaaagactccgcgcctcaggacctggcacctcaagtgagcgctcatcataggtctcaggagtctctcacttcccaggagtcagaggatacatacctgtag

SEQ ID NO: 137325 - DNA, 1548 bp, Artificial Sequence
  Description of Artificial Sequence: Synthetic coding sequence
atggccaagagcaacggcgaaaatggcccccgggcccctgctgctggagagagccttagtggcactcgggagagtctcgcacaaggaccggatgccgccaccaccgatgaactgagcagtctgggaagcgacagcgaggccaatgggtttgcagaaaggagaatcgacaaatttgggttcattgtgggaagccagggggccgaaggcgctccatgtcctttactccacagactcgaggaggttccccttgaggtgctcaggcaacgggagtcaaaatggctcgacatgttgaacaactgggataagtggatggcaaagaaacacaagaaaatccgcctgcgttgccagaagggaatccctccgagtctgcgggggcgtgcatggcagtacctgtccggtggaaaagtaaagttgcagcaaaacccggggaagttcgacgaacttgacatgtctccgggagatcctaaatggctggatgttattgagcgggacctacaccggcaatttccgtttcatgaaatgtttgtctctagaggagggcacgggcaacaggatcttttcagagtgctaaaagcttataccctgtatcgcccagaagagggttactgccaggctcaggcacctatagcagcggtgctgttaatgcacatgcccgcagaacaggcattctggtgtctggtgcagatctgtgagaaatacctgccaggttactattccgagaaattagaggccatccaactcgacggggagattctcttttctttgttacagaaagtctctccagtggcacacaaacatctgagcaggcagaagatcgaccccctgctttatatgacggagtggtttatgtgtgccttcagtcgcacgctaccctggagctccgtactacgggtttgggatatgttcttctgtgagggagttaagatcattttccgagtgggcctcgtgctgttgaaacacgccttgggttcccctgaaaaggtgaaagcatgccagggccagtacgagacgatcgagcggcttaggagcttgagccccaagatcatgcaagaggcttttttggtgcaggaggtcgtggagctcccggtaacggaaagacagatcgaacgcgaacacctaattcagctccgcagatggcaagaaactcgcggcgaactccaatgccggagccctcctcggctgcatggtgcgaaggctattttggacgccgagcccgggccccgaccagccctgcagccctctccgtccatcagattaccgctggacgccccgctgccaggaagcaaagcgaagccgaaacctccgaaacaggcacagaaggagcaaaggaagcagatgaagggcagaggacagctagagaagccaccggcacctaaccaagctatggtggtggcagcagcaggcgatgcctgcccgcctcaacacgtacctcctaaggacagtgctcctaaggactcagctccccaggatcttgccccacaagtgtcagcccaccaccgttctcaggaaagcctcacaagtcaggagtcagaggacacttacctgtag

SEQ ID NO: 137326 - DNA, 2427 bp, Artificial Sequence
  Description of Artificial Sequence: Synthetic coding sequence
atggaaactggtaccgccccacttgtagcccctcctagacgccatggtgcccccgccgcccctagcccccctcccaggggtagccgtgcgggaccggtcgtcgtcgtagcacccggcccaccagttaccacagctacaagcgcccccgtcacgctggtcgcccccggagaagcccgtcccgcctgggtgcccggaagtgctgaaacttccgctcctgcacctgcaccagccccagctccagcccctgccgtaacagggtcgacagttgtggtcctgacgctggaggctagccccgaggctcccaagccacagctgcctagcgggcccgagtctcctgaacctgcagcggtggctggtgtggaaacatcccgtgctctcgccgcaggagcggattcaccgaaaacagaggaggcgcgtccttctcccgcacccggaccaggaacgcctaccgggactccaacacgcactccctcgcgaactgctcccggagccttgacagctaagccaccgttggcacctaagcctgggaccaccgtggccagcggtgtgactgcacggagcgcctcagggcaggttacgggagggcacggtgctgccgccgctacaagtgcgtctgccggacaggctccagaggacccgtctggaccaggcaccggcccttcggggacctgcgaggctccggttgccgttgtgacagtgactccggccccagaaccagcggaaaactctcaggacttagggagcactagcagcctcggccccggtatttctggaccaaggggacaggcccccgataccctgagctatctggattcagtctctctgatgagtgggacattggagagcctggcagatgacgtgagcagtatgggaagcgatagcgaaattaacggtctggccctgaggaaaacggacaagtacgggtttctgggaggcagtcaatacagcggaagcttggagtcaagtatcccggtcgacgtggcgagacaacgtgaacttaagtggctcgacatgttctctaactgggacaaatggctgagcagacggttccagaaggtgaagttaaggtgtcggaaggggattccgagcagcctgagagccaaggcctggcaatatttgtccaatagcaaggagcttctcgagcagaatcctggcaaatttgaggaactggaacgcgccccaggggatcccaaatggttagacgtcattgagaaggatctccaccggcagtttccctttcacgagatgttcgctgctaggggcggccatggccagcaggatctgtacagaatactgaaggcctacactatctataggcccgacgaagggtattgccaggcgcaagccccagtagctgccgtcttgttaatgcatatgcccgcagaacaggctttctggtgcctcgtgcaaatctgtgacaagtaccttcctggctactattcagccggactcgaagccatacagctagacggggagatattcttcgcactgcttcgaagggcttctccacttgctcaccgccacctgcgcaggcagcggatagatcccgtactgtatatgaccgaatggtttatgtgcatctttgctagaaccctaccatgggcgtctgtcctgcgggtctgggacatgttcttctgcgaaggtgttaagataatcttccgagtagctctggttctactccggcacactctcggaagcgtcgagaagttgaggtcatgccaaggcatgtatgaaacaatggagcagctcaggaacttgcctcagcagtgtatgcaggaagactttctggtccatgaagtcacaaacctccccgtgacggaggccctcattgagagagagaatgcagcacagcttaaaaaatggcgggagactcggggtgagctacagtatagaccgtctagacggctgcacgggagtcgggccattcatgaggaaaggagacgacagcagcccccacttggtcctagttcatccctactatctcttcccgggttgaagtcacgcggatcaagagctgctggtggtgccccttcgcccccaccaccggtaagacgcgcctccgctggcccggcaccaggccccgtcgtgactgcagaaggtctgcacccttcccttccttctcctacagggaatagcactcctctgggaagtagtaaggaaactcgtaaacaggagaaagaacgacagaagcaggaaaaagagagacagaagcaagaaaaagaacgagagaaggagagacagaaacaagaaaaggagcgagaaaaacaggagaaggaacgggagaaacaggagaaggagaggcagaaacaagagaagaaggcccaggggaggaagttgtcccttcgccggaaagcagatgggcctcccggaccccacgatggcggggaccgcccctcagccgaagcccgtcaggacgcatacttctag

SEQ ID NO: 137327 - DNA, 1341 bp, Artificial Sequence
  Description of Artificial Sequence: Synthetic coding sequence
atggcgcaggcactcggcgaggacctggtgcagccacccgaattgcaagatgactcctcgtctctgggttcagactctgaactcagcgggcctggaccataccgacaagccgataggtatggttttattggcggaagctctgccgaacccggacccggacatcctccagctgacctgataagacagagagagatgaaatgggtggagatgacctcccactgggaaaaaacaatgtctcgcagatacaaaaaggtgaagatgcaatgtagaaagggcattccaagtgcactccgggctaggtgctggcctctcctctgtggagctcacgtctgtcagaagaactcgcccggtacctaccaggagcttgctgaggcacccggagatccacagtggatggaaacgatcggacgtgacctccatagacaattccccctgcatgaaatgtttgtgtctccacaaggccatgggcagcagggtctattgcaggtcttgaaggcatacaccctttatagaccagagcagggatattgccaggcacagggaccagtcgctgctgtcctgcttatgcatctgcctcctgaggaggccttttggtgtctagtccagatttgcgaggtctatttaccaggatattacggacctcacatggaagccgtcaggctggatgccgaagtcttcatggcattgctgcgaagactgttgcctcacgttcataaacatctgcagcaggtaggagtaggtcccctcttatacctgccggagtggtttctctgtttgtttgcccggagtctcccatttcctacagtgttgagagtgtgggatgcattcctgtcagaaggcgccagagtcttattcagggttggacttactctcgtgagactggcgctggggaccgccgagcagagaggcgcctgccctggacttctggaaaccctaggcgccctaagagctatccccccagctcaactgcaagaggaggcctttatgtctcaggtgcatagtgtcgtgctaagcgagcgggatctgcagagagaaatcaaggcacagttggcccaacttcccgactctgcccccggcccccctcctcggccccaggttcgtctggctggcgcccaggcaatcttcgaggcacaacagctggcaggcgtacgtcgaggagctaagccagaagtacctcgcattgtcgtgcaaccgcccgaggagccccgccccccacgtcgaaagccacagacaagagggaagactttccatggcctcttaacgagggcccgcggcccacccatagagggaccccccaggcctcagaggggatctacgagttttctcgatacgcggttttag

SEQ ID NO: 137328 - DNA, 1341 bp, Artificial Sequence
  Description of Artificial Sequence: Synthetic coding sequence
atggctcaggccctcggagaggatcttgttcagccccctgaacttcaggacgactcaagctccctgggatctgactcagagctctcaggcccggggccttaccggcaagctgacagatatggtttcatcggaggcagcagcgccgagccaggaccaggacatcccccagcggatttgatcagacaacgggagatgaagtgggtcgagatgacgagtcactgggagaagaccatgagccgtaggtacaaaaaggtgaaaatgcagtgtcgcaagggcatcccaagtgcactgagggctaggtgttggccactgctgtgtggtgctcacgtttgtcaaaaaaattcccctggcacttaccaggagctagcagaggcacccggggaccctcagtggatggagacaatcggcagggacctgcaccgccaattcccactgcacgagatgttcgtgagtccacaggggcacggacaacagggactgctgcaagttcttaaggcctataccctttatcggccagaacagggatattgtcaggcacagggccccgtggcagccgtgttacttatgcacctgccccccgaggaggcattttggtgcttggtgcagatttgcgaggtgtacctgcccggctattacggccctcatatggaggccgtgcgcttggatgccgaggtgtttatggcactgctgcgtcgactcctgcctcatgtccataaacacttgcagcaagttggcgtggggccactgctttatctgccggaatggtttctctgcctgtttgcaagatctttgccttttccaacagtactgagagtttgggacgccttcctgtctgagggggccagggtcctctttagagtcggactgacgctagtgcgcctggccctcgggactgccgaacagagaggagcatgccccggtctgctcgagaccctgggagccctgagagccattccccccgcccagctgcaggaggaagcattcatgtctcaagtgcatagcgttgtactcagcgaaagggatttgcagcgagagatcaaagcacagcttgctcaactcccagacagcgcgcctggtccgcctcctagacctcaggtccggctggctggagctcaagccatattcgaggcacagcaactagctggtgtgcgcaggggagccaaaccagaggtgcctaggatcgtcgtgcagccaccagaggaaccgcggcccccaagacgcaaaccccaaaccaggggcaaaacatttcacggtcttctgaccagagcacggggcccccctattgaggggccgccaagaccccaaagaggatcaacctcattcctggacacgaggttttag

SEQ ID NO: 137329 - DNA, 2049 bp, Artificial Sequence
  Description of Artificial Sequence: Synthetic coding sequence
atgtgtccaggactctacccatatagctctttgcttgaatacggacgttccatgatcatttatgaacaggaaggcgtgtatatccacagctcctgcggcaagactaacgaccaagatggcctgatatcaggcatactccgggtgctcgaaaaggacgccgaagtaattgttgactggcggccactagacgacgcgctggacagttcatcaatcctctacgccagaaaggactcaagtagcgtggtcgagtggactcaggcaccaaaagaacgcggacatcgaggatcagaacatttgaattcttatgaagccgagtgggacatggtgaacaccgtgagctttaagcgcaagccacacactaatggggatgcaccatcccatcgcaatgggaagtccaagtggtctttccttttttcactgacagatttaaagagtattaagcagaataaggaagggatgggctggtcctacttggttttctgtctgaaagacgacgtggtgctgcccgcactccacttccaccaaggtgattcaaaactcctcattgagtctctggaaaaatacgtggtgctgtgtgaatcccctcaggacaaacgcaccttgctggtcaactgccaaaataaatcactaagccagtcttttgaaaatctgctggacgagcccgcctacgggcttatacaaaaaattaaaaaggatccttatacggcgacaatgattggcttcagcaaagtgacaaactacatttttgatagcctgcgtgggtcagatccttccacccatcagcgaccccctagtgagatggccgatttcttgtcagatgcgatccctgggctcaagattaaccaacaggaagagcccggcttcgaggtgattacgaggatagacctaggcgagcgtcccgtggtgcaacgccgggaacctgtatctcttgaggagtggacaaagaacatcgatagcgaaggtcgaatcctaaatgtagacaatatgaaacaaatgatcttcaggggcgggctgagccacgccttgagaaagcaggcatggaagtttcttctcggctactttccctgggattccacaaaagaggaaagaacgcagctgcagaaacaaaagaccgatgagtacttcagaatgaaactgcagtggaaatccattagccaagagcaagaaaagcggaattcacgtctgagagactatcgttctttgatcgaaaaggacgtgaatcggaccgaccgcaccaacaaattctatgaagggcaggacaatccaggcctgattctgcttcatgatatcttaatgacatactgtatgtatgattttgacctagggtacgtccaaggcatgtccgacttgctgtcgcccctgttgtatgtaatggagaatgaggtggatgctttctggtgcttcgcatcctatatggatcagatgcaccagaactttgaagaacagatgcagggaatgaaaacgcagctaatccagttgtctactctcctccggctgctcgacagcggattctgctcatacctcgagagccaagacagtggctatctgtacttttgcttccggtggctgctgatccggtttaaacgggaattctccttcctggatattctaagactgtgggaggtgatgtggacagaactcccctgcacaaattttcacttgttattgtgttgtgctatactcgaaagtgaaaaacagcaaattatggagaagcattacggcttcaacgaaatccttaagcacattaacgagctctctatgaaaattgatgtcgaagacatcctttgtaaggcagaagcaattagtctgcaaatggttaaatgtaaggagctcccccaagcagtatgtgaaatcctgggactgcagggctcagaggtgactacaccggactctgacgttggagaggacgaaaacgtggttatgaccccttgtcctaccagcgctttccaatccaacgctttacccacactgagcgcgtctggcgctagaaatgattcccccactcaaatcccggtgtcctccgatgtgtgccggctgacaccagcctag

SEQ ID NO: 137330 - DNA, 1338 bp, Artificial Sequence
  Description of Artificial Sequence: Synthetic coding sequence
atgataggcttctccaaagtcacgaattacatcttcgactccctccggggtagtgatccgagcacacaccagaggccccctagtgagatggctgatttcctctctgatgctatacccggtttgaagattaaccagcaggaggaaccagggttcgaggtgattacccggatcgacttaggagagaggcccgttgtgcaaagaagagaacccgtgtcgttagaggagtggacaaagaacatcgatagcgaaggtagaatcctcaatgtagataacatgaaacaaatgattttcaggggggggctcagccacgcactgagaaagcaagcatggaagttcttactgggctactttccttgggacagtactaaagaggagcgaacccagctgcagaaacagaaaaccgacgagtatttccgaatgaagcttcagtggaagagcatttcacaggagcaagagaaaagaaattcccggctccgcgactatagatctttgatcgaaaaggacgtgaaccggaccgataggacaaacaagttctacgaggggcaggataaccctggccttattcttctgcatgacattctaatgacgtattgtatgtatgactttgatctggggtacgtgcagggaatgtctgatttgctgtctccactgctctatgtgatggaaaatgaggtcgacgcgttttggtgtttcgcatcatacatggatcagatgcatcaaaatttcgaagagcagatgcagggaatgaagacccaactaatacaactctctactctcctgcggcttctggactctggcttttgttcttatctcgagtctcaggacagcggatatctttatttttgttttagatggctgcttatccggttcaaacgcgaattttcattcctcgacatcctccgcctctgggaagtgatgtggactgaacttccctgtactaatttccacctgttgctttgttgcgctatcctggaatcagagaagcagcaaatcatggaaaagcactacggctttaatgaaattttgaagcacatcaatgagctgagcatgaagattgacgtggaagatattttgtgtaaggccgaggccatctcccttcagatggtgaaatgtaaagaactgccccaggcggtctgcgagatccttggcctgcagggatcagaagtgacaacacccgatagcgatgtcggagaagacgaaaatgtagtgatgacaccttgcccaacgtctgcattccagagcaatgccttgccaacactttccgcctccggcgccagaaacgattcccccacacaaatcccggtgtcgtccgacgtttgccgcctgaccccagcctag

SEQ ID NO: 137331 - DNA, 2025 bp, Artificial Sequence
  Description of Artificial Sequence: Synthetic coding sequence
atggctgccgctggagtagtgtcaggtaagatcatctatgagcaggaaggagtctatatccactcaagttgcggcaagaccaacgatcaggatggcctgatttctggtatccttagggttctggagaaggatgctgaggtcatcgtcgattggcgccctcttgatgatgctcttgacagtagttcaattttgtacgctcggaaggactctagctctgtcgtggagtggacacaagcccccaaggaacggggccatagaggctcggagcacttaaatagctatgaggccgaatgggacatggtgaacaccgtctcattcaagcggaagccacacactaacggtgatgcgccttctcacagaaacggtaagagtaagtggtcatttctcttctcccttacagacttaaagtccattaagcagaacaaggagggaatgggctggtcatacctcgtcttctgtctcaaggacgacgtcgtactgcccgccctgcactttcaccagggcgattcaaagcttctcatcgagtctcttgagaagtacgtggtgctgtgtgaatctccacaggataaacgaactctgttggtcaattgtcagaacaagagcctgtcccaatcattcgaaaacctcttggatgagccagcttatgggctcattcagaagatcaagaaggatccatacaccgccaccatgataggcttcagcaaggtcaccaattatatttttgactccctgcgcgggagcgacccttctactcatcaaaggcccccgagcgagatggcagactttctaagcgatgccatccccggtctgaagatcaaccaacaggaggagcctggttttgaagttatcactaggatcgacttaggagagaggccagtagtgcagagacgcgagcctgtgagcctggaagagtggaccaaaaacatcgacagcgaaggccgaattttgaacgtagataatatgaaacagatgatttttagaggaggtctctcccatgccctccggaagcaagcgtggaagttcctgctgggatattttccctgggacagcaccaaagaagaaagaactcagctgcaaaaacagaagaccgacgaatatttccgtatgaagctgcagtggaagagtatatcccaggagcaggaaaaaaggaactcaagactgcgtgattaccgttcattaattgaaaaggacgtgaatcgtactgaccgaactaacaagttctacgaggggcaggataatccgggactaatccttttgcacgatatcttaatgacctactgcatgtatgatttcgacctcggctacgtacagggaatgtctgacctgctgtcccccttactgtatgtcatggaaaatgaggttgatgccttttggtgtttcgcttcctatatggatcagatgcaccaaaacttcgaagagcagatgcagggcatgaagactcagctcatccagctaagcacgcttctccgtctactggattccggattttgttcatacctggagagtcaggactctggctatctgtacttctgcttcagatggcttttaatacggtttaagagagaattcagctttttggacatcttgagactgtgggaggtgatgtggacagagctgccctgtacaaactttcatctccttctctgctgtgccattttggagtcggaaaagcaacaaatcatggagaagcactacggtttcaacgaaattctgaaacacataaacgagcttagtatgaaaatcgatgtggaggatattttgtgcaaagccgaagcgatatccctgcaaatggtgaagtgcaaggaactcccgcaggccgtatgcgagattttgggactgcaggggagtgaggtgactacacccgacagtgatgttggagaggatgaaaatgtcgtgatgactccatgccctacctcagccttccaaagtaacgcgctaccaactcttagtgcctcaggagctcggaatgactcacccacacagatccctgtgtcttcagacgtgtgtaggctaactcctgcctag

SEQ ID NO: 137332 - DNA, 2076 bp, Artificial Sequence
  Description of Artificial Sequence: Synthetic coding sequence
atggctgctgcgggcgtggtatcaggcaagattatctatgaacaggagggggtgtatatccacagctcatgtggcaagacgaacgaccaagacggcttgattagtggcattctgagagtactggagaaggatgccgaagtgattgtcgattggagaccattggacgatgctctggactcttcctcaatcctttacgcgagaaaggactcctcctccgtggtagagtggacgcaggctccgaaggaaaggggccaccgcgggtccgagcatcttaattcctatgaggcagaatgggatatggttaatacagtgtccttcaaaagaaaaccacataccaatggcgatgccccctcccataggaatggcaagtcaaagtggtccttccttttctctctgactgacctgaaatctataaagcagaacaaggagggcatgggttggagttacctggtgttttgcctcaaagatgacgtcgtgctccccgcgttacacttccaccagggcgatagcaaactactgatcgaatctctcgagaaatacgttgtactgtgtgaaagcccccaagacaagcgtactctccttgtcaactgtcagaataaatccctctcccaatcttttgagaatctactagacgaaccagcctacggccttattcaagctggcctcctggatcgtaggaaacttctttgggctatacaccattggaagaaaatcaagaaggatccatacacagcgacgatgatcggatttagtaaggtcacaaactatatcttcgattccttgaggggaagtgatccaagcacacaccagcgccctccatcagaaatggccgattttctgagcgatgctatcccgggtctcaaaatcaaccaacaggaagagcccgggtttgaggtgattacacgaatagatctcggagaacgtccagtggttcagcggagagaacctgtgtcactcgaggaatggactaagaacatcgattccgagggccggatcctgaacgtggataacatgaaacagatgatctttcgagggggactctcccacgccttaagaaagcaggcatggaagttcctgctgggatatttcccttgggattctacaaaggaagagcgaactcagctccagaagcagaaaacggatgagtactttcggatgaagctgcaatggaaaagtatttcacaggagcaggagaagagaaatagtcgcttgagagattatcgaagcctgatcgaaaaagatgtcaacaggaccgacaggaccaacaagttttacgaggggcaggacaacccggggctaattctgctacatgatattttaatgacatactgcatgtatgactttgatctgggctacgtgcagggaatgtccgacttattatcccctcttctgtatgtaatggagaacgaggtggatgccttttggtgtttcgcgtcatacatggaccagatgcaccagaatttcgaagagcagatgcaagggatgaaaacgcaactgattcagttgtcaaccttgctaaggttactggactctggattttgctcttatctagaatcacaagacagtggctatttatacttctgttttaggtggcttcttatccggttcaaacgcgagttttcattcctagacatcttgcggctttgggaggtaatgtggaccgagctgccgtgcacgaacttccatctgctcctttgttgcgctatcttggaaagcgagaaacagcaaatcatggaaaaacactacggctttaatgagattctgaaacatatcaacgagctttcaatgaagatcgacgtagaggacatcctgtgcaaggccgaggccatttctctgcaaatggtgaagtgcaaagaactgcctcaggccgtctgtgagatccttgggctccagggcagtgaagtcactacgcccgattccgacgtaggggaagatgagaatgtggtgatgactccctgccctacttcggccttccagtccaacgccctaccgaccctgagtgcgtccggggcgcgcaatgactctccaactcagattccggtgtccagtgacgtctgtcgacttacaccggcttag

SEQ ID NO: 137333 - DNA, 2133 bp, Artificial Sequence
  Description of Artificial Sequence: Synthetic coding sequence
atgcacaatatcaggggcaataagcaggcgcaggggacgggtcacgaaccgccaggagaggacagtcctcaaagtggagagccgcagcgggaggagcagccactcgcaagcgacgcttccacaccagggagggaacccgaggacagcccaaagcccgccccgaaacccagcttaacgatcagcttcgctcaaaaggcgaaaaggcagaacaatacatttcccttcttcagcgaaggaattaccaggaacaggactgcacaggagaaggtggcagctcttgagcagcaagtgcttatgttgacaaaagagctaaaatcccagaaagaactggttaagatactacacaaggccttagaagcagcgcagcaggagaaacgcgcctccagcgcctacctggccgcggcagaagataaggaccgtttagaactggtgcggcacaaagtccggcagatcgccgagctcggtaggagggtggaggccctcgaacaggaaagggaaagtctagcacacacggctagcctgcgggaacagcaggttcaggagttgcaacaacacgtgcaactactgatggataagaatcatgcaaaacagcaggtaatttgtaagctttccgaaaaggtgacacaggatttcacccatccgcccgatcagagtcctttacgtcccgatgccgcaaaccgggactttctgagccagcagggcaagatcgaacacctgaaagacgatatggaggcatacaggactcagaattgcttcctgaactcggaaatccatcaggtgactaagatatggcgaaaagtggctgagaaagaaaaagctctgctgactaagtgtgcatacttgcaggcaaggaattgtcaggtggagagtaagtatctggccggtttacggcgcctccaggaggctcttggagatgaggcttctgaatgcagtgagctcctgaggcaactggtccaggaagctctccagtgggaggcaggcgaagcttcaagcgacagtattgaactaagtcctatcagtaaatacgacgaatacgggtttctgactgtacctgactatgaggtggaggatctgaagttgcttgcaaagattcaggcattggaatcacgaagccatcatttactcggactggaggccgtagatcgaccactgcgtgagagatgggctgctctgggcgatctggtcccttccgccgagctcaaacagctgctgagagcaggggttcctcgagagcacagaccccgggtttggcggtggctagttcacctgcgtgtgcaacacttacatactccaggatgctaccaggaactcttatccaggggacaagctagagagcacccagctgctagacagatagagctggacttgaataggaccttccccaacaacaaacactttacttgtcccacctcctcttttcccgataagcttagacgagtcctactggctttctcctggcagaaccctacaatcggctactgccaagggctgaataggctcgccgcaattgccctcctagttctggaggaagaagagagtgccttctggtgcctggtagctatcgtggagactatcatgcccgccgactattattgcaataccctaacggcatcacaggttgatcaacgggtcctgcaggacctgctctccgagaagcttcctcggttgatggctcacctgggccagcaccatgttgacctgtccctggttaccttcaactggttcctagtcgtcttcgccgactctctgattagcaatattctcctccgggtgtgggatgcttttttatacgagggcacaaaggtcgtgtttcgttacgccttggcgatattcaaatataatgagaaggagattctcaggctacaaaacggtctagaaatttatcagtacctcaggttttttactaagactatcagtaattctcggaagctgatgaacattgcgtttaacgacatgaaccccttcaggatgaaacagctgaggcagctgagaatggtacatagagagcgcctggaggccgagttacgagagttggagcagctgaaagccgaatatctggaacgtcgcgcgtcccgcagacgggctgtctctgaaggctgcgctagcgaggatgaggtcgagggagaagcctag

SEQ ID NO: 137334 - DNA, 1407 bp, Artificial Sequence
  Description of Artificial Sequence: Synthetic coding sequence
atggaggcctaccgcacccaaaattgcttcctgaattcggaaattcatcaggttactaaaatttggcgaaaagtagctgagaaagagaaggctcttcttaccaaatgcgcatacctgcaggctaggaattgccaggtggagtcaaaatatctcgccgggctgcggagactacaggaagcgctgggagacgaggcttccgagtgcagtgaactgcttaggcagctggtgcaggaggctctgcagtgggaagccggcgaagctagcagcgattctatcgaactttcccccatcagcaaatatgacgaatatgggtttcttacagtgcccgactatgaagtcgaagatttgaagttgttagccaaaattcaggccctggagtcacggtctcaccatctattgggtttggaggctgttgacagacccctcagggagcgttgggcggcgctgggcgacctcgtccccagcgctgaattgaagcaactgcttcgcgccggggtgccccgggaacaccggccccgcgtgtggcgttggcttgtgcatcttagagtgcagcatctccatacgcctggatgctaccaagaactgctgagcagaggccaggctcgggaacatccggccgcacgtcaaattgaactggatctcaatcgaacttttcccaataataaacatttcacttgtcccactagttctttccccgataaactcagacgagtactgctggcattctcatggcagaaccctaccatcggatactgtcagggcctgaatcggcttgctgcaatagccctgcttgttcttgaagaggaagagagcgctttttggtgccttgtcgccattgtggaaactatcatgccggcagactactactgcaacacattaactgcttcccaagttgatcagcgcgttttacaggatctgctttcagagaaactgccaagattgatggcccaccttggccagcatcatgtagacctgtctctggtgaccttcaactggttcctagtagtttttgccgattctctgatctcaaatatcttactgcgcgtgtgggacgccttcctctatgagggcacaaaagtggtctttagatacgcactggcgatattcaagtataatgagaaagagattttacggctgcagaatgggctggaaatctatcagtacctccggttttttacaaaaaccatctctaattcgcggaagctgatgaacattgccttcaatgacatgaatccctttagaatgaagcaactgagacaattacggatggtgcacagagaacgccttgaagctgaactgcgggaactcgagcagctgaaggcagagtacctggagcggcgggcaagccggcggcgcgcagtctccgagggctgtgcctctgaggatgaagtggaaggcgaggcctag

SEQ ID NO: 137335 - DNA, 2583 bp, Artificial Sequence
  Description of Artificial Sequence: Synthetic coding sequence
atggaaggggcgggagaaaatgcacccgaatcgtcatcaagcgcccccggctcagaagagagcgctcgtgacccgcaggttcctccaccggaggaggagtccggcgattgtgcacggagtctcgaagccgtgccaaaaaaattgtgcggttatctctccaaattcggtggaaaaggcccaatccgggggtggaagtcaagatggttcttctacgacgaaaggaaatgtcaactgtattattcaagaactgctcaggatgctaatccacttgattctatcgatttgagctcggcagtcttcgactgtaaggccgacgccgaagaaggcatctttgaaatcaagactccttcacgagttattacgctgaaagcagccacgaaacaggcaatgctgtactggctccaacagctccagatgaagcggtgggaattccataacagcccccctgccccacccgccacgccagatgccgccctggccggcaacggtcctgtgctgcatctggagctgggccaggaggaagcagagctggaagaattcctctgtcccgtcaagacccctccaggactggtgggagttgcagccgctttgcagccttttccagccttacagaacattagcttgaagcatctgggtacggaaatacagaacacgatgcacaacatccggggcaataaacaagctcaaggcactggacacgaacctccgggagaggacagcccccaatcaggggagccccagcgagaggagcaacccctggcatcagacgcttctaccccagggcgggagccagaagattcccctaaacctgcccccaagccgtcactgacaatatcctttgcccagaaggccaagcgtcagaataatacattcccctttttctctgaggggattacgaggaatagaaccgcccaggaaaaggtagccgctctggagcagcaggtgttgatgctgactaaggagctcaagagtcagaaggaactcgtcaaaattctccacaaggctctggaagccgctcagcaggaaaagcgcgcttcctctgcataccttgctgccgcagaggataaggacagactggaattggtccgacataaagttcggcagatagctgaactgggcagaagggttgaagcactggagcaagagcgcgagtcgcttgcacatacagcttccctgcgggagcagcaggtccaggagctccagcagcacgtgcagctgctcatggacaaaaaccacgcgaagcagcaggtgatctgcaaattgtcagaaaaagtaacgcaagacttcactcatcctcccgaccagtcaccattgaggcctgatgctgccaacagagattttctgtctcagcagggaaagatcgagcacttaaaagatgatatggaagcctataggactcagaattgctttcttaattctgaaatccaccaggtgaccaaaatctggcgcaaagtggctgagaaggagaaagcactcctgacaaagtgcgcctacctgcaggcccggaactgtcaggttgagagcaaatatcttgcaggcttgaggagactgcaagaggctctgggcgacgaagcctcagaatgctctgagctgttgcgacaactagttcaggaagccctgcagtgggaagccggagaggcaagctccgactccatcgaactcagcccaatctcaaagtacgacgagtacggctttctaaccgtgccggattatgaagtggaagatttaaagctgctagctaagatccaggctcttgagtcacgatcacaccatctgctcggcctggaagctgtagatcggcctctgcgagaaagatgggctgctctgggtgatctggtacctagcgcagaattaaagcaactgcttagggccggtgtccctcgcgaacacaggccgcgtgtttggaggtggctggttcacctcagagtccagcatttgcacaccccgggatgctaccaggaactattgtcccgggggcaggccagagaacatcccgcagcccgtcagatcgaattggatctcaataggacattccctaataacaagcactttacctgtcctacgtcaagtttccccgataaacttagaagagtgctgctggccttttcgtggcagaatcctaccattggatattgtcagggattgaatagactggccgccatagctcttctcgtgctggaagaggaggagagtgccttctggtgtcttgtggctattgtggaaacaatcatgcccgccgattattattgcaacacactgacagcctctcaggtggaccagagggtcctccaagacctgctttccgagaagctgccacggctgatggctcacctgggccaacaccacgttgacctctctttggttactttcaactggttcctcgtggtgttcgcagactcccttatcagtaatattcttctgcgagtttgggatgccttcctatatgaaggtacaaaggtagtatttcggtacgctctagcaatcttcaagtacaacgaaaaggagattttgagattgcaaaatggcctcgaaatctatcagtatctccgcttcttcacaaagaccatcagtaatagccgctag

SEQ ID NO: 137336 - DNA, 2754 bp, Artificial Sequence
  Description of Artificial Sequence: Synthetic coding sequence
atggagggcgctggcgagaatgcccccgagtcctcatcttccgcacctggatctgaagagtccgctagggatcctcaggttccacccccggaggaagaaagcggagactgcgcacgatcactggaagctgtacccaagaaactgtgtggctacctttcgaagttcggtggaaaaggccctatccgagggtggaagtctaggtggtttttctacgacgaaaggaaatgtcagttgtattactctcggaccgcccaagacgccaacccactagattccatcgaccttagtagtgctgtcttcgattgcaaggccgacgccgaggaggggatcttcgagataaagaccccttcccgagtgataacgctgaaagctgccacgaagcaagcgatgctgtactggttgcagcagcttcagatgaaacgatgggagttccataattcacccccagctcctcctgctacccccgacgccgcgctggcgggaaacggccccgtccttcacttagaattgggccaggaagaggccgaactggaagaatttttatgtccagtgaaaaccccacccggtctggtgggagttgctgcagccctccaaccatttccagctctgcagaacatctctcttaaacatttgggcacagagattcagaatacgatgcataacattagggggaataaacaggcccaaggtactggtcacgagcctccgggcgaggattcccctcaatctggtgagcctcaacgtgaggaacaaccactggccagtgacgccagtacccctggccgtgaacccgaagactcccctaagcctgcccctaaaccaagtttgaccatctcatttgcgcagaaagccaagcggcagaacaacacattcccattttttagtgaaggtatcacccggaacagaacggcccaggagaaagtcgccgcattggaacagcaagtcctaatgctgaccaaggagctgaaatcccagaaagaactcgtcaagatactccataaggctctcgaagccgctcagcaggaaaaacgcgccagtagtgcctatttggctgccgccgaggataaagatcggctggaattagtacggcacaaggtcaggcaaattgcagagctcggccggcgtgtggaagcccttgaacaggagagggagtccttggcccataccgcttctttgagagaacaacaagtgcaggagcttcaacagcacgtacagttgctgatggacaaaaatcatgctaagcagcaggtgatctgcaagttgtctgagaaggtgacacaggatttcacccaccctccagatcagagcccacttcgtccggacgccgctaatagggatttcctgtcccagcaaggaaagattgagcacctgaaggacgacatggaagcctataggacccagaattgtttcctgaatagcgaaattcaccaggtgacgaagatatggcgcaaggtcgcagagaaagaaaaagcgcttctgacgaagtgcgcctatctccaggcacggaactgtcaggtagagtccaaatacctcgctgggctgaggcggctccaagaggccctgggggacgaggcttccgagtgttccgagctcttgcggcagcttgtccaggaggccttgcagtgggaagctggggaagcctcttccgactccatcgagttaagcccaatctcaaagtacgatgagtatggattcctaactgtgccggattacgaagtagaggacctcaagctcttagctaagatccaagctttagagtcccggtcacatcaccttcttggccttgaggctgtagaccgccctctaagggaaaggtgggcagccttaggagatctagtgccaagtgcagaacttaaacagctcctgcgggctggagttccaagagagcaccgcccacgggtgtggcgctggctcgtccaccttcgcgtgcagcacctgcacacacctgggtgttaccaggaactgttgagtcgaggccaggctcgcgagcatccagcagctcggcaaatagaactggatctaaacaggacctttcctaataataaacattttacatgtcctacgtctagcttccccgataaacttagacgggttctgcttgcatttagttggcagaacccgacaatcggttattgccagggactaaacagactggccgccatagccctgcttgtactggaagaagaagagtcagctttctggtgtctggttgcaattgtagaaacaatcatgccagctgattattactgtaacacgctgactgcttcccaggtggaccagagagtgctgcaggacctgttgtctgagaagctcccgcggttgatggcgcacctgggacagcatcacgtggacctctcgttggtcacctttaattggttcctggtagtattcgcagactctctaatttctaacattttgctgcgcgtatgggacgcttttctgtatgagggcacgaaatacaatgaaaaagaaatcttgagacttcagaacggtcttgaaatctaccaatacctgagattctttacaaagaccatcagtaattcccgtaagctgatgaatatagcattcaacgacatgaacccgtttcgtatgaagcagcttcggcaactcagaatggttcacagagaaaggctggaagctgagctcagggaactagagcagctgaaagctgaatacctggaaagacgtgccagccgtcggagagccgtctctgaaggctgtgcttcagaggacgaggtggagggggaggcttag

SEQ ID NO: 137337 - DNA, 1287 bp, Artificial Sequence
  Description of Artificial Sequence: Synthetic coding sequence
atgccaagtggttgttatgtgcctaggagcgaaccccgcctgctgccagcaccaccaccggcgggagcccgggtgggggcactgcgctcagctcaaggtgacgggcctacctctgggcactgggatgggggagcagaaaaggctgattttaacgctaagagaaaaaaaaaggtggctgagatccaccaagcgctcaattcagatcctacggatgtcgcggctctccgaagaatggcgatctcagagggaggtcttttaactgacgaaattaggcggaaagtgtggcccaagctgctaaacgtgaacgccaacgacccccctcctatctcaggtaaaaatctgcggcagatgtccaaagattaccagcaggtcctgcttgacgtccgccgctcccttaggagatttccccctggcatgcctgaggaacagcgcgagggcctgcaagaggagttaatagatatcattttactaatcctcgaaagaaacccgcagctgcattactaccaggggtatcatgacattgttgtaacctttctgcttgtggtcggcgagcgtctggcgacctcactggtggaaaagctttccacccaccacttgagggacttcatggaccctaccatggataacacaaaacacattctaaattatctgatgcctatcatcgatcaagtcaatccagagctgcacgattttatgcagtctgctgaggtcggaacgatcttcgcactctcatggcttataacctggttcggtcatgtgctcagcgacttccggcatgtggttcggctgtacgatttcttcctggcctgtcaccctctgatgcctatttacttcgccgcggtcattgtcctctatagagagcaagaagtcctggattgcgactgcgacatggctagcgttcaccacttgctgtcccagatccctcaagacctcccatatgagacacttatctcaagagccggcgacctttttgtgcagttcccaccaagcgagcttgctcgcgaagccgctgcgcaacaacaagctgagaggacagctgcgtctaccttcaaagattttgagttggcctctgctcagcagcgaccagacatggtgctgcgccaaaggtttcgcgggcttcttcgccctgaggacaggacaaaggacgtcctcactaaaccccgcaccaacagatttgtgaaactcgctgtcatggggctaacggtggccctgggcgcggctgcgttagccgtggtaaaaagcgccctagagtgggctccaaagtttcagctgcagctgtttccatag

SEQ ID NO: 137338 - DNA, 1212 bp, Artificial Sequence
  Description of Artificial Sequence: Synthetic coding sequence
atggcactgcgatcagctcagggagatggtccaacttctggccactgggacggaggggcagaaaaggccgacttcaatgctaagagaaaaaagaaggtggctgagattcatcaggccctcaacagcgaccccaccgacgtggctgccctgcgacggatggccatcagcgaaggcggtctgctgactgacgaaatcaggagaaaagtctggcccaagctcctgaacgtaaacgcaaatgatcccccccctatctcagggaagaacctgagacaaatgtctaaggactaccagcaggtgctgctggatgtcaggcgctcccttcgaagatttccacccggcatgcctgaagagcagagagagggtttgcaggaggagctgatcgacatcatcttgctaatccttgagcgtaaccctcagctccactactaccaggggtaccacgatattgttgtgacttttcttctggtagtcggagagagactggccacctccctagtagaaaaactcagcacgcaccacctaagggactttatggatccaacgatggataacacaaagcatatcctcaactatctaatgcccatcattgatcaggtgaacccggagttgcatgacttcatgcagtccgcggaggttggaacaatctttgcactgagttggttaatcacttggtttggccatgtcctgagcgacttcaggcacgtggtgaggctgtacgactttttcctggcatgccaccccctgatgccaatctatttcgcagcggtgatcgtgctgtaccgcgagcaggaggttctggactgcgactgcgacatggcaagcgtccaccatttgctgtcacaaatccctcaagatctcccttacgaaacacttataagtagagccggggacctgtttgtccaattccctccgagcgagttggctcgcgaagccgcagcacagcagcaagccgaacggactgcggcttccacgttcaaggacttcgaactcgcctcagcccagcaaaggcctgacatggtcctccgccaaaggtttagaggcctgctccgcccggaagaccgaacaaaggacgtgctgacaaaaccccgaacaaatcgttttgtgaagctggcagtaatgggactgacagtcgcgctgggcgccgccgctctggctgttgtcaaaagcgcattagaatgggcccccaaatttcagctgcaactctttccatag

SEQ ID NO: 137339 - DNA, 1212 bp, Artificial Sequence
  Description of Artificial Sequence: Synthetic coding sequence
atggctctgcggtcagcccagggtgatggaccgacatccggccactgggacggcggagcagaaaaagctgatttcaatgcaaagagaaaaaaaaaagtggctgaaatccaccaggctctgaattcggaccccacggacgtcgctgccctgcgtaggatggcgatttcagaggggggactactgacagatgaaatccgaaggaaggtgtggccaaaactgctgaacgtgaatgctaacgacccccctcctatttcgggcaagaaccttcgccagatgtccaaggactaccagcaggtgctgttggacgtgcgtagaagcctgagacggttcccccccggaatgcctgaggagcagagggagggcttgcaggaagagctcatcgacattatccttctaatcctggagaggaatccacaactgcattattatcagggctaccacgacattgtcgttacattcctgttggttgtgggcgagcggctggccacctccctcgttgagaaactatcaacccatcatctgagagatttcatggaccctaccatggataataccaagcatattttgaattatctgatgcctattatagatcaggtgaatcctgaactgcatgactttatgcaatcggccgaggtgggcacgattttcgcccttagttggttgatcacatggtttgggcatgtgctgagcgacttccgtcacgttgtgcggctgtacgattttttccttgcctgccaccctctgatgcccatctatttcgccgctgtaatagtgctgtacagagaacaggaggtcctcgactgtgattgcgatatggccagcgtccaccacttgctgtcgcagattcctcaggatctgccatacgagactctgatctcgagggctggggatctgttcgtgcaattcccacctagtgagctggcacgggaagcagcagcccagcaacaagcagagagaacggctgcatcgacgttcaaggactttgagttggcctctgcacaacagcgcccagatatggtactgaggcagaggttccgaggcctgctccgcccagaagacaggacgaaggacgtcctgaccaaacctcgtaccaaccgctttgtaaaacttgccgttatgggactcacagtggcgctgggtgccgccgcgcttgccgtcgtcaaaagtgccctagagtgggcccccaagttccagcttcaactttttccttag

SEQ ID NO: 137340 - DNA, 1662 bp, Artificial Sequence
  Description of Artificial Sequence: Synthetic coding sequence
atggacagccccgggtacaactgttttgtggataaagataagatggatgcagctattcaggatctcggccctaaggaactctcgtgcacagagctgcaggaacttaaacagttagctcgacaggggtactgggcacagtcccacgctctgcgtgggaaagtgtatcagagattgatccgcgacatcccttgtagaaccgtgaccccggatgcgagtgtctatagtgatattgtaggcaagattgtcggcaagcactcctccagctgtcttcccctaccggaatttgtcgacaatacccaagtcccgtcatattgtctgaacgcgcgaggagaaggtgcggtgcgtaagatattgctgtgtttggccaaccaatttcccgacatctcgttctgcccagccttaccggccgtggttgccctactattacactactcaattgatgaagcagaatgtttcgagaaggcctgtaggatcttggcgtgtaatgacccaggacgccgcttgattgatcagtcgttcttagccttcgaatcttcatgcatgactttcggagatctggtcaataagtactgccaggccgcgcataaactgatggttgcagtcagtgaggatgtgttgcaggtgtatgctgattggcaacggtggctgttcggagagctccccctgtgctactttgcgagagtttttgacgtgttcctggtggaaggctacaaggtgctgtaccgagtagcccttgccatcctgaagttctttcataaagtgcgtgccggccagcccctggagtctgatagcgtgaagcaagacatacgcacttttgttcgggacattgcaaagacagtatctccggagaagctcttagaaaaagcctttgctatccgtctcttctcccggaaggaaattcagctgctgcagatggccaacgagaaggcgctgaaacagaagggcattacagtcaaacagaaaaggcagtttgttcaccttgcggtacacgccgagaacttcaggagtgagatcgtttcagtcagggagatgagggatatatggagctgggttccagaacggttcgccctttgccagccgttgcttctgttttctagcctccagcatgggtatagtctggcccggttctacttccagtgcgaaggccacgaaccaaccctgttacttatcaaaaccacacaaaaggaggtttgcggcgcctatctctccaccgattggtccgagagaaacaagtttggagggaaactaggtttcttcggaaccggggagtgttttgtgtttcgacttcaacccgaagtccagcgctatgaatgggtagtgatcaagcaccccgagctgaccaagccaccacccctgatggccgccgagcccaccgcacccctgtcccatagcgctagtagcgatcccgccgaccggctatcccctttcctcgcagcccggcactttaatttgccgagcaaaacagaaagcatgtttatggccggtggaagcgactgtctcatcgtgggggggggcgggggccaagcactgtacatcgacggggacctcaatcgcggaagaacatcacactgtgacacctttaacaatcagccgttatgcagtgaaaatttcctgattgcagccgttgaggcttggggtttccaggatcctgatacccagtag

SEQ ID NO: 137341 - DNA, 1680 bp, Artificial Sequence
  Description of Artificial Sequence: Synthetic coding sequence
atggactctcctgggtataactgctttgtggataaggacaagatggacgccgccatccaggatctgggtcccaaggaattgtcttgcacggagcttcaggaattgaaacaactggcccggcaggggtattgggcccaatcccacgctttgagaggtaaagtgtatcagaggttaatcagggacataccctgtaggacggttacgcccgatgcaagcgtttacagtgatatagtcggcaaaattgtggggaaacattcaagctcatgtctacctcttcccgaatttgtcgataatactcaagtgccatcctactgcctgaacgctagaggggagggcgcggtgcgaaagattcttttgtgtctcgccaatcagtttcccgatatatctttttgtccagcgctccctgccgtggttgctctcctcttacactactcaattgacgaggctgaatgcttcgaaaaggcatgtaggatacttgcctgtaacgaccctggccgtagacttatcgatcagagctttctcgcatttgaatcatcctgcatgacttttggcgacctagtgaataaatactgtcaggccgctcacaagcttatggtggctgtctcggaggatgtgcttcaggtctatgccgactggcaacgttggctgttcggagaactccctctgtgctacttcgccagagtttttgatgtgttcctggtagaggggtataaagtgctgtatagagtggccttggccatactgaagtttttccataaggttcgggccggacaacctctggagtcggacagcgttaaacaggacatacggactttcgtacgcgatattgcaaaaactgtctctcccgagaaattgctggaaaaggccttcgccattaggctgttcagccgcaaagagattcagcttctccagatggcgaacgagaaagctctgaaacaaaaaggaatcaccgtgaagcagaaaagtgtctcattgtccaagcgccagttcgtgcatttggcggtgcacgccgagaattttagatctgagatagtttctgtgcgggaaatgagagatatttggagctgggtgccagaacgtttcgccctgtgccagcctctactgctcttttcatcacttcaacatgggtactccctggcaagattttactttcaatgcgaaggccatgaacccacactactcctaataaagaccacacagaaggaggtgtgtggagcctacctctcgactgactggtctgaaagaaataagttcggcgggaaactcggattcttcggaactggagagtgctttgtcttccggctgcaaccagaggtacaacggtacgagtgggtcgttattaagcatccagagctgaccaaaccacccccactaatggcagctgagccaaccgcccctctctctcactctgcatccagcgaccccgccgaccggttatcgccttttttggcagctcggcactttaatctacctagcaagacagagtcaatgtttatggctggggggtccgactgtctgattgttgggggtggtgggggccaggccctgtatatagatggggatctcaatagaggccggacttcccactgcgatacttttaataaccagcccttgtgcagtgagaacttcctgatcgctgctgttgaagcgtgggggttccaggacccggatacacagtag

SEQ ID NO: 137342 - DNA, 2067 bp, Artificial Sequence
  Description of Artificial Sequence: Synthetic coding sequence
atggctacagcatctggcgcttctgacctctccgggagcggtgctccaccccctggtgtgggtgcccaagctgctgcagccgctgaggaggaggagcgagaagtggtgcgggtcagagttaaaaaatgtgagagttttcttccccccgagtttagatctttcgctgttgacccccagattacctccctcgacgtcctgcagcacatcttaatcagggcattcgacctcagtgggaagaaaaactttggaatttcctatttaggccgggaccgtcttggccaggaagtttacctctcacttctctcagactgggacctttccaccgccttcgctaccgcctctaagccttatctccagctgagggtggatattcgccccagtgaggattcgccactgctggaggattgggacattatcagtccaaaagatgttatagggtccgatgtgcttctagcagaaaagagatccagcttgacaacggccgcactgccattcactcagtctatactgacccaagtaggtcgaaccttgagtaaggtgcagcaggtcctcagctggtcttacggggaggatgttaaacccttcaagccccccttgtccgatgccgagttccacacatatcttaatcatgagggtcagctcagccggcccgaagaacttcgactgaggatttaccacggcggtgtggaaccttctctgcggaaggtggtatggagatacctgctgaacgtctacccggatggactgacaggccgcgaaagaatggattacatgaaacgcaaatcccgcgagtacgagcagcttaagtccgagtgggcacagagagccaatcccgaggatcttgagtttatcaggagcaccgttctgaaggacgtcttacgaaccgacagggcccatccttattatgcaggcccagaagatggcccgcacttgcgggctctgcacgatttgctgaccacttacgctgtgactcatccccaggtcagctactgtcagggtatgtctgacctggcgtctccaatcctggcagtgatggaccatgaaggccacgcatttgtctgtttttgcgggataatgaaacggctcgccgcaaattttcaccctgacggccgcgctatggcaactaaattcgcgcaccttaaactcctcctgcgacacgccgaccccgatttttaccagtatctgcaggaggccggcgccgacgatctgttcttctgctatagatggctgcttctggagctcaaaagagagtttgcctttgatgacgcattgcgaatgctggaagttacatggtcctcgctgccccccgacccccccgagcatgaggtggaattggtgggcccaccttcccaggtagccgacgccggctttggtggccatagaggatggccagtcaggcagcgtcacatgctgcgtcccgctggcggaggaggttcaacatttgaagacgcagtggatcacctagcaacagcctcccagggacccggaggcgggggtcggctcctccggcaggcttctctcgacggtctgcaacaactccgagataacatgggtagcagaagggaccctcttgttcaattaccccaccccgctgctttgataagttctaaatcactctctgaacccctactcaatagcccggacccgctcctctccagcttttcccatccagattcccccagttcgtccagtccaccctcgacacaggaagcttctcccaccggcgacatggccgtgggatcccctctgatgcaagaggtggggtcacctaaagaccccggcaaatcactgccccccgtcccacccatgggccttccacctccccaggagtttggccgggggaatccgttcatgctctttctctgcctcgcgatcctgctggaacatcgggatcatataatgagaaatggacttgactacaatgagctggccatgcacttcgaccgtctagtgagaaagcatcatctgggacgcgtactcaggagggcacgggccttgtttgcagactacttgcaaagcgaagtgtgggatagcgaggagggcgcggaagccactgctgcaagttag

SEQ ID NO: 137343 - DNA, 693 bp, Artificial Sequence
  Description of Artificial Sequence: Synthetic coding sequence
atggcaaccgctagtggggcctctgacctgtcaggatcaggcgccccccccccaggagtcggggctcaggccgctgccgctgcagaggaagaggagcgggaggtcgtccgtgtcagagttaagcacggggatggcgcacctggcggcttgccacatgttttttcaccgcaaaagtgcgagtctttcttgccgcctgagtttcgctcttttgcagtcgaccctcagattacttcactggacgtcctccagcacatcctgattcgcgccttcgatctgagcggcaaaaagaacttcggaatcagttatctgggccgggacaggttgggtcaagaagtgtacctgtccttgctaagcgactgggacctttcaactgccttcgctaccgccagcaaaccttatcttcagttgagggtggatatcaggccatctgaagacagccctcttctggaagactgggatattatttcacccaaggacgtgattggctctgacgtgttactggctgagaaacgcagtagcttgaccacagccgcactcccttttacacagtccatcttgacccaggtgggtagaactctgtctaaagttcaacaggtgttgagctggagctatggcgaagacgtgaagcctttcaagccacctttgtctgatgccgaattccacacctatctgaaccatgaaggacagttgtag

SEQ ID NO: 137344 - DNA, 303 bp, Artificial Sequence
  Description of Artificial Sequence: Synthetic coding sequence
atggcaaccgcttcaggcgcatcagatctaagcggttcgggggcccctccaccgggagtgggcgcccaagcggctgcggccgcggaagaggaggaacgtgaggtggtacgggttagagtgaaaaagtgtgagagcttcctcccccccgaatttaggagcttcgccgtggatccgcagataacttctctggatgtcctgcagcacatcctgattagagctttcgatctctccgggcccattgctagaagacttggtcacaaccagccgcagcggtgtcattggctgcggcgcgtcgctggctag

SEQ ID NO: 137345 - DNA, 1305 bp, Artificial Sequence
  Description of Artificial Sequence: Synthetic coding sequence
atggattacatgaagcggaagtcaagggaatacgagcagttgaaatcggaatgggcccaaagagctaacccagaagaccttgagtttatcagaagcacagttcttaaggacgttcttcggaccgatcgagcacatccctactatgctggccctgaggatggaccacatctcagggcacttcacgacttgcttaccacctatgccgtgacacatccccaggtctcctactgccagggaatgtctgacctggcgtccccgattcttgccgtaatggaccatgagggccatgcctttgtgtgcttctgcgggatcatgaagcgcttagcagctaattttcatccggacggacgggctatggcaactaaattcgctcacttgaagctgctgctccgccatgcagatccagacttctaccagtaccttcaagaagctggagcggatgacttgtttttttgctatcgatggctgctcctggaactgaaacgtgagttcgcattcgacgacgcactccggatgctggaggtgacttggtccagtcttcccccagatccccctgagcacgaggtggaactggtggggccaccttcccaggtggctgacgccggatttggagggcatagaggatggcctgttcgacagagacatatgctgcgtcccgccgggggcgggggttctacatttgaagatgccgtggaccatctggccacggctagccagggccctgggggaggcggccgcctgttaagacaagcttcacttgatggactacagcagctcagagacaatatggggtcacggagggacccactggtacagctcccccacccagcggctctgattagctctaaatccctgtccgagccgctccttaacagtccggatccgctgctcagctccttttcccatccagatagtcctagttcttcctcaccaccgagcacccaggaggccagccctacaggggatatggccgtagggtctccgctgatgcaggaggtgggctcccccaaggatcctggtaaaagcctaccccctgtgccccccatgggcctgccacccccacaagagttcggcaggggtaatccatttatgctgttcctctgtttggccatcttgctggagcacagagatcatatcatgaggaacggcttagactacaatgagctggccatgcactttgacagactggtgcggaagcaccatctaggaagggtcctgcgccgggcccgggccctcttcgcggactatttgcaaagcgaggtgtgggattccgaagaaggggctgaggcaacggcggctagctag

SEQ ID NO: 137346 - DNA, 876 bp, Artificial Sequence
  Description of Artificial Sequence: Synthetic coding sequence
atggatgtggtggaggttgctggctcctggtgggctcaggagcgagaggatattatcatgaagtatgagaagggacacagagcaggcctgccggaagataagggccccaaacccttccgcagctataacaacaatgttgatcatctgggaatcgtgcacgaaacagagcttcctcccctgactgctagagaggcaaagcagatcaggagggagattagtaggaaatccaaatgggttgatatgctcggagactgggaaaaatacaagtcttcccgcaagctaatcgatagggcttataaggggatgcccatgaatattcgagggccgatgtggagtgtactgctgaacattgaggagatgaagctgaaaaaccctgggcgatatcagattatgaaggaaaaaggaaaaaggtcctccgagcatatacaacgcatcgacagggacgtttctggcacacttcggaagcacatcttctttagggatcgatatggaactaaacaaagggaattgttgcatattctgctggcctacgaagagtataatcccgaggtgggctactgtagggatctctcacacattgcggcactctttctgttatacctccccgaagaggacgccttctgggctctggttcagctgctggcatccgagaggcacagtctgcagggtttccactctccaaatggcggtactgtgcagggtctccaggaccagcaggagcatgtggtggccacctcccaacctaaaactatgggacaccagtcagcatctcggcgccgccccggggtggccaggggccacgttttcgccactggatccctcatccccggaccgggaatgagaacactctgcagcagtatcctgggcccactgtag

SEQ ID NO: 137347 - DNA, 1650 bp, Artificial Sequence
  Description of Artificial Sequence: Synthetic coding sequence
atggacgtcgtggaagtggcggggtcttggtgggcccaagagagggaggatattattatgaagtacgagaagggacacagagcaggtcttcccgaggataagggccctaagccattcagatcatataacaacaacgtagaccatctcggtattgtccatgaaacggaactgccacctctgaccgcccgggaggctaaacaaataagacgggagatttcaaggaaatccaaatgggtcgacatgctgggcgactgggagaaatacaagtcatcaaggaagctgatcgaccgggcatataagggcatgccgatgaacatcagagggccaatgtggtccgtgctcctaaacattgaagagatgaaactgaagaatcctggaagatatcagataatgaaggaaaaggggaaacggtctagtgagcatatccagagaatcgaccgggatgtgagtggcacactgcgcaagcatatattctttcgagataggtacggtacaaagcagcgggagctcctgcacatcttactggcttacgaggagtacaaccccgaagtggggtattgcagggacctcagccatattgccgcactttttctgctgtacttgccagaagaggatgccttctgggcgctggtgcagctgctcgcctctgagagacactcactacaggggttccatagcccaaatggaggtacggttcagggcttacaggaccagcaggagcatgttgtggcaaccagccagccaaagaccatgggccatcaagacaagaaggatctctgtgggcaatgttcccctctgggttgcctaattcggatcctcatcgacgggattagcttggggctcactcttcggctctgggacgtgtatctggtggagggcgaacaggcactcatgcccatcacgagaatcgctttcaaggttcagcaaaagcgcctgaccaaaacatcacgttgtggaccatgggcccgcttttgtaatagattcgtggacacctgggccagagacgaggacaccgttttgaaacacctgagagctagcatgaagaagctgaccaggaagcagggcgacctccctccgcccgccaaaccggagcagggaagtagcgcatcaagaccggtgcctgcctcccgtggcggcaaaactctgtgcaagggcgaccgccaggccccacctggccctccagcccgctttcctagacccatatggtccgcctcacctccgcgcgccccaaggtcatctaccccatgccctggcggagcagtacgggaggacacatatcccgtcggcactcagggggtcccctccccagcgctcgcgcaaggtgggcctcagggatcctggaggtttctccagtggaactccatgcctagactgccaactgatctggacgtggaaggcccttggtttcggcattacgactttagacagagctgttgggtcagggcaatctcccaggaagatcagcttgccccgtgctggcaggctgaacacccagcagaacgggtccgctcggccttcgcagccccatctacagactccgatcaaggcacgcccttccgggcaagagatgaacagccctgtgcccccacctcagggccgtgtctctgtggattgcaccttgaatcaagccagtttcccccaggattttag

SEQ ID NO: 137348 - DNA, 900 bp, Artificial Sequence
  Description of Artificial Sequence: Synthetic coding sequence
atgggccaccaagacaaaaaagatctctgcggccagtgctctccactcggctgcttgatccgtatcctcatcgatggcattagcctgggcctgacattaagactctgggacgtttatctggttgagggcgagcaagctctcatgccaatcacacgcattgcattcaaagttcagcagaagagacttacaaagacatcgcgttgcggtccctgggctagattctgtaaccgttttgtggacacctgggcaagggatgaggacaccgttctgaaacacttaagggcgagtatgaagaaactgacacggaagcagggggacctgcctccaccagcaaaaccggaacagggctcctccgcctcgcggcccgtgccagcctctcggggcggcaaaacgttatgcaagggagaccggcaggcgccacccggtccccccgccaggtttccaagaccaatttggtccgcctctcctcccagagctccgcgctccagcacgccgtgccctggcggcgccgtccgtgaggacacttatccagtagggactcagggggtccccagtcccgctttagcacaaggcgggccccaaggatcttggaggttcctccagtggaattctatgccgaggctccccactgatctcgacgttgagggaccttggttccgacactacgactttcgccagagctgttgggtgcgggccattagccaggaggaccagctggccccatgctggcaagccgaacaccctgcggaaagggttcgaagcgcattcgcagctccttccacggatagcgaccagggaacccccttccgcgctcgggacgagcagccatgtgctccaacctctgggccttgtctttgtggactacaccttgagagctctcaatttccacctggcttctag

SEQ ID NO: 137349 - DNA, 1584 bp, Artificial Sequence
  Description of Artificial Sequence: Synthetic coding sequence
atggacgtggtcgaagtggcaggctcttggtgggcgcaggagcgcgaggacattataatgaagtatgaaaagggccatcgcgccggtcttccagaagataaaggacctaagcccttcagatcatacaataacaatgtggaccatctcggtatcgtgcacgagactgagttacccccacttacagctagggaagcgaagcagattcgtagggaaattagccgtaaatcgaagtgggtggacatgctaggagattgggaaaagtataaatcttctcgcaaactgattgatcgcgcttataaaggcatgcctatgaatatccgtggtccaatgtggagcgtgcttcttaacatcgaagaaatgaaattgaagaaccccggtaggtatcagatcatgaaggagaaggggaagcgcagcagcgaacatatccagaggatcgaccgtgatgtttcaggcacacttaggaagcatatattcttccgtgatcgctacggcactaagcaaagggagctcttacacatcctgctggcttatgaggagtataaccctgaagtggggtattgtagagatctgtcccacatagctgccctgttcttactgtaccttcctgaggaggacgctttttgggctctggtacagcttcttgcctctgagcgccacagtcttcagggatttcatagtcccaacggcggtacagtccagggcctgcaggaccagcaagaacacgtagtggccacctctcaacctaagacaatgggacatcaaatctctcttggcttgacattgaggctgtgggacgtttacctggtcgaaggtgagcaggctctgatgccaatcacacgcattgccttcaaagtgcaacagaagcggctgacgaagacctccagatgcggaccatgggctcgcttctgtaaccggtttgtagacacatgggccagagatgaggataccgtattgaagcatctccgagcatctatgaagaagctgacacgcaagcagggggatttgccaccaccggctaaaccagagcaaggctcatccgccagtcggcccgttccagcctctaggggaggtaagactctctgtaaaggagaccgacaggcaccaccggggccacctgcccggttccctcgccccatttggagcgcttccccccccagggcccctcggagttccaccccatgtcctggtggcgccgtgagagaagacacctacccagtgggtacccagggggtgcctagccccgccctagcgcagggaggcccacagggatcttggcggtttctccagtggaactcaatgccccgacttcccactgacctcgatgtggagggtccctggttccggcattatgacttcaggcagtcgtgctgggtcagagctattagccaagaggatcagcttgctccctgttggcaggccgagcatccggccgaacgggtaaggagcgctttcgctgccccttctactgattcagatcaaggcaccccctttcgcgctcgggacgaacagccttgcgcacctactagcggaccctgcctgtgcgggctgcacctcgaatcgagccagttccccccaggcttttag

SEQ ID NO: 137350 - DNA, 1650 bp, Artificial Sequence
  Description of Artificial Sequence: Synthetic coding sequence
atggatgtcgtggaagttgccgggtcttggtgggcacaggagagagaggacatcatcatgaagtatgagaaggggcaccgcgccggccttccagaggacaaaggcccgaagcctttcagatcatataacaataatgtagatcacctgggaattgttcacgaaactgaactccctccattgaccgcacgggaagcgaaacaaatcaggcgcgaaatttcacggaagtcaaagtgggtcgatatgttaggcgactgggagaagtacaagagtagtcgcaagctgatagatagagcttataaggggatgcctatgaatatacggggccctatgtggagtgttctgttgaacatcgaggagatgaagctgaaaaatccaggaaggtaccaaattatgaaagaaaaaggaaaaagaagcagcgagcatatccagagaattgatcgagacgtgtctggcacactacggaagcatatctttttccgggaccgatatgggaccaagcaacgagaactgctgcatattcttcttgcttacgaggaatacaatcccgaggtgggttactgtagagacctgtctcacatcgccgccctcttcctgctatacctccctgaggaggatgctttctgggccctcgtgcagctgctcgccagcgagcggcattcactccaggggttccactcacctaatgggggaaccgtgcagggcctgcaagaccagcaggagcatgtcgtagcgacctcacagcctaagactatggggcaccaggataagaaggatttatgcggtcagtgttcacctctgggctgcctcatcaggatactgatcgacggaatatctctgggtcttaccctccgactctgggatgtgtacctggtggagggtgagcaagcacttatgcctatcacgaggatagctttcaaggtccagcagaaaaggttgacgaaaacctcacgttgcggtccgtgggctcgcttctgcaaccggtttgtagacacttgggctcgagatgaggatacagtattgaaacatctgcgggcaagcatgaaaaagcttacgcggaagcaaggtgacctacccccccctgccaagcctgagcaaggcagctccgcttcacgcccggttcccgctagcagaggggggaaaaccctctgtaagggcgacagacaggcccctcccgggccgccggcacggtttcccaggccaatttggtcggcctctccaccaagagcaccacggtcgagtacaccgtgtccaggcggggcagtccgcgaggacacctatcccgtgggcactcaaggagttccctccccggccctggcacagggaggacctcagggctcttggaggttcttacaatggaattcaatgccccgcctgccgaccgaccttgacgttgagggtccctggttcaggcattatgatttccgtcaaagctgctgggtcagagcgattagccaggaggatcaactggcaccctgttggcaagccgaacaccccgctgagcgcgttagaagcgcatttgccgcaccaagtaccgactccgaccagggaacccctttccgggccagggacgagcagccgtgtgcccccacctccggcccgtgtctgtgcggcctgcatctggagagttctcagttcccgccagggttttag

SEQ ID NO: 137351 - DNA, 1584 bp, Artificial Sequence
  Description of Artificial Sequence: Synthetic coding sequence
atggatgtcgtggaggtcgcgggatcttggtgggctcaagaacgggaagatataattatgaagtacgaaaaggggcacagagcaggacttcccgaggataagggacccaagccattcagatcttacaacaacaacgtcgaccacctcgggattgtgcatgagacagagctgccccccctgaccgccagagaggctaaacaaattagacgggagatatcccgcaaatccaaatgggtcgacatgctgggagattgggagaagtacaagtctagtcgaaagcttatcgacagagcatacaaaggaatgccgatgaacatacgtggccccatgtggtcagtgctgctcaatatagaagagatgaaactgaagaatcctgggagataccagataatgaaggagaagggtaagcgctccagtgagcatatccaacggattgatcgcgacatctccgggactctccgtaagcacatgttttttcgagaccgctacgggactaagcagagagagctgcttcatatcctgttggcatacgaagagtacaatcccgaagtgggctattgcagggatctctcacacatcgcggcactgttcctcctgtactttcccgaagaggacgcattctgggcactggttcagttactcgcatccgaacgtcatagtctgcaaggctttcactccccaaacggcggaaccgttcagggtctgcaggatcagcaggagcatgttgtcgccactagccagtccaaaaccatggggcaccaaatttcactgggccttactctgcgcctgtgggacgtgtatctggtagagggagagcaggctttaatgcctataacccgtattgccttcaaagtgcagcaaaaacgactgaccaagacatccagatgcggtccttgggcaagattctgcaataggttcgtcgacacttgggcccgagatgaggacaccgtcctgaaacacctgcgtgcttctatgaagaaattgactcgcaagcagggcgacctgccaccccccgctaagcctgaacagggctcttctgcgtcccggcccgtgccagcaagtagaggaggcaagaccctgtgtaagggcgaccgccaggctccacctggccctccagcgagatttcctagacctatctggagtgccagccctccccgggctcccagaagtagcacaccttgtcccgggggtgctgtgagggaagatacttaccctgtgggtacccaaggcgttccatccccagctctggctcaagggggtccacaaggatcttggaggtttttacagtggaattctatgcctaggctgcccactgatctggacgttgaaggcccctggtttagacactacgatttccgccagagttgttgggtgcgggccatcagtcaggaggaccagttggcaccttgttggcaagccgagcatccagcagaaagggtacggagcgctttcgctgctccttctactgactcagatcagggcactccctttcgcgcaagagacgagcagcaatatgcccctacatctggcccttgtctgtgtggcctgcacttagaatcttcgcaatttccaccaggcttttag

SEQ ID NO: 137352 - DNA, 1650 bp, Artificial Sequence
  Description of Artificial Sequence: Synthetic coding sequence
atggacgtggttgaggtcgccggatcctggtgggcacaggagagagaagacataattatgaaatatgagaaagggcatagagcaggcctcccagaagacaagggccctaagccgtttagatcgtataacaataatgtggaccatctgggaatagttcatgaaactgaactccctccacttacagcccgggaggccaagcagatcaggcgggagatttcgagaaagtctaaatgggttgacatgctcggggactgggaaaaatataaatcctcgagaaaattaattgatcgggcctataaaggcatgcctatgaacataagggggcctatgtggtccgtcctgctgaacatcgaggagatgaaacttaaaaatccaggcaggtaccagataatgaaggaaaaagggaagcgtagctccgaacatatacagcgcatcgatagggacatcagtggaacgctaagaaagcacatgtttttccgagatcggtacggaacaaagcagcgagaactcctgcatattctccttgcctacgaagaatataaccctgaggtcgggtattgtcgggacctgtctcacatagctgccctgttcttgctgtactttcccgaggaggatgcattctgggccctcgtccagctgctggctagcgagaggcattctctccaaggcttccattcccctaacggggggacagttcagggcctgcaagaccagcaagaacatgtggttgccacatcccagtccaagaccatgggacaccaggataaaaaggatttatgtggtcagtgctccccactagggtgccttatcaggatcttaatcgatggcatttccctgggactgaccctgcgtttgtgggacgtttacttggtcgagggcgaacaagccctgatgccgattactaggattgcttttaaagtgcagcagaaaaggctcaccaagacctcccgatgtggcccatgggccaggttttgcaatcggtttgtggatacctgggcgcgggacgaggatacagtactgaagcacctcagagcttctatgaaaaaattgacaagaaagcagggcgatttaccccctccagctaagcccgagcagggatcgtccgccagtcggccagtccctgcaagccggggtggtaagaccctgtgcaagggtgacagacaggctcctcctggccctccagcgcgctttcccaggccaatctggtctgcatctcctccccgagctcccagatcttccaccccatgtcctgggggcgctgtgcgcgaagatacttaccccgtcggaactcaaggtgtgccgagccccgcactggcgcaaggcggccctcagggatcatggcggtttctgcagtggaattccatgcctcggctcccaaccgacttggacgttgaaggcccgtggttccggcattatgattttagacaatcatgttgggtgagagcgatttcacaggaagaccagctggctccttgttggcaagccgagcatcccgcagaacgggttaggtctgccttcgcagctccttcgactgatagcgatcaagggactcctttccgcgccagggatgagcagcagtacgctccaacgtcagggccttgcctgtgtgggctgcatctcgagagctctcaatttccccctggcttttag

SEQ ID NO: 137353 - DNA, 1650 bp, Artificial Sequence
  Description of Artificial Sequence: Synthetic coding sequence
atggacgtagtggaagtggcaggctcatggtgggcccaagaacgggaagacattatcatgaaatatgagaagggccatagagcaggcctgcccgaggacaagggtccgaaaccttttcgatcgtacaataacaatgtcgatcatctgggtatcgtgcacgaaaccgagctgcctccccttactgccagagaagctaagcaaataagaagagagatatcaagaaagtcaaaatgggtcgacatgcttggagactgggaaaaatataaaagcagtcgcaaactgatcgacagggcctacaaaggaatgccaatgaacatccgggggcccatgtggtccgtgctgctcaatatcgaagaaatgaaactgaagaaccctggacgttatcagatcatgaaggagaagggcaagagatcttccgaacacatccagaggattgatcgggatatttccggcacacttcgtaaacacatgttcttcagggacaggtatgggactaaacagcgcgagctcctgcatattctgctggcatacgaggaatataaccccgaggtggggtattgtcgtgatctctcgcatatcgccgctttgttcttactttacttccccgaggaggatgctttttgggctttggtccagctgctggcctcagaaaggcactcacttcagggctttcattcccccaatggcgggaccgtccagggtctgcaagaccagcaggagcacgtcgtagccacctcccagagcaaaacaatggggcaccaagataagaaagatctctgtgggcagtgctctcctttgggttgtttgatacggatcttaatcgacggcatttcgcttgggctgactctgaggttatgggatgtatacctggtcgagggagagcaggctctcatgccaataacaaggatagcctttaaggtccaacagaagaggctgacaaagacctcccggtgcgggccttgggcacggttttgcaacaggttcgtggatacttgggcgcgcgatgaagacactgtcctgaagcatctgagagcgtctatgaagaagctgactagaaaacagggtgatctgccaccacctgccaagcctgagcagggctcatccgcttcccgcccagtgcccgcaagccgaggggggaaaacactgtgtaagggtgatcgccaagctcccccaggtccgcccgcacggtttccacggccaatatggtctgccagtccccccagagcaccccggtccagtactccatgcccggggggtgccgtaagagaagacacatatcctgtgggcacacagggtgtcccaagtccagctctagctcagggcggaccccagggaagctggcggttcctgcagtggaacagtatgccacgccttcctacagatctagatgtggaggggccttggtttcgccactatgactttagacagtcctgttgggtgcgcgctattagccaagaggatcagctggcaccgtgttggcaggcagaacacccagccgaacgtgtacgttctgccttcgctgcgcccagcactgattctgaccagggcaccccatttcgtgcaagggacgagcaacaatatgccccaacttctggcccatgcctgtgtgggctgcaccttgaaagtagccaattccctcctggcttctag

SEQ ID NO: 137354 - DNA, 1650 bp, Artificial Sequence
  Description of Artificial Sequence: Synthetic coding sequence
atggatgtcgttgaggtggccggttcatggtgggcccaggaaagggaggacattattatgaaatatgagaaaggacatagagctggccttcctgaagataagggtccaaagccattcagatcttacaataacaacgtcgatcacctaggcatcgtgcacgagaccgagttgccaccactcactgcaagggaggccaagcagatacggcgagagatctcaaggaagagtaagtgggtggacatgctgggcgactgggaaaaatataaatcatcacgtaaactgatcgatcgcgcatataagggtatgcccatgaatattaggggccccatgtggtccgttcttctaaacatcgaagagatgaaactgaagaatcccggacgttaccagattatgaaagagaaaggcaagcgcagctccgagcacatccagagaattgatcgggatatctctggtacgttgcgaaaacacatgttttttcgagatagatacggaacaaaacagcgggaacttctccatatcctgctggcctacgaagagtacaaccctgaggtgggctattgtcgcgacctttcgcacatcgccgccctcttcctactctatctgccggaagaagatgctttctgggcccttgtgcaactcctagcttcggaacgccactctctgcagggttttcacagcccgaatggcggtacagtgcagggcctgcaggaccaacaagagcacgtggtggcaacgtctcagtcaaaaactatgggccaccaggataagaaggatctctgtggacaatgcagcccgctgggatgcctgatcagaattctgattgacggtatatccctcgggctgacccttcggctgtgggacgtgtacctcgtagagggtgagcaggcgttgatgcctatcacgaggattgcatttaaggtccagcaaaaacggcttaccaagaccagtagatgcggaccctgggcccgcttttgtaacaggtttgtagacacatgggccagggatgaggatacagtcttgaaacatctgcgggcttcaatgaagaagctaacccgcaaacaaggtgatctaccccctcccgctaaaccagagcagggatcatcggcctccagacctgtcccggcatcacgaggagggaagacgctgtgcaagggcgacaggcaagctccaccagggcctcctgcctggtttccacgcccaatttggtctgcgtcacccccccgggcgccgagatccagcacgccatgtccggggggagcagttagggaggacacatatcccgtcggaacccagggcgttcccagcccggcactcgcccagggaggaccccaggggtcctggaggttcctgcagtggaacagtatgcccagattgccaaccgaccttgacgtggaaggtccctggttccgccactacgacttccggcagagttgttgggtccgtgctatttctcaagaggatcaactggcgccgtgttggcaggcagaacaccccgccgaacgtgtgcggagtgccttcgccgccccttccaccgactcagatcaggggacgcctttcagagccagggatgagcagcagtgtgcgccgacatctggcccatgtttatgtggcctgcacctggagtcaagccagttccccccgggcttttag

SEQ ID NO: 137355 - DNA, 1584 bp, Artificial Sequence
  Description of Artificial Sequence: Synthetic coding sequence
atggacgtggtagaggttgccggcagctggtgggcccaggaacgggaggatattatcatgaaatacgagaagggtcaccgagctggcttacctgaagataagggtccgaaaccatttaggagctataacaacaatgtggatcatctcggcattgtgcacgaaactgagctgcctccacttactgcccgagaggcgaagcaaatcagacgagagataagtagaaaatctaaatgggtcgacatgctgggggattgggaaaagtataagtctagccggaagttaattgaccgggcctataagggaatgccaatgaacattagaggtcccatgtggagcgttctcctgaatatcgaggagatgaaactgaaaaatcctggacggtatcagatcatgaaggaaaagggcaagcgctccagtgaacacatccagcggatcgatcgtgatatctccgggaccctgagaaagcacatgttctttcgagatcggtacggcaccaaacagcgagaactgctgcatattctcctggcttatgaagaatacaacccagaagtgggttactgccgagacctgtcccatatcgctgcccttttcctgctttatctgccggaggaggatgccttctgggccttagttcaactcctggcctccgaacggcacagcctgcaggggttccacagcccaaatgggggtacagtgcagggcttgcaggatcagcaggaacacgtagtggctactagccaatccaagacaatggggcaccagatatccttggggctgacactcagactgtgggacgtgtatctggtagagggtgagcaagcactcatgccaatcacccggattgccttcaaggtccagcagaagagactgacgaagacaagccgctgtggtccctgggcacggttctgtaatagatttgtggacacatgggcgcgcgacgaggatacggtcctaaagcatttacgcgcttctatgaagaagctaactaggaagcaaggtgacctgccacctcccgccaaacctgagcagggtagtagcgccagtcgccccgttccagcaagtcgtggggggaagactctgtgtaagggagaccggcaggctccaccggggcccccggcatggttcccaagacccatttggagtgcctcgccaccacgcgccccccggtcctctaccccatgccccggcggggcggtgcgggaggacacataccccgttggaacacaaggcgtgcctagccctgctctggcccaaggaggtccccaagggtcctggaggttcctacagtggaactctatgccccgactgcctaccgaccttgatgtcgagggaccttggtttagacattacgacttcaggcagagctgttgggttagagcaatttctcaggaggatcagctcgctccatgttggcaggctgaacacccagccgaaagggttcgctccgccttcgccgccccatcaacagattctgatcagggaactccgttccgggcacgcgatgagcagcaatgcgccccaacctcaggtccttgcctgtgcgggttacacctcgaatcatctcagttccccccggggttctag

SEQ ID NO: 137356 - DNA, 1650 bp, Artificial Sequence
  Description of Artificial Sequence: Synthetic coding sequence
atggacgtggtcgaagtcgccggcagctggtgggcacaagaaagagaagatatcataatgaaatatgagaagggacacagagctgggctgcctgaggataagggacccaaaccatttcggtcatataacaacaacgtggatcacctgggaatcgtccatgagacggagctcccccctctaactgccagggaagccaaacagatacggcgggagatttctcggaagagcaaatgggtggacatgctgggcgattgggaaaaatacaagtcatccaggaaacttattgaccgggcttacaagggtatgccaatgaatattagaggcccaatgtggtccgttcttttgaacatagaggaaatgaagttgaagaaccctggcagatatcaaatcatgaaagaaaaaggcaagaggtcctctgagcatatccagcgcattgacagggatatttccgggaccttgcgcaagcatatgttttttcgggatcgttatggtacgaagcaacgcgagctgctccacattctactagcatacgaagagtacaaccccgaggtgggatactgtagggacctgagccacattgccgcgctgttccttctgtatctccccgaggaggacgcattttgggctttggtccagctgctggccagcgaaagacacagcctgcaggggttccattccccaaacggaggaacggtccagggattgcaggatcagcaagaacatgtggtggctacttcccaatctaagactatggggcaccaagataagaaagatctgtgtggccagtgtagcccactgggctgtctgatacggatcctcatcgacggcatctcattaggccttacgttaaggctatgggatgtgtacctggttgagggggagcaggccctcatgcccatcacccgcatcgctttcaaggtccagcagaaaagattaacaaagaccagccgctgcggtccatgggctagattctgtaaccgttttgtggacacatgggccagggacgaggacaccgttcttaagcatctgagagccagtatgaaaaagcttacccgaaagcagggggatctgccgcccccagccaaacccgaacagggcagtagtgcctcccgccccgttcccgcttctcgtggggggaaaaccctatgcaagggagatagacaggctcctccaggcccccctgcttggtttcctagacccatctggtctgcaagcccaccccgtgcccctcgatctagcacaccttgtccaggcggagccgtgcgcgaagatacatatcctgttgggacacagggtgtgcctagtcctgcacttgcccagggcgggccccagggatcctggcgctttctacaatggaatagtatgccgaggctgcctactgatctggacgtggaaggaccgtggtttagacactatgattttcgccaaagctgctgggtgcgagcaatctctcaggaggatcagctggcaccctgctggcaggccgagcatcccgctgaacgcgtaagaagcgcatttgctgcccccagtacagatagtgatcaaggaactccattccgggctcgggacgaacagcagtgcgcaccgacttctggaccttgcctctgtgggttacacctggagtcctcccagtttccccccgggttttag

SEQ ID NO: 137357 - DNA, 1650 bp, Artificial Sequence
  Description of Artificial Sequence: Synthetic coding sequence
atggacgtcgtggaggtcgcaggtagttggtgggcgcaggaacgtgaagacatcattatgaaatacgaaaaaggacaccgagcaggccttcctgaggacaagggaccgaagccctttcgtagctacaataacaacgttgaccacctcgggattgtccacgaaactgagctcccccctctgacggctcgggaggccaagcagatccgaagagaaatctctagaaaatccaagtgggtggacatgttaggtgactgggaaaaatataagagcagccgcaagctgattgaccgtgcttacaaaggcatgcctatgaatattcgcggccctatgtggtcagtcttgcttaacactgaggaaatgaaactcaaaaatcccgggcgctatcaaatcatgaaggagaagggcaagcgcagcagcgaacacattcagagaatagatcgcgatgtgagtggtaccctccgaaagcatattttcttcagagaccgctacggcactaagcaacgggagttgctacatattttactggcatacgaagaatacaacccggaggttggttactgccgcgatctaagtcacatcgctgcactctttctgctgtatctccccgaagaggatgctttctgggcactcgtgcagttgctggcctctgagagacatagtctgcaaggcttccactcaccaaatggcggcaccgtgcagggccttcaggatcagcaggaacacgtagtggccaccagccaacccaaaactatgggccatcaggataaaaaggacttgtgcggccagtgctccccactcggatgtcttatccggatcttgattgatggaatttccctcgggctgacacttcgcctgtgggatgtgtaccttgttgaaggggaacaggctttaatgcccatcacccgcatcgcctttaaagtgcaacagaaaaggctcacaaagacctcccggtgtggcccctgggctcgtttttgcaatcgctttgtagatacgtgggcgcgcgacgaggataccgtgttgaagcacctgcgcgcctctatgaaaaagctcacgcgcaagcagggtgacctaccaccccctgctaaaccggaacagggcagctcagcgtcccgtcccgtgcctgccagtaggggtgggaaaactctctgtaagggagaccgacaggccccacctggcccaccagccaggtttcccagacctatctggtccgctagcccacctcgggcaccacggtcctcaaccccttgcccagggggcgcagttcgggaggacacctatcccgtgggaacgcagggtgtgcctagtcccgcgctcgcccagggaggacctcagggctcttggcgcttcctccagtggaatagcatgcctagactgcctacggacttggatgtcgagggcccgtggtttaggcactatgacttccggcagtcttgttgggtgagagctatttcccaggaggatcagctggcaccttgttggcaagctgagcatcccgccgagcgtgttagatctgcctttgcagcgccatccacggacagcgatcagggcactcctttcagggcaagggatgagcagccatgtgctcccacaagtggaccatgcctctgcggactgcatcttgagagcagtcagtttccaccaggcttttag

SEQ ID NO: 137358 - DNA, 876 bp, Artificial Sequence
  Description of Artificial Sequence: Synthetic coding sequence
atggatgtggtggaggttgcaggcagctggtgggcacaggaacgggaagacatcattatgaagtatgaaaagggccaccgggctggcctaccagaagataagggaccaaaaccttttcggagctacaacaacaatgtggatcatttaggcatcgtgcacgaaaccgagcttccccctctgacggcaagggaggctaaacagatccggagggagatcagtcggaaatccaagtgggtggatatgctgggggactgggaaaagtataaaagcagtcggaagctaattgaccgggcatacaaagggatgccaatgaacattaggggtcctatgtggtccgtgcttttgaacacagaggaaatgaagctcaaaaaccccggtcggtatcagataatgaaggagaaggggaagcgctcaagtgagcatatccagcgcattgatagagacgtaagcgggactttgaggaaacacattttttttcgggataggtacgggacaaagcagcgggaactactgcacatcctgttggcgtatgaggaatataatcccgaggtcggatactgccgggatcttagtcacatagccgcgctgtttctgctttatctgccagaagaggacgccttctgggccttggtacaactgttggccagcgaaagacatagtctacagggtttccactcaccaaatgggggtaccgtgcagggcctccaggaccagcaggagcatgtggtggcgacttcacagcccaagacaatgggccaccagtctgcatcacgaaggaggcccggagtggcacgcggacacgtgttcgccactgggagtctgattcctggccccggcatgcggaccttgtgttcctccatcctgggcccgctgtag

SEQ ID NO: 137359 - DNA, 900 bp, Artificial Sequence
  Description of Artificial Sequence: Synthetic coding sequence
atgggccaccaggataagaaggacctttgtggacaatgctcgccattgggttgcttgatcagaatccttattgacggtattagcctgggcctgaccctcaggttgtgggacgtatatctggtggaaggagagcaggcgctcatgcctatcaccagaattgccttcaaggtgcagcagaaacggctaactaagacctctcgctgtggcccttgggccaggttctgtaacagatttgtagatacttgggcccgggatgaggacaccgtgctaaaacaccttcgagctagtatgaagaagctgactcggaaacaaggcgacttgcctccacccgcaaagcccgaacagggctcctcagcctctaggcccgtgcccgcatcccgcggcgggaagaccctgtgcaagggggaccgacaggctccacctggcccacccgccaggttcccccgcccgatatggtccgcctcgccacctagggctccgagatcatctaccccatgcccaggcggcgcagtgcgggaggatacttacccagtcggaacccaaggggtcccctccccagctctagcgcagggcggaccccaaggaagctggagattcctgcagtggaatagcatgcccagattgcctactgatctggacgttgagggaccatggttccgccactacgatttccgccagtcatgctgggtcagagcaatctcacaagaagatcagctcgcaccatgttggcaagccgaacaccccgctgaacgggtccgcagtgcatttgcagcaccatctaccgactcagaccagggtacccctttcagggccagggacgagcagccttgcgccccaactagcgggccttgtctctgcggcctccatcttgagtcttcacagtttcctcctggcttctag

SEQ ID NO: 137360 - DNA, 1410 bp, Artificial Sequence
  Description of Artificial Sequence: Synthetic coding sequence
atgctcggggactgggagaaatataaatcttcccggaagcttatcgacagagcgtacaagggcatgccaatgaacattagggggcccatgtggtcagtgctcctcaatactgaggaaatgaagctcaagaaccctggacggtaccaaatcatgaaggagaagggaaagcgcagctcggaacatatccagcgcattgatcgtgatgtgagtgggaccctacggaagcatattttttttagagaccgatacgggacaaaacagcgagaacttttacacatcctcctggcttatgaggaatacaaccccgaggtcggctactgcagggacctcagccatatagccgctcttttcctgctctacctcccggaagaagatgcattctgggccctcgtccagctcctcgcctctgagcgtcactctctgcaagggttccactctcccaatggaggcactgtccaggggctgcaagaccaacaggaacatgtcgtggctacttcgcagcccaaaacaatggggcaccaggacaagaaggacctgtgtggccagtgtagtcccctcggctgtctcatcagaatcctgatagacggaatcagcctgggcctgactctgcggctgtgggacgtgtatctggtcgagggggagcaggcccttatgcctattacacggattgcatttaaagtacaacaaaagaggttaactaaaacctcacgctgcggcccctgggcccgcttttgcaaccgcttcgtggatacctgggcgcgcgatgaggacactgtgctgaagcatttgcgggcatcaatgaagaaactgactcgcaaacagggggatctgcctccgcccgcaaaaccagaacaggggtcctctgcttctcgcccggttcctgcatcaaggggggggaaaaccttatgtaaaggggataggcaggctcctccaggcccaccggcgagattcccccggcccatctggtctgccagccccccaagagcgcccaggtcatccacgccatgcccaggaggggccgtgcgggaagacacatatccagtcgggacgcaaggcgtgccctctccggctctcgctcaaggggggcctcaaggttcatggcgattcttgcaatggaactctatgccaaggctgccaacggaccttgacgtggagggtccatggtttaggcactacgattttcggcagtcttgttgggtgcgcgcaattagccaagaagaccagctggcaccctgctggcaagcggaacacccagctgaacgtgtgagatcggcttttgccgctccttctacagacagcgaccagggcacaccctttcgcgccagggatgagcagccgtgcgctcccacaagcgggccctgtctgtgcggtctgcatctggagtccagtcaatttcctcccggattctag

SEQ ID NO: 137361 - DNA, 1650 bp, Artificial Sequence
  Description of Artificial Sequence: Synthetic coding sequence
atggacgtcgttgaggttgccggcagttggtgggcgcaggagcgagaggatattattatgaagtacgagaagggccatagggctggattacccgaggataaggggccaaagccttttcgaagctacaacaacaacgtggatcatctgggtattgtgcacgagaccgaattgccacccctcacagctagagaggcgaagcagatccgcagagaaatcagccgtaaaagcaagtgggtggacatgcttggagattgggagaaatataagagctctagaaagcttatcgacagagcatataaaggcatgcccatgaatatccgcggccccatgtggtccgttttgctgaatattgaggaaatgaagcttaagaaccctgggaggtaccagattatgaaagagaaaggtaagaggagttccgagcacatacaacgaatcgaccgggacatcagcggcaccctccgcaaacacatgttcttcagagatcgatatggcaccaagcagcgtgagcttctacatattttactggcctatgaggaatacaacccagaagttggctattgcagggatttatcccacattgcggctttattcctgctctacctgccagaagaggacgcattctgggccctggtccagctgctcgcctctgagagacatagcttgcagggattccactcgccgaacggggggacggtgcagggcctccaggatcaacaggagcatgtagttgctacttcccagcccaaaacaatgggtcatcaggataaaaaggatctctgcggccaatgtagcccccttggatgtctcatccggatcctgatagatggcattagtctcggattgacattgaggctctgggatgtgtacctagttgagggcgaacaagcactgatgccaatcacaagaatcgccttcaaggtgcagcagaagcgattaaccaaaactagccggtgtgggccttgggctcggttttgcaacaggtttgtggacacatgggcaagggacgaggacacagtcctgaaacaccttcgggcctctatgaaaaagcttaccagaaaacagggcgacctcccccccccagcgaaaccagagcaaggttcaagtgcgagcagacccgtgccggcaagccgtgggggtaagacattgtgtaagggcgataggcaggcacctcccgggccgcccgcgaggtttccgcgccccatctggagtgcaagcccaccccgggcgcccagatcctctaccccctgccccggcggcgcagtgcgcgaagatacttatcctgtggggacacagggagtcccctcgcccgctctagctcaaggcggcccccaaggaagctggcggtttctgcagtggaatagcatgccgagactgccgaccgacttggacgttgaaggaccctggtttagacactatgacttccgccagagctgttgggtgcgcgctatatcccaagaggatcaattggcgccatgctggcaggcggagcaccccgctgaaagagttaggagcgcatttgccgcacctagcacggactccgatcagggcacgcccttcagagcacgggatgaacagcagtgtgctcctacctccggcccttgcctgtgcggcttacacctagagagttcccaatttccgccgggattctag

SEQ ID NO: 137362 - DNA, 1650 bp, Artificial Sequence
  Description of Artificial Sequence: Synthetic coding sequence
atggatgttgtggaagtggcaggttcctggtgggcccaggagagagaagacataattatgaagtatgagaagggacatcgcgcaggcctgcccgaagacaagggccctaaacctttccgcagttacaataataatgtcgaccatttgggaattgtgcatgaaaccgaacttccccccctcacggcccgggaggctaaacagatccggcgggaaattagtaggaagagcaagtgggtggatatgctcggcgactgggagaaatataaatctagtagaaagctaatagaccgtgcttacaagggtatgccaatgaatattcgtggaccaatgtggagtgtgctgttgaatattgaggagatgaaactgaagaatcccggacggtaccagattatgaaagagaaggggaagagaagttcagaacatatccagagaattgacagagacattagtggtacgctgcggaaacacatgttcttccgggataggtatgggacaaagcagagggagttgctgcacatactcctggcctacgaagagtataatcccgaggttggctactgccgcgacttatcccatatcgctgctctcttcctgctgtacttgccggaagaagatgccttctgggcccttgtgcagcttcttgcgtcagaaaggcattcactgcagggcttccattcccctaacggtgggacagtgcagggattgcaagaccagcaggaacacgtggtagccacttcacaaccgaagaccatgggccaccaggataagaaggacctgtgtggacagtgttctcctttgggctgcctaatccgaattctcattgacggtatctccctgggcttaacgctgaggttatgggacgtctacttagttgagggcgagcaggctctcatgcctatcaccagaattgcctttaaagtgcaacaaaagcgcttgacaaagacttcccgatgcggcccttgggccagattctgcaatcgtttcgtggatacttgggcacgggacgaggatactgtactgaagcacctgagagcatcaatgaaaaaattgacaagaaaacaaggtgacctgcccccaccagccaagcccgagcaaggatcttccgcctcgaggcccgtgcccgcatctaggggcggtaagacactatgtaagggtgatagacaagcgccccctggcccacccgctaggtttccccgaccgatatggagtgcaagcccacctagagccccccggtcctcaacaccttgcccgggtggagcagtgcgggaggacacctatcctgttggcacacagggggtcccatccccagctctggcgcagggcggcccacaggggagctggcgtttcctccagtggaacagcatgccacgattacctactgacttggatgtggaaggcccatggtttcggcattatgactttcgacaatcctgctgggtgcgggccattagccaggaagatcagcttgcgccgtgttggcaggcggaacatcctgccgaaagggtgaggtctgcttttgctgcccccagtaccgactctgaccagggtacaccctttcgggccagggatgagcaacagtgcgcacctacgtccggaccatgtctctgcggccttcatcttgagagttcccaatttccccctgggttttag

SEQ ID NO: 137363 - DNA, 1584 bp, Artificial Sequence
  Description of Artificial Sequence: Synthetic coding sequence
atggacgtcgtggaggtggccgggtcctggtgggcccaagagagagaagacatcattatgaagtacgagaaaggccaccgcgcaggccttccagaggataagggacctaagccctttcgtagctacaataacaacgtggatcacctaggaattgtccacgagaccgaacttccaccattaacagcaagggaggcaaaacaaattcgtcgagaaatatcccgaaaatctaagtgggtggatatgctcggggattgggaaaaatacaagtcttcgcggaagctgatcgatagagcctataaaggcatgccgatgaatattcggggcccaatgtggagtgtcctgctgaacatagaggagatgaagctgaaaaatccgggacgttaccagataatgaaagaaaagggcaagcggtcttcggaacacatccagcgcatcgaccgggacatttctgggaccctgaggaagcacatgtttttccgcgaccggtatgggactaaacagcgcgaattgttgcacattttgcttgcctatgaggaatataacccggaggttggctactgcagggacctgagccatatcgccgctctgttcttgctgtacttgcctgaggaggacgcattctgggcactggtgcaactgttggcctcggagcgccatagccttcagggctttcacagcccaaacgggggaactgtacaggggcttcaggaccagcaagagcacgtggtggccacctcccagcccaagacaatgggacatcagataagtttgggactcaccttacgtttatgggacgtgtacctggttgaaggcgaacaggcgctgatgcccattactcggatcgcctttaaggttcaacaaaaacggcttaccaaaactagcaggtgcggaccttgggcccggttctgcaaccggtttgtagatacctgggcccgcgatgaggatactgtcttgaagcatctgcgtgctagcatgaaaaagctcacacgtaagcagggtgatctccctcccccagcgaagcccgaacaggggtcgtctgcaagccggccagtccccgcctctcgcggcggaaagacgctgtgtaaaggggatcgtcaggccccgccagggcctccggccagattcccccgtccaatttggagcgcaagcccccctagagctcctcggagcagcacgccttgtccggggggggcagtcagagaagacacatacccagtagggacacagggggtcccatccccggccctagctcagggaggtccacaaggcagctggcgcttcctgcaatggaatagcatgccacgattgcctaccgacctggacgttgaaggcccttggtttcgccactacgattttcggcagagctgttgggtgcgcgccatatctcaggaggaccaattggctccctgctggcaagccgaacacccagccgagagggtgaggtccgctttcgctgcacccagtaccgacagcgaccaaggcacgcccttccgtgctcgcgacgaacagcagtgcgcgcctacctctggtccttgtctttgtgggttacatttagagagcagtcagtttcctccagggttctag

SEQ ID NO: 137364 - DNA, 1584 bp, Artificial Sequence
  Description of Artificial Sequence: Synthetic coding sequence
atggatgttgtcgaggtggctggctcctggtgggcacaggaaagggaagatattattatgaaatacgagaaaggacacagagccggactcccagaagacaaggggcccaagccctttcggtcttacaacaataacgtggaccacctggggatcgtgcacgaaacagagctgcctccgcttactgcacgcgaagccaagcagattagacgcgagatctcgcgtaagagcaaatgggtggatatgctaggagactgggaaaaatacaagtctagccgaaagctcattgatcgagcctacaaggggatgccaatgaacattagaggaccaatgtggagcgtcctcctaaatattgaagagatgaaactcaagaatcctgggcgttaccaaataatgaaagagaaaggcaagaggtccagcgagcatatacaacgaatcgatcgcgacatctctgggactctacggaaacacatgtttttcagggaccgttacggcacgaagcagcgggaattgctccacatactgttggcctacgaagaatacaatcctgaagttggttactgccgggatctgtcacacattgcggccctttttcttctctatctgcctgaagaagatgctttttgggctctggtccagctgttggcgtcagaaaggcactccctgcagggctttcactcaccaaacgggggcacggtccaggggcttcaggatcagcaggaacacgtcgtagctacgtcacagcctaaaaccatgggtcatcagatctccttgggcctgacactgagactgtgggacgtgtatttagtggaaggggagcaggcgctcatgcctatcacccgcattgctttcaaagtgcagcagaaaagactaactaagactagtcggtgcggcccatgggctagattttgtaataggttcgtcgacacttgggccagagacgaagatacggttctgaagcacctcagggctagtatgaagaaactcactcgcaagcaaggcgacttgcctccgcctgcgaagcccgaacagggatcatctgcaagcaggccagttcccgcatcccgaggagggaaaaccctctgtaaaggcgacaggcaggcgccaccaggaccgcctgccaggttccctaggcctatctggagtgcctcgccaccccgggcgccacgctcgtctacaccttgcccaggaggcgccgtaagagaagacacttatccagttggtacacagggagtcccttcccccgccttggctcagggtgggccgcagggctcctggcgctttctccaatggaactccatgccgagacttccgacagatctggacgtcgaaggcccgtggtttcggcattatgacttccggcaatcatgttgggtgagagccatctcgcaggaagaccagctggctccctgctggcaggccgaacacccagccgagcgggtgcgatctgcctttgccgctccatctactgactccgatcaaggcactcctttccgtgcccgggacgagcagcagtgtgccccgactagtggcccttgcctttgtggtctccacctagagagctcccagtttccccctggtttctag

SEQ ID NO: 137365 - DNA, 1410 bp, Artificial Sequence
  Description of Artificial Sequence: Synthetic coding sequence
atgcttggcgattgggaaaagtacaaatcttcccggaagctgattgatcgtgcctacaaggggatgccaatgaatattcgtggcccgatgtggagtgtcttactaaatatcgaggaaatgaagttgaagaaccccggacgctatcagatcatgaaggagaaagggaagcgcagctcagagcacatccaaagaatagatagggacatttctggcaccctgcgtaagcacatgttctttagggataggtacgggacaaaacagcgcgagcttctgcacatcctgcttgcctacgaagagtataatcctgaagtgggctactgtagagacctgtctcacattgccgcgttgttcctgctgtacttgccagaggaggatgccttctgggccttggtacagctcctcgcatccgagcggcatagcctacagggctttcattccccaaacgggggaacagtccaggggttgcaagatcagcaggagcatgtagtggctacatctcagccaaagaccatgggtcaccaggacaaaaaagatttgtgtggacaatgctctccccttgggtgcctcatccgaatcctgatcgacggaattagtttgggcttaacactgagactctgggatgtgtatctggtggagggcgaacaggcactaatgcccattacccgaattgcttttaaagtccagcagaaacggctgaccaaaacatccaggtgtgggccatgggcaaggttttgtaatagattcgtggacacatgggccagagatgaggacactgtgctgaaacacttgcgcgcctccatgaagaaactgactcggaaacagggggatcttccaccgcccgcaaaacctgagcaaggaagctcagcgagccgaccagtgcccgccagccgcggtggcaagacgctctgcaaaggagatcggcaggccccacccggccctcctgctagattcccccggcccatatggtctgctagtcccccacgtgcccctaggtctagcactccttgcccagggggtgctgtgagagaagacacctaccccgtcggcacccaaggtgtccctagccccgctctggcccagggaggcccgcaagggtcctggcgctttctgcagtggaattccatgccgagattgcctacagatttagatgtggaaggaccctggttcagacattacgattttcgacagagctgctgggtgagagctataagccaggaagaccagttggcaccctgttggcaggccgaacaccccgcggagagggtccgcagtgccttcgctgcccctagcaccgatagcgaccagggcacccccttcagggcgagagatgagcaacagtgcgctcccacaagcggaccgtgtctttgtggccttcacctggaatcctctcagtttccacctggcttctag

SEQ ID NO: 137366 - DNA, 1410 bp, Artificial Sequence
  Description of Artificial Sequence: Synthetic coding sequence
atgcttggggattgggagaagtataaaagcagcaggaagttaatcgacagggcttacaaaggaatgccgatgaatattagggggcctatgtggagtgtgctactcaacatcgaggaaatgaaactgaagaacccaggccggtaccaaatcatgaaggaaaagggcaagcgcagttccgagcacattcagcggattgatcgagacattagcgggacactgaggaaacatatgttcttcagagaccgttacgggaccaagcaaagagagctgttacatattctgctggcttacgaggaatacaacccagaagtggggtactgtagagatctgtcgcacattgccgccctattcctgctttatctgcctgaggaagacgcgttctgggcgctagttcaactgctggccagtgagagacatagtctccagggctttcacagccctaacggcggcaccgtccagggactgcaggatcagcaagagcacgtggtggctacatcccagcccaagacaatgggccatcaagacaagaaagatctgtgtgggcaatgctcaccgctcggttgcctgatcagaattctgattgatggtatctcactgggccttacgttacgtctttgggacgtatatctggtggagggtgagcaggccttgatgcccatcactaggattgctttcaaagtgcaacagaagcgtcttaccaagacatcacgatgtggcccctgggccagattctgcaataggtttgtggatacctgggcacgagatgaggatactgtccttaagcacctccgcgcaagtatgaagaagctgaccagaaagcagggcgacctacccccgcccgctaaaccggaacagggcagctctgcaagccgacctgtccccgccagtcggggcggaaagacactctgcaagggggaccgacaggcacctcctggaccccctgcctggttccctaggccaatctggtctgcatcacctccaagggctcccagatcatcaacgccttgccctggaggtgctgtgcgcgaggacacataccccgtgggtacccaaggtgttccgtcgcccgctttggcccagggcggtccccagggctcctggcgctttctccagtggaacagtatgcctcgactccccacggacctcgacgttgaaggcccttggtttaggcattacgatttccggcaatcatgttgggtgcgcgcaattagccaggaagatcagttggctccttgttggcaggccgagcaccctgcagaaagggtgcgcagtgccttcgctgcccccagtactgactcagaccaggggacacccttcagagctcgcgacgaacagcaatgtgcacctaccagtggtccctgcctgtgtgggctccacctggagtcatcccagttccccccaggcttctag

SEQ ID NO: 137367 - DNA, 1650 bp, Artificial Sequence
  Description of Artificial Sequence: Synthetic coding sequence
atggacgttgtggaggttgccggctcctggtgggctcaagaacgggaagatatcatcatgaaatacgagaagggtcaccaggctgggctcccggaggacaagggcccaaaacctttcagaagttacaacaacaacgttgaccatctcggcatagtgcacgaaactgaactcccacccttgactgccagagaggccaagcagattaggagagagattagccggaaatcaaagtgggtcgacatgctgggagactgggagaagtacaagagcagtcgcaagctgatcgaccgggcttataaagggatgccaatgaatattagaggcccgatgtggtccgtgttgctgaatatcgaggaaatgaaactgaagaaccccggccgataccagatcatgaaagagaagggtaagcgtagctcagagcatatccagcggatagatagggacatctctggcaccctgagaaaacacatgttcttcagagataggtatggtacgaaacagcgcgaactgctgcatatacttctcgcatatgaggagtataatcccgaggtggggtactgccgtgatctctctcatattgccgcgctcttcctgctgtatctgcctgaggaagatgctttctgggccctcgtccaactcctggcatccgagagacacagccttcagggttttcactctcccaatggcgggacagtgcagggcctccaggaccaacaagagcatgtcgtggcaactagccagcctaagacaatgggacaccaggacaagaaagatctgtgtgggcagtgctctcccctggggtgtctgatcagaatcctaattgatggaatctctttgggattaactctgaggctgtgggacgtctacctcgttgagggagagcaggccctgatgccaattacccgaattgcattcaaagtgcagcagaaacgccttactaagacaagcaggtgtggcccatgggcacggttctgtaatcgattcgtggatacctgggcaagagacgaggacactgtgcttaagcacctgcgagcctcaatgaaaaaactcacacggaagcagggcgacctgcctccaccagctaagccagagcagggctcttcagcctcgcggccagtaccagctagtcggggtggcaaaactttgtgcaaaggcgaccggcaggcaccccctggtcccccagcccggttcccaaggcccatttggtccgcctcaccaccacgcgctcccaggtcgtctacaccttgtcccggaggggccgtcagggaggacacataccccgttggcacccaaggcgtcccctccccagccttggcccaaggaggtccacagggttcatggaggttcctacagtggaactccatgccacgcctaccgaccgacctggatgtagaaggtccgtggttccgccactacgacttcagacagtcctgctgggtgagagccattagccaggaggatcagctggccccctgctggcaagccgagcatcctgctgaacgcgtgcggtcggcttttgcagccccgagcacggactccgaccagggcaccccgttcagggctagggatgaacagcagtgtgcaccgacctcagggccctgcttgtgtggcctccacttagaaagcagtcagttcccccccggcttttag

SEQ ID NO: 137368 - DNA, 1410 bp, Artificial Sequence
  Description of Artificial Sequence: Synthetic coding sequence
atgctcggtgactgggaaaaatacaagtcttcgagaaagctcatcgacagggcctataagggaatgcccatgaatatccggggaccaatgtggtccgtgcttctgaatattgaagagatgaaattgaagaaccctggacgatatcagatcatgaaagaaaaagggaagcgctcaagtgaacacattcaacgtatcgatcgggacataagtggtacactacgtaagcacatgttctttcgggaccgctatgggaccaagcagagagagctcctgcacatcttactggcctacgaggaatacaatcctgaagtaggctactgccgcgacctgtcccatattgccgccctgtttctgctgtatctcccagaagaagatgccttttgggcactggtgcagctactggcctccgagagacactctttacaggggttccactcgccaaatggcggcacagtccagggccttcaggaccagcaagaacatgtggtggccacctcccagcctaagaccatggggcaccaggacaagaaagatctgtgcgggcaatgctctccgctaggctgtttaattcgcattctgattgacggtattagtttggggttaactctgcggctgtgggacgtctatctggtagagggggaacaggccttgatgccaatcaccaggatcgcctttaaagtgcagcagaaacgcctcaccaaaacaagcagatgtggcccctgggcgcggttctgcaatagattcgtggatacatgggccagggacgaagatacggtgctaaagcacctcagagcctccatgaagaagcttacaaggaaacaaggggatctaccccctcctgccaagcctgagcaggggagttctgctagcaggcccgtacctgcttcgcgaggcgggaagaccctgtgcaaaggagatcgccaagcccctcccggcccccctgcctggttccctcgacccatttggtcggcaagcccacccagagctccccgatcctcaactccctgccctggcggcgccgtacgtgaggacacttaccccgtggggacccagggcgtccctagcccggctctcgctcagggagggccgcagggatcctggcgattcctgcaatggaatagcatgccaaggctcccgaccgacctagacgtggaggggccctggtttcgtcactacgattttcgccagtcatgctgggtgcgggctatctcacaggaggatcaactggccccttgctggcaagcggagcaccctgccgagagggtgagaagcgcctttgccgccccaagtacagactcagatcagggtaccccatttagggcacgtgatgaacagcagtgcgctcccacaagtggcccttgcctgtgcggcctgcatctcgaatcctcccagtttcccccggggttttag

SEQ ID NO: 137369 - DNA, 3708 bp, Artificial Sequence
  Description of Artificial Sequence: Synthetic coding sequence
atggagcctccctcatgcatccaagatgagcccttcccccacccgctggaacccgaacccggcgtgtcagcgcagccagggcccggcaaaccatccgacaaacgttttagattatggtatgtggggggttcatgtctggatcatagaactacgttgcccatgcttccatggctgatggctgagattcgccggcgtagccagaaaccagaagccggcggttgcggtgcaccagcagccagagaggtgatactggtactctccgccccttttcttcgttgtgttccagctcccggtgccggggccagtgggggaacatccccgagcgcgactcagcctaaccctgctgtattcatttttgaacacaaggcccagcacatttcccggttcatacataatagccatgatctgacttacttcgcttacttaataaaagctcagcccgatgaccccgagtcacagatggcctgtcacgtttttcgggcgaccgaccctagccaggtccctgatgtaatttcctctattcgccagctttcgaaagccgcaatgaaagaggacgctaaacccagtaaggacaatgaggacgctttctacaattcccagaagtttgaggtgttgtattgtggaaaggtcacagtcacccataaaaaagcaccatcatcattaatcgacgattgtatggagaaattcagccttcatgagcagcagagactgaagatccagggagagcaaaggggacccgaccccggcgaggacctggccgatctggaagtcgtcgtcccagggtctccaggggattgtctacccgaggaagccgacggcaccgacacacatctaggactgcctgccggagcttcacaacctgccttgactagttctagggtgtgttttccagagaggatcctggaagacagcggattcgatgagcaacaagagtttcgttcgagatgcagctcagtcactggcgtccagcggcgcgtacacgaaggatcacagaagagtcagccaagacggagacacgcaagcgcacccagtcacgtgcaaccctctgactctgagaagaatcgaaccatgttgtttcaggtcggccgctttgagattaatttgatatctcctgacactaaatcggtcgtgctggaaaagaactttaaagatatcagcagctgctctcagggaataaagcacgtcgaccatttcggcttcatttgtcgggagtctcccgaacccggcttgtctcaatacatctgttatgtgtttcaatgcgcctcagaaagtctagttgatgaggtaatgctgaccctaaaacaagcctttagcaccgccgcagctcttcaatctgccaaaacgcagattaaactctgtgaagcctgccccatgcacagcctgcacaagctgtgtgagcggatagaggggctctatccaccccgcgccaaattagtgatccagagacacctgagtagcttaaccgataacgagcaggccgacatcttcgagagagttcagaaaatgaagcccgtgtctgatcaggaggaaaacgagttggtcatcttgcacctgagacaattgtgtgaggccaaacagaagactcatgtgcacatcggcgaagggccctcaaccattagcaattccaccatccccgagaatgcaacgtcctccggacgttttaaattggatatcttaaaaaacaaggccaaaagatccctcacctcctcgctcgagaatatttttagccgcggagccaacaggatgcgtggacgcctcgggtctgttgatagtttcgaacgcagcaactctttggcatcagaaaaagattatagccctggggatagtcctcctggcacaccccccgcatcaccgcccagctccgcctggcagactttccctgaagaggattctgactccccccagtttagaagacgagcccatactttcagccatcccccttcgtctaccaaacgaaaactgaacctacaagatggccgggcccagggagtcagaagtccactgctgcgccaaagcagttccgaacagtgttcggatggggaggggcggaaacgaacaagttccacctgctccaacgaatcactctccgttggtggcaccagcgtgactcctcgccgaatctcttggaggcaacgcattttcctccgagtggcctcccctatgaacaaaagcccgtcagccatgcaacagcaggatggattggaccgcaacgagctgttacccttaagtcctcttagccctaccatggaagaggagccactggtggtctttctgagcggcgaggacgaccctgaaaaaatcgaagagagaaaaaagtcaaaggaactgcgttcactgtggcgcaaggcaattcatcagcagattctgctgctgaggatggagaaggaaaatcaaaaactcgaggcgtcccgggatgagctgcaatctcgaaaggtgaagttggactacgaggaggtaggggcatgccaaaaggaagtgctcatcacatgggataagaaactcctcaactgtcgggccaagatccgatgcgacatggaagatatccataccttgctgaaggagggcgtgcctaagtcacggaggggcgaaatctggcaatttctggccttgcagtaccggctaaggcatcggctcccaaacaaacagcagccacctgatattagctataaggaacttcttaagcagctcacagcacagcagcatgctatcttggtagatctgggtcgtactttccctacgcatccttacttctccgtgcagttgggaccaggccagctgtccctgtttaatctgctgaaggcctactccctcctcgataaagaggtggggtactgtcagggaatttcttttgtggctggggtgctgctgcttcacatgtccgaggagcaggcctttgaaatgctcaaattcctgatgtacgacctgggttttaggaagcagtacagacccgacatgatgtctctccagatccagatgtatcagctgtcccgactgttgcacgattatcacagagacctatacaatcatttggaagaaaatgagatcagtcctagcttgtacgcggccccgtggttcctgactctgttcgcaagccagtttagcttagggttcgtggctcgcgtgtttgatattatttttctgcagggcacagaagtaatcttcaaggttgcgctctctctgctaagctcccaggagactctgataatggagtgcgaaagctttgagaatatagtggagtttttgaaaaacaccctgcctgacatgaataccagtgagatggaaaaaatcattactcaggtttttgaaatggatataagtaaacagttgcacgcatacgaggttgagtaccacgtccttcaggacgagctgcaggaatcatcttattcctgtgaggatagcgagactctcgaaaaactggagcgggccaactctcaattgaaaaggcagaacatggatttgcttgaaaagctgcaagtcgcccataccaagatccaggccctcgaatccaacctggaaaatttgctgaccagagagacgaagatgaagtccctaattcggacgttggagcaagaaaaaatggcgtatcagaagacagtggagcagctcaggaagctcctcccagccgatgcacttgtgaattgtgatctactgctgcgagacctgaattgtaatcccaacaacaaagcaaaaattggtaacaagccatag

SEQ ID NO: 137370 - DNA, 3897 bp, Artificial Sequence
  Description of Artificial Sequence: Synthetic coding sequence
atggagccaccatcttgtattcaggacgagccgttccctcatccactggagccagaaccaggcgtgtcagctcagccagggcctgggaagccatcggataaaagatttcgtctctggtacgtcggcggctcctgtctggatcatcggacaacactaccaatgctgccctggctgatggccgagatcaggcggcgctcccagaaacctgaagctggcggctgcggtgcgccagctgcccgggaggtgatcctagtcttgagcgccccatttctcaggtgtgtaccagcgcctggagccggcgcctccggcggtacttctccgtccgcaacgcagccaaacccagctgtcttcatatttgaacacaaagcgcaacacatcagcagattcatccacaattctcatgatcttacgtactttgcttatctgatcaaggcacaaccagacgatccagagtcccagatggcctgccacgtcttccgagcaacagacccttcacaggttcccgacgtcattagtagtatccgccagctgagcaaagccgccatgaaggaggatgcaaagccttccaaggataatgaggacgccttctacaacagccagaaattcgaggtgctatactgcggaaaggtgactgtcacacacaagaaggccccgtctagtttaatcgacgactgtatggagaaattctccctgcatgaacagcagagactgaagatccagggagagcagagaggtccagaccctggtgaagatctcgcagatctagaggtggtcgtccccgggagccctggtgactgtctcccagaggaagctgacggtactgacacacatttgggtttgcctgcaggagcttcccagcctgcactgacatcttcacgcgtgtgcttcccagagcggatccttgaagacagcggatttgacgaacaacaagagtttcggagccgctgctctagtgtgaccggcgtccagaggcgcgttcatgaaggttcgcaaaagtcccagccccgacggcgccacgcttccgctccaagccatgtgcaacccagcgactccgaaaaaaaccggactatgttgttccaggtggggcggtttgaaataaatctgatttcaccggataccaaatctgttgtccttgaaaagaactttaaagacatcagcagctgtagccaagggataaagcacgtggaccactttggctttatctgtcgtgagagtccagagcccggcctgtctcagtacatttgctacgttttccaatgcgcctcagaatcattggtggacgaggtcatgctcacactgaaacaggctttctcaacagcagccgctctccaatctgcaaagacacaaatcaaattgtgtgaagcgtgcccaatgcattctctgcacaagctgtgtgagagaatcgaaggactgtatcctcctcgagctaagctggtgattcagcgacacctatcctcccttactgacaacgagcaggccgacatctttgaaagagtgcaaaaaatgaagcctgtgagtgatcaagaagaaaacgaattagtgatattgcatttgagacaattatgtgaagccaaacaaaaaactcatgttcacattggcgaggggccttcgacgataagcaacagtaccatcccagaaaatgccacctcatctgggcggtttaagcttgacatactgaaaaacaaggctaagaggtcacttacttcatccctggagaacatattttctaggggcgccaaccgaatgagaggccggctggggtccgtggatagcttcgaaaggtcgaatagcctggccagcgagaaagattattctcccggagactcgcctccagggacgccacctgcttctcctccttcctccgcctggcaaaccttccccgaagaggactcagacagccctcaattccgacgaagggcacacaccttctcacatcccccatcttctactaagcggaagctaaatctgcaggatggacgcgcacaaggagttagatctccactcctcagacagagcagcagcgaacaatgtagtaacctctcaagcgtgaggcgaatgtacaaagaatctaacagtagctcttcacttcccagtttgcacacatcgttttcagccccatcatttacagcaccctcttttttgaaatctttttatcaaaattcaggcaggttatccccgcagtatgagaatgagattcgccaggacacggcatctgagtcttccgacggagagggccgtaaaagaacttcatccacctgcagcaatgaatctttgtcggtcggcggcacctctgtgacacctcgtcggatctcttggcgccaacgcatctttctccgagtggcgtccccaatgaataagagcccgtcagcaatgcagcagcaggacggattggatcggaatgaattgctgccacttagtccgctttcccccactatggaggaagaacccctcgttgtgttcctaagcggcgaagatgatccggaaaagatagaagagaggaagaagtcaaaggagctgcggagtctgtggcgtaaggctatccaccagcaaattctacttttgcgaatggaaaaggagaaccagaaactcgaggctagcagagacgaactgcaaagcagaaaagtgaaactcgactacgaggaggtgggtgcttgtcaaaaggaggtgctcatcacatgggataagaaactgttaaattgtcgtgcaaaaataagatgtgatatggaggacatccatacactgctcaaggagggagttccgaagtctcgaaggggcgagatctggcaatttctcgccctgcagtaccgtctgcggcaccgcctgcccaataagcagcaaccaccagacatttcgtataaggaactactaaagcagctgaccgctcaacaacacgccatcctcgtggatttaggtcgcacgttccctacacacccctatttcagtgtgcagctcggccctggccagttgtctctgttcaatttgctgaaggcctactccctcctggataaggaggtcggctactgtcaggggatcagcttcgtggcgggagtccttttgctccatatgtctgaggaacaggcgttcgagatgctaaaattcttgatgtacgatctgggattcaggaagcagtacaggcctgatatgatgagcttacagatccagatgtaccagctgtcgcggctgcttcatgactatcatcgagatttatataatcacctggaggaaaacgaaattagcccatcattgtacgctgcaccatggttccttaccctcttcgcttcacaattttctttgggtttcgtggctcgggtctttgacattatcttcctccaaggaactgaggtgattttcaaggtagccctctctctcttatccagccaggagaccctgattatggagtgcgagtcatttgaaaacattgtggagttcctgaagaatactttgcccgatatgaataccagtgagatggagaagattatcacccaggtctttgaaatggacatatcaaagcagttgcacgcatatgaagtcgagtatcacgtgttacaagacgagctgcaggaatcctcttattcctgcgaagatagtgagaccctggagaagctggagagagccaattcccagttgaagcggcagaatatggacctgctggaaaaactgcaggtggctcacactaagattcaagctcttgagtcaaacctagagaatctcctgaccagagagacaaaaatgaaatcacttattcgaaccctggagcaagaaaagatggcctaccagaagacggtcgagcagctacggaaactgcttcccgccgatgcactcgtgaactgcgaccttttattgcgcgacttaaactgtaatccaaacaacaaggcgaagattggcaacaaaccttag

SEQ ID NO: 137371 - DNA, 849 bp, Artificial Sequence
  Description of Artificial Sequence: Synthetic coding sequence
gataatgaacaagccgatatcttcgaacgggtccagaaaatgaagcccgtgtccgatcaagaggaaaatgagctcgtgatcctccaccttaggcaactttgtgaggccaagcagaagacccatgtccatatcggtgaggggccctcgaccatttctaattccaccattcccgaaaacgcaacgtcttctggtaggtttaaactggacatcctaaaaaataaggctaaaaggagcctgacttcgagtttggagaacatttttagtagaggagctaataggatgcgaggccgtttggggagcgtggattcgttcgaacgcagtaacagcctggcctcagaaaaggactattcccctggggactcacctcctggaacccccccagcgtccccccctagctcagcttggcaaaccttccctgaggaagactccgactctccacagttcagaaggcgagcacataccttctcccatccccccagcagcaccaaacgtaagttgaacctgcaggatggtagagctcagggagtgcggtctccccttctccgtcagagttcatctgagcagtgttcggatggtgaggggaggaagcggacctctagtacatgctccaatgaaagtctcagtgtggggggcacatcagtaactccacgcagaatctcgtggcgtcagcgcattttcctacgggtagcgagccccatgaacaagtcaccttccgcaatgcagcagcaggatggactcgatcgtaacgagcttttacctctctccccattgtcccccaccatggaggaggaacctctggttgtcttcctgtcgggcgaggacgacccagaaaaaattgaggagcggtag

SEQ ID NO: 137372 - DNA, 1389 bp, Artificial Sequence
  Description of Artificial Sequence: Synthetic coding sequence
atgaataagagtccctctgccatgcagcagcaggatggcttggatcgtaatgaactcctgcctctctcacctctcagccctaccatggaggaagaaccactggtggtgttcttgagcggtgaggatgatcctgagaaaattgaagagcgaaaaaagtcaaaagaactccggtcactttggcgcaaagctattcaccagcagatcctccttcttcgcatggaaaaagagaaccaaaaactggagggcgtacccaaatcccgccgaggggaaatatggcaatttctagcattgcagtacaggttgcgccaccgattgcctaataagcagcagccaccggatataagctacaaggagctcctcaagcaactcacagcgcagcagcatgccatcctggtggatctcggacgcacatttcctactcacccctacttttcggtgcaactcggtcccgggcagttgtccctgtttaacctcttgaaggcttacagcctgttggacaaggaagtcggttattgccagggcatatcattcgtcgccggcgtactcctgttgcacatgtccgaggagcaagctttcgagatgttgaaattcctgatgtacgatcttggcttcagaaaacaataccgccctgatatgatgagcctgcagatccaaatgtaccagctcagtagactcctacacgattaccacagagacctgtacaaccatcttgaggaaaacgagattagtccctctctttatgccgcgccttggttccttacactgttcgcctcccagttcagtctcggctttgtcgcccgggtgtttgacattatctttctgcagggcacggaggtgatattcaaagttgccttaagtctgctctcctcacaggaaaccctcattatggaatgcgagagcttcgagaacatcgtggaattcctgaaaaatactctccccgacatgaatacttccgaaatggagaagattatcacccaggtgttcgagatggacatttccaagcaattgcacgcctacgaagtggagtatcatgtgttgcaggacgagctgcaggagagcagctattcttgcgaagatagcgaaaccttggagaagcttgagagagccaactcccagctcaaaagacagaacatggatctcctggaaaaactccaggtggcccacacaaagattcaggctctggagagcaacttagaaaatctgcttacgcgggagactaaaatgaagagcctcatacggacgctggagcaggaaaagatggcgtaccagaagactgttgaacagttaagaaagttgctccccgcagacgcgctcgtaaattgtgacttgctcctcagagatttgaactgtaatccgaataacaaggccaaaattggaaataagccatag

SEQ ID NO: 137373 - DNA, 3873 bp, Artificial Sequence
  Description of Artificial Sequence: Synthetic coding sequence
atggaaccccccagctgtatacaggatgaaccttttcctcacccactcgaacccgagccaggcgtaagcgcccagccggggccgggtaagccatccgacaagagattccgcctttggtacgttggcggcagctgcttggatcaccgcactacactgcctatgctgccctggctaatggcggagatcaggcggaggtctcagaagcccgaggccggaggatgtggcgctccggccgcacgtgaagtcatcctcgtcctttccgccccatttctccgatgtgttcccgcgccaggtgccggtgccagtggcggcacaagccccagtgctacccagccaaacccagctgtgttcatttttgagcacaaagcacagcacatcagcaggttcattcacaattcccatgatttaacatatttcgcctacctgattaaggcccagcccgatgatcctgaaagtcaaatggcttgccacgttttccgggcaaccgaccccagtcaagtccccgatgtgatcagttctataaggcagctgtctaaagccgccatgaaggaggacgctaagccgagtaaggacaacgaggatgcattttacaactctcagaaatttgaagttttatattgcggaaaggttactgtaacgcacaagaaggcacctagcagccttattgatgactgcatggaaaagttctcattacatgaacaacagaggctaaagattcagggagagcagcgggggcccgaccctggggaagatctcgctgacctggaggtcgtcgtgcctgggtcccctggcgattgcctgccggaggaagcggacgggacagatactcacctggggcttccagctggggccagtcagcctgccctgacaagctccagagtctgttttcccgagcggattctggaggattccggttttgacgagcagcaagagtttcgctccaggtgttcgagcgtaaccggagtgcagagacgggtgcacgaaggatctcaaaagtctcagccgaggcgtagacacgcttccgcgcccagccatgtgcagccttctgacagcgagaagaaccggaccatgttgtttcaggtgggaaggtttgaaatcaacctcatttcgcccgacacaaaaagtgtcgttctggagaaaaatttcaaagacataagctcctgctcccaggggatcaaacatgtcgaccatttcggtttcatttgtagagagtccccagaacctggcttatcgcaatatatctgctacgtttttcagtgcgcctctgagtcactcgttgatgaagttatgttgaccctaaaacaagccttcagcacagccgccgccctgcaatcagccaaaacccaaataaaactatgtgaagcctgtcctatgcactcactgcataaactgtgtgaaaggatagaagggctgtatccacctagagccaagctggtgattcaacgccatctatcaagccttacagacaatgagcaagctgacatttttgagcgtgtgcagaagatgaagcccgtgagcgatcaggaagaaaacgaattggtaatcctgcatttacgccaattatgcgaagctaagcagaaaacccatgtgcacattggtgaaggacctagcacaataagcaatagtacaatcccagagaatgccacatcttccgggagatttaaactggatattttgaaaaacaaggccaagcgctcactaacatcgagtctggagaacattttcagtcggggcgccaatagaatgcgcgggagactcggcagtgtggattcatttgaacgttcaaatagtctggcttccgagaaagattactcgcccggcgacagtcctccaggcacgccacccgcttctccaccgagtagcgcatggcaaacatttcccgaggaggactccgactctcctcaatttagaagaagggcccatactttttcgcatccccccagcagtacaaagaggaaattgaacctgcaagatgggagagctcagggcgttcgatcgccccttctgcgccaatcatcttctgaacaatgtagtaacctaagcagtgtaaggcggatgtataaggaatctaacagttcctctagtttaccatctttgcacacctcatttagcgctccctcgtttactgcaccatcctttctgaagtccttctatcagaactcgggcagactctctcctcagtatgaaaatgagatctcagacggggaggggcgcaagcgaacgagctccacctgtagtaatgagtcgttgagtgtgggaggaacttcagtgacacctagaaggatttcctggagacagaggatctttctgcgggtcgcttctcccatgaacaagtccccaagcgcgatgcagcaacaggacggtctcgaccggaatgagctcctacctctgtcccctctcagtcctaccatggaggaagagccactggtcgtgttcttgtccggcgaagatgatcctgagaagattgaggaacgcaaaaagagtaaggaactgcggtcactgtggaggaaggccatccaccagcagattttactactgcggatggaaaaagaaaaccagaaacttgaagcttctagggacgaattacagagcaggaaagtgaaactagactacgaggaagtgggagcttgtcagaaggaagtcctgatcacctgggacaaaaagttgctgaattgccgcgccaagatcaggtgtgatatggaagatattcacaccctgctgaaagagggagttcccaagtcacggaggggtgagatctggcagtttctggctctccaatatcggctccgccaccgcctgcctaataaacagcaaccccccgacatatcctataaggaattgctcaagcagctgaccgctcagcagcatgcaattcttgtagacctgggtagaacgtttccaacccatccctatttttctgttcagctggggcctggacagctgtctttgtttaatctactgaaagcctattctttgctggacaaggaagttggatactgtcaggggatcagcttcgtggcaggggtgctcctcctgcacatgagcgaggagcaggctttcgaaatgctgaaattcctgatgtatgatctcggctttaggaagcagtaccggccagacatgatgagtttgcagatacagatgtaccagctcagcaggctgctgcacgactaccatcgagacctctataaccatctggaggaaaatgaaatctctccctctttgtacgccgcaccctggttcctgacactgtttgcaagtcagttttctctgggctttgtcgcaagagtattcgatattatattcctgcaggggacggaagtgatcttcaaggttgccttatccctcctcagctcacaggagacgcttattatggagtgtgaaagcttcgagaacattgtcgagttcctgaaaaacacgctcccagatatgaatacctctgaaatggagaagattataactcaggtgttcgagatggatataagcaaacagctgcacgcatacgaagttgaataccacgtgctgcaggatgagcttcaggagagctcttactcgtgtgaagattctgagacattagagaaactagagcgagccaacagccagctgaagagacaaaacatggatctcctcgagaagctccaagttgcccacaccaaaatccaggcactggaatctaatctggaaaatttattgacccgggaaactaagatgaaatccctgattcgaactctggagcaagagaaaatggcataccaaaagaccgtcgagcagctgcggaaactgctccccgccgacgctcttgtgaattgtgaccttttactgcgagacttaaattgtaacccaaataataaggctaagattgggaacaaaccatag

SEQ ID NO: 137374 - DNA, 1197 bp, Artificial Sequence
  Description of Artificial Sequence: Synthetic coding sequence
atgcatttcagcaccgtgactagagacatggaagcctttaccgcatcttcattgagcagcctcggtgcagctggaggctttccaggtgccgcctcccccggagccgacccctacggtccgagagaacctcccccaccaccacctagatatgacccctgcgcggccgcggccccaggtgcccccggaccgcctcccccccctcacgcatacccctttgcacccgctgccggagccgccacgtcagccgctgccgagcccgagggcccgggcgcttcatgtgcggcagccgctaaggcgccggtaaagaagaacgcaaaagtggcgggcgtgagtgtccaactggagatgaaggccctatgggacgagttcaatcagctggggactgagatgatcgtgactaaagctggaaggcgaatgtttcccacattccaagtcaagctgttcgggatggatccaatggctgactacatgttactgatggattttgtccccgtcgatgacaagcgctaccgctatgcctttcattcttcctcttggctggtggccggcaaagctgaccccgctaccccaggacgcgtgcattaccatccagactcacctgcaaaaggtgcccagtggatgaagcagatcgtgtcctttgacaagttgaagcttacaaataaccttttggatgataacggccacattatcctaaattccatgcacagatatcagccccggtttcatgtggtgtacgtcgaccctcggaaggacagtgagaaatacgctgaggagaacttcaagaccttcgtctttgaggaaaccagattcacggcagttaccgcataccagaaccatcgcataacccaactaaaaattgcttcaaatcctttcgcgaaaggttttcgtgattgcgaccctgaggattggccacgaaaccatcgacccggtgctctgccactgatgtctgcttttgctcgtagtcggaatccagtcgcctctccgacacagcctagcgggactgagaagggcggtcacgtcctcaaggataaagaggtgaaggccgagaccagcagaaataccccggagcgggaagtcgagcttttgcgcgacgccggcggttgtgttaaccttggacttccatgccccgccgaatgtcagccatttaacacacagggcctggttgccggacggaccgcaggcgataggctttgttag

SEQ ID NO: 137375 - DNA, 1488 bp, Artificial Sequence
  Description of Artificial Sequence: Synthetic coding sequence
atgcacttttccaccgtgacaagggatatggaggcattcacggcctcatccctatcctccctgggagccgccgggggattccccggcgccgcctcccccggagccgatccgtacggtccacgggagcctccccctcctcctcctcgctatgacccatgcgccgctgcagcccctggggctcccggaccacccccgcccccgcatgcttatcctttcgccccagcagcgggggcagctacgagcgctgcggctgagcctgaagggcccggcgccagctgcgccgccgccgcgaaagcgccggtgaaaaagaatgccaaggtcgctggcgtgtccgtgcagctggagatgaaggcgctatgggatgagtttaaccagttggggacagagatgattgttacaaaagccgggaggcgcatgtttcccactttccaggtcaagctcttcggcatggacccgatggctgactacatgttgctgatggacttcgtaccggtggacgacaaacgctatagatatgcttttcattcctcctcttggctggtagcgggaaaagcggacccagcaacaccaggccgtgtccattatcatcccgactctccagcaaaaggtgcacagtggatgaagcagatcgtcagcttcgacaaactcaaacttaccaataacctcctcgacgataacggtcacatcattcttaacagcatgcaccgctaccagccccggtttcatgtggtctatgtggacccccggaaagactccgaaaagtatgctgaagagaacttcaagacattcgtctttgaagaaacccggttcacagcagtaaccgcttatcaaaatcatcgtatcacacagctgaagattgcatccaacccgttcgccaaggggtttcgcgactgcgatccagaggactggccgagaaaccaccgccctggggcgctgcctttaatgagcgctttcgcgcgctctcggaatccggtggccagcccaacacagccctcagggacggagaaggacgccgctgaggcgagacgggagttccagcgtgacgctggaggccctgcagtccttggggatccggctcaccctccacagctgttggcgcgggtgcttagcccttccttaccgggagccggcggagctggtggtctcgtgcctctacccggagcccctggcgggaggccctcaccgccgaacccagagctcaggctagaggcccctggcgcctctgaacctctccaccaccacccctacaaatacccagccgctgcatacgatcattaccttggggccaaaagtagacccgccccctatccactccctggtctcagaggacacggttaccacccacacgcacatcctcatcatcatcaccacccagtctcacctgccgccgcagctgcagcagcagctgcagctgctgccgcagctgccaatatgtacagtagcgcgggggcagcccctccagggtcatacgattactgtcctaggtag

SEQ ID NO: 137376 - DNA, 1119 bp, Artificial Sequence
  Description of Artificial Sequence: Synthetic coding sequence
atgcatttctcgaccgtcaccagagatatggaggcatttactgcatcaagtctctctagcctgggggccgccggcggatttcccggagcagcctcacctggggcagatccctatggtcccagagagcctccccctcccccacccagatacgatccctgcgccgccgctgcaccaggcgcccctggccctccccctcccccccacgcttatcccttcgccccagccgccggcgccgccacgagtgctgccgcggagcccgagggaccaggtgcttcctgtgccgctgccgcaaaggcccctgttaaaaaaaacgcgaaggtagcaggggtgtccgtgcagctggagatgaaagcactttgggatgagttcaaccagttggggaccgagatgatagtgacgaaagccgggagacgcatgttcccaaccttccaggtcaagcttttcggcatggaccctatggcagattacatgctgctgatggactttgtccccgtggatgacaaacgataccgctacgctttccactcgagttcttggctggtagctggtaaagccgatccagcaacgcctggacgggtgcactatcaccccgattcccctgctaagggcgcgcagtggatgaagcagatcgtgagttttgacaagctcaagctcaccaataatttgctggatgataatggtcacatcatcctcaacagcatgcaccggtaccaacctaggttccacgtagtctatgttgatcctcggaaagactctgaaaagtacgccgaggagaacttcaaaacatttgtgtttgaggaaacacggtttaccgcagtcaccgcttaccaaaaccatagaattactcagcttaagatcgcttctaatccttttgcaaaagggtttcgggactgcgaccctgaagattggcccaggaaccataggccgggggcccttcctctgatgagtgccttcgcccggtctagaaacccagttgcaagccccacacagcctagtggcaccgaaaagggcctggtgaccgagggatccggccttcagccgggcttactggacgttttgcttaaacccccaagtaagaaatccgagtcgcttcggccaccgcactgtaaggatacctag

SEQ ID NO: 137377 - DNA, 1158 bp, Artificial Sequence
  Description of Artificial Sequence: Synthetic coding sequence
atggccgcatttctctcagcgggcctcggaatcctggctccctccgaaacatatcccctccctaccacttcctccggctgggaacccagattgggctctccttttccgtccgggccctgtacatcttcaacaggggcccaggcagttgccgagccaacaggccagggacccaaaaatccacgcgtgtcaagggttactgtgcagcttgaaatgaagcctctatgggaggagttcaatcagcttgggaccgaaatgattgtgacaaaggcgggtcgcagaatgttccctcccttccaggttaagatacttgggatggacagcctcgccgattacgccctcctgatggatttcattcctttggacgataagcgctataggtatgcatttcattcttcggcgtggctggttgcgggtaaagcagaccctgccacacctggccgtgttcattttcaccctgatagccctgctaaaggagcacaatggatgaggcaaatcgtgtcttttgataaactgaagctgactaacaaccttctggacgataacgggcatattatccttaactccatgcaccgctaccagcctagattccacgtagtgttcgttgacccgcgcaaggatagcgagagatacgcccaagaaaattttaagagcttcattttcactgagacacaatttacagccgttaccgcctaccagaaccataggatcacgcagctcaagatcgccagcaaccccttcgcaaagggcttcagagagtccgatcttgacagctggcccgtggccccccgtccactgctatctgttccagcgcgcagccactctagcctgagtccatgtgtgctaaaaggagctactgatcgtgaaaaagatccaaacaaggcttcggcatcaacatccaagacgccggcctggttacatcatcaattgctcccccctcccgaggtgctccttgcacctgccacgtaccggcccgtcacttaccagtcactctactcaggggccccctctcatctcggaataccaaggactcgccccgcgccatatcccctgccaaatatcagggcagacagggaccagggcggacttccgctgcctgcagggcttggtctcctctccccaacagtggtgtgcctcgggcccgggcaggattcccagtag

SEQ ID NO: 137378 - DNA, 2454 bp, Artificial Sequence
  Description of Artificial Sequence: Synthetic coding sequence
atgatggatggtcctcggtccgacgtaggccggtggggagggaacccccttcagccacccaccaccccttcacctgagccggagccagagccagatgggaggagtagaagaggggggggtagaagtttctgggcccggtgctgtggctgctgtagttgcaggaacgccgcagatgacgactggggaccagagccctcagatagtaggggaagagggtcctcaagtggcacccgcaggcccggtagtcgcggctctgatagtaggaggccagtgagcaggggatctggagtgaatgcggctggggacggaacaatacgggaaggcatgctcgtagttaatggcgtagatctgctctcttcccggagcgaccaaaatcgcagggaacatcataccgatgaatacgaatatgacgagctgatcgttcggagagggcagccattccacatgctgctgctactgtctcggacatatgaatcttccgaccgtatcactctggagctacttatcgggaacaatcctgaggtggggaagggtacacatgtcataattcccgtgggcaagggaggctccggggggtggaaggcccaagtggtgaaggcctcaggtcagaatctaaacctccgcgttcatacatctcctaacgcaattatcgggaaatttcagttcactgttaggacccaatccgatgcaggagaattccagctgccttttgaccctcgaaacgagatctatattctcttcaatccgtggtgtcctgaagacatcgtttatgtggaccatgaggactggcgccaggagtatgtcttgaatgagtcaggccgtatatactatggcacagaggctcagattggtgagcgcacctggaactacggccagtttgaccatggcgtactcgacgcctgtctgtatatcttagatcgccggggcatgccatatggagggcgcggtgacccagtgaacgtgagtcgagtcatctccgccatggtcaattctttggatgacaatggagtgctgattgggaattggagcggcgattatagtcgaggaacaaacccgagcgcatgggtgggttccgttgagatcctcctttcttatctgcggacaggctacagcgtaccatacggccaatgctgggttttcgccggtgtcacaaccaccgtgctccgttgcctgggactagcaacacggactgtgaccaattttaacagtgcccatgataccgacacttcactcacgatggatatttatttcgacgagaacatgaaaccccttgagcacctaaaccatgattcagtgtggaattttcacgtgtggaacgactgttggatgaaacgccccgatcttccatcaggtttcgacgggtggcaggtcgtcgatgccaccccacaggaaacctcatctggcattttttgttgtggaccttgttcggtggagtcgattaaaaacggacttgtctacatgaaatacgatacgcctttcattttcgcagaggtcaactcagataaggtgtactggcagcgacaggacgatggctcattcaaaatagtttatgtagaagagaaagccatcggtacattaatcgtgaccaaggctataagcagcaatatgagggaagacattacttatctctataaacatcctgaaggctcggacgctgaacgcaaggccgtagaaaccgcggcggcccacgggagcaagccaaatgtttatgccaatcggggctctgctgaagatgttgccatgcaggtggaagcccaggatgctgtgatggggcaagatctaatggtctcagtgatgctcatcaaccactcatcttctaggagaaccgtcaaacttcacctctacctgtccgtgacattctatactggagtgagtggcacaatctttaaagaaacgaagaaggaggtcgagttggcacctggcgcctccgaccgggtcactatgcctgtggcttacaaagagtaccgcccccacctagtggatcaaggtgccatgctactcaatgtgagcgggcacgttaaggaatctggccaggtgctcgccaaacagcacaccttccggctccggacccccgacttaagcctaacgttactcggagctgctgtggttggccaagaatgcgaagtgcagatcgtcttcaaaaatcctctccccgtgactctcactaatgttgtgttcaggctcgagggctcaggtttacagaggccaaaaatcttgaatgtgggtgacattggcggtaacgagaccgttacacttcgccagtcattcgtacccgtgcgccccggacctcgccagctgatcgcctctctggacagcccgcagttaagtcaggttcacggtgtgattcaagtagatgtcgcaccagcgccaggagatggcggcttttttagcgacgcagggggcgactcccaccttggtgagacaatacctatggcctcaagaggcggagcatag

SEQ ID NO: 137379 - DNA, 1200 bp, Artificial Sequence
  Description of Artificial Sequence: Synthetic coding sequence
atgcataagtaccagccacgggtccatgtgatacggaaggatttctcgagcgatctgagccctaccaaaccagttcccgtgggcgacggggtgaaaacatttaatttccccgagacagttttcacaaccgtgaccgcttatcagaaccagcaaattactcggctcaaaattgacaggaatccgtttgccaaaggctttcgagattcaggccgtaaccgtactgggctggaggctattatggagacatacgccttctggcggcctcccgtgcgcacactgacctttgaggactttaccacgatgcaaaaacagcaggcttccaagaaaaccagtcaaggctacaccgttaatcaacatagtagcgaaacagacgccattgaactatacgaacggagagtctggcttatggaaaggcggggttccacagggacctcccctacaaccagtagtaccggcactccttctccgtccgctagtagccatttgcttagcccaagctgtagcccccctacattccatctggcgcctaacactttcaacgtcggttgccgcgaatcacagttgtgcaatcttaacctgagcgattatcccccttgcgccaggagcaatatggccgctctgcaatcataccccggtttgtccgattctggctataatcgacttcagtctggtaccacttctgcaacgcagccctccgagacctttatgccgcagcgcacacctagcctgatttccggcattccaactcccccgtcacttcccggcaactctaagatggaggcctacggcggtcagttgggaagttttcccacctctcagttccaatacgtcatgcaggcggggaatgcagcaagcagttcatcctccccacacatgttcggaggcagtcacatgcaacagtctagctataatgcgttttctctccacaatccctacaacctttacggttataattttcctactagtcctagactggcggcgtccccagagaagctttcggcttcacagtccacgcttctttgtagctccccctctaacggagccttcggcgaaaggcagtacttaccaagcggaatggagcacagcatgcacatgattagtcctagccctaacaatcagcaagcgactaacacttgtgacggtaggcaatatggcgccgtgcctgggtcctcatcccaaatgtccgtgcatatggtctag

SEQ ID NO: 137380 - DNA, 1809 bp, Artificial Sequence
  Description of Artificial Sequence: Synthetic coding sequence
atgtccgaacggcggcgctctgcagttgctttgtctagtagagcccacgctttttccgtcgaggcacttattggatctaataagaaaaggaaactgagggactgggaggaaaaaggactcgatctgagcatggaagccttgtcgccagctggccctctgggcgataccgaagatgctgccgcccacgggctagagccacacccagactcggaacaatccaccggatcagatagcgaagtgcttactgagcgaacttcttgttccttctcaacacatacagacttggcctcaggcgcggctgggcctgttcctgcagcgatgtcctccatggaggagatccaggtcgaactgcagtgtgcggatttgtggaaacggttccatgacattggaacagagatgatcatcacgaaagccggccgccgcatgttcccagctatgcgggtgaaaatcaccggcctcgaccctcatcagcagtactatatagcgatggacatcgtgcccgtagacaataagcgttaccggtacgtgtaccatagctccaaatggatggtggccggtaacgccgatagccctgtgccccctcgggtgtacatccatccagactcactagccagcggcgacacctggatgcgccaagtggtaagcttcgacaagctgaagctgaccaacaatgagctagacgatcagggccatattatcttgcactccatgcacaaataccagcctagggtgcatgtgattagaaaagatttcagttcggacttgagccctaccaaacctgtgcctgtgggagatggcgtcaaaacttttaactttccagagacagtctttacgactgtgactgcttaccagaatcagcaaatcacacgccttaagatcgaccgtaatcctttcgcaaagggcttccgcgactctgggagaaatcggacaggactggaagcgatcatggagacctacgcattctggagaccccccgttcggaccctgacattcgaggatttcacgaccatgcagaagcaacaggggggctccacaggcacctcccccaccacttcatccacgggcacgcctagcccatctgctagcagtcacctcttgagcccttcctgtagtccaccaacgttccacctcgctcccaatacctttaatgttggatgtcgcgagtctcagctatgtaacctaaacctgtctgattatcccccatgtgcccgcagcaatatggctgcactgcagtcctaccctggactgtcggattccggatacaatcgcctgcaatctggaacgacatctgctacacagcccagcgaaacgtttatgccccaacgtacgcccagtctaattagcggaatccctacccccccctccttaccaggaaattcaaaaatggaagcgtacggggggcagcttggcagctttccaaccagccagttccagtacgtgatgcaggcaggaaatgcggcgagttctagcagttctccccacatgtttggtggctcacacatgcagcagagtagctataacgccttcagcctgcacaatccctacaacctgtacggatacaattttccaacaagccctcgcctggccgcttctccagagaagttgagcgcttcccaaagtacattattgtgttcctccccctctaacggtgcatttggagagagacaatacctcccctctggaatggagcacagcatgcacatgatttctccgagccccaacaatcagcaagccacgaacacctgcgatggccgccagtacggtgcagtgcccgggagtagtagtcaaatgtctgttcatatggtgtag

SEQ ID NO: 137381 - DNA, 762 bp, Artificial Sequence
  Description of Artificial Sequence: Synthetic coding sequence
agggtaagaaccggcctggaggccatcatggagacctacgccttctggaggccccctgtccgcacactgacgttcgaggacttcacaaccatgcagaagcagcaggctagcaagaaaacttcacagggatacacagtaaaccagcacagttctgagaccgacgccatcgagttgtacgagagacgtgtttggcttatggaacgcagggggagcacagggacaagccccaccacctcgtcaacggggacgccttccccgtctgcaagcagccatctgttgtccccgagttgctccccgccaaccttccacctagcccctaacacgtttaacgtgggatgtagagagagtcaactgtgtaaccttaatctctccgattacccaccttgcgctagaagtaacatggctgccttgcaatcataccctggtctcagcgattcaggatacaacagactgcagtcagggactacaagtgccacgcagccaagcgagacttttatgccccagcgtactccctctttgatctcaggcattcccacgccaccctctctgccaaccgcccgatggaaacccactgtagcgagctgggggccttttcccctcccttccttcagcatgagttgccgccaggccatgttaccgccagccccccatcaccacacatgtagtggcgccgctacgtgctcacgtgcgcctacaatgccatctccatttaccaccctgacaacttgtatggacaccatatcaccactgcctctgggatag

SEQ ID NO: 137382 - DNA, 993 bp, Artificial Sequence
  Description of Artificial Sequence: Synthetic coding sequence
ggcagaaaccgcacggggctagaggcaataatggagacctatgctttctggcgcccccctgtgcgtaccctgacgtttgaggatttcacgacaatgcagaagcagcaggctagcaagaagaccagccagggctacaccgtcaaccagcacagctctgagaccgacgccatcgagctatatgaacggcgggtctggctgatggagaggaggggatcaacgggtacatcccccacaacctcgtctactggaacaccttcccccagtgctagcagccacctcctgtccccgtcctgtagtccaccaacattccatctggccccgaacacctttaacgtgggctgccgagaaagccagctttgcaacctaaatcttagtgactatccaccgtgtgcacgatccaacatggccgcactgcaaagttaccccggcctgtctgacagcggatataatcgactgcagtcaggaacaacatctgccactcagccttcagagacctttatgccacaacgcactcctagtctgattagcggaatccctaccccaccttccctgcccggcaattccaagatggaagcatatggcgggcagctcggctctttcccaacttcacagttccagtatgtgatgcaggcaggaaatgctgcctcatctagttcaagtcctcacatgtttggcggatcgcacatgcagcaatcctcctacaacgcgtttagtctccacaacccttataacctgtacggatataatttccctacatcaccaaggctggctgcgtcaccagagaaactgagcgctagccagagtactctgctctgcagtagcccctctaatggggcctttggggagcgccagtatcttcccagtggaatggagcatagtatgcacatgatatccccatcccccaacaatcagcaggctaccaacacttgcgatgggagacaatacggtgcggtgcccggatcttcgtctcagatgtcagtccatatggtctag

SEQ ID NO: 137383 - DNA, 1347 bp, Artificial Sequence
  Description of Artificial Sequence: Synthetic coding sequence
atggccatgtcagaactggggactcgcaagccttcagacggtacagtatctcatctgctgaacgtcgtggaaagtgagcttcaggcaggaagggagaaaggcgatcccaccgagaaacagctgcaaattatcctcgaagatgcccccctttggcaacgattcaaagaggtgacaaacgaaatgatagtcactaagaatggcagacggatgtttcccgtgctgaagatctctgtgacgggactggacccgaatgctatgtatagcctgttgctggacttcgtgcctaccgacagtcatagatggaagtatgttaacggagagtgggtcccagctggaaaaccagaagtttctagccacagttgcgtctatattcaccccgattcacccaacttcggagctcattggatgaaggctccgatcagttttagcaaggttaaactgaccaacaaattaaacggaggtggtcagataatgctaaattctctccataaatatgaaccccaggtgcacatcgtccgcgtgggatccgctcaccggatggtgaccaactgctcattcccggaaacccagttcatcgcggtcacagcgtatcagaacgaagagattactgcccttaagatcaagtataacccgttcgcaaaagcattcctggatgccaaggagcgcaatcacctgcgggatgtgcctgaggcaatatccgaatcacagcacgtcacatacagccacctgggcgggtggatcttctcaaacccagatggggtctgtacagcgggcaactcaaactatcagtacgcagctcctttgccgctgcccgctccacacactcaccacggatgtgagcactactcggggttgcggggccatcgacaggctccttatccatccgcttatatgcacaggaatcatagtccaagtgtgaacttgatcgagtcctccagtaataacctgcaggtattctcgggtcccgattcctggacctcattgagcagtacaccccatgctagtatcttgagcgtcccacacaccaacggtcccattaacccaggaccatctccgtatccttgcctctggactatttccaatggtgccggaggcccaagcggacccggccccgaggttcatgctagcacgcccggagccttccttttaggaaaccccgccgtgacaagtcctcccagtgtcctgtctacacaggccccgacgagcgctggagtggaggttctgggcgagccctcactgaccagcatcgcagtttctacctggactgcggtggcctcccacccctttgcagggtgggggggacctggagcaggcggacaccatagtccctcctccttagacggatag

SEQ ID NO: 137384 - DNA, 978 bp, Artificial Sequence
  Description of Artificial Sequence: Synthetic coding sequence
atgatcgtaacaaaaaacgggcggcgcatgtttcccgttctgaaaatcagcgtgactggactggacccaaatgcaatgtacagcttattgcttgatttcgttccaaccgactctcatagatggaagtacgtcaacggcgagtgggtgcccgctggaaaaccagaagtgtcttcacattcatgtgtgtatatccatccagattcacctaatttcggtgctcactggatgaaagcgcccatctcattctctaaggtgaaacttacaaataagctaaatggcggcgggcaaattatgctcaattcactgcacaagtacgagccacaggtgcacatagtgcgtgtcggctccgctcaccgcatggttactaattgctcctttccagagacccaatttatcgccgtgacggcttaccagaatgaggaaattactgccctcaaaatcaaatataatcctttcgcgaaggctttcctggatgcaaaggagcggaatcacctcagggacgtaccagaggccatctctgagagccagcatgtgacttatagccacctaaatctgatagagtcgtccagtaataatctgcaagtcttctcaggccccgactcttggacctcgctttcttctaccccgcatgccagtattctttcggtgccccacacgaacgggcccatcaatccaggaccctccccctacccttgcctgtggaccatatcaaacggcgccgggggtccttccggcccgggacctgaggtgcacgcatcaactcccggggctttccttttaggcaacccggctgtcacttccccaccgagcgtgctcagtacccaggctcccacatctgctggtgtggaggtgctcggtgagcccagtctaaccagcatcgctgtaagtacgtggactgctgtggcaagtcacccctttgctggctgggggggtcccggtgctgggggccaccattccccctcctctttggatggctag

SEQ ID NO: 137385 - DNA, 957 bp, Artificial Sequence
  Description of Artificial Sequence: Synthetic coding sequence
tagcgcatgttccctgtgctgaagatatccgtcaccggcttagatcccaacgctatgtattccctccttcttgacttcgtcccgacagatagccacagatggaagtacgtgaacggtgagtgggtaccagccggcaagcctgaggtgtccagccactcatgtgtttacatccaccccgacagtcctaatttcggtgctcactggatgaaagccccgatttctttcagcaaagtaaagctcaccaacaaattgaacggcggcggacagatcatgctgaattctctgcacaagtatgagccacaggtgcatatcgtgcgggtgggttcagctcatcgcatggttactaattgctcttttccggagacgcaattcattgccgtaacagcctaccagaacgaagaaattactgcattgaagataaagtacaacccattcgccaaggcctttcttgacgctaaagagcggaatcacctgcgagatgtgccggaggccatatcggaaagtcaacacgttacctactctcatctcaatctgattgagagctcatcgaataatctgcaagtgtttagtggcccagatagctggacaagcctcagctcgaccccacatgcgagcatcctatctgtcccccatacgaacggaccaatcaacccaggaccctcaccttacccctgtctgtggaccatcagcaatggcgcaggtggaccgtctggccccggcccagaagtgcacgctagcacgcccggagcatttctccttggcaaccccgccgttacaagcccaccttcagtactcagcactcaggctcccacttcagctggggtcgaggtccttggcgaaccaagcctgacctcaatcgccgtgtctacttggacagcagtggcttcccaccccttcgccggctggggtggaccgggcgccgggggacaccactccccctcttccctggacggatag

SEQ ID NO: 137386 - DNA, 846 bp, Artificial Sequence
  Description of Artificial Sequence: Synthetic coding sequence
tgaaaggaacgcgaactgaactggttctaccgccggcagcgagtactctttgcccacgtctatcccaccttcacaaatacgtcatgcctctgtaaatgcaaaatcacggcgctcaaaatcaaatacaacccctttgccaaggcattcctcgatgcaaaggaaagaaatcatctgcgcgacgtccccgaggccataagcgaatcccagcacgtgacttattcccacttagggggctggatcttctctaatcctgatggggtctgcaccgcagggaatagcaactaccaatatgccgcacccctaccactccccgcacctcatacccatcatggttgcgaacactacagcggactcagggggcaccgccaggcgccatacccttcggcctatatgcatagaaaccactcaccgagcgtgaaccttattgagtcgagtagcaataacctccaggtgttcagtggccccgatagttggacaagcctgagctctacccctcacgcaagcatacttagcgttccccatacgaacggccctataaatccgggaccctccccctacccttgtctttggacaataagcaacggagccggagggcccagcggacccggtcccgaggtgcacgcttcgacgcctggtgccttcctgctgggtaatcctgccgtgacaagtcccccgagtgtgctgtcgacacaggccccaacttccgcaggagtcgaagttctcggggaaccctccctaacctccattgcggtttccacatggacagccgttgcctctcaccctttcgccggatggggcggacccggtgcaggtggccaccatagtccctcttctctggatggatag

SEQ ID NO: 137387 - DNA, 1344 bp, Artificial Sequence
  Description of Artificial Sequence: Synthetic coding sequence
atggagttcactgcaagccctaagccgcaactgtcatcccgggccaacgcattctctatagccgctctaatgagttcgggaggcagtaaagagaaagaagccaccgagaatactattaaaccgctggagcagtttgtcgaaaagtcctcttgtgcccagcctctcggcgagttaaccagcctggacgcccacggcgaattcggtggtggcagcggcagttctccaagctctagctcactttgtaccgagccccttatcccaaccaccccaatcattccttccgaggagatggccaaaatcgcatgctctttggagacaaaagagctttgggataaatttcacgagctgggcactgagatgatcattaccaagtctgggaggcggatgttccccaccatcagagtgtccttctcgggcgttgaccccgaagcaaagtatattgtgcttatggatatcgtccccgttgacaataagcgataccgttacgcgtatcatagatcctcatggctcgttgctggcaaagcagacccacctctccccgccaggttgtatgttcatcctgactcaccattcactggcgaacaactcttaaagcaaatggtgagctttgaaaaagttaagcttactaacaatgagttagatcagcatggccatatcatactcaactccatgcacaaataccaacctagggtacatatcattaagaaaaaggatcatacagcaagtctactcaatctcaaaagtgaggaatttcgaacgttcatttttcccgagacagtattcacggccgtgactgcctaccagaatcagctgatcaccaagttgaagatagatagtaatccattcgcaaagggattcagagatagttcccggcttactgatatcgaacgcgagagcgtggaatcccttatccaaaagcactcatatgcccgcagcccaatccggacctacggtggtgaagaagatgtgctgggagacgagtcccagaccaccccaaaccgaggttccgccttcactacatctgataacctgtctctgtcaagctgggtttcctcctcttcaagctttcccggtttccagcatccacagtctttaaccgcgctagggacaagcactgcgagtatcgctacccctataccacacccaattcagggctcattaccaccctacagcagactggggatgcccctgactccctctgcaatagcttcctcgatgcagggctctgggcctacattcccctcttttcacatgccacgttatcatcactactttcagcagggaccttacgctgcaatccaggggctgaggcacagttccgcggtgatgaccccctttgtttag

SEQ ID NO: 137388 - DNA, 1608 bp, Artificial Sequence
  Description of Artificial Sequence: Synthetic coding sequence
atgggtattgtggaaccgggctgcggcgacatgctgacagggaccgagccaatgccggggagcgatgaaggcagagcgccgggggccgaccctcagcaccggtacttctacccggagccaggtgcccaagatgcagatgaacgcagggggggcggatcattggggagcccttacccaggcggggcccttgtcccagctccacctagccgctttctaggcgcctacgcctaccccccgcgacctcaggccgcaggattcccaggcgcaggcgagagcttccctccacccgccgacgccgagggctaccagcctggggagggctacgctgcacctgatccacgcgcgggtctgtaccctggtcctcgagaggactatgctttgcccgccgggcttgaagtttctggcaaattgagggtggctctgaataaccacctgctctggtccaagtttaatcagcaccagaccgaaatgatcatcacgaaacagggcagacggatgttcccttttctgtcttttacagtcgccggcctggaacccacttcccactaccgcatgtttgtcgacgtcgtgcttgtcgatcaacatcactggcgctatcagtccggcaaatgggtccagtgtgggaaagccgaaggaagcatgccaggcaatcggctctacgtccatccggatagccctaatactggagcccattggatgagacaggaggtcagtttcggaaaactgaaacttacaaataacaagggcgcatccaataacgtgacccaaatgatcgtcctgcagagcctccacaaatatcagcctcgcctgcacattgtggaggtcaatgacggggaaccagaagctgcgtgcaacgcatccaatacccatatttttacttttcaggaaacccaatttatcgctgtgacagcctatcagaatgccgaaattacacagcttaagatcgacaacaaccccttcgctaaggggttccgggagaactttgaaagcatgtacaccagcgtagatacatctatcccatcccccccaggacctaactgccaattcctgggcggcgaccactatagccctttgcttcccaatcagtaccccgtaccttcccggttttatccagacctgcctgggcaagccaaagacgtcgtgcctcaggcatactggttgggagccccccgagaccattcgtacgaagccgagttccgcgccgtcagcatgaagcccgcctttctgccatcagcaccaggaccgactatgtcctactacagaggccaggaggtcctggctcctggagcaggatggcctgtggcacctcaatacccccccaaaatgggccctgcctcttggttcagacccatgagaacgctccctatggagccaggccccggaggatccgaagggcgcggtcccgaagatcagggtccaccgttggtgtggactgagatcgcacccattcggcccgaatcctccgattctggactgggtgagggagacagtaaaaggcggcgcgtcagcccttacccttctagcggcgattcttcatcccccgccggcgccccttcccctttcgacaaagaagctgagggacagttttacaattactttccaaattag

SEQ ID NO: 137389 - DNA, 1203 bp, Artificial Sequence
  Description of Artificial Sequence: Synthetic coding sequence
atgtttccgtcagtgagggtcaaagtcaagggactagatcctggaaagcaataccatgtggccatcgacgtggtacccgtagattcaaagcgctatcgatacgtataccacagtagtcaatggatggttgctggcaatacagaccacctgtgtatcatcccgagattctatgtgcatcctgattcaccttgttctggcgaaacgtggatgagacagataatctcctttgatcgtatgaagctgactaataacgaaatggatgataaagggcacatcatccttcagagcatgcataaatataagccccgcgtgcatgtcatcgagcaaggatccagtgtggacctaagccagatccagagcctgcctactgaaggggttaaaacgttcagcttcaaggaaactgaattcacaactgtaacggcttatcagaatcagcagatcaccaaacttaaaatcgagcgtaatccattcgccaaaggctttcgggataccggcaggaaccgcggagtactcgacggacttctggaaacatacccttggcggccttcctttaccctcgacttcaagacatttggggctgacacgcagtcaggcagttccgggtcctcccctgtgacatcttcaggaggtgcacccagcccactcaactcccttctgagtccactgtgcttctctcctatgtttcacctgccaacgtccagtcttgggatgccatgtcccgaggcttacctcccaaacgtaaatcttcccctttgttataagatttgccccacaaacttctggcagcagcaaccattagtcctcccggcccccgagagactggcaagctcgaacagctctcaaagcctggcacctctcatgatggaagtgccaatgctgagtagcctgggtgtcaccaactctaagagcggctcctctgaagatagttcagaccagtacctccaggctcctaacagcacaaatcagatgctgtatggccttcaatcccctgggaatatttttttgccaaattccatcacgccagaagccctcagctgtagctttcatccttcgtacgatttctatcgttacaatttctctatgcctagcaggttgatctccgggagtaatcacctgaaagttaacgacgatagccaagtctctttcggtgaaggcaagtgcaatcacgttcattggtatccagccataaaccactacctctag

SEQ ID NO: 137390 - DNA, 1563 bp, Artificial Sequence
  Description of Artificial Sequence: Synthetic coding sequence
atggccctctccagccgggcccgggcgtttagcgtcgaggctctcgtaggccgtccaagcaaacgcaaactgcaggatccgattcaggcagagcagccagagctcagggaaaagaaggggggcgaagaagaggaggagcggcgctcaagtgcagccggcaaaagcgagccactcgaaaagcaaccgaaaacagagccaagtaccagtgctagtagtggatgcggcagcgatagcggttacggcaactcttccgaaagtttggaagagaaggatattcaaatggagctgcagggatctgagctgtggaagcggttccacgacatcggcacagaaatgatcatcactaaagctggaagaagaatgtttccttccgtacgggtcaaggtgaaaggcctagatcctggcaaacagtaccacgtagctattgatgtggtcccggtcgacagcaaaaggtatagatatgtgtaccacagtagccaatggatggtggctggcaatactgatcacctgtgtattattccacgcttttatgtccaccccgactctccgtgctctggagaaacatggatgcggcaaataatctcttttgacaggatgaagttgacaaacaatgaaatggatgacaagggccacattatacttcagtctatgcacaaatacaagcccagagttcacgtgattgaacaaggcagtagcgtggacctgtcacagattcagagtttgcccactgagggagtgaaaaccttcagcttcaaagaaacagaattcaccacggtgactgcctatcagaatcaacagatcacgaagctgaagatcgagcggaacccgttcgccaaaggcttccgagataccggtagaaatcgcggggttctagatggcctgctcgagacctacccttggcgcccctctttcacattggattttaagacttttggcgccgatacgcagagcgggagcagtgggagtagccctgtgacctcttcgggcggggctccttcacctttgaacagcttgctttcaccactttgtttcagtcccatgttccacctcccgactagcagccttgggatgccatgtccagaagcatatctcccaaacgtcaatctgcccctgtgctacaaaatctgccctacgaatttctggcagcagcaacctttggtgctgccagcccctgagaggctcgcttcttcaaacagctctcagtccctggcgcccctcatgatggaggtacccatgctgtctagtctgggagtcaccaacagcaagagcggctctagcgaagattcatctgaccagtatctgcaggcccctaattcaacaaatcagatgctgtatgggcttcagagtccagggaacatctttttaccaaacagtatcacccccgaagcactgagctgctcattccacccctcatatgacttctaccggtataacttctccatgccttcccgactgatttcaggatctaatcatctcaaagtcaatgacgacagtcaagtctccttcggagaaggcaaatgtaatcatgtccactggtatcctgccatcaaccattatctctag

SEQ ID NO: 137391 - DNA, 1563 bp, Artificial Sequence
  Description of Artificial Sequence: Synthetic coding sequence
atggctctttcctcacgtgcaagagcattttctgtggaggccctagtcgggagaccgtctaaacggaagttgcaggatcccattcaggcagagcagccagagcttagagaaaaaaaagggggggaggaagaagaagagaggcgctcaagcgccgccggcaagtccgagcccctggaaaagcagcctaagactgaaccgtcaacatcggcctcttcgggatgtggctcagatagcggatacggtaacagctcggagtccctcgaggagaaggatattcaaatggaactccaggggagtgaactgtggaaacgatttcatgacataggtacagagatgattattaccaaagctgggcggcgaatgtttccttccgtcagagtaaaggtaaaagggcttgacccaggaaagcaatatcatgtggccatcgacgttgtcccggtcgactcaaagcgctaccgctacgtgtatcacagctcccagtggatggtcgccggtaacacagatcacctgtgcataattccacgcttctacgtacacccagattctccatgcagcggggagacatggatgcgtcagatcatctccttcgaccgtatgaaactaaccaacaacgaaatggatgacaagggtcacattatcctgcagagcatgcataagtacaagcctcgggtgcatgtcatcgagcaaggctcctctgtggacctgtcgcagattcagtccctccccactgagggagtcaaaacctttagcttcaaagagaccgagtttactactgtcacagcctatcagaaccaacagattacaaaactgaagattgagcggaatccatttgcaaagggttttcgagatacggggcgaaacagaggggtacttgatggtctactcgagacatacccatggcgtccctcgtttactcttgattttaagacttttggtgccgacacacagtccggctcctcggggtctagcccggttacgagtagtggaggagccccgtcccccctgaattctcttctctcaccgctgtgcttcagccccatgttccacttacctacctcctctttaggtatgccttgcccagaggcttaccttcctaacgtcaacctccccctctgctataagatttgccctacaaatttttggcagcagcagcctctggtgctgcctgcaccggaacgactcgctagcagcaattcatctcaatcactcgccccgctcatgatggaggtcccaatgttaagctcgttaggcgtgactaattctaagtctggtagctccgaagactcctccgaccagtacctgcaggcgcctaatagtactaaccagatgctgtatgggctacagtcaccgggcaacatctttttgcctaactcaataacaccggaggctctttcgtgttcgtttcacccctcctatgacttttatagatacaatttttcaatgccaagccgcctaataagcggatccaaccacctgaaggttaatgatgactcccaggtgagtttcggagagggcaagtgcaatcatgtgcattggtatccggcgatcaaccactacctgtag

SEQ ID NO: 137392 - DNA, 1203 bp, Artificial Sequence
  Description of Artificial Sequence: Synthetic coding sequence
atgttccccagcgtacgggttaaggtcaagggcttggaccctggaaagcaataccatgttgcaatcgacgtggtcccagttgattcaaagaggtatagatacgtctaccattcatctcagtggatggtggccgggaatacagaccatctgtgtattatccctcgattttatgtccaccccgatagtccttgttcaggtgaaacctggatgcggcagatcatttcatttgatcgcatgaagctgacaaataatgaaatggacgacaaggggcacatcatcctacagtctatgcacaagtacaagcccagagtgcacgtgatcgagcagggaagcagtgttgacttatcccagattcagtcgctgccaaccgagggcgtgaaaaccttttccttcaaggagacggagttcactaccgtgacagcttaccagaaccagcaaattaccaaactgaagatcgaaaggaacccctttgcaaaagggtttagagacaccggcagaaaccgcggagtgctcgatggactcctggagacctacccttggaggccaagctttacactggactttaaaacatttggtgccgatactcagagcggttcttccggttcctcaccagttacaagctctgggggagcaccgtctccactgaactcactcctgtcaccactctgtttttcccccatgtttcatctccctactagctctcttggaatgccatgcccagaggcctatctgcctaacgtgaacttgcccctgtgttataagatctgtcctaccaacttctggcagcagcaacccttggtcctgcccgcacccgagaggctggcctcatctaacagctctcagtctctggcccctttaatgatggaggttccgatgttgtcttcacttggcgtcacgaacagcaaatctggtagcagtgaagactcatccgatcagtatctgcaggcacccaacagcactaatcagatgctgtatggattgcagtcgcctgggaatatctttctgcctaattcgatcacaccggaggccttatcctgctccttccatcccagctacgatttctatcgttataatttctcaatgccctcacgactgatctcgggctcgaaccacctgaaggtgaacgatgattcacaagtctcatttggagagggcaagtgcaaccacgtacactggtaccctgccatcaaccattatttatag

SEQ ID NO: 137393 - DNA, 2232 bp, Artificial Sequence
  Description of Artificial Sequence: Synthetic coding sequence
atgagcttatcaatgcgcgaccccgttatccccgggacaagcatggcgtatcacccatttctcccacaccgagcacccgatttcgccatgtctgcggtgctcggacaccagccaccctttttcccagctttgaccctgcctccaaacggagcagcagccctgagtttacctggcgctctcgccaagcctatcatggatcagctagtcggcgctgctgagactggtattcctttttcaagcctgggtcctcaggcccatctgaggcctctgaagacaatggagccagaggaagaggtcgaagatgatcctaaggtccatttagaggccaaggagctgtgggatcagttccataaacgagggaccgagatggtgattacgaaatctggtcgcaggatgtttccaccattcaaagtgcgctgttcaggtcttgataaaaaagctaaatacatactcctgatggacattattgcggcggatgattgcaggtacaaattccataactccagatggatggtggccggcaaggccgaccctgagatgcctaagcgcatgtacatccacccagactcaccagccaccggagagcagtggatgtctaaggtggtgacattccataagctcaaactgacaaataatataagtgacaaacacggctttaccttggcctttccctcagatcatgctacttggcagggtaactacagttttggcacacagaccattcttaacagcatgcacaaataccaaccacgcttccacattgtgagggctaatgatattttaaagttgccatattccacatttcggacctatctcttcccggagacagagttcatcgcggttacagcgtatcaaaatgataaaataactcaacttaaaattgataacaatccctttgcaaaagggttccgggataccgggaatggcaggagagaaaagcgaaagcaactcactctgcagtctatgagggtgttcgacgagcggcataagaaggagaatggcacaagcgatgaatcttcttccgagcaagccgctttcaactgcttcgcccaagcaagcagtcccgccgccagtactgtgggcacttccaatttgaaggacctatgtccgagcgaaggcgaatctgacgcagaagcagaatccaaggaagagcacgggcctgaggcctgtgacgcagccaagattagcaccaccacctcagaagagccatgtcgtgacaaaggctcaccagctgtgaaggcgcacttgtttgctgccgagcggccccgggacagcggtcgcctggataaggcctccccagacagcagacattcccctgcgaccatctcgtcctctaccagggggctaggagccgaggaaaggcgcagtcctgtgagagagggcactgcccctgcaaaagtcgaggaggcacgggccttgcccggaaaagaagcgtttgccccactcacggttcagactgatgctgctgcagctcacctcgcgcaaggtcctttgccggggctgggcttcgcccccggtcttgccggtcagcaattctttaatggccatcccctgttcctccaccctagccaatttgcaatgggcggtgcttttagttctatggcagccgcaggcatgggcccactcctggctaccgtcagcggagcaagcactggggtgagtggtctcgactccacagcaatggccagtgccgctgccgctcagggccttagtggcgcctccgcagcaacactgccatttcacttgcagcaacacgtgcttgctagccagggcctggccatgtcaccctttggatcactgtttccttacccttatacttatatggctgctgcagctgccgcgtcctctgccgccgcctcatcttcagtgcaccgccatcctttccttaatctgaatacgatgaggccccgccttaggtattctccgtattcaataccagttccggtgcccgacgggtcatctcttctaactactgcgctgccatctatggcggcagctgcaggcccactcgacggtaaagtcgctgcattagccgcaagtcccgcttcagtcgctgttgacagcggctcggagcttaactcacgcagcagcaccttgtcctccagcagcatgtctctgagtccgaaactatgtgccgaaaaggaagccgcaacttctgagcttcagtccattcagaggctcgtgtcaggccttgaggcaaaacccgatcgttctagatccgcttccccttag

SEQ ID NO: 137394 - DNA, 2172 bp, Artificial Sequence
  Description of Artificial Sequence: Synthetic coding sequence
atgagcctcagcatgcgtgaccctgtaatacctggcacttctatggcgtaccaccctttcctgccccacagggctcccgacttcgcgatgagcgccgtgcttgggcaccagcctcctttttttccagcccttacactcccacccaatggtgccgccgccttaagcttgccaggggcactggccaagcctataatggaccagctggttggggcggctgagactggcatacccttctcaagcctggggccacaggctcatctacgcccgttgaagaccatggagcccgaggaagaagtggaggacgatcccaaagtgcatttagaagccaaggagctgtgggaccagttccacaagaggggaacagagatggttatcacaaaatccggtagaagaatgttcccccctttcaaggtgcgatgttccgggctggacaagaaggctaagtatatcttgctgatggatataatcgccgccgacgactgcaggtacaagtttcataattccagatggatggtggccggcaaagcagatccggagatgcctaaacggatgtatattcaccccgattcacccgccactggagagcaatggatgtcaaaggtggtcacgttccataaactgaagctcaccaacaacatctctgataagcatggttttaccatcctgaattcaatgcataagtatcagcccaggtttcacattgtccgggcgaacgatatccttaaactgccatattctacgttccgtacataccttttccccgaaacagaattcattgccgtgaccgcttaccagaacgacaaaattacacagctcaagattgacaacaacccattcgctaagggattccgcgacactgggaatggtagacgagaaaaaaggaaacagctgaccctccagtctatgagggttttcgatgagcgtcacaagaaagagaatggaactagtgatgagtctagctctgaacaggctgcattcaactgcttcgcacaggcatcatcaccagctgcctcaactgtgggaaccagtaatcttaaggacctgtgtccctccgagggcgaaagcgatgccgaggccgaatctaaggaggaacacggtccagaagcctgcgacgcagcaaagatctcgacgactaccagtgaagagccttgccgggataaaggaagccccgctgtgaaggcccatctgttcgctgcagagcgaccgagagatagcggcaggctcgacaaggcatcacccgacagcaggcattccccagcaacaatcagctcttctacacggggactgggcgctgaggaacgacgctcgccagtgcgggaggggacagccccagccaaggtggaggaagcccgggcgctcccaggaaaagaggcctttgcccccttgacagtccagacggatgccgctgctgctcacctggcacagggacccctgccagggttgggattcgccccgggcctggccggccagcagttcttcaatggtcaccccctctttctgcacccatcgcagtttgctatgggcggcgcgtttagttccatggctgcagcaggcatgggaccccttctcgccacagtgtctggggcctccaccggcgtctcagggctggactcgacagccatggcgtcggctgccgctgcccagggcttgagtggggcaagtgccgccaccttgccatttcatctacagcagcacgtccttgcgtcgcagggcctggccatgagcccctttggtagcctgtttccctatccctacacatacatggccgcggcggccgctgcatcatcggcagcagcttcatcttccgttcatagacacccctttctgaatcttaacacgatgcggccgaggctgagatattctccgtactccattcccgtcccggtgcccgatggtagtagtctgctcaccaccgcattaccgtctatggccgcagccgccgggccattggacggaaaagtagcagccctggccgcctcccctgcctcagtggctgttgattccggaagtgagctgaattctagatccagcacattgagttcttcttcaatgagcctgtccccaaagctgtgcgccgaaaaggaggccgcaactagcgaattgcaatctatccagagactggtgagcgggctcgaagccaagccagataggtctcgatccgccagtccatag

SEQ ID NO: 137395 - DNA, 1803 bp, Artificial Sequence
  Description of Artificial Sequence: Synthetic coding sequence
atgagtttatccatgagagatccagtcattcctggcacaagcatggcttatcatcccttccttccacatcgcgcacctgacttcgccatgtcagctgtactggggcatcagccaccctttttcccggccttaactctgcccccaaatggagctgcggccctttccctgcccggagcactggcaaaacctattatggaccagctggtgggagcagcagagacagggatacccttttcttctctgggaccgcaagctcatttgcgtcctctcaagaccatggagcccgaagaagaggtggaggatgatcccaaagttcatctggaagctaaagagctctgggaccagttccacaagaggggaaccgagatggtgatcacgaagagcggaaggcgcatgtttcctcccttcaaggtgagatgttccgggttggacaaaaaagccaaatatatactcctgatggatatcattgctgcagacgattgtcgctataaattccacaattcaagatggatggttgcaggtaaagccgacccagagatgccgaagaggatgtacattcaccctgattcccctgccacaggggaacaatggatgagtaaagtggtgacgtttcacaagctaaagctgacaaataatatttccgataaacacggctttaccctcgcctttccgagcgaccacgctacttggcagggcaactactccttcggcacacagactatcttgaattctatgcataaataccagcctcggtttcacattgtcagggctaacgatatccttaagttaccttacagtactttcagaacttatctgtttccagagactgagttcattgctgtgaccgcgtaccagaacgataagattacccagttaaaaatcgacaataatcccttcgcaaaggggttcagggataccggtaacggaagacgggagaagcggaagcagctcacgctccagagcatgcgtgtttttgacgaacgtcataaaaaagagaatggcaccagcgacgagagcagtagcgagcaagcagcttttaactgtttcgcccaggcgagttccccggcggccagtacagtaggaacttcgaaccttaaggacctctgtccctcagagggagaaagtgacgcagaggctgagagcaaggaagaacatggccccgaagcgtgcgacgcagcgaagatcagcacaactacgtccgaagaaccctgccgcgacaagggatcaccggcagtgaaagcgcatctcttcgcggccgaaagacccagggactccggccgcctggataaggctagccctgacagccggcatagcccagccacaatcagctcctccacacgggggctgggcgccgaggagcggaggagcccagtaagggaggggaccgccccagccaaggttgaggaagctagagctctgcccgggaaagaggctttcgcccccttaaccgtgcagacagacgccgcggccgccgctgcgagctccagtgtgcaccgacatccatttttgaatctgaatactatgcgaccccggctgagatactctccatacagcatacccgtgcccgtgccggatggctcaagcttgcttactacagcgctagctgcttccccggcgtctgtggccgttgactcaggttcggagctcaactctcgttcttccacactgtcttcatcctctatgagtttgtccccaaaattgtgcgccgagaaagaagctgccacttccgagcttcagtctatccagcggctggtttcaggcctagaagcaaaacctgaccggtctagatctgcctccccatag

SEQ ID NO: 137396 - DNA, 1638 bp, Artificial Sequence
  Description of Artificial Sequence: Synthetic coding sequence
atgctgcaggacaagggactgagcgagagcgaggaagcattcagagcccccgggccagctttgggtgaggcatccgccgcaaatgctcccgagcctgcactagccgccccaggcctgtctggagccgctcttggctcccctcccgggccaggcgctgatgtggtggccgcggcagccgcagaacagactatcgagaacataaaggtgggtttgcacgagaaagagctgtggaagaaattccatgaagccggcacagagatgataataaccaaagccggccgacgaatgttcccttcttataaggttaaggtaacgggaatgaacccaaaaaccaagtatatactgctgattgatattgtcccggccgacgatcaccgctacaagttttgtgacaataaatggatggtggctggaaaggctgagcccgctatgcctggccgcctgtatgtgcaccccgattcgcccgccacaggagcacattggatgcggcagcttgtctccttccagaagctgaagctcaccaataaccacctggatcccttcggtcacatcatcttgaactcaatgcacaagtaccagcccagattacatattgttaaggctgatgagaacaatgcctttgggagcaaaaacacggctttttgcacccacgtttttcccgaaaccagtttcatcagtgtgacctcgtatcagaatcacaagatcactcagctcaaaatcgagaacaaccctttcgcaaaaggattcagaggctctgatgatagtgatcttagggtggccagattgcaatccaaggaatatcctgtgataagcaaaagtatcatgcgacagcgcctcatctctccccaacttagcgccacccctgacgtggggcctcttctgggcactcaccaagcactgcagcactaccagcatgagaacggcgcacattcacagctcgcagagccgcaggacttgccgctgtccacttttcccactcagcgagactcaagcctgttttaccactgtcttaaaagacgcgacgggaccagacatctggatctcccctgcaagcgctcatacttggaggccccctctagtgtcggggaagatcactacttcaggtcacccccaccctacgaccagcagatgctaagtccttcctattgttctgaggttacgcctcgcgaagcctgtatgtactcaggctccgggccagagatagcgggtgttagcggggtcgatgatctgccccctccgcctcttagttgcaatatgtggaccagcgtctcgccctatacttcctactcggtccagaccatggaaacggtgccttaccagcccttccctacccactttactgccacaacaatgatgcctcggctcccaacactaagcgctcagagcagtcaacctccagggaacgcccatttcagcgtgtacaaccagctgagtcagtctcaggtcagagaaagagggccgtcggcttcttttccacgggaacggggcctccctcagggctgtgagaggaaacccccatccccacacctaaatgctgctaacgaatttttgtattctcagaccttttcccttagccgagaatcctcactgcagtatcatagcggcatgggcaccgtggagaactggaccgacggatag

SEQ ID NO: 137397 - DNA, 1641 bp, Artificial Sequence
  Description of Artificial Sequence: Synthetic coding sequence
atgctccaggataaaggccttagtgaatctgaagaagcattcagagctcctgggcctgccctgggagaggcaagcgccgccaatgcacctgaaccggccctggcggcgcctgggttgtctggggcggctctgggaagcccgcctggtcccggcgctgatgtcgtggccgctgctgcagccgaacagactattgagaacattaaagtggggctgcacgaaaaggagctgtggaagaaattccacgaggcaggtacagaaatgatcattaccaaggcgggcagaaggatgttccctagttacaaagtgaaggtaactgggatgaaccccaaaactaaatacatcctgctcattgatatcgttcccgctgacgaccatcgatataaattttgcgataataaatggatggtagcaggcaaggcagaacctgctatgcccgggcgactctacgttcatcctgactctccagcaactggagctcactggatgcgacagctcgtgagtttccagaagctcaagcttactaacaaccatctcgacccgttcggacacattatattaaacagcatgcacaaataccagcctcgcctgcacatcgtaaaagcagatgaaaacaacgcctttggatctaagaataccgctttctgcacgcatgtgtttccagaaactagttttattagcgttacctcataccagaatcacaaaattacccagttgaaaatcgagaataacccctttgccaaggggttccgtggcagcgacgactccgacctcagagttgccaggctccagtcgaaagaatatcccgttataagcaagtccatcatgcgacaaagactgatctctccccagctcagtgctacacctgacgtggggcctctgctggggacccatcaagcactacaacattaccagcacgaaaacggtgctcattcccaactagctgagcctcaagatctacccctgagtaccttcccgacccagcgggattctagcttgttttaccactgtctcaagaggagagcagatggaactcggcatcttgacttaccctgcaaacggtcctaccttgaggcaccatcctccgtgggagaagatcattatttccggtctcctcccccttatgaccagcagatgcttagtccttcttactgctccgaagtaaccccccgggaggcctgcatgtactcaggctctgggccagagattgctggagtgagcggggtagacgatctgcccccacccccactcagctgtaatatgtggacaagcgtgagtccatacacaagctattctgttcaaacaatggagaccgtgccttaccagcccttccccacccatttcacagccaccacaatgatgccccggttgccaacgctgagcgcacagtcctctcagccacctggaaacgcacacttttccgtgtataatcagttgtcacaatcacaggtgagggagagagggccttctgcaagcttccctcgggagcgtggactgcctcagggctgcgagcgtaagcccccaagtccgcatttaaatgccgcaaacgaatttctgtactctcagaccttttcgctgtcgcgggagtcttcacttcagtatcactctggcatgggtaccgtagagaactggactgatggttag

SEQ ID NO: 137398 - DNA, 1557 bp, Artificial Sequence
  Description of Artificial Sequence: Synthetic coding sequence
atggccgatgccgacgaaggcttcggcctggcccacactcccctggagccggacgccaaggacctaccatgcgattcgaaaccagagtctgcgctaggtgctcccagtaagagtcccagctctccccaggccgccttcacacaacaagggatggagggaattaaagttttcttgcacgaaagagaactgtggctaaaatttcacgaagttggtacagagatgattatcactaaggcgggccgccgcatgttcccttcttacaaggtgaaggttaccgggctgaatccaaaaaccaaatatattttgctgatggatatcgtgcccgcagatgatcaccggtataagttcgccgataataagtggtcagtaaccggcaaggccgagccagcaatgcctggaagactctacgtgcaccccgattctcctgcaacaggtgcccactggatgcggcagttagtgagtttccagaaattaaaacttactaacaatcatctggatccctttggtcacataatcttaaattctatgcataagtatcagccacgcctgcacatcgtgaaggccgacgaaaacaacggcttcgggtccaagaacaccgctttctgcacgcacgtcttccccgagacagcattcatcgccgtgaccagttaccagaatcataaaatcacccagcttaagatcgagaataaccctttcgcgaagggatttagaggaagcgatgacatggagttacaccggatgagtaggatgcaatccaaagagtatcctgtcgtgcctcgaagcaccgtccgacagaaggtagcctccaatcacagccctttttccagcgagagcagagctcttagtacaagttccaatcttgggagtcagtaccagtgcgaaaacggcgtatctgggccaagccaagacctactccccccaccgaatccatacccgttacctcaggaacacagccaaatttatcattgcactaaacgcaaggaagaggaatgctcaacaactgaccacccttacaagaaaccctatatggagactagtccttctgaggaggacagcttctaccggtcaagctacccacagcagcaaggactcggcgcctcctataggacagagtctgctcaacggcaggcttgtatgtacgccagttccgcaccaccatctgagccagttccctcattagaagatatatcttgcaatacctggccatctatgccctcttacagctcatgtacagtgaccacggttcagccgatggaccggctgccctaccaacacttcagcgcacacttcacatctgggcctctagtgcctagactggcaggaatggcgaatcacggcagcccacagctgggggagggcatgtttcagcatcaaacatctgtagcacaccaacctgtcgtaaggcagtgtgggccgcagaccggactccagtctccaggcaccttacagccgcctgagttcctctactcacatggggtccctcgtactttgtcacctcatcagtatcattctgtgcatggggtcggaatggtcccagagtggtccgataacagttag

SEQ ID NO: 137399 - DNA, 1407 bp, Artificial Sequence
  Description of Artificial Sequence: Synthetic coding sequence
atggaaggcattaaggtattcctgcatgagagagagctctggctgaaatttcacgaagtgggaacagaaatgataattactaaggctgggaggcggatgttcccttcatacaaggtcaaggtgacaggcctcaatcctaagactaagtacatcttgctaatggatatcgtgcctgctgacgatcatcgctacaagttcgccgataataaatggtctgtaacgggcaaggccgagcctgcgatgcccgggaggctttacgtgcatccggattctcctgcgactggcgcccactggatgcgacagcttgtctcgtttcaaaagttgaagctgaccaataatcacctggatccattcgggcatataattctcaattcaatgcacaaataccagcctagacttcacatcgtcaaagccgacgagaataatggatttggatctaagaacacagccttctgtacccatgtgtttcctgagactgccttcatagctgtcactagttaccagaaccataagattacccaacttaagattgagaataatccctttgccaagggatttaggggcagcgatgatatggaattgcaccgcatgtctcggatgcagtcaaaagaatatccagtggtccccagaagcacagtacgtcagaaagtcgcctcgaatcactccccctttagctcagagtctagggcgctaagcactagctccaacctgggtagtcagtatcagtgtgaaaatggggtctcaggcccttcccaagacttgctcccacctccgaacccatatccactgccccaggagcattctcagatctaccactgcacaaagcggaaagaggaggagtgctccacaacagaccacccttacaaaaagccatatatggagactagtccctccgaggaagactcattttatcgatcgtcgtatccccagcagcaaggactgggagcaagctatcggaccgagtccgcgcagcgacaggcctgtatgtacgcatcatctgcgcctccaagcgaacccgtccctagcttggaggatatttcttgcaatacttggccctctatgcccagctattcctcatgcactgtgaccaccgtccaacctatggacagacttccctatcagcacttctcagcacactttacaagtggacccctggtcccccgtctcgccggcatggctaatcacggcagccctcagctaggggagggcatgtttcagcaccagacaagcgtggctcatcagcccgtggtgaggcagtgcgggccccaaactggactacagtctccagggacactccaacctcctgagtttctgtactcccatggcgtgcctcggactctgagcccgcaccagtaccactccgtgcacggtgtgggcatggtgccagagtggagcgacaacagttag

SEQ ID NO: 137400 - DNA, 1557 bp, Artificial Sequence
  Description of Artificial Sequence: Synthetic coding sequence
atggccgacgcagacgaaggcttcggactggcgcacactcccctggagcctgatgcaaaagatctgccctgtgacagtaaacctgaatctgctctgggcgccccctcaaaaagcccctccagcccccaggcagcctttacccagcaaggaatggaagggataaaagtgtttcttcacgagcgagagctttggctgaaatttcatgaagtgggcaccgagatgataatcactaaggccggcaggaggatgtttccaagctacaaggtaaaggtcaccgggcttaatcctaaaactaaatacatcttactgatggacatcgttcccgcggatgaccaccgttacaaattcgccgataacaagtggtcagtaacggggaaagccgaacccgcaatgcccggacggttatatgtacatccggactctcccgcaacaggtgcccactggatgagacaactggtctcgtttcaaaagctgaagctgacgaacaatcaccttgaccccttcggacatatcatcctaaacagtatgcacaaataccaaccaagattacacatagtcaaagctgatgaaaacaacggatttgggtcaaaaaacacagcattctgtacccacgttttcccagagactgcatttatcgccgttaccagctatcagaatcacaaaattacacagcttaagatcgaaaacaacccattcgctaaaggtttcaggggtagtgacgatatggaactgcaccgaatgtctaggatgcagtctaaggaataccccgtggtaccgagaagcaccgtccgccagaaggtagcgtccaatcactcgcctttcagcagcgaatccagagccctgtctaccagtagcaacctgggaagccagtaccagtgtgaaaatggcgtgagcgggccctcccaagacctgctgcccccgcccaacccgtacccgctgccacaggaacacagccagatctatcattgtaccaagcggaaagaggaagagtgctccaccacagatcacccctacaagaagccttatatggagacaagtccctctgaagaggatagtttttataggagtagttaccctcagcagcagggcctgggcgcctcatatcgaacagagagtgctcagcgccaagcctgtatgtatgccagtagtgcacctccttccgaacccgttccgtctctcgaagacatttcatgcaacacgtggccatccatgcctagttactcctcatgcaccgtgacgaccgtgcagcctatggaccggcttccctatcagcacttcagcgcccactttacgagtggacccctggtacccagactcgccggtatggcaaatcatggtagcccccagctgggtgaaggaatgtttcagcaccagacaagcgtggcacatcagcccgtcgtgaggcaatgtgggccacagactgggctgcagtccccgggtacgcttcaaccccctgagttcctctactcccacggggtaccacgtactctttcccctcaccagtatcatagtgtgcacggcgtcggaatggtcccagaatggtctgacaactcatag

SEQ ID NO: 137401 - DNA, 1269 bp, Artificial Sequence
  Description of Artificial Sequence: Synthetic coding sequence
atggatatcgttcctgctgatgaccaccgttataaatttgcggacaacaaatggagcgtcacagggaaggctgaaccggccatgcccggcagactgtacgtgcacccagattctcccgccacaggggcccattggatgagacagctggtgagctttcagaagttgaaattgacgaataatcacttagatcccttcggacatatcattcttaattccatgcataagtatcagccccgtttacacattgtcaaggccgacgagaataatggctttggatccaaaaacactgcattttgtacccacgtcttcccagagacggctttcattgctgtcacctcataccagaatcacaaaatcacccaactgaagatcgagaacaaccccttcgctaagggctttcgcgggtccgacgacatggagctccatcgcatgagtcggatgcagagcaaggagtatcccgtcgtgccaaggtccacagtgcgccagaaggtggcctctaaccacagcccattttcaagcgaatctagagctttatcaacaagctccaatctgggcagtcagtatcagtgtgaaaatggggtttccggcccaagccaggacctgctgcctccccctaatccataccctctaccccaggagcattctcagatctatcactgcaccaaaagaaaggaagaggagtgctcaactacagatcacccgtataaaaagccttacatggaaacctctccctccgaagaagacagtttctatagatcttcatacccacagcagcagggccttggggcctcatatcgcacagagagtgcccaaaggcaagcatgtatgtacgccagctccgccccgccctctgagcccgtgccaagcctcgaagacatcagttgtaacacctggccttctatgccttcctatagctcttgtaccgtgacaaccgtccagccaatggacagactcccctaccagcactttagtgcacactttacctctggaccactcgtgccccggctggctggcatggctaaccacggttctccccagctgggcgagggcatgtttcagcatcagacctctgtggctcaccaacctgtggtgcggcaatgcggtcctcagaccggtttactgcataacagacacttcctcgagaaggagagagaacgaggcgaaagggagaggcggcgggaaaccgtggccaagcgaaccccacgcacacggttcttcatcagcccaaacgtgcatatttgtacacagggtcgttggatgttaatttag

SEQ ID NO: 137402 - DNA, 1050 bp, Artificial Sequence
  Description of Artificial Sequence: Synthetic coding sequence
atggccgacgcagatgagggttttggccttgctcacactccgctcgagcctgatgctaaggacctgccatgtgactccaagccggaaagcgctctgggagctcctagtaaatcaccatccagtcctcaggcagcctttactcagcaaggaatggagggcattaaggtgtttctacacgaaagggaactctggctcaaattccacgaggtgggtacagagatgatcattacgaaggccggccggcgaatgttccccagctacaaggtgaaggtcactggcctaaatccaaaaaccaaatacattttgcttatggatattgtcccagccgatgatcatcgatataaattcgcagacaataaatggagtgttacgggtaaggctgagcccgcgatgccaggcaggctgtatgttcaccctgattctccagctaccggcgcccactggatgagacagcttgtgtccttccagaagctcaagctgaccaacaatcaccttgatccgtttggccatattatcctaaattctatgcacaaataccagcctagactgcatatagtgaaggctgacgaaaataacgggtttggtagtaagaacaccgccttctgtacccatgtgttcccagagaccgcttttatagccgtgaccagctatcagaatcataaaataacccagctgaaaatagaaaacaacccattcgcaaaggggtttagagggtcggacgatatggaactgcacagaatgtccaggatgcagtcaaaggaatatcctgtcgtgccccgcagtaccgtaaggcagaaggtagcttctaaccattcccccttttcatcagagagtagggccctctccacaagtagcaacctcggatctcaataccagtgtgaaaatggggtgagcgggcccagccaggatcttttgcctcctccaaatccttatcccctccctcaggagcactcccagatctaccactgtactaagcgaaagggcgagtgtgatcacccttggtctatctgcttcttgtcctacctgttcttgtctctaggctggggatag

SEQ ID NO: 137403 - DNA, 1311 bp, Artificial Sequence
  Description of Artificial Sequence: Synthetic coding sequence
atgtaccacccacgtgagctataccccagtctgggggcaggctatagactcggtcctgcccagccaggagcagacagctcctttcctcccgcactggctgaggggtatcggtaccccgaactggatacccccaagcttgattgctttctatccggaatggaagctgcaccacggaccctggccgcccaccctccactgcccctgctccctcctgcaatgggtaccgaacctgctcctagcgcccccgaggctctccacagcctccctggggtgtctctctctctggaaaaccgggagctctggaaggaattttcatccgtgggcaccgaaatgatcatcactaaggccggccgccgtatgttcccggcttgccgggtgtccgtcacaggtcttgaccctgaggctaggtacttatttttgttagatgtaatccctgtggatggcgcaaggtatcgttggcagggacgacggtgggaaccatcaggtaaggcggagcctagattaccagatagagtgtatatacaccctgattcaccggctaccggtgcgcactggatgagacaacctgtaagctttcatagggtcaaactgaccaattccacactggacccgcatgggcatctgattttgcacagcatgcacaaataccagccgcggattcacctggtgcgtgccgcccagctgtgctcacagcattggggaggaatggcatccttccgttttccagagacaacctttataagcgtgacagcctatcaaaatccacagatcacgcaacttaagattgctgccaaccccttcgcgaagggattccgagagaacggccgaaactgcaagcgcgagagggacgcgcgggtgaaacggaaactaagaggccccgaacccgctgccactgaggcgtatggatctggggacacccccggaggaccctgcgatagcactctgggcggtgacatacgcgagtcagaccctgagcaggcacctgcccccggtgaagccacagccgcaccagcaccattgtgtggagggccaagtgcagaggcttacctcctgcatcccgcagctttccatggagccccaagtcatctccctacgcgcagcccgtcctttcctgaggctcctgacagtggtcggagtgccccttactcggccgcgttcttggagcttccacacggtagcggcggctcaggatatccagccgcgccgccagcggttccattcgcaccacatttcctacaaggtggtccatttccacttccttatacggcaccgggtggctatctcgatgtagggagcaagccaatgtattag

SEQ ID NO: 137404 - DNA, 1311 bp, Artificial Sequence
  Description of Artificial Sequence: Synthetic coding sequence
atgtatcacccaagagagttgtacccatctctgggcgctgggtacaggctgggaccagcccagcccggtgccgactcctcattccctcccgcactggctgaagggtaccgctaccctgagctcgacacccccaagctcgactgctttctcagtggcatggaggcagccccgaggactctagctgctcacccacccctacctctcctgcctccggccatgggaacggaacctgccccttcagctcccgaggccctacactcacttcccggcgtgtcactgtcccttgagaacagggagttgtggaaggagttttcttctgtgggcacagaaatgattattaccaaagctggtcgaagaatgtttccagcgtgccgggtttctgtgacaggtttggaccccgaggcacgctatttgttcctgttagacgttatccccgtagatggggccaggtataggtggcaaggaagacgatgggaaccgagtggaaaggccgaaccacgactgcctgaccgagtgtacatccacccagatagccctgcaacgggagcccactggatgcgccaacctgtgagtttccatcgcgtcaagttgacgaacagcaccctggacccacatggtcatctgattctacatagcatgcacaaataccaaccgcgcatccacctggtccgagctgcccagctgtgctcacagcactggggcggcatggcctcttttcggttccctgagacgactttcattagtgttaccgcctaccagaacccacagatcacccagctgaagattgctgcgaaccccttcgccaagggatttcgcgaaaatggccgaaattgcaaaagagagagagacgctcgagtcaagagaaaattgagggggccggagccagctgcgacagaggcttacggttccggtgataccccgggcggaccttgcgatagcaccctcgggggcgacattagagagtccgatccagagcaggcccccgcaccgggggaggcgactgctgcacctgctcccctttgcggagggccatccgccgaggcctatttgctccacccagccgcctttcatggagccccaagccacctgcccacccgcagcccctctttcccagaggcacctgattccggaagatccgccccgtactcagctgcttttctggagctgccccatggctctggcggctccggctatcctgctgcacctcccgcggttccatttgcacctcattttctgcaggggggtccttttccattgccctacactgccccaggaggttatctggatgtcggttcaaagccaatgtattag

SEQ ID NO: 137405 - DNA, 888 bp, Artificial Sequence
  Description of Artificial Sequence: Synthetic coding sequence
atgtatcatccccgcgagctctatccgagtctgggggcgggctataggttgggccccgcacagccgggagccgactcgagtttcccgccagcactggccgaaggataccgctaccccgagctggacacaccaaagctcgactgctttctgagcggcatggaagccgccccccgcactctggccgcccaccccccactcccactgctcccacccgcaatggggaccgagccggcaccttccgcaccagaggccctgcactcgctgcccggtgtgtctctctctctcgaaaaccgagagttgtggaaggaattcagctccgtgggcacagagatgataatcacaaaagctggccgacgcatgtttcctgcctgtcgagtgtccgttactggcctggaccccgaggcaagatacctgtttctgctcgacgtcatccctgttgacggggcccgatatcgctggcagggtcgccgctgggaaccatcgggcaaggcagaaccgcggctccctgatcgagtgtacatccaccctgactcgcccgcaaccggcgcacactggatgcgccagcccgtctccttccaccgcgtcaaactcaccaattcaacactggacccccatggccatctcatactgcacagcatgcataaataccagcctcgcattcacttggtgcgtgctgcccagttgtgcagtcagcactggggcgggatggcatcattccggttccctgaaacaacattcatcagcgtcacagcctatcagaatccgcaaattacacagctcaaaattgcagccaatccatttgctaagggatttcgtgaaaatggccgtaattgcaagcggtgggaattgttcatccatcttttcatgcactccactaatgtttattag

SEQ ID NO: 137406 - DNA, 1974 bp, Artificial Sequence
  Description of Artificial Sequence: Synthetic coding sequence
atggagatggagacaacggaacccgaaccagattgtgtggttcagccgcctagccctcccgacgacttcagttgtcagatgaggctctctgagaagatcacaccccttaaaacctgcttcaagaagaaggatcagaagcgattggggaccggaacccttagaagtttgcgtcctatcctgaacactctcctcgagtcgggatccttagacggggtattccgaagtcgcaaccagtcaaccgacgaaaacagcctgcacgagccgatgatgaagaaggcaatggaaatcaatagctcctgcccgcctgccgagaataacatgagtgtattgattccggatagaacgaatgtgggggaccagatacctgaagcgcatccctccaccgaagcaccagaaagggttgtgccaatccaagatcatagtttcccctccgaaactctgagcgggacagtggccgatagtaccccggcccattttcagaccgatcttctgcatcccgtttcttcagacgtccctacgagtcctgactgcctggataaagtgattgattacgtgcccggaatcttccaggagaatagcttcaccatccagtacatcttggatacgtccgataaactgagcaccgagctcttccaggacaagtctgaagaggccagtctggatctagtgtttgagctagtgaaccagctgcaataccacacccatcaggagaacgggattgaaatctgtatggattttctccaggggacatgcatttacggcagagactgcctcaaacaccatactgtgcttccctatcactggcagattaagagaacaaccactcaaaagtggcagtcggtgttcaacgactcccaggaacatctggaacggttctattgcaatccggagaatgataggatgcgcatgaagtatggggggcaggagttttgggctgacctcaacgcaatgaatgtgtacgagaccacagagttcgatcagctgcgtaggctctcgactcctccatctagcaatgttaattcaatttatcacaccgtctggaaatttttctgccgcgatcactttggctggcgcgagtaccctgaaagcgtaatcaggttaatcgaggaggcgaatagcagaggcctcaaggaggtcagattcatgatgtggaacaatcactacatcttacacaatagtttttttcgtagggaaattaagagaagaccgctgttccgttcctgctttatcctgctcccctacctgcagaccctcggtggtgtgccaacccaggcacccccaccactggaggcaacatcttccagccagataatctgccctgacggtgtcacatctgccaacttctatcctgagacgtgggtgtacatgcatcctagtcaggattttattcaagtgcccgtgagtgctgaagataaaagctataggatcatctataatctgtttcacaagaccgtgcccgaattcaagtaccgaatcctgcagatcctacgcgtgcagaatcagtttctatgggagaagtataagagaaagaaggagtacatgaatagaaagatgttcggccgcgaccggatcattaatgagaggcacttatttcacggcacctcccaggatgtggtggacggaatttgcaagcataactttgatccccgggtttgtgggaagcacgccaccatgtttgggcagggaagctactttgcaaaaaaagcatcctacagtcataacttttcaaaaaagtccagcaagggggtgcattttatgtttctggccaaagtgttaaccggaagatacaccatgggatcacacggcatgcgacgccccccccctgtgaatccaggatcagttactagcgatctgtacgactcttgcgtcgataactttttcgagccgcagatttttgtcatttttaatgatgatcaaagctacccatactttgtgatccagtatgaggaagtttctaatactgtatcaatttag

SEQ ID NO: 137407 - DNA, 1974 bp, Artificial Sequence
  Description of Artificial Sequence: Synthetic coding sequence
atggagatggagactaccgagcccgaaccagactgtgtggtgcagccacccagtccgccagatgacttctcctgtcaaatgagactcagtgagaagatcacaccactgaagacatgcttcaagaagaaggaccagaaaagacttgggactggtaccctgaggtccctgagaccgatattgaatacactgctggagagcgggtccttggacggcgttttcaggtcaaggaaccagtcaacagacgagaacagcctccacgaacctatgatgaagaaggctatggagattaactctagttgtcccccagccgaaaacaatatgtccgtcctgattcctgaccggactaacgtcggggaccaaatcccagaggcccaccccagtaccgaagctccggaacgagttgttcccattcaggatcattcattcccgagtgagaccctcagcgggacagtcgcagattccacccccgcccactttcagacggatctgctgcacccagtgtccagtgatgtcccaacttcgcctgattgcctagacaaggtgatagattatgtcccgggcatttttcaggagaacagctttacaatccaatatatcttagacacaagcgataagcttagcacggagctcttccaggacaaaagcgaggaggcctctttagatttggtcttcgagctagtcaatcagctgcagtatcacacccatcaggaaaatggaatagaaatttgcatggattttctccaggggacttgcatctacggacgcgactgcctcaagcaccacaccgtgttaccctatcactggcagatcaagcgaaccaccactcagaaatggcagtcagtgtttaatgatagccaagaacaccttgaacgattctactgcaaccctgagaacgaccgtatgagaatgaagtatggtggccaggaattctgggccgatcttaacgccatgaacgtgtatgaaaccaccgaattcgatcagcttcggcgcctgtcaacaccaccctcttctaacgtcaactcgatctaccataccgtgtggaaatttttctgtcgagatcatttcggatggcgcgaataccccgagtctgtgatacgcctgatcgaagaggctaactcacgcggtctcaaggaagtcaggtttatgatgtggaataatcactatatattgcacaatagctttttcagaagggagatcaagaggaggcccctgtttaggagttgcttcatcctgttaccatatcttcaaacactcggcggtgtccccactcaagctccaccacctctcgaggccacttcatcctcacaaatcatatgcccagacggcgtcacgtccgccaatttctacccggagacatgggtgtatatgcatccctctcaagatttcattcaagtgccagttagcgccgaagacaagagctacaggatcatctacaatctatttcacaagacggtgcctgagtttaagtacagaatattgcagattcttcgggtgcaaaaccagttcctgtgggaaaaatataagcgtaagaaagagtacatgaaccgcaagatgttcgggcgggaccgaatcattaacgagaggcatttatttcatggcacgtcgcaggatgtcgtggacggcatctgtaaacataacttcgatcctcgagtctgcggtaaacacgctacaatgttcggacagggaagttacttcgctaagaaagccagctactcccacaatttcagcaaaaaatccagtaagggcgtgcatttcatgttcctggcaaaggtgttaacagggagatacactatggggagccatgggatgaggagacctccgcctgtcaatcctgggtctgtcacgtccgacctttatgactcctgtgtcgacaatttcttcgagccccaaatattcgtaatcttcaacgatgaccaatcatacccgtattttgttattcagtatgaggaggtatccaacaccgttagcatctag

SEQ ID NO: 137408 - DNA, 1521 bp, Artificial Sequence
  Description of Artificial Sequence: Synthetic coding sequence
atggagatggaaacgaccgagccggagcctgactgtgtggttcagccgcccagcccaccagacgacttctcttgccaaatgagactgtccgagaagatcacgccgctgaaaacctgttttaaaaagaaggaccagaagcggttaggtaccgggaccctgcggagtctaaggcccatcctgaatactctgttggaatctgggagcctggatggggtgtttcgaagcaggaaccagtccactgacgagaacagcctgcacgagcctatgatgaagaaggctatggaaatcaacagctcatgcccacccgcagaaaataacatgagtgtgttgattccagaccgcacgaacgttggggatcagatacccgaggctcatcccagcacagaggccccggagcgcgttgtccctattcaggaccattctttcccttcggaaactctgtccgggacagtggccgactctacacctgctcatttccagaccgacttacttcatcctgtcagcagcgatgttcccacaagtccagactgcctggacaaagtgatcgattacgtacccggtatctttcaggagaattcatttaccatccagtacatcctcgacacctccgacaagctgtctactgagcttttccaggataagagcgaggaggcttctctggatttagtctttgagctcgtgaatcagctgcagtatcatacccatcaagagaatggcatcgaaatatgcatggactttctgcagggcacttgcatctacgggagggattgtttaaagcatcacacggtgttaccctaccattggcagattaagcggactaccacgcagaaatggcaatctgtcttcaacgattcacaggagcacctagagaggttctactgcaatcctgaaaatgatcgcatgcggatgaagtatggcgggcaagaattctgggccgatttgaacgccatgaatgtgtacgaaaccaccgagttcgatcaactgaggcgcctgagtacacctccgagtagtaatgtcaattccatctatcacaccgtttggaagttcttctgcagagatcacttcggttggcgtgagtaccctgaatcagtgataagactgatagaagaggccaatagtagaggtttaaaagaagtaagatttatgatgtggaacaaccattatatcttgcacaattcctttttcaggcgagaaattaagagacggcccctgtttagatcatgctttattctcctcccttacctccagaccttgggaggcgtccctactcaggcccctccccccttagaggccacttcttcttcacaaatcatttgccctgacggagtcacttctgcaaacttttatcccgaaacctgggtgtatatgcacccatctcaggatttcattcaagttccagtgagcgctgaagacaaatcatataggataatttacaacctgtttcataaaactgtgccagagtttaaatacagaattctgcagatactacgagtccagaaccaatttctgtgggagaaatag

SEQ ID NO: 137409 - DNA, 1965 bp, Artificial Sequence
  Description of Artificial Sequence: Synthetic coding sequence
atggagatggagacaacagagccagaacctgattgcgtggtgcagcccccttcgccacctgatgacttctcttgccagatgcgtctgtccgagaagataaccccactcaagacctgcttcaagaaaaaagaccaaaagagactgggcaccggaaccctgagaagtctgcggccaatactaaatactctgttggagtctggatcactcgacggagtgtttcgaagtcgcaaccagagcaccgacgagaacagtctacatgagcctatgatgaaaaaggccatggaaattaattcaagttgcccccctgctgaaaacaatatgtctgtcctcattcccgacagaacgaatgttggtgaccagattccagaggcccacccctctacggaagcccctgagcgggttgtgccgattcaggatcattcatttccctccgaaaccctcagtggcaccgtggccgacagcacacctgcacattttcagacggacctgttgcatcctgtgagcagcgacgtgcctacatctcctgactgcctggataaggtgattgattacgtccctggaatttttcaagagaatagctttaccatccagtacatcctggataccagcgataagctgtccactgagctgtttcaggacaagtccgaggaagcttcgctggatctggtgtttgagttagtgaaccaattgcagtaccacactcatcaggagaatggtatcgaaatttgcatggatttccttcagggaacctgtatttatgggagggactgccttaagcatcacacagttttgccctatcattggcaaattaaacgcacaaccacgcagaaatggcagagcgtctttaatgacagtcaggagcacctggagagattttactgtaaccctgaaaacgacagaatgcgcatgaagtacgggggtcaggagttctgggctgatctgaatgctatgaatgtttacgaaactacggagttcgaccagctaagaagactaagcacgcctccgagctcgaatgtgaattcaatctaccataccgtctggaagtttttctgccgcgaccacttcggctggcgcgaataccctgagtccgtgatccgactgatcgaggaggccaattctcgaggtctgaaggaggtgcgcttcatgatgtggaacaaccactacattctgcacaactcattcttcaggcgggagataaagagacgaccattatttagatcctgctttatcctgttgccatacctgcagacactagggggtgtaccaacccaggcccctcccccactggaggccactagttccagtcaaattatctgccctgacggggtcacatctgccaacttttatcctgaaacttgggtgtatatgcatccatctcaagactttatccaggttccagtgagcgccgaagacaaatcttaccggattatctataatctgttccacaagacagtcccagaattcaaatacaggattctgcagatcctcagggtgcagaaccagtttctgtgggaaaagtacaagcggaagaaggagtatatgaacagaaagatgttcggacgggacaggattatcaatgagcgacacctttttcatgggaccagccaggatgtggttgatggaatttgcaagcacaattttgatcctcgcgtgtgtggtaagcacgccaccatgttcggtcaaggctcttactttgcgaagaaagccagctattcccacaacttctcaaagaagtcttccaagggcgtgcattttatgttcttagcgaaagtcctcactgggcggtacaccatgggctctcatggcatgaggaggcctccacctgtgaatcctggatccgttacctccgacctgtatgactcatgtgttgataatttcttcgagccgcagattttcgttatcttcaatgacgatcagtcgtacccctactttgtgatccagtacgaggaagtgtcaaacacctag

SEQ ID NO: 137410 - DNA, 1974 bp, Artificial Sequence
  Description of Artificial Sequence: Synthetic coding sequence
atggagatggaaactacagagcctgagccagattgtgtggtgcagcctccatcgccgccagatgatttctcgtgtcagatgagactgagcgaaaagatcacacccctcaagacctgttttaagaagaaagatcagaagaggctcggaaccggcacacttagatccttgcggcctatcttgaatacacttttggagagtggtagcttggatggagtttttagaagccgcaaccagtctaccgatgagaactctttacacgaaccaatgatgaagaaagctatggagattaatagctcgtgtccacccgcagaaaacaacatgagcgtcctcattccagaccgcaccaatgtgggcgatcaaatcccggaggcacatccgtctacagaggctcctgagagagtggtaccaatccaggaccacagcttcccgtcggaaaccctttctggtactgtggcagactccactcccgctcatttccagaccgaccttcttcatccagtctcttccgacgtgccaaccagcccagattgtctcgataaggtaatcgactacgtgcctgggatcttccaggagaactctttcactatacagtatatactcgacaccagcgacaaattgagcaccgagctctttcaagacaagagtgaggaagcctcacttgacctggtgtttgaactcgtgaaccagctccaataccatacccatcaggaaaatgggattgagatctgcatggatttcctgcagggcacctgtatctatgggcgagactgccttaagcatcacactgttctgccataccattggcaaataaagagaactacaacacagaagtggcagtcagtgttcaatgattcccaggagcacttagagaggttttactgcaatccggagaacgatcggatgcgtatgaaatacggtggccaggaattttgggcagatctgaatgccatgaacgtatacgagactactgaattcgatcagctccgaaggcttagtacaccccccagttctaacgtcaattccatctatcacacagtgtggaagtttttttgcagggatcactttggttggcgggaataccccgagtctgtgattcggctgattgaggaagcaaactcaaggggcctgaaggaggtgcgctttatgatgtggaacaaccactatatcttacacaactcattcttccgccgtgagattaaacggcgacccctctttcgctcatgcttcatcctgttgccctacctgcagaccctggggggagtccccacccaagccccgcctccacttgaggctaccagctcttctcagatcatctgtcccgatggagtgactagcgccaatttttatcctgagacatgggtgtacatgcacccatctcaagacttcatacaggtccccgtgtccgcggaagacaagtcctataggataatttataacctcttccacaaaacggtgccggaatttaaatacaggattttacagattctccgtgtacagaaccagtttctctgggaaaaatacaagcgcaagaaggagtatatgaatcgaaaaatgtttggtcgcgaccgcatcatcaacgagcgacatttgtttcacgggacatctcaggatgtagtcgacggaatttgcaagcacaatttcgacccacgagtttgtggcaagcacgccaccatgttcggtcaggggtcatacttcgctaagaaggcatcgtatagccacaacttttctaaaaagtcctcgaagggggtccacttcatgttcctggctaaggtactgactgggaggtacacgatgggatcccacggcatgagacgtcctcctcccgtgaacccagggtcagtaacatctgacctctacgacagctgcgtggacaacttcttcgagccgcagatctttgtgatcttcaatgacgaccagagctatccttactttgtcattcagtatgaggaggtcagtaacaccgtatccatttag

SEQ ID NO: 137411 - DNA, 1974 bp, Artificial Sequence
  Description of Artificial Sequence: Synthetic coding sequence
atggaaatggaaaccactgagccggagccggattgcgtcgtgcagcctcccagccccccagacgatttcagctgccagatgagactttccgagaagattacccctctgaagacatgcttcaagaagaaggaccagaaaagattgggtacggggactctccgctccctaaggcccatattgaatacgttactcgagtccgggtctctggacggcgtcttccgtagccgcaaccagtccactgatgaaaattcattgcacgaaccaatgatgaagaaagctatggagattaactcgtcatgcccgcctgccgaaaacaatatgtcagtgttaattcctgaccgcaccaacgtgggggaccagatccctgaggctcacccatctacagaagcccctgagcgggtggtgcctatccaggaccattcgttcccttctgaaactctgagcggcacagtcgccgactctacaccagcacactttcagacagatttactccatcctgtgagctcggacgtcccaacctcccccgactgcctggacaaagttatagactacgtaccaggtatcttccaggaaaacagtttcaccatccagtatattcttgacacatccgataagctgagcactgaactcttccaggacaagtctgaggaggcttcacttgacctagttttcgaactagtcaaccaacttcagtatcatacccatcaagaaaacggcattgagatttgtatggactttctgcagggaacatgcatatacggtcgggattgtctgaaacaccatacagtgttgccttaccattggcagatcaaacgaaccactacccagaaatggcagtccgtgtttaacgatagtcaggagcacctcgaacggttttactgtaaccccgaaaatgaccgcatgaggatgaagtacggcggtcaggagttctgggccgacctgaacgccatgaatgtatatgaaacaacggaattcgaccagctccgcaggctgtctactccgccttcctcaaatgtcaattccatttaccacactgtgtggaaatttttttgtcgagaccatttcggttggcgcgagtaccccgagtccgtgatcagactcattgaggaggccaactccaggggactcaaagaggtacgctttatgatgtggaacaaccattacattctccacaactcattcttccgcagagaaattaagcgcaggcctttgttccggtcctgttttatcctgctgccgtacctccaaacactagggggggtgcccacacaggctcccccgcctttagaagctacctcatcctctcaaattatttgtccggacggtgtgacatcagcaaatttttacccagaaacgtgggtttacatgcatccttcccaggatttcattcaagtgcctgtgagtgcagaggacaaaagttaccggatcatatataatctctttcacaaaacagtgccagaattcaagtatagaatattacaaatccttcgagttcagaatcagtttctctgggagaaatacaaaagaaagaaagagtacatgaacaggaagatgttcggacgggacagaattataaacgaaaggcacctgttccacgggacatcccaggacgtagttgacggcatctgcaaacacaatttcgatccgagggtctgtgggaagcacgctactatgtttgggcaaggtagctatttcgctaaaaaagcttcctattctcacaacttcagcaaaaagtccagcaagggggtccatttcatgttcctggccaaagtgcttaccgggaggtacacaatgggaagccacggtatgaggcgcccccctcctgtgaatcccggctctgttacatccgatctctacgatagctgcgtggacaacttcttcgagccacagatattcgtaattttcaatgatgatcagtcttatccatatttcgtgatccagtacgaagaagtgagtaacacagtctcaatttag

SEQ ID NO: 137412 - DNA, 1662 bp, Artificial Sequence
  Description of Artificial Sequence: Synthetic coding sequence
atgggcgcactggaaatgcaggatgaagaagatcgcattgaagccttgaaacaggtcgctgataagttacctcgaccaaacctgctcctgttgaagcatctcgtttacgtgctccaccttatcagcaagaacagcgaggttaatcggatggactcatctaacctcgccatttgcatcgggcccaacatgctgaccctggaaaatgaccagtctctgagcttcgaagcccagaaggatctcaataacaaagtgaaaacacttgtggagttccttattgataactgcttcgagattttcggtgagaacattccagtgcactcctcgattacatccgatgactctctcgagcatactgattccagtgatgtgagtactctgcagaatgatagcgcctacgactctaatgacccagacgtggagtcaaacagctcttccggaatctcgtcaccttccaggcagcctcaggtcccgatggccacagcggctggcctggatagtgccggtccacaggatgctcgggaggtttctcccgaacccatcgtttctaccgtggcgcgtttgaaatcttcactcgcgcaacccgataggcgttactctgaaccgtcaatgcccagctcccaggagtgtttagagagtagggttactaaccagacgctgacaaagtctgagggagacttccctgttccaagggtgggctctcgacttgagtcagaggaagctgaggatccgtttccggaagaagtatttcccgctgtgcagggcaagacgaagaggccggtcgaccttaaaattaagaacctggcccccgggagcgtgcttcctagagcccttgtgttgaaggcatttagctctagctcactggatgctagctccgattcctcccctgtcgctagcccatccagtcccaagcgcaacttcttcagcaggcaccagtctttcaccacaaaaaccgagaagggtaagccaagccgggagataaagaagcacagcatgagtttcacttttgcgccacataaaaaggtgctcactaaaaatctaagcgccggttcaggaaagagccaggactttacaagagatcacgtcccgcgcggcgttagaaaagagtctcagctagctggacggatcgtccaggaaaacggttgcgaaacccacaaccagacggccagaggcttctgtttgcggcctcatgctttgtctgtggacgacgtgtttcagggcgccgattgggagagacctggcagccccccctcatacgaagaggccatgcaggggccggccgccaggctggtagccagtgaatcacagacagtgggaagcatgaccgtcggctcaatgagggcccgcatgttggaggctcactgtcttttgcctcctctcccacctgctcaccacgtcgaagactcccggcacagaggcagcaaggaaccactcccagggcatggcctgagtccattaccagagcggtggaaacaaagtcgtacagtgcatgccagtggcgactccctgggccatgtgagtggtccagggaggcctgagctgctgccactccgcactgtttccgaatctgttcagagaaataagagggattgcctcgtgcgccgctgttcccagccagtttttgaagctgaccagtttcaatatgccaaagagtcctacatttag

SEQ ID NO: 137413 - DNA, 801 bp, Artificial Sequence
  Description of Artificial Sequence: Synthetic coding sequence
atgaagctcagatctagccacaacgcaagcaaaacactgaacgccaataacatggaaacacttatagaatgccagtctgagggcgatattaaggagcatcctttgctcgccagctgcgagtctgaggactctatttgtcagcttatcgaagtgaaaaagcgcaagaaagtcttatcctggcctttcttgatgcgccgactgagtcccgctagcgacttttctggggccctcgaaaccgacctcaaagctagcttgttcgatcagcctctgtctatcatttgcggggattccgataccttgccaaggcccatccaggacatccttacaattctgtgcttgaagggtccgagtaccgagggcatttttcgtcgcgccgctaacgagaaggcacgaaaagagctgaaggaggagttgaatagtggcgacgcagttgatctggaaagactccccgttcacctcctggcagtggttttcaaagacttcctgcgctccatccctcgcaagctacttagctccgacttgttcgaggaatggatgggggctctggagatgcaggacgaggaggacagaattgaggctcttaagcaggtagcagataaacttccgcggcccaacctcttgcttttgaagcacttggtctatgttctgcacctaataagtaagaactccgaggtgaatcgaatggattcctcaaatttggcaatatgtatcggtcctaatatgctcactctggaaaatgaccagagcctgtcatttgaggcccagaaggacctgaacaataaagtttgctcagcgtactag

SEQ ID NO: 137414 - DNA, 2196 bp, Artificial Sequence
  Description of Artificial Sequence: Synthetic coding sequence
atgaagctgaggtcgtctcataacgcgagcaagacattgaatgctaataatatggagacacttattgaatgtcagtctgagggggatattaaggagcacccgctgctcgctagctgtgaatctgaggactccatatgtcaattaatcgaggttaagaaaaggaagaaagtcctgtcatggccgtttttgatgagacggctgagcccggctagcgacttctcaggcgcgttggagacggacctcaaggccagcctcttcgaccagcccctgagtataatctgtggagacagtgacacactcccaagacctatccaagacatcctgaccatattgtgcttgaaggggccaagtactgagggaatctttaggagggccgctaatgaaaaggctagaaaagaactcaaggaggagctcaattcgggcgacgccgtggatctggagagactcccagtgcatctgcttgctgtggtcttcaaagactttctgcgctcgatcccccgtaaacttctgtcttccgatctgtttgaagagtggatgggtgccctcgagatgcaggatgaggaggatcgaatcgaggcactgaagcaggttgctgataagctgccacgacctaacttactgctgttaaagcatctggtgtacgttctgcacctgatcagtaaaaactccgaggtcaaccgcatggactcaagcaacctagccatatgtatcgggcccaacatgttaactctggagaatgatcagagcctttctttcgaggctcagaaggacttgaacaataaagtgaagactttggttgaattcctgatcgacaactgttttgagattttcggcgagaatatccccgtgcactcctccatcactagcgatgacagtttggagcacactgactctagtgacgtcagtactctgcagaacgattcagcttatgactccaacgaccccgatgtggaaagcaattcaagctctggcatcagcagtccaagcagacaaccgcaagtgcctatggcgacagccgccggcctggatagcgccggtccccaggacgccagagaggttagtcctgagcccatcgtgtccacagtggctcgcttgaagtccagtctggcgcagcccgatcggagatactcagagcctagtatgccaagctcacaagaatgtttggaatcaagagtgaccaaccagacgctaaccaagtccgagggtgacttccctgtgcctagggtaggaagcagactggagagcgaggaagcggaggatcccttcccagaggaggttttccctgctgttcagggaaagactaagcggccggtggatctcaaaataaagaatttggctcccgggagcgtcctgccacgcgcgcttgtcctgaaggctttcagttcgagttcactcgacgcatcaagtgatagttctcctgtagcctccccttcatctcctaaacggaatttcttttcacgccatcagtctttcacaactaagaccgagaagggtaagcccagcagggagataaaaaaacatagcatgtcattcactttcgcgccacacaaaaaggtgttaaccaagaacctgtctgcaggttcaggcaaatcccaagatttcaccagagatcatgtgcctaggggcgtgcggaaggagtctcaactggccggacggatcgtgcaagaaaatggatgtgagacccataatcagacggcccgggggttctgccttaggccacacgctctgagcgttgacgatgtgttccagggagcggattgggaaaggcctgggtctccccctagctacgaggaggccatgcaggggccagcagcccgcctcgttgcctcagaatcccagacagtcgggagcatgactgtgggcagcatgcgtgcaaggatgctggaggcccactgtctgctccctcctctgcctcccgcccatcatgtcgaagattctaggcaccgcgggtcgaaagaaccactgcctggccacggcctgagtccactcccagagcggtggaaacaatcccggacagtgcacgcctctggcgatagcctgggccatgtgtctggaccaggtcgccctgagctgctccccctaaggacagtgagcgagagcgttcagcgcaataagagagactgtctggtacgccggtgcagtcaaccagtttttgaggcagatcaattccagtacgcaaaggagtcctacatttag

SEQ ID NO: 137415 - DNA, 828 bp, Artificial Sequence
  Description of Artificial Sequence: Synthetic coding sequence
atggcaaccgcagccggtctggatagcgcagggcctcaggatgcacgtgaagtcagccccgagccgattgtatccaccgtggcccgtttgaaaagcagccttgcgcaaccagaccggaggtacagtgagcccagcatgccgagctctcaggagtgcctagagagtagagtcactaatcaaactcttaccaaatcagagggtgatttcccggtacccagggtgggtagccgcctggagtccgaggaggctgaagacccattccccgaagaggtctttccagcagtgcaaggtaaaacaaagagacctgtagacctgaagatcaagaatctggcacccgggtctgttctgcccagagcactcgtgctcaaagcattttcaagttcatccctggatgcgtccagcgacagttcccccgtggcctccccttcaagccccaaacggaattttttcagtaggcatcagtccttcacaactaaaactgagaagggaaaaccatctcgggagattaaaaagcatagcatgagctttacttttgccccgcataaaaaagtcctgactaaaaacctctcagccggaagcggcaagtctcaggatttcactagggaccacgtgccgcgaggagttcggaaggaaagtcagctcgccggaagaatcgtgcaggaaaacgggtgcgagacccacaatcagacagctaggggattttgcttgcgtcctcacgccctatcggtcgatgacgtgttccaaggggctgactgggaacggccaggctcaccgccaagctacgaagaagcgatgcaaggcccagcagctagaccatggggagcttag

SEQ ID NO: 137416 - DNA, 327 bp, Artificial Sequence
  Description of Artificial Sequence: Synthetic coding sequence
atgacaagaaagatcttcaccaacacaagagagcgctggaggcaacagaatgttaactccgctttcgctaagctgaggaaactgatccccacacatcctccggacaagaagctgagtaagaatgagaccctccgcttggcaatgcgatacattaactttctggtcaaggtgcttggggagcaatcactgcaacagactggcgtggcagcccaagggaacattctggggctttttcctcagggacctcatcttcctggactggaagatcggacccttcttgaaaattaccaggtcccatctcccgggccatcccaccacatcccatag

SEQ ID NO: 137417 - DNA, 780 bp, Artificial Sequence
  Description of Artificial Sequence: Synthetic coding sequence
atggccagcccacagggtggccaaattgctattgctatgagattaaggaaccagctccaatcggtgtataaaatggatccactgagaaatgaagaggaggtgcgtgttaaaataaaggatctgaatgaacatattgtgtgctgtctctgtgccggctattttgtggacgctactacgattaccgaatgcctgcataccttttgcaaatcttgcatcgtcaaatatctgcaaacatccaaatattgccccatgtgtaacataaaaattcatgagactcagcccctgctgaatttgaagctcgatagggttatgcaggacattgtctataagttggtcccaggactccaggactccgaggaaaaacggattagggagttctaccaaagcagaggcctggatcgagtgacacagcccacaggtgaggagcccgcactcagtaacctgggacttccattctccagctttgatcattcaaaagctcactactaccgatacgatgaacaactcaacctttgtctggaacgtctgtctagcggcaaggacaaaaacaaaagcgtgttgcagaacaaatatgtcagatgcagcgtccgcgccgaagtcagacacttgcggcgggtcctgtgtcaccgcttaatgcttaacccacaacacgtgcagctcctgttcgacaacgaagtcctacccgatcacatgacaatgaaacaaatctggcttagtaggtggtttggtaagccatcccctctccttctgcagtattcagtgaaggagaagcggcgctag

SEQ ID NO: 137418 - DNA, 876 bp, Artificial Sequence
  Description of Artificial Sequence: Synthetic coding sequence
atggaagcccctgccagcgcccagacgccccacccccatgaacccataagttttgggatagaccagatcttgaattctcccgatcaggactctgcacccgcgccaaggggacctgacggagcctcatatctgggcgggccacctggcggtaggcccggagctacctatccatctttacccgcaagttttgcaggcctaggagcccccttcgaggatgctggctcgtactcggtgaatctgagtttggcaccggcgggagtgatccgagttcctgctcatcggcccctgcccggggcagttcccccgcctcttccctccgccttaccagctatgcccagtgtgcctaccgtgtcatccctgggcggcctaaattttccctggatggagagctcacgtaggttcgtgaaagatcggttcacggcagcagctgctctgaccccattcacagtgacacgccggatcggccacccttaccaaaaccggacaccgccaaaacgaaagaagccacgcacatcttttagcagggttcagatatgcgaattggaaaagaggtttcacaggcagaaatacctcgcctccgcagaacgggctgccttagccaaatcacttaaaatgaccgacgcccaggtgaagacctggtttcagaacaggaggacaaaatggaggcgtcagaccgccgaagagagggaagccgaaaggcagcaagcttctcggttgatgctccaactgcaacacgatgcctttcagaagtccctgaacgattctattcagcccgatcccctgtgtctgcacaatagctctctattcgctctgcagaacctgcagccgtgggaggaggactcctctaaggtgcctgccgtcaccagtttggtgtag

SEQ ID NO: 137419 - DNA, 312 bp, Artificial Sequence
  Description of Artificial Sequence: Synthetic coding sequence
atggccgagtcttggagcggacaagccttgcaggccctgcctgccacagtgttaggcgccctcggctccgaattcctcagagaatgggaggctcaggatatgagggttaccttgttcaagctgctcctcctatggcttgtgctttccttgctgggaatacagctcgcatgggggttttatggaaatacagtgaccgggctctaccatagacccggactgggtggccagaatggctccacgccggatggaagcacccacttcccatcctgggaaatggccgccaacgaacccttgaagacccaccgagagtag

SEQ ID NO: 137420 - DNA, 387 bp, Artificial Sequence
  Description of Artificial Sequence: Synthetic coding sequence
atggcctccgaggcttctgttcggctgggggtgccccccgggcgcctatggatccaacgccccgggatctacgaggacgaagagggtagaacgtgggtcacagtggtggtacgattcaatccttcgcgccgtgagtgggcacgcgcctcacagggttccaggtatgagcccagcatcactgtccacctgtggcagatggccgttcatacgagggagctcctatcctctggacagatgccattttcccagctgcccgctgtctggcagttgtaccccgggagaaaatacagggccgcagatagctccttttgggaaatcgcagaccatggccagatcgattcaatggaacagctggtgctcacttaccaacccgaacggaaggactag

SEQ ID NO: 137421 - DNA, 387 bp, Artificial Sequence
  Description of Artificial Sequence: Synthetic coding sequence
atggctagtgaggcctcagtgcgcctcggagtcccaccaggcaggttgtggatccagcggcccgggatctacgaagacgaggaaggcagaacatgggtcacagtggtggttcgattcaacccctctagacgggaatgggccagagcatcacaaggaagtcgatacgagcctagtatcacagtccacctctggcagatggcagtccacacgcgcgagctgctatcttccggccagatgcccttttcccagctccctgctgtgtggcagctgtatccgggtcgtaagtatagagccgcggactcttcattttgggaaatcgcggaccacggccagatagacagcatggagcagctggttttgacttaccagccagaacggaaggattag

SEQ ID NO: 137422 - DNA, 4776 bp, Artificial Sequence
  Description of Artificial Sequence: Synthetic coding sequence
atgggcaatgccgagagccagcatgtcgagcacgaattttatggggagaagcacgcctcgctcggtaggaagcatacttcaagatctctgagactgagccacaagactaggcgcacgaggcacgcttcttcaggaaaggtgatccataggaactccgaagtaagcactagatcttcaagcactccgtccatcccgcagagtctggcagaaaacggcctggaacccttttcacaggatggcacattggaggatttcggctctccaatatgggtggacagggttgatatggggcttaggccagtctcatacactgacagctcagtaacccctagcgtcgactcgagcatcgtgttaaccgccgcctccgtgcagtctatgccagacaccgaagagtctaggctgtacggtgatgacgcgacatatcttgcagagggagggcgaagacaacactcatacactagcaatggtcctactttcatggaaaccgcttcatttaagaagaaaagatcaaagtctgcagatatttggcgcgaggactcgctggaattctcccttagcgatttgagccaggagcacctgacttcgaacgaagagatactcggatccgccgaggaaaaggattgcgaagaagcccgggggatggagactcgcgcatcccccaggcagttgagcacctgtcaacgggcaaacagcctcggggacctgtacgcgcaaaaaaactctggagtcacagctaacggagggcctgggagtaaattcgcagggtactgccgcaaccttgtctcagatatccccaacctcgccaaccataagatgccgccagccgctgctgaggaaactcccccttatagtaactacaacactctgccctgtaggaagagtcactgcctgagcgagggcgcaaccaatcctcaaattagccactctaatagcatgcaaggacgccgggccaagaccacccaagacgtgaacgccggcgagggctctgagtttgcagatagtggtatcgaaggggctaccacagataccgatctcctgagccggagatccaacgcaactaactcttcctactccccaaccactggaagggcattcgtcggcagcgactccggtagttcctctacgggtgacgctgccaggcagggagtgtatgaaaacttccggagggagctggaaatgtctacaacgaatagtgagtcccttgaggaggctggctccgctcacagcgatgaacagagtagcgggacactgagctcccctgggcagtcagacattctgttgacggcagcgcagggtacggtgcgcaaggcgggggccctggctgttaaaaattttctcgtgcacaagaaaaataagaaagtcgaaagtgcaacaaggcgtaagtggaagcactattgggtgtccctgaagggatgcactctgtttttctatgagagcgatggccggtccgggattgatcataattcgattccaaagcacgcagtgtgggtcgaaaattcgatcgtgcaggctgtgcctgagcaccctaagaaagactttgtcttctgtctatcaaacagcctaggtgatgcgttccttttccagaccacctcccagaccgagctcgagaactggatcaccgccatccattccgcctgtgccactgcagtggccagacaccaccataaagaagatacgttacgcctactgaagtcagagataaaaaagctggaacagaagattgacatggatgaaaagatgaaaaaaatgggtgaaatgcagttaagcagtgtgactgatagcaaaaaaaaaaagacaatcttagaccagatcttcgtgtgggagcaaaatctggagcagtttcagatggacctttttagatttcgatgctacttggcgtccctgcaggggggcgagctgcccaaccccaagcggctgctggcatttgcctcaagaccaactaaggtggccatgggcagactgggcattttctccgtctcctccttccatgccctcgtcgcagcacggacaggggaaaccggagtccgccgccggacccaagccatgtctagatccgcatcgaagagaagaagccggttttctagtctctggggactggatactacaagcaaaaaaaagcagggacgccccagcataaatcaggtatttggcgaaggcacggaggcagttaaaaaatcccttgagggaatatttgacgacatagtacctgacggcaagagagagaaagaagttgtattgccaaacgtgcaccaacataatccagactgtgacatttgggtgcacgagtacttcacaccaagttggttttgcttgccaaacaaccaaccggccctgaccgtggttcggccgggcgacacagcaagggatactttagagcttatctgcaagacgcaccaactggaccactctgcgcattacttgcggctcaagttcctgattgagaataaaatgcagctgtacgtgcctcaacctgaggaggacatctacgaattgctgtataaggaaatagagatctgcccgaaggtgacccaatctatccacatagagaagtctgacacagctgctgacacctatggcttctctctgagctcagttgaagaagacgggatccgtcgcctttatgttaattctgttaaagagacaggactggcctctaaaaagggactgaaagctggcgatgaaatccttgaaattaataatcgggctgctgatgctctgaactcatcgatgcttaaagacttcctgagtcagccctctctcggtctactggttcgaacgtatcccgagctggaggaaggagtggaactgctggaatcccctccccaccgcgtggacggaccggcagacctgggtgaatctccactggctttcctcacctctaaccccggccactcgctctgttctgaacagggatcaagcgcggagacggcaccagaggagaccgaagggccagatctggaaagctccgacgaaacagaccacagctccaaatctactgagcaagtggctgctttctgtcggagtctgcacgaaatgaatccgagcgatcagagtcctagcccccaggattcaactggcccacaattggctacaatgcgacagctatctgatgcggataagctgagaaaagttatttgtgagctgttggaaacagaacgtacatacgtgaaagacttaaattgcctaatggaaagatatctgaagcccctccagaaggagaccttcctgacacaggacgaacttgacgtgctgttcggcaacctgacggagatggtcgaattccaggtggaattcctcaagaccctggaggacggcgtgcgcctggtgccagatctggagaaactggagaaggtggaccagtttaagaaagtgttgttttcacttgggggttcatttctttattacgcggacaggtttaaactgtactccgcattttgcgcctcgcatacgaaagtccccaaagttctcgtcaaggccaaaaccgacaccgcctttaaggcctttctggatgctcagaaccctaagcagcaacatagctcgacactggagtcctatctgatcaagccgatccagaggattttgaagtacccattgttgcttagggagctctttgccctaaccgatgcggaatcagaggagcactatcacctcgacgtggcaatcaagacaatgaacaaggtggctagtcacattaatgagatgcagaagatccacgaagagtttggcgctgtcttcgaccagctgatcgcggagcagaccggagaaaagaaagaagtggcagatctgtccatgggagatcttctgctccacaccacagttatatggctgaacccacctgcatctctcggaaagtggaagaaagaacctgaactggctgcattcgtctttaaaacggctgttgtgctcgtctacaaagatggctcgaagcagaagaagaaactggttggctcacaccgcctgagcatctatgaagattgggacccatttaggttccgacatatgatccctaccgaggctctgcaggtgagagccctggcatcagccgacgctgaggcgaacgcagtctgcgagattgtgcatgttaaaagtgaatccgagggcagacctgagcgtgtttttcacctgtgttgctcaagccccgaatcccgcaaggacttcttgaaggcggtgcattcaatcctccgggataagcaccgccgacagctcctcaagacagagagtttaccatctagccagcaatacgtcccattcggcggcaagcgactgtgcgctctcaagggcgcaaggccagccatgagtagggccgtgagcgcgccatcaaaatcgctgggcagacgtcggcgccgcctggcacgaaatcgctttacaattgattctgacgcagtcagcgccagcagccccgagaaggagtcccagcagccacctggtggaggcgataccgacaggtgggtggaggagcaattcgacttagcccagtatgaggaacaggacgatatcaaggaaacggacatcctgtcggatgatgatgagttttgcgagtcagtaaagggggctagcgtggatcgagatctgcaggagcgccttcaggcaacgtccatttctcagagggagcggggcaggaaaactcttgatagtcacgcttcgcgcatggcccaactgaagaaacaggccgcactgtctggtatcaacggtggcctagaatctgcatcagaagaagtcatatgggtgcggagggaagatttcgctccctcgcgtaagctcaatactgaaatctag

SEQ ID NO: 137423 - DNA, 3216 bp, Artificial Sequence
  Description of Artificial Sequence: Synthetic coding sequence
atggaaactgcttcttttaaaaaaaaacgctctaaatccgcagacatttggagggaggattctttagagtttagcttgagcgacctgtctcaggaacacctcacaagcaacgaagaaattctgggaagcgcagaagaaaaggattgcgaggaggcacgggggatggaaacacgggcctcccctcgccagttatctacctgccagcgggctaactctctaggcgatctgtacgcccagaaaaacagcggtgttaccgcgaatggaggcccggggagcaagttcgcgggctattgccgcaacttagtctccgatatcccaaacctcgccaatcacaagatgccacccgcagctgcagaggagactccgccctattctaactacaataccctgccatgcagaaaaagccattgcctgtcagagggcgcaaccaacccccagataagccatagcaatagcatgcagggaaggcgggctaaaactactcaggatgttaacgccggcgagggcagcgagttcgctgactctgggattgagggcgcaacaaccgacacggatctgctttcccgcaggagcaatgctactaattcgtcatatagtccgaccactggtagggcctttgtgggtagtgattcaggatcctcatcaacaggcgacgcagcaaggcaaggtgtctatgaaaattttaggagagaacttgaaatgtctaccacaaatagtgaatcactggaagaggccggcagtgcccactctgacgagcagtcctctggaaccctgagcagccctgggcagagcgacatcttgctaaccgcagctcagggcacagtgaggaaggcaggcgctttagctgtgaagaattttctggtgcataagaaaaataaaaaggttgagtcagcgacccgcaggaagtggaaacactattgggtcagtctgaagggttgtacgctttttttttatgagtctgacggccggagcggaatcgatcacaatagtatacctaaacacgccgtttgggtggagaattctatcgtccaggctgtccctgaacatcccaaaaaggatttcgtcttctgcctgtctaactccctcggggacgcattcctgtttcagaccacctcacagaccgagctggagaattggataactgcaatacactccgcttgtgcaacagctgtcgcacgccaccaccacaaggaggataccttgaggctgctgaagtctgagattaaaaaactagagcaaaaaatcgatatggatgaaaagatgaaaaagatgggggagatgcaactctcatcagttactgattcaaaaaaaaagaagacaatcctggatcagatttttgtctgggagcagaacctagagcagttccagatggatctgtttagattccgatgttacctggcaagcttgcaggggggggaactgccgaatcccaagcggctgctggcatttgcctctagacctacaaaggttgccatggggagactcggaatcttcagtgtctcttctttccacgccctggttgccgcacggaccggcgaaaccggggtcagacgacgcactcaggctatgagcagaagcgcttccaagcgcagatctagattctcctcactgtggggcctggatacaacaagtaagaaaaagcagggccgtcccagcattaaccaggtgtttggtgaaggaactgaagcagttaaaaagtccctggaagggatctttgatgatatcgtaccggacggcaagcgggagaaggaagttgtgctccccaacgtccatcaacataatcccgactgtgacatctgggtccacgagtactttactcctagctggttttgtttgccaaacaatcagcccgcactaaccgtggtgcgccccggtgacactgccagggacactttagagttgatatgcaaaacccaccaactcgaccactcggcacactacttgagactgaagttcttgattgaaaacaaaatgcaactgtatgtaccacagcctgaagaggatatatatgagctcctctataaagaaatcgaaatttgcccaaaggtgactcagtctatacacatcgagaagtcagacacagctgcagatacatatggcttttctctgagcagtgtggaagaggacggcatccgccgcctgtacgtaaactctgtgaaggaaaccgggctcgcctccaagaagggattgaaagccggggacgaaatactggaaatcaataatagagccgccgatgctctgaatagctctatgcttaaagatttcctgtctcagccatccctgggattgctcgtaaggacatacccagagctagaagagggcgttgaattactcgaatccccaccacatcgggtggatggtccggctgacttgggcgaaagcccattggcattcctgacaagcaaccccgggcattcactgtgctctgagcagggatctagtgccgaaacagcccccgaagaaacagaaggaccggacttggagagtagtgatgagacagatcactcctctaagtcaaccgaacaggttgcagccttctgccgttcccttcacgaaatgaatccatcggaccaaagtccgtctcctcaagattccacaggaccccagttagctacaatgagacagctttcggatgcggataaattgaggaaagtgatctgcgaactgctggagaccgaacgtacgtacgtgaaggatttgaactgcctaatggagagatacttgaaacccctacagaaggagacctttctgacacaggacgagctggacgtgttatttggcaatcttacagaaatggtggaatttcaggtggaattcctgaaaacgctggaagatggggtgagactggtcccggatctcgagaaattagaaaaagttgaccaattcaaaaaagtcctgtttagcctaggcggatctttcctgtattacgccgacagatttaagctttatagtgccttctgcgcccataagagcagccaggggccaggagaatctcaggacagacacggctttcagggtattttgggctgccctgagcccgaggccgctgccctcatccacgcgggtgtggtacctcatcaagcacatcctgaagatccccaggttcccacatcagctcaaggcgcagtgaggcccgatcgctgtggagagcgaggggctttgcctccaggccgagggcatcaggatcacgaacaaggctgtcagagccatcaatag

SEQ ID NO: 137424 - DNA, 678 bp, Artificial Sequence
  Description of Artificial Sequence: Synthetic coding sequence
atggggaacgctgagtctcagcacgtggagcatgagttttatggtgagaaacacgccagtctgggacggaagcacacgagcagaagtttgaggttgagtcataagactcgccggacccgccatgcatcaagcggaaaagtgatccaccgtaatagcgaagtgtccacccgctcctcaagcaccccgagtattccccagtcactggcagagaacgggctggaacctttctctcaagatggcacactcgaggattttggctctccaatatgggttgatcgagtcgacatgggtctccggcctgtgagctacaccgactcttccgtgaccccctccgtggactcatctattgttctgactgctgccagcgtgcaaagcatgcccgataccgaagagtcgaggctgtatggggacgatgctacatacttagccgagggagggcgccggcagcactcatacacctctaatggaccgacatttatggaaaccgcttcttttaagaaaaagaggagtaagagcgctgacatttggcgggaagatagtctggaattcagtctctctgatctctcccaggagcacctgacctctaacgaagagatactgggctcagccgaggaaaaagattgtgaggaggctcggggaatggagactcgcgcctcaccccgacaactatccacgtag

SEQ ID NO: 137425 - DNA, 4596 bp, Artificial Sequence
  Description of Artificial Sequence: Synthetic coding sequence
atgggaaacgcggaatctcagcacgtagaacacgagttttatggggagaaacatgcctctttagggaggaagcacacttcccgatctcttaggctgtcccataaaacacgaaggaccagacatgccagttctggaaaggttattcacaggaactctgaggtatccacccgtagctcctctactccctctatcccccagtccttagccgaaaacggactagagccgttctcccaggacggcactctggaggattttggtagccctatttgggtcgacagagtcgatatgggactgcggccagtgtcgtacaccgatagtagcgtcacgccttccgtggactctagcatagtgctaacggccgcgtcagtacaatccatgcctgacaccgaggagtcccggctgtatggggacgatgcgacatacttggccgagggagggagacgacaacattcctacacctcgaacggtccaacatttatggaaactgcctctttcaagaaaaaaagatcaaaatctgccgatatttggcgtgaggattcactggaattcagtctgagtgacttgtcacaagaacatcttacgagtaacgaagagatcttggggagcgcagaagaaaaggactgcgaggaggccagagggatggaaacaagagcctcaccacgccaactttccacttgccagcgtgctaattctcttggcgacctttacgcacaaaaaaattccggcgtaacagccaatggcgggcctgggtcaaagttcgcggggtattgcaggaacttagtgtccgatatcccgaacctcgcaaatcacaaaatgcctccagctgccgccgaggagacaccgccgtattccaattacaacactcttccgtgtagaaagtcacactgtttgagcgaaggcgctactaaccctcagatctctcattcaaatagcatgcaaggccgcagagccaagacaacccaagatgtcaatgccggggaagggagcgaatttgctgacagtggcatagaaggcgcaaccaccgatactgacttacttagtagaaggagcaacgcaaccaattcatcttatagccccactacgggcagagcctttgttgggagtgactcgggaagctcctccactggcgatgccgcccgccagggcgtctatgaaaattttcgccgggaactggagatgtcaaccaccaatagtgagtccctcgaggaagccggcagcgcccactctgacgaacagagctctggaacactctcaagtccaggtcagtcagatatcttattaacagccgcccagggtaccgttaggaaggccggggccctcgccgtgaagaattttctcgtacataagaagaataagaaagtggaaagcgcaacccggcgaaagtggaaacactactgggtaagcctgaaagggtgcaccctgttcttttatgagtccgacggtcgcagcggcatcgaccacaactcgataccaaagcacgccgtgtgggtggagaacagcatcgtgcaggccgtgcccgagcaccccaaaaaagattttgtgttctgcttaagtaattccctgggggatgctttcctcttccaaaccacaagtcagacggaacttgagaactggatcacagcaattcactctgcatgcgccacagcggtggcacggcatcaccataaagaggacacccttcgactactcaagtctgagattaaaaagctcgagcagaagattgatatggacgaaaagatgaaaaagatgggagaaatgcaactgtcctctgtgactgattccaaaaagaaaaaaacaatcttggaccagatttttgtctgggagcagaacctcgaacagttccaaatggatttgtttcggttcagatgttacctggcatctcttcaaggtggggaattgcctaatcccaagcgtctgctggcttttgccagcaggccgactaaggtagccatggggcgactcggcatcttttcagtctcatcctttcacgctttggtggccgcccggactggagagaccggagtgagaagaagaacacaggcaatgtctcgatcggcctctaaacgtagatcccggttctcgagcttgtgggggctggacacaacttcgaagaaaaaacagggccggccatcaatcaatcagcgagagaaagaggtcgttctgcccaacgtgcatcagcataatcctgactgtgacatctgggtccatgaatactttactccaagttggttctgtctccccaataatcagcccgcactcactgtggtaaggcccggcgataccgctcgcgatacgctcgagctgatctgtaaactgtacaaagaaattgaaatctgccccaaagtcactcagtccatccacatcgaaaagagcgacacggcagccgatacatacggcttttccttaagcagcgtggaggaggacggaatcagaagactatacgtgaatagcgtcaaagaaactggtctggcgtccaagaagggccttaaggccggagacgaaatcttggaaattaacaatcgggcagccgatgcattgaattcttcaatgctgaaggactttctgagccagcctagcttgggactgttagtgagaacctatccggaactcgaggagggtgtggagttactggagagcccccctcaccgggtggacggcccagctgacctgggtgagagtcctctggctttcctgacgtccaacccgggccattctttatgcagcgaacagggcagttcagcggagacggcccccgaagaaaccgaaggtcctgacctggagtcctctgatgagaccgaccacagttctaaatcaacagaacaggttgccgcattctgcaggagtcttcatgaaatgaatcctagtgatcagagcccatcacctcaagatagtacagggcctcaactggcaactatgcgccagctgtctgatgcggacaaattaagaaaggtcatttgcgagctgctggaaacggaacggacctatgtgaaggatctgaactgtttaatggagcgctatctgaaacccctccaaaaagaaactttcctgactcaggacgaactggatgtgctcttcgggaacctcaccgagatggtagagtttcaggtggagtttctgaagaccctggaggacggtgttcggctggtcccagacctcgagaaactcgagaaagtggatcagtttaaaaaagttttattctccctcggcggctcatttctgtactacgctgacaggtttaagctgtactcggcattttgcgcttctcataccaaggttccaaaggttctcgtgaaggccaagacagataccgcttttaaagcatttctcgacgcccagaatcccaagcaacagcactcatccaccttggagtcctatttgatcaagccaatacagcgcattctgaagtatccactgctgctgagagagttattcgccctcaccgatgcagaaagtgaggagcactaccatctggacgttgccatcaaaaccatgaacaaggtagccagccatatcaatgaaatgcagaaaatccatgaggagttcggggccgtgttcgaccagttgattgctgagcagacgggagaaaagaaagaggtcgccgatttgtctatgggggatctgctgctgcacacaacggtgatctggttgaatcctccagctagcttgggaaagtggaaaaaggagcctgagctggcagcattcgttttcaagacagccgtcgtcttggtgtacaaggacggcagtaaacagaagaaaaagttagtcgggagccacagactctccatttatgaggattgggacccatttcgctttagacacatgatccctacggaagcgctgcaggtgagagctctggccagcgccgatgcagaagctaacgccgtctgtgaaatcgttcacgttaagagcgaatccgagggtcgccccgaaagagtgttccacctgtgctgctcatcccctgaatcacgaaaggattttctcaaagccgtgcactccatcctgagagacaaacatcgtagacagcttctcaagacagagtcactcccaagctcccagcagtacgtgccattcggtggaaaaagactctgtgccctgaagggggcgcgacccgccatgtctagagcggtgagtgctccatcgaagtctcttggcagaagaaggagacgcctggcaagaaaccggttcaccatagactctgacgcagtgtcagccagctcacccgagaaggagtcccaacagccacctggtggaggcgatacagatcggtgggtggaggagcaattcgatttggcccagtacgaagaacaagatgacataaaggagactgatatactgagcgacgatgatgagttctgtgagtctgtgaagggcgcatctgtggaccgcgacctccaagagcgactacaagctacaagcatttctcagcgggagcgcggcagaaagacactcgattctcatgcttctcgaatggctcagttgaaaaagcaagccgctctgtccgggataaatggcggattagagtcagcatctgaggaagtgatttgggtaaggagggaagattttgctccctctcgcaagttgaacaccgaaatttag

SEQ ID NO: 137426 - DNA, 2493 bp, Artificial Sequence
  Description of Artificial Sequence: Synthetic coding sequence
atgggtagcatgtttcgctcggaagaagtagccctggttcagctgttcctccccacagcagcggcctacacctgtgtcagccgcttgggcgaactggggctggtggaatttcgggatcttaacgcgtctgtgtccgcttttcagaggagattcgtggttgatgtacggcggtgcgaggaattggagaaaacattcaccttcctgcaggaagaagtacggagagctggtctggtgttgccgccgccaaagggtagactgcccgccccccctcctcgggacctccttcgcatccaggaggagaccgaacgcctggctcaagagcttcgggatgttcgggggaatcaacaagctctgcgcgcccagctccatcaattgcagctccacgccgccgtgctaagacaaggccacgaaccccagctggccgccgcacacaccgatggcgccagtgagaggacccccctgctgcaggccccaggcggaccccaccaggatctcagggtgaatttcgtggcaggagccgtcgaaccacacaaggctccggcactagaacgcctcttgtggagagcttgtaggggtttccttattgcctcgtttcgggagctggaacagcctctcgaacatcccgtgaccggagagcctgcaacttggatgaccttcttgatttcctactggggggaacaaataggccagaagatcagaaaaattaccgactgctttcattgtcatgtattcccattcttacagcaggaggaggcccgccttggcgctctgcagcagctgcaacaacaatcccaggagctgcaggaagtacttggggagaccgaaaggttcctgagtcaagtgttaggtcgagttcttcagctcctcccccctgggcaagtccaggtgcacaaaatgaaggccgtgtatttggccctcaatcagtgttccgtcagcactacacacaagtgcctcattgccgaagcttggtgctctgtgagggacctacccgcccttcaggaggccttgagagattcgagcatggaagagggcgtctccgccgtggcacacaggattccatgcagggatatgccccccaccctaatacgaaccaatagattcaccgcctcttttcaagggatagtggatgcgtacggtgtcgggcgataccaggaggtgaatcccgccccgtacacaattatcacattccctttcctgttcgccgttatgttcggtgatgtcgggcacggcctgcttatgtttctctttgccctagcgatggtactagcagagaacagacccgcagtcaaagcagctcagaacgagatatggcagactttctttcgcggccgttacttacttttattgatgggcctgttttccatttatactggctttatatataatgagtgctttagtcgggccacatcaatctttccgagcggctggtctgtcgctgcgatggcaaaccagtccggttggagcgatgcatttttagcccagcatactatgctaacccttgacccaaatgtcacaggggtcttcttgggaccatacccgttcggtatcgatcccatctggtctctagccgccaaccatctttcgtttctgaatagttttaagatgaaaatgtcagtgatcttgggagtggtccacatggctttcggcgtggtgctgggtgtgttcaatcatgtccatttcgggcaacgccaccgtctgctgctggaaacattgccggaactaaccttcctgctagggctttttggctatttggtgttcctggttatatataaatggctgtgcgtatgggccgcccgagccgcatctgctccctccattctcattcacttcattaacatgttcttattttcccatagccctagcaaccgcttactataccctcgtcaagaagtagtgcaggcaacattagttgtcctggcgctggccatggtcccaattctcttgcttgggacgccactccatctcttgcacaggcaccggcggcgattgcggagacggcccgctgatcgacaggaagaaaacaaagctgggcttctcgacctccccgacgcctcagtgaacggctggtcatccgatgaagagaaggccggtggacttgatgacgaggaagaggccgagctggtcccaagcgaggtgctcatgcaccaggccattcacacaatcgagttctgcttagggtgcgtctcaaacactgctagttacctgaggttgtgggccctttctctggctcacgcccagttgtccgaggtactgtgggctatggtaatgaggatcggcctgggccttggacgggaggtcggggttgccgccgttgttttggtgcctatctttgctgccttcgctgtcatgaccgtggccattttgttggttatggagggtttatctgccttcttgcacgcgctgaggctgcattgggtggagttccaaaataagttctatagcgggaccggttacaagctgagccccttcacattcgctgcgacggacgactag

SEQ ID NO: 137427 - DNA, 657 bp, Artificial Sequence
  Description of Artificial Sequence: Synthetic coding sequence
atggggtccatgttcagatccgaggaagtggcgctggtgcagctgtttctccccaccgctgcagcctacacctgcgtcagtaggttgggggagttaggccttgtcgaattccgagatctaaacgcaagcgtgtccgcttttcagagacgctttgtggtggacgtaagacgctgcgaagaattagagaagacgtttacgttcctgcaggaggaagtacggagggccggacttgtcctccccccccccaaggggagactgccggcaccgccgccacgggacctcctgcgaatccaggaggaaaccgagcgactggcccaggagctccgagacgtccggggcaaccagcaagccttgcgagcccagctacaccagctgcagctccatgctgcagtgcttcgccaaggccacgagccgcagctggcggcagctcacactgatggcgcatctgaaaggacaccactactgcaagccccaggcgggccgcatcaggatctgcgggttaacttcgtcgccggggcagtggagccccacaaagctcccgccctggagcgactcttatggcgggcctgtcgcgggtttctgattgcctccttcagagaactggagcaacctctggaacaccctgttacaggggaacccgccacctggatgacctag

SEQ ID NO: 137428 - DNA, 186 bp, Artificial Sequence
  Description of Artificial Sequence: Synthetic coding sequence
gacgacgaggaagaagcggagttagtacccagcgaagtgctgatgcaccaggctatccatacaatcgagttctgtctaggttgtgtgtctaacacggcctcttatttacgactctgggcactcagcttggcccacgcgaggtggaattcccgaacatcatcgacacaagccagagccacctcatag

SEQ ID NO: 137429 - DNA, 1845 bp, Artificial Sequence
  Description of Artificial Sequence: Synthetic coding sequence
atgacttttctgattagctattggggagagcagatcggccagaagataaggaaaatcaccgactgctttcactgccacgtttttccctttttgcagcaggaagaagctcggttgggagcgctgcaacagcttcagcaacagtcacaggaactgcaggaagttctgggagaaacagagcggttcttgagccaggtgctcggcagagtcctacagctgttgccgccgggacaggtgcaagtgcataagatgaaggcagtgtacttggccttgaaccagtgttccgtctccacaacacacaaatgtctgattgctgaggcatggtgttcagttagagaccttccagccctgcaggaggctctaagggatagctcgatggaggaaggcgtatcagctgttgcccatcgaattccgtgcagggacatgcctcccaccctcatcagaacaaatcgttttaccgcttcatttcagggcattgtcgatgcttacggggtcggccgataccaagaggtgaatcccgcaccctacacgattataacgttcccttttcttttcgcagtcatgtttggcgacgtgggtcatggcctgctgatgtttctctttgcattggcgatggtgctggcagagaacaggcccgcggtgaaagccgctcagaatgaaatatggcagacattttttcggggtaggtaccttctcctgctcatgggactttttagtatctacacaggctttatttataacgagtgtttttctcgggccacgtcgatctttccgtccggctggtccgttgctgctatggctaaccagtccgggtggtctgacgcatttctcgcccagcataccatgctgacactggatcccaacgtcaccggtgtcttcctaggaccatatccttttggaatcgatcctatttggagtctcgccgcaaaccacttgtcctttctgaactcttttaagatgaaaatgagcgtgattttgggtgtagtgcacatggcctttggtgtggtgcttggggtgttcaatcacgttcacttcgggcagcgacaccgcttattacttgaaacgcttccggaactaactttcttactgggactcttcggataccttgttttcctggtaatttacaagtggctgtgtgtctgggcggctagggccgcttcagctccaagtattttgatacactttatcaacatgttcctttttagccatagtccttctaatagactcctctatcctagacaggaggtagtgcaggcaacactcgttgtactggcgttggcgatggtacctatcctcctgcttggaacacctcttcacctgcttcatcgccaccggagaaggctgcgacggcgcccggcggaccggcaggaagaaaataaggccggcctgcttgacctgcccgacgcctccgtgaatgggtggagtagcgacgaggaaaaagccgggggcctggatgacgaggaagaagctgagttggttccgagcgaagtcctgatgcaccaggccatccatactatagagttctgcctgggttgtgtgtctaacaccgcatcctacctgcgcttgtgggctctgtctctggcccacgctcagctctctgaggtgctgtgggctatggtgatgcgcatcggcctcgggctgggccgtgaggtgggggtggctgccgtcgtactagtgcccatttttgctgcctttgccgtgatgactgtcgccatattgctcgttatggaaggcctatctgcctttctgcatgcactcagattgcattgggtcgaattccaaaacaagttctactctggtaccggatacaaactgtctccctttacatttgccgctacagacgactag

SEQ ID NO: 137430 - DNA, 357 bp, Artificial Sequence
  Description of Artificial Sequence: Synthetic coding sequence
atggtcccaatactcctgctcggaaccccgctgcacttgttgcacaggcatcgccgacgcctgaggaggaggccagccgacagacaggaggagaataaagctgggttgctagacctacccgacgcctcagtgaacgggtggagctccgatgaggagaaggccgggggactcgatgacgaagaggaggcggaactcgttccctccgaagtcctaatgcaccaagccatacataccatcgagttctgtctcgggtgtgtgagtaatacagcgtcctatcttcgactgtgggccctgtcactggctcatgcaagatggaatagcagaacatcttccactcaggccagggctacatcctag

SEQ ID NO: 137431 - DNA, 1671 bp, Artificial Sequence
  Description of Artificial Sequence: Synthetic coding sequence
atggagggacccctgtctgtcttcggtgatcgcagcaccggggaaacaatccggagtcaaaatgtcatggctgccgcttcgatagctaacatagtgaaatccagtcttgggccagtaggtctggataagatgctcgtggatgatatcggcgatgtcaccattaccaatgatggagctacaattctgaagctgttggaggtggagcacccagctgcaaaggtcttgtgcgaactggctgatcttcaggataaggaagtaggagatggaacaactagtgtggtgattattgccgccgaactgcttaagaatgccgatgagctggttaagcagaaaatccacccaacatcagtgatctcagggtaccgcctggcttgtaaggaggccgtgcgttatatcaatgaaaatttgatcgtgaacacggacgagcttggccgggactgcctgataaacgctgctaagacatcgatgtccagtaagatcattgggatcaatggagatttttttgcaaatatggttgtggacgccgtgctggcaataaagtacactgacatcaggggccaacctagatatccagtaaactccgttaacatcttgaaagcgcacggtagatctcagatggaaagtatgctgatcagtgggtacgccctcaattgtgtggtgggctctcaaggcatgccaaaaaggattgttaacgccaaaatcgcctgcctcgatttctctttgcagaaaaccaagatgaaattgggggtgcaagttgtgatcacagatccagaaaaactggatcagatccgtcagagagaatccgacattaccaaggagcggattcaaaagattctggccacgggagccaacgtgattttgaccacaggagggattgacgacatgtgtttaaagtacttcgttgaagccggagcaatggctgtgcgacgcgtgttgaagcgcgatctgaagaggattgcgaaggcgtcgggagcgaccatattgtccacactagctaatcttgaaggagaagagacattcgaagcggccatgttaggccaggcagaggaggtggtccaggaaagaatttgcgacgacgaactaatcctgattaaaaacacaaaagctcggacctctgcttccatcatcctgaggggagctaacgattttatgtgcgacgagatggaacgcagcctgcacgacgctctgtgtgtggtcaaaagagtcctggagtcaaagtcagtggtgcccggcggtggcgctgtggaggcagcccttagcatttacctggaaaactatgccaccagcatgggctcacgcgagcaactcgccattgcagagttcgctcgctctctcctggtgattccaaacacactcgctgtcaacgccgcgcaagattctacagacttggtcgcgaagttaagggcatttcataatgaagctcaggtcaatcctgagcgaaaaaacctgaagtggatcggactggacctttctaatggcaaaccaagggataataaacaagccggcgtgttcgaaccgaccatcgtgaaggtgaaatcacttaagtttgctaccgaggccgccattactatactgcggatcgatgacctcatcaagttacatcctgagagcaaagacgacaaacatggctcctacgaagacgctgtgcactccggagcactaaatgactag

SEQ ID NO: 137432 - DNA, 1206 bp, Artificial Sequence
  Description of Artificial Sequence: Synthetic coding sequence
atgagctcaaagatcatcgggatcaacggggatttcttcgcaaatatggttgtcgacgctgttctcgcaatcaaatataccgatatacgcggccagcctcggtatccagtgaattcagtgaatatcctcaaggctcacgggaggtcccagatggaaagtatgttgatttcaggatacgccctgaattgtgtggtggggagtcaaggtatgcccaaacgaatcgtgaacgccaagatcgcatgtcttgatttcagccttcagaaaacgaagatgaagctgggtgtccaggtggtgatcacggatccagaaaaactcgaccagattagacagcgggaaagtgatattactaaggagcggattcagaaaatacttgcaaccggagccaacgtgattctgactaccggggggatagacgacatgtgcctcaagtatttcgtggaagccggggcaatggccgtccgtcgagtgctcaagagagatctgaagagaattgccaaggcttcaggcgccacaattttgtccacactggccaatctggagggcgaagaaacatttgaagccgccatgttagggcaggccgaagaagtcgttcaggaacgaatctgcgatgacgagttaatacttattaagaatactaaggccagaacctctgctagtatcattcttcgaggagctaacgactttatgtgcgatgaaatggaacgctccctacacgacgcattatgtgtggtcaagcgagtccttgagagcaagtctgtggtgcccggggggggggctgtcgaggccgctctctctatttacttggagaattacgccacatcaatgggaagtcgggagcagctcgccattgctgaatttgctcgtagtttgttggtgattccaaataccctggcagtaaacgccgcccaggacagtacggacttggtggccaaactgagggccttccacaatgaggcccaggtgaatcctgagcgcaaaaaccttaagtggattgggctggatctcagtaacggcaaaccaagggacaataagcaggccggcgtgttcgagcctactatcgtgaaggtgaagtccctcaagtttgccacggaagccgcaataacaatcctgcgaatcgatgacctaattaaactgcaccctgaatctaaagatgataagcatggaagctatgaggatgctgtccactcaggagccctcaacgactag

SEQ ID NO: 137433 - DNA, 1302 bp, Artificial Sequence
  Description of Artificial Sequence: Synthetic coding sequence
atggaaggcccgctgagtgtgtttggcgaccgcagcacaggagagacaatccgctcccagaatgtcatggcagctgccagtattgctaacatcgtgaagtcttcattaggacccgtgggccttgacaaaatgcttgtggatgatatcggagatgtgaccatcaccaacgacggcgctaccatcctcaagctgcttgaggtcgagcatcccgctgccaaagtactgtgtgagctcgccgaccttcaggataaggaggtgggagatggaacaacatcagtagtcattattgctgcagagttgctaaagaatgccgacgaacttgtcaagcagaagatccaccccaccagcgtgatcagtggctacagattagcatgcaaggaggctgtgcggtatatcaatgagaacctcattgttaacaccgacgagcttggccgcgattgtctcattaatgcggccaaaacatccatgtcaagcaagatcataggcattaatggggatttctttgctaatatggttgtggacgccgtgctggcaattaaatatactgacatccgaggacaaccgagatatccagtcaactccgtaaacatcctcaaggctcatggtcggtcccaaatggaatccatgctgatttctggctatgccctgaattgcgtggtgggttcacagggaatgccaaagcggattgtcaacgcaaagatagcctgcctggattttagcttgcaaaaaaccaaaatgaaacttggcgtgcaggtggtgattactgacccggagaagctggaccagatccgtcagagggagagcgatatcacaaaagaacggatccaaaaaatcctggccacgggtgccaatgtgatcctgacgactggtggtatagacgacatgtgtctaaagtatttcgtggaagcaggtgccatggctgttcgaagggttcttaagagggatcttaagcgcatcgcgaaggcatccggcgccacgattctttctaccctcgcaaatctggagggtgaagagacctttgaggcagcaatgctgggacaggcagaagaagtcgtgcaggagagaatttgtgacgacgagttgattctcattaagaacaccaaggcaagaacctctgcaagtatcatcttgcgtggagctaacgattttatgtgcgacgaaatggaacgctctttgcatgacgctctgtgcgtggtaaaacgagtattagagagcaagtctgtagtgcccggaggtggggcggtcgaggcggcattatctatctatctggagaactacgccaccagtatggactggtcgtag

SEQ ID NO: 137434 - DNA, 648 bp, Artificial Sequence
  Description of Artificial Sequence: Synthetic coding sequence
atgctcgcagggcagttggaagcaagagacccaaaggaggggacccaccccgaagatccttgtcccggagcgggggcagtgatggaaaaaacagccgttgcagctgaggtccttaccgaggactgcaatacaggagaaatgccccctctgcagcagcagattatcagactgcaccaggagctgggccggcagaaatccctgtgggcggatgtccatggaaagttgaggtctcatattgatgctcttcgggaacagaatatggagcttcgtgaaaagctgcgcgccctacagctacagaggtggaaggcacggaaaaagtcggccgccagccctcacgcagggcaagaatcacataccctagccctcgaaccggcctttggtaagatttcccccctatctgctgacgaggagacgatacccaaatatgcaggacataagaaccaaagcgccacactccttggccagcgaagctccagcaacaactctgcaccgcccaaacctatgtccctgaaaattgagagaatctccagctggaaaactccaccccaggaaaatcgcgataagaacctcagcaggcgacgccaggatagacgggccacacccacgggtcgtccgactccctgcgcagagcggcggggaggtgtgtag

SEQ ID NO: 137435 - DNA, 981 bp, Artificial Sequence
  Description of Artificial Sequence: Synthetic coding sequence
atggagaagacacctgctgctgctgaggtcccacgagaggattctaatgccggagagatgccatctctgcagcagcagatcacctccctacatcaggagctggggcgccagcagtcactttgggccgatatccaccggaaattgcagtcccatatggatgctttaagaaaacagaaccgggagctcagagaggagctgcgggggctccaaaggcagcagtgggaagccgggaagaaacccgcagcaagtcctcacgcgggccgagaaagccataccctcgcgttagaacccgctttcgggaagataagccatctgagtgcagacgaagacaccacccctaagtacgcaggaaggaaatctcagtccgccactttactcggacagcgttggtcctccaaccacctagctccccccaaacccatgtccctgaaaaccgaaaggatcaactcgggaaaaaccccaccacaagaagatcgggagaagagccctcctgggcgcagacaagaccggtcccctgccccgaccggcagacccacaccaggtgctgaacgacgcggggtgtctgaggatggtaagatcatgcacccttcttctagatcaccccaaaactccgggggtcgaaagtcgccagtacaagcctcgcaggcaacaactctgcaggaacagactgccgcagcccgaggggcagaccgctcctcgtccgtccttggtagctcggaaggcgggtttttgagccgcgttcaggccgatgaattcgcatcaagcgcgccggactcagctgagcggcagaacctgccagttaaccctcctagcagcttagaaattgcccaggcaatggatacaaaaatgaaaaaggaggaagtgcaggaagagaagcgacatccaaaggggaaggctgacgattgccgccgctcaggatttcccagcgagttccctggtgcacttcacgcagccccttcaaggcaggacatgggtccttag

SEQ ID NO: 137436 - DNA, 1326 bp, Artificial Sequence
  Description of Artificial Sequence: Synthetic coding sequence
atggccccaaagggtattctgggtagctttccaacagctatgaatctttcactagagggcaaagtaaaggaaacggttcataacgccttttgggatcacctaaaggagcagctgagcgccacaccacctgatttttcttgcgcactagaacttcttaaagaaatcaaagaaatcctgctgagcctgcttctgccacggcagaaccgactgcgcatagaaatcgaggaggcactcgatatggacctgctgaaacaggaggccgagcacggcgctctgaaggttctgtacctgagcaaatacgtgctgaacatgatggccctgctgtgcgcccctgtgcgggatgaggccgtgcagaaactggaaaatatcaccgaccccgtgtggctgctgcgcgggatatttcaggtgctggggaggatgaagatggacatggtcaactatactattcagtcactacagccacatctgcaggagcactcaatacagtatgagagagcaaaatttcaagaactcctcaacaaacagcctagcctcctgaaccacactactaagtggctgacccaggctgccggcgatctgacaatgtccccccccacgtgccccgatacgtctgactcatccagcgtggctggtccatctcctaatgaggcagcaaataaccctgagcccctcagccctacaatggttctgtgccagggattcctcaatctgctcctttgggatctcgaaaacgaagagttccccgagaccttgctgatggataggaccaggctccaggaattgaaatctcagctgcatcaacttaccgtgatggcctctgtgctgctggtggcttctagctttagcggcagtgtattgtttggtagcccacagttcgtcgacaagctgaagaggatcaccaagtctctcctggaggactttcacagccgcccagaggaggcaattctgacggtctccgaacaggtttcccaggagattcatcagtcactgaaaaacatgggactcgtcgctcttagctctgacaataccgcctccctaatgggccaactccagaatatcgcaaaaaaagagaattgcgtatgttcagttatcgaccagcgcattcatctgtttttaaaatgttgccttgtcttgggcgtgcagcggtccttgctcgacttacccggcggcttaaccctgattgaggcggaactggccgagctcgggcagaagttcgttaacctaacccaccataaccaacaggtcttcggcccatactatacagagattctcaaaaccctcatttctccagcccaggcgctggaaactaaggtggagtcggtgtag

SEQ ID NO: 137437 - DNA, 1551 bp, Artificial Sequence
  Description of Artificial Sequence: Synthetic coding sequence
atgacacgggggggcgggggaggtgatacgatctccaagatgcctgatgtgaaagaatcagtcccgccaaaataccctggcgactccgagggcagatcttgcaagccagagacatctggaccaccccaagaggataagtccggctctgaagatccacctccattcctcagtgtgaccggtctgaccgaaacagtcaacgaggtgagcaagctgagcaataagattggtatgaattgtgattactatatggaggagaaggtgctcccccccagtagtttggaaggcaaagtgaaagaaaccgtccataatgctttctgggaccacctgaaagaacaattatcagcaactcccccagacttttcctgcgccttggagctgcttaaggaaatcaaggagattctgctgtctcttctgcttccaagacaaaatcggctgcgaatcgaaatcgaggaggcgctcgacatggatctcctcaagcaggaagctgagcatggagccctgaaagttctgtatctgagcaagtacgttctaaatatgatggccctcctctgcgcccccgttcgggatgaggctgtgcagaagctggagaatataaccgatccggtctggctcctacgcggaatcttccaggtgttaggccgcatgaaaatggatatggtgaattatacaattcaatcactgcagccacatctgcaggagcacagtatccagtacgaacgcgcaaaatttcaggagctgttgaacaaacagcctagtcttctgaatcacacaaccaagtggctcacccaggccgctggagatctcaccatgtcccctccgacatgccccgacacttccgatagcagctcagtggccggcccttcccccaacgaagcagctaataatccagagcccctctccccaactatggttctctgccaaggttttctcaatctcctgctgtgggacctggagaacgaagagttccctgagacccttctgatggaccggactcggctgcaggagctaaaatcacagctgcatcaattaacagtgatggcctcagtattgctcgtggccagtagtttctctggcagtgttctattcggcagtccccagttcgtcgataagttgaaaaggatcacaaaatcgcttctggaggactttcatagccggcccgaagaggcaatcctgacagtgagcgaacaagtcagccaggagatccatcagtcattgaagaacatgggtttagtggccctgagttccgataacaccgcttctctgatggggcagcttcagaatatcgctaaaaaagagaactgcgtttgttccgttatcgaccaaagaattcatctctttctcaagtgttgtctggtactgggggttcagcgtagcctgctggacctgcccggaggtctaaccctcattgaggcagaactggccgaattgggacagaaattcgtcaacctgacccaccacaaccagcaggtttttggaccctattacacggaaattctgaaaacattaatttcacccgcgcaggccctagagaccaaggtggagagtgtctag

SEQ ID NO: 137438 - DNA, 822 bp, Artificial Sequence
  Description of Artificial Sequence: Synthetic coding sequence
gggttaagtcatagggccactcctcagccagccgctccccctagatggtatgcgccgggccgccaagctgcacgtcccacggaacgcacacctgtcgatgaccctcgacgagggagacgctctctggagggaaaagttaaggagaccgttcataacgccttctgggaccacctgaaagagcagttgtcagcaacaccccctgacttttcgtgcgcactcgagttgctgaaagagatcaaggaaattctactgtccctgcttttgccccggcaaaaccggttgcgcatagagattgaagaagccttggacatggatctgctgaaacaggaggcggaacacggggccctgaaggtactctatttgtcaaaatatgttctgaacatgatggccctcctatgcgcaccagtgcgtgatgaagctgtgcaaaagttggagaatatcacggacccagtatggctcctgagagggatctttcaggtgttgggacgcatgaagatggacatggtgaactacactatccaatctctgcagcctcacttgcaggaacacagcatccagtacgagagggcaaaattccaagagcttctgaataagcagccttctctgctgaatcacacaactaagtggctgacccaggccgcaggggacctaaccatgagccccccgacatgcccagacacatccgattcttcgtccgtggccggtcccagtcccaacgaggccgcaaataatccagagcccctgtcccccacaatggttctctgccaggggtttttaaacctcttgttgtgggacctcgaaaacgaggaatttcctgaatag

SEQ ID NO: 137439 - DNA, 1326 bp, Artificial Sequence
  Description of Artificial Sequence: Synthetic coding sequence
atggctcccaaggggatcctcggctcgtttcccacagctatgaacctctcattagagggtaaagttaaggaaacagtgcacaacgcgttctgggatcacctcaaggaacaattgagtgcaactccacccgatttcagttgtgccttagaactgctgaaggagattaaggagatcctgctctcactcctgctaccacggcagaaccgccttagaattgagatagaagaggccctggatatggatctgctcaaacaagaggctgaacacggggcactgaaagtcctgtacctcagcaagtacgtgctcaacatgatggctctactttgtgctccagtgcgcgatgaagccgttcagaaattggagaatattacagaccctgtttggcttctgcgtggcatttttcaggttctcggaaggatgaagatggacatggtaaactatacaatccaatccttacagccacatttacaggagcacagtatacagtacgagagggccaagttccaggagcttctcaacaagcagccttccctcctcaaccacacgacaaaatggctgactcaggcggccggggatctgactatgtctcccccaacatgcccggacacttcggacagttcaagcgtggcagggccttctcccaatgaagccgccaataacccggagcccctgtcacccaccatggtcctatgccaggggttcttgaacctgctgctctgggatcttgaaaacgaagaatttccagagaccctattgatggatagaacgagattacaggagctgaagtcccagctccaccagctgaccgttatggcaagcgtactcctcgtggcctcctccttctccggatctgtgttgttcggcagccctcagttcgtggacaagttaaagaggatcacaaaatccctgctggaagacttccattcgaggcccgaggaggcaatccttaccgttagcgagcaggtgagccaagagattcaccagtctctgaaaaacatggggctggtcgccctttcatcggacaacaccgcaagtctgatggggcagctgcagaatattgccaagaaggaaaactgcgtgtgctcagtgatcgatcaacgcattcaccttttcttaaagtgctgtcttgtcttaggcgtgcagcgttctttacttgatctacccggtggattaacccttatcgaggccgaactagctgagcttggccagaagtttgtgaatctgacgcaccataaccagcaggttttcggcccttattacacagagatcctcaagacgctaatttctccagctcaggctctggagaccaaggttgagtctgtgtag

SEQ ID NO: 137440 - DNA, 312 bp, Artificial Sequence
  Description of Artificial Sequence: Synthetic coding sequence
atggcgcctaagggtatcctcgggagcttccccacggccatgaacctgtcactcgaggggaaggttaaggaaaccgtccacaacgcgttttgggaccacctcaaagagcagctgtcggccactcctccggacttttcctgcgccttagaactattgaaggagatcaaagagattctgctgagcctgctgctgcccagacagaatcgcctcagaatcgaaattgaagaggctctggatatggaccttctgaaacaggaagccgaacatggcgctctcaaagtgctgtatctgtccaagtacgttctcaattag

SEQ ID NO: 137441 - DNA, 1512 bp, Artificial Sequence
  Description of Artificial Sequence: Synthetic coding sequence
atgccagatgtaaaggagtccgtgccgcccaaataccctggggactcggagggaagatcttgcaagcctgagacttcgggccctccacaggaagacaagtctggatctgaagaccccccaccttttctttcagtgacagggctcactgagacggtgaatgaggtaagtaagctgtccaataaaattggaatgaattgtgactactacatggaggagaaagtactgcccccttcttccctagaaggcaaggtcaaagaaaccgtgcataatgcattttgggatcatctgaaggaacagctgagcgcaacccccccagacttttcctgcgcactggaactattgaaagaaatcaaggagatccttctgagcctgctactgcctcgccaaaaccgattgagaatcgagatagaggaagctctggacatggacctgctgaaacaagaggccgagcacggcgctcttaaggtactctatttgtctaagtacgtgctcaatatgatggcactgctgtgtgccccggtacgcgatgaagccgtacaaaagctagagaatattacagatccagtctggctcctgcggggcatattccaggtgctggggcggatgaagatggatatggtgaattacaccatccaaagtctacagccccatttacaggagcacagcatacagtacgaacgggctaagttccaggagctgctgaataagcagccatctttgcttaatcacactacaaaatggttaactcaggccgctggagatctcacgatgtccccccctacctgccctgacacctctgactccagcagtgtcgctggtcccagccccaatgaggctgcaaataatcctgagccgctctcccccactatggtcttgtgccagggcttcctcaacctgttgctctgggatctcgaaaacgaggagttcccagaaacattgctcatggaccgaacccgtctgcaggagctgaagagccagctgcaccagctgactgtgatggcaagtgtcctgctggtcgcttccagcttcagtgggtcggtactgttcggttccccgcagtttgtcgataagctcaagcgaatcaccaagagcctcctcgaggacttccactctcgcccagaagaagccattctgactgtgagcgagcaggtaagccaggagatccatcagagtctcaaaaacatgggattggttgccttatcttctgataacacagcctctctgatgggccagttgcagaatatcgccaaaaaagaaaattgtgtctgttccgtgatcgatcagagaattcatctctttctgaaatgttgtctcgtactgggggtgcagcgctccctgctggatctccctggtggcttaaccctaatagaagccgagctggccgagctggggcagaagttcgtgaatcttacccatcacaaccagcaggtatttggaccttattacaccgaaatactgaaaacactcatctcaccggcgcaagcccttgaaaccaaggtcgagtctgtgtag

SEQ ID NO: 137442 - DNA, 1413 bp, Artificial Sequence
  Description of Artificial Sequence: Synthetic coding sequence
atgacacgcgggggcggcggtggagttctgtctgttaccggactcacggagaccgtgaacgaggtgtctaaattgagcaataagattggaatgaattgtgattactacatggaggaaaaggtgctgccaccctcatctttggaaggcaaggtgaaagaaaccgtacataatgccttctgggatcatttaaaggagcagctgtctgccacaccccccgattttagctgcgccctggaactcctgaaggaaattaaggaaatactgctgagcctccttctccctcggcagaatcgcctgaggatagagattgaagaggctttggacatggatttattaaagcaggaggctgaacatggagctctaaaggtactgtacttgagcaaatatgtgctcaacatgatggccctcctgtgcgcacctgtgagggatgaagctgtgcaaaaactggaaaacatcactgatcccgtgtggctcttaagaggtatcttccaggtactcggtcgtatgaagatggacatggtgaactatactattcagtcactgcagccacacctgcaagagcatagtatccagtatgaaagggcaaaatttcaggagctcctgaataaacagccttccctcttgaatcacaccacgaagtggctgacacaggccgccggcgatcttacaatgtccccacccacatgcccagatacctcagatagtagctccgtggctggcccctcgccaaacgaggcggctaataacccggaacctctgagcccaacaatggtgctctgccagggattcctcaatttgctgctctgggaccttgagaacgaagagttcccggaaacactcctcatggaccggaccagattgcaggaactgaagagccaacttcaccagttaaccgtcatggcttccgtgctgctagtcgcctctagtttttcaggatcagtgctgttcggctcaccccagtttgtggacaagttgaaacgtatcactaaatctctgttggaagacttccattcgcggccagaggaggcgatcttgaccgtgagcgagcaagtctcccaagaaatccatcaatcattgaagaatatgggcctcgtggctctcagttccgataacacagcgagcttgatgggccagttgcaaaacatcgctaagaaggaaaactgcgtgtgtagcgtcatcgaccaacggattcacttattcctaaaatgttgccttgttctaggtgtgcaaagatcactgctggacctccccggcggtctcacactgattgaggctgaacttgcggagctggggcagaaatttgtgaatctcactcatcacaatcaacaggtgttcggaccgtactacactgagatcctgaagaccttgatctcgcctgcacaggctctggagacaaaggtggagtctgtctag

SEQ ID NO: 137443 - DNA, 1398 bp, Artificial Sequence
  Description of Artificial Sequence: Synthetic coding sequence
atgactcgcggaggaggaggaggcggactaaccgagaccgtgaacgaagtgtccaagttgagtaataagattgggatgaattgtgattattacatggaggaaaaggtcctgcctccttccagcttggagggcaaagtcaaggaaaccgtccacaatgccttttgggatcatctaaaggaacagcttagcgcgacacctcccgacttctcatgcgcgcttgaactactgaaggagattaaagagattctgttgtcacttctcctccctaggcagaatagactccggattgagatcgaagaggccctggacatggatttgctcaagcaggaagccgaacacggagcacttaaggtgctttatctcagcaagtacgtgctgaatatgatggctctgctttgtgcgcctgtacgcgacgaggctgtccagaagttggagaatatcaccgaccctgtatggctcctccgaggtattttccaggtactaggacgaatgaaaatggatatggtgaactacacaatccagtcactgcagccccaccttcaagaacattcaattcagtacgagagagcaaaattccaagagctccttaataagcagccgtcgctcctgaatcacactaccaaatggttgacccaggcagcaggcgatctgactatgtcccctcccacctgtcccgatacttccgattcttcctctgtggccggtccctctccgaatgaggccgccaataatccggagcctctatcacccacaatggtcctatgccaggggtttctgaacctgttactgtgggatttagagaacgaggagttcccggagactctgctgatggacaggactcggctgcaggaactcaagtctcaactgcaccagttgaccgtgatggcttcggtacttttggtcgccagctcattttcggggtctgtcctgtttggttctcctcaattcgtcgacaagctgaagcgcatcacaaagtccctcctggaggacttccacagcagacccgaggaagccattttgaccgtgtctgaacaagtaagtcaggagattcatcagtccctaaaaaatatgggccttgtggcactaagttctgataacaccgcgtccctcatgggccaactgcaaaacatagcgaagaaagagaactgcgtctgctccgtgatcgatcaacgcatccatctcttcctcaagtgctgtctggtcctgggggtgcagaggtccttgctagacctccctggcggcctcactctgatcgaagcggagttggcagaactaggacagaaattcgtcaacctgacccaccacaatcagcaggtgttcggcccgtactatacggaaattctcaaaacactgattagtcccgctcaggcattagaaacaaaagttgaatccgtttag

SEQ ID NO: 137444 - DNA, 165 bp, Artificial Sequence
  Description of Artificial Sequence: Synthetic coding sequence
atgacgaggggcgggggcggaggggacaccatttcaaaaatgcccgatgtcaaagaaagcgtccctcctaagtatccaggggattccgaagggcgatcttgcaagccggagacgtccggaccacctcaagaggacaagtcaggctccgaggatcctcccccctag

SEQ ID NO: 137445 - DNA, 165 bp, Artificial Sequence
  Description of Artificial Sequence: Synthetic coding sequence
atgaccagaggaggcggcggtggcgatactatatccaaaatgcccgatgtcaaggaatccgtacctcctaaataccctggtgactcagaaggcagatcttgcaagcccgagactagcggaccgccccaagaggataagagcggatcagaagaccctccaccctag

SEQ ID NO: 137446 - DNA, 597 bp, Artificial Sequence
  Description of Artificial Sequence: Synthetic coding sequence
atgttttttgaacgccatctcgagaatctgctcaaacatttcatccctggaaccacagaccccgccgtcattctggatttgctgcctctgtgccggaactacgtgcggagagtgcatgttgaccagttcctaccccccgtccagctgccggctcaattacggcctggagaccagtcagacagtggcagcgagggggagatggaggagccaactgtggatcactaccaactcggcgacctggtggctgggcttagtcacttagaggagttagatttggtttatgacgtgaaggattgcggaatgaacttcgagtggaatttgttcctcttcacgtaccgggattgtctcagtcttgccgccgctatcaaagcgtgtcatacgctgaaagacggagggaaacagctgctcgagggcatgtcagataataagaccctgcttgagtttgatctgagactcagtgatgtggctcaggagtcagaatacttgatcgggcaggctctgtacgcaaatcgtgaggccgctcggcagcgcgccctgaacccctctcacttcatgtccaccatcactgctaatggcccggaaaactcagtcgggtag

SEQ ID NO: 137447 - DNA, 597 bp, Artificial Sequence
  Description of Artificial Sequence: Synthetic coding sequence
atgttcttcgagcggcatcttgaaaacttgctgaagcacttcatccctggaaccactgaccctgccgttatcttggacttattacccctgtgccgcaattacgtcaggcgcgttcacgtcgatcaattcctcccgccagtccagctccccgcgcagctgagaccgggcgatcagtcagacagcggttcagagggcgagatggaggaaccaaccgtggaccactatcagttaggcgacctggtggcaggcctatctcatttagaagaacttgacctcgtttatgatgtgaaagactgcggcatgaattttgaatggaacctattcctgtttacttatcgagattgcctgtcactggctgccgcaataaaggcttgccatactctgaaagatggaggcaaacagttgctcgaaggaatgagtgataacaaaacacttcttgaattcgatctcaggctgtcggatgtagctcaggaatctgagtacttgatcggccaagctctctatgccaatagggaagctgctcgccagagggctcttaaccccagtcacttcatgtcaaccatcactgcaaacggccctgaaaatagcgtgggctag

SEQ ID NO: 137448 - DNA, 1506 bp, Artificial Sequence
  Description of Artificial Sequence: Synthetic coding sequence
atgcaggacaccgttactacctctgcgctgctggatcccagccatagcagtgtgtctacacaggataattcctctacaggcggccacacttcgagtactagcccacagctctccaagcctagcattacacctgtgcctgccaaatctagaaatcctcaccctagggctaacatccgacgaatgcgtcgcatcatagccgaggatcctgaatggtctcttgcgattgttccgctgttgaccgagctttgcattcaacatattattcggaactttcagaagaacccgatcctgaaacagatgctgcccgaacaccagcagaaagtgctcaaccacctgagcccagatttgcctcttgctgttaccgccaacctaattgacagcgagaactattggctgcgctgctgcatgcacagatggcctgtgtgtcacgtggcacaccacgggggttcgtggaagagaatgttctttgaaagacacctggagaaccttctgaagcactttatccctgggacaacagaccctgctgtaattttggatctactccccctgtgtcggaattacgtgcgacgcgtacatgtagaccaatttttgccgcctgtgcaattaccagcccagctgcgccccggtgaccagtccgattcaggatccgagggcgagatggaggaacccactgtggaccactaccagctgggtgatcttgtagcaggcttgtcgcacctggaagagcttgacctggtgtatgatgtcaaggattgtggtatgaactttgagtggaacctgtttctgttcacctacagagattgcctctcgctcgcagccgcaatcaaagcatgccacacgctcaagatattcaagttgactagatccaaggtcgacgatgacaaggccaggatcattatcaggagcttactggaccacccggtgcttgaggagctcgatttgtcccaaaatcttattggggatcgaggcgccagaggggctgccaagctcctatcacatagtcgtctccgcgtactgaacttagcaaacaaccaagtgagagccccgggggctcaatctcttgcacacgctctcgcccacaatactaaccttattagcttgaacttgcgactaaattgtatcgaagatgagggaggacaggcactggcacatgccctgcagacaaataagtgcctgacaacgctgcatctgggggggaatgagctctctgagccaacagccaccttactctcacaggtcctggctattaacacaacactcactagcatcaacttgagttgcaaccacatcggcctggatggcggcaaacagctcctggaaggaatgtctgataataagaccttgctggaattcgatcttcgactctcagatgttgctcaggagagtgaatacctgattgggcaggccctctatgccaaccgggaggccgcccgccagcgggctctgaacccttcacactttatgtccacaattacggctaatggaccagagaattcagtcgggtag

SEQ ID NO: 137449 - DNA, 597 bp, Artificial Sequence
  Description of Artificial Sequence: Synthetic coding sequence
atggagaaaagggggcgaggcgtgaaaagctcaccgatccaaactccgaaccagacacctcaacaggcacctgtgactccaaggaaagagcgccgcccttccatgttcgagaaggaggcatacactcaaatcctccgagagcgcctaagagagtccatacacaacgtgcaatatgtcgaacctcctttcgacgacagcattgctgatatcggaaaggagtggaagagtgcactggctaagttgaagttcgccaactcctaccgaatggaaccactgaaaaaattccaggctcattcagtggaaaccaaggtgcagcagatactaacagagtctctcaaagacgtaaagtacgatgataaggtcttttcacacttgtccctggaactggcggataggatcctcctggccgttaaagaattcggatatcacaggtataagtttatcataaaagtgctgtttatccaaaaaaccggccaggctatcaacatcgcatccagatggatatgggatatagcctgggacagttgggtcgccgcaaagcacgaggcagagagttacgttgccctcgtgttggtgtttgctctgtattacgaatag

SEQ ID NO: 137450 - DNA, 666 bp, Artificial Sequence
  Description of Artificial Sequence: Synthetic coding sequence
atggcctctcggccactgcctcccggcagacaggaggaggagaatgcgaaggactccgggcgtaagccatctcccgtcagaccacggggctgcttgccctccatcgacgaggcccgccctgccggacccggtcctgcgcccgccagtagaaggggcagcatgctgggactggccgcctcattcagcaggcgtaactctctcgttggccctggcgccggcccaggaggtcaacgcccaagtctggggccagtgcccccactcggctctagggttagcttctccgggttgccattggctcccgcgcgttgggtagccccctcttatcggaccgagccagtacctggcgagcgttgggaggccgccagagcccagcgcgccttggaggctgccttggctgcgggattgcacgatgcctgctacagctccgatgaggccgcacgtctggtgagggagctctgcgaacaagtgcacgtacgactcagagaactatcccctcccaggtacaagcttgtctgttcagtggttctggggccgagggcaggacaaggcgttcacgtggtgtcccgggcgctgtgggacgttgcccgcgatggactcgcctctgtttcttacaccaatacttccctcttcgccgttgctacagtgcatggcctctattgcgagtag

SEQ ID NO: 137451 - DNA, 666 bp, Artificial Sequence
  Description of Artificial Sequence: Synthetic coding sequence
atggcttctcgaccactccctccaggacgccaggaggaagagaatgccaaggactctggacggaagccaagtccagttagaccaagaggctgtctcccatccatcgatgaggcacgcccggccggacccgggcccgctccggccagccgccgcggatctatgctggggcttgccgcctcctttagcaggcggaatagcttggtggggcctggagctgggccaggaggtcagcgccccagtctgggacccgttcctcctctcgggagccgagtttcctttagtggcctcccactggccccagctcgttgggtcgcaccaagttataggaccgagcctgtccccggcgagaggtgggaagccgcacgcgcgcagcgcgccctggaggctgctttagccgccgggttgcatgacgcatgctacagtagcgacgaagccgcccgcctcgtacgggaactgtgtgagcaggtgcacgtcagactccgggaactcagtccaccgcgctataagctcgtgtgtagtgtggttctgggccctcgcgccggtcaaggggtgcatgtggtctctagagctctttgggatgtagcacgtgatggactcgcctcagtaagttatacaaacacttcattatttgccgtggctacagtgcacggcctttattgcgaatag

SEQ ID NO: 137452 - DNA, 1074 bp, Artificial Sequence
  Description of Artificial Sequence: Synthetic coding sequence
atggagaggatgtccgactccgccgacaaacccattgacaacgacgccgagggtgtgtggtcaccagatatcgaacagagtttccaggaggccttagccatttatcctccttgtggaagacgcaaaattatcctgtctgatgagggtaaaatgtacggaagaaatgaattaattgcccggtacatcaagctgcggaccgggaaaactcgtacgaggaagcaggtcagcagccatatccaggtccttgcccggcggaaaagcagagattttcacagcaagctgaaagttacatccatggatcagactgcgaaggacaaggcactgcagcacatggcggccatgtcaagtgcacaaatagtcagtgccacagccatccataataagctgggcctacccgggatacccagacccaccttccccggagcgccagggttctggcccggaatgatacagaccggccagccaggatcatctcaggacgttaagccattcgtccagcaagcctaccctatccaacccgctgtgactgcaccaatcccaggatttgagccagcctctgcacctgcccccagcgtacccgcctggcaggggaggagcatcggcacaacaaagctgcggttagtggagtttagcgcatttttggagcagcagagagaccccgatagcgctgacctgaattgcaacatccaggatgatgctggcgcattctatggcgttaccagccaatacgaatccagtgagaacatgacagtcacttgcagtaccaaggtgtgttcgttcggcaaacaggttgtcgaaaaagtggagactgagtacgcgcggttcgaaaatggtagatttgtgtaccgcatcaatagaagcccaatgtgcgagtacatgattaatttcatccacaagctgaaacatctccctgagaagtacatgatgaactctgtgcttgagaactttacaatattgctcgtggttaccaatagagatacccaggaaacactgctctgcatggcttgcgtcttcgaggtcagtaattccgagcatggtgcccagcatcacatttaccgcttggttaaggactag

SEQ ID NO: 137453 - DNA, 1236 bp, Artificial Sequence
  Description of Artificial Sequence: Synthetic coding sequence
atggagaggatgtctgacagcgcggacaagccaatcgacaatgatgccgaaggcgtgtggtccccggatatcgaacaatccttccaggaggctctggccatctaccccccctgtggccgacggaagattattctctctgatgagggcaagatgtacgggcggaacgagctcatagcccgatacatcaagctccgtacaggcaagactaggaccaggaagcaggtgtctagccatatccaggtgttagccaggaggaagtcacgtgatttccacagtaaactgaaggatcagaccgctaaggataaagccctgcagcatatggctgcaatgtctagcgctcaaatcgtatctgctacagcaatacacaataagcttggcctccctggtattccacgaccaacctttccaggcgcccctggtttctggcccggaatgatccaaacagggcagcccggttccagccaggacgttaaacctttcgtgcagcaagcctatccgatccagccagcagtgaccgcaccaattcctgggttcgagcctgcttccgctcccgcgccatccgtgccagcttggcaaggaaggagcattgggaccactaaattgaggctcgtggagtttagtgcctttttagagcagcagcgggacccggatagctacaataagcacctgttcgtccacattggccacgcgaatcattcttactccgatcctcttctcgaaagcgtcgacattcgacaaatttacgacaagttcccggaaaagaagggagggttgaaggagctttttggcaaggggcctcaaaacgcgtttttcctagttaagttttgggcagatctcaactgcaacattcaagatgatgcaggagcattctatggggttacatcacagtatgaatcttctgagaacatgaccgtcacatgtagcaccaaagtgtgttcctttggaaagcaggtcgtggaaaaggtggaaaccgagtatgctagattcgagaacggcaggttcgtatatcggattaatcgcagtcccatgtgtgaatacatgatcaactttatacataaactgaagcatttacccgaaaaatacatgatgaattcagtactggagaatttcaccattctactggtcgtaaccaacagagacacgcaggagactctgctgtgcatggcatgtgtgttcgaggtttcaaacagcgaacatggagcgcaacaccacatttatcggctggtgaaagactag

SEQ ID NO: 137454 - DNA, 1281 bp, Artificial Sequence
  Description of Artificial Sequence: Synthetic coding sequence
atcgaacctagctcctggtccggctctgagagtcctgctgagaacatggagcgtatgagcgattcggctgacaagccgattgacaatgatgcagaaggtgtctggtcccctgacatagaacagagttttcaggaagcgctagctatctatccaccctgtggccgtcggaagatcattctgtctgatgagggcaagatgtacggacgtaacgagttaattgctcgttacattaagctgagaacgggaaagactcggaccaggaaacaggtatcatctcacattcaggtgctggcacgaagaaagtcccgagacttccattccaaacttaaggaccagaccgctaaggacaaggccctccagcatatggctgcgatgtcctccgcccagatagtctctgccactgcaatccacaacaaattaggactgccagggatccctaggcctactttccccggggcccccggcttctggcccgggatgatacaaaccggccagcccggatcctctcaggatgtaaagccatttgtgcagcaggcatatcctattcaaccagccgtgacggcgcctatccccggattcgagcccgccagtgcaccagcgccatccgtgccggcctggcaaggaagatccatcggcaccacaaagttgcgtttagtcgaattcagtgcgttcctggaacaacagcgagatccagactcttacaataaacatttgttcgtccacattggacacgccaatcacagctactcagatccccttctggagagcgttgacatcaggcagatctacgacaagttcccagagaagaagggtgggctaaaggaactgtttggcaaaggcccacaaaatgccttctttttggtgaagttttgggctgacttaaactgtaatatacaggatgacgctggggccttctacggggtaactagccagtatgaatcctccgaaaacatgaccgttacctgttcgaccaaggtctgcagcttcggtaagcaggttgtcgaaaaggtggaaaccgaatatgcgagatttgagaacggaagattcgtgtacagaatcaacagatctccgatgtgcgagtacatgattaattttatacataaactcaaacacctgcctgagaagtatatgatgaatagcgtgctggaaaattttacgatcctgctggttgtgaccaaccgggacacgcaggaaaccttgctgtgtatggcatgcgtcttcgaggtgtccaactcagaacacggagcccagcatcatatctatcggttggtcaaagactag

SEQ ID NO: 137455 - DNA, 993 bp, Artificial Sequence
  Description of Artificial Sequence: Synthetic coding sequence
atgcgctatgtgctgtcctggtgcgtgacagtaacttttaaggatcagactgcgaaggacaaagccttacagcacatggctgcaatgtcgtctgcccagatcgtttcagcaactgccatccacaataagctgggcttgcccggcatccctaggcccacttttccgggcgcaccaggcttttggccagggatgattcagactggacagccaggttctagccaggacgtcaagcccttcgtccagcaggcctatcccattcagccagccgtgacggcccccattcccgggtttgagcccgcctccgcccccgccccctctgtcccggcgtggcagggtcggtccatcggaacgaccaagctcaggctggtcgagttcagtgcgttcttagaacaacaacgagatcctgactcctacaacaagcaccttttcgtgcatattggacacgcaaatcattcttactccgacccactcctcgaaagtgtcgatattcggcagatttatgataagttccctgagaagaagggaggcctgaaggagctgttcgggaaaggccctcaaaacgcttttttcctcgtgaagttttgggcagatctgaattgtaatatccaggatgacgccggcgcattttacggagtgacatcacagtacgagtcttctgagaacatgaccgtaacctgctcgactaaggtgtgttcctttggcaaacaagttgttgagaaggtcgaaacagaatatgctaggttcgagaacgggcgcttcgtttacagaatcaatcgctctcccatgtgtgaatacatgatcaattttattcacaagttgaagcaccttccagagaagtacatgatgaactcagtactggagaattttaccatcttgctcgtggtcaccaatagggatacccaggaaacactactttgtatggcctgcgttttcgaagtcagtaacagcgagcacggtgcccagcatcatatctaccgcctggttaaggactag

SEQ ID NO: 137456 - DNA, 207 bp, Artificial Sequence
  Description of Artificial Sequence: Synthetic coding sequence
attgagcccagtagctggtctggttccgaatcaccagccgaaaacatggaacgcatgtccgattctgctgataagcccattgataatgatgcggaaggagtatggtctcctgatattgaacagagtttccaagaggccctcgctatatatcccccttgtggacggcgaaaaatcatccttagcgacgaaggcaagatgtacgggtag

SEQ ID NO: 137457 - DNA, 1281 bp, Artificial Sequence
  Description of Artificial Sequence: Synthetic coding sequence
attgaaccgagttcatggagtgggtctgagtcacctgccgagaatatggagagaatgtcagacagcgccgataaaccaatcgacaatgatgccgaaggcgtatggtctccggatattgagcaatcatttcaagaggcccttgccatatatccaccctgcggccgcaggaaaatcattctctccgacgaaggcaaaatgtatggccgcaatgaacttatagcccggtacataaaactacggaccggcaagacacgcacccgaaagcaggtgtcttcacacatccaggttctcgcacgcaggaaaagcagggactttcattctaagttgaaggatcagaccgcgaaggataaggccctgcagcatatggccgcgatgtcttccgcccagattgtcagtgcgaccgccatccacaataaactcgggctcccagggatacctaggccaacttttccaggcgctcccgggttttggcccgggatgatccagacaggacagcccggcagctcccaggacgtaaaaccttttgtgcaacaggcttaccctatccagccagcagtaaccgctcctattcctggtttcgaacccgcttccgctcccgctccttctgtgcccgcatggcaggggcgctccatcggtaccacaaagttaaggctggttgagttttcggcttttctggagcagcagagggaccctgatagctacaataaacacttgttcgtgcatatcggtcacgcaaaccattcatacagtgacccgcttctggagagtgtggatattaggcaaatctatgacaaattcccagagaagaaggggggtttaaaggagctattcgggaagggaccccaaaatgccttcttccttgtcaagttctgggccgatctgaattgcaacattcaagatgacgcaggagccttctacggagtcacatcgcaatacgagagctccgaaaatatgaccgtcacctgtagcactaaagtctgctcctttggcaaacaggttgtggaaaaggtggagactgagtatgctcgcttcgaaaatgggaggtttgtgtaccgcattaacaggtctcctatgtgtgagtatatgatcaacttcatccataaactgaagcacttacccgagaagtatatgatgaactctgtgttagagaactttaccattttactcgtagtgacaaatcgagatactcaggaaactctcctctgtatggcatgtgtattcgaagtctccaatagtgagcatggtgcccagcaccacatctaccggcttgttaaggactag

SEQ ID NO: 137458 - DNA, 1344 bp, Artificial Sequence
  Description of Artificial Sequence: Synthetic coding sequence
atgggtgagcccagagccggagcagctctggacgacggaagtggttggaccggtagtgaggaagggtcagaagaaggaacagggggatccgaaggggcaggtggcgatggcgggcccgatgctgaaggggtgtggtcccccgacatcgagcagagctttcaagaggctctagcgatatacccaccatgtggccgaaggaaaatcatcctaagcgacgaggggaagatgtacggaagaaatgagctgatagccagatacataaaacttaggaccggaaagacaaggacccggaaacaggtctcatcccatatacaggtgctggcacgccgaaaatctagggagatccagtctaagttgaaagatcaagtctctaaagataaagcctttcaaacgatggccaccatgtcctcagctcagctcatcagtgccccatcattgcaggccaaactggggcccaccggcccccaagcttccgaactattccagttttggagtggcggatccgggccaccttggaacgtacctgatgtcaaaccgttttcccaaaccccttttacattgtctctgacacctccttccactgatcttcccgggtacgagcctccgcaagccctctcacctttacctccgcccactccaagtcctcctgcttggcaggcccgaggcctagggaccgcaaggttacaacttgttgagttttccgcattcgttgaacctcctgatgctgtcgactcgtaccagaggcatctgtttgttcatatatcccagcattgtcctagtccaggtgccccgccattagagtcagttgacgttcggcaaatctatgataagtttcccgagaagaagggaggccttcgggagctatatgaccgcgggcccccccacgcttttttcctcgtgaagttttgggccgatttaaattggggaccctccggtgaggaggccggagctggggggagtatctcatctggaggcttctacggggtctccagtcagtatgagtcacttgagcacatgactctcacctgcagcagcaaggtgtgcagctttggaaagcaggttgtggaaaaagtagagacggaaagggctcaattagaggacggtaggttcgtctatagactcctacgctcccctatgtgcgaatacctcgttaacttcctgcacaaactgcgccagctgcctgagcggtatatgatgaactctgtactggagaactttaccatcttacaggtggttacgaaccgcgacacacaagagcttcttttgtgcactgcttacgtgtttgaggtgtcaacctcagaacggggcgcccagcaccacatctacagactggtgcgcgactag

SEQ ID NO: 137459 - DNA, 1353 bp, Artificial Sequence
  Description of Artificial Sequence: Synthetic coding sequence
atgggagagccaagagcgggcgcagctctggatgacgggtccgggtggacgggctccgaggaaggtagtgaggagggtaccggcggatcagaaggtgctgggggggacggcggcccggatgcagagggggtttggagtccagacatcgagcagtctttccaggaagctttggctatctacccaccctgtggccgaagaaaaataatcttgagcgacgagggcaaaatgtacgggaggaatgagttaatcgcgcggtatatcaagttgcggacaggcaaaacccggacccgtaaacaggtctcgtcacacatccaagtgctagctcggcggaaaagcagagagatccagagtaaactgaaagatcaggtttcaaaggataaggctttccagactatggctaccatgtccagcgcccagctaattagcgccccctctctccaggcaaaactcggcccaacgggaccccaagtggtgcaggccagtgagctcttccagttctggagtggcggctcgggccccccttggaatgtaccagacgtgaagccgttctcgcagactccctttaccctgtctttgacccccccctccacagacttgccagggtatgagcccccccaagctctctccccccttccacctccaaccccctctccaccggcgtggcaggcacggggcctagggaccgcccgattgcagctggttgagttttccgctttcgtggaaccgcccgacgccgtggatagctaccagcggcacctcttcgtccacatttcacagcattgccccagccccggagcaccccccctggagagcgtggacgtccgtcagatttacgataagttccctgagaagaaaggcgggctccgcgaactgtatgatagaggacctcctcatgctttcttcctggttaaattctgggcagatttgaattggggcccgtccggggaagaagctggcgccggaggttctatctcttccggtgggttctacggtgttagctctcagtatgagtcactggaacacatgaccctgacctgcagcagcaaggtatgtagcttcgggaagcaagtggtggaaaaagtcgagacggagagggcccagttggaggacgggaggttcgtctaccgtttgttgcggtccccgatgtgtgaatacctcgtcaactttttgcataaactgaggcagctccccgaaagatacatgatgaatagcgtactcgaaaactttactatcctgcaagtggtgacaaatcgggacacgcaggagctgctcctttgcactgcttacgtctttgaagtgagcactagcgaaaggggcgcacagcatcacatttatcgcctggtgagggattag

SEQ ID NO: 137460 - DNA, 960 bp, Artificial Sequence
  Description of Artificial Sequence: Synthetic coding sequence
atggctacaatgtccagtgcccagcttatctctgcaccatctctgcaggctaagctggggcccactgggccccaagtggtgcaggcaagtgaactgtttcagttttggagcggggggtccggccctccctggaatgttcctgatgtgaaaccgttcagtcagaccccctttactttgtctctgacgccaccctctactgacctgccgggatatgaacccccacaggcgctgtctccactgccacctcctacaccatccccccctgcatggcaagccaggggtctcggcaccgccaggctgcagcttgtagaatttagtgctttcgtggagccccccgatgctgtggatagctaccaacggcatctgtttgtacacatctcccagcattgcccaagccctggggcgccccctctggagagcgtagatgtgaggcaaatctatgataaattccctgagaaaaaaggcggattgagggaattatacgataggggaccacctcacgctttttttctggtcaagttttgggccgacttgaactggggaccgtcaggggaagaggcaggagctggcggctcgataagtagcggaggcttttacggcgtgagctcacagtatgaatcactggagcatatgacacttacatgctcttcaaaggtctgctcattcgggaagcaggtggtggaaaaggttgaaacagagagagctcagctagaggacggacggttcgtgtataggctgctcaggtcacccatgtgtgagtacctggtaaacttcctgcacaagctgcggcaactacccgagcgatacatgatgaatagtgtcctggaaaacttcaccattctccaggtggttaccaaccgcgatactcaggagctgctcctctgcaccgcttatgtgtttgaggtgagcaccagcgaacgtggagcacagcatcatatctacaggctggtccgggattag

SEQ ID NO: 137461 - DNA, 1356 bp, Artificial Sequence
  Description of Artificial Sequence: Synthetic coding sequence
atgggcgagccacgggcgggagccgccctggatgatgggtctgggtggaccggtagcgaagaggggtcggaggaaggaacgggcggatctgaaggcgctggcggagatggaggcccggatgcagagggtgtgtggtctcccgatattgagcagtcctttcaagaggcactagccatttaccccccatgtggtcgccgtaaaattattttgagcgacgaggggaagatgtatgggcggaacgaactgattgctcgttacattaagctgaggacgggcaaaacaaggacaagaaagcaggtaagtagtcacatccaggttcttgcgcgccgcaagtctcgggagattcagtcgaagctgaaggccctcaatgtggaccaagtcagcaaagacaaggcctttcagaccatggcaactatgtcatcagcccagctgatttccgcaccttctctccaggccaaactcggcccgactggacctcaggcttccgaactgttccagttttggtctggaggctcgggcccaccttggaacgtcccagatgttaaacccttctcccagacccctttcaccctctctcttacaccaccctcaacggatttaccaggttacgagccaccccaggccctctccccattgccacccccaaccccaagtccccctgcttggcaggctcgggggctaggaacagctcgcctccagctggtcgaattctccgcctttgttgagcctccagacgcagtcgactcataccaacgccacctgttcgttcatatcagccagcactgcccatcccctggagctcctccactggagtccgttgacgttcgacagatctacgacaagttcccagaaaaaaaaggagggctccgggagctgtacgatagaggacctccccacgctttcttcctggtaaagttttgggccgacctgaattggggccccagcggggaggaagctggtgctggaggctccatttcgtccggcggcttttacggagtgagcagtcaatatgagtctcttgaacacatgacactcacctgctcaagtaaggtgtgcagcttcggcaaacaggtggtcgagaaggtggaaactgaaagggcccagctagaggatgggagatttgtgtacagactactgcgcagcccaatgtgtgagtaccttgtgaatttcctgcacaaactgcggcagctccccgagcggtatatgatgaacagtgtcctggaaaattttacgatcctgcaggtggtgactaaccgtgacactcaggaattgctgctctgtacggcttacgtgttcgaagtgtctacttcagaaagaggggcgcagcaccacatctaccgtctggtaagagactag

SEQ ID NO: 137462 - DNA, 1356 bp, Artificial Sequence
  Description of Artificial Sequence: Synthetic coding sequence
atgggagagccccgagctggagccgctctggatgacggctcgggctggaccggaagcgaagaggggagtgaagaagggaccggagggtccgagggggccggcggagacggcggtccagacgcagaaggcgtgtggtcacccgatatcgaacagagctttcaggaagccctggcaatttatcctccatgtggtagacgtaagattatactttctgatgagggaaaaatgtacggcaggaacgagctgatcgcacgttatattaaactgcggactgggaagacgaggacgaggaaacaggtgtcctcccacatccaggtgttggctcgtagaaaaagccgggaaattcaaagtaagctgaaggctctgaatgtagaccaggtgagtaaggacaaagccttccaaaccatggccacaatgagctccgcacagttaatttccgcccccagccttcaagctaagctcggtcctacagggccccaagcgtctgagcttttccagttctggagcggaggctcgggccctccatggaacgtccctgacgttaagccgttttcccagacccccttcacgcttagcctgactccaccttctaccgacttgccaggttatgaacctccacaagccctcagccctttaccccctccgacgcccagtccgcctgcctggcaggcccgtggactcggtaccgcacgattacagcttgttgaattctccgcttttgtagaacctcccgacgccgtggactcttatcaacgccatctgttcgttcatatctcccagcattgtcctagccccggcgcacccccactagaatctgtcgacgtccgtcagatctacgataagtttcccgagaagaagggcggactgagggagttgtacgacagaggtcccccacacgcattttttctagtgaagttttgggctgatctgaattgggggcccagcggcgaagaggcaggggcgggaggatccatcagcagtggcgggttctatggcgtctcttcccaatacgagtcactcgaacatatgactttaacctgttcatccaaggtttgctcattcggcaagcaagtggtggaaaaggtggagacagagcgcgcacagctggaggacggaaggtttgtctatagactgctgcggtcgcctatgtgtgagtacctggtgaactttctacacaaactcaggcagctccccgaaagatatatgatgaacagtgtgcttgaaaacttcactatccttcaggtggtgacaaaccgggacacccaggagcttttactttgcacagcttatgtgttcgaagtgagcacctccgagaggggagcccagcatcatatttatagacttgttcgagactag

SEQ ID NO: 137463 - DNA, 1353 bp, Artificial Sequence
  Description of Artificial Sequence: Synthetic coding sequence
atgggggagcctcgagcaggcgctgccttggatgacggttcaggatggacgggaagtgaagaaggatctgaggagggaacaggaggatcagagggggctgggggggacggaggacccgacgccgagggtgtgtggtcccccgacatcgaacagagcttccaagaggctttagctatttaccccccctgcggccgcagaaaaatcattttgtccgacgaaggtaaaatgtacggacgcaacgagctgattgcccggtatataaaattgcggactggtaaaacacgtacaagaaagcaggtgtcttctcacatacaggtgttggccagacgaaagtctcgggagatacagagcaaacttaaggatcaagtgagcaaagacaaggccttccagaccatggccaccatgtcttcagcacagctgatcagcgccccttctctccaggcgaagctggggcctaccggaccccaagttgtccaagcgtccgagctcttccagttctggtccggaggctctgggcccccgtggaatgtacccgacgtgaagcccttcagtcaaactccctttaccctttcactcactcccccaagcaccgacctacctggctatgagccccctcaggccctatcacctctcccaccacccaccccaagtcctcccgcttggcaggcccggggattaggcaccgcgcgactgcaactcgtcgaattttctgcgtttgtggagcccccagatgctgtcgactcctaccagcggcacctcttcgtccacatttctcagcactgtcccagcccaggcgcccccccactcgagtcagtcgatgtcagacaaatatatgacaaatttcccgaaaaaaagggcgggctaagggaactctatgatcgagggccgccccacgcattcttcctcgttaaattttgggccgacctcaattggggtccctccggcgaagaagccggggccggtggatctatttcctcgggcggcttttatggagttagctcacagtacgagtctttggaacacatgaccctgacttgtagctccaaggtctgctcctttgggaaacaagtagtggagaaggtcgaaaccgagcgggctcaactcgaagacggccgatttgtctatcgcctgctgaggtctcccatgtgcgagtatctggtaaacttcctccataaacttcgtcagttgcccgaacgttatatgatgaactctgtcctggaaaactttactatcctgcaggtggtcacgaatagggacacacaggaactccttttgtgcacagcttatgtgttcgaagtcagcacctcagagcggggcgctcaacaccatatctacagacttgtccgggattag

SEQ ID NO: 137464 - DNA, 1308 bp, Artificial Sequence
  Description of Artificial Sequence: Synthetic coding sequence
atagcgagcaactcttggaacgcatcctcatcgccaggtgaagctagggaggatgggcccgaagggctggacaaaggactagataacgatgcagagggcgtctggagtcctgacattgagcagagctttcaagaggctctggccatttaccccccctgtggacgcagaaaaatcatactttccgacgaggggaagatgtatggcaggaacgagttaatcgctcggtacattaaactgaggacggggaaaacccgtacgcggaagcaggtgagctctcacatccaagtgttggctcgaaaaaaggtgcgcgagtatcaggtcggcattaaagccatgaacctggatcaagtaagtaaggataaggccctgcaatcgatggcctctatgagctcagcacagatcgtgtcagcatcagtactccagaacaagttctctcccccctcgccccttccacaggccgtgttttctacctccagccgcttctggagcagccccccactcctgggccagcagcctggcccctcgcaggatattaagccatttgctcagccggcctatccgattcagcctcccctgcctcctacactttcatcctatgaaccccttgccccactgccctccgccgcagcttcagtccctgtatggcaggacaggaccatcgcctcctcccggctgcggttgcttgagtacagtgcttttatggaagtccagagagatcccgatacgtattctaagcatctgtttgttcacatcggtcaaacgaaccccgccttctccgaccccccactggaagccgtggacgttcgacagatctatgacaagttcccagagaaaaaggggggcctaaaagagttgtacgaaaaggggccccccaacgcgttctttttggtgaagttctgggccgacttgaatagtactatccaagaaggtcccggcgccttctatggcgtgtcctctcagtattcctcagctgacagtatgacaataagcgtgagcacgaaggtttgctcctttggaaagcaggttgtcgagaaggttgaaaccgagtacgcgaggttagaaaatgggagattcgtataccggattcataggagcccgatgtgtgaatatatgatcaacttcattcacaaactgaagcatctgcccgagaaatacatgatgaactccgtcttggaaaacttcactatcttgcaggttgtgacgagccgagactcacaggaaacactgctcgtaattgccttcgtgttcgaagtgtcaacgagcgagcacggggcacagcaccatgtctacaaactggttaaagactag

SEQ ID NO: 137465 - DNA, 1356 bp, Artificial Sequence
  Description of Artificial Sequence: Synthetic coding sequence
ttatctaggcccgtcggctctggtcccgagcccagagccaccagtaccatcgcgagtaatagttggaatgcatccagcagccctggcgaggccagggaggatggacctgaaggcttggataaggggctagacaacgacgcggagggcgtgtggtcccctgatatagagcagtcattccaggaggctctggctatttaccctccctgcggtaggagaaaaataattctctccgatgagggtaagatgtatggacgcaatgagctcatcgcaagatacatcaaactgagaaccgggaagacacgaactcggaagcaggtgagcagtcacctgcaggtgctggcaagaaggaagagccgagaaattcagagtaagctgaaatccagtccccaggaccaggtatccaaagacaaggccttgcagtcgatggccagtatgtcaagcgctcagatcgtgagtgcgtccgtgctccagaataaatttagcccccccagtccactcccacaagccgtgttctcaacctcttctcgcttttggtccagccccccactattaggacagcagccagggccttctcaggacattaagccctttgcacagcccgcttaccctattcagccccccctgcctcctactctcagtagttacgaacctcttgctccactgcccagcgccgcagcatctgtgcccgtgtggcaagacaggactatcgcctcctctcgactgcgcctgctggagtatagtgctttcatggaagtccagagagacccagatacttactccaagcatctcttcgttcacattggccagaccaacccagctttttcagatccgccattagaagccgtcgatgtgcgacagatatacgataagttccccgagaagaagggtggcctgaaagagctgtacgaaaaagggccaccaaacgcattttttttagtcaagttttgggcggatcttaattctactatccaggaaggtcctggggccttctatggcgtatctagccagtactcctctgctgattctatgactatatcagtgagcacgaaagtatgcagcttcggcaagcaggtggtcgaaaaggtagaaaccgaatatgctagattagagaacggtcgattcgtctaccgaattcacaggagcccaatgtgtgaatacatgatcaattttatccataagctcaagcacctccctgaaaagtatatgatgaatagtgttctagagaacttcactattctgcaggtcgtgacatcgcgcgacagtcaggagaccctcctggttatcgcctttgtctttgaggtgagtacgtccgagcacggcgcccaacatcacgtgtataagcttgtgaaggattag

SEQ ID NO: 137466 - DNA, 1176 bp, Artificial Sequence
  Description of Artificial Sequence: Synthetic coding sequence
cttgagggcaccgcagggacaatcacatctaatgaatggtcatccccaacaagtcccgaaggctccaccgccagcgggggcagtcaggcattagacaaacccatcgataacgacgcggaaggtgtgtggtcccccgacatcgaacagagctttcaagaagcattggccatctaccccccgtgtggccggagaaagatcattctatccgatgaggggaagatgtatggcagaaatgaactgattgcccggtacatcaagctgcggaccgggaagacaagaacgaggaaacaggttagttctcacattcaagtgctggcccggagaaaggctcgtgaaatccaggctaaacttaagttctggcagggcgccctgcccgggcaagccgggacttctcacgacgttaagccattttcccaacagacctacgcggtacaacccccactacctcttcccggattcgaaagtcctgctgggcccgcgccttcacctagtgctcccccggcccctccgtggcaaggcagaagcgttgcatcgagcaagctgtggatgctggagttctcggccttcctcgaacagcaacaggatcccgacacttataataagcatctctttgttcatatcgggcagagcagtccctcctacagcgatccatatttggaggcggttgacattcggcagatttatgataagtttcctgagaaaaagggtggcttaaaggacctctttgagagagggccaagcaatgccttctttctagtgaaattttgggctgacctcaatacaaatattgaggacgagggctcttcattctatggggtaagctctcaatatgaaagtccagagaatatgataatcacctgttccaccaaagtttgttcttttgggaagcaagtcgtggagaaggtggagactgaatacgctcgttatgagaatggtcattattcttatcggattcatcgttctcctctctgcgagtacatgataaactttatacataaactgaaacacctccctgagaaatacatgatgaattcggtgctggagaactttactatactgcaggtggtgaccaatcgcgatactcaggagaccctgctttgtattgcatacgtgttcgaggtgtctgcgtctgagcatggggcacagcaccatatttatcgtctggtcaaggagtag

SEQ ID NO: 137467 - DNA, 1305 bp, Artificial Sequence
  Description of Artificial Sequence: Synthetic coding sequence
ctagagggcaccgctggaactatcacatcaaacgaatggtcctcacccacctcccccgaggggtccacggctagcggtggtagccaggctctcgataagcccatcgataatgacgcggaaggggtatggtcccctgatatcgaacaatcattccaggaggctctggcgatttaccccccctgcggtcggcgtaaaattattctaagtgacgaagggaagatgtacggcaggaatgagctgatagcgcgatacattaaactgcgcactggcaaaacccgaactaggaaacaggtatctagtcacattcaagtacttgctcgacgcaaagccagggagattcaggctaagctgaaagaccaagccgccaaggataaagcccttcaatcaatggcggctatgagttctgcccagatcatctctgcgaccgcttttcatagttccatggcccttgcacggggtcctggacgtcctgctgtgagcggtttttggcagggcgcattgcccggccaggctgggactagccatgacgtcaaacccttttcccagcagacttacgctgtccagccccccctgccactcccaggcttcgagagcccagcaggccctgctcctagcccatctgcgccgcctgctcccccttggcaaggccgtagtgttgcttccagtaaactgtggatgttggagtttagcgcctttcttgaacagcagcaagatccggatacttacaataaacacttgtttgtgcacatcggtcagtcaagcccatcctactccgacccttacctcgaggccgtggacattagacagatttatgataagtttcccgaaaagaagggcggactgaaagacctttttgagcggggccccagtaacgctttctttttggtgaaattttgggcagacctcaacaccaatatcgaagatgaggggagtagtttttatggcgtttcatcccagtatgagtcacctgagaacatgattattacctgttcaaccaaagtctgctcattcggaaagcaggtggtggaaaaggtagagactgagtatgcgcgttacgagaacggccactactcctatcggatccacagaagtccactttgcgaatacatgatcaacttcatacacaagttgaaacatctgcctgagaaatacatgatgaatagcgtgctggagaatttcacaatactccaagtggtgactaatcgggatacacaagaaacccttctgtgcattgcgtacgtgtttgaggtttccgcatcggagcacggagcacagcatcacatttataggctggtcaaagagtag

SEQ ID NO: 137468 - DNA, 918 bp, Artificial Sequence
  Description of Artificial Sequence: Synthetic coding sequence
atggcagctatgagctcggcgcagataatcagcgcgacagccttccatagctcaatggccctggcacgggggcctgggaggcctgctgtgtccggcttttggcagggcgccctccctggccaagctggtaccagccatgacgtgaagccattcagccagcagacctacgcagttcaacccccgcttccactacctgggttcgagtcacccgctgggccagcaccatccccaagcgcccccccagcccccccctggcagggccgatccgtggcttctagcaaactctggatgcttgagttttccgctttcttggagcagcaacaggatcctgacacttataacaagcacctcttcgttcacattggtcagtcaagtccctcatacagcgatccctacctggaagcagtcgatatccggcagatatatgataaattccccgagaagaagggtggcctgaaggacttatttgagcgcgggccctcaaatgcattctttctcgtgaaattctgggcggatctcaatactaacattgaagatgagggcagtagcttttatggggtgagcagccagtatgagtctcctgaaaatatgatcattacctgctcaaccaaggtttgctcttttggtaagcaggtggtggaaaaagtcgaaactgaatacgctcgatatgaaaatggtcactatagctatcgcattcatagatcaccgctgtgcgagtacatgattaactttattcacaagctgaaacatctgcccgaaaaatacatgatgaatagcgtgctagaaaatttcactatcctgcaggtggtgaccaacagagatacacaggagaccctcctgtgcatcgcatacgtgttcgaggtaagcgcctccgagcatggcgcccaacatcatatctaccggctcgtcaaagaatag

SEQ ID NO: 137469 - DNA, 219 bp, Artificial Sequence
  Description of Artificial Sequence: Synthetic coding sequence
cttgagggaactgcaggcaccattaccagcaacgagtggagcagcccaactagtccagaaggatctacagcttccggcggcagtcaggcactggacaagcctatcgataacgatgcggagggagtatggagcccggacatagagcagtcttttcaggaagccctcgctatctacccaccttgtggtagacgaaagattatcttgtctgacgaagggtag

SEQ ID NO: 137470 - DNA, 69 bp, Artificial Sequence
  Description of Artificial Sequence: Synthetic coding sequence
ctggagggaaccgccggcacaataacatcgaacgaatggtcatccccaacctctcccgagggttcttag

SEQ ID NO: 137471 - DNA, 528 bp, Artificial Sequence
  Description of Artificial Sequence: Synthetic coding sequence
ctggagggtactgccgggactattacctcaaacgaatggagttctccaacctcaccagaggggagtacagctagtgggggctctcaggctttggacaaaccaatagataacgatgcagaaggagtttggagcccggacatcgagcagagttttcaggaagctctggccatctaccccccgtgcggcagacggaagatcatcctcagcgacgagggcaagatgtatgggcgcaatgagctgatagctcgctatatcaagttacggacaggcaagactcggactagaaagcaagtttcctctcatatacaggtgctcgccaggcgtaaggcccgcgagatccaggccaagctgaaggaccaggccgcaaaggacaaggctctgcagtcaatggcggccatgagcagcgcccagataatcagtgcaactgctttccattcgagtatggccttggcccgcgggcccggaagaccagccgtctctggcttctggcagggggctctccccggccaggccggcacatcccattag

SEQ ID NO: 137472 - DNA, 3099 bp, Artificial Sequence
  Description of Artificial Sequence: Synthetic coding sequence
atgtgtaacgaggagaccgagatcaaagaagctcagtcttaccaaaacagtccagtgtcctctgctacgaaccaggacgccggatacgggtccccgttttccgagtcctctgatcagctggcgcatttcaagggctcctcaagtcgggaagagaaggaagatcctcagtgtccagactcagtgagctacccgcaagactccctagctcagattaaggccgtgtatgccaacctcttctccgagagttgctggtccagccttgcattagatctgaagaagtctggctccacaacgagcacaaacgatgcaagtcagaaggagagctctgccccaacacccaccccccccacctgccctgtgagcacaaccggacctaccacctccacccccagtacttcatgctctagcagcacttcccactcatccaccacttctactagttcttcatccgggtacgattggcaccaggcagctctcgcaaaaacactgcagcagactagtagttacgggttactgcccgagccttcactcttttccactgtccaactttaccgccagaacaataagctgtatggaagtgtcttcactggtgctagtaaattcaggtgcaaggactgttctgcagcatacgacacgctagtcgagctgacagttcacatgaacgaaacaggccattaccgggatgacaatcgcgataaggactcagaaaagaccaagcgatggtcaaaaccgcgtaaaagatctctgatggaaatggagggaaaggaggatgcccagaaagtactgaagtgcatgtactgtggtcattccttcgagtccctgcaggacctctcggtgcacatgatcaagaccaagcactatcagaaagtgcccctgaaggaaccggttccagcgattactaaacttgtcccatccaccaaaaaacgcgccctccaagacctagcgcccccgtgtagcccagagcccgccggcatggcagctgaagtagccctgtccgaatcagctaaggatcagaaggccgccaacccctacgtcactcctaataatcgctatgggtaccagaacggagcttcatatacatggcagttcgaggcccgcaaggctcaaattctcaagtgcatggagtgtgggagtagccacgatacactgcagcagttgaccgcccacatgatggtgacaggccattttttgaaggtaaccacttccgcatctaaaaagggcaagcaattggtcctcgatcccgtggtcgaggagaagatacagagcattccacttccccctaccacacacaccaggctgcccgccagcagcataaagaagcaaccagatagccccgccggctctacaacgagtgaggagaaaaaggagcctgaaaaggagaagccccctgtcgcaggggacgcggaaaaaattaaggaggagagcgaagatagcctcgagaaatttgaaccatcaactctttatccatatctgcgcgaagaggacctggatgacagccccaaaggcggtctggatatcctgaagtccctggaaaataccgttagtaccgccatctccaaagcacaaaatggagccccctcatgggggggctacccgagcatacacgcggcttaccagctgcctggaacggtgaaacctttgcccgcagctgttcagtcagtgcaggtgcagccgagctacgccgggggcgtgaaatccctctcttccgcagagcataatgcacttctgcactcccctgggtcactcactccacctccacataaatcgaacgtgtccgcaatggaggaattagtggagaaggtgacagggaaagtgaacatcaaaaaagaggagagacctccggaaaaggagaagagtagtctggccaaagccgcatcgcctattgctaaagaaaacaaagacttcccaaagaccgaagaggtttcagggaagccgcaaaaaaaaggcccagaagccgaaacggggaaagccaagaaggaagggccgctcgacgtccataccccaaacggcaccgagcccttaaaagccaaagttacaaacggatgtaataatctgggaataattatggatcacagcccagagccctcctttattaaccccctcagcgcactacagagtatcatgaatactcatcttggaaaagtaagcaaacccgtaagtccgtctctggatcccctcgccatgctttacaaaatctccaactcgatgctagacaagcccgtctatcctgctacacctgtgaagcaggcagacgctattgacaggtattactatgaaaactcagaccagccaatcgatctgaccaagtccaagaataaacctctcgtgtccagcgtggcagattcagtcgcctcgccattgagggaatccgccctcatggacatcagcgacatggtaaagaacctgaccggacgcctgaccccgaaaagcagcaccccctctacggtttcggaaaagtcagacgccgatggatctagcttcgaggaagctctggacgaactgtctccagtgcacaaacgtaaagggcggcaaagcaactggaaccctcagcaccttctcattctgcaggctcagttcgcatccagccttagggagaccacagagggcaagtatattatgagcgacttaggaccacaagagcgggtccacatttcaaagttcaccggactgtctatgacaactatctctcattggcttgctaacgtgaagtatcagttacgtagaaccggcggaaccaagtttctgaagaatttggacactggccacccagtcttcttctgtaacgactgtgcgtcccagttccgtaccgcgagcacatacatcagccaccttgaaacacatctcggcttctcgttaaaggatctgagtaagcttcccctgaaccaaatccaggagcagcagaacgtctccaaggtgctgacaaacaaaactctcggccccctgggggccacagaggaagaccttggatcaacctttcaatgtaagctgtgtaaccggactttcgcatccaaacatgctgtgaaactgcacctgtccaaaactcacggaaaaagcccggaggatcacttaatttatgtaactgagctggaaaagcagtag

SEQ ID NO: 137473 - DNA, 237 bp, Artificial Sequence
  Description of Artificial Sequence: Synthetic coding sequence
atgtgcaacgaagagaccgaaatcaaggaggctcaatcgtaccagaattccccagtttcctctgcaacaaaccaagatgcaggatacggttctccattttcagaaagctctgatcaactagcacactttaagggatcctccagtagggaagaaaaagaagaccctcagtgtcctgactccgtgtcctacccccaagatagtttagcccagataaaagctgtgtatgccaacctgtag

SEQ ID NO: 137474 - DNA, 321 bp, Artificial Sequence
  Description of Artificial Sequence: Synthetic coding sequence
atgtgtaacgaagagaccgagattaaggaggcccagtcttaccagaatagccctgtatcttcagctaccaaccaggatgcaggatatggttctccattctcagagagttctgatcagctggcgcacttcaaagggagcagctcgagggaggaaaaagaggatccacagtgtccagacagtgtatcttacccccaggattctctcgctcagattaaagcagtgtacgcgaatttattctccgagtcatgttggagtagcctggccctggacctgaaaaagtccgggagtacaaccagcaccaatgacgcctcgcagaagtag

SEQ ID NO: 137475 - DNA, 3096 bp, Artificial Sequence
  Description of Artificial Sequence: Synthetic coding sequence
atgatggcggctgccctgctgcactataccggctatgcccaggaggaacagctgaaagaggaagaggagataaaggaggaggaggaagaggaggactcaggaagtgtcgctcaactgcaagggggtaacgacactggaacggacgaggagctggagacaggccccgagcagaaaggatgcttctcttatcaaaattcccctggttcgcacctgagtaaccaagatgctgaaaatgagagcttgttatccgacgcctccgatcaagtgtctgatattaaaagcgtctgtgggcgtgacgccagcgacaaaaaagcacatactcacgtgagactccccaacgaggcacacaattgcatggacaagatgactgccgtctatgcgaacatcctctcggatagctactggtcaggattaggcctgggattcaagctctctaattccgagcgacgtaattgcgacacccggaatggatccaacaagtcagacttcgattggcatcaggatgccctatctaagtctctgcaacagaacctaccttctcggtctgtatccaaaccctctttgttttcatcagtccagttatacaggcagtcaagtaaaatgtgcggcacggtctttactggtgcctctagatttagatgtaggcagtgttcggccgcttacgacacactagtggaattgaccgtccacatgaacgagactgggcactaccaagatgacaataggaaaaaggacaagctgcgccccacctcctactcaaaacccaggaaaagggccttccaggacatggataaagaagatgcccagaaagttctcaagtgtatgttttgtggggattcattcgacagccttcaggacctgagcgtgcacatgatcaagacaaaacattatcaaaaggtcccccttaaggaacccgtgccaactattagttccaaaatggtgacgcctgccaagaagcgcgtcttcgacgtgaatcggccatgctcgcccgactccaccacaggatcatttgctgactcgttctcttcccagaaaaacgccaacctgcagctatcctctaataataggtacggctaccagaacggagcctcatatacgtggcagttcgaagcttgtaaatcacaaatacttaagtgtatggagtgtgggtcttctcacgatacgttgcagcagctgaccacacatatgatggttactggccattttttgaaggtcacgtcctctgcctctaagaaaggtaagcaactggtcctggatcccctggccgtcgagaagatgcaatctctgagtgaagcccccaattccgattctcttgcccccaagccatcctccaacagtgcaagcgattgtactgctagcactacagagcttaagaaggagtccaagaaggaaagacctgaagaaactagcaaggacgaaaaggtggtcaaatccgaggattacgaagatcccctgcagaaaccgctcgatcccactatcaagtaccaatacttaagagaagaggacttggaggatggcagtaagggcggaggggatattctcaaaagtctcgagaacactgtcacaacagctatcaacaaagctcagaacggggctccctcctggtccgcctacccttcaattcacgcagcctaccaactaagcgagggaacaaagccaccactgcctatgggtagtcaggtgcttcagataagaccaaaccttactaataaactgcgcccgatagctcccaaatggaaggtaatgccactagtctcaatgccgacccacctcgctccatacactcaggtgaaaaaggagtccgaagacaaagacgaggcggtgaaagaatgtggtaaagagtcaccccacgaagaagcctcatccttttctcacagcgaaggggactcattcagaaagagtgaaacgccgccggaggcaaaaaagacagagttggggccacttaaggaggaagaaaagctgatgaaggagggctcagagaaagagaagccccagccactggagcccacatccgcgctgagcaatggctgcgctctggccaaccacgccccagctcttccctgcatcaaccctttgtctgcgctgcagagcgtgctgaataaccatttggggaaagcaaccgaaccccttagaagtccgtcctgtagcagtcccagctcatcaacgatctcgatgtttcacaaaagtaacctgaatgtgatggacaaacctgttctaagtccggctagcacaaggtccgcgtccgttagtcggcggtatctgtttgagaactctgatcaacccatcgatctaacgaagagtaagagtaagaaagccgagagtagccaggctcagagttgcatgtctccccctcaaaagcacgccctgagtgacatcgcagacatggttaaggttttacctaaagccactactcctaaacccgccagttcctccagagtgccacctatgaaactggagatggatgtgagacgtttcgaggatgtcagtagcgaggtgtcgacgctccacaaacggaagggacgccaatcgaattggaatcctcagcacctgctcattctccaggcccagtttgcctcctcattgttccagacgtcggaaggcaagtatctgctcagcgatttgggcccccaggagcgaatgcagatcagcaagttcacgggattaagcatgactacaatttcgcactggctggccaatgtgaagtatcaattgcggaaaacagggggaacaaaattcctgaagaacatggataaggggcatccaatcttttattgttccgactgcgcttctcaattcagaacaccttccacttacatctcccacctggaatctcacctggggttccaaatgaaggatatgacccgcctgtcggttgatcagcaaagcaaagtcgaacaagagatctctcgggtgtcatcagctcagaggtcccctgagacaattgctgctgaagaagataccgacagtaaatttaagtgtaagctgtgttgtcggaccttcgtgagtaagcatgcagtcaaactgcatctgtctaagacccattccaaatcccccgaacaccacagccaatttgtcacagacgtggacgaggaatag

SEQ ID NO: 137476 - DNA, 3105 bp, Artificial Sequence
  Description of Artificial Sequence: Synthetic coding sequence
atgccccgaagaaaacagcaagctcccaagagggcagccggttacgctcaggaggagcagctgaaggaggaggaagagatcaaagaggaggaagaggaggaggactccggctccgtggcgcagctgcaagggggaaacgatactggtactgacgaagaactcgagacaggacccgaacagaaaggatgcttttcgtatcaaaattctcccggatctcacctgtccaaccaagacgccgaaaacgagtctctcctcagtgacgccagtgatcaagtatctgatataaagagcgtgtgtggtcgcgacgctagcgataaaaaagctcatacacacgtgagactaccaaacgaggcccacaactgtatggacaagatgaccgctgtttatgctaacattctctctgattcatactggtctggtctgggcttggggtttaagctgtctaactccgaacgcaggaactgtgacacacggaatggcagcaacaaatccgattttgactggcaccaagacgcattatctaaatcacttcagcagaacctgccctcaaggtccgtgagcaaaccgagcttattctcctctgtgcagctgtatcgacagagcagtaaaatgtgtggaaccgtgttcaccggcgcctccaggttcaggtgtagacagtgtagcgctgcctacgacacactggttgaactcacagtgcatatgaacgaaactggtcactatcaggacgacaacaggaagaaggacaagcttaggcctacctcgtactccaagcctcgcaagcgagcctttcaagacatggataaagaagatgcccagaaggtgcttaaatgcatgttttgtggagattcctttgattccctccaagacctctctgtccacatgattaaaacaaagcattatcagaaagtgccgcttaaagaacctgtgcccacaatctctagcaagatggttacgccagccaagaagagggtgtttgatgtgaatcgtccatgctcaccagattcaacaaccgggtctttcgccgattctttttcctctcagaaaaatgccaacctgcagctcagcagtaacaaccgatacgggtatcaaaacggcgcaagctatacatggcagttcgaagcttgtaagtcgcagattttgaagtgtatggagtgcggcagcagtcacgacaccctacagcaactgacaacccatatgatggtgaccgggcatttccttaaggtgacatcttctgcctctaaaaaggggaaacagttggtgcttgacccattagccgtcgagaagatgcagagtctgtcagaagccccaaattctgactccctcgcacctaagccttcctccaactcggcatccgactgtactgcaagcaccacagaacttaagaaggaaagcaaaaaggagcgcccagaagaaacatctaaggacgagaaagtggtgaaaagtgaagattacgaggaccccctgcagaagccactcgatcctaccatcaagtatcaatatctgcgtgaagaagacctcgaggatgggagcaaaggtggtggcgacatcttgaagagtttggagaacaccgttactactgccatcaataaggctcagaacggagccccgagctggtccgcttatccatctattcacgccgcatatcagctgagtgaggggactaagcctcctctgcctatgggcagccaagtattacaaatacggcctaacctcactaataagctgcggcctatcgctccgaagtggaaggtgatgcccctggtgtctatgccaacacacctggccccgtacacccaggttaaaaaggaaagtgaggacaaggatgaagcggtgaaggaatgcggtaaggaaagccctcacgaggaggcttcctcgttctctcacagtgagggcgactcttttcggaagagtgaaaccccacccgaagcgaagaagactgagctcggcccgttgaaggaggaagagaaacttatgaaggaaggttccgagaaggagaagccgcaacccctggaacccacctctgccctgtccaacgggtgcgccctggccaaccatgcgcctgccttgccttgcatcaacccactttcagctttgcagtcagtgcttaataaccacctggggaaggctaccgagccattgcggtcaccgtcatgttcttcaccttcatcctcaactatatccatgtttcacaaatctaacttgaacgtcatggataaacccgtgttgtctcccgcctctacacggagcgcaagcgtctcacgccgctacctgtttgaaaattctgaccaacccatagatctcacaaaatccaaatccaaaaaggcagaaagctcccaggcccagtcttgcatgtcaccccctcagaagcatgctctgtccgatattgctgacatggttaaggttctccccaaggctaccacccccaaaccagcttcttccagtagagtgccacctatgaaactcgagatggatgtgaggagatttgaagacgtcagtagcgaagtgagtactttacacaaacgaaaaggcagacagtctaattggaatccccagcacctcctgatcctccaagcacaatttgcttcctcgttgttccaaacatcagagggtaaatacctgctgagtgatctgggtcctcaggaacggatgcagatcagcaagtttaccggtctgagtatgactacaataagtcactggctcgccaacgtcaagtaccaactcagaaagactggaggcactaagttcctaaagaacatggacaaagggcatccaatattctactgcagtgactgtgcttcgcaatttcgaaccccttccacttatatctctcatctggagtcccacctgggattccaaatgaaggatatgacacggctatctgtggaccagcagagtaaggtagagcaggaaattagcagagtgtcgtcggcccagcggagcccggaaacgatcgctgccgaagaagacacagactctaaatttaagtgtaaactgtgctgccggacatttgtgtcaaaacacgcagtcaaactgcacctgtctaagacacacagcaagagccctgagcatcactctcagttcgtgaccgatgtggatgaggaatag

SEQ ID NO: 137477 - DNA, 3246 bp, Artificial Sequence
  Description of Artificial Sequence: Synthetic coding sequence
atgccccgcagaaaacaacaggcaccacggcgtgcagccgcctacgtcagcgaggagctgaaagccgcggctctggtcgacgagggactggacccagaagaacacaccgcagacggcgagccgtccgcgaagtatatgtgtccagagaaggagctggccagagcatgtccaagttaccagaacagccctgcagcagagtttagctgccatgagatggattccgaaagccacataagcgagacgtcagaccggatggcagacttcgaatcaggatcgattaaaaacgaggaggaaactaaggaggtgactgtccccctggaagataccacagtttccgatagcctcgagcaaatgaaagcagtttacaacaattttctgagtaattcctactggtcgaatttaaatttgaacctgcatcaaccatctagcgaaaaaaataatggcagctccagcagcagctcatcctcatcaagttcctgcggtagcggcagcttcgactggcatcaaagcgccatggctaaaacactgcagcaagtgagccagtcccgaatgctgccagaaccatctctgttctctactgtccagctttacaggcagagttccaaactgtacgggtctattttcacaggtgcaagcaaatttagatgcaaagactgctcagccgcctacgataccctggtggagctgaccgtgcatatgaacgagactggacactacagggacgacaatcatgagaccgataataataatcctaagagatggagcaaacctagaaaaaggagtctgctcgagatggagggcaaggaggatgcacaaaaggtgttaaaatgcatgtactgtggacatagcttcgagagtttacaggatttgtctgttcacatgatcaaaactaagcactatcagaaggtccccctgaaagagcccgttacacccgtggccgccaagattatacctgcaacacgcaaaaaagctagccttgaactggaactgcctagcagccctgactcaaccggagggaccccgaaggcaaccatatctgacactaacgacgccctgcaaaagaattcaaacccctatattacccctaataaccgatacggccatcagaatggggccagttatgcttggcatttcgaagcccgtaagtctcagatccttaaatgcatggaatgcgggtctagccacgacacattgcaagagctaacagcccacatgatggtaacgggccactttatcaaggtcaccaacagcgcaatgaagaagggcaagcccatcgtcgagactcctgtgacacctactatcaccacattgctggatgagaaagtccagtcagttccccttgcagctaccacattcacatccccatcaaacacaccggccagcatttcgcctaagctgaatgttgaggtgaagaaagaggtcgataaggagaaagcagttactgatgaaaaacccaaacaaaaggacaagccgggagaggaagaggagaagtgtgatatttccagtaaatatcactacctgacagaaaatgatttggaagagtctccgaagggcggtctcgatattctgaagtcgctggaaaataccgtcacatccgcaatcaataaggcccaaaacggaacaccttcttggggaggctacccatccatacatgccgcctaccaacttcctaatatgatgaagttgtcccttggtagttccggaaaatccactccactgaagccaatgttcggaaattcagaaatagtgtctccaaccaagaaccagaccctcgtgagtcctccatcctctcagactagtcctatgccaaaaacaaacttccacgcaatggaggagctggtcaaaaaggtgacggagaaggttgcgaaagttgaagagaaaatgaaggaacctgatggaaagttgagcccccccaagcgggccacaccaagtccctgttcttcagaagtgggagaacccatcaagatggaagcctcatctgatgggggatttagaagccaagagaacagcccgtctccacccagagacggctgtaaagatggtagccccctggccgagcccgtggagaacgggaaagaactggtaaaacctctggcgagtagcttgtctgggagcactgccattattacggaccatcccccagaacagccctttgttaatcctctctccgcacttcagtccgttatgaacattcacctgggaaaggccgccaaaccatctctgcccgccttggatcccatgtccatgctgtttaagatgtcgaactcactggccgagaaggccgctgttgccacgccaccaccactgcagtctaaaaaggccgatcatctcgacagatatttttaccacgtcaataatgatcagcctattgatcttaccaagggtaaatctgataagggctgtagcctcggtagcgtgctactttccccaacctctacggcccccgctacttcctcatctaccgttacaactgccaagactagtgccgtcgtgtcatttatgtccaactctcctctcagagagaacgccctttcagacatatctgacatgctgaagaacctgaccgaaagccataccagcaaaagcagcacaccaagtagcatcagtgagaaaagtgacatcgacggcgcaacattagaggaggccgaggagagtactccagcgcagaaaaggaagggcagacagagcaactggaatccgcagcatttgctcatccttcaagcacagtttgctgcctccctccgccagaccagcgaaggcaagtatatcatgtctgacctgagcccacaagaaagaatgcacatcagtaggttcacaggcctgtctatgaccacaatttctcattggctcgcaaatgtgaaataccagctcagaagaactggcggcaccaagtttttgaaaaatcttgatactggacaccccgtgtttttttgtaacgattgcgcttcccaaatccgcacccctagcacatacatttctcacctggaaagccacctgggtttcagattgcgagacctgtcaaaactgagcactgagcagatcaatagccagatcgctcagactaaatcgccaagtgaaaagatggtcacatcctctccagaggaggacctcggtacatcctaccagtgtaagctctgtaacagaaccttcgcttccaagcatgctgtgaagttacacctgtccaagacgcatggtaagagccctgaggaccacctgctgtatgtgtctgaacttgaaaagcagtag

SEQ ID NO: 137478 - DNA, 1896 bp, Artificial Sequence
  Description of Artificial Sequence: Synthetic coding sequence
atgaatttcaacaccattttggaggagatcctgattaagaggagccagcagaagaaaaagacatctcccctgaattataaagaaaggctgttcgtgctgacaaagtctatgttgacctattatgagggacgggcagaaaagaagtaccgcaagggcttcattgatgtgagtaagataaaatgcgtggagatagttaagaacgatgacggcgtgataccatgtcagaacaaatacccctttcaggtggtgcacgatgccaataccctgtacatattcgctccatccccccagagtcgggacctgtgggttaaaaagcttaaggaagagatcaaaaacaataacaacatcatgataaagtatcatcctaagttttggacagacggttcttaccagtgttgccggcagaccgagaaactagcacccgggtgtgaaaagtacaatctgttcgaatcctccatccgcaaagctttgcctccggcccccgaaacaaagaagcggcgcccccctccaccaatcccactggaggaggaggacaatagcgaggaaatcgtagttgcaatgtacgattttcaggctgccgagggacacgatctccggttggaaagaggtcaggaatatctgatactggagaaaaacgacgtgcactggtggagggcgagggacaagtacggcaacgaaggctacatcccttccaactatgtgactgggaagaagagtaataatctggaccagtacgaatggtactgccggaatatgaacagaagcaaagcagaacaattactacgcagtgaggacaaggagggcggcttcatggttagggacagttcgcagcctgggctgtacacggtgagcctatataccaagttcggaggtgaggggtccagtggattccggcactaccacattaaagagaccacaacatctccaaagaagtattacctagctgaaaaacatgcctttggaagcatccccgaaattattgaataccacaaacacaatgccgccggcctggttactaggctgcggtaccccgtttcagtcaagggcaagaacgctcccactaccgctggttttagctatgaaaagtgggaaatcaaccccagcgagctgacattcatgcgagaactgggctccggtctctttggcgtggttcggctgggcaagtggcgcgctcagtacaaagtggccattaaggccatacgggagggagctatgtgtgaggaggactttattgaggaggccaaggtgatgatgaagcttacgcatcccaagctggtgcagctctacggagtctgtacacagcaaaagcccatatatatcgttactgaatttatggagaggggctgccttttaaattttctgcgccagcggcagggccacttctcaagagatgtactgctgtcaatgtgccaggatgtgtgcgagggaatggagtacttggaacgcaactctttcatccaccgtgacttagccgcaaggaactgcctggtgtccgaggctggagtggtgaaggtgtctgatttcggcatggccagatacgtcctcgacgaccagtacacctcaagctcaggggccaaatttcccgtcaaatggtgtccacccgaggttttcaattacagccggttttcgtcaaagtctgatgtctggagctttggtgtcctgatgtgggaggtgtttactgaaggcaggatgccttttgaaaagtacacaaattatgaagtcgtgaccatggtcactagaggacatagactctaccagccgaagctcgcctcaaattacgtttatgaagtgatgttgaggtgctggcaggagaagcccgagggacggccatccttcgaggacctgctgcgaaccatagatgagctggtggagtgtgaggagacattcggccggtag

SEQ ID NO: 137479 - DNA, 2094 bp, Artificial Sequence
  Description of Artificial Sequence: Synthetic coding sequence
atggggtttcagccgccggctgcactgttgttgaggttgttcctgctgcaaggaattctgcgactcctctggggtgacctcgcctttatcccaccatttatccgtatgtcgggacccgcagtgagcgctagtctggtaggtgataccgaaggcgtgactgtctcgcttgccgttctgcaagacgaggccggcattcttcccattcctacttgcggagtcttgaacaatgagactgaggattggagtgtcaccgttatccctggggcgaaagtacttgaggtgacagtccggtggaagcgaggcctcgactggtgttcttcaaacgagaccgacagcttttccgaatcgccctgtattctgcagacactgttggtttccgcgagccataacagcagctgctccgcacaccttctgatccaggtcgagatctacgccaactcatcactcacacataatgccagcgaaaacgttacagtcatccctaatcaagtttaccagccactgggcccctgtccctgtaaccttactgcaggagcatgcgatgtaagatgttgctgtgaccaggagtgttcctccaacctgacaaccctttttcggcgaagctgtttcaccggcgtctttgggggagatgtgaatccacctttcgatcagctgtgctcagcagggactaccaccaggggagtcccagattggtttccgttcctttgcgtgcagagtcctctagcaaacacaccctttctcggatatttctaccatggcgcggtttctcctaagcaggattcctccttcgaagtgtatgtggacacagacgcgaaggacttcgctgacttcgggtacaagcagggggacccgattatgacagttaaaaaggcgtacttcactattccgcaggtgtctctcgcaggacagtgcatgcagaacgctcccgtggcctttttgcacaatttcgatgtcaaatgtgtaactaacctggagctgtaccaggaacgcgatggcatcattaacgcaaagattaagaatgtggcacttggggggattgtgacccccaaagttatttacgaggaggcaaccgacctcgacaagttcattacgaataccgagaccccactgaacaacgggagcacccctcgtatcgtcaacgtcgaggaacactacatcttcaagtggaataacaacacgatctcggaaattaacgtgaaaattttcagagccgagatcaacgctcatcagaaagggatcatgacacagcgatttgtggtgaaattcctgagctacaacagtgggaatgaagaggagttatctggtaaccctgggtatcagcttggcaagcctgtgagggcgttgaatattaacaggatgaataacgtcaccacccttcacttgtggcaatctgcgggacggggcctctgcacatccgccacgtttaagcccatcttatttggggagaacgttctgagtggatgcctcctggaggtgggcatcaacgagaattgtacccagctaagggagaacgccgtggagagattggactcattgatccaagctacacatgttgcgatgcggggaaacagcgactacgccgatctgtctgatggctggttagaaatcattcgggtggacgctcccgaccctggagcggacccactagcctcctcagtgaatggaatgtgtttggacataccggcgcacctgtccatccgtatcttaatatcagatgccggggctgttgaagggatcacccagcaggaaatccttggagtagagacgcgtttttcaagcgtgaattggcagtatcagtgcggccttacttgtgaacacaaggccgaccttcttcccattagcgccagcgtgcagttcatcaaaattcccgcccagctgcctcaccctctcactcgattccagatcaattatacagagtacgactgtaacaggaacgaagtctgttggccacagttattgtacccatggacccagtattaccagggggagttgcactcgcaatgcgtggcaaaagggctgcttctgctgctattcctcactctggctctcttccttagcaacccatggacacgaatatgcaaggcctatagctag

SEQ ID NO: 137480 - DNA, 2091 bp, Artificial Sequence
  Description of Artificial Sequence: Synthetic coding sequence
atgggttttcagcccccagctgccttgctgctaaggctcttccttctgcaaggtatcttgcggttgctctggggagacctcgcatttatccctccttttatacgcatgtccgggccagccgtgtccgcgagcctggttggggacacagaaggagtgaccgtgagtttggcagtactccaagacgaggcgggtattctcccgatccctacctgtggcgtgctgaacaacgagacggaggactggtctgtcactgtgattccgggggctgtcctggaagtgacggtgaggtggaaaagaggcctggattggtgttcttccaacgaaactgactcatttagtgagagcccgtgcatcctacaaactctcctggtgtctgcatctcacaactcatcctgtagcgcacacctcttgattcaggtggagatctatgcgaactcttctctgactcataatgcctccgagaatgtgactgtgatccccaaccaagtgtatcagccattgggcccatgtccgtgcaacctaaccgccggggcatgcgacgtcagatgctgctgtgaccaggaatgttcctctaacctaacaacactgtttagaaggtcatgttttacgggcgtattcggaggcgatgttaatccaccattcgaccagctctgctcggcgggcaccacaacccgtggagtgcctgattggtttccgttcctgtgtgttcagtcgccgctggcgaacaccccttttctgggctacttttatcacggtgccgtgtcccccaagcaggatagctccttcgaagtatatgtagatacagacgcgaaagacttcgctgatttcggatacaaacagggagacccgataatgactgtaaagaaggcgtactttaccattcctcaggtgagcctggcagggcaatgcatgcagaatgcgcccgtagcattcctgcacaatttcgacgtgaagtgtgtgacgaacctggaactctatcaggaaagggacggaattatcaacgccaagatcaaaaacgtcgcacttggtggtatagtaacccctaaggtgatctatgaagaagctaccgacctggacaaatttatcactaataccgagacccctcttaacaatggctcgactccccggatcgtgaacgtagaagagcactacatcttcaaatggaacaacaacacaatctcggagattaatgtcaagatttttagggcggaaattaacgcgcaccaaaaaggtattatgacccaaaggtttgtagtaaagttcctgtcatacaatagcgggaacgaagaagagctgtccggaaacccgggctatcaactgggaaaacccgttagagctctcaatattaatagaatgaataatgttaccactctgcacctgtggcagtcggccggacgcggactgtgtacatccgcgacctttaagccgatactgtttggtgaaaacgtcctgtccggttgtctcctagaggtggggatcaatgagaattgcactcagctcagggaaaacgctgttgagcggttggacagcttgattcaggctacacatgtcgccatgcgaggtaattcagattacgcggatctgtctgatggatggctggagatcatcagggtggacgcacccgatcccggagcggaccccctggcctcatccgttaatggcatgtgcctcgacattccggctcacttgagtatcagaatccttatctctgacgcgggagcagtggagggaatcacacagcaggaaattttgggagttgaaaccaggttctcatccgtaaactggcaataccagtgcggcctgacctgtgagcacaaggccgatttactacctatcagcgcatccgtgcagttcattaagattcccgcacagctgccgcatccactgacgagatttcagatcaattacacagagtatgattgcaaccgaaatgaagtgtgctggcctcaactcctatacccctggacgcaatattatcagggtgagttacattcccagtgtgtagccaagggcttgctgctactgttgttcctcaccctggccctgtttctgagcaatccatggacaaggatttgtaaggcttactcatag

SEQ ID NO: 137481 - DNA, 1824 bp, Artificial Sequence
  Description of Artificial Sequence: Synthetic coding sequence
atgaggacaccgcagctggcgctgctgcaggtcttcttcctggtctttcctgacggagtgcgaccccagccctctagttccccttccggggccgtgccgacatcccttgagttgcagagaggcactgatggtggaacactgcagtctcctagcgaagcaaccgctacccggccagccgtgcccgggctgcctaccgtggtgcccacactcgtgacgcccagcgcaccaggtaatcggactgtggatctattcccagtgctacccatctgcgtttgtgacctgacccctggcgcttgcgatataaactgctgttgcgatcgcgactgttatcttctgcatccaaggaccgttttctctttttgcctgccaggcagcgtgcggtcctcttcttgggtatgtgtggataattctgtcattttccgaagtaattcaccattccctagccgcgttttcatggacagtaatgggatacgtcaattttgtgtacacgtgaacaattcaaatctgaactacttccagaagctgcagaaggtaaatgccacaaacttccaggcactggcagcagaattcggaggcgaatcatttactagtacattccagacccagagcccaccaagcttttaccgtgccggtgatccaatcctcacatactttccaaagtggtccgtgatttcactcctccggcaaccagctggcgtaggagcaggcgggctttgcgctgagtctaaccctgccggcttcttggagtctaagtccacaacctgcactcgctttttcaaaaatttggcgtcaagttgcaccctggacagcgctctgaacgctgcgtcttattacaacttcacagtgctaaaggttccccgttccatgaccgatccacagaatatggaattccaggtgcccgtgattctcactagtcaggcaaatgcccccctcctggctggcaacacgtgccagaacgtcgtctcccaggtaacatacgaaattgaaaccaacggtactttcggaattcagaaggtttcagttagtcttggccagactaatctgaccgtggagccaggggcctccctccagcagcatttcatcttacgctttcgcgcgtttcagcaaagtacggctgcgtccctaacctctccgcgctctggtaaccctggctacatagtgggcaagcccctgctggcgttgaccgacgacatctcttactcaatgacactattgcagtcccaaggcaacggtagctgtagcgtgaaaaggcacgaagtgcagttcggcgtcaacgccattagcggatgcaagcttcggctcaaaaaggccgattgtagccatctccagcaggaaatctaccagacactgcatggacgccccagaccagagtatgtggctatctttggaaacgcggacccagcacagaagggcggatggacgcgcatcctgaaccgacattgctcaatttccgcgattaactgtacctcctgctgcctcatcccggtgagtcttgagatacaagtactctgggcctacgtgggcctcctgtcaaacccgcaggcgcacgtgtcaggcgtcaggtttctgtaccagtgccagtccattcaagactctcaacaggtaactgaggtttcactcacaacattagtgaattttgtggacatcacccagaagcctcagccacctagaggacagcccaagatggactggaaatggcctttcgatttctttccttttaaggtcgccttcagtcgcggcgtgtttagtcagaagtgcagcgtgagtccaattctcatactgtgtcttcttctcctcggcgttctgaatctggaaaccatgtag

SEQ ID NO: 137482 - DNA, 1290 bp, Artificial Sequence
  Description of Artificial Sequence: Synthetic coding sequence
atggattctaacggtattcggcagttttgcgttcacgtgaataactccaacttgaactactttcaaaagctgcagaaggtgaacgcgacaaactttcaggctctcgctgccgaatttgggggtgaatccttcacaagtacgttccagacccagtcacccccttcattctaccgcgccggcgatcccattctaacatacttccccaagtggtcagttataagtctgctgaggcagcctgcgggcgtcggcgcgggaggactgtgcgcagaatccaacccagccggatttctggagtcaaagtctaccacttgcactcgctttttcaagaacttggcgtcctcctgcaccctcgactccgccctcaatgcggccagctactacaattttaccgtgctgaaggtcccaaggagcatgaccgatccccaaaatatggaggtgacctatgaaatcgaaacaaatggcacattcgggatacagaaggttagcgtatcattgggtcaaactaatctaactgtggagccaggggcctcgcttcagcaacacttcatcctgcggttcagggcattccagcagagtacagcagcatctctcacatccccccgtagtggtaaccctgggtatatcgtgggcaaacctcttttagccttaacagatgatatttcatactcgatgacgctgctgcagtctcagggaaacggcagttgctctgtcaaacgccatgaggtgcagtttggagtcaacgccattagtgggtgcaaattaagactcaaaaaagccgattgcagccatcttcagcaggaaatatatcaaacactgcacggcagacctcgccccgagtacgtggccatattcgggaacgccgatcccgcacagaagggaggctggacccggatccttaaccgccactgcagcattagtgctatcaactgtacatcgtgttgcctgatcccagtatctctggagattcaagtgctgtgggcgtatgtgggattactgtcaaacccccaggcccatgtgtctggtgtgagatttctctaccagtgccagtctatccaagacagtcaacaggtcacagaggtgagcctgactactctcgttaattttgtcgatatcacacagaaaccccagccgccacgcggtcagccgaagatggactggaaatggccattcgatttcttcccattcaaggtcgcctttagtcgcggagtcttctcgcaaaagtgttctgtgtctcctatcttaatcttgtgtctcttgctcctgggagtcctcaaccttgagacaatgtag

SEQ ID NO: 137483 - DNA, 1332 bp, Artificial Sequence
  Description of Artificial Sequence: Synthetic coding sequence
atgcgtactcctcaactcgcattgctacaggtcttttttctggtgtttcccgatggggtgcgtccacagcccagctctagtccttccggagctgtgccaacctccttggagctgcagcgagggaccgatggtggcaccctgcagtctccttctgaagctactgctacaaggccagccgtcccaggactccccaccgtggtgccaacgcttgttacgccctccgctcccggcaatagaaccgtggacctttttcctgtactcccgatttgcgtgtgcgaccttacccctggggcgtgtgacatcaattgctgctgcgatcgggactgttatcttctgcatcctcggaccgtattcagcttctgtttaccaggctctgtgaggagcagctcctgggtctgcgtagataattccgttattttccgatccaatagcccatttccctcgcgcgtctttatggacagcaacggcattcgccagttctgcgttcacgtcaacaacagtaatcttaactatttccaaaagctacagaaggtgaatgcaaccaactttcaggccttggccgccgaattcgggggagaaagttttacaagcacattccaaactcagtctcccccctcgttctatcgggccggggaccctatattaacctatttccctaagtggtccgtgattagcctcttaaggcagcctgcaggggtgggcgccggaggactttgtgctgagtccaatcccgcaggatttctggaatcgaagagtaccacctgtactaggttttttaaaaatctcgcgagctcctgtacactagattccgcactgaatgctgcatcgtattacaatttcaccgtactcaaagttccacgatccatgaccgacccccagaacatggagtttcaagtccctgtaatcctgacaagtcaggcaaatgcaccactgctcgcgggcaacacatgccagaatgtagtgtcacaggtgacttatgagattgagacaaatggaacttttggcatacagaaggtgtccgtctcgttaggacagaccaatttgaccgttgagcctggcgcgtccttgcagcagcactttattctgaggttccgcgcattccagcagtccacagctgcctccttaacttcccctcggagcggtaaccctggctacatcgtaggtaagcccctcttagcgctgacagacgacataagttacagcgtcagtttcctggaacttgggggtctgcttcagccaaacgagaaaagctgcaaagggtttcaaacttacgtgaggttagcaaaaggtgaggagtttttcgtccattacaatgaggtgttaatctattag

SEQ ID NO: 137484 - DNA, 1878 bp, Artificial Sequence
  Description of Artificial Sequence: Synthetic coding sequence
atgagactcgagaccgccgaggcctatgtcgggcccggtggtcctgaatgcccgatgagaacaccccagctggctcttctgcaggttttttttctggttttcccagatggcgtacggccgcagcccagtagctcgccctcaggggcggtacctaccagcctggagctccagcgcggcactgatggtggcaccctccagtctccttctgaagcaacagccacacggccagccgtacctggcctacccactgtggtgcccaccctggtgacaccaagcgcaccaggtaaccggaccgtcgacctgttcccggttctccctatctgcgtctgcgacctgacgcccggtgcatgcgatatcaactgctgctgcgacagggattgctatctcctgcaccctcggacggtgttctctttttgcttgcccggctccgttcggagcagctcgtgggtatgcgtcgataactctgtgattttccgcagcaattctccctttccaagccgagtgttcatggactccaatggcatcagacagttctgtgtccacgtcaataacagcaacctgaactattttcagaagctacagaaggtgaacgctacaaatttccaggccctcgctgccgagttcggcggagagtcttttacatcgacattccagacccaatcccccccatccttctatagagcaggcgacccaatcctgacctattttccaaagtggagcgtcatttcgttactgaggcagcccgccggagtgggggcaggaggtttatgtgcagagtccaaccctgcaggcttcctcgagtccaaatcaacaacttgtactcggttcttcaaaaatctggcatcttcctgcactttagactctgccctgaacgctgccagctattacaacttcaccgtgttgaaagttccccgctctatgactgatccacaaaacatggagtttcaagtgcctgtgatcctcacatctcaggccaacgcccctctgctggcaggaaacacgtgtcagaacgtggtgtctcaggttacctacgagattgagaccaacggaacattcggtatacagaaagtatccgtttcgctaggacagacaaacctcacagtcgaaccaggtgccagcctgcagcagcactttatcttgaggttcagagcctttcaacagagtacggctgctagcctaacctcccccagatccggcaatcccgggtacattgtgggcaagcccctacttgccttgacagatgacatctcatatagcatgacattactccaatcccaggggaacgggtcctgctcggtcaaaagacatgaagttcagtttggggtcaatgcaatctcaggatgcaaactgaggctaaagaaggccgactgctctcaccttcagcaggagatttaccaaacgttgcatggccgtccccggcccgaatatgttgcgatctttggtaacgcagaccccgcacagaaagggggatggacgcgcatcctaaaccgccattgttcaatatccgcaatcaattgcacatcttgttgcctcatccctgtgtcactcgaaatccaggtcctgtgggcctatgtcggcttactgtcgaatccacaggcgcacgtctccggtgtgcggttcctataccaatgccagagtattcaggactcccaacaggtcactgaagtaagtctcaccacactggttaactttgtggacatcacccagaagccccagccgcctcggggtcagcccaaaatggactggaagtggccattcgacttttttcctttcaaagtggctttttccagaggcgtattctcacagaaatgcagcgtgtcacctattctcattctctgcctgctcctcctcggagtgctgaatctcgaaactatgtag

SEQ ID NO: 137485 - DNA, 1380 bp, Artificial Sequence
  Description of Artificial Sequence: Synthetic coding sequence
atgagaaccccacagctggccctcttgcaggtattctttctggtgttccccgacggagtgcgcccgcaaccatctagttcaccatccggggccgtcccaactagcctagagttgcagagaggcaccgacggcgggaccttgcagtcacccagcgaggccacagctactcggcccgctgtgcccggcctgcccaccgtggtgccaactctagttacaccatcggctcccggcaatagaacagtagacctcttcccagtcctgcctatctgcgtttgcgatctcactcctggcgcatgcgacataaactgttgttgcgatcgcgactgttatctcctgcacccacgcactgtgttttcattctgcttaccaggctcggttagaagctcatcttgggtttgcgtggacaactcagtcatcttccgatcaaattctcccttcccgtctcgggtgtttatggattcaaacggcattcgccagttctgtgtacacgtgaataactgttttctcgagagtaagtccaccacgtgcactcgattcttcaagaacctggcttcatcttgcacactagattcagccctgaacgccgccagctattacaactttactgtacttaaggtgcctaggagtatgaccgacccccagaatatggaggctttccaacaatccactgcggcatcccttacaagcccaaggagtggaaatcccgggtacattgtaggtaaacccctgctagcactgaccgatgacatcagctacagtatgacccttcttcagagtcagggaaatggaagttgtagcgtcaagcgccacgaggttcagtttggagtgaatgcaattagtggctgtaaacttcggttgaagaaagcagattgtagccatctgcaacaggagatatatcagaccctgcatggccgtcctcggccagaatacgtagccattttcggaaatgccgaccccgctcagaaaggtgggtggacaaggatcctcaatcgccactgctcgatttctgcaattaactgcacgtcttgttgtctaatccctgttagtctggagatacaggtcctgtgggcttatgtgggacttctctccaacccgcaggcacatgtttcaggtgtccggttcttgtatcagtgccagagcatccaggacagtcagcaagtgactgaggtatccctgacaacactagtaaattttgtcgatattacccaaaagcctcagccccctcgagggcaacccaaaatggattggaaatggccttttgacttcttcccattcaaagtagccttctctcggggagttttctcccagaagtgctccgtgtccccaatactgattctgtgtcttctgctgttgggggtgcttaaccttgagactatgtag

SEQ ID NO: 137486 - DNA, 6468 bp, Artificial Sequence
  Description of Artificial Sequence: Synthetic coding sequence
atgaattactctagtttcctccgaatatgggtgtcttttatcttcgcattagtccagcaccaggcccagccacgggagctgatgtatcccttttggcaaaacgacaccaagactcccaaagtggatgatggcagtagcagcgagattaagttagccatccccgtgtttttttttggagtgccatacagaacagtttatgttaacaacaacggggtcgtatccttcaacgttctggtgtcgcagttcacacctgaaagtttcccactcactgatggccgtgctttcgtggctcctttctgggcagacgtgcataacggaatccgaggcgaaatttattacagagagacgatggagccagcgatcctcaagagggcgacgaaggacatacgaaagtattttaaagatatggccacgttctcagccacatgggttttcatcgtaacatgggaggaggtgacgttctacggcggcagctctaccacacctgttaacacctttcaggcggtcctcgttagtgacgggagttacacttttacactgttcaattactatgaaataaactggactaccgggacggccagcggaggagatcccctcacagggctggggggcgtaatggctcaagctggcttcaacggggggaacctgactaacttcttcagtctacccggatccagaacgcctgagattgtgaatatacaggagactactaatgtgaatgtccccggcagatgggcgttcaaagtcgatggcaaagagattgacccagctaacggctgtactagcagaggccagttcctgcgccgcggggaagtcttctgggacgacttaaattgtaccgtcaaatgcagatgtctcgactttaataatgaaatttattgtcaggaggcatcgtgcagcccttacgaggtgtgcgaacctaaaggcaagttcttttactgtagcgctgtagaaactagtacatgtgtggttttcggggaaccccactatcacactttcgatggctttttgttccatttccagggtagttgcgcatatctgctggcaagacagtgcctccagacttcttccttgcctttcttttccgtcgaggcgaaaaacgagcatcgtagaggatcggccgtgtcatgggtgaaggaactatcagttgaggtaaacggctacaagatactgattccaaaaggctcctacggaagggtcaaggtgaatgatctggtgacctccttgccggtgacactcgatctcggcacagtgaaaatttatcagtcaggaatcagtacagctgtggagacagattttggattgctggtgacctttgacggtcagcactacgcctcaataagcgtgcctgggagttacatcaattctacatgcgggctctgcggtaactataataagaatcctctcgatgattttctccgtcccgacggtagaccggccatgagtgtcttggatctcggtgagtcctggcgcgtgtaccacgctgactggaaatgcgattctggctgtgtggataattgcactcagtgcgacgccgctaccgaggccctatatttcggctcggattattgcgggttcctcaataagactgatgggcccctgtgggagtgtggaaccgtggtcgaccctacagcattcgttcacagctgtgtttatgacttgtgttcagtgcgggacaatggcacgctgctctgtcaagccatacaggcctatgctttagtctgtcaggctctggggattccgatcggagattggcggactcaaactggatgtgtgagcaccgtccagtgcccttccttctcccactacagcgtttgcacgtcttcttgtcccgacacctgcagcgatctgacagctagcagaaactgcgcgaccccttgcactgagggatgcgaatgcaaccagggctttgtactctccactagccagtgtgtccccttacacaagtgtggatgcgacttcgatggccattactacactatgggcgagttcttctgggccactgccaactgcacagtgcagtgcctctgtgaggaaggtggtgacgtttactgcttcaacaagacctgcgggtctggggaagtctgcgccgtcgaagatggttaccagggctgcttccctaaacgagagacagtatgcttgctgagtcaaaatcaggtccttcacactttcgacggggcatcgtacgctttcccatcagagtttagttacaccctcctgaagacatgccccgagagaccagaatatctcgagatcgatattaacaaaaaaaagcctgatgctggccctgcctggctcaggggactcagaatacttgtcgcagaccaagaagttaagatcggtggcatcggagctagcgaagtcaaacttaacgggcaagaagtcgagcttccctttttccaccccagcgggaagttggaaatttatcggaataagaattctaccaccgtggaatcaaaaggcgtggttaccgtgcagtacagcgacatcggcctgctctatatccggctgtctaccacgtacttcaattgtaccgggggactctgcggattttataatgcaaatgcaagtgatgagttttgtctgcccaatgggaagtgtacagataacttggctgtctttttagaaagctggacaaccttcgaagagatttgcaatggcgagtgcggagaccttctgaaggcatgtaataacgacagcgaactacttaaattttaccgttccaggtccaggtgtggaatcattaacgacccctccaactcttcattcctggagtgtcacggggtggttaatgtgaccgcttactacaggacttgtctgtttcggctctgtcaaagcggggggaacgagtcagagctgtgtgactcagttgctcgctatgcctccgcttgtaaaaatgccgatgtggaggtcggaccttggaggacttatgatttctgcccccttgaatgccccgagaattcccattttgaggagtgcattacatgcacagaaacttgcgagactttgacactgggcccgatatgcgtcgattcatgctcggaaggctgtcaatgcgacgagggatatgcactgcttggttctcagtgtgttacccggagtgagtgcggctgcaatttcgagggtcaccagctcgcaacgaacgagaccttctgggtagatctggactgccagatattctgctactgctctggtactgataaccgcgtccactgtgaaactattccatgtaaagacgatgaatactgtatggaggagggaggactgtactattgccaggcccgaactgacgcttcatgtatagtgtccggatatggccactacctgacctttgacgggtttccattcgactttcagacctcatgcccactaattctgtgtaccacaggatcaaggccctcctccgacagtttcccaaagtttgttgtcaccgccaaaaacgaggatcgagaccctagtctggcactgtgggtcaagcaggtcgacgtgactgtatttggatactcaattgtgattcaccgcgcttataagcacaccgtgcttgttaatagcgagaggctatacctgccgcttaaactggggcaggggaagattaatatcttttcttttgggttccacgtggtggtggagactgattttggtctaaaggttgtgtacgactggaaaacattcctgtccattacagtgccacgttccatgcagaactccacgtatggactctgcgggagatacaatggcaatcctgacgacgatctggaaatgcccatgggtctgttagcttcttccgtcaatgagtttggacaaagctgggtgaagagagacaccttctgtcaggtcggatgtggagacaggtgtccctcatgcgccaaggtagagggcttctctaaagtccaacagttgtgctctctaatcccaaaccagaacgctgctttttctaagtgtcatagcaaggtgaacccaaccttcttctacaaaaactgtctgtttgatagttgtatcgacggcggggcagtgcagaccgcctgttcctggcttcagaattacgccagcacttgtcaaacccaaggcattaccgtcactgggtggcgcaattacacatcatgtaccgtgacatgtccccccaacagccactacgagagctgtgtgtccgtctgccagccaagatgcgcggcaataaggcttaagtctgactgttctcactactgtgtagaaggctgccattgcgatgcgggttacgtgctcaatggtaaatcatgtatcttaccacattcgtgcggctgttactctgatggaaaatattatgaaccaaagcaactgttctggaatagtgattgtacgagacgttgccggtgcttccgacgcaatgtcattcagtgtgaccctaggcagtgcaagagtgatgaagaatgtgccttacggaacggggtgcgggggtgctttagtactaagaccagttattgcctagcggcaggcggcggggtgtttcgaacctttgacggcgcctttctaagatttcccgctaattgcgcatttgtgctgagcacaatttgccagaaactccccgacattagttttcagcttattatcaattttgataagtggagcgccccaaatttaactattatttctcctgtgtacttctacatcaacgaagaacagattctcattaacgacaggaatactgtcaaagtgaatggcacccaagttaacgttccatttattacagggctcgcaaccaagatatactcttcagaagggttcttggtaatcgacacctctccagacattcaaatttactacaatgggtttaatgtcattaaaattagtattagcgaaagactgcagaataaagtttgcgggctgtgtggcaacttcaatggcgatctgacagacgattatgtaacattgaggggaaaaccggtcgtttcctccgtcgtccttgcgcagtcctggaaaaccaatggaatgcagaaacgccctcttgcccccagctgtaacgaacttcagttttcccagtacgcggctatgtgcgacaacgtgcacatccaaaagatgcagggcgatggatactgtctgaaactcactgacatgaagggctttttccagccctgttacggtttattggacccactgcctttttacgagagctgctatctggacggttgctactcacacaagaaattccagctgtgtggctctttggcagcttacggggaagcctgccggtcattcggtatactgagcaccgagtggatcgaaaaggagaactgtagcggagtggtggaagatccatgcgtgggcgctgactgtcccaaccgcacatgcgaactgggcaatggtcgagagttatgcggctgtatcgaacctcctccctacggtaataactctcacgacataatcgacgccgaggtgacttgcaaagccgctcagatggaggtgagtatctctaagtgcaagctgtttcaactgggcttcgagcgcgagggggtacgtatcaacgatcgacagtgtacagggatcgaaggggaggatttcatctcctttcagatcaataatacaaaaggcaattgcggcaacatagtgcagagcaatggaacccacatcatgtacaaaaatacactttggatagagtctgccaacaacaccggaaacattatcactagagatcgcacaataaacgtggagttcagttgcgcctatgaactcgacatcaagatctccctggattccgtagtgaagcccatgctgtccgtaattaacttgacggtccccacacaggaggggagttttatcaccaagatggcactctataagaacgcctcatataaacacccctacagacagggtgaagttgtccttacgactcgtgacgtgctgtacgtgggggtattcgtagtgggcgcggacgctactcacctcattctcaccctgaataagtgttatgccacgccaactcgcgactccaacgacaaactcaggtacttcattattgaaggtgggtgtcaaaatctcaaagataatactatcgggattgaggagaatgctgtgtctttaacgtgcagatttcatgtgaccgtattcaagtttatcggcgactacgacgaagttcacctgcactgcgccgtttccctgtgcgacagcgaaaagtacagctgtaagattacctgtccccataatagccggatagccaccgattatacaaaagagccaaaagaacaaatcatatctgtcggaccaatcaggaggaagcgtctggactggtgcgaggacaacggcgggtgcgagcaaatctgtacaagtagagtcgatgggccactgtgcagctgcgtgacaggcaccttgcaggaggacgggaagtcatgcagagcatccaattccagcatggagctccaggtttggaccctgcttctcatcatgatccagatcagcttgtggcactttgtctacaagtcggggaccacctcatag

SEQ ID NO: 137487 - DNA, 6468 bp, Artificial Sequence
  Description of Artificial Sequence: Synthetic coding sequence
atgaattatagttccttcctccgcatttgggtgagctttattttcgcactggtgcagcaccaagctcagccccgggagctcatgtatcctttctggcagaatgacactaaaacacctaaagtggacgacggctcaagcagtgagatcaaactcgctattccagtgttctttttcggggttccgtaccgcacagtgtacgtgaacaacaatggcgtcgttagctttaacgtgctggtgtcacagttcacaccagaaagcttccctttaactgatggtcgtgcctttgtggcaccattctgggccgacgtgcataatggaattcggggtgagatctattaccgcgagaccatggagcccgcaattcttaaacgcgcaacaaaggatattcggaaatacttcaaagatatggcgacattttcggcgacctgggtatttatcgttacgtgggaagaagtcacgttctacggaggttcatctaccacccctgttaataccttccaggccgttcttgtgtcggatgggtcctatacgtttaccctgttcaattactatgagatcaattggactacgggaaccgctagcggcggcgacccgcttaccggcctaggaggcgtcatggctcaggcgggcttcaacggcggaaaccttaccaactttttttccttacccggatcccggacaccagagattgttaatattcaggagaccaccaacgtcaacgtccctgggagatgggccttcaaagttgatggtaaggagattgatcccgcaaacggctgtacctcaagggggcagtttttacggcgtggagaggtgttctgggatgacctcaactgtaccgtgaagtgtaggtgcttggacttcaacaacgagatctactgccaggaggcctcttgtagcccatatgaagtgtgcgagcccaagggaaagttcttctactgttctgctgtagaaacgagcacatgcgtggtttttggggagcctcattaccacacctttgacggcttcttgttccattttcagggaagttgcgcttacttacttgcaaggcagtgtctacagactagcagccttccgttcttctcagttgaagctaaaaatgagcacagacgcggctcagcagtctcctgggtgaaggagttgagcgtcgaggttaacggctataagatcctaattcctaaaggctcttacgggcgcgtgaaggtcaacgacctcgtgacctctttgcccgtgacgctggacttaggcactgtgaagatctatcagtctgggatctccaccgccgtcgagactgacttcggattgctggtgaccttcgatggccaacattacgccagcatttctgtcccaggctcctacattaactcaacctgtggtctctgcgggaactacaacaaaaaccctttggacgactttttgcggcctgatggcagaccagccatgagtgtcctggatttgggcgaaagttggcgagtttaccacgccgactggaaatgcgactcagggtgcgtagacaactgcacccagtgcgacgcagcaacagaggccctgtatttcggatcagactattgcggctttcttaacaaaaccgacggcccattatgggagtgcggcaccgtagtcgatcccacagctttcgtccattcttgcgtgtatgatctgtgctccgtacgtgacaatgggactctgctgtgccaagctattcaggcttatgctcttgtgtgccaagccctgggtattcccattggcgactggcgtacccaaactggctgcgtgagcactgtgcaatgtccaagtttctctcactactcggtttgtacgtcctcctgcccagatacatgctcagacctgacagctagtcggaattgtgcaacaccatgcaccgagggttgcgagtgtaaccagggttttgtgctctccactagtcagtgcgtgcctttacacaagtgcgggtgcgatttcgatggccactattacacaatgggcgaatttttctgggccacagcgaactgcacagtccaatgcctgtgcgaggagggcggagatgtgtattgcttcaataaaacttgcggctcaggggaggtgtgcgcagtagaagatggctatcaaggatgtttcccaaagcgcgaaacagtttgtctgctgtcccagaaccaagtcctgcatacattcgatggcgcgtcttatgctttccctagtgaattttcttacaccttactgaagacctgccccgagcgtcccgaatatcttgaaatcgatataaataaaaaaaaacccgacgccggtccagcctggttaaggggactgcgaatcctggtagcagatcaagaggtcaagataggcggcattggggcaagcgaggtgaaactgaacgggcaggaggtcgagttgccctttttccatccttccggtaagctggaaatctatcgcaataagaattcaacaaccgtagagagcaagggtgtcgttaccgtgcagtactccgatatcggcctcctgtacatccggctgagcacaacttactttaattgtacaggagggctgtgcggcttttacaacgccaatgcttctgatgagttttgtttgccaaacggcaaatgcaccgataatctcgctgtgttcctggaaagctggaccactttcgaggaaatatgtaatggagaatgcggcgatcttctaaaagcgtgcaacaacgactctgagctgctcaaattttaccgatccaggtccaggtgcgggattattaacgatccaagtaactcctctttcctcgagtgccacggggtggtaaacgtcactgcctattatcggacatgcctctttaggctttgccagagtgggggcaacgagagcgaactgtgtgattccgtggcaaggtatgcctcggcctgcaagaatgcagatgtggaagtagggccttggagaacctatgatttctgtcccttggaatgtcctgagaactcccatttcgaggagtgtattacctgtaccgaaacatgtgagacactaacattagggccgatctgcgtggacagctgttcagaagggtgtcagtgcgacgagggctacgccttgctgggctcccaatgcgtcacccgttcagagtgcggctgcaattttgaaggtcaccaactcgccaccaacgagacgttctgggttgacctggattgtcaaatcttttgctattgttcagggaccgacaatagagtacattgcgagaccattccttgtaaggacgatgagtattgcatggaggaaggtgggctatactattgccaggccagaaccgatgccagctgtattgtctctggctacggtcactatcttacattcgacgggttcccgtttgatttccaaactagttgtccactgattctctgcaccaccggttcccgaccttcaagtgattcttttcctaagttcgtggtcacagccaaaaatgaggacagagaccctagccttgcgctgtgggtgaaacaagtagatgtaacagtgtttggctatagcatcgttattcacagggcctacaaacacactgtgttggtaaactccgaaagactgtacctacccctgaagcttggtcagggaaagatcaacattttttctttcgggttccatgttgttgtcgagacagattttgggctcaaggtggtgtatgattggaaaactttcctgagtatcaccgtgccaaggtctatgcagaactcgacatatgggctgtgcggtcgatacaatggtaatcccgacgatgatcttgaaatgccaatgggcctgctcgcttcaagcgtgaatgagtttggccagtcatgggttaagagagacactttttgccaggtgggatgcggcgaccgatgcccgagctgcgccaaggtcgaaggcttctctaaggtacagcagctgtgttccttgatcccgaaccagaatgcggccttcagtaaatgccactcaaaagtgaatccaactttcttctacaagaattgcttgtttgattcctgcatcgacggcggcgccgttcagaccgcgtgctcatggttgcagaactacgcctctacatgccagactcagggcattaccgtaacgggctggagaaactatacgtcctgcaccgttacctgtccgccgaacagccactacgagtcatgcgtgtctgtttgccagccccggtgtgccgctatccgtctgaagtccgattgtagtcactactgtgtggaagggtgtcactgcgacgcagggtacgtgttaaatggcaaatcttgcattttaccccattcttgtggctgctatagcgacggaaagtattatgaacctaagcagctcttctggaatagcgactgcaccagacgatgtcgttgcttccggcgcaacgtgatccagtgcgaccctcggcagtgcaaatcagacgaagaatgcgcactccgcaatggtgttcggggctgcttttcaaccaaaacaagctattgtctggctgccggcggcggagtttttcgcacatttgatggggccttcctcagattcccagcaaattgcgcattcgtgttgtcaactatctgtcaaaagcttcccgatattagcttccagctcatcatcaattttgacaagtggtcggcccccaatctaacaataatctctccagtgtatttttatatcaatgaagagcagattctcatcaatgaccgcaatacagtaaaggtgaatggcacacaggttaacgtccctttcataaccggactagccacaaagatatattcatcagagggcttcctggtcattgacacaagccctgacatccagatctattataatggctttaacgtcattaaaatttccatttccgaacgactccaaaataaggtgtgcggtttatgtgggaatttcaacggcgatttgaccgacgattacgtaacgttaaggggcaagcctgtcgtctcgtcggtcgtcctagctcagtcttggaagactaacgggatgcaaaagagaccactggccccatcctgcaatgagctacagtttagtcagtacgctgcaatgtgcgataatgtgcatattcagaaaatgcaaggtgatggctactgtctgaagcttaccgacatgaaaggcttcttccagccctgctatggcctattagatcccttgcctttctacgagagttgctatttagatggctgctacagccataagaagttccagctgtgtgggtcacttgcagcctatggtgaagcgtgtaggagcttcggcattctgagcacagagtggatcgagaaagagaattgctcaggcgtggtcgaggatccatgcgtaggagctgattgtcctaatagaacttgcgagttgggaaatggaagagagctgtgcgggtgtatcgagccacctccctatggcaataattcgcatgacatcatcgacgcagaagtgacctgtaaggccgcgcaaatggaggtgagcatctccaagtgcaaactgttccagctgggtttcgagagagagggtgtaaggattaacgatcgacagtgcacgggcatagagggagaagatttcatttcttttcaaatcaataatacaaaaggcaattgtggtaatatcgtgcagagcaatgggacacacatcatgtataaaaacacactgtggatcgagtctgcaaataatacagggaatattataaccagagacagaacaatcaatgtggaatttagttgtgcttatgagctggatattaagattagtttagacagcgtcgtcaagcctatgctgagtgtcatcaatctgaccgtacctacacaggaagggtcatttatcaccaaaatggctctgtacaaaaatgcctcctacaaacacccttacagacagggagaagtcgttctgaccacaagagacgtcctgtacgttggagtgttcgtggtaggagccgacgcgactcatctgattctgaccctcaataaatgctacgctacaccaacgcgagattccaacgacaagctgagatactttatcatagagggggggtgccagaatctgaaggataacactatcggcattgaggaaaacgcagtgtcgctgacttgtaggtttcatgtgacggtgttcaagtttattggggattacgacgaggttcacctacattgcgccgtctcgctttgtgactctgagaagtacagttgtaagattacatgtccgcataattctaggatcgccacggactataccaaggagccgaaggaacagataatcagtgtcggccctatacgcagaaagaggttggattggtgcgaagataacggaggatgtgaacagatttgcaccagtcgggttgatgggcccctgtgctcctgtgtgaccggcacattgcaggaggacgggaagtcctgtcgggcttccaattcgtccatggagttacaggtctggaccctgctcctgataatgatccagatctctctctggcattttgtgtacaaaagtggcaccacatcatag

SEQ ID NO: 137488 - DNA, 1257 bp, Artificial Sequence
  Description of Artificial Sequence: Synthetic coding sequence
atggcgaaactccttcagccccccccaaaatttcttccttcagagtggcacatcgcaaacaaaaatcaataccatcgcgccgatgcccagcgctctcgctccgaacggctcgtggccgaatcacagcggctggtggacgaaatcgaaaagaccactaggaagtcccagtctgatgtgaataagaagcttgaacagcggctcgaggaggtgcagttctggaaaaaagaactggacgataaactggaacaactggtgaatgtgactgatgatttgttaatatataaaataaggctagagaaagctctagaaacactaaaagaacccctgcatatcaccgaaacctgcttggcatatcgagagaaacggatcggcattgatcttgtgcacgacaccgtcgaacatgagctcattaaagaggccgagattattcagggtatcatggcattgcttacgcggaccctggaggaggcatccgagcagatccggatgaatcgcagtgctaagtataacctggaaaaggatcttaaagacaagttcgtggcccttaccattgatgatatatgtttcagcctcaacaacaattccccaaatattagatactctgaaaatgcggtccgtatagagcccaatagtgttagtttggaagactggttggacttttcttcaacaaatgtagagaaggccgacaaacagaggaataattcccttatgctcaaagcactggtggacaggatcctgtcacagacggcaaacgatctgaggaaacaatgtgacgtggtcgataccgcgtttaagaacggcttgaaggacacgaaggatgctcgcgataagttagctgaccacttggcaaaggtcatggaggagattgccagtcaagagaagaatataactgctctcgagaaggcaattctggaccaggaaggaccagctaaagtcgcccacaccaggttggaaacacgcacacatcgccctaatgttgaactctgtcgggatgtggctcagtacaggctgatgaaggaagtccaggagatcacacacaacgtcgcacgcctcaaagagaccctcgcgcaggctcaggcagaactgaaggggctccacagaagacaactagccttacaagaggaaattcaggtgaaagaaaatacaatttacattgacgaagtgctctgtatgcagatgagaaagtcaatccccctgagagacggggaggatcatggagtgtgggctggcggactgaggcccgacgccgtgtgttag

SEQ ID NO: 137489 - DNA, 819 bp, Artificial Sequence
  Description of Artificial Sequence: Synthetic coding sequence
atggccctgctcacacggactcttgaggaggcgagcgaacagatccgtatgaacagatctgccaaatacaatctggaaaaggacctgaaggacaaattcgtggccttgaccattgacgacatctgtttttcattgaataacaactctccaaatatccgctattccgagaacgctgtgcgaattgagcctaacagcgtgtcactcgaagactggctggattttagctccacaaatgtggaaaaggccgataaacagaggaacaatagtctgatgctgaaggccttagtggatcgaatactttcccaaaccgcaaatgatttaagaaagcagtgtgacgtcgttgatacggccttcaaaaatggcttgaaggataccaaagatgcacgcgacaagttagccgaccaccttgctaaagtaatggaggagatcgcgtcccaggagaagaatattactgccctggagaaggctatattggaccaagagggccccgctaaggtagcacacaccagactcgagacacgaactcatagaccgaacgtggaactgtgcagagatgttgcacagtaccgactcatgaaagaggtacaggagataacccacaacgtggcccgcttgaaagagaccctcgctcaggcacaagccgaattgaaaggattgcatagaaggcagttggccctgcaggaggagattcaagttaaggaaaacaccatttatatagatgaggtcctgtgcatgcagatgcggaaatctatacctcttcgggacggcgaggatcacggggtttgggcaggtgggttgagacctgacgctgtatgctag

SEQ ID NO: 137490 - DNA, 1473 bp, Artificial Sequence
  Description of Artificial Sequence: Synthetic coding sequence
atggaacgggtggggtgtacacttactactacatatgcacacccgaggcccacgccgacaaacttcctgcctgccattagcaccatggcttcgagttatcgggacaggtttccccactctaacttgacacattctctgtccctgccctggcggcctagcacctactataaagtcgcttctaacagcccctctgtcgccccctattgcactaggagccagcgagtgagcgaaaacacgatgctgccatttgtgtcaaacagaaccacatttttcacgcggtacacgcctgatgactggtatcgttccaacctgacaaattatcaggagtccaacacaagcaggcataatagtgaaaaactgagagttgatacctccaggctcatccaagacaaataccagcaaacaagaaagacgcaggcagacacgactcagaatcttggagagcgtgtgaatgatattggcttctggaagtccgaaattatccacgaactggacgagatgatcggtgaaacgaatgccctgactgacgtgaagaaacggctggaacgcgccctgatggaaacagaggcgcctctccaagttgctagagagtgtctgttccaccgggagaagagaatgggtattgacctagtgcatgacgaggtcgaagcgcagcttctgacagaagtggacacaatcctatgctgtcaggagagaatgaagttacatctggacaaggccatcgcccagctcgctgcaaaccgcgcatcgcaacatgaactggaaaaagacctgagcgacaagcagaccgcctacaggatcgatgacaagtgtcatcatctgaggaatacttccgacggggtgggctattttcgcggagtggagagggtggacgcaacagtaagtgtgcctgaaagctgggctaaatttactgatgacaatatcctccgctcacagagcgaaagggctgcctcagctaagttaagggacgacattgagaatctgttggtcgtgaccgccaacgaaatgtggaatcagtttaacaaggtgaatctgtcctttaccaataggatcgcagagaccgccgacgccaagaacaaaatccaaactcacctggctaagactctccaggagattttccagacagagatgaccattgagagcattaagaaggctattaaggataaaacagcctttctgaaggtggcccaaacccggttggacgagagaacacggcgcccgaatattgagctttgccgggacatggctcagctgagactcgtgaacgaggtccatgaagttgatgacacaatccaaacactgcaacagaggctgagggatgccgaggacacattacaaagtctggtccacattaaggccaccttagaatacgacctcgcagttaaagctaacagcctgtatatcgaccaagagaaatgcatgtctatgcggaagagttatcccaataccctgaggttagttggtttctgttag

SEQ ID NO: 137491 - DNA, 1473 bp, Artificial Sequence
  Description of Artificial Sequence: Synthetic coding sequence
atggaacgagtagggtgcaccctgactactacttacgcacatccacggccaacacccaccaattttctgccagctatatccaccatggcttccagttacagagataggttcccccattcaaaccttacccactccctgtcattaccatggcggccatctacctactataaggtggcttcaaactctcctagcgtcgctccatactgtactcgcagccagcgggtgtcagaaaacacaatgttaccttttgtctctaatcggactacgttcttcacacgctatactcctgatgattggtatagaagtaacttaacaaactaccaggaaagtaatacgagtaggcataatagtgagaaactaagagtggatacctcaagattaattcaggataagtatcaacagactcgaaaaacccaggccgatacaactcagaacctgggtgagagggtcaacgatattggtttttggaagagcgagatcatccatgagctcgatgaaatgataggggaaacaaacgctctaaccgatgtcaagaaacgcctcgagagagcccttatggagactgaggccccacttcaggttgccagggagtgcctctttcatcgggagaagagaatgggtatcgatctcgtccatgatgaagtagaggcccagctgctgactgaagtggacaccattctgtgctgtcaggaaaggatgaagttgcatctagacaaagccatcgcacagctggctgccaatcgcgcatcccagcatgagctagaaaaggacttgtcggataagcagacggcgtaccgaatagatgataaatgccaccatctccggaacacctccgatggggtgggttatttccgcggtgtagagagggtggatgctaccgtctcggtgcccgaaagttgggcgaaattcacggacgacaacattctccggagccaaagcgagagagccgcatctgccaagctgcgggatgatattgaaaatttgctcgtcgtaaccgctaatgaaatgtggaatcaatttaacaaagttaacctaagcttcaccaatcggatagccgaaaccgccgatgcaaaaaacaagatacaaacgcacctcgcaaagaccctgcaggagattttccagaccgagatgacgatagagtctataaagaaagctatcaaggacaaaacagcctttttaaaagtcgcgcaaacaagattagacgaaaggaccaggcggcccaatattgaattgtgtagggatatggctcagttaaggcttgtcaatgaggtgcacgaggtggacgacacgatccagaccctgcaacaaagacttcgcgatgctgaagacacattgcaatcgctggtacacattaaagctacacttgagtacgacctggccgtgaaggctaactcactgtacatagaccaagagaagtgcatgagcatgcgaaaaagctatcctaacactttacgcctcgttggtttctgctag

SEQ ID NO: 137492 - DNA, 444 bp, Artificial Sequence
  Description of Artificial Sequence: Synthetic coding sequence
atggaaagggttgggtgcacacttaccactacctacgcacatccacgacctacacccaccaatttcctgcccgctatctcaactatggcctcatcctaccgggacaggttcccacatagtaacctgacgcattctctgtctctgccctggagaccttctacttactataaggtcgcatcaaattctccaagtgtcgcaccctattgcactcgaagtcagagagtcagcgagaacactatgctgccttttgtatctaatcggactacattcttcacacggtacacacccgacgattggtaccgaagcaacctaactaattatcaagaaagtaatacatcccgccacaatagcgagaaactgagggttgacacgtcgcggctgattcaagacaagtatcagcagacacggaaaacccaggccgatacgacacagaacttaggctag

SEQ ID NO: 137493 - DNA, 423 bp, Artificial Sequence
  Description of Artificial Sequence: Synthetic coding sequence
atggagagagtcgggtgcactttaactaccacttacgcacatcctcgcccaacacccactaacttcctgccagccatttccactatggctagctcataccgtgatcgctttccgcattcaaacctgactcactcattgtcgcttccttggagaccgagcacctactataaggtggcctcaaacagtcctagtgtggctccctattgtactagatcccagcgcgtctccgagaacacaatgttgccctttgtgagcaatcgaactaccttcttcacgcgttacacacctgatgattggtaccggtccaatctcaccaactatcaggaatccaataccagccgccataacagcgaaaagctgagagtggacacttctcgccttattcaggacaagtatcagcagactcggaaaacccaggcatag

SEQ ID NO: 137494 - DNA, 249 bp, Artificial Sequence
  Description of Artificial Sequence: Synthetic coding sequence
atggaacgggtcggatgtacgttaactaccacatacgctcaccccaggcccacacctacaaatttcttgcccgcaatctccacaatggcatcttcatatagggacaggttcccacattccaacctaacgcactcactgtccctgccatggagaccctctacttactacaaagtggccagcaactcaccatccgtagcaccttactgtaccagatcacagcgggtcagtgagaacaccatgcttccttag

SEQ ID NO: 137495 - DNA, 2514 bp, Artificial Sequence
  Description of Artificial Sequence: Synthetic coding sequence
atggagcctgcaccctctgaagtaaggcttgccgtgagagaagccattcacgccctctcctcgtcggaagatgggggtcatattttctgtacacttgagagcctcaaacgttacctaggtgagatggagccacctgcgcttcctcgcgaaaaggaggagttcgcatccgctcacttctctcctgtgctaagatgcctcgcctcgcgcctgagtcccgcttggctagaactgcttccccatggccgcctggaagagctgtgggccagctttttcctagagggacctgcggatcaggcttttctggtgctcatggagaccatcgagggcgccgccgggccttcttttagactcatgaaaatggcccgcctgctggcgagatttctaagggaaggccgactggcagtgcttatggaagcgcaatgcagacagcagacccagcccggttttattctgctgcgggagacactgctgggaaaggtggtcgcgttacccgaccacctcggcaataggctgcagcaggaaaatctggcagaattcttcccacaaaactattttaggctactgggcgaggaagtagttagggtgctccaagccgtggtggatagtctccaagggggtctagacagctccgtcagttttgtttcccaggtcctaggcaaagcctgcgtgcatggaaggcagcaagaaatactgggcgtcctggtcccgaggctggctgcgctgacgcaggggtcttatctgcatcaaagagtttgctggcgccttgtagaacaggtgcctgaccgggctatggaggcggtactcacggggctcgtggaagccgcacttggcccagaagtgctgtcgcgtctgttgggcaacctggtggtgaaaaataagaaagcccagtttgttatgacacagaagctgctcttccttcagtcccgcttgactactcccatgctgcagagtttgctgggacatctggccatggactcccaacggagaccccttctgctgcaggttcttaaggaacttctcgagacgtggggctcatcgagtgctatcaggcacacccccttgccccagcagagacacgttagcaaggccgttctcatttgcctcgcacagcttggtgaacccgagctgcgggactctcgggacgagttattggcatccatgatggcgggggtcaagtgccgccttgacagcagcctgccgcctgtgcggcggttgggcatgatagttgccgaggttgtctcagcccggatccaccctgaaggcccccccttgaagttccagtatgaagaagacgagctgtccctggagcttctcgcactggcctcacctcagcccgccggggatggcgcttccgaagcgggtaccagcctcgtgcccgccaccgctgaaccccctgctgagacacccgccgaaattgtggatggcggcgtgccgcaggcacaattggctgggagtgactcagatcttgactctgacgatgaatttgtgccttacgatatgtctggcgaccgggagctgaaaagctccaaggcacctgcttacgttagagactgcgtggaggctctcacaacttctgaggacatagaaagatgggaggccgctctgcgagcgctggaaggtctggtttatcggagccccaccgccacccgcgaagtctccgttgagcttgctaaggtgctgctacatttagaggagaagacatgtgtggtcggttttgctggcctccgtcagagggccttggtggctgtaacggtgaccgaccccgcaccagtcgctgactatctcactagccagttctacgccttgaactattctctacgccagagaatggacattctggacgtgctgacccttgccgcacaagagcttagtcgtcccggctgtttgggccgcaccccccagcccggaagcccatcccccaatacgccttgcctacctgaagctgccgtgtcacagcccggcagcgccgtcgcatccgattggcgcgtggtggttgaggaaagaattaggagcaagacacagagactgtccaagggcggccctcgacagggaccggcaggatctccgagccgttttaactctgttgccggccactttttttttccactgttgcagagattcgatcggccactggttacgtttgatctactcggcgaggaccagcttgtactgggccgactggctcatacgctgggtgccttaatgtgcctggcggtaaatacaactgtagcggtcgctatggggaaggcacttcttgaattcgtatgggccttgagatttcatattgacgcatatgtaaggcagggcttactttccgccgtctcatcagttttgcttagtcttccagctgctcggctgctcgaagatctgatggatgagttgctagaggcaaggagttggcttgctgacgtcgccgaaaaggacccagacgaggattgtcgcacattggctcttagggccctcttgttattacagcggctcaaaaatcgactactgccaccagccagcccatag

SEQ ID NO: 137496 - DNA, 1083 bp, Artificial Sequence
  Description of Artificial Sequence: Synthetic coding sequence
atgatggcaggtgtgaagtgcaggctggacagcagcctgcccccagtcaggcgtttgggaatgatcgtggcagaagtggtctccgctcggatacaccctgagggcccacccttgaagtttcagtacgaagaggatgaactgagtctggagcttctggccctagcttcccctcagcctgccggggatggggcctcggaggccggtactagcttagtcccagctaccgccgaacctcccgctgagacccctgcggagattgttgatggcggtgtgcctcaagctcagctcgccggaagtgattccgaccttgatagtgatgacgagtttgtgccctacgacatgtccggagacagggaactaaaatcatccaaggctcctgcatatgtgcgcgattgcgtcgaggttttagatgtcctcaccttggctgcacaggagctgagccggccgggttgtctgggacgtacaccacaacccggttctccctctcccaataccccgtgcctgccagaagcggcagtgagccaacccggatcagcagttgcatctgactggcgggtggtcgtggaagagcgaattcggtcgaagacacagaggctttctaaaggcggaccccgtcagggccctgcaggcagtccttcccgattcaacagcgtcgccggccacttcttctttccactgctgcagagatttgaccgccccctcgtcacctttgacctgttaggtgaggaccagttggtgctaggccgactggcccatactctgggtgcgctcatgtgcctcgccgttaacaccacggttgcagtggctatgggtaaagcactgctggaatttgtgtgggcattgcggttccacattgatgcttatgtgaggcagggtctcctcagtgcagtgtcaagcgtgttgctgagcttgcccgctgctcggctgctcgaagaccttatggatgagctcttggaggccaggtcctggctcgctgacgtggccgagaaagaccctgacgaggactgcaggactctggccctgcgggcactgctcctgctgcaacgcctgaagaatcggctcctgcctccagcctctccatag

SEQ ID NO: 137497 - DNA, 3270 bp, Artificial Sequence
  Description of Artificial Sequence: Synthetic coding sequence
atggccgtgttcgatacacccgaagaggctttcggcgttctgcgcccagtctgtgtgcaactgacaaagacccaaactgtggagaacgtggaacatctccagacaagactgcaagccgtgtctgatagtgctttgcaggaactgcagcagtacattctgtttccacttcggttcaccctgaaaacacccgggcccaagagagagagactgatccaatcagtggtggagtgcctgacatttgtgctgtcgagcacatgtgtgaaagaacaggagcttttacaagaactcttttcggaacttagcgcctgtttgtacagcccttcgagccagaaacccgccgccgtttcagaggaacttaaactggcagtgatacagggcctctctacactgatgcattctgcatatggagatattatcctcacgttctacgagccgagcattcttcccaggctcggattcgctgttagcctactcttggggctggccgagcaagagaaaagcaaacagatcaagatcgccgccctcaagtgcctccaagtgctgctcctccagtgcgattgccaagaccaccccagatctctggacgaactggaacagaaacagctaggagacctgttcgcatccttcctgccaggcatctcgactgctctcaccagattgatcaccggagactttaagcagggtcacagtatagtggtgtcatctctgaaaattttctataaaaccgtcagcttcatcatggccgacgagcagctgaaaagaatttccaaggttcaggctaagcctgctgtcgaacaccgcgtcgccgaactgatggtctaccgcgaagccgactgggtaaagaagacgggcgataaactgaccattctaatcaaaaagattatcgaatgtgtatccgtccacccgcactggaaagtgcggctggagctggtggaactggtagaagatctccttctcaagtgtagccaatccctggttgaatgtgcgggcccactgctgaaggcgctagtcgggctggtgaacgacgaatcccctgaaattcaagcacagtgcaacaaggtgctccgccacttcgcggatcagaaagtcgtggtgggaaacaaagctctcgcggatatcctatctgaatcactccactcgcttgctacttctctgccccgattgatgaacagtcaggacgaccagggaaaattcagtacactctctctgctgttgggatatcttaagttactggggcccaaaatcaactttgtcctgaattcagtggcccacctgcagaggctcagcaaggcccttatccaggtcctagagctggacgtcgcggatattaaaatcgtagaagagcggaggtggaactcagacgatcttaacgcttctcctaagacaagcgccacgcagccttggaacaggatccagaggcggtactttagattcttcactgacgagaggatcttcatgctcctgcgacaagtgtgccagctgctaggctactatggaaatctgtatttgctggtggatcatttcatggaactctatcaccagagcgtggtgtacaggaaacaggcagctatgattttgaacgagcttgtgactggagccgcaggactcgaagtggaggacctgcacgaaaaacacattaagacaaacccagaagagttacgtgagattgttacgagtattctggaagagtatacgtcccaggaaaactggtatctggtgacgtgccttgagacagaagagatgggtgaagaactcatgatggagcaccctggacttcaggcaattacctccggggaacatacctgtcaagtgacctccttccttgcctttagcaagccaagtccaaccatttgcagtatgaactcaaacatatggcaaatatgcatccagctcgaaggaattggtcaatttgcttatgccctcgggaaagacttttgcctcttactgatgtcagctctttaccctgtactcgaaaaggctggagaccagacattactgatctcacaggtcgcaacctctactatgatggacgtttgtcgggcatgcgggtatgactcccttcagcacctgataaaccagaatagcgactatctggttaacgggattagccttaacctaagacacttagccctacatccacacacacctaaggtactggaggtcatgctcaggaactcggatgccaaccttttaccactggttgctgatgtcgtgcaagacgtgttggccacactcgatcaattttatgacaaaagagcggcctccttcgtttccgtgttgcacgccttaatggctgccctcgcccagtggtttccagacacaggtaacctgggccacctgcaggaacaatcccttggcgaagaaggctcacatttaaaccagcggcccgccgccctggagaagagtacaaccacagcggaggacatcgagcagtttctgctgaactatctgaaagaaaaggatgtggcagacggtaatgttagcgattttgacaatgaggaggaagaacagtcagtgccacccaaagtggacgaaaacgacacgcgacctgatgtcgaaccacctttgccactccagatccagatagctatggatgtaatggagagatgcatacacctgttgtctgataaaaaccttcaaatacgccttaaagttctcgatgtactggacctgtgtgtggtggtcctgcaatcgcacaagaatcagctcttacccctggcacaccaggcgtggccaagcctagtccacagattgacacgtgatgcccctttggccgtactacgggcatttaaagtcctccgaacactgggctcgaaatgtggggacttcctccgcagcaggttttgtaaggatgtgttacctaagttggctgggagtctcgtgacgcaggctccaatttctgcaagggcgggcccggtctactcacacacactcgcctttaagctccagctcgctgtgctccagggcctaggacctctttgtgaacgactggatttaggcgaaggcgatttgaataaagtggccgacgcttgcttgatttatttatctgttaagcagccggtcaaactccaggaggcagcccggagcgtttttctgcatctgatgaaggtagaccctgatagtacttggtttctgctgaacgagctgtattgtcccgtgcagttcaccccgccacacccatcactccaccccgtgcagctccatggtgcctccgggcagcagaacccgtataccaccaatgtgctccagcttttaaaagagctgcagtag

SEQ ID NO: 137498 - DNA, 3270 bp, Artificial Sequence
  Description of Artificial Sequence: Synthetic coding sequence
atggctgttttcgacacaccagaggaggctttcggcgtgctcaggcctgtgtgcgttcagctgaccaagacccagaccgtggagaatgtggaacacttgcaaacccggctccaggctgtgagcgacagcgctctgcaggagttgcagcagtatatcctctttccactcaggtttacattgaaaaccccaggccctaagagggaaagacttatacagtcagtagtagaatgtctgacttttgtcctcagtagcacttgtgtcaaggagcaggagttgctgcaggaactgttcagtgaactcagcgcctgtctgtattcgccgtcatcacaaaaacccgccgccgtgagcgaggaacttaaactggcagtgatacagggcctgtccacgctgatgcactccgcatatggtgacattattctcactttctacgagcccagtatactcccaagattgggcttcgctgtgtcacttctgctgggactggccgagcaagaaaaatctaagcagattaagattgccgcactcaagtgtctacaggtgttattactgcagtgcgactgtcaggatcacccacggagcctagatgagctggagcagaaacagctgggggaccttttcgcatcattccttccaggcattagcacagccctcaccaggttaatcaccggcgatttcaagcaagggcacagtatcgtggttagcagcttgaagatcttctacaaaactgtctcgttcataatggccgacgagcaactgaagagaatctccaaagtgcaggccaagcctgcagtagagcaccgcgtggccgagctaatggtctatcgcgaagcggattgggtgaagaaaactggagataagctcaccatactgattaagaaaattattgagtgtgtgagcgttcatccacattggaaagttcgattggaacttgttgaactggttgaagacctcctgcttaaatgtagtcaaagtctggtggagtgtgcaggtcccttactgaaggccttagttggactggtgaatgacgagagcccggagatccaagctcagtgtaacaaagtcctgcggcattttgccgaccagaaagttgttgtcgggaacaaggcattggcagatatcttgagcgaaagtctccattccttagctacctcgctgcctcggctgatgaattcacaagatgatcagggtaagttcagtactctcagtttattgttaggatacctgaagttattgggcccaaagatcaacttcgtcttgaattctgtagcccatctccagaggctgtctaaggcactgatacaggtactggaactggatgtagccgacatcaagatcgtggaggaacgtaggtggaattcagatgacctaaacgccagccctaaaaccagcgctacccaaccctggaataggattcagagaagatatttcaggtttttcaccgatgagagaatatttatgctgcttaggcaagtctgccagttgctaggctattatgggaacctgtatctactcgttgatcattttatggagctgtaccaccagagcgtcgtgtacagaaagcaggccgcgatgatcctgaatgaactcgtgacaggggcagcaggactggaggtggaagatctgcacgaaaaacatattaagaccaaccctgaagaactcagagagattgttactagcatcctggaggagtacacctcccaggagaactggtatctagtgacttgtctggaaaccgaggagatgggagaagaattgatgatggaacacccaggcctgcaggcaatcacatctggtgaacatacgtgtcaggtgacaagcttcttggcattttccaagccctctcctacaatctgctccatgaattcaaatatctggcaaatatgtatccagctggagggtatcggccagtttgcatacgccctgggaaaggacttctgcctgctgctgatgagcgctctctaccctgtgcttgaaaaggctggggaccagacactgttaatttcccaggtcgctacctctacaatgatggatgtgtgccgggcgtgtggctatgatagcctgcagcacctgataaaccaaaacagtgattacttagtgaacggcatcagcctgaatctccgccatcttgctctacatccccacacgcccaaggtgctagaggttatgctgcggaatagtgatgccaatctcctcccattggtcgccgacgtcgttcaggatgtactggccacactcgatcagttttacgataagagggcagcaagttttgtctccgttttgcatgccctgatggccgccctcgctcagtggttcccggacacagggaacctgggccatctgcaggagcagagcctgggtgaggaaggatctcacctgaatcagagacccgccgccctggagaaatcgactaccaccgcggaagatatagaacagttcttactgaactacctaaaggaaaaagacgtcgcggacggcaacgtaagtgacttcgacaacgaggaggaggagcaaagcgtaccgcctaaagtggacgaaaatgacacacgaccagatgttgaaccaccactccccctccagatccagattgcaatggatgtcatggaacggtgtatacacctgctgtccgacaagaaccttcaaatacgtctgaaagtgttagacgtcctcgatctatgtgtggtggtgctccagagtcataagaatcagctcctccctctggcccaccaggcttggccctcactcgtgcacagactaacacgggatgctcctctcgccgtgttgagggcattcaaagtgcttagaaccctcgggtctaaatgtggggatttcttgaggtccaggttttgtaaggacgtcctgccaaaactcgccggctcactggtgacgcaggccccaatttccgcgcgtgccggaccagtttatagccatacactggcctttaagctacagcttgccgtcttacaggggctggggccactgtgcgagagactagacttaggggagggggatctgaacaaagttgcggatgcttgcctaatctacttgtccgtcaagcagcctgtaaaactgcaagaggcagcgagaagtgtgtttctgcatttaatgaaggtcgatcctgacagcacatggtttctgctgaacgagctgtattgtcctgtgcagtttaccccaccccacccatcattgcaccccgtacagctccacggcgccagtggtcaacagaatccatataccacgaacgtgctgcagctgctgaaggagttacagtag

SEQ ID NO: 137499 - DNA, 3270 bp, Artificial Sequence
  Description of Artificial Sequence: Synthetic coding sequence
atggccgtgtttgacacgccagaggaagcttttggagtattaagacctgtgtgcgtgcagttaacgaagacccaaactgtggagaacgtggagcacctgcaaacaagactgcaggcagttagcgattccgcgctgcaggagctgcagcagtacatcctgtttcccctgagattcacactcaagacgcccggaccgaaaagggagaggctgattcaatccgtcgtggaatgcctcacattcgtactcagtagcacctgcgtcaaggagcaggaactgctccaggaactgttttccgaactgtctgcctgtttgtacagcccttcttcccagaaaccagctgcagttagtgaagagcttaagcttgctgtcatacagggtctgtcaaccctgatgcacagcgcctatggcgacatcattttgacattctacgaaccatctattctgccaaggctgggctttgccgtgagtctcctcttaggtctcgcagagcaagaaaagtctaagcagataaagattgccgcactgaagtgcttgcaggtccttttgctccagtgcgattgccaggaccaccctcggtctctcgacgagctcgagcagaaacagctgggtgacctgtttgcctcctttctccctggaatctccactgccttaacgcggctgatcacaggtgattttaagcaaggacacagtatcgtggtaagcagcctgaaaatcttctacaaaactgttagtttcataatggcagacgagcagcttaagcggattagtaaggtgcaagctaagcctgcagtggagcaccgagtcgctgagttaatggtataccgtgaggctgactgggtgaagaagacaggggataaactcacaatcttgatcaagaagataatcgaatgcgtgagcgtccatcctcattggaaagtccgccttgaactcgtggagttggtagaagatctcctcctgaaatgttctcagtcactggtcgagtgtgctggtcccctcctgaaagccctggtcggactcgtcaatgatgagagtcccgagattcaggctcaatgtaataaggtcctacgtcactttgctgaccagaaagtagtcgtgggaaacaaggcactcgccgacattttatctgagtctctgcattccttagccacctccttgcctcgactcatgaattctcaggacgaccaggggaagttttcaaccctatccctgctcctgggatacctcaaattacttgggcctaaaattaattttgtactcaatagtgtggcgcacttacagaggctctcaaaagccctgattcaggtacttgagctcgatgtggccgatattaagatagtggaggagagacgatggaactctgatgatcttaacgctagcccgaagacttcggctacacagccatggaatagaatccagcggcgctactttagattcttcacagacgagagaatctttatgctgcttagacaagtctgtcagctgcttggctactatgggaacctgtatctgctcgtggatcattttatggagctgtatcaccagtccgtggtatacagaaagcaggctgctatgattctcaacgagctagtgacgggagcggctggattggaggttgaagacctacatgaaaaacatatcaagacaaatccggaggagttgcgagagatcgttacctctattttagaagaatacacttcccaggaaaactggtatctagtgacttgtctggaaactgaggagatgggcgaagagctgatgatggaacatcccggattgcaggccataaccagtggcgagcatacatgccaggtgacaagttttctcgcattttccaagcccagccccaccatctgctccatgaactcaaatatctggcagatttgtatccagctagaaggtataggacagttcgcctacgcccttggcaaggacttctgtcttctgttaatgtctgccctatatccagtgctcgaaaaggccggcgaccagactttgcttatttcacaggtggccacaagcaccatgatggacgtctgccgcgcgtgcggatacgattcactacaacacctgataaatcagaattcagattatttggtaaatggtataagtttgaatctccgccacctagctttacacccccatacccccaaagttctggaggtcatgcttaggaattctgatgccaacctgctgcccctagttgctgacgtggttcaggatgtgttagctacccttgaccagttctatgataaaagagctgcaagttttgtgtcggtattacacgcactcatggcggcattagcacagtggttcccggataccggaaatttgggacacctacaggaacagtctctgggagaggagggttcacatttgaaccagcgcccagccgccctcgaaaagagtactaccacagccgaggacatcgagcagtttctgcttaattacttgaaggagaaggacgttgctgacggcaacgtgtccgattttgataacgaggaagaagagcagtcagtgccgcctaaggtggatgagaacgatactcggcccgacgtcgagccaccattgcctctgcagatccagattgctatggacgtgatggagcgatgcattcatctccttagcgacaaaaatctccagatcagactcaaagtcctcgacgtgctagacctctgtgttgtcgtgttacagagccacaagaatcagctgctccccctcgcccaccaagcctggcccagcctggtacatcggctcacgagggatgccccactggccgttctgagggctttcaaggtgctgcggacgttgggatccaagtgcggagacttcctccggagccgcttctgtaaggacgtgttgcctaaacttgcagggtcactggtcactcaggcaccgatttctgctcgcgctgggccggtgtacagccataccttggcgtttaagctacagctcgcggtgttgcaaggactcggtcctctgtgtgagcggctggacttaggtgagggggacctgaataaggtggctgacgcttgccttatttacctttccgtgaaacagcctgttaagctgcaggaggcggctaggagtgtgtttctgcacttgatgaaagtggatcccgattccacatggttcctgctgaatgagttgtattgtcccgtgcagtttacgcctccccacccttctctgcaccctgtccaacttcacggcgcatcaggacagcagaatccttacacaactaacgtgctgcagctactcaaggaacttcagtag

SEQ ID NO: 137500 - DNA, 1527 bp, Artificial Sequence
  Description of Artificial Sequence: Synthetic coding sequence
atggaactcgacagcgctctggaagccccatctcaggaggacagtaacctgagtgaggaactgagtcactccgcttttggccaggccttcagcaaaattctgcactgccttgcaaggcctgaggccagacgtggaaatgtgaaagatgccgtactcaaggacttaggggatctgatcgaggcgactgagttcgatcggttattcgaagggaccggtgcaaggctgcgcggaatgccagaaacactgggtcaggttgccaaagcccttgaaaagtacgccgcgccttctaaagaggaggagggaggtggtgacggtcactccgaggcggctgagaaagccgcgcaggttggactgctgttccttaagcttctgggcaaggtggagacagccaaaaattctctcgtgggccctgcttggcaaaccgggctgcaccaccttgccggcccggtctatatatttgcaatcacccattcactcgagcagccttggacgaccccacggagtcgtgaagtggcccgcgaagtgttaacatctctgttgcaggtcacagagtgcggaagtgtcgcaggatttctgcatggggagaacgaagacgagaagggccggctctctgtcatactcgggctcttgaagcctgacttatataaagagtcttggaagaataatcccgcaatcaaacacgtgttttcctggacgctgcaacaagttacacgaccatggctatcccagcaccttgagagggtgctgcctgcgtctttggtcatatctgatgattatcaaactgaaaacaaaatactcggggtgcactgtctacaccacattgttctgaacgtccccgctgccgacctgctgcagtataatcgggcacaggtgttataccatgccatctcaaatcatctctacactcctgaacaccatctcatacaagccgttctcctgtgtctcttggacctttttccaatactagaaaagaccctccattggaagggggacggcgcacgcccaacaacccactgcgatgaggtactgagactgatcctcacgcacatggagccagagcatcggctgctgcttcgcagaacatacgcccggaatctcccggccttcgtaaatagactgggcattctgaccgtgaggcacttaaaacgcctggagcgcgtgattatcggctatctcgaagtatatgatggcccggaagaggaagccaggctgaagatcctcgagactcttaagctcttaatgcagcatacctggccacgggtatcctgtaggctggtggttctcttaaaggctctactgaaactgatctgtgatgttgctcgcgaccccaacctgaccccggaatctgtcaaaagcgctctgctacaggaggccacagattgcctcattctgctggaccggtgtagtcaggggcgcgttaagggcctgctggctaaaatcccacagtcctgcgaggacagaaaggtggttaactacatccggaaggtacagcaggtctctgaaggcgctccctataacgggacctag
